United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 17

SEQ ID NO: 642828 - RNA, 21 nt, Escherichia coli CFT073
gccggauaagccucgcuuucc

SEQ ID NO: 642829 - RNA, 21 nt, Escherichia coli CFT073
gccggauacgcuuuauccagc

SEQ ID NO: 642830 - RNA, 14 nt, Escherichia coli CFT073
gccgggcaggugac

SEQ ID NO: 642831 - RNA, 20 nt, Escherichia coli CFT073
gccggggagauauuccccag

SEQ ID NO: 642832 - RNA, 21 nt, Escherichia coli CFT073
gccggggagauauuccccaga

SEQ ID NO: 642833 - RNA, 22 nt, Escherichia coli CFT073
gcccugggcuucauccagcagc

SEQ ID NO: 642834 - RNA, 21 nt, Escherichia coli CFT073
gccgauagacacugccgccgu

SEQ ID NO: 642835 - RNA, 20 nt, Escherichia coli CFT073
gccgauggugcuaagccccu

SEQ ID NO: 642836 - RNA, 14 nt, Escherichia coli CFT073
gccgauggcagaaa

SEQ ID NO: 642837 - RNA, 18 nt, Escherichia coli CFT073
gccgcauugagaucuuuc

SEQ ID NO: 642838 - RNA, 19 nt, Escherichia coli CFT073
gccgccaaacugugcaccg

SEQ ID NO: 642839 - RNA, 21 nt, Escherichia coli CFT073
gccgccaaacugugcaccgcc

SEQ ID NO: 642840 - RNA, 22 nt, Escherichia coli CFT073
gccgcauuuuguuggacaugug

SEQ ID NO: 642841 - RNA, 13 nt, Escherichia coli CFT073
gccgcaucuggca

SEQ ID NO: 642842 - RNA, 13 nt, Escherichia coli CFT073
gccgccaccgcca

SEQ ID NO: 642843 - RNA, 21 nt, Escherichia coli CFT073
gccgccacuucuggcggcggc

SEQ ID NO: 642844 - RNA, 22 nt, Escherichia coli CFT073
gccgccagaccacugcgccgcu

SEQ ID NO: 642845 - RNA, 20 nt, Escherichia coli CFT073
gccgccagauccuggcugua

SEQ ID NO: 642846 - RNA, 23 nt, Escherichia coli CFT073
gccgcagcggcgguuucuuuauc

SEQ ID NO: 642847 - RNA, 15 nt, Escherichia coli CFT073
gccgcauagagaaag

SEQ ID NO: 642848 - RNA, 16 nt, Escherichia coli CFT073
gccgcauauuccacca

SEQ ID NO: 642849 - RNA, 15 nt, Escherichia coli CFT073
gccgcaucagugauc

SEQ ID NO: 642850 - RNA, 14 nt, Escherichia coli CFT073
gccgcaucauccuc

SEQ ID NO: 642851 - RNA, 13 nt, Escherichia coli CFT073
gccgcauccggcg

SEQ ID NO: 642852 - RNA, 18 nt, Escherichia coli CFT073
gccgcauccggcuuaaau

SEQ ID NO: 642853 - RNA, 21 nt, Escherichia coli CFT073
gccgcagguagcagcagcgcc

SEQ ID NO: 642854 - RNA, 14 nt, Escherichia coli CFT073
gccgccauuccagc

SEQ ID NO: 642855 - RNA, 13 nt, Escherichia coli CFT073
gccgccaucaucg

SEQ ID NO: 642856 - RNA, 22 nt, Escherichia coli CFT073
gccgccagggauaaagccccca

SEQ ID NO: 642857 - RNA, 18 nt, Escherichia coli CFT073
gccgccaguacgcgcccg

SEQ ID NO: 642858 - RNA, 21 nt, Escherichia coli CFT073
gccgccaguuccaggcaaacu

SEQ ID NO: 642859 - RNA, 19 nt, Escherichia coli CFT073
gccgcccccacugccgccu

SEQ ID NO: 642860 - RNA, 14 nt, Escherichia coli CFT073
gccgcccagcgaac

SEQ ID NO: 642861 - RNA, 13 nt, Escherichia coli CFT073
gccgccgcaaccg

SEQ ID NO: 642862 - RNA, 18 nt, Escherichia coli CFT073
gccugaaauaaugcagcg

SEQ ID NO: 642863 - RNA, 13 nt, Escherichia coli CFT073
gccugaauaauca

SEQ ID NO: 642864 - RNA, 14 nt, Escherichia coli CFT073
gccucuuucauccg

SEQ ID NO: 642865 - RNA, 13 nt, Escherichia coli CFT073
gccucuuuauaaa

SEQ ID NO: 642866 - RNA, 21 nt, Escherichia coli CFT073
gccucucugacagcuccuccg

SEQ ID NO: 642867 - RNA, 18 nt, Escherichia coli CFT073
gccucuuccaguaaacca

SEQ ID NO: 642868 - RNA, 13 nt, Escherichia coli CFT073
gccucugccagcu

SEQ ID NO: 642869 - RNA, 13 nt, Escherichia coli CFT073
gccucugcgccca

SEQ ID NO: 642870 - RNA, 16 nt, Escherichia coli CFT073
gccugacggaucggcu

SEQ ID NO: 642871 - RNA, 15 nt, Escherichia coli CFT073
gccugacggacgcgc

SEQ ID NO: 642872 - RNA, 19 nt, Escherichia coli CFT073
gccugauaagacgcggccc

SEQ ID NO: 642873 - RNA, 22 nt, Escherichia coli CFT073
gccugaugugcuccgcucauca

SEQ ID NO: 642874 - RNA, 18 nt, Escherichia coli CFT073
gccugcaaaaucuguuga

SEQ ID NO: 642875 - RNA, 18 nt, Escherichia coli CFT073
gccugauguagcgugauu

SEQ ID NO: 642876 - RNA, 19 nt, Escherichia coli CFT073
gccugauuguuuguagccg

SEQ ID NO: 642877 - RNA, 13 nt, Escherichia coli CFT073
gccugcaaauaaa

SEQ ID NO: 642878 - RNA, 19 nt, Escherichia coli CFT073
gccugaugcgacgcuggcg

SEQ ID NO: 642879 - RNA, 23 nt, Escherichia coli CFT073
gccugaucgagcaguaauccagc

SEQ ID NO: 642880 - RNA, 15 nt, Escherichia coli CFT073
gccugcacgaccggg

SEQ ID NO: 642881 - RNA, 22 nt, Escherichia coli CFT073
gccugcaauuuaccuuuccagu

SEQ ID NO: 642882 - RNA, 21 nt, Escherichia coli CFT073
gccugcacaaagcgccagaau

SEQ ID NO: 642883 - RNA, 14 nt, Escherichia coli CFT073
gccugcaccagccu

SEQ ID NO: 642884 - RNA, 19 nt, Escherichia coli CFT073
gccugcaagcgucgcgcca

SEQ ID NO: 642885 - RNA, 16 nt, Escherichia coli CFT073
gccugccacauccccu

SEQ ID NO: 642886 - RNA, 18 nt, Escherichia coli CFT073
gccugccauugcgggcug

SEQ ID NO: 642887 - RNA, 15 nt, Escherichia coli CFT073
gccugcaucacgagc

SEQ ID NO: 642888 - RNA, 21 nt, Escherichia coli CFT073
gccugcauaaaggcaaaacag

SEQ ID NO: 642889 - RNA, 12 nt, Escherichia coli CFT073
gccugcagcggc

SEQ ID NO: 642890 - RNA, 22 nt, Escherichia coli CFT073
gccugcagcugcucauuacagu

SEQ ID NO: 642891 - RNA, 21 nt, Escherichia coli CFT073
gccugcaggaaaucaaugcca

SEQ ID NO: 642892 - RNA, 16 nt, Escherichia coli CFT073
gccugccuucccuucu

SEQ ID NO: 642893 - RNA, 14 nt, Escherichia coli CFT073
gccugcgaaucuaa

SEQ ID NO: 642894 - RNA, 21 nt, Escherichia coli CFT073
gccugcccgugggcaggccag

SEQ ID NO: 642895 - RNA, 18 nt, Escherichia coli CFT073
gccugguuuugccaugca

SEQ ID NO: 642896 - RNA, 15 nt, Escherichia coli CFT073
gccugguuucucucc

SEQ ID NO: 642897 - RNA, 13 nt, Escherichia coli CFT073
gccugugcaaccu

SEQ ID NO: 642898 - RNA, 15 nt, Escherichia coli CFT073
gccugugccugagcc

SEQ ID NO: 642899 - RNA, 16 nt, Escherichia coli CFT073
gccuguucaaccucaa

SEQ ID NO: 642900 - RNA, 19 nt, Escherichia coli CFT073
gccugucggagcucccccu

SEQ ID NO: 642901 - RNA, 16 nt, Escherichia coli CFT073
gccuguccacauccag

SEQ ID NO: 642902 - RNA, 18 nt, Escherichia coli CFT073
gccugggggggaaaccca

SEQ ID NO: 642903 - RNA, 13 nt, Escherichia coli CFT073
gccugggcgaggu

SEQ ID NO: 642904 - RNA, 15 nt, Escherichia coli CFT073
gccuggguuuucaca

SEQ ID NO: 642905 - RNA, 20 nt, Escherichia coli CFT073
gccugguaaucgcggguugc

SEQ ID NO: 642906 - RNA, 16 nt, Escherichia coli CFT073
gccuggcgaaaggagg

SEQ ID NO: 642907 - RNA, 21 nt, Escherichia coli CFT073
gccuggcgcgacaauauucac

SEQ ID NO: 642908 - RNA, 19 nt, Escherichia coli CFT073
gccuggcgcugcucaggcg

SEQ ID NO: 642909 - RNA, 23 nt, Escherichia coli CFT073
gccuggaaguugaugguguagaa

SEQ ID NO: 642910 - RNA, 17 nt, Escherichia coli CFT073
gccuggcagcaugcugc

SEQ ID NO: 642911 - RNA, 18 nt, Escherichia coli CFT073
gccuggcccauagacagg

SEQ ID NO: 642912 - RNA, 18 nt, Escherichia coli CFT073
gccugcuccaucauccgc

SEQ ID NO: 642913 - RNA, 18 nt, Escherichia coli CFT073
gccugcguucaguugauu

SEQ ID NO: 642914 - RNA, 19 nt, Escherichia coli CFT073
gccugcggggagauguaau

SEQ ID NO: 642915 - RNA, 18 nt, Escherichia coli CFT073
gccugcugaauauugcca

SEQ ID NO: 642916 - RNA, 22 nt, Escherichia coli CFT073
gccugcugauaagacgcaucca

SEQ ID NO: 642917 - RNA, 18 nt, Escherichia coli CFT073
gccucccgcaacauaucu

SEQ ID NO: 642918 - RNA, 22 nt, Escherichia coli CFT073
gccucccauucaucgccaccgc

SEQ ID NO: 642919 - RNA, 14 nt, Escherichia coli CFT073
gccucccugccucc

SEQ ID NO: 642920 - RNA, 12 nt, Escherichia coli CFT073
gccucaucaucg

SEQ ID NO: 642921 - RNA, 23 nt, Escherichia coli CFT073
gccucagccgaaacacacaaagc

SEQ ID NO: 642922 - RNA, 13 nt, Escherichia coli CFT073
gccucacgccagc

SEQ ID NO: 642923 - RNA, 13 nt, Escherichia coli CFT073
gccucacuuugau

SEQ ID NO: 642924 - RNA, 13 nt, Escherichia coli CFT073
gccucgcagcggc

SEQ ID NO: 642925 - RNA, 17 nt, Escherichia coli CFT073
gccucgccgaaacgcuu

SEQ ID NO: 642926 - RNA, 22 nt, Escherichia coli CFT073
gccucgucccuuugccugccgc

SEQ ID NO: 642927 - RNA, 23 nt, Escherichia coli CFT073
gccucgucccuuugccugccgcc

SEQ ID NO: 642928 - RNA, 20 nt, Escherichia coli CFT073
gccgguaacugcuugaauuu

SEQ ID NO: 642929 - RNA, 16 nt, Escherichia coli CFT073
gccguguuauccgccg

SEQ ID NO: 642930 - RNA, 22 nt, Escherichia coli CFT073
gccguugaguucaaauuccaca

SEQ ID NO: 642931 - RNA, 19 nt, Escherichia coli CFT073
gccguugacgaugucgaca

SEQ ID NO: 642932 - RNA, 13 nt, Escherichia coli CFT073
gccguucuucagc

SEQ ID NO: 642933 - RNA, 19 nt, Escherichia coli CFT073
gccguucguccgagcggca

SEQ ID NO: 642934 - RNA, 16 nt, Escherichia coli CFT073
gccguuaacacggugc

SEQ ID NO: 642935 - RNA, 15 nt, Escherichia coli CFT073
gccuacggcauucug

SEQ ID NO: 642936 - RNA, 22 nt, Escherichia coli CFT073
gccuacuaccaguagugaaaaa

SEQ ID NO: 642937 - RNA, 14 nt, Escherichia coli CFT073
gccucaagcacccg

SEQ ID NO: 642938 - RNA, 17 nt, Escherichia coli CFT073
gccuaagccauuuaacu

SEQ ID NO: 642939 - RNA, 20 nt, Escherichia coli CFT073
gccguugcgcccaucaucau

SEQ ID NO: 642940 - RNA, 17 nt, Escherichia coli CFT073
gccuaauaccagaacug

SEQ ID NO: 642941 - RNA, 16 nt, Escherichia coli CFT073
gccuacaaaggcacgc

SEQ ID NO: 642942 - RNA, 13 nt, Escherichia coli CFT073
gccuaccaccagc

SEQ ID NO: 642943 - RNA, 12 nt, Escherichia coli CFT073
gccuaccgcauc

SEQ ID NO: 642944 - RNA, 23 nt, Escherichia coli CFT073
gccuaccggacggcucacuuugu

SEQ ID NO: 642945 - RNA, 14 nt, Escherichia coli CFT073
gcccgcuccagcua

SEQ ID NO: 642946 - RNA, 22 nt, Escherichia coli CFT073
gcccguccccugagcauacauu

SEQ ID NO: 642947 - RNA, 13 nt, Escherichia coli CFT073
gcccgucauaccg

SEQ ID NO: 642948 - RNA, 20 nt, Escherichia coli CFT073
gcccggguuugccgcuggca

SEQ ID NO: 642949 - RNA, 17 nt, Escherichia coli CFT073
gcccguagcuucccaua

SEQ ID NO: 642950 - RNA, 22 nt, Escherichia coli CFT073
gcccggcguggugcagccgcca

SEQ ID NO: 642951 - RNA, 17 nt, Escherichia coli CFT073
gcccucuaaaauaacga

SEQ ID NO: 642952 - RNA, 15 nt, Escherichia coli CFT073
gcccucuuucaccag

SEQ ID NO: 642953 - RNA, 19 nt, Escherichia coli CFT073
gcccucuuuuuuaccgaua

SEQ ID NO: 642954 - RNA, 19 nt, Escherichia coli CFT073
gcccugaauuucaauaauu

SEQ ID NO: 642955 - RNA, 22 nt, Escherichia coli CFT073
gcccucagccuucuguaaccuu

SEQ ID NO: 642956 - RNA, 21 nt, Escherichia coli CFT073
gcccuaaaaacaguaccagac

SEQ ID NO: 642957 - RNA, 22 nt, Escherichia coli CFT073
gcccguuucucuuaaaugcaca

SEQ ID NO: 642958 - RNA, 18 nt, Escherichia coli CFT073
gcccguuuucuccagcgc

SEQ ID NO: 642959 - RNA, 21 nt, Escherichia coli CFT073
gcccguuuucaccuuacuucc

SEQ ID NO: 642960 - RNA, 19 nt, Escherichia coli CFT073
gcccguuaagcguucugca

SEQ ID NO: 642961 - RNA, 15 nt, Escherichia coli CFT073
gcccguucuuccuca

SEQ ID NO: 642962 - RNA, 17 nt, Escherichia coli CFT073
gccccuggcuggucagc

SEQ ID NO: 642963 - RNA, 18 nt, Escherichia coli CFT073
gccccuggucgcgcggca

SEQ ID NO: 642964 - RNA, 19 nt, Escherichia coli CFT073
gccccuggucgcgcggcag

SEQ ID NO: 642965 - RNA, 17 nt, Escherichia coli CFT073
gccccggguuuccugga

SEQ ID NO: 642966 - RNA, 21 nt, Escherichia coli CFT073
gccccugugccagcucgugca

SEQ ID NO: 642967 - RNA, 14 nt, Escherichia coli CFT073
gcccgacaaagccc

SEQ ID NO: 642968 - RNA, 20 nt, Escherichia coli CFT073
gcccgacaauaugcagcagu

SEQ ID NO: 642969 - RNA, 23 nt, Escherichia coli CFT073
gccccgcuucccgauaagggagc

SEQ ID NO: 642970 - RNA, 15 nt, Escherichia coli CFT073
gccccggccuuaccu

SEQ ID NO: 642971 - RNA, 19 nt, Escherichia coli CFT073
gccccgcucacgcagcggc

SEQ ID NO: 642972 - RNA, 13 nt, Escherichia coli CFT073
gccccgcgcggcg

SEQ ID NO: 642973 - RNA, 21 nt, Escherichia coli CFT073
gccccgcgcggcgcaggcgcu

SEQ ID NO: 642974 - RNA, 23 nt, Escherichia coli CFT073
gccccgcgaacggggcugccagc

SEQ ID NO: 642975 - RNA, 17 nt, Escherichia coli CFT073
gccccgcgccagcgggc

SEQ ID NO: 642976 - RNA, 21 nt, Escherichia coli CFT073
gccccgccgguaauuccagcg

SEQ ID NO: 642977 - RNA, 18 nt, Escherichia coli CFT073
gcccgacgauaccgccgc

SEQ ID NO: 642978 - RNA, 13 nt, Escherichia coli CFT073
gcccgcagcgucc

SEQ ID NO: 642979 - RNA, 16 nt, Escherichia coli CFT073
gcccgcagcguccagc

SEQ ID NO: 642980 - RNA, 22 nt, Escherichia coli CFT073
gcccgccacaauugcaguauga

SEQ ID NO: 642981 - RNA, 19 nt, Escherichia coli CFT073
gcccgccagcaugccgcca

SEQ ID NO: 642982 - RNA, 22 nt, Escherichia coli CFT073
gcccgccgagaaauaucagcag

SEQ ID NO: 642983 - RNA, 13 nt, Escherichia coli CFT073
gcccgccgccauc

SEQ ID NO: 642984 - RNA, 13 nt, Escherichia coli CFT073
gcccgccgccauu

SEQ ID NO: 642985 - RNA, 20 nt, Escherichia coli CFT073
gcccgcgauuuguuucaauu

SEQ ID NO: 642986 - RNA, 23 nt, Escherichia coli CFT073
gcccgcgauaaaaauccuguucc

SEQ ID NO: 642987 - RNA, 16 nt, Escherichia coli CFT073
gcccaguaccgccagu

SEQ ID NO: 642988 - RNA, 13 nt, Escherichia coli CFT073
gcccaguguuuua

SEQ ID NO: 642989 - RNA, 19 nt, Escherichia coli CFT073
gcccagugcugagaguaac

SEQ ID NO: 642990 - RNA, 14 nt, Escherichia coli CFT073
gcccagugccagca

SEQ ID NO: 642991 - RNA, 15 nt, Escherichia coli CFT073
gcccaggucucccag

SEQ ID NO: 642992 - RNA, 20 nt, Escherichia coli CFT073
gcccaggcgaccaggccggu

SEQ ID NO: 642993 - RNA, 22 nt, Escherichia coli CFT073
gcccauacuuaaugccaguuca

SEQ ID NO: 642994 - RNA, 19 nt, Escherichia coli CFT073
gcccauacucaucuuccau

SEQ ID NO: 642995 - RNA, 21 nt, Escherichia coli CFT073
gcccauaugcagccacugcug

SEQ ID NO: 642996 - RNA, 17 nt, Escherichia coli CFT073
gcccaucaccgccaggc

SEQ ID NO: 642997 - RNA, 14 nt, Escherichia coli CFT073
gcccauaccacagc

SEQ ID NO: 642998 - RNA, 18 nt, Escherichia coli CFT073
gcccaguuucgacaucac

SEQ ID NO: 642999 - RNA, 19 nt, Escherichia coli CFT073
gcccaguuucgacaucaca

SEQ ID NO: 643000 - RNA, 23 nt, Escherichia coli CFT073
gcccaguuucgacaucacauuaa

SEQ ID NO: 643001 - RNA, 15 nt, Escherichia coli CFT073
gcccaguuucuucag

SEQ ID NO: 643002 - RNA, 20 nt, Escherichia coli CFT073
gcccauaaacaucgucagga

SEQ ID NO: 643003 - RNA, 23 nt, Escherichia coli CFT073
gcccauaaacaucgucaggaaga

SEQ ID NO: 643004 - RNA, 15 nt, Escherichia coli CFT073
gcccaucaggccagg

SEQ ID NO: 643005 - RNA, 19 nt, Escherichia coli CFT073
gcccaucaggccaggcgug

SEQ ID NO: 643006 - RNA, 17 nt, Escherichia coli CFT073
gcccaucauugacagac

SEQ ID NO: 643007 - RNA, 15 nt, Escherichia coli CFT073
gcccauccaggguuu

SEQ ID NO: 643008 - RNA, 21 nt, Escherichia coli CFT073
gcccaucaguguccagaugcu

SEQ ID NO: 643009 - RNA, 21 nt, Escherichia coli CFT073
gcccaucgccacgccuguacc

SEQ ID NO: 643010 - RNA, 15 nt, Escherichia coli CFT073
gcccaucgccagcgc

SEQ ID NO: 643011 - RNA, 17 nt, Escherichia coli CFT073
gcccacuuucugcgcaa

SEQ ID NO: 643012 - RNA, 20 nt, Escherichia coli CFT073
gcccacuguuugaucugcug

SEQ ID NO: 643013 - RNA, 22 nt, Escherichia coli CFT073
gcccacuguuugaucugcugcc

SEQ ID NO: 643014 - RNA, 15 nt, Escherichia coli CFT073
gccaugcgaaugcca

SEQ ID NO: 643015 - RNA, 22 nt, Escherichia coli CFT073
gccaugcgcuccgguuuacuca

SEQ ID NO: 643016 - RNA, 15 nt, Escherichia coli CFT073
gcccacgguaaaaua

SEQ ID NO: 643017 - RNA, 17 nt, Escherichia coli CFT073
gcccagccuuuccagca

SEQ ID NO: 643018 - RNA, 20 nt, Escherichia coli CFT073
gcccagccugaaugccgcgc

SEQ ID NO: 643019 - RNA, 22 nt, Escherichia coli CFT073
gcccagccugaaugccgcgccc

SEQ ID NO: 643020 - RNA, 17 nt, Escherichia coli CFT073
gcccaucguugaaaaaa

SEQ ID NO: 643021 - RNA, 18 nt, Escherichia coli CFT073
gcccaugcgggcaacuuu

SEQ ID NO: 643022 - RNA, 15 nt, Escherichia coli CFT073
gccccaggcauagaa

SEQ ID NO: 643023 - RNA, 20 nt, Escherichia coli CFT073
gccccagcguucgguggugc

SEQ ID NO: 643024 - RNA, 12 nt, Escherichia coli CFT073
gccccagagcua

SEQ ID NO: 643025 - RNA, 16 nt, Escherichia coli CFT073
gccccagauugccgau

SEQ ID NO: 643026 - RNA, 21 nt, Escherichia coli CFT073
gccccacuucuuccuauggcu

SEQ ID NO: 643027 - RNA, 17 nt, Escherichia coli CFT073
gccccagaacucacgca

SEQ ID NO: 643028 - RNA, 22 nt, Escherichia coli CFT073
gccccagaauaacgcggcagga

SEQ ID NO: 643029 - RNA, 13 nt, Escherichia coli CFT073
gccccagacacag

SEQ ID NO: 643030 - RNA, 20 nt, Escherichia coli CFT073
gccccagacguuucgccagc

SEQ ID NO: 643031 - RNA, 17 nt, Escherichia coli CFT073
gccccagagacaacccg

SEQ ID NO: 643032 - RNA, 20 nt, Escherichia coli CFT073
gccccacagagugguggggc

SEQ ID NO: 643033 - RNA, 16 nt, Escherichia coli CFT073
gccccaccagcaaaua

SEQ ID NO: 643034 - RNA, 20 nt, Escherichia coli CFT073
gccccaucgaaccaucggcu

SEQ ID NO: 643035 - RNA, 20 nt, Escherichia coli CFT073
gccccaucgaaucaaacaug

SEQ ID NO: 643036 - RNA, 12 nt, Escherichia coli CFT073
gccccaguuccg

SEQ ID NO: 643037 - RNA, 22 nt, Escherichia coli CFT073
gccccaguaaacacaccacagc

SEQ ID NO: 643038 - RNA, 16 nt, Escherichia coli CFT073
gcccccagucgccagu

SEQ ID NO: 643039 - RNA, 18 nt, Escherichia coli CFT073
gcccccauaagccgcggc

SEQ ID NO: 643040 - RNA, 23 nt, Escherichia coli CFT073
gccccauguugacuucaaucuga

SEQ ID NO: 643041 - RNA, 20 nt, Escherichia coli CFT073
gccccauugcugaugcaccu

SEQ ID NO: 643042 - RNA, 21 nt, Escherichia coli CFT073
gccccauuuugauguacucgc

SEQ ID NO: 643043 - RNA, 18 nt, Escherichia coli CFT073
gccccauuuuuaauaacu

SEQ ID NO: 643044 - RNA, 22 nt, Escherichia coli CFT073
gcccccugaagcaguuucacca

SEQ ID NO: 643045 - RNA, 13 nt, Escherichia coli CFT073
gcccccguucugu

SEQ ID NO: 643046 - RNA, 13 nt, Escherichia coli CFT073
gcccccgauccag

SEQ ID NO: 643047 - RNA, 18 nt, Escherichia coli CFT073
gccccgccaacagugccg

SEQ ID NO: 643048 - RNA, 15 nt, Escherichia coli CFT073
gccaucgccaggaac

SEQ ID NO: 643049 - RNA, 21 nt, Escherichia coli CFT073
gccauccgcgugacgcuggca

SEQ ID NO: 643050 - RNA, 13 nt, Escherichia coli CFT073
gccauccgcguga

SEQ ID NO: 643051 - RNA, 19 nt, Escherichia coli CFT073
gccaucggcagacagcgcc

SEQ ID NO: 643052 - RNA, 21 nt, Escherichia coli CFT073
gccaucggcagacagcgccag

SEQ ID NO: 643053 - RNA, 21 nt, Escherichia coli CFT073
gccaucgcgguuaaucggcag

SEQ ID NO: 643054 - RNA, 15 nt, Escherichia coli CFT073
gccaucgccugcugg

SEQ ID NO: 643055 - RNA, 18 nt, Escherichia coli CFT073
gccaucgccgccuggcua

SEQ ID NO: 643056 - RNA, 20 nt, Escherichia coli CFT073
gccaugcacccgcaaaugau

SEQ ID NO: 643057 - RNA, 15 nt, Escherichia coli CFT073
gccaugcacgcaaaa

SEQ ID NO: 643058 - RNA, 16 nt, Escherichia coli CFT073
gccaucgguagcacca

SEQ ID NO: 643059 - RNA, 17 nt, Escherichia coli CFT073
gccaugauuaccagcau

SEQ ID NO: 643060 - RNA, 13 nt, Escherichia coli CFT073
gccaugccaacgc

SEQ ID NO: 643061 - RNA, 22 nt, Escherichia coli CFT073
gccaugcauuuuuguccucacc

SEQ ID NO: 643062 - RNA, 20 nt, Escherichia coli CFT073
gccauaucuauuacagcgca

SEQ ID NO: 643063 - RNA, 13 nt, Escherichia coli CFT073
gccauaugacacc

SEQ ID NO: 643064 - RNA, 21 nt, Escherichia coli CFT073
gccauauaacguccaguugaa

SEQ ID NO: 643065 - RNA, 22 nt, Escherichia coli CFT073
gccauauaacguccaguugaag

SEQ ID NO: 643066 - RNA, 12 nt, Escherichia coli CFT073
gccauccaguga

SEQ ID NO: 643067 - RNA, 18 nt, Escherichia coli CFT073
gccauccaucaacgccag

SEQ ID NO: 643068 - RNA, 14 nt, Escherichia coli CFT073
gccaucccaggggc

SEQ ID NO: 643069 - RNA, 14 nt, Escherichia coli CFT073
gccauccccacggc

SEQ ID NO: 643070 - RNA, 18 nt, Escherichia coli CFT073
gccaucccugcaacauca

SEQ ID NO: 643071 - RNA, 18 nt, Escherichia coli CFT073
gccauaaccgccagcaca

SEQ ID NO: 643072 - RNA, 18 nt, Escherichia coli CFT073
gccagugccgagauauuu

SEQ ID NO: 643073 - RNA, 18 nt, Escherichia coli CFT073
gccagucgguagugccgu

SEQ ID NO: 643074 - RNA, 16 nt, Escherichia coli CFT073
gccagucguuguccgu

SEQ ID NO: 643075 - RNA, 14 nt, Escherichia coli CFT073
gccaguagcaccuc

SEQ ID NO: 643076 - RNA, 18 nt, Escherichia coli CFT073
gccaguagcaccucucca

SEQ ID NO: 643077 - RNA, 19 nt, Escherichia coli CFT073
gccaguagcaccucuccac

SEQ ID NO: 643078 - RNA, 16 nt, Escherichia coli CFT073
gccaguacgcgcccgu

SEQ ID NO: 643079 - RNA, 12 nt, Escherichia coli CFT073
gccaguacugca

SEQ ID NO: 643080 - RNA, 19 nt, Escherichia coli CFT073
gccaguacugcagguugca

SEQ ID NO: 643081 - RNA, 17 nt, Escherichia coli CFT073
gccaguaccgccgcagu

SEQ ID NO: 643082 - RNA, 20 nt, Escherichia coli CFT073
gccaguaagcaguccagcgc

SEQ ID NO: 643083 - RNA, 14 nt, Escherichia coli CFT073
gccaguaauaaaga

SEQ ID NO: 643084 - RNA, 15 nt, Escherichia coli CFT073
gccaguucauccaga

SEQ ID NO: 643085 - RNA, 19 nt, Escherichia coli CFT073
gccaguguagcgauuucac

SEQ ID NO: 643086 - RNA, 17 nt, Escherichia coli CFT073
gccagugucgcaucagg

SEQ ID NO: 643087 - RNA, 18 nt, Escherichia coli CFT073
gccagugucgcaucaggc

SEQ ID NO: 643088 - RNA, 23 nt, Escherichia coli CFT073
gccagugugaauaauugugcaau

SEQ ID NO: 643089 - RNA, 15 nt, Escherichia coli CFT073
gccaguguucuuccg

SEQ ID NO: 643090 - RNA, 18 nt, Escherichia coli CFT073
gccaguguuuaucaucuc

SEQ ID NO: 643091 - RNA, 20 nt, Escherichia coli CFT073
gccaguguuucgacaauaau

SEQ ID NO: 643092 - RNA, 23 nt, Escherichia coli CFT073
gccaguucguuauaguguuccug

SEQ ID NO: 643093 - RNA, 19 nt, Escherichia coli CFT073
gccaguucguugaucagca

SEQ ID NO: 643094 - RNA, 12 nt, Escherichia coli CFT073
gccaguuccccc

SEQ ID NO: 643095 - RNA, 14 nt, Escherichia coli CFT073
gccaguucccccug

SEQ ID NO: 643096 - RNA, 23 nt, Escherichia coli CFT073
gccaguucuuccgcagaguaaug

SEQ ID NO: 643097 - RNA, 20 nt, Escherichia coli CFT073
gccaguuuacccagugaauc

SEQ ID NO: 643098 - RNA, 17 nt, Escherichia coli CFT073
gccaguuucgggaucau

SEQ ID NO: 643099 - RNA, 22 nt, Escherichia coli CFT073
gccaguuuggucuggcaaaaau

SEQ ID NO: 643100 - RNA, 23 nt, Escherichia coli CFT073
gccaguuuggucuggcaaaaaua

SEQ ID NO: 643101 - RNA, 18 nt, Escherichia coli CFT073
gccaguuugacaucguca

SEQ ID NO: 643102 - RNA, 19 nt, Escherichia coli CFT073
gccauaaacaccagcagca

SEQ ID NO: 643103 - RNA, 20 nt, Escherichia coli CFT073
gccauaaaccgagccaaacg

SEQ ID NO: 643104 - RNA, 19 nt, Escherichia coli CFT073
gccauaaacuucauucagc

SEQ ID NO: 643105 - RNA, 20 nt, Escherichia coli CFT073
gccauaaacuucauucagcc

SEQ ID NO: 643106 - RNA, 16 nt, Escherichia coli CFT073
gccauaaacagcaggc

SEQ ID NO: 643107 - RNA, 14 nt, Escherichia coli CFT073
gccagcgauuuguc

SEQ ID NO: 643108 - RNA, 17 nt, Escherichia coli CFT073
gccagccucauccaugc

SEQ ID NO: 643109 - RNA, 14 nt, Escherichia coli CFT073
gccagccucaucca

SEQ ID NO: 643110 - RNA, 15 nt, Escherichia coli CFT073
gccagccucauccau

SEQ ID NO: 643111 - RNA, 10 nt, Escherichia coli CFT073
gccagccuca

SEQ ID NO: 643112 - RNA, 13 nt, Escherichia coli CFT073
gccagcaguucaa

SEQ ID NO: 643113 - RNA, 19 nt, Escherichia coli CFT073
gccagcagcagcgaauaau

SEQ ID NO: 643114 - RNA, 13 nt, Escherichia coli CFT073
gccagcagcaacc

SEQ ID NO: 643115 - RNA, 18 nt, Escherichia coli CFT073
gccagcagaggaauaucu

SEQ ID NO: 643116 - RNA, 15 nt, Escherichia coli CFT073
gccagcagagcaaaa

SEQ ID NO: 643117 - RNA, 14 nt, Escherichia coli CFT073
gccagcgcaucaug

SEQ ID NO: 643118 - RNA, 15 nt, Escherichia coli CFT073
gccagcgccaaagcc

SEQ ID NO: 643119 - RNA, 15 nt, Escherichia coli CFT073
gccagcgccagcacu

SEQ ID NO: 643120 - RNA, 16 nt, Escherichia coli CFT073
gccagcgccaccacca

SEQ ID NO: 643121 - RNA, 14 nt, Escherichia coli CFT073
gccagcgcgcggcu

SEQ ID NO: 643122 - RNA, 16 nt, Escherichia coli CFT073
gccagcgcgauacagg

SEQ ID NO: 643123 - RNA, 18 nt, Escherichia coli CFT073
gccagcgcgauacaggcc

SEQ ID NO: 643124 - RNA, 19 nt, Escherichia coli CFT073
gccagcgguagcucgaccu

SEQ ID NO: 643125 - RNA, 19 nt, Escherichia coli CFT073
gccagcuugcgauccugca

SEQ ID NO: 643126 - RNA, 21 nt, Escherichia coli CFT073
gccagcuugcgauccugcaga

SEQ ID NO: 643127 - RNA, 22 nt, Escherichia coli CFT073
gccagcuugcuuuccagcuuca

SEQ ID NO: 643128 - RNA, 17 nt, Escherichia coli CFT073
gccagcuuucaccugcg

SEQ ID NO: 643129 - RNA, 13 nt, Escherichia coli CFT073
gccagcuccagcg

SEQ ID NO: 643130 - RNA, 18 nt, Escherichia coli CFT073
gccagcuccgggcugguu

SEQ ID NO: 643131 - RNA, 11 nt, Escherichia coli CFT073
gccaggcagcg

SEQ ID NO: 643132 - RNA, 13 nt, Escherichia coli CFT073
gccaggaccgcug

SEQ ID NO: 643133 - RNA, 15 nt, Escherichia coli CFT073
gccaggacaucagcg

SEQ ID NO: 643134 - RNA, 22 nt, Escherichia coli CFT073
gccaguaaaccaaucaauucuc

SEQ ID NO: 643135 - RNA, 14 nt, Escherichia coli CFT073
gccaguaacucauu

SEQ ID NO: 643136 - RNA, 22 nt, Escherichia coli CFT073
gccagauacugccgaccagagc

SEQ ID NO: 643137 - RNA, 17 nt, Escherichia coli CFT073
gccagauaauggcuguu

SEQ ID NO: 643138 - RNA, 21 nt, Escherichia coli CFT073
gccagauaaauauuauuggca

SEQ ID NO: 643139 - RNA, 13 nt, Escherichia coli CFT073
gccagauccgcca

SEQ ID NO: 643140 - RNA, 19 nt, Escherichia coli CFT073
gccagauugugugacacuu

SEQ ID NO: 643141 - RNA, 19 nt, Escherichia coli CFT073
gccagcaaaaucaccauca

SEQ ID NO: 643142 - RNA, 18 nt, Escherichia coli CFT073
gccagauguuuaaacugg

SEQ ID NO: 643143 - RNA, 21 nt, Escherichia coli CFT073
gccagaauccccggcaggaag

SEQ ID NO: 643144 - RNA, 19 nt, Escherichia coli CFT073
gccagaaucgcaaccagcc

SEQ ID NO: 643145 - RNA, 20 nt, Escherichia coli CFT073
gccagacaauggcccgccgc

SEQ ID NO: 643146 - RNA, 18 nt, Escherichia coli CFT073
gccagacacuggaaacag

SEQ ID NO: 643147 - RNA, 16 nt, Escherichia coli CFT073
gccagacauuacaaaa

SEQ ID NO: 643148 - RNA, 20 nt, Escherichia coli CFT073
gccagaccuuaucccgccgg

SEQ ID NO: 643149 - RNA, 22 nt, Escherichia coli CFT073
gccagacgaaugaagcagaagc

SEQ ID NO: 643150 - RNA, 19 nt, Escherichia coli CFT073
gccagagucagcaaugcca

SEQ ID NO: 643151 - RNA, 22 nt, Escherichia coli CFT073
gccagagucagcacgagugagu

SEQ ID NO: 643152 - RNA, 19 nt, Escherichia coli CFT073
gccagaagcagaaugaaug

SEQ ID NO: 643153 - RNA, 15 nt, Escherichia coli CFT073
gccagaagaaccgcc

SEQ ID NO: 643154 - RNA, 23 nt, Escherichia coli CFT073
gccagaauaagucucccgcccug

SEQ ID NO: 643155 - RNA, 17 nt, Escherichia coli CFT073
gccagaauagccgcagc

SEQ ID NO: 643156 - RNA, 14 nt, Escherichia coli CFT073
gccagaaucaccuc

SEQ ID NO: 643157 - RNA, 13 nt, Escherichia coli CFT073
gccagaaucccca

SEQ ID NO: 643158 - RNA, 21 nt, Escherichia coli CFT073
gccagaacacgcucccagcag

SEQ ID NO: 643159 - RNA, 16 nt, Escherichia coli CFT073
gccagaaaucagcagc

SEQ ID NO: 643160 - RNA, 21 nt, Escherichia coli CFT073
gccagaaauuugcagugcugu

SEQ ID NO: 643161 - RNA, 23 nt, Escherichia coli CFT073
gccacugccagcaaaaaauagaa

SEQ ID NO: 643162 - RNA, 18 nt, Escherichia coli CFT073
gccacgucguuccccauc

SEQ ID NO: 643163 - RNA, 17 nt, Escherichia coli CFT073
gccacucgauaccagau

SEQ ID NO: 643164 - RNA, 23 nt, Escherichia coli CFT073
gccacucacuaccagugccagaa

SEQ ID NO: 643165 - RNA, 16 nt, Escherichia coli CFT073
gccacucacugaugcc

SEQ ID NO: 643166 - RNA, 16 nt, Escherichia coli CFT073
gccacuccacugcgca

SEQ ID NO: 643167 - RNA, 21 nt, Escherichia coli CFT073
gccacuccacugcgcauaauc

SEQ ID NO: 643168 - RNA, 21 nt, Escherichia coli CFT073
gccacggugguuccacucugc

SEQ ID NO: 643169 - RNA, 23 nt, Escherichia coli CFT073
gccacggugguuccacucugccc

SEQ ID NO: 643170 - RNA, 19 nt, Escherichia coli CFT073
gccacgguaucaagcccgc

SEQ ID NO: 643171 - RNA, 13 nt, Escherichia coli CFT073
gccacgguccgcc

SEQ ID NO: 643172 - RNA, 20 nt, Escherichia coli CFT073
gccacgcucuggugagugac

SEQ ID NO: 643173 - RNA, 13 nt, Escherichia coli CFT073
gccacgcguucgg

SEQ ID NO: 643174 - RNA, 20 nt, Escherichia coli CFT073
gccacgcguucggaccaaug

SEQ ID NO: 643175 - RNA, 21 nt, Escherichia coli CFT073
gccacgcguucggaccaaugc

SEQ ID NO: 643176 - RNA, 20 nt, Escherichia coli CFT073
gccacgccuguaccagcggc

SEQ ID NO: 643177 - RNA, 13 nt, Escherichia coli CFT073
gccacggcagaau

SEQ ID NO: 643178 - RNA, 21 nt, Escherichia coli CFT073
gccacggaauaaaccguggca

SEQ ID NO: 643179 - RNA, 18 nt, Escherichia coli CFT073
gccacgcuuucuggcgcg

SEQ ID NO: 643180 - RNA, 17 nt, Escherichia coli CFT073
gccacggaaacauucaa

SEQ ID NO: 643181 - RNA, 16 nt, Escherichia coli CFT073
gcauagcgguaaauga

SEQ ID NO: 643182 - RNA, 16 nt, Escherichia coli CFT073
gcauagcguucuucca

SEQ ID NO: 643183 - RNA, 22 nt, Escherichia coli CFT073
gcauagcguucuuccacuuuaa

SEQ ID NO: 643184 - RNA, 20 nt, Escherichia coli CFT073
gccacaguuuuacugcagcc

SEQ ID NO: 643185 - RNA, 13 nt, Escherichia coli CFT073
gcauagcaccacc

SEQ ID NO: 643186 - RNA, 16 nt, Escherichia coli CFT073
gcauaccgaucgcggu

SEQ ID NO: 643187 - RNA, 13 nt, Escherichia coli CFT073
gcauaccuucaca

SEQ ID NO: 643188 - RNA, 23 nt, Escherichia coli CFT073
gcauaccuucacaaaaugccagc

SEQ ID NO: 643189 - RNA, 19 nt, Escherichia coli CFT073
gcauacaacgccaugaaga

SEQ ID NO: 643190 - RNA, 15 nt, Escherichia coli CFT073
gcauacaugcuuaac

SEQ ID NO: 643191 - RNA, 23 nt, Escherichia coli CFT073
gcauacacgucgucgccaaugcg

SEQ ID NO: 643192 - RNA, 13 nt, Escherichia coli CFT073
gccacauccggca

SEQ ID NO: 643193 - RNA, 15 nt, Escherichia coli CFT073
gccacauccagcggc

SEQ ID NO: 643194 - RNA, 22 nt, Escherichia coli CFT073
gccacauccccuccccggcggc

SEQ ID NO: 643195 - RNA, 21 nt, Escherichia coli CFT073
gccacauccgcgguaucgccg

SEQ ID NO: 643196 - RNA, 14 nt, Escherichia coli CFT073
gccaccacgcccag

SEQ ID NO: 643197 - RNA, 19 nt, Escherichia coli CFT073
gccaccacgcccagcgacc

SEQ ID NO: 643198 - RNA, 17 nt, Escherichia coli CFT073
gccaccacgccaagaaa

SEQ ID NO: 643199 - RNA, 17 nt, Escherichia coli CFT073
gccaccaccucuuccag

SEQ ID NO: 643200 - RNA, 16 nt, Escherichia coli CFT073
gccaccagcgccacca

SEQ ID NO: 643201 - RNA, 18 nt, Escherichia coli CFT073
gccaccagugcaggcacc

SEQ ID NO: 643202 - RNA, 12 nt, Escherichia coli CFT073
gccaccaguaac

SEQ ID NO: 643203 - RNA, 19 nt, Escherichia coli CFT073
gccaccaguaacgcucccu

SEQ ID NO: 643204 - RNA, 16 nt, Escherichia coli CFT073
gccaccaggcagcaca

SEQ ID NO: 643205 - RNA, 13 nt, Escherichia coli CFT073
gccaccaggccac

SEQ ID NO: 643206 - RNA, 21 nt, Escherichia coli CFT073
gccaccaggaaaaagaucagc

SEQ ID NO: 643207 - RNA, 18 nt, Escherichia coli CFT073
gccaccagcgucagaaac

SEQ ID NO: 643208 - RNA, 14 nt, Escherichia coli CFT073
gccaccagaaccgc

SEQ ID NO: 643209 - RNA, 17 nt, Escherichia coli CFT073
gccaccagaaccgccgc

SEQ ID NO: 643210 - RNA, 14 nt, Escherichia coli CFT073
gccaccucuuucac

SEQ ID NO: 643211 - RNA, 12 nt, Escherichia coli CFT073
gccaccugugca

SEQ ID NO: 643212 - RNA, 13 nt, Escherichia coli CFT073
gccaccucuuuca

SEQ ID NO: 643213 - RNA, 21 nt, Escherichia coli CFT073
gccaccguccagaucaucccg

SEQ ID NO: 643214 - RNA, 13 nt, Escherichia coli CFT073
gccaccgggaacg

SEQ ID NO: 643215 - RNA, 17 nt, Escherichia coli CFT073
gccacgaucggugaugc

SEQ ID NO: 643216 - RNA, 19 nt, Escherichia coli CFT073
gccacgaaacugcuggcuu

SEQ ID NO: 643217 - RNA, 22 nt, Escherichia coli CFT073
gccaccuuucuguuccauaauc

SEQ ID NO: 643218 - RNA, 21 nt, Escherichia coli CFT073
gccacgaaaacccucaauaau

SEQ ID NO: 643219 - RNA, 14 nt, Escherichia coli CFT073
gccacgccaccagc

SEQ ID NO: 643220 - RNA, 15 nt, Escherichia coli CFT073
gccacgccacgcugc

SEQ ID NO: 643221 - RNA, 19 nt, Escherichia coli CFT073
uagaacugcggcagguuga

SEQ ID NO: 643222 - RNA, 15 nt, Escherichia coli CFT073
uagaacguuuaucug

SEQ ID NO: 643223 - RNA, 19 nt, Escherichia coli CFT073
uagaaccuaagaaccagaa

SEQ ID NO: 643224 - RNA, 16 nt, Escherichia coli CFT073
uagaacggcagagaaa

SEQ ID NO: 643225 - RNA, 17 nt, Escherichia coli CFT073
uagaaggcgacaaagcc

SEQ ID NO: 643226 - RNA, 13 nt, Escherichia coli CFT073
uagaagcgacuga

SEQ ID NO: 643227 - RNA, 15 nt, Escherichia coli CFT073
uagaaugcagcagca

SEQ ID NO: 643228 - RNA, 17 nt, Escherichia coli CFT073
uacuauauaaaccuucu

SEQ ID NO: 643229 - RNA, 19 nt, Escherichia coli CFT073
uagaaaccauccagcagac

SEQ ID NO: 643230 - RNA, 12 nt, Escherichia coli CFT073
uacuauccugaa

SEQ ID NO: 643231 - RNA, 16 nt, Escherichia coli CFT073
uacuauccugaaagcu

SEQ ID NO: 643232 - RNA, 16 nt, Escherichia coli CFT073
uacuauccacagccug

SEQ ID NO: 643233 - RNA, 18 nt, Escherichia coli CFT073
uacuaugaggaccgaauc

SEQ ID NO: 643234 - RNA, 16 nt, Escherichia coli CFT073
uacuaugauuuuccug

SEQ ID NO: 643235 - RNA, 16 nt, Escherichia coli CFT073
uacuauggauauaauu

SEQ ID NO: 643236 - RNA, 16 nt, Escherichia coli CFT073
uagaaagugacugcug

SEQ ID NO: 643237 - RNA, 14 nt, Escherichia coli CFT073
uagaacaauuaaua

SEQ ID NO: 643238 - RNA, 22 nt, Escherichia coli CFT073
uagaaccaaaguuugcaaaccc

SEQ ID NO: 643239 - RNA, 21 nt, Escherichia coli CFT073
uagagucgaucuuuugucgcu

SEQ ID NO: 643240 - RNA, 18 nt, Escherichia coli CFT073
uagaggugauaugaauga

SEQ ID NO: 643241 - RNA, 12 nt, Escherichia coli CFT073
uagaguguugug

SEQ ID NO: 643242 - RNA, 15 nt, Escherichia coli CFT073
uagaguuugaacuca

SEQ ID NO: 643243 - RNA, 13 nt, Escherichia coli CFT073
uagauagcguucu

SEQ ID NO: 643244 - RNA, 19 nt, Escherichia coli CFT073
uagauaauuuugaaauaaa

SEQ ID NO: 643245 - RNA, 22 nt, Escherichia coli CFT073
uagauaauuuugaaauaaaauc

SEQ ID NO: 643246 - RNA, 13 nt, Escherichia coli CFT073
uagauaagcaagg

SEQ ID NO: 643247 - RNA, 12 nt, Escherichia coli CFT073
uagagcccaugc

SEQ ID NO: 643248 - RNA, 15 nt, Escherichia coli CFT073
uagagaucuucauac

SEQ ID NO: 643249 - RNA, 22 nt, Escherichia coli CFT073
uagagccgguuuugguuuucug

SEQ ID NO: 643250 - RNA, 21 nt, Escherichia coli CFT073
uagagcugguuucuggcggua

SEQ ID NO: 643251 - RNA, 16 nt, Escherichia coli CFT073
uagacaauguaucuuu

SEQ ID NO: 643252 - RNA, 19 nt, Escherichia coli CFT073
uagacaauguaucuuucau

SEQ ID NO: 643253 - RNA, 14 nt, Escherichia coli CFT073
uagacauuacgcau

SEQ ID NO: 643254 - RNA, 21 nt, Escherichia coli CFT073
uagacuguugaaauacaaaca

SEQ ID NO: 643255 - RNA, 22 nt, Escherichia coli CFT073
uagacgauagaaccuuccacgu

SEQ ID NO: 643256 - RNA, 14 nt, Escherichia coli CFT073
uagagaauguaaau

SEQ ID NO: 643257 - RNA, 21 nt, Escherichia coli CFT073
uagacuuccccacaaaauaac

SEQ ID NO: 643258 - RNA, 18 nt, Escherichia coli CFT073
uagacuuugucaucaguc

SEQ ID NO: 643259 - RNA, 16 nt, Escherichia coli CFT073
uagggcgcagcugugc

SEQ ID NO: 643260 - RNA, 18 nt, Escherichia coli CFT073
uagggggggcucuuucca

SEQ ID NO: 643261 - RNA, 17 nt, Escherichia coli CFT073
uaggguggggaaaaaac

SEQ ID NO: 643262 - RNA, 11 nt, Escherichia coli CFT073
uagggaaguag

SEQ ID NO: 643263 - RNA, 14 nt, Escherichia coli CFT073
uagggcagggugcc

SEQ ID NO: 643264 - RNA, 21 nt, Escherichia coli CFT073
uaggagguuuccgggucggca

SEQ ID NO: 643265 - RNA, 17 nt, Escherichia coli CFT073
uagcgugauuuuguagg

SEQ ID NO: 643266 - RNA, 18 nt, Escherichia coli CFT073
uagcgugauuuuuguagg

SEQ ID NO: 643267 - RNA, 17 nt, Escherichia coli CFT073
uagcgauuucacgcuca

SEQ ID NO: 643268 - RNA, 23 nt, Escherichia coli CFT073
uagcgauuucacgcucagcaaca

SEQ ID NO: 643269 - RNA, 14 nt, Escherichia coli CFT073
uagcgaucgucaaa

SEQ ID NO: 643270 - RNA, 19 nt, Escherichia coli CFT073
uagcgaucucggucaccag

SEQ ID NO: 643271 - RNA, 18 nt, Escherichia coli CFT073
uagcucaagcaaucaagc

SEQ ID NO: 643272 - RNA, 10 nt, Escherichia coli CFT073
uagcuaauca

SEQ ID NO: 643273 - RNA, 21 nt, Escherichia coli CFT073
uagcuaaucaucuguugugcc

SEQ ID NO: 643274 - RNA, 22 nt, Escherichia coli CFT073
uagcucaguugguagagcacga

SEQ ID NO: 643275 - RNA, 13 nt, Escherichia coli CFT073
uagcuuuggugcc

SEQ ID NO: 643276 - RNA, 20 nt, Escherichia coli CFT073
uagcuugauuucaggauaau

SEQ ID NO: 643277 - RNA, 16 nt, Escherichia coli CFT073
uagcugauaucaccug

SEQ ID NO: 643278 - RNA, 15 nt, Escherichia coli CFT073
uagaucuaaaugcca

SEQ ID NO: 643279 - RNA, 20 nt, Escherichia coli CFT073
uagaucgccagaaaguggca

SEQ ID NO: 643280 - RNA, 17 nt, Escherichia coli CFT073
uagauaggucaccagag

SEQ ID NO: 643281 - RNA, 16 nt, Escherichia coli CFT073
uagauauauccugaac

SEQ ID NO: 643282 - RNA, 18 nt, Escherichia coli CFT073
uagauauauccugaacuu

SEQ ID NO: 643283 - RNA, 14 nt, Escherichia coli CFT073
uagauaucaugcuc

SEQ ID NO: 643284 - RNA, 16 nt, Escherichia coli CFT073
uagauauccacaacaa

SEQ ID NO: 643285 - RNA, 17 nt, Escherichia coli CFT073
uagauauccacaacaau

SEQ ID NO: 643286 - RNA, 17 nt, Escherichia coli CFT073
uagauauucaucaaaau

SEQ ID NO: 643287 - RNA, 17 nt, Escherichia coli CFT073
uagcaaugccaucacca

SEQ ID NO: 643288 - RNA, 17 nt, Escherichia coli CFT073
uagcaagcgcugugaaa

SEQ ID NO: 643289 - RNA, 22 nt, Escherichia coli CFT073
uagcaagcgcugugaaacaccu

SEQ ID NO: 643290 - RNA, 14 nt, Escherichia coli CFT073
uagcaaggaugcca

SEQ ID NO: 643291 - RNA, 18 nt, Escherichia coli CFT073
uagccaaagcaccacucc

SEQ ID NO: 643292 - RNA, 14 nt, Escherichia coli CFT073
uagcauauacgaaa

SEQ ID NO: 643293 - RNA, 15 nt, Escherichia coli CFT073
uagcaucaagaaaaa

SEQ ID NO: 643294 - RNA, 16 nt, Escherichia coli CFT073
uagcaucaagaaaaau

SEQ ID NO: 643295 - RNA, 17 nt, Escherichia coli CFT073
uagcaguuccagcaucu

SEQ ID NO: 643296 - RNA, 18 nt, Escherichia coli CFT073
uagcaguucuuaaggcau

SEQ ID NO: 643297 - RNA, 19 nt, Escherichia coli CFT073
uagcacuuuucgucaggau

SEQ ID NO: 643298 - RNA, 18 nt, Escherichia coli CFT073
uagcacgacguuucuuuc

SEQ ID NO: 643299 - RNA, 19 nt, Escherichia coli CFT073
uagcaccucuccacgcauc

SEQ ID NO: 643300 - RNA, 17 nt, Escherichia coli CFT073
uagcaccaguuggucgg

SEQ ID NO: 643301 - RNA, 15 nt, Escherichia coli CFT073
uagcacauaaaaugg

SEQ ID NO: 643302 - RNA, 11 nt, Escherichia coli CFT073
uagccugccag

SEQ ID NO: 643303 - RNA, 12 nt, Escherichia coli CFT073
uagccugccagu

SEQ ID NO: 643304 - RNA, 14 nt, Escherichia coli CFT073
uagccuucaucaga

SEQ ID NO: 643305 - RNA, 21 nt, Escherichia coli CFT073
uagccuuuuuuaauauuucau

SEQ ID NO: 643306 - RNA, 21 nt, Escherichia coli CFT073
uagcgaauaaucccggcacca

SEQ ID NO: 643307 - RNA, 14 nt, Escherichia coli CFT073
uagcgaauuuuucg

SEQ ID NO: 643308 - RNA, 19 nt, Escherichia coli CFT073
uagccgguaaaucaccauc

SEQ ID NO: 643309 - RNA, 13 nt, Escherichia coli CFT073
uagccuccggcca

SEQ ID NO: 643310 - RNA, 19 nt, Escherichia coli CFT073
uagccugaugcgaugcugg

SEQ ID NO: 643311 - RNA, 18 nt, Escherichia coli CFT073
uagccguagcuggcaaug

SEQ ID NO: 643312 - RNA, 23 nt, Escherichia coli CFT073
uagccagccucauccaugcggca

SEQ ID NO: 643313 - RNA, 13 nt, Escherichia coli CFT073
uagccagcagagc

SEQ ID NO: 643314 - RNA, 20 nt, Escherichia coli CFT073
uagccacauccaugcuuguu

SEQ ID NO: 643315 - RNA, 15 nt, Escherichia coli CFT073
uagccaugaaaaagu

SEQ ID NO: 643316 - RNA, 19 nt, Escherichia coli CFT073
uagccauauggcugcaucc

SEQ ID NO: 643317 - RNA, 17 nt, Escherichia coli CFT073
uagccgcauaguccagu

SEQ ID NO: 643318 - RNA, 18 nt, Escherichia coli CFT073
uagccgccaaacgccgca

SEQ ID NO: 643319 - RNA, 16 nt, Escherichia coli CFT073
uagccauuaccagguc

SEQ ID NO: 643320 - RNA, 15 nt, Escherichia coli CFT073
uagccgcuucugcag

SEQ ID NO: 643321 - RNA, 17 nt, Escherichia coli CFT073
uagccgcuucugcagcu

SEQ ID NO: 643322 - RNA, 23 nt, Escherichia coli CFT073
uagccgcguacauugcugacaug

SEQ ID NO: 643323 - RNA, 22 nt, Escherichia coli CFT073
uaucugaaguaaagaaacuggu

SEQ ID NO: 643324 - RNA, 18 nt, Escherichia coli CFT073
uaucucgucacuuuucuu

SEQ ID NO: 643325 - RNA, 19 nt, Escherichia coli CFT073
uaucuaucacuauaaauau

SEQ ID NO: 643326 - RNA, 14 nt, Escherichia coli CFT073
uaucuuauucccac

SEQ ID NO: 643327 - RNA, 15 nt, Escherichia coli CFT073
uaucuguucuuuuau

SEQ ID NO: 643328 - RNA, 20 nt, Escherichia coli CFT073
uaucugucagacuaucuuug

SEQ ID NO: 643329 - RNA, 21 nt, Escherichia coli CFT073
uaucugauuacucauuaauca

SEQ ID NO: 643330 - RNA, 16 nt, Escherichia coli CFT073
uaucugauuuaaaaau

SEQ ID NO: 643331 - RNA, 13 nt, Escherichia coli CFT073
uaucugcacugcu

SEQ ID NO: 643332 - RNA, 23 nt, Escherichia coli CFT073
uaucuggucaguuaacaauaaca

SEQ ID NO: 643333 - RNA, 16 nt, Escherichia coli CFT073
uaucuguaauuaaauu

SEQ ID NO: 643334 - RNA, 15 nt, Escherichia coli CFT073
uaucuaauaaacauu

SEQ ID NO: 643335 - RNA, 19 nt, Escherichia coli CFT073
uaucuaaccggauaucuaa

SEQ ID NO: 643336 - RNA, 16 nt, Escherichia coli CFT073
uaucuaaaaugucacc

SEQ ID NO: 643337 - RNA, 22 nt, Escherichia coli CFT073
uaucgauauacaccggcaucaa

SEQ ID NO: 643338 - RNA, 17 nt, Escherichia coli CFT073
uauccagcagccagaga

SEQ ID NO: 643339 - RNA, 22 nt, Escherichia coli CFT073
uauccagaccgcgcuugccgcc

SEQ ID NO: 643340 - RNA, 16 nt, Escherichia coli CFT073
uauccagcggcagcca

SEQ ID NO: 643341 - RNA, 22 nt, Escherichia coli CFT073
uauccagccacggcuccagcaa

SEQ ID NO: 643342 - RNA, 16 nt, Escherichia coli CFT073
uaucaucaauaugaau

SEQ ID NO: 643343 - RNA, 15 nt, Escherichia coli CFT073
uaucaucacccugcg

SEQ ID NO: 643344 - RNA, 19 nt, Escherichia coli CFT073
uaucaucaucggucaguuu

SEQ ID NO: 643345 - RNA, 23 nt, Escherichia coli CFT073
uaucaucaucggucaguuugccc

SEQ ID NO: 643346 - RNA, 13 nt, Escherichia coli CFT073
uaucaugcccgga

SEQ ID NO: 643347 - RNA, 14 nt, Escherichia coli CFT073
uaucaugcccggau

SEQ ID NO: 643348 - RNA, 19 nt, Escherichia coli CFT073
uaucaugcccuuuuuucuu

SEQ ID NO: 643349 - RNA, 23 nt, Escherichia coli CFT073
uaucaugccuacgaguucgaugc

SEQ ID NO: 643350 - RNA, 21 nt, Escherichia coli CFT073
uaucaucgcggcacacagcac

SEQ ID NO: 643351 - RNA, 17 nt, Escherichia coli CFT073
uaucccggcaaaaaaca

SEQ ID NO: 643352 - RNA, 22 nt, Escherichia coli CFT073
uaucccaucagcggguuuuucc

SEQ ID NO: 643353 - RNA, 14 nt, Escherichia coli CFT073
uauccgacuuauuc

SEQ ID NO: 643354 - RNA, 19 nt, Escherichia coli CFT073
uauccgaguagcucaccag

SEQ ID NO: 643355 - RNA, 22 nt, Escherichia coli CFT073
uauccgccagcgccaaagccag

SEQ ID NO: 643356 - RNA, 14 nt, Escherichia coli CFT073
uauccuguuuuuaa

SEQ ID NO: 643357 - RNA, 21 nt, Escherichia coli CFT073
uaucgaccagcgcacugccgc

SEQ ID NO: 643358 - RNA, 15 nt, Escherichia coli CFT073
uauccuuuaucugcc

SEQ ID NO: 643359 - RNA, 22 nt, Escherichia coli CFT073
uauccuuuaucugcccuuuagu

SEQ ID NO: 643360 - RNA, 16 nt, Escherichia coli CFT073
uauauugcugauuuuc

SEQ ID NO: 643361 - RNA, 20 nt, Escherichia coli CFT073
uaucaaucgcggugauuuua

SEQ ID NO: 643362 - RNA, 17 nt, Escherichia coli CFT073
uaucaaucucagcaaga

SEQ ID NO: 643363 - RNA, 17 nt, Escherichia coli CFT073
uaucaaucuucucuucc

SEQ ID NO: 643364 - RNA, 15 nt, Escherichia coli CFT073
uaucaauaacauacc

SEQ ID NO: 643365 - RNA, 23 nt, Escherichia coli CFT073
uaucaauucuuuuucugaagacg

SEQ ID NO: 643366 - RNA, 18 nt, Escherichia coli CFT073
uaucaccaauauaaacau

SEQ ID NO: 643367 - RNA, 23 nt, Escherichia coli CFT073
uaucaccaaugauaaguuucacu

SEQ ID NO: 643368 - RNA, 13 nt, Escherichia coli CFT073
uaucaccacacaa

SEQ ID NO: 643369 - RNA, 19 nt, Escherichia coli CFT073
uaucaccacugaugccacu

SEQ ID NO: 643370 - RNA, 19 nt, Escherichia coli CFT073
uaucagcgccaccacaaaa

SEQ ID NO: 643371 - RNA, 14 nt, Escherichia coli CFT073
uaucaggccuacaa

SEQ ID NO: 643372 - RNA, 20 nt, Escherichia coli CFT073
uaucaggccuacgccagaca

SEQ ID NO: 643373 - RNA, 15 nt, Escherichia coli CFT073
uaucagguuuauaug

SEQ ID NO: 643374 - RNA, 20 nt, Escherichia coli CFT073
uaucaggucaauugaacucu

SEQ ID NO: 643375 - RNA, 22 nt, Escherichia coli CFT073
uaucaggucgaaaauaauccug

SEQ ID NO: 643376 - RNA, 15 nt, Escherichia coli CFT073
uaucaggucuuucug

SEQ ID NO: 643377 - RNA, 23 nt, Escherichia coli CFT073
uaucaguuguaugucauaaaaau

SEQ ID NO: 643378 - RNA, 13 nt, Escherichia coli CFT073
uauaggcaaugcg

SEQ ID NO: 643379 - RNA, 14 nt, Escherichia coli CFT073
uauagcuuauucuu

SEQ ID NO: 643380 - RNA, 22 nt, Escherichia coli CFT073
uauagcguugcccgauugguuc

SEQ ID NO: 643381 - RNA, 19 nt, Escherichia coli CFT073
uauagccgccuuuuuguug

SEQ ID NO: 643382 - RNA, 21 nt, Escherichia coli CFT073
uauagcgauuuuucaucacug

SEQ ID NO: 643383 - RNA, 11 nt, Escherichia coli CFT073
uauauccugaa

SEQ ID NO: 643384 - RNA, 13 nt, Escherichia coli CFT073
uauauauaauagu

SEQ ID NO: 643385 - RNA, 22 nt, Escherichia coli CFT073
uauauaggugauaaaguacauu

SEQ ID NO: 643386 - RNA, 15 nt, Escherichia coli CFT073
uauauaguaagaagc

SEQ ID NO: 643387 - RNA, 17 nt, Escherichia coli CFT073
uauauuccuauauauuu

SEQ ID NO: 643388 - RNA, 19 nt, Escherichia coli CFT073
uauauuacucauuaaugua

SEQ ID NO: 643389 - RNA, 21 nt, Escherichia coli CFT073
uauauuaucccccgauaaaac

SEQ ID NO: 643390 - RNA, 20 nt, Escherichia coli CFT073
uauauuccccggucagcagc

SEQ ID NO: 643391 - RNA, 21 nt, Escherichia coli CFT073
uauauuccccggucagcagca

SEQ ID NO: 643392 - RNA, 16 nt, Escherichia coli CFT073
uauaucuucuuuauau

SEQ ID NO: 643393 - RNA, 12 nt, Escherichia coli CFT073
uauaugaauacg

SEQ ID NO: 643394 - RNA, 18 nt, Escherichia coli CFT073
uauaugacucauaaaaau

SEQ ID NO: 643395 - RNA, 23 nt, Escherichia coli CFT073
uauaugacucauaaaaauauauu

SEQ ID NO: 643396 - RNA, 15 nt, Escherichia coli CFT073
uauacaaacauaaag

SEQ ID NO: 643397 - RNA, 14 nt, Escherichia coli CFT073
uauacaaccacccc

SEQ ID NO: 643398 - RNA, 23 nt, Escherichia coli CFT073
uauaauuuauuagcagugauuua

SEQ ID NO: 643399 - RNA, 16 nt, Escherichia coli CFT073
uauacaccuguuccau

SEQ ID NO: 643400 - RNA, 15 nt, Escherichia coli CFT073
uauacacgaaaugaa

SEQ ID NO: 643401 - RNA, 16 nt, Escherichia coli CFT073
uauacacgaaaugaau

SEQ ID NO: 643402 - RNA, 19 nt, Escherichia coli CFT073
uauacagccuuaacaagau

SEQ ID NO: 643403 - RNA, 17 nt, Escherichia coli CFT073
uauaauuauuuuaccau

SEQ ID NO: 643404 - RNA, 19 nt, Escherichia coli CFT073
uauaauuauuuuaccauau

SEQ ID NO: 643405 - RNA, 15 nt, Escherichia coli CFT073
uauaauaaauauuau

SEQ ID NO: 643406 - RNA, 19 nt, Escherichia coli CFT073
uauaauagugcuucaaaua

SEQ ID NO: 643407 - RNA, 14 nt, Escherichia coli CFT073
uauacuccugaugg

SEQ ID NO: 643408 - RNA, 13 nt, Escherichia coli CFT073
uauacucuaaaua

SEQ ID NO: 643409 - RNA, 21 nt, Escherichia coli CFT073
uauaccccaccccgagaugcc

SEQ ID NO: 643410 - RNA, 17 nt, Escherichia coli CFT073
uauaccuguuaauucuc

SEQ ID NO: 643411 - RNA, 16 nt, Escherichia coli CFT073
uauagaucaggaaaaa

SEQ ID NO: 643412 - RNA, 15 nt, Escherichia coli CFT073
uauagauucuacgaa

SEQ ID NO: 643413 - RNA, 16 nt, Escherichia coli CFT073
uaguggcaaauucuug

SEQ ID NO: 643414 - RNA, 16 nt, Escherichia coli CFT073
uagugcuucaaauauu

SEQ ID NO: 643415 - RNA, 15 nt, Escherichia coli CFT073
uagugugcaaucacu

SEQ ID NO: 643416 - RNA, 21 nt, Escherichia coli CFT073
uagugguaccaggaucagcaa

SEQ ID NO: 643417 - RNA, 17 nt, Escherichia coli CFT073
uaguguugcguuuuuau

SEQ ID NO: 643418 - RNA, 23 nt, Escherichia coli CFT073
uaguguugcguuuuuaucuucac

SEQ ID NO: 643419 - RNA, 15 nt, Escherichia coli CFT073
uaguuaaacuuucau

SEQ ID NO: 643420 - RNA, 16 nt, Escherichia coli CFT073
uaguuaaacuuucaua

SEQ ID NO: 643421 - RNA, 17 nt, Escherichia coli CFT073
uaguuaauaccugcacc

SEQ ID NO: 643422 - RNA, 15 nt, Escherichia coli CFT073
uaguuaauucauguc

SEQ ID NO: 643423 - RNA, 14 nt, Escherichia coli CFT073
uagucuuauuuaau

SEQ ID NO: 643424 - RNA, 18 nt, Escherichia coli CFT073
uagucugguugagcagua

SEQ ID NO: 643425 - RNA, 21 nt, Escherichia coli CFT073
uagucugaauugaauagauau

SEQ ID NO: 643426 - RNA, 17 nt, Escherichia coli CFT073
uagucugaccucuucua

SEQ ID NO: 643427 - RNA, 20 nt, Escherichia coli CFT073
uagguacaaagccaacagca

SEQ ID NO: 643428 - RNA, 12 nt, Escherichia coli CFT073
uaggucaccaga

SEQ ID NO: 643429 - RNA, 14 nt, Escherichia coli CFT073
uaggucaccagaga

SEQ ID NO: 643430 - RNA, 14 nt, Escherichia coli CFT073
uagucgcuuucauu

SEQ ID NO: 643431 - RNA, 20 nt, Escherichia coli CFT073
uauaaacauaucacuuuuau

SEQ ID NO: 643432 - RNA, 13 nt, Escherichia coli CFT073
uauaaaaaauacg

SEQ ID NO: 643433 - RNA, 21 nt, Escherichia coli CFT073
uauaaaccguccccaaaaaag

SEQ ID NO: 643434 - RNA, 21 nt, Escherichia coli CFT073
uauaaaugccggguaaagauu

SEQ ID NO: 643435 - RNA, 12 nt, Escherichia coli CFT073
uaguuugguuaa

SEQ ID NO: 643436 - RNA, 19 nt, Escherichia coli CFT073
uaguuuuuuacgaugcaau

SEQ ID NO: 643437 - RNA, 18 nt, Escherichia coli CFT073
uaguuucaaugccuuucu

SEQ ID NO: 643438 - RNA, 23 nt, Escherichia coli CFT073
uacgaccgcaaagguugcagcuc

SEQ ID NO: 643439 - RNA, 17 nt, Escherichia coli CFT073
uacgacuggccauggau

SEQ ID NO: 643440 - RNA, 18 nt, Escherichia coli CFT073
uacgauuaacgccagacu

SEQ ID NO: 643441 - RNA, 17 nt, Escherichia coli CFT073
uaccuuauccagcagau

SEQ ID NO: 643442 - RNA, 18 nt, Escherichia coli CFT073
uaccuuauccagcagauc

SEQ ID NO: 643443 - RNA, 22 nt, Escherichia coli CFT073
uaccuggccccuggcuggucag

SEQ ID NO: 643444 - RNA, 20 nt, Escherichia coli CFT073
uaccuguucgcgguuuucuu

SEQ ID NO: 643445 - RNA, 21 nt, Escherichia coli CFT073
uaccugucgcgucaaucacuu

SEQ ID NO: 643446 - RNA, 15 nt, Escherichia coli CFT073
uacgcccuuccccca

SEQ ID NO: 643447 - RNA, 14 nt, Escherichia coli CFT073
uacgccgcuaaugu

SEQ ID NO: 643448 - RNA, 17 nt, Escherichia coli CFT073
uacgccggaaaguuaau

SEQ ID NO: 643449 - RNA, 14 nt, Escherichia coli CFT073
uacgcccacgccag

SEQ ID NO: 643450 - RNA, 19 nt, Escherichia coli CFT073
uacgcgaucgcgaaaccac

SEQ ID NO: 643451 - RNA, 16 nt, Escherichia coli CFT073
uacgcgcaccgcguga

SEQ ID NO: 643452 - RNA, 21 nt, Escherichia coli CFT073
uacgcgccaaucggcaauuca

SEQ ID NO: 643453 - RNA, 20 nt, Escherichia coli CFT073
uacgccucagccgaaacaca

SEQ ID NO: 643454 - RNA, 18 nt, Escherichia coli CFT073
uacgcaaagcagcaagaa

SEQ ID NO: 643455 - RNA, 21 nt, Escherichia coli CFT073
uacgcaacugccaguaaagca

SEQ ID NO: 643456 - RNA, 13 nt, Escherichia coli CFT073
uacgccacuucau

SEQ ID NO: 643457 - RNA, 15 nt, Escherichia coli CFT073
uacgccaaucugcaa

SEQ ID NO: 643458 - RNA, 14 nt, Escherichia coli CFT073
uacuaauuaaugcc

SEQ ID NO: 643459 - RNA, 21 nt, Escherichia coli CFT073
uacuaaucucacccauagaua

SEQ ID NO: 643460 - RNA, 21 nt, Escherichia coli CFT073
uacuaaauaauuugaacuggu

SEQ ID NO: 643461 - RNA, 16 nt, Escherichia coli CFT073
uacguucacuuuucuu

SEQ ID NO: 643462 - RNA, 16 nt, Escherichia coli CFT073
uacguugcaaauauuc

SEQ ID NO: 643463 - RNA, 21 nt, Escherichia coli CFT073
uacguuaucgcgccaucaaau

SEQ ID NO: 643464 - RNA, 16 nt, Escherichia coli CFT073
uacguuauugucgguc

SEQ ID NO: 643465 - RNA, 15 nt, Escherichia coli CFT073
uacguguuguuccag

SEQ ID NO: 643466 - RNA, 20 nt, Escherichia coli CFT073
uacgguuuucucgccaccgg

SEQ ID NO: 643467 - RNA, 18 nt, Escherichia coli CFT073
uacgguacugaaaccuga

SEQ ID NO: 643468 - RNA, 13 nt, Escherichia coli CFT073
uacgcugaccuua

SEQ ID NO: 643469 - RNA, 22 nt, Escherichia coli CFT073
uacgcucugacgacauaauaau

SEQ ID NO: 643470 - RNA, 12 nt, Escherichia coli CFT073
uacgcucccacg

SEQ ID NO: 643471 - RNA, 13 nt, Escherichia coli CFT073
uacgcucauccug

SEQ ID NO: 643472 - RNA, 20 nt, Escherichia coli CFT073
uacgguaagccgcaaccacc

SEQ ID NO: 643473 - RNA, 13 nt, Escherichia coli CFT073
uacgcuucucucu

SEQ ID NO: 643474 - RNA, 15 nt, Escherichia coli CFT073
uacgcuucucucugu

SEQ ID NO: 643475 - RNA, 13 nt, Escherichia coli CFT073
uacgcuuaucagg

SEQ ID NO: 643476 - RNA, 18 nt, Escherichia coli CFT073
uaccagugccagaacaga

SEQ ID NO: 643477 - RNA, 21 nt, Escherichia coli CFT073
uaccagugccagaacagaaau

SEQ ID NO: 643478 - RNA, 14 nt, Escherichia coli CFT073
uaccaguggcggca

SEQ ID NO: 643479 - RNA, 21 nt, Escherichia coli CFT073
uaccaguuaaagcucuucuua

SEQ ID NO: 643480 - RNA, 20 nt, Escherichia coli CFT073
uaccaguagugaaaaaagca

SEQ ID NO: 643481 - RNA, 15 nt, Escherichia coli CFT073
uaccagucaauaaua

SEQ ID NO: 643482 - RNA, 20 nt, Escherichia coli CFT073
uaccaguccuacacacgcca

SEQ ID NO: 643483 - RNA, 17 nt, Escherichia coli CFT073
uaccacaaugguauugc

SEQ ID NO: 643484 - RNA, 11 nt, Escherichia coli CFT073
uaccacaucaa

SEQ ID NO: 643485 - RNA, 14 nt, Escherichia coli CFT073
uaccaguuccagcg

SEQ ID NO: 643486 - RNA, 19 nt, Escherichia coli CFT073
uaccauaucugguuaaaaa

SEQ ID NO: 643487 - RNA, 20 nt, Escherichia coli CFT073
uaccauccggccauuuucau

SEQ ID NO: 643488 - RNA, 15 nt, Escherichia coli CFT073
uaccaucgacaccau

SEQ ID NO: 643489 - RNA, 14 nt, Escherichia coli CFT073
uaccauccacacca

SEQ ID NO: 643490 - RNA, 15 nt, Escherichia coli CFT073
uaccaugaucugcaa

SEQ ID NO: 643491 - RNA, 15 nt, Escherichia coli CFT073
uaccaugcaccaacc

SEQ ID NO: 643492 - RNA, 15 nt, Escherichia coli CFT073
uaccccaccgccgag

SEQ ID NO: 643493 - RNA, 17 nt, Escherichia coli CFT073
uaccccagaugaguaau

SEQ ID NO: 643494 - RNA, 16 nt, Escherichia coli CFT073
uacccgauccacugaa

SEQ ID NO: 643495 - RNA, 21 nt, Escherichia coli CFT073
uacccgccaguguagcgauuu

SEQ ID NO: 643496 - RNA, 21 nt, Escherichia coli CFT073
uacccggauuuuucagcgcca

SEQ ID NO: 643497 - RNA, 21 nt, Escherichia coli CFT073
uacccgcucgaaguuuuccuc

SEQ ID NO: 643498 - RNA, 13 nt, Escherichia coli CFT073
uacccggugccgc

SEQ ID NO: 643499 - RNA, 19 nt, Escherichia coli CFT073
uacccagcguguugaggaa

SEQ ID NO: 643500 - RNA, 22 nt, Escherichia coli CFT073
uacccagcguguugaggaagcg

SEQ ID NO: 643501 - RNA, 19 nt, Escherichia coli CFT073
uaccauugaagcaauccau

SEQ ID NO: 643502 - RNA, 14 nt, Escherichia coli CFT073
uacccagacaaaau

SEQ ID NO: 643503 - RNA, 12 nt, Escherichia coli CFT073
uacccagacuuu

SEQ ID NO: 643504 - RNA, 14 nt, Escherichia coli CFT073
uacccagacuuuuc

SEQ ID NO: 643505 - RNA, 15 nt, Escherichia coli CFT073
uacccagcaaugcca

SEQ ID NO: 643506 - RNA, 19 nt, Escherichia coli CFT073
uacccagcaaugccaggcu

SEQ ID NO: 643507 - RNA, 12 nt, Escherichia coli CFT073
uacccagcagca

SEQ ID NO: 643508 - RNA, 17 nt, Escherichia coli CFT073
uacccagcagcagcggu

SEQ ID NO: 643509 - RNA, 13 nt, Escherichia coli CFT073
uaccauuucuucu

SEQ ID NO: 643510 - RNA, 14 nt, Escherichia coli CFT073
uaccauuucuucug

SEQ ID NO: 643511 - RNA, 22 nt, Escherichia coli CFT073
uaccuccugucuaaccgccugc

SEQ ID NO: 643512 - RNA, 22 nt, Escherichia coli CFT073
uaccugagucauuaacucaguu

SEQ ID NO: 643513 - RNA, 19 nt, Escherichia coli CFT073
uaccugagccugugcaugu

SEQ ID NO: 643514 - RNA, 21 nt, Escherichia coli CFT073
uaccuggaacucgaaaauauu

SEQ ID NO: 643515 - RNA, 18 nt, Escherichia coli CFT073
uaccgacgaucgggaaca

SEQ ID NO: 643516 - RNA, 14 nt, Escherichia coli CFT073
uaccgagcagccac

SEQ ID NO: 643517 - RNA, 12 nt, Escherichia coli CFT073
uaccgagcagcc

SEQ ID NO: 643518 - RNA, 21 nt, Escherichia coli CFT073
uaccgucagaaauuaaacugu

SEQ ID NO: 643519 - RNA, 13 nt, Escherichia coli CFT073
uaccgugcagcac

SEQ ID NO: 643520 - RNA, 18 nt, Escherichia coli CFT073
uaccgugcuguacagcag

SEQ ID NO: 643521 - RNA, 18 nt, Escherichia coli CFT073
uaccggcaggaaauuaag

SEQ ID NO: 643522 - RNA, 16 nt, Escherichia coli CFT073
uaccggaugcucacag

SEQ ID NO: 643523 - RNA, 14 nt, Escherichia coli CFT073
uacaucugcaucaa

SEQ ID NO: 643524 - RNA, 15 nt, Escherichia coli CFT073
uacauguauaaaaag

SEQ ID NO: 643525 - RNA, 12 nt, Escherichia coli CFT073
uacauggcagac

SEQ ID NO: 643526 - RNA, 12 nt, Escherichia coli CFT073
uacaugcugcuu

SEQ ID NO: 643527 - RNA, 12 nt, Escherichia coli CFT073
uacaugcagggc

SEQ ID NO: 643528 - RNA, 14 nt, Escherichia coli CFT073
uacaucgcgauacu

SEQ ID NO: 643529 - RNA, 15 nt, Escherichia coli CFT073
uacaucgauuucgcu

SEQ ID NO: 643530 - RNA, 16 nt, Escherichia coli CFT073
uacaucagaguacaga

SEQ ID NO: 643531 - RNA, 18 nt, Escherichia coli CFT073
uacaucaccguucagcuu

SEQ ID NO: 643532 - RNA, 24 nt, Escherichia coli CFT073
uacagcggaacuuuuuucauccag

SEQ ID NO: 643533 - RNA, 22 nt, Escherichia coli CFT073
uacaggcaucgggaauggcaua

SEQ ID NO: 643534 - RNA, 23 nt, Escherichia coli CFT073
uacaggcaucgggaauggcauac

SEQ ID NO: 643535 - RNA, 13 nt, Escherichia coli CFT073
uacaggcaucuuc

SEQ ID NO: 643536 - RNA, 22 nt, Escherichia coli CFT073
uacaggccaccaggccacggcg

SEQ ID NO: 643537 - RNA, 20 nt, Escherichia coli CFT073
uacaggccaccgcccaccau

SEQ ID NO: 643538 - RNA, 16 nt, Escherichia coli CFT073
uacaggcagauaaaau

SEQ ID NO: 643539 - RNA, 16 nt, Escherichia coli CFT073
uacagguaagcacaca

SEQ ID NO: 643540 - RNA, 21 nt, Escherichia coli CFT073
uacauagcguuaccucaaaau

SEQ ID NO: 643541 - RNA, 13 nt, Escherichia coli CFT073
uacaggggccagc

SEQ ID NO: 643542 - RNA, 22 nt, Escherichia coli CFT073
uacagggaacacauguguugau

SEQ ID NO: 643543 - RNA, 11 nt, Escherichia coli CFT073
uacaggcggaa

SEQ ID NO: 643544 - RNA, 23 nt, Escherichia coli CFT073
uacaggcuaucggccagguauug

SEQ ID NO: 643545 - RNA, 21 nt, Escherichia coli CFT073
uaccaauacguuucuuccaca

SEQ ID NO: 643546 - RNA, 13 nt, Escherichia coli CFT073
uaccaagccaagc

SEQ ID NO: 643547 - RNA, 22 nt, Escherichia coli CFT073
uaccaacauauugcuccauaau

SEQ ID NO: 643548 - RNA, 21 nt, Escherichia coli CFT073
uaccaaccagauuaccgccuu

SEQ ID NO: 643549 - RNA, 19 nt, Escherichia coli CFT073
uaccaaaauugaugaguau

SEQ ID NO: 643550 - RNA, 14 nt, Escherichia coli CFT073
uacauucauauacu

SEQ ID NO: 643551 - RNA, 19 nt, Escherichia coli CFT073
uacauugccaccaccagcg

SEQ ID NO: 643552 - RNA, 13 nt, Escherichia coli CFT073
uacauugccgggc

SEQ ID NO: 643553 - RNA, 21 nt, Escherichia coli CFT073
uacauuaauuuucaauugaua

SEQ ID NO: 643554 - RNA, 20 nt, Escherichia coli CFT073
uacauugggaagauaaaaac

SEQ ID NO: 643555 - RNA, 17 nt, Escherichia coli CFT073
uacauugcugacauggc

SEQ ID NO: 643556 - RNA, 16 nt, Escherichia coli CFT073
uacauuguuuuccaga

SEQ ID NO: 643557 - RNA, 18 nt, Escherichia coli CFT073
uacaauuuguaacgauuc

SEQ ID NO: 643558 - RNA, 14 nt, Escherichia coli CFT073
uacagaacgcugca

SEQ ID NO: 643559 - RNA, 16 nt, Escherichia coli CFT073
uacagcaauggaaaaa

SEQ ID NO: 643560 - RNA, 13 nt, Escherichia coli CFT073
uacagcccaggaa

SEQ ID NO: 643561 - RNA, 18 nt, Escherichia coli CFT073
uacagcccgccggaaagc

SEQ ID NO: 643562 - RNA, 16 nt, Escherichia coli CFT073
uacagccgccagacaa

SEQ ID NO: 643563 - RNA, 13 nt, Escherichia coli CFT073
uacagccggguga

SEQ ID NO: 643564 - RNA, 15 nt, Escherichia coli CFT073
uacagccgccagaca

SEQ ID NO: 643565 - RNA, 17 nt, Escherichia coli CFT073
uacagccuuaacaagau

SEQ ID NO: 643566 - RNA, 23 nt, Escherichia coli CFT073
uacagcgaauaguggaguaugag

SEQ ID NO: 643567 - RNA, 17 nt, Escherichia coli CFT073
uacagacucaaaccaau

SEQ ID NO: 643568 - RNA, 13 nt, Escherichia coli CFT073
uacagauacauuu

SEQ ID NO: 643569 - RNA, 14 nt, Escherichia coli CFT073
uacagaugaaauac

SEQ ID NO: 643570 - RNA, 13 nt, Escherichia coli CFT073
uacagaugcugcu

SEQ ID NO: 643571 - RNA, 23 nt, Escherichia coli CFT073
uacagauucaauuuugcagcauu

SEQ ID NO: 643572 - RNA, 15 nt, Escherichia coli CFT073
uacagcaaaauacca

SEQ ID NO: 643573 - RNA, 22 nt, Escherichia coli CFT073
uacaaucccguugaaaaugcug

SEQ ID NO: 643574 - RNA, 21 nt, Escherichia coli CFT073
uacaauccugugcuccaguac

SEQ ID NO: 643575 - RNA, 18 nt, Escherichia coli CFT073
uacaauccaguaccaggc

SEQ ID NO: 643576 - RNA, 20 nt, Escherichia coli CFT073
uacaaucgucugguuuuccu

SEQ ID NO: 643577 - RNA, 14 nt, Escherichia coli CFT073
uacaacgcuuuauc

SEQ ID NO: 643578 - RNA, 17 nt, Escherichia coli CFT073
uacaacgggggaauaac

SEQ ID NO: 643579 - RNA, 20 nt, Escherichia coli CFT073
uacaaaucgugcaucuccug

SEQ ID NO: 643580 - RNA, 12 nt, Escherichia coli CFT073
uacaaaucucca

SEQ ID NO: 643581 - RNA, 19 nt, Escherichia coli CFT073
uacaaauagaucgccagaa

SEQ ID NO: 643582 - RNA, 17 nt, Escherichia coli CFT073
uaauaauucaaaaaccu

SEQ ID NO: 643583 - RNA, 22 nt, Escherichia coli CFT073
uaauaaucucgccuuaucagaa

SEQ ID NO: 643584 - RNA, 21 nt, Escherichia coli CFT073
uaauacaggcuacucccagua

SEQ ID NO: 643585 - RNA, 22 nt, Escherichia coli CFT073
uaauaauuugcgcgguaacgcc

SEQ ID NO: 643586 - RNA, 18 nt, Escherichia coli CFT073
uaauacguuuuaucaaac

SEQ ID NO: 643587 - RNA, 13 nt, Escherichia coli CFT073
uaauaccaucggc

SEQ ID NO: 643588 - RNA, 14 nt, Escherichia coli CFT073
uaauaccgccaaca

SEQ ID NO: 643589 - RNA, 16 nt, Escherichia coli CFT073
uaauaccgccaacaug

SEQ ID NO: 643590 - RNA, 20 nt, Escherichia coli CFT073
uaauaccgccaacaugcgca

SEQ ID NO: 643591 - RNA, 22 nt, Escherichia coli CFT073
uaauaccgcgagauauccacau

SEQ ID NO: 643592 - RNA, 17 nt, Escherichia coli CFT073
uaauacggcucucaccu

SEQ ID NO: 643593 - RNA, 16 nt, Escherichia coli CFT073
uaauacguagcaccaa

SEQ ID NO: 643594 - RNA, 20 nt, Escherichia coli CFT073
uaauacgcuaaauaaacaau

SEQ ID NO: 643595 - RNA, 21 nt, Escherichia coli CFT073
uaauacgcuaaauaaacaaug

SEQ ID NO: 643596 - RNA, 16 nt, Escherichia coli CFT073
uaauaccgaacgcaga

SEQ ID NO: 643597 - RNA, 13 nt, Escherichia coli CFT073
uaauaauauaaau

SEQ ID NO: 643598 - RNA, 19 nt, Escherichia coli CFT073
uaauaaggcucucauuauu

SEQ ID NO: 643599 - RNA, 20 nt, Escherichia coli CFT073
uaauaaggcucucauuauuu

SEQ ID NO: 643600 - RNA, 20 nt, Escherichia coli CFT073
uaauaaguggugucagaaga

SEQ ID NO: 643601 - RNA, 18 nt, Escherichia coli CFT073
uaauaagagauccaggcc

SEQ ID NO: 643602 - RNA, 12 nt, Escherichia coli CFT073
uaauaagagguu

SEQ ID NO: 643603 - RNA, 18 nt, Escherichia coli CFT073
uaauaacccgucagcaga

SEQ ID NO: 643604 - RNA, 16 nt, Escherichia coli CFT073
uaauaaccaccacuga

SEQ ID NO: 643605 - RNA, 20 nt, Escherichia coli CFT073
uaauaaacguggagauaaac

SEQ ID NO: 643606 - RNA, 20 nt, Escherichia coli CFT073
uaauaaaaaguuguuaauaa

SEQ ID NO: 643607 - RNA, 19 nt, Escherichia coli CFT073
uaauaaaaaccugucugga

SEQ ID NO: 643608 - RNA, 21 nt, Escherichia coli CFT073
uaauaaaaaccugucuggauu

SEQ ID NO: 643609 - RNA, 21 nt, Escherichia coli CFT073
uaauaaaaaggugauuuauuu

SEQ ID NO: 643610 - RNA, 17 nt, Escherichia coli CFT073
uaaguugccacgcuuca

SEQ ID NO: 643611 - RNA, 23 nt, Escherichia coli CFT073
uaaguugccgcuuuuuugugcac

SEQ ID NO: 643612 - RNA, 14 nt, Escherichia coli CFT073
uaaguuucccagcu

SEQ ID NO: 643613 - RNA, 14 nt, Escherichia coli CFT073
uaaguugaaucggc

SEQ ID NO: 643614 - RNA, 12 nt, Escherichia coli CFT073
uaaguucagaaa

SEQ ID NO: 643615 - RNA, 21 nt, Escherichia coli CFT073
uaaguuagucgcuuucauuca

SEQ ID NO: 643616 - RNA, 22 nt, Escherichia coli CFT073
uaaguuacuaaaaguaaauaag

SEQ ID NO: 643617 - RNA, 14 nt, Escherichia coli CFT073
uaagucagaaagcc

SEQ ID NO: 643618 - RNA, 21 nt, Escherichia coli CFT073
uaagucuggcacgaccgccuu

SEQ ID NO: 643619 - RNA, 22 nt, Escherichia coli CFT073
uaaguguauguuggcuuuauaa

SEQ ID NO: 643620 - RNA, 22 nt, Escherichia coli CFT073
uaagugauggauguugccaaca

SEQ ID NO: 643621 - RNA, 19 nt, Escherichia coli CFT073
uaagugccggaugcgaugc

SEQ ID NO: 643622 - RNA, 16 nt, Escherichia coli CFT073
uaaguacuuuccauuu

SEQ ID NO: 643623 - RNA, 22 nt, Escherichia coli CFT073
uaaguacuuuccauuuuggaau

SEQ ID NO: 643624 - RNA, 16 nt, Escherichia coli CFT073
uaaguacauuaaaauc

SEQ ID NO: 643625 - RNA, 15 nt, Escherichia coli CFT073
uaaguacguuuucuu

SEQ ID NO: 643626 - RNA, 15 nt, Escherichia coli CFT073
uaaguacuaaauaau

SEQ ID NO: 643627 - RNA, 14 nt, Escherichia coli CFT073
uaaguaaucauaau

SEQ ID NO: 643628 - RNA, 12 nt, Escherichia coli CFT073
uaaguaaacaaa

SEQ ID NO: 643629 - RNA, 15 nt, Escherichia coli CFT073
uaaguaaacaaacau

SEQ ID NO: 643630 - RNA, 17 nt, Escherichia coli CFT073
uaaguaaacaaacauga

SEQ ID NO: 643631 - RNA, 13 nt, Escherichia coli CFT073
uaaggccaaacac

SEQ ID NO: 643632 - RNA, 13 nt, Escherichia coli CFT073
uaaggcaucagcc

SEQ ID NO: 643633 - RNA, 20 nt, Escherichia coli CFT073
uaaggagcaauaaucagugc

SEQ ID NO: 643634 - RNA, 20 nt, Escherichia coli CFT073
uaaggcguugauuggcgcag

SEQ ID NO: 643635 - RNA, 14 nt, Escherichia coli CFT073
uaaggcuucaauca

SEQ ID NO: 643636 - RNA, 22 nt, Escherichia coli CFT073
uaaugcuucuaccgucuguaac

SEQ ID NO: 643637 - RNA, 18 nt, Escherichia coli CFT073
uaaugcuucgcacugugu

SEQ ID NO: 643638 - RNA, 22 nt, Escherichia coli CFT073
uaaucuuccagaucaccgcaga

SEQ ID NO: 643639 - RNA, 16 nt, Escherichia coli CFT073
uaaucuuuacaccaac

SEQ ID NO: 643640 - RNA, 22 nt, Escherichia coli CFT073
uaauguccauauauaaaaucau

SEQ ID NO: 643641 - RNA, 22 nt, Escherichia coli CFT073
uaauguaucugaaguaaagaaa

SEQ ID NO: 643642 - RNA, 19 nt, Escherichia coli CFT073
uaauguaugugcgaaaauu

SEQ ID NO: 643643 - RNA, 16 nt, Escherichia coli CFT073
uaauguaaauauuggu

SEQ ID NO: 643644 - RNA, 15 nt, Escherichia coli CFT073
uaauggcaauggucu

SEQ ID NO: 643645 - RNA, 14 nt, Escherichia coli CFT073
uaauuaaauuauca

SEQ ID NO: 643646 - RNA, 11 nt, Escherichia coli CFT073
uaauuaaacug

SEQ ID NO: 643647 - RNA, 21 nt, Escherichia coli CFT073
uaauuaacaccuuaaccucag

SEQ ID NO: 643648 - RNA, 16 nt, Escherichia coli CFT073
uaauuaagacugaugc

SEQ ID NO: 643649 - RNA, 21 nt, Escherichia coli CFT073
uaaugucucgguagagaaaac

SEQ ID NO: 643650 - RNA, 23 nt, Escherichia coli CFT073
uaaugucucgguagagaaaacca

SEQ ID NO: 643651 - RNA, 20 nt, Escherichia coli CFT073
uaaugucgcgaucauggucu

SEQ ID NO: 643652 - RNA, 17 nt, Escherichia coli CFT073
uaaugugccgaauccaa

SEQ ID NO: 643653 - RNA, 20 nt, Escherichia coli CFT073
uaaugugucugaaagcagac

SEQ ID NO: 643654 - RNA, 15 nt, Escherichia coli CFT073
uaauguguucaacuu

SEQ ID NO: 643655 - RNA, 23 nt, Escherichia coli CFT073
uaauuccucccguuaugaucagc

SEQ ID NO: 643656 - RNA, 16 nt, Escherichia coli CFT073
uaauucuggaucaagu

SEQ ID NO: 643657 - RNA, 13 nt, Escherichia coli CFT073
uaauucuguccuc

SEQ ID NO: 643658 - RNA, 13 nt, Escherichia coli CFT073
uaauucuucagca

SEQ ID NO: 643659 - RNA, 16 nt, Escherichia coli CFT073
uaauuccccugccaga

SEQ ID NO: 643660 - RNA, 17 nt, Escherichia coli CFT073
uaauuauaaaucccugc

SEQ ID NO: 643661 - RNA, 18 nt, Escherichia coli CFT073
uaauuagcuuaucaaucu

SEQ ID NO: 643662 - RNA, 21 nt, Escherichia coli CFT073
uaauugacaagguaguagaaa

SEQ ID NO: 643663 - RNA, 16 nt, Escherichia coli CFT073
uaauugaccagaucuu

SEQ ID NO: 643664 - RNA, 19 nt, Escherichia coli CFT073
uaauugaccagaucuucau

SEQ ID NO: 643665 - RNA, 18 nt, Escherichia coli CFT073
uaauugacgccaucaacg

SEQ ID NO: 643666 - RNA, 22 nt, Escherichia coli CFT073
uaauugccauuacuacaaacaa

SEQ ID NO: 643667 - RNA, 22 nt, Escherichia coli CFT073
uaauugcgcagcggaggcgaua

SEQ ID NO: 643668 - RNA, 17 nt, Escherichia coli CFT073
uaaucauaauuauaaua

SEQ ID NO: 643669 - RNA, 14 nt, Escherichia coli CFT073
uaauccacuuucuu

SEQ ID NO: 643670 - RNA, 20 nt, Escherichia coli CFT073
uaauccacuuucuuaaagcc

SEQ ID NO: 643671 - RNA, 20 nt, Escherichia coli CFT073
uaaucaguuuaucaaucuca

SEQ ID NO: 643672 - RNA, 22 nt, Escherichia coli CFT073
uaaucagcacaauaaucagccc

SEQ ID NO: 643673 - RNA, 12 nt, Escherichia coli CFT073
uaaucagcgcac

SEQ ID NO: 643674 - RNA, 20 nt, Escherichia coli CFT073
uaaucagcgccguagccauu

SEQ ID NO: 643675 - RNA, 14 nt, Escherichia coli CFT073
uaaucaaucaccuc

SEQ ID NO: 643676 - RNA, 14 nt, Escherichia coli CFT073
uaaucaauuuaucg

SEQ ID NO: 643677 - RNA, 16 nt, Escherichia coli CFT073
uaaucaauuuuuugau

SEQ ID NO: 643678 - RNA, 20 nt, Escherichia coli CFT073
uaaucaaccauuaaacguac

SEQ ID NO: 643679 - RNA, 19 nt, Escherichia coli CFT073
uaaucaacgcuacguuauu

SEQ ID NO: 643680 - RNA, 22 nt, Escherichia coli CFT073
uaaucaacgcuacguuauuuau

SEQ ID NO: 643681 - RNA, 22 nt, Escherichia coli CFT073
uaaucaacguucggugcgcgcu

SEQ ID NO: 643682 - RNA, 19 nt, Escherichia coli CFT073
uaaucaaaucaacaaccug

SEQ ID NO: 643683 - RNA, 14 nt, Escherichia coli CFT073
uaaucaaauaaaua

SEQ ID NO: 643684 - RNA, 17 nt, Escherichia coli CFT073
uaauaugcagacucauu

SEQ ID NO: 643685 - RNA, 21 nt, Escherichia coli CFT073
uaauaugcagacucauuguau

SEQ ID NO: 643686 - RNA, 16 nt, Escherichia coli CFT073
uaauagccugauguag

SEQ ID NO: 643687 - RNA, 23 nt, Escherichia coli CFT073
uaauagagccuuugacuauuuca

SEQ ID NO: 643688 - RNA, 13 nt, Escherichia coli CFT073
uaauagauaauuu

SEQ ID NO: 643689 - RNA, 20 nt, Escherichia coli CFT073
uaaucgccuuacccugaccg

SEQ ID NO: 643690 - RNA, 14 nt, Escherichia coli CFT073
uaaucgccuuuuuu

SEQ ID NO: 643691 - RNA, 22 nt, Escherichia coli CFT073
uaaucgccagcaaaaucaccau

SEQ ID NO: 643692 - RNA, 16 nt, Escherichia coli CFT073
uaaucgcccggauauc

SEQ ID NO: 643693 - RNA, 19 nt, Escherichia coli CFT073
uaaucgccgcauaauaucu

SEQ ID NO: 643694 - RNA, 21 nt, Escherichia coli CFT073
uaaucgccgcauaauaucuuu

SEQ ID NO: 643695 - RNA, 11 nt, Escherichia coli CFT073
uaauccagcaa

SEQ ID NO: 643696 - RNA, 15 nt, Escherichia coli CFT073
uaauccagcaaacug

SEQ ID NO: 643697 - RNA, 20 nt, Escherichia coli CFT073
uaauccccacaucaggccca

SEQ ID NO: 643698 - RNA, 15 nt, Escherichia coli CFT073
uaaucgauuuagaac

SEQ ID NO: 643699 - RNA, 14 nt, Escherichia coli CFT073
uaaucucaccauuu

SEQ ID NO: 643700 - RNA, 14 nt, Escherichia coli CFT073
uaaucuauauuucu

SEQ ID NO: 643701 - RNA, 13 nt, Escherichia coli CFT073
uaaucuaaucugu

SEQ ID NO: 643702 - RNA, 14 nt, Escherichia coli CFT073
uaaucgucaucagc

SEQ ID NO: 643703 - RNA, 15 nt, Escherichia coli CFT073
uaaucucuuuccauu

SEQ ID NO: 643704 - RNA, 13 nt, Escherichia coli CFT073
uaaucucuuucuu

SEQ ID NO: 643705 - RNA, 23 nt, Escherichia coli CFT073
uaaucugaacggcugcauuccuu

SEQ ID NO: 643706 - RNA, 22 nt, Escherichia coli CFT073
uaaucugguaucgaguggcgca

SEQ ID NO: 643707 - RNA, 22 nt, Escherichia coli CFT073
uaaucuggauguucggcgucuu

SEQ ID NO: 643708 - RNA, 22 nt, Escherichia coli CFT073
uaaucuguugauuuaacagcaa

SEQ ID NO: 643709 - RNA, 20 nt, Escherichia coli CFT073
uaagccgguaaucaccagca

SEQ ID NO: 643710 - RNA, 23 nt, Escherichia coli CFT073
uaagccuuccgcugacagcgcgu

SEQ ID NO: 643711 - RNA, 13 nt, Escherichia coli CFT073
uaagccgccgcca

SEQ ID NO: 643712 - RNA, 21 nt, Escherichia coli CFT073
uaagcgaucgcuaaagcauuc

SEQ ID NO: 643713 - RNA, 18 nt, Escherichia coli CFT073
uaagcgagaacugccuua

SEQ ID NO: 643714 - RNA, 16 nt, Escherichia coli CFT073
uaagcgaguuauugau

SEQ ID NO: 643715 - RNA, 20 nt, Escherichia coli CFT073
uaagcgauaaaaauaccgag

SEQ ID NO: 643716 - RNA, 20 nt, Escherichia coli CFT073
uaagcgucguuaaucgccug

SEQ ID NO: 643717 - RNA, 14 nt, Escherichia coli CFT073
uaagcguucugcaa

SEQ ID NO: 643718 - RNA, 17 nt, Escherichia coli CFT073
uaagcguuuucugccag

SEQ ID NO: 643719 - RNA, 20 nt, Escherichia coli CFT073
uaagcgcagucaccagcauc

SEQ ID NO: 643720 - RNA, 18 nt, Escherichia coli CFT073
uaagcgcauaaucaaucg

SEQ ID NO: 643721 - RNA, 23 nt, Escherichia coli CFT073
uaagcgcgcggccucaucuccag

SEQ ID NO: 643722 - RNA, 21 nt, Escherichia coli CFT073
uaagcgcguuguucaccucuu

SEQ ID NO: 643723 - RNA, 16 nt, Escherichia coli CFT073
uaagcuuagucuuauu

SEQ ID NO: 643724 - RNA, 21 nt, Escherichia coli CFT073
uaagcuuagucuuauuuaaug

SEQ ID NO: 643725 - RNA, 17 nt, Escherichia coli CFT073
uaagcuuuuucugcuuc

SEQ ID NO: 643726 - RNA, 16 nt, Escherichia coli CFT073
uaagcucucagcauau

SEQ ID NO: 643727 - RNA, 16 nt, Escherichia coli CFT073
uaagcucaaugguguu

SEQ ID NO: 643728 - RNA, 19 nt, Escherichia coli CFT073
uaagcuguacacuucccag

SEQ ID NO: 643729 - RNA, 20 nt, Escherichia coli CFT073
uaagcuguacacuucccagc

SEQ ID NO: 643730 - RNA, 20 nt, Escherichia coli CFT073
uaagcuguucagauacacca

SEQ ID NO: 643731 - RNA, 13 nt, Escherichia coli CFT073
uaagcccagggaa

SEQ ID NO: 643732 - RNA, 22 nt, Escherichia coli CFT073
uaagcccggcauuguuuuuauc

SEQ ID NO: 643733 - RNA, 17 nt, Escherichia coli CFT073
uaagcaucgcaacgcau

SEQ ID NO: 643734 - RNA, 22 nt, Escherichia coli CFT073
uaagcaucgcaacgcaucuuuu

SEQ ID NO: 643735 - RNA, 20 nt, Escherichia coli CFT073
uaagcacaaagcaauauuau

SEQ ID NO: 643736 - RNA, 13 nt, Escherichia coli CFT073
uaagcaaucacuu

SEQ ID NO: 643737 - RNA, 14 nt, Escherichia coli CFT073
uaagcaauuauuca

SEQ ID NO: 643738 - RNA, 16 nt, Escherichia coli CFT073
uaagcaauuauucaua

SEQ ID NO: 643739 - RNA, 16 nt, Escherichia coli CFT073
uaagcaguccagcgcc

SEQ ID NO: 643740 - RNA, 15 nt, Escherichia coli CFT073
uaagcacguuaccca

SEQ ID NO: 643741 - RNA, 17 nt, Escherichia coli CFT073
uaagcaaauccuuccgc

SEQ ID NO: 643742 - RNA, 15 nt, Escherichia coli CFT073
uaagaucgugcagca

SEQ ID NO: 643743 - RNA, 18 nt, Escherichia coli CFT073
uaagaugcgccaacauca

SEQ ID NO: 643744 - RNA, 22 nt, Escherichia coli CFT073
uaagaugcgccaacaucaaugg

SEQ ID NO: 643745 - RNA, 15 nt, Escherichia coli CFT073
uaagaguuucaacau

SEQ ID NO: 643746 - RNA, 18 nt, Escherichia coli CFT073
uaagaucaucggccagau

SEQ ID NO: 643747 - RNA, 22 nt, Escherichia coli CFT073
uaagaucaucggccagauaaua

SEQ ID NO: 643748 - RNA, 22 nt, Escherichia coli CFT073
uaagauagacuguugaaauaca

SEQ ID NO: 643749 - RNA, 23 nt, Escherichia coli CFT073
uaagauagacuguugaaauacaa

SEQ ID NO: 643750 - RNA, 14 nt, Escherichia coli CFT073
uaagaggcauuuuu

SEQ ID NO: 643751 - RNA, 20 nt, Escherichia coli CFT073
uaagagauccaggccagaua

SEQ ID NO: 643752 - RNA, 16 nt, Escherichia coli CFT073
uaagagagcaacagca

SEQ ID NO: 643753 - RNA, 22 nt, Escherichia coli CFT073
uaagaccaauccagccggcaaa

SEQ ID NO: 643754 - RNA, 22 nt, Escherichia coli CFT073
uaagacgcagauuuuuauuaau

SEQ ID NO: 643755 - RNA, 18 nt, Escherichia coli CFT073
uaagacgcauccaccaga

SEQ ID NO: 643756 - RNA, 18 nt, Escherichia coli CFT073
uaagacgcgccagcaucg

SEQ ID NO: 643757 - RNA, 11 nt, Escherichia coli CFT073
uaagaauaaaa

SEQ ID NO: 643758 - RNA, 15 nt, Escherichia coli CFT073
uaagaauaauaagug

SEQ ID NO: 643759 - RNA, 20 nt, Escherichia coli CFT073
uaagaagucauuggccgagc

SEQ ID NO: 643760 - RNA, 14 nt, Escherichia coli CFT073
uaagaauuucucag

SEQ ID NO: 643761 - RNA, 17 nt, Escherichia coli CFT073
uaagaaugcgaaaacga

SEQ ID NO: 643762 - RNA, 19 nt, Escherichia coli CFT073
uaacuucaccgguucauca

SEQ ID NO: 643763 - RNA, 18 nt, Escherichia coli CFT073
uaacuuauggcguacuga

SEQ ID NO: 643764 - RNA, 15 nt, Escherichia coli CFT073
uaacuuaucaagaaa

SEQ ID NO: 643765 - RNA, 19 nt, Escherichia coli CFT073
uaacuguggcguuauggca

SEQ ID NO: 643766 - RNA, 21 nt, Escherichia coli CFT073
uaacuuuaauuuugugcagca

SEQ ID NO: 643767 - RNA, 20 nt, Escherichia coli CFT073
uaagaacuccugaaagcgaa

SEQ ID NO: 643768 - RNA, 14 nt, Escherichia coli CFT073
uaagaaccacagcc

SEQ ID NO: 643769 - RNA, 15 nt, Escherichia coli CFT073
uaagaaccacagccc

SEQ ID NO: 643770 - RNA, 12 nt, Escherichia coli CFT073
uaagaagcggcu

SEQ ID NO: 643771 - RNA, 21 nt, Escherichia coli CFT073
uaagaagguagguguuacaug

SEQ ID NO: 643772 - RNA, 17 nt, Escherichia coli CFT073
uaacuuugaagcccagu

SEQ ID NO: 643773 - RNA, 22 nt, Escherichia coli CFT073
uaacuaucaggucuuucugaaa

SEQ ID NO: 643774 - RNA, 23 nt, Escherichia coli CFT073
uaacuaucaggucuuucugaaau

SEQ ID NO: 643775 - RNA, 20 nt, Escherichia coli CFT073
uaacucaaaaauaaucaucu

SEQ ID NO: 643776 - RNA, 16 nt, Escherichia coli CFT073
uaacucgaauuauuca

SEQ ID NO: 643777 - RNA, 19 nt, Escherichia coli CFT073
uaacucgaauuauucagag

SEQ ID NO: 643778 - RNA, 21 nt, Escherichia coli CFT073
uaacuccugcgucggaacauc

SEQ ID NO: 643779 - RNA, 23 nt, Escherichia coli CFT073
uaacuccuucuaaagcaacucca

SEQ ID NO: 643780 - RNA, 17 nt, Escherichia coli CFT073
uaacucauugauuuuca

SEQ ID NO: 643781 - RNA, 17 nt, Escherichia coli CFT073
uaacucaugacaaccug

SEQ ID NO: 643782 - RNA, 19 nt, Escherichia coli CFT073
uaacucaggaugagaaaag

SEQ ID NO: 643783 - RNA, 20 nt, Escherichia coli CFT073
uaacugacaguagccuuuau

SEQ ID NO: 643784 - RNA, 12 nt, Escherichia coli CFT073
uaacugaauaau

SEQ ID NO: 643785 - RNA, 13 nt, Escherichia coli CFT073
uaacucuuccugc

SEQ ID NO: 643786 - RNA, 14 nt, Escherichia coli CFT073
uaacucucaugcuu

SEQ ID NO: 643787 - RNA, 14 nt, Escherichia coli CFT073
uaacucuuucaaug

SEQ ID NO: 643788 - RNA, 20 nt, Escherichia coli CFT073
uaacucuuucaaugcuuuuu

SEQ ID NO: 643789 - RNA, 18 nt, Escherichia coli CFT073
uaacucuuugggcagaaa

SEQ ID NO: 643790 - RNA, 23 nt, Escherichia coli CFT073
uaacucuuugggcagaaaaucca

SEQ ID NO: 643791 - RNA, 16 nt, Escherichia coli CFT073
uaacuggcaaaaacaa

SEQ ID NO: 643792 - RNA, 14 nt, Escherichia coli CFT073
uaacugcaugucag

SEQ ID NO: 643793 - RNA, 15 nt, Escherichia coli CFT073
uaacuggcaaucaug

SEQ ID NO: 643794 - RNA, 15 nt, Escherichia coli CFT073
uaacuggucaucaag

SEQ ID NO: 643795 - RNA, 19 nt, Escherichia coli CFT073
uaacgccagccacaaacca

SEQ ID NO: 643796 - RNA, 20 nt, Escherichia coli CFT073
uaacgccagccacaaaccau

SEQ ID NO: 643797 - RNA, 15 nt, Escherichia coli CFT073
uaacgcauaauaaag

SEQ ID NO: 643798 - RNA, 17 nt, Escherichia coli CFT073
uaaccucugacucacug

SEQ ID NO: 643799 - RNA, 14 nt, Escherichia coli CFT073
uaaccuguuccuua

SEQ ID NO: 643800 - RNA, 16 nt, Escherichia coli CFT073
uaaccuguuuucgauu

SEQ ID NO: 643801 - RNA, 19 nt, Escherichia coli CFT073
uaaccuuauggugucuaug

SEQ ID NO: 643802 - RNA, 20 nt, Escherichia coli CFT073
uaacccaccaccgcuaacug

SEQ ID NO: 643803 - RNA, 13 nt, Escherichia coli CFT073
uaacccacaccau

SEQ ID NO: 643804 - RNA, 17 nt, Escherichia coli CFT073
uaacccacaccauaaug

SEQ ID NO: 643805 - RNA, 18 nt, Escherichia coli CFT073
uaacccagcaccaacaaa

SEQ ID NO: 643806 - RNA, 13 nt, Escherichia coli CFT073
uaaccccagacca

SEQ ID NO: 643807 - RNA, 13 nt, Escherichia coli CFT073
uaacccccugccc

SEQ ID NO: 643808 - RNA, 14 nt, Escherichia coli CFT073
uaacccccugcccc

SEQ ID NO: 643809 - RNA, 21 nt, Escherichia coli CFT073
uaacccauccagcagagauac

SEQ ID NO: 643810 - RNA, 18 nt, Escherichia coli CFT073
uaacccauuuaaaaauca

SEQ ID NO: 643811 - RNA, 14 nt, Escherichia coli CFT073
uaacggccugacca

SEQ ID NO: 643812 - RNA, 18 nt, Escherichia coli CFT073
uaacgcgcugccagauca

SEQ ID NO: 643813 - RNA, 16 nt, Escherichia coli CFT073
uaacggcauuuuccag

SEQ ID NO: 643814 - RNA, 17 nt, Escherichia coli CFT073
uaacggcauuuuccagc

SEQ ID NO: 643815 - RNA, 22 nt, Escherichia coli CFT073
uaacggccaggcgcuuuuucuu

SEQ ID NO: 643816 - RNA, 16 nt, Escherichia coli CFT073
uaacggcucaccccca

SEQ ID NO: 643817 - RNA, 22 nt, Escherichia coli CFT073
uaacggcucacccccaucagca

SEQ ID NO: 643818 - RNA, 19 nt, Escherichia coli CFT073
uaacgcgggcuucuucuuu

SEQ ID NO: 643819 - RNA, 15 nt, Escherichia coli CFT073
uaacgccccacuccu

SEQ ID NO: 643820 - RNA, 17 nt, Escherichia coli CFT073
uaacgccccggcaaaac

SEQ ID NO: 643821 - RNA, 19 nt, Escherichia coli CFT073
uaacgccacgccaccagcg

SEQ ID NO: 643822 - RNA, 21 nt, Escherichia coli CFT073
uaacguaaggcgcaacauauu

SEQ ID NO: 643823 - RNA, 18 nt, Escherichia coli CFT073
uaacgguucggcaaucca

SEQ ID NO: 643824 - RNA, 16 nt, Escherichia coli CFT073
uaacgguuucaaccag

SEQ ID NO: 643825 - RNA, 19 nt, Escherichia coli CFT073
uaacguaaaaacccgcuuc

SEQ ID NO: 643826 - RNA, 17 nt, Escherichia coli CFT073
uaacgguaucuuuccag

SEQ ID NO: 643827 - RNA, 20 nt, Escherichia coli CFT073
uaacguuucuuucaucagau

SEQ ID NO: 643828 - RNA, 16 nt, Escherichia coli CFT073
uaacguuugccagcca

SEQ ID NO: 643829 - RNA, 18 nt, Escherichia coli CFT073
uaacuaaaugaaauauuu

SEQ ID NO: 643830 - RNA, 16 nt, Escherichia coli CFT073
uaacaauacgcccacg

SEQ ID NO: 643831 - RNA, 20 nt, Escherichia coli CFT073
uaacaauccgauaaucccuu

SEQ ID NO: 643832 - RNA, 13 nt, Escherichia coli CFT073
uaacaaucaccaa

SEQ ID NO: 643833 - RNA, 15 nt, Escherichia coli CFT073
uaacacuucugccgc

SEQ ID NO: 643834 - RNA, 20 nt, Escherichia coli CFT073
uaacacugagcgugagugcg

SEQ ID NO: 643835 - RNA, 19 nt, Escherichia coli CFT073
uaacacgcucuggcaggcu

SEQ ID NO: 643836 - RNA, 22 nt, Escherichia coli CFT073
uaacacgcucuggcaggcuuca

SEQ ID NO: 643837 - RNA, 20 nt, Escherichia coli CFT073
uaaaugccgcaaugugcucu

SEQ ID NO: 643838 - RNA, 19 nt, Escherichia coli CFT073
uaaaugccacugaauaaag

SEQ ID NO: 643839 - RNA, 15 nt, Escherichia coli CFT073
uaaaugucaucccuu

SEQ ID NO: 643840 - RNA, 12 nt, Escherichia coli CFT073
uaaccaaucacg

SEQ ID NO: 643841 - RNA, 19 nt, Escherichia coli CFT073
uaaccacaaacgauccugg

SEQ ID NO: 643842 - RNA, 19 nt, Escherichia coli CFT073
uaaccaccaguaaauuguu

SEQ ID NO: 643843 - RNA, 17 nt, Escherichia coli CFT073
uaaccaccagcacugau

SEQ ID NO: 643844 - RNA, 22 nt, Escherichia coli CFT073
uaaccagacgccccaguaaaca

SEQ ID NO: 643845 - RNA, 15 nt, Escherichia coli CFT073
uaaccagcaccagcu

SEQ ID NO: 643846 - RNA, 14 nt, Escherichia coli CFT073
uaaccagaaaccgu

SEQ ID NO: 643847 - RNA, 21 nt, Escherichia coli CFT073
uaacauccccauaucccggaa

SEQ ID NO: 643848 - RNA, 17 nt, Escherichia coli CFT073
uaacaucccuucaauua

SEQ ID NO: 643849 - RNA, 17 nt, Escherichia coli CFT073
uaacaucgcaaaauaca

SEQ ID NO: 643850 - RNA, 18 nt, Escherichia coli CFT073
uaacaucguccaugccuu

SEQ ID NO: 643851 - RNA, 15 nt, Escherichia coli CFT073
uaaccaacaucuuua

SEQ ID NO: 643852 - RNA, 21 nt, Escherichia coli CFT073
uaaccaacggcgagccagcgc

SEQ ID NO: 643853 - RNA, 20 nt, Escherichia coli CFT073
uaacagucuggcguuuucuu

SEQ ID NO: 643854 - RNA, 19 nt, Escherichia coli CFT073
uaacagugauugcuuuugu

SEQ ID NO: 643855 - RNA, 14 nt, Escherichia coli CFT073
uaacaguuccagca

SEQ ID NO: 643856 - RNA, 15 nt, Escherichia coli CFT073
uaacaguuccagcaa

SEQ ID NO: 643857 - RNA, 21 nt, Escherichia coli CFT073
uaacaguacgagcaucaucuu

SEQ ID NO: 643858 - RNA, 23 nt, Escherichia coli CFT073
uaacagaaugcgcgcgaaaacau

SEQ ID NO: 643859 - RNA, 16 nt, Escherichia coli CFT073
uaacacuuucgccugc

SEQ ID NO: 643860 - RNA, 17 nt, Escherichia coli CFT073
uaacagcguccacagcc

SEQ ID NO: 643861 - RNA, 15 nt, Escherichia coli CFT073
uaacauaacagccau

SEQ ID NO: 643862 - RNA, 22 nt, Escherichia coli CFT073
uaacauaccagguaugccaacu

SEQ ID NO: 643863 - RNA, 17 nt, Escherichia coli CFT073
uaaauaaccuuauuaug

SEQ ID NO: 643864 - RNA, 12 nt, Escherichia coli CFT073
uaaauaauaucc

SEQ ID NO: 643865 - RNA, 22 nt, Escherichia coli CFT073
uaaauaauauuuccccaauuca

SEQ ID NO: 643866 - RNA, 11 nt, Escherichia coli CFT073
uaaauacagag

SEQ ID NO: 643867 - RNA, 22 nt, Escherichia coli CFT073
uaaauaccguucauuaacgccc

SEQ ID NO: 643868 - RNA, 16 nt, Escherichia coli CFT073
uaaauacucauuaauu

SEQ ID NO: 643869 - RNA, 17 nt, Escherichia coli CFT073
uaaauacucauuaauuu

SEQ ID NO: 643870 - RNA, 18 nt, Escherichia coli CFT073
uaaauaguggcaaauucu

SEQ ID NO: 643871 - RNA, 22 nt, Escherichia coli CFT073
uaaagggaugcccccagauugu

SEQ ID NO: 643872 - RNA, 18 nt, Escherichia coli CFT073
uaaaguaucaaacagaaa

SEQ ID NO: 643873 - RNA, 14 nt, Escherichia coli CFT073
uaaagucuggaaga

SEQ ID NO: 643874 - RNA, 16 nt, Escherichia coli CFT073
uaaaguuaguaccgaa

SEQ ID NO: 643875 - RNA, 20 nt, Escherichia coli CFT073
uaaaguggcggggaucacuc

SEQ ID NO: 643876 - RNA, 13 nt, Escherichia coli CFT073
uaaagugaaauau

SEQ ID NO: 643877 - RNA, 17 nt, Escherichia coli CFT073
uaaagugaaauauuucu

SEQ ID NO: 643878 - RNA, 18 nt, Escherichia coli CFT073
uaaagugaaauauuucuu

SEQ ID NO: 643879 - RNA, 18 nt, Escherichia coli CFT073
uaaaucauuguuuucauu

SEQ ID NO: 643880 - RNA, 18 nt, Escherichia coli CFT073
uaaaucaugcuccuguaa

SEQ ID NO: 643881 - RNA, 23 nt, Escherichia coli CFT073
uaaaucaugcuccuguaauggcu

SEQ ID NO: 643882 - RNA, 11 nt, Escherichia coli CFT073
uaaaucagauc

SEQ ID NO: 643883 - RNA, 18 nt, Escherichia coli CFT073
uaaaucagccuuaaucuu

SEQ ID NO: 643884 - RNA, 12 nt, Escherichia coli CFT073
uaaauaguggca

SEQ ID NO: 643885 - RNA, 14 nt, Escherichia coli CFT073
uaaauauuauuggc

SEQ ID NO: 643886 - RNA, 15 nt, Escherichia coli CFT073
uaaauauuauuguuu

SEQ ID NO: 643887 - RNA, 15 nt, Escherichia coli CFT073
uaaauauucugccca

SEQ ID NO: 643888 - RNA, 16 nt, Escherichia coli CFT073
uaaauauuguuuuuau

SEQ ID NO: 643889 - RNA, 17 nt, Escherichia coli CFT073
uaaaucggggucugauu

SEQ ID NO: 643890 - RNA, 19 nt, Escherichia coli CFT073
uaaaucguucaauaggugu

SEQ ID NO: 643891 - RNA, 16 nt, Escherichia coli CFT073
uaaaugcaaauuucca

SEQ ID NO: 643892 - RNA, 21 nt, Escherichia coli CFT073
uaaaucgagaagacaaucccc

SEQ ID NO: 643893 - RNA, 15 nt, Escherichia coli CFT073
uaaacuguuuccagu

SEQ ID NO: 643894 - RNA, 19 nt, Escherichia coli CFT073
uaaagauacacagcccagu

SEQ ID NO: 643895 - RNA, 18 nt, Escherichia coli CFT073
uaaaggcaaacaggaucc

SEQ ID NO: 643896 - RNA, 17 nt, Escherichia coli CFT073
uaaaggauuuacuaaaa

SEQ ID NO: 643897 - RNA, 16 nt, Escherichia coli CFT073
uaaaggcaaaaugcca

SEQ ID NO: 643898 - RNA, 11 nt, Escherichia coli CFT073
uaaagcaauga

SEQ ID NO: 643899 - RNA, 13 nt, Escherichia coli CFT073
uaaagaucuuauu

SEQ ID NO: 643900 - RNA, 15 nt, Escherichia coli CFT073
uaaagauuguucuuu

SEQ ID NO: 643901 - RNA, 18 nt, Escherichia coli CFT073
uaaagauuguucuuuauc

SEQ ID NO: 643902 - RNA, 16 nt, Escherichia coli CFT073
uaaacaucgccauaaa

SEQ ID NO: 643903 - RNA, 23 nt, Escherichia coli CFT073
uaaacaggauaucugaaaguugu

SEQ ID NO: 643904 - RNA, 15 nt, Escherichia coli CFT073
uaaacaggcaguaau

SEQ ID NO: 643905 - RNA, 22 nt, Escherichia coli CFT073
uaaacagggggaggcaucuucc

SEQ ID NO: 643906 - RNA, 13 nt, Escherichia coli CFT073
uaaacagcacuga

SEQ ID NO: 643907 - RNA, 15 nt, Escherichia coli CFT073
uaaacagccccuccg

SEQ ID NO: 643908 - RNA, 17 nt, Escherichia coli CFT073
uaaacagccccuccgga

SEQ ID NO: 643909 - RNA, 14 nt, Escherichia coli CFT073
uaaaccaggaacag

SEQ ID NO: 643910 - RNA, 13 nt, Escherichia coli CFT073
uaaaccaggccaa

SEQ ID NO: 643911 - RNA, 22 nt, Escherichia coli CFT073
uaaacccuucacuguaggcaua

SEQ ID NO: 643912 - RNA, 18 nt, Escherichia coli CFT073
uaaacccuuucugcugcu

SEQ ID NO: 643913 - RNA, 19 nt, Escherichia coli CFT073
uaaacccuuucugcugcuu

SEQ ID NO: 643914 - RNA, 16 nt, Escherichia coli CFT073
uaaacccggcaucaug

SEQ ID NO: 643915 - RNA, 15 nt, Escherichia coli CFT073
uaaacccuaacauca

SEQ ID NO: 643916 - RNA, 19 nt, Escherichia coli CFT073
uaaacgcaguaaacgccag

SEQ ID NO: 643917 - RNA, 17 nt, Escherichia coli CFT073
uaaacgcauaucgcccu

SEQ ID NO: 643918 - RNA, 15 nt, Escherichia coli CFT073
uaaacgccuuaucag

SEQ ID NO: 643919 - RNA, 12 nt, Escherichia coli CFT073
uaaacgccaggu

SEQ ID NO: 643920 - RNA, 18 nt, Escherichia coli CFT073
uaaacgccgguuccugca

SEQ ID NO: 643921 - RNA, 22 nt, Escherichia coli CFT073
uaaacugaugugucccuuuacu

SEQ ID NO: 643922 - RNA, 13 nt, Escherichia coli CFT073
uaaacuggcugug

SEQ ID NO: 643923 - RNA, 12 nt, Escherichia coli CFT073
uaaacuccuuuc

SEQ ID NO: 643924 - RNA, 23 nt, Escherichia coli CFT073
uaaaaauaaacaacaaaauaccg

SEQ ID NO: 643925 - RNA, 22 nt, Escherichia coli CFT073
uaaaaaguuguuaauaaguuuu

SEQ ID NO: 643926 - RNA, 19 nt, Escherichia coli CFT073
uaaaaagcagguuguuaag

SEQ ID NO: 643927 - RNA, 21 nt, Escherichia coli CFT073
guuugaugcgcgagguaacaa

SEQ ID NO: 643928 - RNA, 15 nt, Escherichia coli CFT073
guuugcaaacccaca

SEQ ID NO: 643929 - RNA, 23 nt, Escherichia coli CFT073
uaaaaagaaugacccauuuguua

SEQ ID NO: 643930 - RNA, 21 nt, Escherichia coli CFT073
uaaaaacucaucgucaaaauu

SEQ ID NO: 643931 - RNA, 18 nt, Escherichia coli CFT073
uaaaaacgcuuugcugcc

SEQ ID NO: 643932 - RNA, 14 nt, Escherichia coli CFT073
uaaaaauuucuccc

SEQ ID NO: 643933 - RNA, 13 nt, Escherichia coli CFT073
uaaaaccaccgac

SEQ ID NO: 643934 - RNA, 12 nt, Escherichia coli CFT073
uaaaaccaaugg

SEQ ID NO: 643935 - RNA, 16 nt, Escherichia coli CFT073
uaaaaccaauucacau

SEQ ID NO: 643936 - RNA, 12 nt, Escherichia coli CFT073
uaaaagauaaac

SEQ ID NO: 643937 - RNA, 18 nt, Escherichia coli CFT073
uaaaacgccgcuggugau

SEQ ID NO: 643938 - RNA, 18 nt, Escherichia coli CFT073
uaaaacgguggccacagc

SEQ ID NO: 643939 - RNA, 19 nt, Escherichia coli CFT073
uaaaacgguggccacagca

SEQ ID NO: 643940 - RNA, 11 nt, Escherichia coli CFT073
uaaaaccauua

SEQ ID NO: 643941 - RNA, 20 nt, Escherichia coli CFT073
uaaaaccccgcguacugaau

SEQ ID NO: 643942 - RNA, 16 nt, Escherichia coli CFT073
uaaaaccgacuuaaaa

SEQ ID NO: 643943 - RNA, 19 nt, Escherichia coli CFT073
uaaaaccggcggcaaugga

SEQ ID NO: 643944 - RNA, 13 nt, Escherichia coli CFT073
uaaaacugccaga

SEQ ID NO: 643945 - RNA, 22 nt, Escherichia coli CFT073
uaaaauuauccaacuuuuccca

SEQ ID NO: 643946 - RNA, 18 nt, Escherichia coli CFT073
uaaaauugauaaccaaua

SEQ ID NO: 643947 - RNA, 20 nt, Escherichia coli CFT073
uaaaauugauaaccaauagu

SEQ ID NO: 643948 - RNA, 21 nt, Escherichia coli CFT073
uaaaauuucuuuuuuucauug

SEQ ID NO: 643949 - RNA, 13 nt, Escherichia coli CFT073
uaaaauuuagcaa

SEQ ID NO: 643950 - RNA, 24 nt, Escherichia coli CFT073
uaaacagaauacccagcaaugcca

SEQ ID NO: 643951 - RNA, 16 nt, Escherichia coli CFT073
uaaacacaccacagca

SEQ ID NO: 643952 - RNA, 19 nt, Escherichia coli CFT073
uaaacaauugcauaucaau

SEQ ID NO: 643953 - RNA, 15 nt, Escherichia coli CFT073
uaaacaccaccgaaa

SEQ ID NO: 643954 - RNA, 15 nt, Escherichia coli CFT073
uaaacaccagcagca

SEQ ID NO: 643955 - RNA, 14 nt, Escherichia coli CFT073
uaaacaccagcaau

SEQ ID NO: 643956 - RNA, 18 nt, Escherichia coli CFT073
uaaacaccagcaauaaug

SEQ ID NO: 643957 - RNA, 18 nt, Escherichia coli CFT073
uaaacaccuucguccagc

SEQ ID NO: 643958 - RNA, 15 nt, Escherichia coli CFT073
uaaacaacaaaauac

SEQ ID NO: 643959 - RNA, 18 nt, Escherichia coli CFT073
uaaacaagacaucacuca

SEQ ID NO: 643960 - RNA, 12 nt, Escherichia coli CFT073
uaaaauaucuuc

SEQ ID NO: 643961 - RNA, 13 nt, Escherichia coli CFT073
uaaaauaucuucu

SEQ ID NO: 643962 - RNA, 21 nt, Escherichia coli CFT073
uaaaauaucuucuacuucacg

SEQ ID NO: 643963 - RNA, 14 nt, Escherichia coli CFT073
uaaaauaucacucg

SEQ ID NO: 643964 - RNA, 20 nt, Escherichia coli CFT073
uaaaauaaccgucuuugcug

SEQ ID NO: 643965 - RNA, 15 nt, Escherichia coli CFT073
uaaaauaaucaccag

SEQ ID NO: 643966 - RNA, 19 nt, Escherichia coli CFT073
uaaaauaaucaccagagga

SEQ ID NO: 643967 - RNA, 20 nt, Escherichia coli CFT073
uaaaauaagcacaaagcaau

SEQ ID NO: 643968 - RNA, 15 nt, Escherichia coli CFT073
uaaaagggcagcagg

SEQ ID NO: 643969 - RNA, 17 nt, Escherichia coli CFT073
uaaaagggcagcaggau

SEQ ID NO: 643970 - RNA, 18 nt, Escherichia coli CFT073
uaaaaugucaccuaauuu

SEQ ID NO: 643971 - RNA, 14 nt, Escherichia coli CFT073
uaaaauguguacuu

SEQ ID NO: 643972 - RNA, 14 nt, Escherichia coli CFT073
uaaaaugcgaaaaa

SEQ ID NO: 643973 - RNA, 23 nt, Escherichia coli CFT073
uaaaaucuauuauuauuuuugug

SEQ ID NO: 643974 - RNA, 23 nt, Escherichia coli CFT073
uaaaaucuaaugcuccuuuaauc

SEQ ID NO: 643975 - RNA, 18 nt, Escherichia coli CFT073
uaaaaucgacaucugcaa

SEQ ID NO: 643976 - RNA, 15 nt, Escherichia coli CFT073
uaaaaucgccaaacu

SEQ ID NO: 643977 - RNA, 19 nt, Escherichia coli CFT073
uaaaaucgcccacucugua

SEQ ID NO: 643978 - RNA, 17 nt, Escherichia coli CFT073
guuguuuaacgguggug

SEQ ID NO: 643979 - RNA, 17 nt, Escherichia coli CFT073
guuguugauaagcccca

SEQ ID NO: 643980 - RNA, 13 nt, Escherichia coli CFT073
guuguugcaugaa

SEQ ID NO: 643981 - RNA, 20 nt, Escherichia coli CFT073
guuguugaacggcaaacgca

SEQ ID NO: 643982 - RNA, 18 nt, Escherichia coli CFT073
guuguaugucauaaaaau

SEQ ID NO: 643983 - RNA, 21 nt, Escherichia coli CFT073
guuguucugcgacgcgcggug

SEQ ID NO: 643984 - RNA, 18 nt, Escherichia coli CFT073
guuguaaucugcaccagg

SEQ ID NO: 643985 - RNA, 22 nt, Escherichia coli CFT073
guuguagccacgucugccacgg

SEQ ID NO: 643986 - RNA, 15 nt, Escherichia coli CFT073
guuuagccaaaaauc

SEQ ID NO: 643987 - RNA, 19 nt, Escherichia coli CFT073
guuuagccgcuucugcagc

SEQ ID NO: 643988 - RNA, 14 nt, Escherichia coli CFT073
guuuacgaaccuuc

SEQ ID NO: 643989 - RNA, 14 nt, Escherichia coli CFT073
guuuaucaaucuca

SEQ ID NO: 643990 - RNA, 14 nt, Escherichia coli CFT073
guuuaccggugcca

SEQ ID NO: 643991 - RNA, 19 nt, Escherichia coli CFT073
guuuacauggcagaccaaa

SEQ ID NO: 643992 - RNA, 22 nt, Escherichia coli CFT073
guuuaccaacgccgggaugaac

SEQ ID NO: 643993 - RNA, 13 nt, Escherichia coli CFT073
guuuaccacggcu

SEQ ID NO: 643994 - RNA, 12 nt, Escherichia coli CFT073
guuuaccagcag

SEQ ID NO: 643995 - RNA, 20 nt, Escherichia coli CFT073
guuuaaaugccggaaugcug

SEQ ID NO: 643996 - RNA, 14 nt, Escherichia coli CFT073
guuuaaccaacaca

SEQ ID NO: 643997 - RNA, 19 nt, Escherichia coli CFT073
guuuaaccgggagauuuuc

SEQ ID NO: 643998 - RNA, 20 nt, Escherichia coli CFT073
guuuaaccgggagauuuucu

SEQ ID NO: 643999 - RNA, 21 nt, Escherichia coli CFT073
guuugaaaugauuacucccuu

SEQ ID NO: 644000 - RNA, 12 nt, Escherichia coli CFT073
guuucucuucug

SEQ ID NO: 644001 - RNA, 21 nt, Escherichia coli CFT073
guuugacuuauaagucucaga

SEQ ID NO: 644002 - RNA, 15 nt, Escherichia coli CFT073
guuucgauuaacuaa

SEQ ID NO: 644003 - RNA, 17 nt, Escherichia coli CFT073
guuucgcauccagagau

SEQ ID NO: 644004 - RNA, 15 nt, Escherichia coli CFT073
guuucgccauaaaac

SEQ ID NO: 644005 - RNA, 20 nt, Escherichia coli CFT073
guuucgcccguucuuccuca

SEQ ID NO: 644006 - RNA, 13 nt, Escherichia coli CFT073
guuucgccugcca

SEQ ID NO: 644007 - RNA, 18 nt, Escherichia coli CFT073
guuucucgacuuuuucca

SEQ ID NO: 644008 - RNA, 20 nt, Escherichia coli CFT073
guuucucuuaaaugcacaau

SEQ ID NO: 644009 - RNA, 14 nt, Escherichia coli CFT073
guuuccauaaccgc

SEQ ID NO: 644010 - RNA, 14 nt, Escherichia coli CFT073
guuuccauccggca

SEQ ID NO: 644011 - RNA, 19 nt, Escherichia coli CFT073
guuuaucuuccagcauuuc

SEQ ID NO: 644012 - RNA, 15 nt, Escherichia coli CFT073
guuucccugauaaug

SEQ ID NO: 644013 - RNA, 14 nt, Escherichia coli CFT073
guuuccccugguuc

SEQ ID NO: 644014 - RNA, 23 nt, Escherichia coli CFT073
guuucgauauaaccauggcuggc

SEQ ID NO: 644015 - RNA, 16 nt, Escherichia coli CFT073
guuucgacaauaauca

SEQ ID NO: 644016 - RNA, 18 nt, Escherichia coli CFT073
guuuccuuccagaaacau

SEQ ID NO: 644017 - RNA, 20 nt, Escherichia coli CFT073
guuggcgcguguuccagaga

SEQ ID NO: 644018 - RNA, 20 nt, Escherichia coli CFT073
guuggucugcagacugaagc

SEQ ID NO: 644019 - RNA, 13 nt, Escherichia coli CFT073
guuggucaucauc

SEQ ID NO: 644020 - RNA, 22 nt, Escherichia coli CFT073
guuggguugccagcgacagaaa

SEQ ID NO: 644021 - RNA, 20 nt, Escherichia coli CFT073
guugguagagcacgaccuug

SEQ ID NO: 644022 - RNA, 21 nt, Escherichia coli CFT073
guugguagagcacgaccuugc

SEQ ID NO: 644023 - RNA, 19 nt, Escherichia coli CFT073
guuggacggucuaccaguu

SEQ ID NO: 644024 - RNA, 14 nt, Escherichia coli CFT073
guuggccaaaguuc

SEQ ID NO: 644025 - RNA, 15 nt, Escherichia coli CFT073
guuggcagcggcaag

SEQ ID NO: 644026 - RNA, 19 nt, Escherichia coli CFT073
guugcugucgcgcagcacu

SEQ ID NO: 644027 - RNA, 19 nt, Escherichia coli CFT073
guugcuguuguuccagcuu

SEQ ID NO: 644028 - RNA, 12 nt, Escherichia coli CFT073
guugccgcccgu

SEQ ID NO: 644029 - RNA, 18 nt, Escherichia coli CFT073
guugccguccagcgccug

SEQ ID NO: 644030 - RNA, 13 nt, Escherichia coli CFT073
guugccagcagca

SEQ ID NO: 644031 - RNA, 17 nt, Escherichia coli CFT073
guugccagcagcaacca

SEQ ID NO: 644032 - RNA, 13 nt, Escherichia coli CFT073
guugccagcgaca

SEQ ID NO: 644033 - RNA, 23 nt, Escherichia coli CFT073
guugcccgcagauccagugcuca

SEQ ID NO: 644034 - RNA, 19 nt, Escherichia coli CFT073
guugcgaacuucaggcagg

SEQ ID NO: 644035 - RNA, 14 nt, Escherichia coli CFT073
guugcgcccaucau

SEQ ID NO: 644036 - RNA, 18 nt, Escherichia coli CFT073
guugcgcugguggcaggc

SEQ ID NO: 644037 - RNA, 20 nt, Escherichia coli CFT073
guugcgcuucccgaaucaug

SEQ ID NO: 644038 - RNA, 21 nt, Escherichia coli CFT073
guugcggacugcccgaggcga

SEQ ID NO: 644039 - RNA, 14 nt, Escherichia coli CFT073
guugcggauuaaau

SEQ ID NO: 644040 - RNA, 18 nt, Escherichia coli CFT073
guugcggcugcccaucau

SEQ ID NO: 644041 - RNA, 18 nt, Escherichia coli CFT073
guugcguaacugaucgua

SEQ ID NO: 644042 - RNA, 14 nt, Escherichia coli CFT073
guugcgugccuaau

SEQ ID NO: 644043 - RNA, 19 nt, Escherichia coli CFT073
guugcguuuuuaucuucac

SEQ ID NO: 644044 - RNA, 17 nt, Escherichia coli CFT073
guugcgguuucucccgu

SEQ ID NO: 644045 - RNA, 16 nt, Escherichia coli CFT073
guugauuggcgcaggu

SEQ ID NO: 644046 - RNA, 13 nt, Escherichia coli CFT073
guugauuuuaaag

SEQ ID NO: 644047 - RNA, 19 nt, Escherichia coli CFT073
guugaucuucucgucaauc

SEQ ID NO: 644048 - RNA, 14 nt, Escherichia coli CFT073
guugaucuucucuu

SEQ ID NO: 644049 - RNA, 13 nt, Escherichia coli CFT073
guugaugcucagc

SEQ ID NO: 644050 - RNA, 14 nt, Escherichia coli CFT073
guugaugguaaaau

SEQ ID NO: 644051 - RNA, 15 nt, Escherichia coli CFT073
guugcagacccgcca

SEQ ID NO: 644052 - RNA, 16 nt, Escherichia coli CFT073
guugcagcucugccau

SEQ ID NO: 644053 - RNA, 14 nt, Escherichia coli CFT073
guugcauaaagcuc

SEQ ID NO: 644054 - RNA, 16 nt, Escherichia coli CFT073
guugcacuauugcgug

SEQ ID NO: 644055 - RNA, 13 nt, Escherichia coli CFT073
guugcaccagcaa

SEQ ID NO: 644056 - RNA, 16 nt, Escherichia coli CFT073
guugcaaauauuccau

SEQ ID NO: 644057 - RNA, 14 nt, Escherichia coli CFT073
guugagagcaaaca

SEQ ID NO: 644058 - RNA, 18 nt, Escherichia coli CFT073
guugaggaacuuccagcc

SEQ ID NO: 644059 - RNA, 11 nt, Escherichia coli CFT073
guugaggaagc

SEQ ID NO: 644060 - RNA, 21 nt, Escherichia coli CFT073
guugagcgccguucaaugacg

SEQ ID NO: 644061 - RNA, 22 nt, Escherichia coli CFT073
guugaggcgaucgucgccgugc

SEQ ID NO: 644062 - RNA, 20 nt, Escherichia coli CFT073
guugaguagaccagacgacu

SEQ ID NO: 644063 - RNA, 19 nt, Escherichia coli CFT073
guugaguccgguagcgagg

SEQ ID NO: 644064 - RNA, 16 nt, Escherichia coli CFT073
guugauacaggaacag

SEQ ID NO: 644065 - RNA, 17 nt, Escherichia coli CFT073
guugauccaugccgcca

SEQ ID NO: 644066 - RNA, 13 nt, Escherichia coli CFT073
guugaucccugca

SEQ ID NO: 644067 - RNA, 18 nt, Escherichia coli CFT073
guugaauuccgaauuuca

SEQ ID NO: 644068 - RNA, 23 nt, Escherichia coli CFT073
guugaccauaucaucaauaugaa

SEQ ID NO: 644069 - RNA, 14 nt, Escherichia coli CFT073
guugacaaaaauac

SEQ ID NO: 644070 - RNA, 12 nt, Escherichia coli CFT073
guugaaauaaac

SEQ ID NO: 644071 - RNA, 16 nt, Escherichia coli CFT073
guugaaauaaaccagu

SEQ ID NO: 644072 - RNA, 19 nt, Escherichia coli CFT073
guugaacgguuuggugaug

SEQ ID NO: 644073 - RNA, 17 nt, Escherichia coli CFT073
guucguugaucacuuuc

SEQ ID NO: 644074 - RNA, 21 nt, Escherichia coli CFT073
guucguugaucacuuucaccg

SEQ ID NO: 644075 - RNA, 16 nt, Escherichia coli CFT073
guucuucgcugacagu

SEQ ID NO: 644076 - RNA, 13 nt, Escherichia coli CFT073
guucuuuccugcg

SEQ ID NO: 644077 - RNA, 14 nt, Escherichia coli CFT073
guucuuuagcaguu

SEQ ID NO: 644078 - RNA, 20 nt, Escherichia coli CFT073
guucuuuaucacgaccguca

SEQ ID NO: 644079 - RNA, 21 nt, Escherichia coli CFT073
guucuuucaacacaugcacau

SEQ ID NO: 644080 - RNA, 23 nt, Escherichia coli CFT073
guucuucuucugcaaucaacacu

SEQ ID NO: 644081 - RNA, 17 nt, Escherichia coli CFT073
guucuucuguuaaauca

SEQ ID NO: 644082 - RNA, 18 nt, Escherichia coli CFT073
guucagucguauccucag

SEQ ID NO: 644083 - RNA, 16 nt, Escherichia coli CFT073
guucagucacuucaaa

SEQ ID NO: 644084 - RNA, 14 nt, Escherichia coli CFT073
guucagugaucgcc

SEQ ID NO: 644085 - RNA, 16 nt, Escherichia coli CFT073
guucagugauggcaca

SEQ ID NO: 644086 - RNA, 20 nt, Escherichia coli CFT073
guucagugauggcacaccau

SEQ ID NO: 644087 - RNA, 21 nt, Escherichia coli CFT073
guucaggauauuuauauuuug

SEQ ID NO: 644088 - RNA, 14 nt, Escherichia coli CFT073
guucagcggcugac

SEQ ID NO: 644089 - RNA, 18 nt, Escherichia coli CFT073
guucagcgggcagggcau

SEQ ID NO: 644090 - RNA, 16 nt, Escherichia coli CFT073
guucaggcguuucuuc

SEQ ID NO: 644091 - RNA, 19 nt, Escherichia coli CFT073
guucaggcguuucuucacc

SEQ ID NO: 644092 - RNA, 18 nt, Escherichia coli CFT073
guucaguacgaaauaacu

SEQ ID NO: 644093 - RNA, 21 nt, Escherichia coli CFT073
guucauuaaugccguuauaca

SEQ ID NO: 644094 - RNA, 20 nt, Escherichia coli CFT073
guucauuggguucaucugau

SEQ ID NO: 644095 - RNA, 17 nt, Escherichia coli CFT073
guucauuggguucaucu

SEQ ID NO: 644096 - RNA, 22 nt, Escherichia coli CFT073
guucaucacgaaaaucaucugc

SEQ ID NO: 644097 - RNA, 18 nt, Escherichia coli CFT073
guucaugcugcggcuguc

SEQ ID NO: 644098 - RNA, 23 nt, Escherichia coli CFT073
guuagcauggcugaaaucgauca

SEQ ID NO: 644099 - RNA, 20 nt, Escherichia coli CFT073
guuagcaaacgacacaugcu

SEQ ID NO: 644100 - RNA, 14 nt, Escherichia coli CFT073
guuagaaaacgccu

SEQ ID NO: 644101 - RNA, 13 nt, Escherichia coli CFT073
guuagaaagcugc

SEQ ID NO: 644102 - RNA, 16 nt, Escherichia coli CFT073
guuagaaagcugcugc

SEQ ID NO: 644103 - RNA, 21 nt, Escherichia coli CFT073
guucagacgcucuuucaccag

SEQ ID NO: 644104 - RNA, 13 nt, Escherichia coli CFT073
guucagacgcugc

SEQ ID NO: 644105 - RNA, 12 nt, Escherichia coli CFT073
guucagauaaau

SEQ ID NO: 644106 - RNA, 15 nt, Escherichia coli CFT073
guucagauacaccau

SEQ ID NO: 644107 - RNA, 19 nt, Escherichia coli CFT073
guucacugccguacaggca

SEQ ID NO: 644108 - RNA, 19 nt, Escherichia coli CFT073
guucagcacguuaaguuca

SEQ ID NO: 644109 - RNA, 22 nt, Escherichia coli CFT073
guucagcaguucugccaggcug

SEQ ID NO: 644110 - RNA, 19 nt, Escherichia coli CFT073
guucagccgcuuuaucuga

SEQ ID NO: 644111 - RNA, 21 nt, Escherichia coli CFT073
guucggacauguuuuccagca

SEQ ID NO: 644112 - RNA, 18 nt, Escherichia coli CFT073
guucggaccaaugcccaa

SEQ ID NO: 644113 - RNA, 13 nt, Escherichia coli CFT073
guucgcuuugaau

SEQ ID NO: 644114 - RNA, 16 nt, Escherichia coli CFT073
guucgcuuugaaugug

SEQ ID NO: 644115 - RNA, 18 nt, Escherichia coli CFT073
guucgcuuuuauuucugc

SEQ ID NO: 644116 - RNA, 17 nt, Escherichia coli CFT073
guucgccgggauuucaa

SEQ ID NO: 644117 - RNA, 15 nt, Escherichia coli CFT073
guuccugaugaaaaa

SEQ ID NO: 644118 - RNA, 18 nt, Escherichia coli CFT073
guuccugaugaaaaaucu

SEQ ID NO: 644119 - RNA, 20 nt, Escherichia coli CFT073
guucgccagucuccaggcag

SEQ ID NO: 644120 - RNA, 21 nt, Escherichia coli CFT073
guucccgcggcgcagcuccag

SEQ ID NO: 644121 - RNA, 13 nt, Escherichia coli CFT073
guuccccucaccc

SEQ ID NO: 644122 - RNA, 13 nt, Escherichia coli CFT073
guuccccaucacc

SEQ ID NO: 644123 - RNA, 20 nt, Escherichia coli CFT073
guuccccccacaaucagcca

SEQ ID NO: 644124 - RNA, 13 nt, Escherichia coli CFT073
guuccaauaaauc

SEQ ID NO: 644125 - RNA, 21 nt, Escherichia coli CFT073
guuccaacgccaccacucaaa

SEQ ID NO: 644126 - RNA, 18 nt, Escherichia coli CFT073
guuccaccgcguuuucca

SEQ ID NO: 644127 - RNA, 22 nt, Escherichia coli CFT073
guuccaccgcguuuuccaguuc

SEQ ID NO: 644128 - RNA, 23 nt, Escherichia coli CFT073
guuacucugcaagucuugcugcg

SEQ ID NO: 644129 - RNA, 16 nt, Escherichia coli CFT073
guuacugccaucuucc

SEQ ID NO: 644130 - RNA, 21 nt, Escherichia coli CFT073
guuacugcccgcacaccucac

SEQ ID NO: 644131 - RNA, 23 nt, Escherichia coli CFT073
guuacucccggauaaaucuccau

SEQ ID NO: 644132 - RNA, 19 nt, Escherichia coli CFT073
guuacgccgcacccggcac

SEQ ID NO: 644133 - RNA, 21 nt, Escherichia coli CFT073
guuacgccgggcgacuggccg

SEQ ID NO: 644134 - RNA, 17 nt, Escherichia coli CFT073
guuacggaucuggaaca

SEQ ID NO: 644135 - RNA, 23 nt, Escherichia coli CFT073
guuacguccauguagcucaucug

SEQ ID NO: 644136 - RNA, 18 nt, Escherichia coli CFT073
guuacuauccugaaagcu

SEQ ID NO: 644137 - RNA, 12 nt, Escherichia coli CFT073
guuacuaaaagu

SEQ ID NO: 644138 - RNA, 16 nt, Escherichia coli CFT073
guuacuaaaaguaaau

SEQ ID NO: 644139 - RNA, 17 nt, Escherichia coli CFT073
guuacgcaagccaggua

SEQ ID NO: 644140 - RNA, 18 nt, Escherichia coli CFT073
guuacgaagcagcaucag

SEQ ID NO: 644141 - RNA, 21 nt, Escherichia coli CFT073
guuacgauaaucaggaaugug

SEQ ID NO: 644142 - RNA, 14 nt, Escherichia coli CFT073
guuacgaaaaggau

SEQ ID NO: 644143 - RNA, 16 nt, Escherichia coli CFT073
guuacaaccuccuccg

SEQ ID NO: 644144 - RNA, 17 nt, Escherichia coli CFT073
guuaauuuccucuuccc

SEQ ID NO: 644145 - RNA, 22 nt, Escherichia coli CFT073
guuaauaagagauccaggccag

SEQ ID NO: 644146 - RNA, 23 nt, Escherichia coli CFT073
guuaauacuacgcagacggcuuu

SEQ ID NO: 644147 - RNA, 17 nt, Escherichia coli CFT073
guuaaggccaaacacca

SEQ ID NO: 644148 - RNA, 23 nt, Escherichia coli CFT073
guuaauaaagugcgcuuugugug

SEQ ID NO: 644149 - RNA, 17 nt, Escherichia coli CFT073
guuaaagcccugcucgc

SEQ ID NO: 644150 - RNA, 19 nt, Escherichia coli CFT073
guuaaaggugucaauaaua

SEQ ID NO: 644151 - RNA, 21 nt, Escherichia coli CFT073
guguuuaucuuccagcauuuc

SEQ ID NO: 644152 - RNA, 11 nt, Escherichia coli CFT073
guguucuuccg

SEQ ID NO: 644153 - RNA, 17 nt, Escherichia coli CFT073
guguucuuccggccagu

SEQ ID NO: 644154 - RNA, 21 nt, Escherichia coli CFT073
guguaauccugccagugcaaa

SEQ ID NO: 644155 - RNA, 18 nt, Escherichia coli CFT073
guguaauacguuuuauca

SEQ ID NO: 644156 - RNA, 12 nt, Escherichia coli CFT073
guguaaucagcc

SEQ ID NO: 644157 - RNA, 18 nt, Escherichia coli CFT073
gugugauccacugcagaa

SEQ ID NO: 644158 - RNA, 16 nt, Escherichia coli CFT073
gugucuggaucuucuu

SEQ ID NO: 644159 - RNA, 22 nt, Escherichia coli CFT073
gugucuggcgaauuuauaaaac

SEQ ID NO: 644160 - RNA, 19 nt, Escherichia coli CFT073
gugugaaacaguaaguuca

SEQ ID NO: 644161 - RNA, 16 nt, Escherichia coli CFT073
gugugggucuaaaaac

SEQ ID NO: 644162 - RNA, 17 nt, Escherichia coli CFT073
guguguuccucugcucc

SEQ ID NO: 644163 - RNA, 21 nt, Escherichia coli CFT073
gugugguuauugggugacugg

SEQ ID NO: 644164 - RNA, 18 nt, Escherichia coli CFT073
guggugccgauaucgaua

SEQ ID NO: 644165 - RNA, 21 nt, Escherichia coli CFT073
guggugcgcaccaggcgugga

SEQ ID NO: 644166 - RNA, 13 nt, Escherichia coli CFT073
gugguaucgccac

SEQ ID NO: 644167 - RNA, 21 nt, Escherichia coli CFT073
gugguuaccgaauccagcaag

SEQ ID NO: 644168 - RNA, 16 nt, Escherichia coli CFT073
gugguugcggacugcc

SEQ ID NO: 644169 - RNA, 17 nt, Escherichia coli CFT073
gugguuuucucuuguuc

SEQ ID NO: 644170 - RNA, 12 nt, Escherichia coli CFT073
gugguuucuccc

SEQ ID NO: 644171 - RNA, 21 nt, Escherichia coli CFT073
gugguuccauucaaggacaaa

SEQ ID NO: 644172 - RNA, 13 nt, Escherichia coli CFT073
gugguagcggcuc

SEQ ID NO: 644173 - RNA, 18 nt, Escherichia coli CFT073
gugguauugcagcucugu

SEQ ID NO: 644174 - RNA, 15 nt, Escherichia coli CFT073
guggcugcguuucau

SEQ ID NO: 644175 - RNA, 13 nt, Escherichia coli CFT073
guggcugagugau

SEQ ID NO: 644176 - RNA, 16 nt, Escherichia coli CFT073
guggggaaugauauuu

SEQ ID NO: 644177 - RNA, 18 nt, Escherichia coli CFT073
guggauuuuuguuucaca

SEQ ID NO: 644178 - RNA, 22 nt, Escherichia coli CFT073
guggauuuuuguuucacacuga

SEQ ID NO: 644179 - RNA, 15 nt, Escherichia coli CFT073
guggcaaaauccaac

SEQ ID NO: 644180 - RNA, 19 nt, Escherichia coli CFT073
guggcaaaguuggcgcuga

SEQ ID NO: 644181 - RNA, 17 nt, Escherichia coli CFT073
guggcaauagagacaaa

SEQ ID NO: 644182 - RNA, 22 nt, Escherichia coli CFT073
guggcaagaccugccgggcuga

SEQ ID NO: 644183 - RNA, 23 nt, Escherichia coli CFT073
gugcuguccagaucgggccuggc

SEQ ID NO: 644184 - RNA, 14 nt, Escherichia coli CFT073
gugcuguacagcag

SEQ ID NO: 644185 - RNA, 15 nt, Escherichia coli CFT073
guggaucgauuucaa

SEQ ID NO: 644186 - RNA, 21 nt, Escherichia coli CFT073
guggcgauaaucagcgccagc

SEQ ID NO: 644187 - RNA, 22 nt, Escherichia coli CFT073
guggcgaauuaacaccaccagc

SEQ ID NO: 644188 - RNA, 22 nt, Escherichia coli CFT073
guggccauaaccaugcagcgcc

SEQ ID NO: 644189 - RNA, 14 nt, Escherichia coli CFT073
guggccaugaccac

SEQ ID NO: 644190 - RNA, 19 nt, Escherichia coli CFT073
guggcccgauggugaugcc

SEQ ID NO: 644191 - RNA, 18 nt, Escherichia coli CFT073
guggcccgccagcaugcc

SEQ ID NO: 644192 - RNA, 22 nt, Escherichia coli CFT073
guggcgcauccguuauagggaa

SEQ ID NO: 644193 - RNA, 22 nt, Escherichia coli CFT073
gugccuuuaauaccaucggcag

SEQ ID NO: 644194 - RNA, 19 nt, Escherichia coli CFT073
gugccuuuuuuauuuaugc

SEQ ID NO: 644195 - RNA, 14 nt, Escherichia coli CFT073
gugcgaaaaucaau

SEQ ID NO: 644196 - RNA, 15 nt, Escherichia coli CFT073
gugcgagagcggagg

SEQ ID NO: 644197 - RNA, 20 nt, Escherichia coli CFT073
gugccgcgcauagcaccacc

SEQ ID NO: 644198 - RNA, 17 nt, Escherichia coli CFT073
gugccgcgaucccagac

SEQ ID NO: 644199 - RNA, 20 nt, Escherichia coli CFT073
gugccgcguuuugacagcuc

SEQ ID NO: 644200 - RNA, 19 nt, Escherichia coli CFT073
gugccgccgucagacgcgc

SEQ ID NO: 644201 - RNA, 22 nt, Escherichia coli CFT073
gugccgcgauaccacccgcagu

SEQ ID NO: 644202 - RNA, 15 nt, Escherichia coli CFT073
gugccgccgcccggc

SEQ ID NO: 644203 - RNA, 21 nt, Escherichia coli CFT073
gugcgcgauagauagcguucu

SEQ ID NO: 644204 - RNA, 23 nt, Escherichia coli CFT073
gugcgcgauagauagcguucuuu

SEQ ID NO: 644205 - RNA, 19 nt, Escherichia coli CFT073
gugcggcucucuuucucca

SEQ ID NO: 644206 - RNA, 14 nt, Escherichia coli CFT073
gugcggcgcaccag

SEQ ID NO: 644207 - RNA, 16 nt, Escherichia coli CFT073
gugcgguaucaccacc

SEQ ID NO: 644208 - RNA, 15 nt, Escherichia coli CFT073
gugcggucaggcauc

SEQ ID NO: 644209 - RNA, 15 nt, Escherichia coli CFT073
gugcgggcacaggcg

SEQ ID NO: 644210 - RNA, 19 nt, Escherichia coli CFT073
gugcgguuucagcucacgg

SEQ ID NO: 644211 - RNA, 17 nt, Escherichia coli CFT073
gugcuaagccccugagc

SEQ ID NO: 644212 - RNA, 15 nt, Escherichia coli CFT073
gugcguugcagcaaa

SEQ ID NO: 644213 - RNA, 15 nt, Escherichia coli CFT073
gugcguugucaucga

SEQ ID NO: 644214 - RNA, 18 nt, Escherichia coli CFT073
gugcucaauuaccacaau

SEQ ID NO: 644215 - RNA, 18 nt, Escherichia coli CFT073
gugcucauuagcccggca

SEQ ID NO: 644216 - RNA, 22 nt, Escherichia coli CFT073
gugcuccaaucguucaaccacu

SEQ ID NO: 644217 - RNA, 13 nt, Escherichia coli CFT073
gugcuccauuguu

SEQ ID NO: 644218 - RNA, 23 nt, Escherichia coli CFT073
gugcuccgcucaucaggccuggc

SEQ ID NO: 644219 - RNA, 19 nt, Escherichia coli CFT073
gugcuccuucucugagcug

SEQ ID NO: 644220 - RNA, 21 nt, Escherichia coli CFT073
gugcugaagggcaucagccuc

SEQ ID NO: 644221 - RNA, 21 nt, Escherichia coli CFT073
gugcugccagccagaguugaa

SEQ ID NO: 644222 - RNA, 16 nt, Escherichia coli CFT073
gugcugcgauucaggg

SEQ ID NO: 644223 - RNA, 17 nt, Escherichia coli CFT073
gugcugcgauucagggu

SEQ ID NO: 644224 - RNA, 14 nt, Escherichia coli CFT073
gugcugggcugggu

SEQ ID NO: 644225 - RNA, 14 nt, Escherichia coli CFT073
gugcuggcggccug

SEQ ID NO: 644226 - RNA, 19 nt, Escherichia coli CFT073
gugaugcggucgcugccgc

SEQ ID NO: 644227 - RNA, 20 nt, Escherichia coli CFT073
gugaugcguccgcuaguggc

SEQ ID NO: 644228 - RNA, 21 nt, Escherichia coli CFT073
gugaugcccggucgcuccggc

SEQ ID NO: 644229 - RNA, 11 nt, Escherichia coli CFT073
gucgcuuugac

SEQ ID NO: 644230 - RNA, 22 nt, Escherichia coli CFT073
gucgcuucgcgaaucgccacaa

SEQ ID NO: 644231 - RNA, 22 nt, Escherichia coli CFT073
gucgcuggucgauggccgggug

SEQ ID NO: 644232 - RNA, 17 nt, Escherichia coli CFT073
gucgcugugacauccag

SEQ ID NO: 644233 - RNA, 12 nt, Escherichia coli CFT073
gucgcugaucac

SEQ ID NO: 644234 - RNA, 14 nt, Escherichia coli CFT073
gucgcuggccggac

SEQ ID NO: 644235 - RNA, 15 nt, Escherichia coli CFT073
gucgcugcugccugc

SEQ ID NO: 644236 - RNA, 21 nt, Escherichia coli CFT073
gugauuccguucaguaaucaa

SEQ ID NO: 644237 - RNA, 20 nt, Escherichia coli CFT073
gugauuauuuaggugccaac

SEQ ID NO: 644238 - RNA, 19 nt, Escherichia coli CFT073
gugauucauaguaagcaga

SEQ ID NO: 644239 - RNA, 18 nt, Escherichia coli CFT073
gugcaacuuucaauaacc

SEQ ID NO: 644240 - RNA, 18 nt, Escherichia coli CFT073
gugauugguuucaaccug

SEQ ID NO: 644241 - RNA, 13 nt, Escherichia coli CFT073
gugauuguuuaaa

SEQ ID NO: 644242 - RNA, 19 nt, Escherichia coli CFT073
gugcacaaacuucuucagu

SEQ ID NO: 644243 - RNA, 21 nt, Escherichia coli CFT073
gugcaauucggcuuuuuucuc

SEQ ID NO: 644244 - RNA, 11 nt, Escherichia coli CFT073
gugcagcaucg

SEQ ID NO: 644245 - RNA, 13 nt, Escherichia coli CFT073
gugcagcccauaa

SEQ ID NO: 644246 - RNA, 17 nt, Escherichia coli CFT073
gugcagauaccaccagc

SEQ ID NO: 644247 - RNA, 17 nt, Escherichia coli CFT073
gugcagaucgccagagu

SEQ ID NO: 644248 - RNA, 15 nt, Escherichia coli CFT073
gugcagacucaccug

SEQ ID NO: 644249 - RNA, 14 nt, Escherichia coli CFT073
gugccacauccagc

SEQ ID NO: 644250 - RNA, 17 nt, Escherichia coli CFT073
gugccacauccagcggc

SEQ ID NO: 644251 - RNA, 14 nt, Escherichia coli CFT073
gugccagaacagaa

SEQ ID NO: 644252 - RNA, 15 nt, Escherichia coli CFT073
gugccagaacagaaa

SEQ ID NO: 644253 - RNA, 17 nt, Escherichia coli CFT073
gugccagaacagaaaug

SEQ ID NO: 644254 - RNA, 14 nt, Escherichia coli CFT073
gugccagauagcca

SEQ ID NO: 644255 - RNA, 16 nt, Escherichia coli CFT073
gugcccgaccacuuca

SEQ ID NO: 644256 - RNA, 17 nt, Escherichia coli CFT073
gugcccguccccugagc

SEQ ID NO: 644257 - RNA, 17 nt, Escherichia coli CFT073
gugccgacagguggugu

SEQ ID NO: 644258 - RNA, 20 nt, Escherichia coli CFT073
gugccgacaucgccacggca

SEQ ID NO: 644259 - RNA, 17 nt, Escherichia coli CFT073
gugcccgggucagcgcc

SEQ ID NO: 644260 - RNA, 11 nt, Escherichia coli CFT073
gucgcaucuuc

SEQ ID NO: 644261 - RNA, 15 nt, Escherichia coli CFT073
gucgcaucaggcaau

SEQ ID NO: 644262 - RNA, 21 nt, Escherichia coli CFT073
gucgcauccaacaauaaaaag

SEQ ID NO: 644263 - RNA, 16 nt, Escherichia coli CFT073
gucgccagcagcucac

SEQ ID NO: 644264 - RNA, 12 nt, Escherichia coli CFT073
gucgccagcgcc

SEQ ID NO: 644265 - RNA, 22 nt, Escherichia coli CFT073
gucgcccgaugccagcacagau

SEQ ID NO: 644266 - RNA, 15 nt, Escherichia coli CFT073
gucgcgcgcgguggc

SEQ ID NO: 644267 - RNA, 15 nt, Escherichia coli CFT073
gucgccucgccgagc

SEQ ID NO: 644268 - RNA, 15 nt, Escherichia coli CFT073
gucgcagccagcgca

SEQ ID NO: 644269 - RNA, 20 nt, Escherichia coli CFT073
gucgcaauacccugacccag

SEQ ID NO: 644270 - RNA, 22 nt, Escherichia coli CFT073
gucgcagacaaggcgauuuggg

SEQ ID NO: 644271 - RNA, 14 nt, Escherichia coli CFT073
gucgcaaaacucac

SEQ ID NO: 644272 - RNA, 22 nt, Escherichia coli CFT073
gucgauuuucacauaagcugaa

SEQ ID NO: 644273 - RNA, 16 nt, Escherichia coli CFT073
gucgauugcucaacac

SEQ ID NO: 644274 - RNA, 16 nt, Escherichia coli CFT073
gucgauucgccgucuc

SEQ ID NO: 644275 - RNA, 14 nt, Escherichia coli CFT073
gucgaggcaaccag

SEQ ID NO: 644276 - RNA, 15 nt, Escherichia coli CFT073
gucgaggcaaccagc

SEQ ID NO: 644277 - RNA, 18 nt, Escherichia coli CFT073
guccuucaauaucauuac

SEQ ID NO: 644278 - RNA, 14 nt, Escherichia coli CFT073
guccuucucaucuu

SEQ ID NO: 644279 - RNA, 21 nt, Escherichia coli CFT073
guccuucaucuucauccggcu

SEQ ID NO: 644280 - RNA, 23 nt, Escherichia coli CFT073
guccccggaugaguaaacuucaa

SEQ ID NO: 644281 - RNA, 17 nt, Escherichia coli CFT073
gucccaugaugcgcggc

SEQ ID NO: 644282 - RNA, 21 nt, Escherichia coli CFT073
gucccauaacauauucacccg

SEQ ID NO: 644283 - RNA, 12 nt, Escherichia coli CFT073
gucauuuugucg

SEQ ID NO: 644284 - RNA, 19 nt, Escherichia coli CFT073
guccauaccggacuccaga

SEQ ID NO: 644285 - RNA, 22 nt, Escherichia coli CFT073
guccauauuucgucgcaucaca

SEQ ID NO: 644286 - RNA, 16 nt, Escherichia coli CFT073
gucauuaccacaacaa

SEQ ID NO: 644287 - RNA, 13 nt, Escherichia coli CFT073
gucauuaugucug

SEQ ID NO: 644288 - RNA, 20 nt, Escherichia coli CFT073
gucauuggccggaauaccac

SEQ ID NO: 644289 - RNA, 22 nt, Escherichia coli CFT073
gucauugaugcugccaucaucu

SEQ ID NO: 644290 - RNA, 22 nt, Escherichia coli CFT073
gucauugccugauguugauaaa

SEQ ID NO: 644291 - RNA, 12 nt, Escherichia coli CFT073
guccguugaaau

SEQ ID NO: 644292 - RNA, 18 nt, Escherichia coli CFT073
guccuggcgcuguggugg

SEQ ID NO: 644293 - RNA, 21 nt, Escherichia coli CFT073
guccgcacgcuggagaauaaa

SEQ ID NO: 644294 - RNA, 20 nt, Escherichia coli CFT073
guccgcaauacaucaaagcg

SEQ ID NO: 644295 - RNA, 21 nt, Escherichia coli CFT073
guccgcauccccuacucucug

SEQ ID NO: 644296 - RNA, 14 nt, Escherichia coli CFT073
guccggcaccagcg

SEQ ID NO: 644297 - RNA, 17 nt, Escherichia coli CFT073
guccgccauuuccagcg

SEQ ID NO: 644298 - RNA, 14 nt, Escherichia coli CFT073
gucaugacauucau

SEQ ID NO: 644299 - RNA, 11 nt, Escherichia coli CFT073
gucauuaaauc

SEQ ID NO: 644300 - RNA, 16 nt, Escherichia coli CFT073
gucauuaauacaucaa

SEQ ID NO: 644301 - RNA, 22 nt, Escherichia coli CFT073
gucauuacgggcaaucaucacc

SEQ ID NO: 644302 - RNA, 13 nt, Escherichia coli CFT073
gucauaaaaauga

SEQ ID NO: 644303 - RNA, 13 nt, Escherichia coli CFT073
gucaucuuacugc

SEQ ID NO: 644304 - RNA, 22 nt, Escherichia coli CFT073
gucaguacggcaaagauauuca

SEQ ID NO: 644305 - RNA, 23 nt, Escherichia coli CFT073
gucaguaguuuuugcagauggau

SEQ ID NO: 644306 - RNA, 18 nt, Escherichia coli CFT073
gucaggggcauuuuccag

SEQ ID NO: 644307 - RNA, 17 nt, Escherichia coli CFT073
gucagggucuggugcug

SEQ ID NO: 644308 - RNA, 15 nt, Escherichia coli CFT073
gucaggguugacuug

SEQ ID NO: 644309 - RNA, 12 nt, Escherichia coli CFT073
gucagugguggc

SEQ ID NO: 644310 - RNA, 15 nt, Escherichia coli CFT073
gucagucccaacuga

SEQ ID NO: 644311 - RNA, 13 nt, Escherichia coli CFT073
gucagugucagaa

SEQ ID NO: 644312 - RNA, 22 nt, Escherichia coli CFT073
gucagugucuuaucuggcauuu

SEQ ID NO: 644313 - RNA, 14 nt, Escherichia coli CFT073
gucaguuccauaau

SEQ ID NO: 644314 - RNA, 11 nt, Escherichia coli CFT073
gucaguuucac

SEQ ID NO: 644315 - RNA, 16 nt, Escherichia coli CFT073
gucaguugcggcagga

SEQ ID NO: 644316 - RNA, 17 nt, Escherichia coli CFT073
gucaggauguugccacg

SEQ ID NO: 644317 - RNA, 18 nt, Escherichia coli CFT073
gucaggauuaaacuggca

SEQ ID NO: 644318 - RNA, 14 nt, Escherichia coli CFT073
gucaggaucaccaa

SEQ ID NO: 644319 - RNA, 23 nt, Escherichia coli CFT073
gucaggaucaccaauaccagcau

SEQ ID NO: 644320 - RNA, 14 nt, Escherichia coli CFT073
gucaggcgucgcgc

SEQ ID NO: 644321 - RNA, 12 nt, Escherichia coli CFT073
gucagccagcac

SEQ ID NO: 644322 - RNA, 15 nt, Escherichia coli CFT073
gucagccaaucacau

SEQ ID NO: 644323 - RNA, 16 nt, Escherichia coli CFT073
gucagcacucacgcca

SEQ ID NO: 644324 - RNA, 17 nt, Escherichia coli CFT073
gucagcaaugccagagu

SEQ ID NO: 644325 - RNA, 18 nt, Escherichia coli CFT073
gucagcaaugccagagug

SEQ ID NO: 644326 - RNA, 17 nt, Escherichia coli CFT073
gucagcacaaacaauuu

SEQ ID NO: 644327 - RNA, 15 nt, Escherichia coli CFT073
gucagcacauccagu

SEQ ID NO: 644328 - RNA, 19 nt, Escherichia coli CFT073
gucagcgcaaucugcuucu

SEQ ID NO: 644329 - RNA, 23 nt, Escherichia coli CFT073
gucagcgccaggcuuuccgucag

SEQ ID NO: 644330 - RNA, 18 nt, Escherichia coli CFT073
gucaccgggcaaacgcug

SEQ ID NO: 644331 - RNA, 18 nt, Escherichia coli CFT073
gucacgcgguuaucccaa

SEQ ID NO: 644332 - RNA, 15 nt, Escherichia coli CFT073
gucacggaaucccgu

SEQ ID NO: 644333 - RNA, 16 nt, Escherichia coli CFT073
gucacgggcggugcgg

SEQ ID NO: 644334 - RNA, 18 nt, Escherichia coli CFT073
gucacugauagugcugcc

SEQ ID NO: 644335 - RNA, 22 nt, Escherichia coli CFT073
gucacuuugcugucgauuuuca

SEQ ID NO: 644336 - RNA, 23 nt, Escherichia coli CFT073
gucacugugacgcggugcuuccg

SEQ ID NO: 644337 - RNA, 13 nt, Escherichia coli CFT073
gucagauccgcca

SEQ ID NO: 644338 - RNA, 13 nt, Escherichia coli CFT073
gucagagcauuac

SEQ ID NO: 644339 - RNA, 19 nt, Escherichia coli CFT073
gucagaccuccguuuuucu

SEQ ID NO: 644340 - RNA, 16 nt, Escherichia coli CFT073
gucagacuaucuuugg

SEQ ID NO: 644341 - RNA, 14 nt, Escherichia coli CFT073
gucagacuuaagcc

SEQ ID NO: 644342 - RNA, 18 nt, Escherichia coli CFT073
gucagagagccagcccca

SEQ ID NO: 644343 - RNA, 22 nt, Escherichia coli CFT073
gucagaaacaguuguaaaguac

SEQ ID NO: 644344 - RNA, 16 nt, Escherichia coli CFT073
gucagaaagugccacg

SEQ ID NO: 644345 - RNA, 14 nt, Escherichia coli CFT073
gucagaacaaugau

SEQ ID NO: 644346 - RNA, 18 nt, Escherichia coli CFT073
guauaccugauuaccaaa

SEQ ID NO: 644347 - RNA, 16 nt, Escherichia coli CFT073
guauaugagaagacug

SEQ ID NO: 644348 - RNA, 15 nt, Escherichia coli CFT073
guauaugcguugcgg

SEQ ID NO: 644349 - RNA, 15 nt, Escherichia coli CFT073
guauuuuuccagcuc

SEQ ID NO: 644350 - RNA, 21 nt, Escherichia coli CFT073
gucaagaaggauauaaaaaua

SEQ ID NO: 644351 - RNA, 15 nt, Escherichia coli CFT073
gucaaugccggucgg

SEQ ID NO: 644352 - RNA, 12 nt, Escherichia coli CFT073
gucaaucugcuc

SEQ ID NO: 644353 - RNA, 14 nt, Escherichia coli CFT073
gucaaugaaauuac

SEQ ID NO: 644354 - RNA, 18 nt, Escherichia coli CFT073
gucaacaguucaugguua

SEQ ID NO: 644355 - RNA, 14 nt, Escherichia coli CFT073
gucaacagggcaga

SEQ ID NO: 644356 - RNA, 21 nt, Escherichia coli CFT073
gucaacugcgccacucgauac

SEQ ID NO: 644357 - RNA, 18 nt, Escherichia coli CFT073
guagguguauugcccgcc

SEQ ID NO: 644358 - RNA, 11 nt, Escherichia coli CFT073
guaguaaguag

SEQ ID NO: 644359 - RNA, 16 nt, Escherichia coli CFT073
guaguacgcgggaaua

SEQ ID NO: 644360 - RNA, 18 nt, Escherichia coli CFT073
guaguacucguagcccug

SEQ ID NO: 644361 - RNA, 16 nt, Escherichia coli CFT073
guagucaauuuuucag

SEQ ID NO: 644362 - RNA, 16 nt, Escherichia coli CFT073
guagucggacaaacac

SEQ ID NO: 644363 - RNA, 21 nt, Escherichia coli CFT073
guagugauaccccgcaucgug

SEQ ID NO: 644364 - RNA, 17 nt, Escherichia coli CFT073
guagugcgcagaacaua

SEQ ID NO: 644365 - RNA, 14 nt, Escherichia coli CFT073
guaguugaucgccc

SEQ ID NO: 644366 - RNA, 23 nt, Escherichia coli CFT073
guaguugugugggucuaaaaaca

SEQ ID NO: 644367 - RNA, 15 nt, Escherichia coli CFT073
guaguugcgcuggug

SEQ ID NO: 644368 - RNA, 12 nt, Escherichia coli CFT073
guaguugcugau

SEQ ID NO: 644369 - RNA, 19 nt, Escherichia coli CFT073
guaguuaugaaaauaggaa

SEQ ID NO: 644370 - RNA, 14 nt, Escherichia coli CFT073
guaguuccagcaug

SEQ ID NO: 644371 - RNA, 16 nt, Escherichia coli CFT073
guaguguaaaugcaaa

SEQ ID NO: 644372 - RNA, 14 nt, Escherichia coli CFT073
guaguggccacaga

SEQ ID NO: 644373 - RNA, 13 nt, Escherichia coli CFT073
guauaaaggguau

SEQ ID NO: 644374 - RNA, 19 nt, Escherichia coli CFT073
guauaaggagcaauaauca

SEQ ID NO: 644375 - RNA, 18 nt, Escherichia coli CFT073
guauaaggcaucagccag

SEQ ID NO: 644376 - RNA, 22 nt, Escherichia coli CFT073
guauaacucgccuucagguuuu

SEQ ID NO: 644377 - RNA, 12 nt, Escherichia coli CFT073
guauaacacacc

SEQ ID NO: 644378 - RNA, 17 nt, Escherichia coli CFT073
guaggccugagaagcgc

SEQ ID NO: 644379 - RNA, 23 nt, Escherichia coli CFT073
guagcugaaaaucagauccgcac

SEQ ID NO: 644380 - RNA, 20 nt, Escherichia coli CFT073
guagcucaucuucauaacuu

SEQ ID NO: 644381 - RNA, 22 nt, Escherichia coli CFT073
guagccucugcguuauuuucag

SEQ ID NO: 644382 - RNA, 17 nt, Escherichia coli CFT073
guagccuuuuucagccg

SEQ ID NO: 644383 - RNA, 21 nt, Escherichia coli CFT073
guagccuuuuuuaauauuuca

SEQ ID NO: 644384 - RNA, 16 nt, Escherichia coli CFT073
guagcucaccagcagg

SEQ ID NO: 644385 - RNA, 18 nt, Escherichia coli CFT073
guagcucaccagcaggca

SEQ ID NO: 644386 - RNA, 23 nt, Escherichia coli CFT073
guagcuaaacugaucuuuaucaa

SEQ ID NO: 644387 - RNA, 14 nt, Escherichia coli CFT073
guagcucagcugga

SEQ ID NO: 644388 - RNA, 17 nt, Escherichia coli CFT073
guagcucaucuucauaa

SEQ ID NO: 644389 - RNA, 20 nt, Escherichia coli CFT073
guagcuaccuugcucggcgc

SEQ ID NO: 644390 - RNA, 14 nt, Escherichia coli CFT073
guagcgugauuuug

SEQ ID NO: 644391 - RNA, 14 nt, Escherichia coli CFT073
guagcgugauuuuu

SEQ ID NO: 644392 - RNA, 23 nt, Escherichia coli CFT073
guagcgauuuacuauucaccacu

SEQ ID NO: 644393 - RNA, 15 nt, Escherichia coli CFT073
guagcgcagcaggca

SEQ ID NO: 644394 - RNA, 15 nt, Escherichia coli CFT073
guacucaccgcucac

SEQ ID NO: 644395 - RNA, 14 nt, Escherichia coli CFT073
guacucaucgcccg

SEQ ID NO: 644396 - RNA, 18 nt, Escherichia coli CFT073
guacuaccgaagcgguga

SEQ ID NO: 644397 - RNA, 16 nt, Escherichia coli CFT073
guacguuuauuagccc

SEQ ID NO: 644398 - RNA, 20 nt, Escherichia coli CFT073
guacguaaaacaagaucgcc

SEQ ID NO: 644399 - RNA, 21 nt, Escherichia coli CFT073
guacggcccauaacccacacc

SEQ ID NO: 644400 - RNA, 15 nt, Escherichia coli CFT073
guaccgugcagcgca

SEQ ID NO: 644401 - RNA, 20 nt, Escherichia coli CFT073
guaccgggcgcgaggccagc

SEQ ID NO: 644402 - RNA, 22 nt, Escherichia coli CFT073
guaccguuauugcuuauuguug

SEQ ID NO: 644403 - RNA, 11 nt, Escherichia coli CFT073
guagacuuagc

SEQ ID NO: 644404 - RNA, 15 nt, Escherichia coli CFT073
guagagauuuuuccc

SEQ ID NO: 644405 - RNA, 19 nt, Escherichia coli CFT073
guagagcagcacgcaguga

SEQ ID NO: 644406 - RNA, 13 nt, Escherichia coli CFT073
guacuguacaaca

SEQ ID NO: 644407 - RNA, 13 nt, Escherichia coli CFT073
guacugucugcug

SEQ ID NO: 644408 - RNA, 12 nt, Escherichia coli CFT073
guacuuaaaacu

SEQ ID NO: 644409 - RNA, 18 nt, Escherichia coli CFT073
guacuggcaaucgccagc

SEQ ID NO: 644410 - RNA, 14 nt, Escherichia coli CFT073
guaauccuguaucu

SEQ ID NO: 644411 - RNA, 11 nt, Escherichia coli CFT073
guaaucgaugg

SEQ ID NO: 644412 - RNA, 14 nt, Escherichia coli CFT073
guaaucgccagcaa

SEQ ID NO: 644413 - RNA, 12 nt, Escherichia coli CFT073
guaaucucuuuc

SEQ ID NO: 644414 - RNA, 22 nt, Escherichia coli CFT073
guaaugcucgacgagaauuucc

SEQ ID NO: 644415 - RNA, 19 nt, Escherichia coli CFT073
guaauguuuccagcaucgc

SEQ ID NO: 644416 - RNA, 14 nt, Escherichia coli CFT073
guaauguuuugcac

SEQ ID NO: 644417 - RNA, 16 nt, Escherichia coli CFT073
guacaugguaauaaug

SEQ ID NO: 644418 - RNA, 14 nt, Escherichia coli CFT073
guacauuucuucuu

SEQ ID NO: 644419 - RNA, 22 nt, Escherichia coli CFT073
guaccaaagccucaaugcugaa

SEQ ID NO: 644420 - RNA, 21 nt, Escherichia coli CFT073
guacauucggcguuaacaaua

SEQ ID NO: 644421 - RNA, 15 nt, Escherichia coli CFT073
guacauuguuuucca

SEQ ID NO: 644422 - RNA, 16 nt, Escherichia coli CFT073
guaccgccgccauaaa

SEQ ID NO: 644423 - RNA, 22 nt, Escherichia coli CFT073
guaccgccgccauaaacagcag

SEQ ID NO: 644424 - RNA, 23 nt, Escherichia coli CFT073
guaccgagaagccgaccagcacc

SEQ ID NO: 644425 - RNA, 16 nt, Escherichia coli CFT073
guaccaugauccugca

SEQ ID NO: 644426 - RNA, 14 nt, Escherichia coli CFT073
guaccaucgccagc

SEQ ID NO: 644427 - RNA, 19 nt, Escherichia coli CFT073
guaccaucguccagcagca

SEQ ID NO: 644428 - RNA, 18 nt, Escherichia coli CFT073
guaaaucaugcuccugua

SEQ ID NO: 644429 - RNA, 21 nt, Escherichia coli CFT073
guaaauacugcgcauggaagc

SEQ ID NO: 644430 - RNA, 15 nt, Escherichia coli CFT073
guaaaguaacgaaua

SEQ ID NO: 644431 - RNA, 15 nt, Escherichia coli CFT073
guaaagucuggaaga

SEQ ID NO: 644432 - RNA, 14 nt, Escherichia coli CFT073
guaaagccugcugg

SEQ ID NO: 644433 - RNA, 17 nt, Escherichia coli CFT073
guaaagcggcaacuuua

SEQ ID NO: 644434 - RNA, 20 nt, Escherichia coli CFT073
guaaagcggcgaguauucuu

SEQ ID NO: 644435 - RNA, 16 nt, Escherichia coli CFT073
guaaauggcgcuaaaa

SEQ ID NO: 644436 - RNA, 23 nt, Escherichia coli CFT073
guaaauucauccaguagaauaau

SEQ ID NO: 644437 - RNA, 15 nt, Escherichia coli CFT073
guaaauugccccaga

SEQ ID NO: 644438 - RNA, 19 nt, Escherichia coli CFT073
guaaauugugcuuauuuua

SEQ ID NO: 644439 - RNA, 16 nt, Escherichia coli CFT073
guaacaccagagugac

SEQ ID NO: 644440 - RNA, 13 nt, Escherichia coli CFT073
guaacagagcauc

SEQ ID NO: 644441 - RNA, 16 nt, Escherichia coli CFT073
guaacagagcaucggu

SEQ ID NO: 644442 - RNA, 15 nt, Escherichia coli CFT073
guaacagcggacggc

SEQ ID NO: 644443 - RNA, 16 nt, Escherichia coli CFT073
guaacagucaguuauc

SEQ ID NO: 644444 - RNA, 11 nt, Escherichia coli CFT073
guaaacaacau

SEQ ID NO: 644445 - RNA, 19 nt, Escherichia coli CFT073
guaaacaagacaucacuca

SEQ ID NO: 644446 - RNA, 12 nt, Escherichia coli CFT073
guaaaauacugg

SEQ ID NO: 644447 - RNA, 23 nt, Escherichia coli CFT073
gguuaacccacagcgcaccaacg

SEQ ID NO: 644448 - RNA, 18 nt, Escherichia coli CFT073
gguuaaauaauauuuccc

SEQ ID NO: 644449 - RNA, 20 nt, Escherichia coli CFT073
guaaaaguagggcgcugcca

SEQ ID NO: 644450 - RNA, 23 nt, Escherichia coli CFT073
guaaaccacugacacaggcagca

SEQ ID NO: 644451 - RNA, 21 nt, Escherichia coli CFT073
guaaacagauaggcaucagca

SEQ ID NO: 644452 - RNA, 13 nt, Escherichia coli CFT073
guaaacaucaucc

SEQ ID NO: 644453 - RNA, 19 nt, Escherichia coli CFT073
guaaaccgcucgucacauc

SEQ ID NO: 644454 - RNA, 16 nt, Escherichia coli CFT073
guaaaccgcucgucac

SEQ ID NO: 644455 - RNA, 17 nt, Escherichia coli CFT073
guaaaccguuaucacca

SEQ ID NO: 644456 - RNA, 20 nt, Escherichia coli CFT073
guaaacgacccugccacagu

SEQ ID NO: 644457 - RNA, 19 nt, Escherichia coli CFT073
guaaacgccuuauccgacu

SEQ ID NO: 644458 - RNA, 17 nt, Escherichia coli CFT073
guaaacgcgaaggacug

SEQ ID NO: 644459 - RNA, 14 nt, Escherichia coli CFT073
guaaacgccuuauc

SEQ ID NO: 644460 - RNA, 17 nt, Escherichia coli CFT073
guaaacgugcggcugug

SEQ ID NO: 644461 - RNA, 13 nt, Escherichia coli CFT073
guaacuuuugccc

SEQ ID NO: 644462 - RNA, 14 nt, Escherichia coli CFT073
guaagaacguaaau

SEQ ID NO: 644463 - RNA, 20 nt, Escherichia coli CFT073
guaagaguuucaacaucauu

SEQ ID NO: 644464 - RNA, 21 nt, Escherichia coli CFT073
guaacgucgcaucuggucaga

SEQ ID NO: 644465 - RNA, 19 nt, Escherichia coli CFT073
guaacuaccguacauugcc

SEQ ID NO: 644466 - RNA, 20 nt, Escherichia coli CFT073
guaacucaggaugagaaaag

SEQ ID NO: 644467 - RNA, 15 nt, Escherichia coli CFT073
guaacucauugccag

SEQ ID NO: 644468 - RNA, 19 nt, Escherichia coli CFT073
guaacgauggcaauuuuca

SEQ ID NO: 644469 - RNA, 15 nt, Escherichia coli CFT073
guaacguggcagcag

SEQ ID NO: 644470 - RNA, 22 nt, Escherichia coli CFT073
guaacugccuuucccuuucuua

SEQ ID NO: 644471 - RNA, 15 nt, Escherichia coli CFT073
guaacugcuugaauu

SEQ ID NO: 644472 - RNA, 18 nt, Escherichia coli CFT073
guaacuggcgcaguugug

SEQ ID NO: 644473 - RNA, 20 nt, Escherichia coli CFT073
guaacuggugacuuuugccc

SEQ ID NO: 644474 - RNA, 21 nt, Escherichia coli CFT073
guaacugucuucaccauaguu

SEQ ID NO: 644475 - RNA, 23 nt, Escherichia coli CFT073
guaacuguucgagguaauccagc

SEQ ID NO: 644476 - RNA, 13 nt, Escherichia coli CFT073
guaacgacugcgg

SEQ ID NO: 644477 - RNA, 16 nt, Escherichia coli CFT073
guaacgacaugaagau

SEQ ID NO: 644478 - RNA, 12 nt, Escherichia coli CFT073
guaaccuucacc

SEQ ID NO: 644479 - RNA, 22 nt, Escherichia coli CFT073
guaacggcauuguucugcaaau

SEQ ID NO: 644480 - RNA, 22 nt, Escherichia coli CFT073
guaaccagccguuauguugauu

SEQ ID NO: 644481 - RNA, 17 nt, Escherichia coli CFT073
guaaccaccagcacuga

SEQ ID NO: 644482 - RNA, 18 nt, Escherichia coli CFT073
guaaccaccagcacugau

SEQ ID NO: 644483 - RNA, 16 nt, Escherichia coli CFT073
guaaccaccgcaggca

SEQ ID NO: 644484 - RNA, 19 nt, Escherichia coli CFT073
guaaccaguuuaucaauga

SEQ ID NO: 644485 - RNA, 23 nt, Escherichia coli CFT073
guaacccauccagcagagauaca

SEQ ID NO: 644486 - RNA, 23 nt, Escherichia coli CFT073
guaaccaaacguggucgccagca

SEQ ID NO: 644487 - RNA, 19 nt, Escherichia coli CFT073
guaauaaaaucuauuauua

SEQ ID NO: 644488 - RNA, 17 nt, Escherichia coli CFT073
guaauaaaccaaagccc

SEQ ID NO: 644489 - RNA, 22 nt, Escherichia coli CFT073
guaauaugugcgccacgcagcg

SEQ ID NO: 644490 - RNA, 24 nt, Escherichia coli CFT073
guaauaugcagacucauuguaucu

SEQ ID NO: 644491 - RNA, 21 nt, Escherichia coli CFT073
guaauaacccgucagcagauc

SEQ ID NO: 644492 - RNA, 22 nt, Escherichia coli CFT073
guaagcuccagugccuggcaua

SEQ ID NO: 644493 - RNA, 21 nt, Escherichia coli CFT073
guaaggauaaaaaagggugac

SEQ ID NO: 644494 - RNA, 21 nt, Escherichia coli CFT073
guaaggcaucgcuaaucuggc

SEQ ID NO: 644495 - RNA, 14 nt, Escherichia coli CFT073
guaaggcaucuucu

SEQ ID NO: 644496 - RNA, 19 nt, Escherichia coli CFT073
guaaggccaaauaccggcg

SEQ ID NO: 644497 - RNA, 17 nt, Escherichia coli CFT073
guaagcaaacagagcaa

SEQ ID NO: 644498 - RNA, 23 nt, Escherichia coli CFT073
guaagcaaacagagcaaaacgca

SEQ ID NO: 644499 - RNA, 15 nt, Escherichia coli CFT073
guaagccgcaaccac

SEQ ID NO: 644500 - RNA, 19 nt, Escherichia coli CFT073
guaagccgguaaucaccag

SEQ ID NO: 644501 - RNA, 20 nt, Escherichia coli CFT073
guaagccguaaacagguuga

SEQ ID NO: 644502 - RNA, 21 nt, Escherichia coli CFT073
guaagcgugauaacaguuggu

SEQ ID NO: 644503 - RNA, 21 nt, Escherichia coli CFT073
guaagcgcggauuuuauucag

SEQ ID NO: 644504 - RNA, 23 nt, Escherichia coli CFT073
guaagcgauaaaaauaccgagca

SEQ ID NO: 644505 - RNA, 19 nt, Escherichia coli CFT073
gguggcgauugucggcgcu

SEQ ID NO: 644506 - RNA, 14 nt, Escherichia coli CFT073
gguggcaaagaaau

SEQ ID NO: 644507 - RNA, 19 nt, Escherichia coli CFT073
ggugcucauuagcccggca

SEQ ID NO: 644508 - RNA, 15 nt, Escherichia coli CFT073
ggugcguugaagaua

SEQ ID NO: 644509 - RNA, 17 nt, Escherichia coli CFT073
gguggcuucacgcacug

SEQ ID NO: 644510 - RNA, 21 nt, Escherichia coli CFT073
gguggcgucaugcucgcaggu

SEQ ID NO: 644511 - RNA, 16 nt, Escherichia coli CFT073
ggugugaaugaccagg

SEQ ID NO: 644512 - RNA, 18 nt, Escherichia coli CFT073
ggugcgcguggcaauugc

SEQ ID NO: 644513 - RNA, 17 nt, Escherichia coli CFT073
ggugcgagagcggaggu

SEQ ID NO: 644514 - RNA, 15 nt, Escherichia coli CFT073
ggugcagaaucaauc

SEQ ID NO: 644515 - RNA, 22 nt, Escherichia coli CFT073
ggucgcugucuuucaacagaua

SEQ ID NO: 644516 - RNA, 14 nt, Escherichia coli CFT073
ggucggaaucccau

SEQ ID NO: 644517 - RNA, 12 nt, Escherichia coli CFT073
gguccuucaucu

SEQ ID NO: 644518 - RNA, 22 nt, Escherichia coli CFT073
ggugaagguaaguuguugauaa

SEQ ID NO: 644519 - RNA, 17 nt, Escherichia coli CFT073
ggugaaagcaaaaaaga

SEQ ID NO: 644520 - RNA, 18 nt, Escherichia coli CFT073
ggugaaagcaaaaaagaa

SEQ ID NO: 644521 - RNA, 13 nt, Escherichia coli CFT073
ggugaaaagagcg

SEQ ID NO: 644522 - RNA, 17 nt, Escherichia coli CFT073
ggugaacgccaccaacg

SEQ ID NO: 644523 - RNA, 15 nt, Escherichia coli CFT073
ggugauaagcgaggc

SEQ ID NO: 644524 - RNA, 23 nt, Escherichia coli CFT073
ggugauaaucaucccacaugaau

SEQ ID NO: 644525 - RNA, 22 nt, Escherichia coli CFT073
ggugauacugaucgucaucaaa

SEQ ID NO: 644526 - RNA, 21 nt, Escherichia coli CFT073
ggucuucauagauagccagca

SEQ ID NO: 644527 - RNA, 23 nt, Escherichia coli CFT073
ggucguggguucaucgagcagca

SEQ ID NO: 644528 - RNA, 14 nt, Escherichia coli CFT073
gguaauacccagac

SEQ ID NO: 644529 - RNA, 21 nt, Escherichia coli CFT073
gguaauauauaacagaagguu

SEQ ID NO: 644530 - RNA, 23 nt, Escherichia coli CFT073
gguaaugucucgguagagaaaac

SEQ ID NO: 644531 - RNA, 18 nt, Escherichia coli CFT073
gguaaugcgcgcuaugau

SEQ ID NO: 644532 - RNA, 20 nt, Escherichia coli CFT073
gguaaugcgcgcuaugauga

SEQ ID NO: 644533 - RNA, 16 nt, Escherichia coli CFT073
gguaaugcugaaauua

SEQ ID NO: 644534 - RNA, 13 nt, Escherichia coli CFT073
gguaaucgccagc

SEQ ID NO: 644535 - RNA, 22 nt, Escherichia coli CFT073
gguaaucucaccgcaggcggca

SEQ ID NO: 644536 - RNA, 21 nt, Escherichia coli CFT073
gguaaucaucgccuucaucug

SEQ ID NO: 644537 - RNA, 15 nt, Escherichia coli CFT073
gguacaaaagcaaua

SEQ ID NO: 644538 - RNA, 16 nt, Escherichia coli CFT073
gguacaaagccaacag

SEQ ID NO: 644539 - RNA, 17 nt, Escherichia coli CFT073
gguacaaacaucaucca

SEQ ID NO: 644540 - RNA, 23 nt, Escherichia coli CFT073
gguacaauggagcuaaacagagc

SEQ ID NO: 644541 - RNA, 19 nt, Escherichia coli CFT073
gguacgaccgcaaagguug

SEQ ID NO: 644542 - RNA, 17 nt, Escherichia coli CFT073
gguacgacuuccuggcu

SEQ ID NO: 644543 - RNA, 19 nt, Escherichia coli CFT073
gguaccuuugaacugcuga

SEQ ID NO: 644544 - RNA, 17 nt, Escherichia coli CFT073
gguaccaugggaaaugg

SEQ ID NO: 644545 - RNA, 22 nt, Escherichia coli CFT073
gguaccgacugacgcucugcuu

SEQ ID NO: 644546 - RNA, 18 nt, Escherichia coli CFT073
gguagagcugaaaauugc

SEQ ID NO: 644547 - RNA, 16 nt, Escherichia coli CFT073
gguacugaccgcgacc

SEQ ID NO: 644548 - RNA, 11 nt, Escherichia coli CFT073
gguaggaaaag

SEQ ID NO: 644549 - RNA, 12 nt, Escherichia coli CFT073
gguagcugguga

SEQ ID NO: 644550 - RNA, 21 nt, Escherichia coli CFT073
gguagaugacgcccgggcuug

SEQ ID NO: 644551 - RNA, 17 nt, Escherichia coli CFT073
  misc_feature (8)..(8): n is a, c, g or u
gguagcungcaggauaa

SEQ ID NO: 644552 - RNA, 16 nt, Escherichia coli CFT073
gguaucgccacugcgc

SEQ ID NO: 644553 - RNA, 15 nt, Escherichia coli CFT073
gguaguuaaaggugg

SEQ ID NO: 644554 - RNA, 16 nt, Escherichia coli CFT073
gguagucgcgguccgg

SEQ ID NO: 644555 - RNA, 21 nt, Escherichia coli CFT073
gguagucaaaagcacucagag

SEQ ID NO: 644556 - RNA, 20 nt, Escherichia coli CFT073
gguauuccacuccagucuuu

SEQ ID NO: 644557 - RNA, 13 nt, Escherichia coli CFT073
ggucaccaguuca

SEQ ID NO: 644558 - RNA, 22 nt, Escherichia coli CFT073
ggucacggcuguagccagcucg

SEQ ID NO: 644559 - RNA, 14 nt, Escherichia coli CFT073
ggucagccagcggc

SEQ ID NO: 644560 - RNA, 23 nt, Escherichia coli CFT073
ggucagccacaguugaucagcca

SEQ ID NO: 644561 - RNA, 15 nt, Escherichia coli CFT073
gggugaaagggugcg

SEQ ID NO: 644562 - RNA, 23 nt, Escherichia coli CFT073
gggugaacccggcgauugauagc

SEQ ID NO: 644563 - RNA, 17 nt, Escherichia coli CFT073
gggugaauaaaagaaau

SEQ ID NO: 644564 - RNA, 22 nt, Escherichia coli CFT073
gggugaauaaaagaaauagcgg

SEQ ID NO: 644565 - RNA, 20 nt, Escherichia coli CFT073
gggugacggagaaaauccgc

SEQ ID NO: 644566 - RNA, 15 nt, Escherichia coli CFT073
gggugagacuuuacc

SEQ ID NO: 644567 - RNA, 22 nt, Escherichia coli CFT073
gggugacguuugaugcgcgagg

SEQ ID NO: 644568 - RNA, 19 nt, Escherichia coli CFT073
gggugagggcguagagaga

SEQ ID NO: 644569 - RNA, 21 nt, Escherichia coli CFT073
gggucuaaaaacaauucuucg

SEQ ID NO: 644570 - RNA, 18 nt, Escherichia coli CFT073
gggucaguugccagacgg

SEQ ID NO: 644571 - RNA, 22 nt, Escherichia coli CFT073
ggguuaucuuccagcggccaga

SEQ ID NO: 644572 - RNA, 19 nt, Escherichia coli CFT073
ggguuuccuggagaguguu

SEQ ID NO: 644573 - RNA, 19 nt, Escherichia coli CFT073
ggguuucgacggcaccaaa

SEQ ID NO: 644574 - RNA, 21 nt, Escherichia coli CFT073
ggguuucuucaaacugcagca

SEQ ID NO: 644575 - RNA, 15 nt, Escherichia coli CFT073
ggguugcugaccaaa

SEQ ID NO: 644576 - RNA, 15 nt, Escherichia coli CFT073
gguaacccauccagc

SEQ ID NO: 644577 - RNA, 22 nt, Escherichia coli CFT073
gguaacaccagagugaccacca

SEQ ID NO: 644578 - RNA, 23 nt, Escherichia coli CFT073
gguaacaauaaauucgccagaca

SEQ ID NO: 644579 - RNA, 18 nt, Escherichia coli CFT073
gguaacgcucacaucugc

SEQ ID NO: 644580 - RNA, 19 nt, Escherichia coli CFT073
gguaacguuugccagccac

SEQ ID NO: 644581 - RNA, 19 nt, Escherichia coli CFT073
gguaaagcccaucgccagc

SEQ ID NO: 644582 - RNA, 21 nt, Escherichia coli CFT073
gguaaacaccuucguccagca

SEQ ID NO: 644583 - RNA, 13 nt, Escherichia coli CFT073
gguaaaucagacc

SEQ ID NO: 644584 - RNA, 16 nt, Escherichia coli CFT073
gguaaaacggcagaau

SEQ ID NO: 644585 - RNA, 17 nt, Escherichia coli CFT073
gguaaacaacaugcuau

SEQ ID NO: 644586 - RNA, 21 nt, Escherichia coli CFT073
gggcgaggggagacuucacug

SEQ ID NO: 644587 - RNA, 16 nt, Escherichia coli CFT073
gggcgagguccagcuc

SEQ ID NO: 644588 - RNA, 22 nt, Escherichia coli CFT073
gggcgagcuuauauacucuaaa

SEQ ID NO: 644589 - RNA, 19 nt, Escherichia coli CFT073
gggcgauaaaucguuucca

SEQ ID NO: 644590 - RNA, 17 nt, Escherichia coli CFT073
gggcgacaaucaucgcc

SEQ ID NO: 644591 - RNA, 14 nt, Escherichia coli CFT073
gggcgacauuuagu

SEQ ID NO: 644592 - RNA, 15 nt, Escherichia coli CFT073
gggccuggaaguuga

SEQ ID NO: 644593 - RNA, 19 nt, Escherichia coli CFT073
ggggaaacccacgaccagu

SEQ ID NO: 644594 - RNA, 22 nt, Escherichia coli CFT073
gggcuuucucgcgcccaaccag

SEQ ID NO: 644595 - RNA, 22 nt, Escherichia coli CFT073
gggcuuuuuuuuauuauuccgu

SEQ ID NO: 644596 - RNA, 14 nt, Escherichia coli CFT073
ggggaaguggugau

SEQ ID NO: 644597 - RNA, 18 nt, Escherichia coli CFT073
gggcguuuccacgcccca

SEQ ID NO: 644598 - RNA, 21 nt, Escherichia coli CFT073
gggcuggaaacgcgaucgcca

SEQ ID NO: 644599 - RNA, 15 nt, Escherichia coli CFT073
gggcguuacagcugg

SEQ ID NO: 644600 - RNA, 11 nt, Escherichia coli CFT073
gggcgcgggca

SEQ ID NO: 644601 - RNA, 14 nt, Escherichia coli CFT073
gggauaugguggua

SEQ ID NO: 644602 - RNA, 17 nt, Escherichia coli CFT073
gggaucuuccaguucuu

SEQ ID NO: 644603 - RNA, 22 nt, Escherichia coli CFT073
gggauauccaccgucaaaucca

SEQ ID NO: 644604 - RNA, 15 nt, Escherichia coli CFT073
gggauaaagccccca

SEQ ID NO: 644605 - RNA, 19 nt, Escherichia coli CFT073
gggauaaagcccccacaac

SEQ ID NO: 644606 - RNA, 15 nt, Escherichia coli CFT073
gggaguugaucgcca

SEQ ID NO: 644607 - RNA, 17 nt, Escherichia coli CFT073
gggaguuggaguaaaac

SEQ ID NO: 644608 - RNA, 13 nt, Escherichia coli CFT073
gggcaccgccgcc

SEQ ID NO: 644609 - RNA, 18 nt, Escherichia coli CFT073
gggaggcugcauuaucca

SEQ ID NO: 644610 - RNA, 15 nt, Escherichia coli CFT073
gggaaaucaccacca

SEQ ID NO: 644611 - RNA, 23 nt, Escherichia coli CFT073
gggcaggcuucaacacaggccgg

SEQ ID NO: 644612 - RNA, 17 nt, Escherichia coli CFT073
gggcaggcagaauuaau

SEQ ID NO: 644613 - RNA, 14 nt, Escherichia coli CFT073
gggcaggccagggu

SEQ ID NO: 644614 - RNA, 19 nt, Escherichia coli CFT073
gggcaucgcaaccacacag

SEQ ID NO: 644615 - RNA, 19 nt, Escherichia coli CFT073
gggcauguguuagcccugu

SEQ ID NO: 644616 - RNA, 21 nt, Escherichia coli CFT073
gggccacagauucaauacuuc

SEQ ID NO: 644617 - RNA, 22 nt, Escherichia coli CFT073
gggcauuuuccagugacauacu

SEQ ID NO: 644618 - RNA, 16 nt, Escherichia coli CFT073
ggcugcugccagcaug

SEQ ID NO: 644619 - RNA, 15 nt, Escherichia coli CFT073
ggcugcguuucaugu

SEQ ID NO: 644620 - RNA, 23 nt, Escherichia coli CFT073
ggcugcgggaguugcuccacugc

SEQ ID NO: 644621 - RNA, 14 nt, Escherichia coli CFT073
ggcugcgcgacggc

SEQ ID NO: 644622 - RNA, 22 nt, Escherichia coli CFT073
ggcugcggacgaccaauuaaau

SEQ ID NO: 644623 - RNA, 22 nt, Escherichia coli CFT073
ggcugcaugccuaaagugcugg

SEQ ID NO: 644624 - RNA, 12 nt, Escherichia coli CFT073
ggcugcaguggu

SEQ ID NO: 644625 - RNA, 19 nt, Escherichia coli CFT073
ggcugccagcucucagaca

SEQ ID NO: 644626 - RNA, 13 nt, Escherichia coli CFT073
ggcugccaugguu

SEQ ID NO: 644627 - RNA, 12 nt, Escherichia coli CFT073
ggcuggcacugg

SEQ ID NO: 644628 - RNA, 14 nt, Escherichia coli CFT073
ggcuggcacuggca

SEQ ID NO: 644629 - RNA, 18 nt, Escherichia coli CFT073
ggcuggcgcuacugaagc

SEQ ID NO: 644630 - RNA, 20 nt, Escherichia coli CFT073
ggcuggcggcaaucgccaga

SEQ ID NO: 644631 - RNA, 21 nt, Escherichia coli CFT073
ggcuucuaccuuauccagcag

SEQ ID NO: 644632 - RNA, 15 nt, Escherichia coli CFT073
ggcuucgucgccagc

SEQ ID NO: 644633 - RNA, 16 nt, Escherichia coli CFT073
ggcuucggcguccagu

SEQ ID NO: 644634 - RNA, 16 nt, Escherichia coli CFT073
ggcuugugcgcccggc

SEQ ID NO: 644635 - RNA, 19 nt, Escherichia coli CFT073
ggcuuuuuuacaucaucag

SEQ ID NO: 644636 - RNA, 12 nt, Escherichia coli CFT073
ggcuuuuuucau

SEQ ID NO: 644637 - RNA, 14 nt, Escherichia coli CFT073
ggcuuuuuucucaa

SEQ ID NO: 644638 - RNA, 18 nt, Escherichia coli CFT073
ggcuguuuacauggcaga

SEQ ID NO: 644639 - RNA, 17 nt, Escherichia coli CFT073
ggcuguuuucagcacca

SEQ ID NO: 644640 - RNA, 20 nt, Escherichia coli CFT073
ggcugguagcgauauuucgu

SEQ ID NO: 644641 - RNA, 22 nt, Escherichia coli CFT073
ggcuggguagcuuccugcuguu

SEQ ID NO: 644642 - RNA, 18 nt, Escherichia coli CFT073
ggcugguuuucagcgaaa

SEQ ID NO: 644643 - RNA, 16 nt, Escherichia coli CFT073
ggcucauaccuuccac

SEQ ID NO: 644644 - RNA, 23 nt, Escherichia coli CFT073
ggcucauaucuucuccugucaug

SEQ ID NO: 644645 - RNA, 12 nt, Escherichia coli CFT073
ggcucagcucug

SEQ ID NO: 644646 - RNA, 20 nt, Escherichia coli CFT073
ggcucauccccugaugcugu

SEQ ID NO: 644647 - RNA, 13 nt, Escherichia coli CFT073
ggcucaucaaaca

SEQ ID NO: 644648 - RNA, 21 nt, Escherichia coli CFT073
ggcucaucaaacaacggcacu

SEQ ID NO: 644649 - RNA, 12 nt, Escherichia coli CFT073
ggcuauucuggc

SEQ ID NO: 644650 - RNA, 21 nt, Escherichia coli CFT073
ggcuccauagggcagggugcc

SEQ ID NO: 644651 - RNA, 16 nt, Escherichia coli CFT073
ggcuccuguuugcauu

SEQ ID NO: 644652 - RNA, 23 nt, Escherichia coli CFT073
ggcugaccgucgcagccagcgca

SEQ ID NO: 644653 - RNA, 19 nt, Escherichia coli CFT073
ggcugacguuaagaaaacg

SEQ ID NO: 644654 - RNA, 15 nt, Escherichia coli CFT073
ggcugaauaaaagcu

SEQ ID NO: 644655 - RNA, 18 nt, Escherichia coli CFT073
ggcugacauuaucagaca

SEQ ID NO: 644656 - RNA, 16 nt, Escherichia coli CFT073
ggcugauguugauaaa

SEQ ID NO: 644657 - RNA, 14 nt, Escherichia coli CFT073
ggcugauuacccac

SEQ ID NO: 644658 - RNA, 15 nt, Escherichia coli CFT073
ggcugcacuuucagu

SEQ ID NO: 644659 - RNA, 19 nt, Escherichia coli CFT073
ggcgacacaucuaaugcuu

SEQ ID NO: 644660 - RNA, 13 nt, Escherichia coli CFT073
ggcgacaggaacc

SEQ ID NO: 644661 - RNA, 13 nt, Escherichia coli CFT073
ggcgaauuccuga

SEQ ID NO: 644662 - RNA, 23 nt, Escherichia coli CFT073
ggcgacaaagccucuauggaagu

SEQ ID NO: 644663 - RNA, 13 nt, Escherichia coli CFT073
ggcgacaaagugg

SEQ ID NO: 644664 - RNA, 18 nt, Escherichia coli CFT073
ggcgacaauaaucguucc

SEQ ID NO: 644665 - RNA, 16 nt, Escherichia coli CFT073
ggcgaacgagauaaug

SEQ ID NO: 644666 - RNA, 23 nt, Escherichia coli CFT073
ggcgaacucuuccggcagggugu

SEQ ID NO: 644667 - RNA, 14 nt, Escherichia coli CFT073
ggcgaaaagcuucu

SEQ ID NO: 644668 - RNA, 15 nt, Escherichia coli CFT073
ggcgaaagcgucagc

SEQ ID NO: 644669 - RNA, 11 nt, Escherichia coli CFT073
ggcgaaagggc

SEQ ID NO: 644670 - RNA, 16 nt, Escherichia coli CFT073
ggcgaaacaauccagc

SEQ ID NO: 644671 - RNA, 23 nt, Escherichia coli CFT073
ggcgaccguaaauucucccgccc

SEQ ID NO: 644672 - RNA, 21 nt, Escherichia coli CFT073
ggcgaccguucgccaggucag

SEQ ID NO: 644673 - RNA, 21 nt, Escherichia coli CFT073
ggcgaccguuuucaccaguug

SEQ ID NO: 644674 - RNA, 16 nt, Escherichia coli CFT073
ggcgagcgccagcaug

SEQ ID NO: 644675 - RNA, 15 nt, Escherichia coli CFT073
ggcgagccagcgcau

SEQ ID NO: 644676 - RNA, 18 nt, Escherichia coli CFT073
ggcgagaacgccuuaucc

SEQ ID NO: 644677 - RNA, 20 nt, Escherichia coli CFT073
ggcgacucgguugcacagac

SEQ ID NO: 644678 - RNA, 14 nt, Escherichia coli CFT073
ggcgacugccagcc

SEQ ID NO: 644679 - RNA, 18 nt, Escherichia coli CFT073
ggccuugauuauuucccu

SEQ ID NO: 644680 - RNA, 21 nt, Escherichia coli CFT073
ggccugaugagcggagcacau

SEQ ID NO: 644681 - RNA, 23 nt, Escherichia coli CFT073
ggccugaugagcggagcacauca

SEQ ID NO: 644682 - RNA, 13 nt, Escherichia coli CFT073
ggccugcgaccag

SEQ ID NO: 644683 - RNA, 20 nt, Escherichia coli CFT073
ggccucugccagcugcucau

SEQ ID NO: 644684 - RNA, 15 nt, Escherichia coli CFT073
ggccugaacaagcaa

SEQ ID NO: 644685 - RNA, 18 nt, Escherichia coli CFT073
ggccugaauacacaucag

SEQ ID NO: 644686 - RNA, 21 nt, Escherichia coli CFT073
ggccugagaagcgcagcgcau

SEQ ID NO: 644687 - RNA, 14 nt, Escherichia coli CFT073
ggccuccugcagcg

SEQ ID NO: 644688 - RNA, 20 nt, Escherichia coli CFT073
ggccuccggcacuaacgcaa

SEQ ID NO: 644689 - RNA, 22 nt, Escherichia coli CFT073
ggccucaagcuuacugagcaga

SEQ ID NO: 644690 - RNA, 14 nt, Escherichia coli CFT073
ggccuacgggaaca

SEQ ID NO: 644691 - RNA, 19 nt, Escherichia coli CFT073
ggccuacaugauuucugca

SEQ ID NO: 644692 - RNA, 19 nt, Escherichia coli CFT073
ggccuacaugccaucacac

SEQ ID NO: 644693 - RNA, 17 nt, Escherichia coli CFT073
ggccuaccggacggcuc

SEQ ID NO: 644694 - RNA, 13 nt, Escherichia coli CFT073
ggccguuccggca

SEQ ID NO: 644695 - RNA, 16 nt, Escherichia coli CFT073
ggcgcgaugacagcgu

SEQ ID NO: 644696 - RNA, 17 nt, Escherichia coli CFT073
ggcgcgaugacagcgug

SEQ ID NO: 644697 - RNA, 18 nt, Escherichia coli CFT073
ggcgauaaucagcgccag

SEQ ID NO: 644698 - RNA, 20 nt, Escherichia coli CFT073
ggcgauaaucagcgccagcg

SEQ ID NO: 644699 - RNA, 18 nt, Escherichia coli CFT073
ggcgauaaacagcacguu

SEQ ID NO: 644700 - RNA, 23 nt, Escherichia coli CFT073
ggcgaggggacgguccgugcgcu

SEQ ID NO: 644701 - RNA, 21 nt, Escherichia coli CFT073
ggcgaucgacgugggcguggg

SEQ ID NO: 644702 - RNA, 17 nt, Escherichia coli CFT073
ggcgaucccuaccacga

SEQ ID NO: 644703 - RNA, 13 nt, Escherichia coli CFT073
ggcgaucagugau

SEQ ID NO: 644704 - RNA, 19 nt, Escherichia coli CFT073
ggcgaucauauccagcauc

SEQ ID NO: 644705 - RNA, 21 nt, Escherichia coli CFT073
ggcgcaaacgacgggcgcugg

SEQ ID NO: 644706 - RNA, 12 nt, Escherichia coli CFT073
ggcgauuucaga

SEQ ID NO: 644707 - RNA, 14 nt, Escherichia coli CFT073
ggcgauucagcaac

SEQ ID NO: 644708 - RNA, 13 nt, Escherichia coli CFT073
ggcgauuccacuc

SEQ ID NO: 644709 - RNA, 21 nt, Escherichia coli CFT073
ggcgaugcuuugaccucccgc

SEQ ID NO: 644710 - RNA, 13 nt, Escherichia coli CFT073
ggcgaugcugcgu

SEQ ID NO: 644711 - RNA, 12 nt, Escherichia coli CFT073
ggcgcagcgcgc

SEQ ID NO: 644712 - RNA, 17 nt, Escherichia coli CFT073
ggcgcagcaguucgccg

SEQ ID NO: 644713 - RNA, 14 nt, Escherichia coli CFT073
ggcgcagcaauuau

SEQ ID NO: 644714 - RNA, 23 nt, Escherichia coli CFT073
ggcgcacguucugucgcucugcu

SEQ ID NO: 644715 - RNA, 14 nt, Escherichia coli CFT073
ggcgcacgcggcuc

SEQ ID NO: 644716 - RNA, 20 nt, Escherichia coli CFT073
ggcgcagcuaauugauugua

SEQ ID NO: 644717 - RNA, 19 nt, Escherichia coli CFT073
ggcgcauucgaucaccgca

SEQ ID NO: 644718 - RNA, 16 nt, Escherichia coli CFT073
ggcgcauugcuggcug

SEQ ID NO: 644719 - RNA, 20 nt, Escherichia coli CFT073
ggcgcauguuggcgcgguga

SEQ ID NO: 644720 - RNA, 22 nt, Escherichia coli CFT073
ggcgucgauugcucaacaccgu

SEQ ID NO: 644721 - RNA, 18 nt, Escherichia coli CFT073
ggcgucgaucucuuccac

SEQ ID NO: 644722 - RNA, 18 nt, Escherichia coli CFT073
ggcgugaacgccuuaucc

SEQ ID NO: 644723 - RNA, 19 nt, Escherichia coli CFT073
ggcgucuuguugaacagac

SEQ ID NO: 644724 - RNA, 18 nt, Escherichia coli CFT073
ggcgugaacaccuuaucc

SEQ ID NO: 644725 - RNA, 12 nt, Escherichia coli CFT073
ggcguggaaacg

SEQ ID NO: 644726 - RNA, 20 nt, Escherichia coli CFT073
ggcguggccccaggcauaga

SEQ ID NO: 644727 - RNA, 23 nt, Escherichia coli CFT073
ggcguguugauacacaccgagcg

SEQ ID NO: 644728 - RNA, 16 nt, Escherichia coli CFT073
ggcguggugcagccgc

SEQ ID NO: 644729 - RNA, 20 nt, Escherichia coli CFT073
ggcgugcucacugaaaucuc

SEQ ID NO: 644730 - RNA, 20 nt, Escherichia coli CFT073
ggcgugauaaaagucaggca

SEQ ID NO: 644731 - RNA, 12 nt, Escherichia coli CFT073
ggcuaacagucu

SEQ ID NO: 644732 - RNA, 16 nt, Escherichia coli CFT073
ggcuaaccaaacuuca

SEQ ID NO: 644733 - RNA, 22 nt, Escherichia coli CFT073
ggcguuuuuucaucacugcgcu

SEQ ID NO: 644734 - RNA, 12 nt, Escherichia coli CFT073
ggcuaaaaaaag

SEQ ID NO: 644735 - RNA, 19 nt, Escherichia coli CFT073
ggcuaaaaaaagccaccac

SEQ ID NO: 644736 - RNA, 12 nt, Escherichia coli CFT073
ggcguuuugcuu

SEQ ID NO: 644737 - RNA, 23 nt, Escherichia coli CFT073
ggcguuuuuaucgcccacgcacc

SEQ ID NO: 644738 - RNA, 16 nt, Escherichia coli CFT073
ggcguuauggcaaucu

SEQ ID NO: 644739 - RNA, 14 nt, Escherichia coli CFT073
ggcguuacagcugg

SEQ ID NO: 644740 - RNA, 20 nt, Escherichia coli CFT073
ggcguuaucggguccgggca

SEQ ID NO: 644741 - RNA, 14 nt, Escherichia coli CFT073
ggcuaccgcaguga

SEQ ID NO: 644742 - RNA, 16 nt, Escherichia coli CFT073
ggcuacacuuucugca

SEQ ID NO: 644743 - RNA, 18 nt, Escherichia coli CFT073
ggcuaacgagcaguuugg

SEQ ID NO: 644744 - RNA, 15 nt, Escherichia coli CFT073
ggcuagccucccugc

SEQ ID NO: 644745 - RNA, 19 nt, Escherichia coli CFT073
ggcuaucuucgauaaacuc

SEQ ID NO: 644746 - RNA, 12 nt, Escherichia coli CFT073
ggcuaugcugga

SEQ ID NO: 644747 - RNA, 18 nt, Escherichia coli CFT073
ggcggcuuuuugugaacc

SEQ ID NO: 644748 - RNA, 15 nt, Escherichia coli CFT073
ggcgguaaagaaauc

SEQ ID NO: 644749 - RNA, 22 nt, Escherichia coli CFT073
ggcggguuaaccagcaccagcu

SEQ ID NO: 644750 - RNA, 21 nt, Escherichia coli CFT073
ggcggucugcgaugaucgccg

SEQ ID NO: 644751 - RNA, 13 nt, Escherichia coli CFT073
ggcguacagcugg

SEQ ID NO: 644752 - RNA, 13 nt, Escherichia coli CFT073
ggcgucagcggcu

SEQ ID NO: 644753 - RNA, 22 nt, Escherichia coli CFT073
ggcgucaguagcguaaaggcug

SEQ ID NO: 644754 - RNA, 14 nt, Escherichia coli CFT073
ggcguccaccugcg

SEQ ID NO: 644755 - RNA, 13 nt, Escherichia coli CFT073
ggcguaucuccag

SEQ ID NO: 644756 - RNA, 18 nt, Escherichia coli CFT073
ggcguauauugguaggcu

SEQ ID NO: 644757 - RNA, 23 nt, Escherichia coli CFT073
ggcguauucggcagacguaaugu

SEQ ID NO: 644758 - RNA, 13 nt, Escherichia coli CFT073
ggcggaugcagga

SEQ ID NO: 644759 - RNA, 17 nt, Escherichia coli CFT073
ggcggauggaguggggc

SEQ ID NO: 644760 - RNA, 14 nt, Escherichia coli CFT073
ggcggcacagccag

SEQ ID NO: 644761 - RNA, 15 nt, Escherichia coli CFT073
ggcggcacagccagc

SEQ ID NO: 644762 - RNA, 22 nt, Escherichia coli CFT073
ggcggcacaggucgcccccggc

SEQ ID NO: 644763 - RNA, 23 nt, Escherichia coli CFT073
ggcggcaaagcgcaucagcuuac

SEQ ID NO: 644764 - RNA, 16 nt, Escherichia coli CFT073
ggcggcaguauuuuua

SEQ ID NO: 644765 - RNA, 12 nt, Escherichia coli CFT073
ggcggcgacugg

SEQ ID NO: 644766 - RNA, 14 nt, Escherichia coli CFT073
ggcggcucaccugc

SEQ ID NO: 644767 - RNA, 18 nt, Escherichia coli CFT073
ggcggcgucagcggcugu

SEQ ID NO: 644768 - RNA, 23 nt, Escherichia coli CFT073
ggcgcgucuuauccgaccugcgg

SEQ ID NO: 644769 - RNA, 23 nt, Escherichia coli CFT073
ggcgcguguuccagagaacgacc

SEQ ID NO: 644770 - RNA, 22 nt, Escherichia coli CFT073
ggcgcucgcgccgcauccgaca

SEQ ID NO: 644771 - RNA, 15 nt, Escherichia coli CFT073
ggcgcugaaucccgc

SEQ ID NO: 644772 - RNA, 17 nt, Escherichia coli CFT073
ggcgcugaaucccgcaa

SEQ ID NO: 644773 - RNA, 15 nt, Escherichia coli CFT073
ggcgcuggcaaaaaa

SEQ ID NO: 644774 - RNA, 14 nt, Escherichia coli CFT073
ggcgcuuuuauccu

SEQ ID NO: 644775 - RNA, 16 nt, Escherichia coli CFT073
ggcgcuuugaaacgca

SEQ ID NO: 644776 - RNA, 14 nt, Escherichia coli CFT073
ggcgcuucggguuc

SEQ ID NO: 644777 - RNA, 17 nt, Escherichia coli CFT073
ggccguacagcccagga

SEQ ID NO: 644778 - RNA, 19 nt, Escherichia coli CFT073
ggccgcuuucagagcggcc

SEQ ID NO: 644779 - RNA, 13 nt, Escherichia coli CFT073
ggccggagccagu

SEQ ID NO: 644780 - RNA, 18 nt, Escherichia coli CFT073
ggcccgacgaugaccgca

SEQ ID NO: 644781 - RNA, 17 nt, Escherichia coli CFT073
ggcccuugcgcaaugag

SEQ ID NO: 644782 - RNA, 16 nt, Escherichia coli CFT073
ggccaauuggcuggcc

SEQ ID NO: 644783 - RNA, 14 nt, Escherichia coli CFT073
ggccaauuuggcug

SEQ ID NO: 644784 - RNA, 14 nt, Escherichia coli CFT073
ggccacagcgccag

SEQ ID NO: 644785 - RNA, 12 nt, Escherichia coli CFT073
ggccagccgccg

SEQ ID NO: 644786 - RNA, 17 nt, Escherichia coli CFT073
ggccagcgccaccacca

SEQ ID NO: 644787 - RNA, 17 nt, Escherichia coli CFT073
ggccagcguuuugcucu

SEQ ID NO: 644788 - RNA, 14 nt, Escherichia coli CFT073
ggccagcuccgccg

SEQ ID NO: 644789 - RNA, 21 nt, Escherichia coli CFT073
ggccagguuuucuuucaccuc

SEQ ID NO: 644790 - RNA, 20 nt, Escherichia coli CFT073
ggccauccgcgugacgcugg

SEQ ID NO: 644791 - RNA, 14 nt, Escherichia coli CFT073
ggccaucggcagcg

SEQ ID NO: 644792 - RNA, 23 nt, Escherichia coli CFT073
ggccagucguaaugaaucagcag

SEQ ID NO: 644793 - RNA, 22 nt, Escherichia coli CFT073
ggccaguccgucguucaacaag

SEQ ID NO: 644794 - RNA, 14 nt, Escherichia coli CFT073
ggccaguacgcggg

SEQ ID NO: 644795 - RNA, 19 nt, Escherichia coli CFT073
ggccaugauuaccagcauc

SEQ ID NO: 644796 - RNA, 14 nt, Escherichia coli CFT073
ggcaucaacgggug

SEQ ID NO: 644797 - RNA, 18 nt, Escherichia coli CFT073
ggcauaaaagggcagcag

SEQ ID NO: 644798 - RNA, 21 nt, Escherichia coli CFT073
ggcauaaaagggcagcaggau

SEQ ID NO: 644799 - RNA, 16 nt, Escherichia coli CFT073
ggcauaaagcugccuu

SEQ ID NO: 644800 - RNA, 20 nt, Escherichia coli CFT073
ggcaguuuuuuaacgccgcu

SEQ ID NO: 644801 - RNA, 15 nt, Escherichia coli CFT073
ggcaguuaccagggc

SEQ ID NO: 644802 - RNA, 13 nt, Escherichia coli CFT073
ggcaucagcaauu

SEQ ID NO: 644803 - RNA, 23 nt, Escherichia coli CFT073
ggcaucaccggaguaaagcacuu

SEQ ID NO: 644804 - RNA, 22 nt, Escherichia coli CFT073
ggcaggugacaccaccgcccgg

SEQ ID NO: 644805 - RNA, 15 nt, Escherichia coli CFT073
ggcagaagcagcagg

SEQ ID NO: 644806 - RNA, 21 nt, Escherichia coli CFT073
ggcagaaucuuaagucugcgu

SEQ ID NO: 644807 - RNA, 16 nt, Escherichia coli CFT073
ggcagaaugaaguaaa

SEQ ID NO: 644808 - RNA, 22 nt, Escherichia coli CFT073
ggcagaaugguaacaccagagu

SEQ ID NO: 644809 - RNA, 22 nt, Escherichia coli CFT073
ggcaggcuucaacacaggccgg

SEQ ID NO: 644810 - RNA, 16 nt, Escherichia coli CFT073
ggcacuuuuucaucag

SEQ ID NO: 644811 - RNA, 18 nt, Escherichia coli CFT073
ggcagaaaccaggucaau

SEQ ID NO: 644812 - RNA, 16 nt, Escherichia coli CFT073
ggcagaaacggcuucu

SEQ ID NO: 644813 - RNA, 17 nt, Escherichia coli CFT073
ggcacuguagcucgccu

SEQ ID NO: 644814 - RNA, 21 nt, Escherichia coli CFT073
ggcacuucuuccgccagcauc

SEQ ID NO: 644815 - RNA, 12 nt, Escherichia coli CFT073
ggcaugaaucau

SEQ ID NO: 644816 - RNA, 14 nt, Escherichia coli CFT073
ggcaugaaugguca

SEQ ID NO: 644817 - RNA, 12 nt, Escherichia coli CFT073
ggcaucuucccg

SEQ ID NO: 644818 - RNA, 12 nt, Escherichia coli CFT073
ggcaugauucau

SEQ ID NO: 644819 - RNA, 22 nt, Escherichia coli CFT073
ggcaugagccgcuugugccacc

SEQ ID NO: 644820 - RNA, 19 nt, Escherichia coli CFT073
ggcauugauucgccgccgc

SEQ ID NO: 644821 - RNA, 19 nt, Escherichia coli CFT073
ggcauuuccacuggcaaca

SEQ ID NO: 644822 - RNA, 19 nt, Escherichia coli CFT073
ggcauuguguagggcagcg

SEQ ID NO: 644823 - RNA, 21 nt, Escherichia coli CFT073
ggcauuguuuuuaucccggca

SEQ ID NO: 644824 - RNA, 13 nt, Escherichia coli CFT073
ggcauuuuuugca

SEQ ID NO: 644825 - RNA, 14 nt, Escherichia coli CFT073
ggccaaaagcacaa

SEQ ID NO: 644826 - RNA, 14 nt, Escherichia coli CFT073
ggccaaaucgccau

SEQ ID NO: 644827 - RNA, 15 nt, Escherichia coli CFT073
ggccaacaaaaaauu

SEQ ID NO: 644828 - RNA, 15 nt, Escherichia coli CFT073
ggccaaagaccagga

SEQ ID NO: 644829 - RNA, 21 nt, Escherichia coli CFT073
ggccaaagcauucguaaugaa

SEQ ID NO: 644830 - RNA, 17 nt, Escherichia coli CFT073
ggccaaagccgccgagc

SEQ ID NO: 644831 - RNA, 22 nt, Escherichia coli CFT073
ggccaaaguuccgggauauaaa

SEQ ID NO: 644832 - RNA, 12 nt, Escherichia coli CFT073
ggcacaaagucg

SEQ ID NO: 644833 - RNA, 23 nt, Escherichia coli CFT073
ggcaauuagcuggaauaauaacu

SEQ ID NO: 644834 - RNA, 20 nt, Escherichia coli CFT073
ggcaauucuuuccguuuuca

SEQ ID NO: 644835 - RNA, 15 nt, Escherichia coli CFT073
ggcaauugcaccgcg

SEQ ID NO: 644836 - RNA, 14 nt, Escherichia coli CFT073
ggcaauuggcacau

SEQ ID NO: 644837 - RNA, 17 nt, Escherichia coli CFT073
ggcaauuuaccgccgau

SEQ ID NO: 644838 - RNA, 17 nt, Escherichia coli CFT073
ggcaaugucaagugaau

SEQ ID NO: 644839 - RNA, 23 nt, Escherichia coli CFT073
ggcaaugguguccaaaugcagca

SEQ ID NO: 644840 - RNA, 22 nt, Escherichia coli CFT073
ggcaaugcgaucccgacaauca

SEQ ID NO: 644841 - RNA, 13 nt, Escherichia coli CFT073
ggcaaugcccggu

SEQ ID NO: 644842 - RNA, 15 nt, Escherichia coli CFT073
ggcacaccaacuuca

SEQ ID NO: 644843 - RNA, 15 nt, Escherichia coli CFT073
ggcacugcgaucccg

SEQ ID NO: 644844 - RNA, 13 nt, Escherichia coli CFT073
ggcacggaaagca

SEQ ID NO: 644845 - RNA, 18 nt, Escherichia coli CFT073
ggcaccgguacacaaccg

SEQ ID NO: 644846 - RNA, 17 nt, Escherichia coli CFT073
ggcaaucacauccacca

SEQ ID NO: 644847 - RNA, 19 nt, Escherichia coli CFT073
ggcaaucaacagauaaaug

SEQ ID NO: 644848 - RNA, 17 nt, Escherichia coli CFT073
ggcaauccccgccagca

SEQ ID NO: 644849 - RNA, 17 nt, Escherichia coli CFT073
ggcaaucauucccagac

SEQ ID NO: 644850 - RNA, 21 nt, Escherichia coli CFT073
ggcaaucuuuaccggucagga

SEQ ID NO: 644851 - RNA, 14 nt, Escherichia coli CFT073
ggcaaugaaacuca

SEQ ID NO: 644852 - RNA, 22 nt, Escherichia coli CFT073
ggcaauauagauaucaugcucu

SEQ ID NO: 644853 - RNA, 16 nt, Escherichia coli CFT073
ggcaauaacucccagg

SEQ ID NO: 644854 - RNA, 22 nt, Escherichia coli CFT073
ggcaauacgauccugagcagca

SEQ ID NO: 644855 - RNA, 15 nt, Escherichia coli CFT073
ggcaaguagcgccag

SEQ ID NO: 644856 - RNA, 14 nt, Escherichia coli CFT073
ggcaagugucgccu

SEQ ID NO: 644857 - RNA, 15 nt, Escherichia coli CFT073
ggcaauaaacagcac

SEQ ID NO: 644858 - RNA, 14 nt, Escherichia coli CFT073
ggcaaguucuuuug

SEQ ID NO: 644859 - RNA, 16 nt, Escherichia coli CFT073
ggcaagaauccgcccc

SEQ ID NO: 644860 - RNA, 12 nt, Escherichia coli CFT073
ggcaacugcugc

SEQ ID NO: 644861 - RNA, 19 nt, Escherichia coli CFT073
ggcaagaaaaugagcauca

SEQ ID NO: 644862 - RNA, 19 nt, Escherichia coli CFT073
ggcaacggcguuaagcaag

SEQ ID NO: 644863 - RNA, 17 nt, Escherichia coli CFT073
ggcaacgucagucccaa

SEQ ID NO: 644864 - RNA, 21 nt, Escherichia coli CFT073
ggcaagaucgcgaugagucgc

SEQ ID NO: 644865 - RNA, 19 nt, Escherichia coli CFT073
ggcaagcgucgcaucaggc

SEQ ID NO: 644866 - RNA, 21 nt, Escherichia coli CFT073
ggcaaggcugucgcaaauucg

SEQ ID NO: 644867 - RNA, 21 nt, Escherichia coli CFT073
ggcaaagccucccgcaacaua

SEQ ID NO: 644868 - RNA, 19 nt, Escherichia coli CFT073
ggcaaagcgacgugcagua

SEQ ID NO: 644869 - RNA, 20 nt, Escherichia coli CFT073
ggcaaaaacccuucuuccau

SEQ ID NO: 644870 - RNA, 14 nt, Escherichia coli CFT073
ggauuuuuuuauuu

SEQ ID NO: 644871 - RNA, 13 nt, Escherichia coli CFT073
ggcaaagucuuca

SEQ ID NO: 644872 - RNA, 14 nt, Escherichia coli CFT073
ggcaaaucaaauca

SEQ ID NO: 644873 - RNA, 12 nt, Escherichia coli CFT073
ggcaaaaaaguc

SEQ ID NO: 644874 - RNA, 18 nt, Escherichia coli CFT073
ggauuuuuaugacgcugg

SEQ ID NO: 644875 - RNA, 13 nt, Escherichia coli CFT073
ggauuuuuuauug

SEQ ID NO: 644876 - RNA, 15 nt, Escherichia coli CFT073
ggauuuaaugccaau

SEQ ID NO: 644877 - RNA, 15 nt, Escherichia coli CFT073
ggauuuacuaaaacu

SEQ ID NO: 644878 - RNA, 15 nt, Escherichia coli CFT073
ggcaacaaaagcgag

SEQ ID NO: 644879 - RNA, 23 nt, Escherichia coli CFT073
ggcaacaucaaaucacagcaccu

SEQ ID NO: 644880 - RNA, 12 nt, Escherichia coli CFT073
ggcaacagccau

SEQ ID NO: 644881 - RNA, 17 nt, Escherichia coli CFT073
ggcaaccagcagcauca

SEQ ID NO: 644882 - RNA, 20 nt, Escherichia coli CFT073
ggcaaccagcagcaucacca

SEQ ID NO: 644883 - RNA, 20 nt, Escherichia coli CFT073
ggcaaccagcggcuacugau

SEQ ID NO: 644884 - RNA, 14 nt, Escherichia coli CFT073
ggcaaccucuggug

SEQ ID NO: 644885 - RNA, 20 nt, Escherichia coli CFT073
ggcaacgaccgcgagcaaaa

SEQ ID NO: 644886 - RNA, 21 nt, Escherichia coli CFT073
ggcaacgaccgcgagcaaaau

SEQ ID NO: 644887 - RNA, 23 nt, Escherichia coli CFT073
ggaugauuaccggagcugcagcc

SEQ ID NO: 644888 - RNA, 17 nt, Escherichia coli CFT073
ggaugcccccagauugu

SEQ ID NO: 644889 - RNA, 22 nt, Escherichia coli CFT073
ggaugcaaacgauuaucaacac

SEQ ID NO: 644890 - RNA, 17 nt, Escherichia coli CFT073
ggaugcaucuucauuaa

SEQ ID NO: 644891 - RNA, 20 nt, Escherichia coli CFT073
ggaucugauuuucuuccagu

SEQ ID NO: 644892 - RNA, 21 nt, Escherichia coli CFT073
ggaucugauuuucuuccagua

SEQ ID NO: 644893 - RNA, 16 nt, Escherichia coli CFT073
ggaugagucggcguau

SEQ ID NO: 644894 - RNA, 22 nt, Escherichia coli CFT073
ggaugauagccaugaaaaaguu

SEQ ID NO: 644895 - RNA, 20 nt, Escherichia coli CFT073
ggaucacaucauaaauaaga

SEQ ID NO: 644896 - RNA, 19 nt, Escherichia coli CFT073
ggaucaauccccagaugcu

SEQ ID NO: 644897 - RNA, 21 nt, Escherichia coli CFT073
ggaucaauuaauccuuucgaa

SEQ ID NO: 644898 - RNA, 14 nt, Escherichia coli CFT073
ggaucacaucgccg

SEQ ID NO: 644899 - RNA, 21 nt, Escherichia coli CFT073
ggaucaccagaccaauggcuu

SEQ ID NO: 644900 - RNA, 18 nt, Escherichia coli CFT073
ggauuauccagccaggcg

SEQ ID NO: 644901 - RNA, 20 nt, Escherichia coli CFT073
ggauuagaacuaaaggcugu

SEQ ID NO: 644902 - RNA, 20 nt, Escherichia coli CFT073
ggauuacccggcaucauuau

SEQ ID NO: 644903 - RNA, 12 nt, Escherichia coli CFT073
ggauggcggcuu

SEQ ID NO: 644904 - RNA, 19 nt, Escherichia coli CFT073
ggauggcgcucugcuagau

SEQ ID NO: 644905 - RNA, 19 nt, Escherichia coli CFT073
ggauggcgauacucugcca

SEQ ID NO: 644906 - RNA, 22 nt, Escherichia coli CFT073
ggauggcgaugcugcguugaaa

SEQ ID NO: 644907 - RNA, 22 nt, Escherichia coli CFT073
ggauacgguuuuuugaacagac

SEQ ID NO: 644908 - RNA, 18 nt, Escherichia coli CFT073
ggauacgcugacgugcug

SEQ ID NO: 644909 - RNA, 12 nt, Escherichia coli CFT073
ggauagaguguu

SEQ ID NO: 644910 - RNA, 17 nt, Escherichia coli CFT073
ggauauuuuccagcaac

SEQ ID NO: 644911 - RNA, 20 nt, Escherichia coli CFT073
ggaucaaagucaucaacguu

SEQ ID NO: 644912 - RNA, 23 nt, Escherichia coli CFT073
ggauagccgccccagacuccagc

SEQ ID NO: 644913 - RNA, 16 nt, Escherichia coli CFT073
ggaguggcgaaauugg

SEQ ID NO: 644914 - RNA, 11 nt, Escherichia coli CFT073
ggagugcagca

SEQ ID NO: 644915 - RNA, 17 nt, Escherichia coli CFT073
ggaguauggcccagccu

SEQ ID NO: 644916 - RNA, 18 nt, Escherichia coli CFT073
ggaguaacaaaugugcca

SEQ ID NO: 644917 - RNA, 16 nt, Escherichia coli CFT073
ggaggcauagcguucg

SEQ ID NO: 644918 - RNA, 21 nt, Escherichia coli CFT073
ggaggagagugcaaugaaaaa

SEQ ID NO: 644919 - RNA, 19 nt, Escherichia coli CFT073
ggacgauaaaccaggccaa

SEQ ID NO: 644920 - RNA, 13 nt, Escherichia coli CFT073
ggacgaugaagcg

SEQ ID NO: 644921 - RNA, 20 nt, Escherichia coli CFT073
ggacucggacaaauccacug

SEQ ID NO: 644922 - RNA, 17 nt, Escherichia coli CFT073
ggacggucuaccaguuu

SEQ ID NO: 644923 - RNA, 22 nt, Escherichia coli CFT073
ggacgugcaccgucacuucuuc

SEQ ID NO: 644924 - RNA, 13 nt, Escherichia coli CFT073
ggagaucccguga

SEQ ID NO: 644925 - RNA, 13 nt, Escherichia coli CFT073
ggacuuuuuauuu

SEQ ID NO: 644926 - RNA, 18 nt, Escherichia coli CFT073
ggagaaauauaaagaaug

SEQ ID NO: 644927 - RNA, 18 nt, Escherichia coli CFT073
ggacuguagauauucagu

SEQ ID NO: 644928 - RNA, 20 nt, Escherichia coli CFT073
ggacuguucaccacugaaua

SEQ ID NO: 644929 - RNA, 19 nt, Escherichia coli CFT073
ggacuuaacgucacagaag

SEQ ID NO: 644930 - RNA, 17 nt, Escherichia coli CFT073
ggacuucaugcgcagca

SEQ ID NO: 644931 - RNA, 10 nt, Escherichia coli CFT073
ggaccacgga

SEQ ID NO: 644932 - RNA, 22 nt, Escherichia coli CFT073
ggacaugauuaccgcaaacuca

SEQ ID NO: 644933 - RNA, 22 nt, Escherichia coli CFT073
ggacauguugcuuaaugcggga

SEQ ID NO: 644934 - RNA, 14 nt, Escherichia coli CFT073
ggacauguuuucca

SEQ ID NO: 644935 - RNA, 22 nt, Escherichia coli CFT073
ggaccauucacacuccaguccc

SEQ ID NO: 644936 - RNA, 17 nt, Escherichia coli CFT073
ggaccaucuuccagcug

SEQ ID NO: 644937 - RNA, 21 nt, Escherichia coli CFT073
ggaccaucuuccagcugcacg

SEQ ID NO: 644938 - RNA, 22 nt, Escherichia coli CFT073
ggaccugcgucugaugaaagca

SEQ ID NO: 644939 - RNA, 15 nt, Escherichia coli CFT073
ggaaguguccaguug

SEQ ID NO: 644940 - RNA, 13 nt, Escherichia coli CFT073
ggaaguuacucaa

SEQ ID NO: 644941 - RNA, 21 nt, Escherichia coli CFT073
ggaaucgauaacugcucuccc

SEQ ID NO: 644942 - RNA, 19 nt, Escherichia coli CFT073
ggaaucgauuuucucacca

SEQ ID NO: 644943 - RNA, 16 nt, Escherichia coli CFT073
ggaauccgggucugua

SEQ ID NO: 644944 - RNA, 12 nt, Escherichia coli CFT073
ggaauagcucag

SEQ ID NO: 644945 - RNA, 18 nt, Escherichia coli CFT073
ggaauagcucaguuggua

SEQ ID NO: 644946 - RNA, 14 nt, Escherichia coli CFT073
ggaauaccacuuuc

SEQ ID NO: 644947 - RNA, 20 nt, Escherichia coli CFT073
ggaauagauuaugaaauuca

SEQ ID NO: 644948 - RNA, 18 nt, Escherichia coli CFT073
ggaauacguugcaaauau

SEQ ID NO: 644949 - RNA, 23 nt, Escherichia coli CFT073
ggacaaaagccccaggcgauauu

SEQ ID NO: 644950 - RNA, 20 nt, Escherichia coli CFT073
ggaaugacgggcaggcagaa

SEQ ID NO: 644951 - RNA, 19 nt, Escherichia coli CFT073
ggaaucuuuaaugacugaa

SEQ ID NO: 644952 - RNA, 18 nt, Escherichia coli CFT073
cugcgccuuugaugccac

SEQ ID NO: 644953 - RNA, 19 nt, Escherichia coli CFT073
cugcgccgggcagagucuc

SEQ ID NO: 644954 - RNA, 15 nt, Escherichia coli CFT073
cugcgcggugacauc

SEQ ID NO: 644955 - RNA, 16 nt, Escherichia coli CFT073
cugcgcggaauuuguc

SEQ ID NO: 644956 - RNA, 18 nt, Escherichia coli CFT073
cugcgcggaccccgcgcu

SEQ ID NO: 644957 - RNA, 14 nt, Escherichia coli CFT073
cugcgccagugccg

SEQ ID NO: 644958 - RNA, 16 nt, Escherichia coli CFT073
cugcgcauggaagcgc

SEQ ID NO: 644959 - RNA, 14 nt, Escherichia coli CFT073
cugcgcaucuuccc

SEQ ID NO: 644960 - RNA, 22 nt, Escherichia coli CFT073
cugcgcauuucccagcaagaac

SEQ ID NO: 644961 - RNA, 14 nt, Escherichia coli CFT073
cugcgcccgcccgc

SEQ ID NO: 644962 - RNA, 18 nt, Escherichia coli CFT073
cugcgaucgcaaauccac

SEQ ID NO: 644963 - RNA, 13 nt, Escherichia coli CFT073
cugcgcagcggug

SEQ ID NO: 644964 - RNA, 15 nt, Escherichia coli CFT073
cugccuuccuccggc

SEQ ID NO: 644965 - RNA, 22 nt, Escherichia coli CFT073
cugccuggauaaggccaccagc

SEQ ID NO: 644966 - RNA, 14 nt, Escherichia coli CFT073
cugccuccaugaaa

SEQ ID NO: 644967 - RNA, 19 nt, Escherichia coli CFT073
cugccucgggauccaugca

SEQ ID NO: 644968 - RNA, 23 nt, Escherichia coli CFT073
cugccguuaaagauaaugccagc

SEQ ID NO: 644969 - RNA, 15 nt, Escherichia coli CFT073
cugccguuccuggca

SEQ ID NO: 644970 - RNA, 14 nt, Escherichia coli CFT073
cugccguucucaaa

SEQ ID NO: 644971 - RNA, 18 nt, Escherichia coli CFT073
cugccguugaucugcccc

SEQ ID NO: 644972 - RNA, 18 nt, Escherichia coli CFT073
cugccgccagcauuguca

SEQ ID NO: 644973 - RNA, 13 nt, Escherichia coli CFT073
cugccccauagag

SEQ ID NO: 644974 - RNA, 23 nt, Escherichia coli CFT073
cugccaugaucaaauccaauaac

SEQ ID NO: 644975 - RNA, 11 nt, Escherichia coli CFT073
cugcccggcaa

SEQ ID NO: 644976 - RNA, 24 nt, Escherichia coli CFT073
cugcccggcaaacgucgcgcaugc

SEQ ID NO: 644977 - RNA, 16 nt, Escherichia coli CFT073
cugcccgccgcgagcu

SEQ ID NO: 644978 - RNA, 22 nt, Escherichia coli CFT073
cugccaguggagccaucaccau

SEQ ID NO: 644979 - RNA, 19 nt, Escherichia coli CFT073
cugccaucacuauucagau

SEQ ID NO: 644980 - RNA, 12 nt, Escherichia coli CFT073
cugccagaugca

SEQ ID NO: 644981 - RNA, 17 nt, Escherichia coli CFT073
cugccagauucuccagc

SEQ ID NO: 644982 - RNA, 15 nt, Escherichia coli CFT073
cugccagcacugcca

SEQ ID NO: 644983 - RNA, 13 nt, Escherichia coli CFT073
cugccagccacac

SEQ ID NO: 644984 - RNA, 20 nt, Escherichia coli CFT073
cugccagaaucgcaaccagc

SEQ ID NO: 644985 - RNA, 18 nt, Escherichia coli CFT073
cugccagacaaaacugac

SEQ ID NO: 644986 - RNA, 20 nt, Escherichia coli CFT073
cugccaauggcaggaucugg

SEQ ID NO: 644987 - RNA, 20 nt, Escherichia coli CFT073
cugccaaccaacgcgccgca

SEQ ID NO: 644988 - RNA, 23 nt, Escherichia coli CFT073
cugccaaccguaacgacggcuau

SEQ ID NO: 644989 - RNA, 23 nt, Escherichia coli CFT073
cugccaacgcaccguaacccuga

SEQ ID NO: 644990 - RNA, 21 nt, Escherichia coli CFT073
cugcagugcgcgaaccagaga

SEQ ID NO: 644991 - RNA, 12 nt, Escherichia coli CFT073
cugcaguaccag

SEQ ID NO: 644992 - RNA, 16 nt, Escherichia coli CFT073
cugcagguugcaguug

SEQ ID NO: 644993 - RNA, 14 nt, Escherichia coli CFT073
cugcagguuggcuu

SEQ ID NO: 644994 - RNA, 19 nt, Escherichia coli CFT073
cugcacaccaaccgcuucc

SEQ ID NO: 644995 - RNA, 17 nt, Escherichia coli CFT073
cugcacagagcuaugaa

SEQ ID NO: 644996 - RNA, 15 nt, Escherichia coli CFT073
cugcagggcuuuuua

SEQ ID NO: 644997 - RNA, 17 nt, Escherichia coli CFT073
cugcaaugccauucaca

SEQ ID NO: 644998 - RNA, 14 nt, Escherichia coli CFT073
cugcaauuucauuu

SEQ ID NO: 644999 - RNA, 13 nt, Escherichia coli CFT073
cugcaauuuccgc

SEQ ID NO: 645000 - RNA, 15 nt, Escherichia coli CFT073
cugcaauuugugcgu

SEQ ID NO: 645001 - RNA, 16 nt, Escherichia coli CFT073
cugcaaucuuuccugc

SEQ ID NO: 645002 - RNA, 22 nt, Escherichia coli CFT073
cugcaauguuaacuguuuaucg

SEQ ID NO: 645003 - RNA, 23 nt, Escherichia coli CFT073
cugcaauugcggcaggucaucgu

SEQ ID NO: 645004 - RNA, 13 nt, Escherichia coli CFT073
cugcauccguucu

SEQ ID NO: 645005 - RNA, 22 nt, Escherichia coli CFT073
cugcaugccuaaagugcugggc

SEQ ID NO: 645006 - RNA, 22 nt, Escherichia coli CFT073
cugcauggccagacauuacaaa

SEQ ID NO: 645007 - RNA, 16 nt, Escherichia coli CFT073
cugcaugacagcgccc

SEQ ID NO: 645008 - RNA, 21 nt, Escherichia coli CFT073
cugcaugaugucgaauuucuc

SEQ ID NO: 645009 - RNA, 13 nt, Escherichia coli CFT073
cugcaucuggcga

SEQ ID NO: 645010 - RNA, 18 nt, Escherichia coli CFT073
cugcauguaaccuaauuu

SEQ ID NO: 645011 - RNA, 23 nt, Escherichia coli CFT073
cugcauuccuuguuuaaggaaaa

SEQ ID NO: 645012 - RNA, 18 nt, Escherichia coli CFT073
cugcauucggcgaccagc

SEQ ID NO: 645013 - RNA, 18 nt, Escherichia coli CFT073
cugcauugcuuuuguggu

SEQ ID NO: 645014 - RNA, 19 nt, Escherichia coli CFT073
cugccaaacgcucccagcc

SEQ ID NO: 645015 - RNA, 22 nt, Escherichia coli CFT073
cugccaaacgcucccagccagu

SEQ ID NO: 645016 - RNA, 21 nt, Escherichia coli CFT073
cugcgcguuuuaucaggccuc

SEQ ID NO: 645017 - RNA, 19 nt, Escherichia coli CFT073
cugcgcgugaagcacguaa

SEQ ID NO: 645018 - RNA, 13 nt, Escherichia coli CFT073
cugcgcucuucug

SEQ ID NO: 645019 - RNA, 20 nt, Escherichia coli CFT073
cugcgcuuaucaggccuaaa

SEQ ID NO: 645020 - RNA, 16 nt, Escherichia coli CFT073
cugcgcuuccaguucc

SEQ ID NO: 645021 - RNA, 17 nt, Escherichia coli CFT073
cugcgggagaauugcca

SEQ ID NO: 645022 - RNA, 17 nt, Escherichia coli CFT073
cugcgggaguugcucca

SEQ ID NO: 645023 - RNA, 19 nt, Escherichia coli CFT073
cugcgggaacauaugcaca

SEQ ID NO: 645024 - RNA, 19 nt, Escherichia coli CFT073
cugcggugcgccaaacugc

SEQ ID NO: 645025 - RNA, 22 nt, Escherichia coli CFT073
cugcggugguaucgaucacuuu

SEQ ID NO: 645026 - RNA, 18 nt, Escherichia coli CFT073
cugcggugacguagcucg

SEQ ID NO: 645027 - RNA, 16 nt, Escherichia coli CFT073
cugcgcuucugccacg

SEQ ID NO: 645028 - RNA, 12 nt, Escherichia coli CFT073
cugcgcuggcag

SEQ ID NO: 645029 - RNA, 17 nt, Escherichia coli CFT073
cugcguuuugguggcga

SEQ ID NO: 645030 - RNA, 14 nt, Escherichia coli CFT073
cugcguuuucacag

SEQ ID NO: 645031 - RNA, 21 nt, Escherichia coli CFT073
cugcuaaaucggggaucauua

SEQ ID NO: 645032 - RNA, 21 nt, Escherichia coli CFT073
cugcucaaccgccaguucccc

SEQ ID NO: 645033 - RNA, 21 nt, Escherichia coli CFT073
cugcucaaucgaacgcagcaa

SEQ ID NO: 645034 - RNA, 13 nt, Escherichia coli CFT073
cugcucacaccau

SEQ ID NO: 645035 - RNA, 17 nt, Escherichia coli CFT073
cugcgucaucggcagca

SEQ ID NO: 645036 - RNA, 15 nt, Escherichia coli CFT073
cugcguuauuuucag

SEQ ID NO: 645037 - RNA, 15 nt, Escherichia coli CFT073
cugcguuccggcaug

SEQ ID NO: 645038 - RNA, 16 nt, Escherichia coli CFT073
cugcguugagaaacgc

SEQ ID NO: 645039 - RNA, 19 nt, Escherichia coli CFT073
cugcguagaguccagcgcc

SEQ ID NO: 645040 - RNA, 19 nt, Escherichia coli CFT073
cugcgguuugucaucauug

SEQ ID NO: 645041 - RNA, 18 nt, Escherichia coli CFT073
cugcguaauucgccaccg

SEQ ID NO: 645042 - RNA, 17 nt, Escherichia coli CFT073
cugcugcaaugccauuc

SEQ ID NO: 645043 - RNA, 12 nt, Escherichia coli CFT073
cugcugcacaua

SEQ ID NO: 645044 - RNA, 22 nt, Escherichia coli CFT073
aaacucaacgguccaaugguca

SEQ ID NO: 645045 - RNA, 17 nt, Escherichia coli CFT073
cugcucuugauccauua

SEQ ID NO: 645046 - RNA, 16 nt, Escherichia coli CFT073
aaacucacaaccaggg

SEQ ID NO: 645047 - RNA, 18 nt, Escherichia coli CFT073
cugcugccguugccgcuc

SEQ ID NO: 645048 - RNA, 16 nt, Escherichia coli CFT073
cugcucaggcagaaga

SEQ ID NO: 645049 - RNA, 11 nt, Escherichia coli CFT073
cugcucaggcg

SEQ ID NO: 645050 - RNA, 14 nt, Escherichia coli CFT073
cugcucuauugccg

SEQ ID NO: 645051 - RNA, 22 nt, Escherichia coli CFT073
cugcucuauugccguaaucgcc

SEQ ID NO: 645052 - RNA, 22 nt, Escherichia coli CFT073
cugcucugacauagacgccacc

SEQ ID NO: 645053 - RNA, 10 nt, Escherichia coli CFT073
cugcucuccc

SEQ ID NO: 645054 - RNA, 18 nt, Escherichia coli CFT073
cugcucggucugcugggc

SEQ ID NO: 645055 - RNA, 15 nt, Escherichia coli CFT073
cuggccaguccaggu

SEQ ID NO: 645056 - RNA, 19 nt, Escherichia coli CFT073
cuggccauggauucaagca

SEQ ID NO: 645057 - RNA, 21 nt, Escherichia coli CFT073
cuggccauugaauuaaaaugu

SEQ ID NO: 645058 - RNA, 19 nt, Escherichia coli CFT073
cuggcaauaauaucccaac

SEQ ID NO: 645059 - RNA, 21 nt, Escherichia coli CFT073
cuggcaauaauaucccaacgc

SEQ ID NO: 645060 - RNA, 15 nt, Escherichia coli CFT073
cuggcauuacaagaa

SEQ ID NO: 645061 - RNA, 16 nt, Escherichia coli CFT073
cuggcauuuugcugcu

SEQ ID NO: 645062 - RNA, 20 nt, Escherichia coli CFT073
cuggcaagaaacgcuccacc

SEQ ID NO: 645063 - RNA, 21 nt, Escherichia coli CFT073
cuggcaacacuuuaucugcca

SEQ ID NO: 645064 - RNA, 23 nt, Escherichia coli CFT073
cuggcaacacuuuaucugccauu

SEQ ID NO: 645065 - RNA, 22 nt, Escherichia coli CFT073
cuggcaacaacgcaacuccagc

SEQ ID NO: 645066 - RNA, 13 nt, Escherichia coli CFT073
cuggcaaaaacaa

SEQ ID NO: 645067 - RNA, 13 nt, Escherichia coli CFT073
cuggcaaaaauaa

SEQ ID NO: 645068 - RNA, 18 nt, Escherichia coli CFT073
cuggaugaaauccauauc

SEQ ID NO: 645069 - RNA, 16 nt, Escherichia coli CFT073
cuggauuugugucaga

SEQ ID NO: 645070 - RNA, 18 nt, Escherichia coli CFT073
cuggaucguggcugagug

SEQ ID NO: 645071 - RNA, 16 nt, Escherichia coli CFT073
cuggaucccagaagau

SEQ ID NO: 645072 - RNA, 21 nt, Escherichia coli CFT073
cuggaacacgcgcauauuguu

SEQ ID NO: 645073 - RNA, 21 nt, Escherichia coli CFT073
cuggaaaugaucccagaacca

SEQ ID NO: 645074 - RNA, 12 nt, Escherichia coli CFT073
cuggaaaggccg

SEQ ID NO: 645075 - RNA, 14 nt, Escherichia coli CFT073
cuggaaauagauuu

SEQ ID NO: 645076 - RNA, 16 nt, Escherichia coli CFT073
cuggacacugaauaaa

SEQ ID NO: 645077 - RNA, 18 nt, Escherichia coli CFT073
cuggaaacagccaaucau

SEQ ID NO: 645078 - RNA, 21 nt, Escherichia coli CFT073
cuggaaacagccaaucauaaa

SEQ ID NO: 645079 - RNA, 12 nt, Escherichia coli CFT073
cuggaaacgcga

SEQ ID NO: 645080 - RNA, 20 nt, Escherichia coli CFT073
cugcuuuguucagcccuucu

SEQ ID NO: 645081 - RNA, 12 nt, Escherichia coli CFT073
cugcuuuuucaa

SEQ ID NO: 645082 - RNA, 18 nt, Escherichia coli CFT073
cugcuuuuucaauuucca

SEQ ID NO: 645083 - RNA, 15 nt, Escherichia coli CFT073
cugcuuuuucaucau

SEQ ID NO: 645084 - RNA, 20 nt, Escherichia coli CFT073
cugcuuaucgcccugcucca

SEQ ID NO: 645085 - RNA, 15 nt, Escherichia coli CFT073
cugcuuaaauuucuu

SEQ ID NO: 645086 - RNA, 20 nt, Escherichia coli CFT073
cugcuuaagacguuguugaa

SEQ ID NO: 645087 - RNA, 19 nt, Escherichia coli CFT073
cugcuuucguaauaaauca

SEQ ID NO: 645088 - RNA, 23 nt, Escherichia coli CFT073
cugcuuuacccacgcuuuucauc

SEQ ID NO: 645089 - RNA, 16 nt, Escherichia coli CFT073
cugcuuuaucagauca

SEQ ID NO: 645090 - RNA, 18 nt, Escherichia coli CFT073
cugcugcguuccggcaug

SEQ ID NO: 645091 - RNA, 14 nt, Escherichia coli CFT073
cugaguuacgucca

SEQ ID NO: 645092 - RNA, 13 nt, Escherichia coli CFT073
cugaguuauuuca

SEQ ID NO: 645093 - RNA, 20 nt, Escherichia coli CFT073
cugagucggaacuuugcugc

SEQ ID NO: 645094 - RNA, 18 nt, Escherichia coli CFT073
cugagccaguuuuucuuu

SEQ ID NO: 645095 - RNA, 21 nt, Escherichia coli CFT073
cugagccaguuuuucuuuuuc

SEQ ID NO: 645096 - RNA, 14 nt, Escherichia coli CFT073
cugagcccacuguu

SEQ ID NO: 645097 - RNA, 13 nt, Escherichia coli CFT073
cugagcccgcuuc

SEQ ID NO: 645098 - RNA, 16 nt, Escherichia coli CFT073
cugagccgacgccagc

SEQ ID NO: 645099 - RNA, 19 nt, Escherichia coli CFT073
cugauaauccagacuauuu

SEQ ID NO: 645100 - RNA, 14 nt, Escherichia coli CFT073
cugauaauaaauaa

SEQ ID NO: 645101 - RNA, 22 nt, Escherichia coli CFT073
cugauaauaaauaacagugccg

SEQ ID NO: 645102 - RNA, 20 nt, Escherichia coli CFT073
cugauaauuucagcacuuga

SEQ ID NO: 645103 - RNA, 22 nt, Escherichia coli CFT073
cugauaaggaucuggauaaaua

SEQ ID NO: 645104 - RNA, 18 nt, Escherichia coli CFT073
cugauaaggcguuuacgc

SEQ ID NO: 645105 - RNA, 16 nt, Escherichia coli CFT073
cugaguuucagaccaa

SEQ ID NO: 645106 - RNA, 17 nt, Escherichia coli CFT073
cugauacaccuucaucg

SEQ ID NO: 645107 - RNA, 16 nt, Escherichia coli CFT073
cugauacuauucauug

SEQ ID NO: 645108 - RNA, 17 nt, Escherichia coli CFT073
cugauacuauucauugc

SEQ ID NO: 645109 - RNA, 21 nt, Escherichia coli CFT073
cugaucgauaaauucguuuuc

SEQ ID NO: 645110 - RNA, 17 nt, Escherichia coli CFT073
cugauccguaaaauacu

SEQ ID NO: 645111 - RNA, 20 nt, Escherichia coli CFT073
cugaucaccugcgauaaacc

SEQ ID NO: 645112 - RNA, 15 nt, Escherichia coli CFT073
cugaucaaagaccgg

SEQ ID NO: 645113 - RNA, 21 nt, Escherichia coli CFT073
cugaucaauaaauuuuuucug

SEQ ID NO: 645114 - RNA, 12 nt, Escherichia coli CFT073
cugaucaauaag

SEQ ID NO: 645115 - RNA, 11 nt, Escherichia coli CFT073
cugaucaccca

SEQ ID NO: 645116 - RNA, 14 nt, Escherichia coli CFT073
cugcaaauacccaa

SEQ ID NO: 645117 - RNA, 17 nt, Escherichia coli CFT073
cugcaaagcguacaacc

SEQ ID NO: 645118 - RNA, 17 nt, Escherichia coli CFT073
cugcaaaauaccaauaa

SEQ ID NO: 645119 - RNA, 14 nt, Escherichia coli CFT073
cugcaaggcucuau

SEQ ID NO: 645120 - RNA, 16 nt, Escherichia coli CFT073
cugcaagguggucaga

SEQ ID NO: 645121 - RNA, 23 nt, Escherichia coli CFT073
cugcaacucggcuauacgagcuu

SEQ ID NO: 645122 - RNA, 17 nt, Escherichia coli CFT073
cugcaacguuuuaagca

SEQ ID NO: 645123 - RNA, 22 nt, Escherichia coli CFT073
cugcaacguuuuaagcaaauaa

SEQ ID NO: 645124 - RNA, 14 nt, Escherichia coli CFT073
cugcaacugcugca

SEQ ID NO: 645125 - RNA, 12 nt, Escherichia coli CFT073
cugaugcgugcg

SEQ ID NO: 645126 - RNA, 21 nt, Escherichia coli CFT073
cugaugcgugcgccagagccc

SEQ ID NO: 645127 - RNA, 15 nt, Escherichia coli CFT073
cugauucgcuucaau

SEQ ID NO: 645128 - RNA, 16 nt, Escherichia coli CFT073
cugcaaaaaacagccg

SEQ ID NO: 645129 - RNA, 20 nt, Escherichia coli CFT073
cugcaaaaagccuugcugaa

SEQ ID NO: 645130 - RNA, 23 nt, Escherichia coli CFT073
cugauuuacuuacuucugcugca

SEQ ID NO: 645131 - RNA, 16 nt, Escherichia coli CFT073
cugauugcuggcgggc

SEQ ID NO: 645132 - RNA, 21 nt, Escherichia coli CFT073
cugauugucagguagguuggu

SEQ ID NO: 645133 - RNA, 15 nt, Escherichia coli CFT073
cugauuguucagucg

SEQ ID NO: 645134 - RNA, 15 nt, Escherichia coli CFT073
cugaugcccaaaaaa

SEQ ID NO: 645135 - RNA, 21 nt, Escherichia coli CFT073
cugaugcccaaaaaaacggca

SEQ ID NO: 645136 - RNA, 16 nt, Escherichia coli CFT073
cugaugcgacgcuggc

SEQ ID NO: 645137 - RNA, 22 nt, Escherichia coli CFT073
cugaugcgacgcuggcgcgucu

SEQ ID NO: 645138 - RNA, 23 nt, Escherichia coli CFT073
cugaugcgcugcgcuucucaggc

SEQ ID NO: 645139 - RNA, 15 nt, Escherichia coli CFT073
cugaucuuauugguu

SEQ ID NO: 645140 - RNA, 18 nt, Escherichia coli CFT073
cugaugcagcgucaguga

SEQ ID NO: 645141 - RNA, 24 nt, Escherichia coli CFT073
cugaugcagcgucagugacggcuu

SEQ ID NO: 645142 - RNA, 13 nt, Escherichia coli CFT073
cugagcaaacagu

SEQ ID NO: 645143 - RNA, 21 nt, Escherichia coli CFT073
cugagcaaacaguucugcagc

SEQ ID NO: 645144 - RNA, 15 nt, Escherichia coli CFT073
cugagcaagccuuac

SEQ ID NO: 645145 - RNA, 18 nt, Escherichia coli CFT073
cugagcaagccuuacuuc

SEQ ID NO: 645146 - RNA, 14 nt, Escherichia coli CFT073
cugagcaucacaua

SEQ ID NO: 645147 - RNA, 17 nt, Escherichia coli CFT073
cugagaauuccggcaga

SEQ ID NO: 645148 - RNA, 20 nt, Escherichia coli CFT073
cugagaauuccggcagagaa

SEQ ID NO: 645149 - RNA, 22 nt, Escherichia coli CFT073
cugagaauuccggcagagaaag

SEQ ID NO: 645150 - RNA, 19 nt, Escherichia coli CFT073
cugagacaaacagucucaa

SEQ ID NO: 645151 - RNA, 18 nt, Escherichia coli CFT073
cugagacagacagccuca

SEQ ID NO: 645152 - RNA, 20 nt, Escherichia coli CFT073
cugagaacuucggcagagaa

SEQ ID NO: 645153 - RNA, 12 nt, Escherichia coli CFT073
cugagaacaaga

SEQ ID NO: 645154 - RNA, 15 nt, Escherichia coli CFT073
cugacgcugcucagg

SEQ ID NO: 645155 - RNA, 20 nt, Escherichia coli CFT073
cugacgcgcuuuucaccgac

SEQ ID NO: 645156 - RNA, 17 nt, Escherichia coli CFT073
cugacgcggguauuuaa

SEQ ID NO: 645157 - RNA, 17 nt, Escherichia coli CFT073
cugacgccugccagcuc

SEQ ID NO: 645158 - RNA, 17 nt, Escherichia coli CFT073
cugacgaaggugccgga

SEQ ID NO: 645159 - RNA, 13 nt, Escherichia coli CFT073
cugaccuucuuca

SEQ ID NO: 645160 - RNA, 17 nt, Escherichia coli CFT073
cugacuacuuucaugcu

SEQ ID NO: 645161 - RNA, 17 nt, Escherichia coli CFT073
cugacuauccacuggaa

SEQ ID NO: 645162 - RNA, 15 nt, Escherichia coli CFT073
cugacuaagcgggau

SEQ ID NO: 645163 - RNA, 15 nt, Escherichia coli CFT073
cugacugaugacaaa

SEQ ID NO: 645164 - RNA, 23 nt, Escherichia coli CFT073
cugacugaugagaaauauuuuca

SEQ ID NO: 645165 - RNA, 12 nt, Escherichia coli CFT073
cugagaaaaugu

SEQ ID NO: 645166 - RNA, 16 nt, Escherichia coli CFT073
cugacugacgugauga

SEQ ID NO: 645167 - RNA, 22 nt, Escherichia coli CFT073
cugacugacuucaacaggaaaa

SEQ ID NO: 645168 - RNA, 20 nt, Escherichia coli CFT073
cugacugaguaauagccuga

SEQ ID NO: 645169 - RNA, 20 nt, Escherichia coli CFT073
cugacaccaucacccaacaa

SEQ ID NO: 645170 - RNA, 16 nt, Escherichia coli CFT073
cugacacaggcagcaa

SEQ ID NO: 645171 - RNA, 18 nt, Escherichia coli CFT073
cugacacaggcagcaauc

SEQ ID NO: 645172 - RNA, 21 nt, Escherichia coli CFT073
cugacaaagugcacuuguuua

SEQ ID NO: 645173 - RNA, 21 nt, Escherichia coli CFT073
cugacacuauucgccagcacg

SEQ ID NO: 645174 - RNA, 21 nt, Escherichia coli CFT073
cugacauuugcauccaacuuc

SEQ ID NO: 645175 - RNA, 19 nt, Escherichia coli CFT073
cugaaggggucuucuuccg

SEQ ID NO: 645176 - RNA, 14 nt, Escherichia coli CFT073
cugaaggcgcauug

SEQ ID NO: 645177 - RNA, 18 nt, Escherichia coli CFT073
cugaagcuaaaaccugca

SEQ ID NO: 645178 - RNA, 13 nt, Escherichia coli CFT073
cugaagcgcgccu

SEQ ID NO: 645179 - RNA, 14 nt, Escherichia coli CFT073
cugaagcgcgccug

SEQ ID NO: 645180 - RNA, 23 nt, Escherichia coli CFT073
cugaccauuacuguauacgggcu

SEQ ID NO: 645181 - RNA, 23 nt, Escherichia coli CFT073
cugaccagacagucgccgcuucg

SEQ ID NO: 645182 - RNA, 13 nt, Escherichia coli CFT073
cugaccaccacca

SEQ ID NO: 645183 - RNA, 14 nt, Escherichia coli CFT073
cugacccagcacca

SEQ ID NO: 645184 - RNA, 15 nt, Escherichia coli CFT073
cugacccagcaccag

SEQ ID NO: 645185 - RNA, 17 nt, Escherichia coli CFT073
cugaccuuaccaaugcu

SEQ ID NO: 645186 - RNA, 12 nt, Escherichia coli CFT073
cugaccuggaag

SEQ ID NO: 645187 - RNA, 13 nt, Escherichia coli CFT073
cugaccuggaagu

SEQ ID NO: 645188 - RNA, 19 nt, Escherichia coli CFT073
cugaccuggaaguguccag

SEQ ID NO: 645189 - RNA, 23 nt, Escherichia coli CFT073
cugaccucuucuacugcaugauu

SEQ ID NO: 645190 - RNA, 20 nt, Escherichia coli CFT073
cugaccguuguugaacggca

SEQ ID NO: 645191 - RNA, 13 nt, Escherichia coli CFT073
cugaaauuuaucg

SEQ ID NO: 645192 - RNA, 22 nt, Escherichia coli CFT073
cugaaauguaaaaguugcaguc

SEQ ID NO: 645193 - RNA, 19 nt, Escherichia coli CFT073
cugaaaugugcgcaaugcu

SEQ ID NO: 645194 - RNA, 17 nt, Escherichia coli CFT073
cugaaaggucaucauca

SEQ ID NO: 645195 - RNA, 19 nt, Escherichia coli CFT073
cugaaccaucgacguccaa

SEQ ID NO: 645196 - RNA, 14 nt, Escherichia coli CFT073
cugaacaagcaaga

SEQ ID NO: 645197 - RNA, 17 nt, Escherichia coli CFT073
cugaacaagcaagagug

SEQ ID NO: 645198 - RNA, 15 nt, Escherichia coli CFT073
cugaagaucaacguc

SEQ ID NO: 645199 - RNA, 20 nt, Escherichia coli CFT073
cugaagaaguaaaacagucg

SEQ ID NO: 645200 - RNA, 17 nt, Escherichia coli CFT073
cugaagauugaacagca

SEQ ID NO: 645201 - RNA, 19 nt, Escherichia coli CFT073
cugaagauugaacagcaga

SEQ ID NO: 645202 - RNA, 21 nt, Escherichia coli CFT073
cugaagauugaacagcagaac

SEQ ID NO: 645203 - RNA, 14 nt, Escherichia coli CFT073
cugaagcaguuuca

SEQ ID NO: 645204 - RNA, 21 nt, Escherichia coli CFT073
cugaagcaguuucaccagcag

SEQ ID NO: 645205 - RNA, 13 nt, Escherichia coli CFT073
cugaagcauauuc

SEQ ID NO: 645206 - RNA, 16 nt, Escherichia coli CFT073
cugaagccaugaccua

SEQ ID NO: 645207 - RNA, 19 nt, Escherichia coli CFT073
cugaagcaguuucaccagc

SEQ ID NO: 645208 - RNA, 15 nt, Escherichia coli CFT073
cugaaccgccccggg

SEQ ID NO: 645209 - RNA, 15 nt, Escherichia coli CFT073
cugaacgcaccuucc

SEQ ID NO: 645210 - RNA, 17 nt, Escherichia coli CFT073
cugaacgagaaaagcca

SEQ ID NO: 645211 - RNA, 22 nt, Escherichia coli CFT073
cugaacgcuucaccacgcccca

SEQ ID NO: 645212 - RNA, 23 nt, Escherichia coli CFT073
cugaacgucuuugcgcuccauca

SEQ ID NO: 645213 - RNA, 15 nt, Escherichia coli CFT073
cugaacgugaaaugu

SEQ ID NO: 645214 - RNA, 17 nt, Escherichia coli CFT073
cugaaaaggcuaaaauu

SEQ ID NO: 645215 - RNA, 23 nt, Escherichia coli CFT073
cugaaaaaugagcgaacaauaaa

SEQ ID NO: 645216 - RNA, 12 nt, Escherichia coli CFT073
cugaaaaccagg

SEQ ID NO: 645217 - RNA, 19 nt, Escherichia coli CFT073
cugaaaggcacucauuuuc

SEQ ID NO: 645218 - RNA, 19 nt, Escherichia coli CFT073
cugaaaaugaaauaaaaca

SEQ ID NO: 645219 - RNA, 20 nt, Escherichia coli CFT073
cugaaacaauuuaccgaccu

SEQ ID NO: 645220 - RNA, 16 nt, Escherichia coli CFT073
cugaaacaugaacauc

SEQ ID NO: 645221 - RNA, 14 nt, Escherichia coli CFT073
cucuuucacuccau

SEQ ID NO: 645222 - RNA, 16 nt, Escherichia coli CFT073
cucuuuauaaaguaaa

SEQ ID NO: 645223 - RNA, 18 nt, Escherichia coli CFT073
cucuuuagcauucagcgu

SEQ ID NO: 645224 - RNA, 13 nt, Escherichia coli CFT073
cucuuucuccagc

SEQ ID NO: 645225 - RNA, 16 nt, Escherichia coli CFT073
cucuuucuucagcacg

SEQ ID NO: 645226 - RNA, 17 nt, Escherichia coli CFT073
cucuuugggcagaaaau

SEQ ID NO: 645227 - RNA, 18 nt, Escherichia coli CFT073
cucuuugugacaaacuaa

SEQ ID NO: 645228 - RNA, 16 nt, Escherichia coli CFT073
cucuuuuuucagaaua

SEQ ID NO: 645229 - RNA, 18 nt, Escherichia coli CFT073
cucuuuaaacagauagcc

SEQ ID NO: 645230 - RNA, 22 nt, Escherichia coli CFT073
cucuugcuggcauuacaagaau

SEQ ID NO: 645231 - RNA, 16 nt, Escherichia coli CFT073
cucuugccagauuuuc

SEQ ID NO: 645232 - RNA, 21 nt, Escherichia coli CFT073
cucuucuuuugccuguugcac

SEQ ID NO: 645233 - RNA, 14 nt, Escherichia coli CFT073
cucuucuucaagcc

SEQ ID NO: 645234 - RNA, 13 nt, Escherichia coli CFT073
cucuucuuccgcu

SEQ ID NO: 645235 - RNA, 15 nt, Escherichia coli CFT073
cucuucggcaagugu

SEQ ID NO: 645236 - RNA, 20 nt, Escherichia coli CFT073
cucuucuaguucauguauuu

SEQ ID NO: 645237 - RNA, 14 nt, Escherichia coli CFT073
cucuucuacauuuc

SEQ ID NO: 645238 - RNA, 17 nt, Escherichia coli CFT073
cucuucugauaaaugaa

SEQ ID NO: 645239 - RNA, 22 nt, Escherichia coli CFT073
cucuucugcuuuacccacgcuu

SEQ ID NO: 645240 - RNA, 14 nt, Escherichia coli CFT073
cucuucuggcacca

SEQ ID NO: 645241 - RNA, 14 nt, Escherichia coli CFT073
cucuuccagaccaa

SEQ ID NO: 645242 - RNA, 19 nt, Escherichia coli CFT073
cucuuccagcgucuccaga

SEQ ID NO: 645243 - RNA, 23 nt, Escherichia coli CFT073
cucuucgacaaucgcaaauaugu

SEQ ID NO: 645244 - RNA, 17 nt, Escherichia coli CFT073
cucuuccggaaccacca

SEQ ID NO: 645245 - RNA, 14 nt, Escherichia coli CFT073
cucugcuugaauuc

SEQ ID NO: 645246 - RNA, 14 nt, Escherichia coli CFT073
cucuggcacaugca

SEQ ID NO: 645247 - RNA, 13 nt, Escherichia coli CFT073
cucuggcaggcga

SEQ ID NO: 645248 - RNA, 12 nt, Escherichia coli CFT073
cucuggaugaaa

SEQ ID NO: 645249 - RNA, 13 nt, Escherichia coli CFT073
cucuggcugcuuc

SEQ ID NO: 645250 - RNA, 20 nt, Escherichia coli CFT073
cucuggcuggucauugccgu

SEQ ID NO: 645251 - RNA, 22 nt, Escherichia coli CFT073
cucuggcauuuuugucgcgcug

SEQ ID NO: 645252 - RNA, 18 nt, Escherichia coli CFT073
cucuggccccaccugcuc

SEQ ID NO: 645253 - RNA, 21 nt, Escherichia coli CFT073
cucuggccccaccugcucgaa

SEQ ID NO: 645254 - RNA, 21 nt, Escherichia coli CFT073
cucuguagaacaccugucuuc

SEQ ID NO: 645255 - RNA, 19 nt, Escherichia coli CFT073
cucuguaucgcaucaggca

SEQ ID NO: 645256 - RNA, 13 nt, Escherichia coli CFT073
cucuguguaggcc

SEQ ID NO: 645257 - RNA, 22 nt, Escherichia coli CFT073
cucuguuggcgauaaaacccag

SEQ ID NO: 645258 - RNA, 16 nt, Escherichia coli CFT073
cucuuaccguaggcca

SEQ ID NO: 645259 - RNA, 20 nt, Escherichia coli CFT073
cucuuaaugcaggcagcacu

SEQ ID NO: 645260 - RNA, 21 nt, Escherichia coli CFT073
cucuuaaaugcacaauaauau

SEQ ID NO: 645261 - RNA, 13 nt, Escherichia coli CFT073
cucuuaaagcuac

SEQ ID NO: 645262 - RNA, 18 nt, Escherichia coli CFT073
cucuucaaacugaagauu

SEQ ID NO: 645263 - RNA, 14 nt, Escherichia coli CFT073
cucuucaaaccacu

SEQ ID NO: 645264 - RNA, 18 nt, Escherichia coli CFT073
cucuucaaacgcuucugg

SEQ ID NO: 645265 - RNA, 20 nt, Escherichia coli CFT073
cucuucaauggcaucacgca

SEQ ID NO: 645266 - RNA, 15 nt, Escherichia coli CFT073
cucuucaauccgcga

SEQ ID NO: 645267 - RNA, 22 nt, Escherichia coli CFT073
cucuucaacacacugaauaaaa

SEQ ID NO: 645268 - RNA, 16 nt, Escherichia coli CFT073
cucuucaacuucagca

SEQ ID NO: 645269 - RNA, 17 nt, Escherichia coli CFT073
cucuucaccgguacgga

SEQ ID NO: 645270 - RNA, 17 nt, Escherichia coli CFT073
cucuucaccugccugca

SEQ ID NO: 645271 - RNA, 14 nt, Escherichia coli CFT073
cucuucauuaccuu

SEQ ID NO: 645272 - RNA, 18 nt, Escherichia coli CFT073
cucuucagcaaucucuuc

SEQ ID NO: 645273 - RNA, 16 nt, Escherichia coli CFT073
cucugcgcccugcauc

SEQ ID NO: 645274 - RNA, 13 nt, Escherichia coli CFT073
cucugcugccaca

SEQ ID NO: 645275 - RNA, 19 nt, Escherichia coli CFT073
cucugcaguagccagugcu

SEQ ID NO: 645276 - RNA, 15 nt, Escherichia coli CFT073
cucugccacuggcuu

SEQ ID NO: 645277 - RNA, 21 nt, Escherichia coli CFT073
cucugccgccaauuugucgcc

SEQ ID NO: 645278 - RNA, 17 nt, Escherichia coli CFT073
cucugauacucaacuca

SEQ ID NO: 645279 - RNA, 13 nt, Escherichia coli CFT073
cucugaucacaga

SEQ ID NO: 645280 - RNA, 21 nt, Escherichia coli CFT073
cucugacgauucucccacagc

SEQ ID NO: 645281 - RNA, 21 nt, Escherichia coli CFT073
cucugacgcgcauacucuccu

SEQ ID NO: 645282 - RNA, 16 nt, Escherichia coli CFT073
cucugacccagaagac

SEQ ID NO: 645283 - RNA, 15 nt, Escherichia coli CFT073
cucugaugacugaug

SEQ ID NO: 645284 - RNA, 21 nt, Escherichia coli CFT073
cucugaauaaacgguacacga

SEQ ID NO: 645285 - RNA, 14 nt, Escherichia coli CFT073
cucugaaugccagu

SEQ ID NO: 645286 - RNA, 19 nt, Escherichia coli CFT073
cucugaaugccaguuuauu

SEQ ID NO: 645287 - RNA, 11 nt, Escherichia coli CFT073
cucucuuucuc

SEQ ID NO: 645288 - RNA, 16 nt, Escherichia coli CFT073
cucucuuucuccagcg

SEQ ID NO: 645289 - RNA, 18 nt, Escherichia coli CFT073
cucucuuucuccagcgua

SEQ ID NO: 645290 - RNA, 18 nt, Escherichia coli CFT073
cucucuucguggcccgcc

SEQ ID NO: 645291 - RNA, 21 nt, Escherichia coli CFT073
cucucugcaguagccagugcu

SEQ ID NO: 645292 - RNA, 14 nt, Escherichia coli CFT073
cucucgggcaguaa

SEQ ID NO: 645293 - RNA, 23 nt, Escherichia coli CFT073
cucucgccagagaucgcacaugu

SEQ ID NO: 645294 - RNA, 23 nt, Escherichia coli CFT073
cucuccuguuuaauaugcaauuc

SEQ ID NO: 645295 - RNA, 23 nt, Escherichia coli CFT073
cucuccgugggcuaacacugcca

SEQ ID NO: 645296 - RNA, 18 nt, Escherichia coli CFT073
cucuccacacggagaggc

SEQ ID NO: 645297 - RNA, 14 nt, Escherichia coli CFT073
cucucagagaauca

SEQ ID NO: 645298 - RNA, 15 nt, Escherichia coli CFT073
cucucaacaccgcuc

SEQ ID NO: 645299 - RNA, 19 nt, Escherichia coli CFT073
cucuauacgcucauuuucu

SEQ ID NO: 645300 - RNA, 20 nt, Escherichia coli CFT073
cucgucgcgacgaccaccca

SEQ ID NO: 645301 - RNA, 18 nt, Escherichia coli CFT073
cucgucgcugauauugcu

SEQ ID NO: 645302 - RNA, 17 nt, Escherichia coli CFT073
cucggacaauaguuuca

SEQ ID NO: 645303 - RNA, 15 nt, Escherichia coli CFT073
cucgcuaaccacugu

SEQ ID NO: 645304 - RNA, 14 nt, Escherichia coli CFT073
cucgcucaugccag

SEQ ID NO: 645305 - RNA, 16 nt, Escherichia coli CFT073
cucgcucucgccgcgc

SEQ ID NO: 645306 - RNA, 16 nt, Escherichia coli CFT073
cucgcgucuggcauuu

SEQ ID NO: 645307 - RNA, 22 nt, Escherichia coli CFT073
cucgcguucgauagcgcgccag

SEQ ID NO: 645308 - RNA, 18 nt, Escherichia coli CFT073
cucgcguucuguugccgc

SEQ ID NO: 645309 - RNA, 22 nt, Escherichia coli CFT073
cucgucaaacucauaaaccagc

SEQ ID NO: 645310 - RNA, 18 nt, Escherichia coli CFT073
cucgucacaucaccaaca

SEQ ID NO: 645311 - RNA, 19 nt, Escherichia coli CFT073
cucgucgagaauauacagc

SEQ ID NO: 645312 - RNA, 15 nt, Escherichia coli CFT073
cucguccauaguaac

SEQ ID NO: 645313 - RNA, 14 nt, Escherichia coli CFT073
cucgucaccaccuc

SEQ ID NO: 645314 - RNA, 13 nt, Escherichia coli CFT073
cucggcugcugcc

SEQ ID NO: 645315 - RNA, 19 nt, Escherichia coli CFT073
cuccuuucugagcaucaca

SEQ ID NO: 645316 - RNA, 18 nt, Escherichia coli CFT073
cucgacagccucuuccag

SEQ ID NO: 645317 - RNA, 15 nt, Escherichia coli CFT073
cucgacaccaaacag

SEQ ID NO: 645318 - RNA, 16 nt, Escherichia coli CFT073
cucgaauuauucagag

SEQ ID NO: 645319 - RNA, 15 nt, Escherichia coli CFT073
cucgaaguuuuccuc

SEQ ID NO: 645320 - RNA, 22 nt, Escherichia coli CFT073
cucgaauacgccgauaucgcug

SEQ ID NO: 645321 - RNA, 13 nt, Escherichia coli CFT073
cucgaggaaaugc

SEQ ID NO: 645322 - RNA, 17 nt, Escherichia coli CFT073
cucgagagagaaaauaa

SEQ ID NO: 645323 - RNA, 21 nt, Escherichia coli CFT073
cucgacacccagcuucaucau

SEQ ID NO: 645324 - RNA, 22 nt, Escherichia coli CFT073
cuccggcagcuuuaccggcuuc

SEQ ID NO: 645325 - RNA, 17 nt, Escherichia coli CFT073
cuccggcacuucccccu

SEQ ID NO: 645326 - RNA, 20 nt, Escherichia coli CFT073
cuccugguucccgaugcugu

SEQ ID NO: 645327 - RNA, 21 nt, Escherichia coli CFT073
cuccuggcgaauuuguucccc

SEQ ID NO: 645328 - RNA, 23 nt, Escherichia coli CFT073
cuccuggcgaauuuguuccccau

SEQ ID NO: 645329 - RNA, 15 nt, Escherichia coli CFT073
cuccugauuccaggu

SEQ ID NO: 645330 - RNA, 18 nt, Escherichia coli CFT073
cuccugcaagccaacgau

SEQ ID NO: 645331 - RNA, 23 nt, Escherichia coli CFT073
cuccugagaacuucggcagagaa

SEQ ID NO: 645332 - RNA, 23 nt, Escherichia coli CFT073
cuccugagaauuccggcagagaa

SEQ ID NO: 645333 - RNA, 14 nt, Escherichia coli CFT073
cucccgccugcugc

SEQ ID NO: 645334 - RNA, 15 nt, Escherichia coli CFT073
cucccgccugcugcg

SEQ ID NO: 645335 - RNA, 21 nt, Escherichia coli CFT073
cucccgcccccgccagcgcca

SEQ ID NO: 645336 - RNA, 19 nt, Escherichia coli CFT073
cucccgcaguaagcuguac

SEQ ID NO: 645337 - RNA, 14 nt, Escherichia coli CFT073
cucccgcagccacu

SEQ ID NO: 645338 - RNA, 16 nt, Escherichia coli CFT073
cucccgcagccacucc

SEQ ID NO: 645339 - RNA, 22 nt, Escherichia coli CFT073
cucccagcguaccaguggcggc

SEQ ID NO: 645340 - RNA, 18 nt, Escherichia coli CFT073
cuccccuuucuuauuuuu

SEQ ID NO: 645341 - RNA, 19 nt, Escherichia coli CFT073
cuccccuuucuuauuuuuc

SEQ ID NO: 645342 - RNA, 18 nt, Escherichia coli CFT073
cucccacaguuucagccc

SEQ ID NO: 645343 - RNA, 13 nt, Escherichia coli CFT073
cuccaugaugacc

SEQ ID NO: 645344 - RNA, 20 nt, Escherichia coli CFT073
cuccgccggaaucaacggca

SEQ ID NO: 645345 - RNA, 23 nt, Escherichia coli CFT073
cuccgcgaccuguuuugccaggc

SEQ ID NO: 645346 - RNA, 13 nt, Escherichia coli CFT073
cuccgcgccgccg

SEQ ID NO: 645347 - RNA, 13 nt, Escherichia coli CFT073
cuccgcagccaug

SEQ ID NO: 645348 - RNA, 20 nt, Escherichia coli CFT073
cuccgccagugacugcgccg

SEQ ID NO: 645349 - RNA, 14 nt, Escherichia coli CFT073
cuccgccccggcaa

SEQ ID NO: 645350 - RNA, 14 nt, Escherichia coli CFT073
cuccaggccggaug

SEQ ID NO: 645351 - RNA, 21 nt, Escherichia coli CFT073
cuccaggcgaagacaaaacca

SEQ ID NO: 645352 - RNA, 15 nt, Escherichia coli CFT073
cuccagucgcgugug

SEQ ID NO: 645353 - RNA, 20 nt, Escherichia coli CFT073
cuccagucuuuuaaccggcg

SEQ ID NO: 645354 - RNA, 19 nt, Escherichia coli CFT073
cuccagugcgcuuuauuca

SEQ ID NO: 645355 - RNA, 16 nt, Escherichia coli CFT073
cuccaguaccugcaaa

SEQ ID NO: 645356 - RNA, 14 nt, Escherichia coli CFT073
cuccauagggcagg

SEQ ID NO: 645357 - RNA, 22 nt, Escherichia coli CFT073
cuccauccgggaucacaucaua

SEQ ID NO: 645358 - RNA, 19 nt, Escherichia coli CFT073
cucaugccguagaacagca

SEQ ID NO: 645359 - RNA, 17 nt, Escherichia coli CFT073
cucaugggucugcggau

SEQ ID NO: 645360 - RNA, 20 nt, Escherichia coli CFT073
cuccagcgccgccagaauca

SEQ ID NO: 645361 - RNA, 16 nt, Escherichia coli CFT073
cucauguagccgcuuu

SEQ ID NO: 645362 - RNA, 21 nt, Escherichia coli CFT073
cucauguagccgcuuuuucug

SEQ ID NO: 645363 - RNA, 13 nt, Escherichia coli CFT073
cucauguuaucga

SEQ ID NO: 645364 - RNA, 19 nt, Escherichia coli CFT073
cuccagcgggcgaaucaac

SEQ ID NO: 645365 - RNA, 23 nt, Escherichia coli CFT073
cuccagcgggcgaaucaacucca

SEQ ID NO: 645366 - RNA, 22 nt, Escherichia coli CFT073
cucauaauacaggcuacuccca

SEQ ID NO: 645367 - RNA, 21 nt, Escherichia coli CFT073
cucauaauacaggcuacuccc

SEQ ID NO: 645368 - RNA, 20 nt, Escherichia coli CFT073
cucaguuccgggaucaccag

SEQ ID NO: 645369 - RNA, 22 nt, Escherichia coli CFT073
cucaguugguagagcacgaccu

SEQ ID NO: 645370 - RNA, 17 nt, Escherichia coli CFT073
cucaguugguagagcac

SEQ ID NO: 645371 - RNA, 16 nt, Escherichia coli CFT073
cucaguugggccagaa

SEQ ID NO: 645372 - RNA, 18 nt, Escherichia coli CFT073
cucagugaccgucaugcc

SEQ ID NO: 645373 - RNA, 14 nt, Escherichia coli CFT073
cucaggcucucauu

SEQ ID NO: 645374 - RNA, 16 nt, Escherichia coli CFT073
cucaggcuggcugacc

SEQ ID NO: 645375 - RNA, 16 nt, Escherichia coli CFT073
cucagaccauauuccc

SEQ ID NO: 645376 - RNA, 15 nt, Escherichia coli CFT073
cucagaaucacgcca

SEQ ID NO: 645377 - RNA, 16 nt, Escherichia coli CFT073
cucagacucauuaaaa

SEQ ID NO: 645378 - RNA, 20 nt, Escherichia coli CFT073
cucagagaggcuuuggcacc

SEQ ID NO: 645379 - RNA, 21 nt, Escherichia coli CFT073
cucaggcgguggaacaaguca

SEQ ID NO: 645380 - RNA, 14 nt, Escherichia coli CFT073
cucagaguaccgau

SEQ ID NO: 645381 - RNA, 18 nt, Escherichia coli CFT073
cucagauaaaugcaaacg

SEQ ID NO: 645382 - RNA, 18 nt, Escherichia coli CFT073
cucaugcaacacaagcca

SEQ ID NO: 645383 - RNA, 14 nt, Escherichia coli CFT073
cucaugcaacugcu

SEQ ID NO: 645384 - RNA, 13 nt, Escherichia coli CFT073
cucaucuucauaa

SEQ ID NO: 645385 - RNA, 21 nt, Escherichia coli CFT073
cucaucuuccauucuccgcuc

SEQ ID NO: 645386 - RNA, 16 nt, Escherichia coli CFT073
cucauccccugacugu

SEQ ID NO: 645387 - RNA, 17 nt, Escherichia coli CFT073
cucauccuguggcuuuu

SEQ ID NO: 645388 - RNA, 20 nt, Escherichia coli CFT073
cucauccuguggcuuuuuug

SEQ ID NO: 645389 - RNA, 13 nt, Escherichia coli CFT073
cucaucgccgcca

SEQ ID NO: 645390 - RNA, 14 nt, Escherichia coli CFT073
cucaucgccgccaa

SEQ ID NO: 645391 - RNA, 21 nt, Escherichia coli CFT073
cucaucgucaaaauucauaaa

SEQ ID NO: 645392 - RNA, 19 nt, Escherichia coli CFT073
cucauagggugugacgaca

SEQ ID NO: 645393 - RNA, 21 nt, Escherichia coli CFT073
cucaucaauuaaugccuucaa

SEQ ID NO: 645394 - RNA, 16 nt, Escherichia coli CFT073
cucaucaagcauuuuc

SEQ ID NO: 645395 - RNA, 12 nt, Escherichia coli CFT073
cucaucaccgca

SEQ ID NO: 645396 - RNA, 22 nt, Escherichia coli CFT073
cucaucaccgcaaagucggcac

SEQ ID NO: 645397 - RNA, 19 nt, Escherichia coli CFT073
cucaucagcgguaaaacgc

SEQ ID NO: 645398 - RNA, 14 nt, Escherichia coli CFT073
cucaucaggccugc

SEQ ID NO: 645399 - RNA, 21 nt, Escherichia coli CFT073
cucauccaccacaaaagcaaa

SEQ ID NO: 645400 - RNA, 13 nt, Escherichia coli CFT073
cucaucauccucu

SEQ ID NO: 645401 - RNA, 14 nt, Escherichia coli CFT073
cucauccaucaaau

SEQ ID NO: 645402 - RNA, 13 nt, Escherichia coli CFT073
cucaacagccaga

SEQ ID NO: 645403 - RNA, 19 nt, Escherichia coli CFT073
cucaacagccagaagguga

SEQ ID NO: 645404 - RNA, 13 nt, Escherichia coli CFT073
cucaacaguaagg

SEQ ID NO: 645405 - RNA, 20 nt, Escherichia coli CFT073
cucaacaaccaggccagcgc

SEQ ID NO: 645406 - RNA, 15 nt, Escherichia coli CFT073
cucaaccccagccau

SEQ ID NO: 645407 - RNA, 23 nt, Escherichia coli CFT073
cucaaccgccaguucccccugcc

SEQ ID NO: 645408 - RNA, 16 nt, Escherichia coli CFT073
cucaaccgcuucuuuc

SEQ ID NO: 645409 - RNA, 17 nt, Escherichia coli CFT073
cucaaccgcuucuuucu

SEQ ID NO: 645410 - RNA, 17 nt, Escherichia coli CFT073
cucaacaucuucaccaa

SEQ ID NO: 645411 - RNA, 12 nt, Escherichia coli CFT073
cucaaccagauu

SEQ ID NO: 645412 - RNA, 19 nt, Escherichia coli CFT073
cuauuaccuuuaugacuau

SEQ ID NO: 645413 - RNA, 12 nt, Escherichia coli CFT073
cuauuaccaggc

SEQ ID NO: 645414 - RNA, 22 nt, Escherichia coli CFT073
cucaagcguugcuucacgcggg

SEQ ID NO: 645415 - RNA, 21 nt, Escherichia coli CFT073
cucaagcucguugguuccacg

SEQ ID NO: 645416 - RNA, 16 nt, Escherichia coli CFT073
cucaagcacccgccgc

SEQ ID NO: 645417 - RNA, 15 nt, Escherichia coli CFT073
cucaagccagauauu

SEQ ID NO: 645418 - RNA, 23 nt, Escherichia coli CFT073
cucaagccagauauuaagcggca

SEQ ID NO: 645419 - RNA, 15 nt, Escherichia coli CFT073
cucaagcaaucaagc

SEQ ID NO: 645420 - RNA, 18 nt, Escherichia coli CFT073
cucaagcaaucaagcccu

SEQ ID NO: 645421 - RNA, 16 nt, Escherichia coli CFT073
cucaagaaucacuuca

SEQ ID NO: 645422 - RNA, 15 nt, Escherichia coli CFT073
cucaacuuccugaau

SEQ ID NO: 645423 - RNA, 13 nt, Escherichia coli CFT073
cucaacgccugcu

SEQ ID NO: 645424 - RNA, 15 nt, Escherichia coli CFT073
cucaacgccgcacag

SEQ ID NO: 645425 - RNA, 21 nt, Escherichia coli CFT073
cucaacgccgcuaucagauuc

SEQ ID NO: 645426 - RNA, 21 nt, Escherichia coli CFT073
cucaacgccuaaugccagcga

SEQ ID NO: 645427 - RNA, 19 nt, Escherichia coli CFT073
cucaacgguccaaugguca

SEQ ID NO: 645428 - RNA, 23 nt, Escherichia coli CFT073
cucaacggugaccucagguucaa

SEQ ID NO: 645429 - RNA, 14 nt, Escherichia coli CFT073
cucaacucacacaa

SEQ ID NO: 645430 - RNA, 19 nt, Escherichia coli CFT073
cucaccaacuggcgcagca

SEQ ID NO: 645431 - RNA, 12 nt, Escherichia coli CFT073
cucacauccagc

SEQ ID NO: 645432 - RNA, 23 nt, Escherichia coli CFT073
cucacagaguauuuccagcucaa

SEQ ID NO: 645433 - RNA, 21 nt, Escherichia coli CFT073
cucaaguugcgaaagcgagca

SEQ ID NO: 645434 - RNA, 13 nt, Escherichia coli CFT073
cucaauacccagc

SEQ ID NO: 645435 - RNA, 15 nt, Escherichia coli CFT073
cucaauauccugacc

SEQ ID NO: 645436 - RNA, 14 nt, Escherichia coli CFT073
cucaaucaccacca

SEQ ID NO: 645437 - RNA, 16 nt, Escherichia coli CFT073
cucaccggcuccaggc

SEQ ID NO: 645438 - RNA, 19 nt, Escherichia coli CFT073
cucaccuuuaaacaggccg

SEQ ID NO: 645439 - RNA, 21 nt, Escherichia coli CFT073
cucacuacguagucuuuaccg

SEQ ID NO: 645440 - RNA, 20 nt, Escherichia coli CFT073
cucacucaucacuccccgca

SEQ ID NO: 645441 - RNA, 14 nt, Escherichia coli CFT073
cucacgcagcggcg

SEQ ID NO: 645442 - RNA, 22 nt, Escherichia coli CFT073
cucacuaauugcaaacagagcg

SEQ ID NO: 645443 - RNA, 15 nt, Escherichia coli CFT073
cuauaucucaaucaa

SEQ ID NO: 645444 - RNA, 19 nt, Escherichia coli CFT073
cuauaucgcugauaucaaa

SEQ ID NO: 645445 - RNA, 22 nt, Escherichia coli CFT073
cuauauauuuaguucauauaau

SEQ ID NO: 645446 - RNA, 19 nt, Escherichia coli CFT073
cuaucaaccucuuuuucug

SEQ ID NO: 645447 - RNA, 17 nt, Escherichia coli CFT073
cuaucaaccugaggccu

SEQ ID NO: 645448 - RNA, 22 nt, Escherichia coli CFT073
cuauaugacucauaaaaauaua

SEQ ID NO: 645449 - RNA, 19 nt, Escherichia coli CFT073
cuauaccagauaaacaucg

SEQ ID NO: 645450 - RNA, 14 nt, Escherichia coli CFT073
cuauaccccacccc

SEQ ID NO: 645451 - RNA, 21 nt, Escherichia coli CFT073
cuaucggcgauguagcgcugu

SEQ ID NO: 645452 - RNA, 15 nt, Escherichia coli CFT073
cuaugaugaaaaagc

SEQ ID NO: 645453 - RNA, 14 nt, Escherichia coli CFT073
cuaugauuuuccug

SEQ ID NO: 645454 - RNA, 14 nt, Escherichia coli CFT073
cuauccacauuagu

SEQ ID NO: 645455 - RNA, 16 nt, Escherichia coli CFT073
cuaucacuauaaauau

SEQ ID NO: 645456 - RNA, 12 nt, Escherichia coli CFT073
cuaucagcgcca

SEQ ID NO: 645457 - RNA, 22 nt, Escherichia coli CFT073
cuaucagcgccaccacaaaagc

SEQ ID NO: 645458 - RNA, 16 nt, Escherichia coli CFT073
cuaucaggucuuucug

SEQ ID NO: 645459 - RNA, 20 nt, Escherichia coli CFT073
cuauccugguuauuucacuu

SEQ ID NO: 645460 - RNA, 13 nt, Escherichia coli CFT073
cuaucgaaaucaa

SEQ ID NO: 645461 - RNA, 20 nt, Escherichia coli CFT073
cuaucgaacaugcgggucuu

SEQ ID NO: 645462 - RNA, 22 nt, Escherichia coli CFT073
cuaucgcauuauccuuuaucug

SEQ ID NO: 645463 - RNA, 15 nt, Escherichia coli CFT073
cuauccgcuuucaca

SEQ ID NO: 645464 - RNA, 14 nt, Escherichia coli CFT073
cuacuuucaugcuc

SEQ ID NO: 645465 - RNA, 14 nt, Escherichia coli CFT073
cuacuuuuuuaaga

SEQ ID NO: 645466 - RNA, 22 nt, Escherichia coli CFT073
cuacuuugcgagucugcuccag

SEQ ID NO: 645467 - RNA, 14 nt, Escherichia coli CFT073
cuagauaagcaagg

SEQ ID NO: 645468 - RNA, 20 nt, Escherichia coli CFT073
cuagauaagcaaggcaaucu

SEQ ID NO: 645469 - RNA, 18 nt, Escherichia coli CFT073
cuagcaacaaaaaaacca

SEQ ID NO: 645470 - RNA, 14 nt, Escherichia coli CFT073
cuaccuuauccagc

SEQ ID NO: 645471 - RNA, 12 nt, Escherichia coli CFT073
cuacgcaaagag

SEQ ID NO: 645472 - RNA, 19 nt, Escherichia coli CFT073
cuacgcagggauauuucac

SEQ ID NO: 645473 - RNA, 21 nt, Escherichia coli CFT073
cuacgcccgccagugcauauc

SEQ ID NO: 645474 - RNA, 15 nt, Escherichia coli CFT073
cuaacauuuuaguuu

SEQ ID NO: 645475 - RNA, 17 nt, Escherichia coli CFT073
cuaacaugccacuggcu

SEQ ID NO: 645476 - RNA, 23 nt, Escherichia coli CFT073
cuaacaucauccccguaucuuca

SEQ ID NO: 645477 - RNA, 21 nt, Escherichia coli CFT073
cuaacaugcccauuccccagc

SEQ ID NO: 645478 - RNA, 23 nt, Escherichia coli CFT073
cuaaauuuuaagccauuaaauca

SEQ ID NO: 645479 - RNA, 14 nt, Escherichia coli CFT073
cuaaauuuuuccac

SEQ ID NO: 645480 - RNA, 13 nt, Escherichia coli CFT073
cuaacaguucacc

SEQ ID NO: 645481 - RNA, 13 nt, Escherichia coli CFT073
cuacucugaccca

SEQ ID NO: 645482 - RNA, 16 nt, Escherichia coli CFT073
cuacucugacccagaa

SEQ ID NO: 645483 - RNA, 22 nt, Escherichia coli CFT073
cuacugaagcgaccaccacccu

SEQ ID NO: 645484 - RNA, 17 nt, Escherichia coli CFT073
cuacugacuccagguga

SEQ ID NO: 645485 - RNA, 15 nt, Escherichia coli CFT073
cuacuggcaauccug

SEQ ID NO: 645486 - RNA, 23 nt, Escherichia coli CFT073
cguuugaugcgcgagguaacaau

SEQ ID NO: 645487 - RNA, 18 nt, Escherichia coli CFT073
cguuugauuaacgccaga

SEQ ID NO: 645488 - RNA, 22 nt, Escherichia coli CFT073
cguuugauuaacgccagauuac

SEQ ID NO: 645489 - RNA, 15 nt, Escherichia coli CFT073
cguuucuuucaucag

SEQ ID NO: 645490 - RNA, 19 nt, Escherichia coli CFT073
cguuucugcgcuucugcca

SEQ ID NO: 645491 - RNA, 17 nt, Escherichia coli CFT073
cguuuccagcaguucca

SEQ ID NO: 645492 - RNA, 18 nt, Escherichia coli CFT073
cguuucaccaccacuucu

SEQ ID NO: 645493 - RNA, 20 nt, Escherichia coli CFT073
cguuucaccucuuucaccaa

SEQ ID NO: 645494 - RNA, 13 nt, Escherichia coli CFT073
cuaaaaauaguuc

SEQ ID NO: 645495 - RNA, 16 nt, Escherichia coli CFT073
cguuugccagccacac

SEQ ID NO: 645496 - RNA, 18 nt, Escherichia coli CFT073
cguuugccccaaccguuc

SEQ ID NO: 645497 - RNA, 13 nt, Escherichia coli CFT073
cuaaaauccacau

SEQ ID NO: 645498 - RNA, 14 nt, Escherichia coli CFT073
cuaaaaucaucacg

SEQ ID NO: 645499 - RNA, 19 nt, Escherichia coli CFT073
cuaaaaugucaccuaauuu

SEQ ID NO: 645500 - RNA, 23 nt, Escherichia coli CFT073
cuaaauuaucaacguagaauaaa

SEQ ID NO: 645501 - RNA, 16 nt, Escherichia coli CFT073
cuaaagcuaucccuug

SEQ ID NO: 645502 - RNA, 17 nt, Escherichia coli CFT073
cuaaaggcaaaaugcca

SEQ ID NO: 645503 - RNA, 13 nt, Escherichia coli CFT073
cuaaaggcuguca

SEQ ID NO: 645504 - RNA, 12 nt, Escherichia coli CFT073
cuaaaucagguu

SEQ ID NO: 645505 - RNA, 12 nt, Escherichia coli CFT073
cuaaauaaccuu

SEQ ID NO: 645506 - RNA, 17 nt, Escherichia coli CFT073
cguugcugucgcgcagc

SEQ ID NO: 645507 - RNA, 22 nt, Escherichia coli CFT073
cguugcugucgcgcagcacuug

SEQ ID NO: 645508 - RNA, 18 nt, Escherichia coli CFT073
cguugcggcuccagacgc

SEQ ID NO: 645509 - RNA, 16 nt, Escherichia coli CFT073
cguugcgacaaaccag

SEQ ID NO: 645510 - RNA, 17 nt, Escherichia coli CFT073
cguugcgccaaacguca

SEQ ID NO: 645511 - RNA, 18 nt, Escherichia coli CFT073
cguugccgcucccggcau

SEQ ID NO: 645512 - RNA, 22 nt, Escherichia coli CFT073
cguugccgcucccggcauaaca

SEQ ID NO: 645513 - RNA, 15 nt, Escherichia coli CFT073
cguuucaaaaacaaa

SEQ ID NO: 645514 - RNA, 22 nt, Escherichia coli CFT073
cguuucaacuucugcugugacu

SEQ ID NO: 645515 - RNA, 16 nt, Escherichia coli CFT073
cguuuacgcagguucu

SEQ ID NO: 645516 - RNA, 18 nt, Escherichia coli CFT073
cguugguacgaucagagu

SEQ ID NO: 645517 - RNA, 14 nt, Escherichia coli CFT073
cguuccacgucaca

SEQ ID NO: 645518 - RNA, 19 nt, Escherichia coli CFT073
cguuccacgucacaggcca

SEQ ID NO: 645519 - RNA, 15 nt, Escherichia coli CFT073
cguuccacucuuccc

SEQ ID NO: 645520 - RNA, 19 nt, Escherichia coli CFT073
cguucgccagcuccagcgc

SEQ ID NO: 645521 - RNA, 18 nt, Escherichia coli CFT073
cguuaagcgucgcaucag

SEQ ID NO: 645522 - RNA, 18 nt, Escherichia coli CFT073
cguuaagcuggaaaucaa

SEQ ID NO: 645523 - RNA, 12 nt, Escherichia coli CFT073
cguuaagcccag

SEQ ID NO: 645524 - RNA, 18 nt, Escherichia coli CFT073
cguucauggcgugacaug

SEQ ID NO: 645525 - RNA, 21 nt, Escherichia coli CFT073
cguuaaggccgcuuucagagc

SEQ ID NO: 645526 - RNA, 15 nt, Escherichia coli CFT073
cguuaaccacuucag

SEQ ID NO: 645527 - RNA, 12 nt, Escherichia coli CFT073
cguucuuccugu

SEQ ID NO: 645528 - RNA, 11 nt, Escherichia coli CFT073
cguucugcggg

SEQ ID NO: 645529 - RNA, 13 nt, Escherichia coli CFT073
cguucuguuucug

SEQ ID NO: 645530 - RNA, 20 nt, Escherichia coli CFT073
cguucugaauacccgccaga

SEQ ID NO: 645531 - RNA, 14 nt, Escherichia coli CFT073
cguucggcgagcag

SEQ ID NO: 645532 - RNA, 21 nt, Escherichia coli CFT073
cguucggcaaagcgcugaaga

SEQ ID NO: 645533 - RNA, 19 nt, Escherichia coli CFT073
cguucggaccaaugcccaa

SEQ ID NO: 645534 - RNA, 21 nt, Escherichia coli CFT073
cguugagauuguuggucacaa

SEQ ID NO: 645535 - RNA, 21 nt, Escherichia coli CFT073
cguugaccuggaugccugcau

SEQ ID NO: 645536 - RNA, 22 nt, Escherichia coli CFT073
cguguuuaugaaaguuuaacua

SEQ ID NO: 645537 - RNA, 16 nt, Escherichia coli CFT073
cguguuucaucucauc

SEQ ID NO: 645538 - RNA, 17 nt, Escherichia coli CFT073
cguguugaggaagcgca

SEQ ID NO: 645539 - RNA, 16 nt, Escherichia coli CFT073
cgugugguaaaaccuu

SEQ ID NO: 645540 - RNA, 13 nt, Escherichia coli CFT073
cguguuauccggc

SEQ ID NO: 645541 - RNA, 14 nt, Escherichia coli CFT073
cgugguuuugguaa

SEQ ID NO: 645542 - RNA, 14 nt, Escherichia coli CFT073
cguggucauggcau

SEQ ID NO: 645543 - RNA, 15 nt, Escherichia coli CFT073
cguggcuggcugacc

SEQ ID NO: 645544 - RNA, 17 nt, Escherichia coli CFT073
cgugggcuaacacugcc

SEQ ID NO: 645545 - RNA, 17 nt, Escherichia coli CFT073
cgugggcaucgcgacag

SEQ ID NO: 645546 - RNA, 20 nt, Escherichia coli CFT073
cguggccaugaccaccgcag

SEQ ID NO: 645547 - RNA, 19 nt, Escherichia coli CFT073
cguggagcaacacgccagc

SEQ ID NO: 645548 - RNA, 17 nt, Escherichia coli CFT073
cguggacauguuccggc

SEQ ID NO: 645549 - RNA, 21 nt, Escherichia coli CFT073
cguggacauguuccggcgaca

SEQ ID NO: 645550 - RNA, 14 nt, Escherichia coli CFT073
cgugcuaaauguca

SEQ ID NO: 645551 - RNA, 20 nt, Escherichia coli CFT073
cguggcgauaaucagcgcca

SEQ ID NO: 645552 - RNA, 14 nt, Escherichia coli CFT073
cguggccuccaaaa

SEQ ID NO: 645553 - RNA, 19 nt, Escherichia coli CFT073
cgugaaacgcguuuuguag

SEQ ID NO: 645554 - RNA, 12 nt, Escherichia coli CFT073
cgugaaauucac

SEQ ID NO: 645555 - RNA, 16 nt, Escherichia coli CFT073
cgucuuacggauuagu

SEQ ID NO: 645556 - RNA, 21 nt, Escherichia coli CFT073
cgucuucccgagacaucccuu

SEQ ID NO: 645557 - RNA, 14 nt, Escherichia coli CFT073
cgucuucccgcagc

SEQ ID NO: 645558 - RNA, 20 nt, Escherichia coli CFT073
cgugaacgccuuauccgacc

SEQ ID NO: 645559 - RNA, 21 nt, Escherichia coli CFT073
cgugaacugggccugcauauc

SEQ ID NO: 645560 - RNA, 17 nt, Escherichia coli CFT073
cgugacacuaacagcag

SEQ ID NO: 645561 - RNA, 23 nt, Escherichia coli CFT073
cgugaccaugagccaguucuucu

SEQ ID NO: 645562 - RNA, 23 nt, Escherichia coli CFT073
cgugacgucucaaucaccaccag

SEQ ID NO: 645563 - RNA, 17 nt, Escherichia coli CFT073
cgugaccgccagaacac

SEQ ID NO: 645564 - RNA, 16 nt, Escherichia coli CFT073
cgucugaauaucauca

SEQ ID NO: 645565 - RNA, 22 nt, Escherichia coli CFT073
cgucugaucggcaaucacgccc

SEQ ID NO: 645566 - RNA, 15 nt, Escherichia coli CFT073
cgucugaugaaagca

SEQ ID NO: 645567 - RNA, 16 nt, Escherichia coli CFT073
cgucuuauccggcaua

SEQ ID NO: 645568 - RNA, 20 nt, Escherichia coli CFT073
cgucugcccggugccgcguu

SEQ ID NO: 645569 - RNA, 22 nt, Escherichia coli CFT073
cgucgcgccaggcgcgagaaga

SEQ ID NO: 645570 - RNA, 13 nt, Escherichia coli CFT073
cgucgccuuucac

SEQ ID NO: 645571 - RNA, 13 nt, Escherichia coli CFT073
cgucgccuucaac

SEQ ID NO: 645572 - RNA, 14 nt, Escherichia coli CFT073
cgugcgcuuuuuag

SEQ ID NO: 645573 - RNA, 17 nt, Escherichia coli CFT073
cgugcggcggcugacau

SEQ ID NO: 645574 - RNA, 19 nt, Escherichia coli CFT073
cgugcggugagaacuguuc

SEQ ID NO: 645575 - RNA, 18 nt, Escherichia coli CFT073
cgugcgguuucagcucac

SEQ ID NO: 645576 - RNA, 12 nt, Escherichia coli CFT073
cgugcggugggc

SEQ ID NO: 645577 - RNA, 19 nt, Escherichia coli CFT073
cgugcggugguuucucccc

SEQ ID NO: 645578 - RNA, 14 nt, Escherichia coli CFT073
cgugcgguaacuuc

SEQ ID NO: 645579 - RNA, 16 nt, Escherichia coli CFT073
cgugcgguaucaccac

SEQ ID NO: 645580 - RNA, 18 nt, Escherichia coli CFT073
cgugcgguaucaccaccc

SEQ ID NO: 645581 - RNA, 12 nt, Escherichia coli CFT073
cgugccagagca

SEQ ID NO: 645582 - RNA, 13 nt, Escherichia coli CFT073
cgugccagauguu

SEQ ID NO: 645583 - RNA, 18 nt, Escherichia coli CFT073
cgugccaggaccauucac

SEQ ID NO: 645584 - RNA, 15 nt, Escherichia coli CFT073
cgugagucuccuuua

SEQ ID NO: 645585 - RNA, 13 nt, Escherichia coli CFT073
cgugaguguggcc

SEQ ID NO: 645586 - RNA, 21 nt, Escherichia coli CFT073
cgugauauuacauaccagcag

SEQ ID NO: 645587 - RNA, 23 nt, Escherichia coli CFT073
cgugauauuacauaccagcagca

SEQ ID NO: 645588 - RNA, 17 nt, Escherichia coli CFT073
cgugcacuacaacggcg

SEQ ID NO: 645589 - RNA, 19 nt, Escherichia coli CFT073
cgguuuuuuuaauuacugc

SEQ ID NO: 645590 - RNA, 17 nt, Escherichia coli CFT073
cguaaaaacccgcuucg

SEQ ID NO: 645591 - RNA, 17 nt, Escherichia coli CFT073
cgguuuugcgccaucaa

SEQ ID NO: 645592 - RNA, 15 nt, Escherichia coli CFT073
cgguuuucugccugg

SEQ ID NO: 645593 - RNA, 16 nt, Escherichia coli CFT073
cgguuugccauuuucu

SEQ ID NO: 645594 - RNA, 17 nt, Escherichia coli CFT073
cgguuuuaacaccacuc

SEQ ID NO: 645595 - RNA, 14 nt, Escherichia coli CFT073
cgguuugucaucau

SEQ ID NO: 645596 - RNA, 14 nt, Escherichia coli CFT073
cgguuuguuaucaa

SEQ ID NO: 645597 - RNA, 14 nt, Escherichia coli CFT073
cgguuuucaucauc

SEQ ID NO: 645598 - RNA, 18 nt, Escherichia coli CFT073
cguaaaccaauggucgug

SEQ ID NO: 645599 - RNA, 17 nt, Escherichia coli CFT073
cguaaaccacugacaca

SEQ ID NO: 645600 - RNA, 12 nt, Escherichia coli CFT073
cguaaaaccugc

SEQ ID NO: 645601 - RNA, 17 nt, Escherichia coli CFT073
cguaacuuaucaauuga

SEQ ID NO: 645602 - RNA, 17 nt, Escherichia coli CFT073
cguaagcaacgccaaau

SEQ ID NO: 645603 - RNA, 19 nt, Escherichia coli CFT073
cguaacguaauccugcggu

SEQ ID NO: 645604 - RNA, 12 nt, Escherichia coli CFT073
cguaacgacugc

SEQ ID NO: 645605 - RNA, 16 nt, Escherichia coli CFT073
cguaacgacugcggau

SEQ ID NO: 645606 - RNA, 12 nt, Escherichia coli CFT073
cguaaauucucc

SEQ ID NO: 645607 - RNA, 19 nt, Escherichia coli CFT073
cguaacaggugauaaucca

SEQ ID NO: 645608 - RNA, 14 nt, Escherichia coli CFT073
cguaacauauuccc

SEQ ID NO: 645609 - RNA, 22 nt, Escherichia coli CFT073
cguaaccugagaucugaucuuu

SEQ ID NO: 645610 - RNA, 20 nt, Escherichia coli CFT073
cguaaccuugauccugcagu

SEQ ID NO: 645611 - RNA, 17 nt, Escherichia coli CFT073
cguaaagucaaaauuca

SEQ ID NO: 645612 - RNA, 16 nt, Escherichia coli CFT073
cgguuauccugcaaau

SEQ ID NO: 645613 - RNA, 17 nt, Escherichia coli CFT073
cgguucaauaucuuccu

SEQ ID NO: 645614 - RNA, 15 nt, Escherichia coli CFT073
cgguuagcggcuuca

SEQ ID NO: 645615 - RNA, 17 nt, Escherichia coli CFT073
cgguuagcucaacgcau

SEQ ID NO: 645616 - RNA, 22 nt, Escherichia coli CFT073
cgguuagaaaauuauuuuaaau

SEQ ID NO: 645617 - RNA, 21 nt, Escherichia coli CFT073
cgguuaugaauaacuccgccg

SEQ ID NO: 645618 - RNA, 17 nt, Escherichia coli CFT073
cgguuaacaguuuguuu

SEQ ID NO: 645619 - RNA, 14 nt, Escherichia coli CFT073
cgguuaaucagaua

SEQ ID NO: 645620 - RNA, 18 nt, Escherichia coli CFT073
cgguugaucucaucuucc

SEQ ID NO: 645621 - RNA, 22 nt, Escherichia coli CFT073
cgguugaugccguuccacccag

SEQ ID NO: 645622 - RNA, 14 nt, Escherichia coli CFT073
cgguucuccuggca

SEQ ID NO: 645623 - RNA, 21 nt, Escherichia coli CFT073
cgguucgagaaaaccgaugcc

SEQ ID NO: 645624 - RNA, 22 nt, Escherichia coli CFT073
cgguuguuuugguuauuaacug

SEQ ID NO: 645625 - RNA, 16 nt, Escherichia coli CFT073
cgguuucaaccagcag

SEQ ID NO: 645626 - RNA, 18 nt, Escherichia coli CFT073
cgguuucaaccagcaggg

SEQ ID NO: 645627 - RNA, 18 nt, Escherichia coli CFT073
cgguuucugauucccugc

SEQ ID NO: 645628 - RNA, 21 nt, Escherichia coli CFT073
cgguuucuacaagcagagaga

SEQ ID NO: 645629 - RNA, 23 nt, Escherichia coli CFT073
cgguuucucccgccugcugcguc

SEQ ID NO: 645630 - RNA, 14 nt, Escherichia coli CFT073
cgguuucucuucug

SEQ ID NO: 645631 - RNA, 15 nt, Escherichia coli CFT073
cgguuucccggcaau

SEQ ID NO: 645632 - RNA, 21 nt, Escherichia coli CFT073
cgguuuccacuuccaccacuu

SEQ ID NO: 645633 - RNA, 15 nt, Escherichia coli CFT073
cgguugcugaacagc

SEQ ID NO: 645634 - RNA, 17 nt, Escherichia coli CFT073
cgguugccagcgccagc

SEQ ID NO: 645635 - RNA, 20 nt, Escherichia coli CFT073
cgguugugauuuuagccaua

SEQ ID NO: 645636 - RNA, 19 nt, Escherichia coli CFT073
cgguggcuggcgcggcgca

SEQ ID NO: 645637 - RNA, 18 nt, Escherichia coli CFT073
cgguggcguacagcuggc

SEQ ID NO: 645638 - RNA, 13 nt, Escherichia coli CFT073
cgguggcggcagu

SEQ ID NO: 645639 - RNA, 18 nt, Escherichia coli CFT073
cgguggagagcauauaaa

SEQ ID NO: 645640 - RNA, 15 nt, Escherichia coli CFT073
cgguguaacccgccu

SEQ ID NO: 645641 - RNA, 15 nt, Escherichia coli CFT073
cggugguguuaucac

SEQ ID NO: 645642 - RNA, 22 nt, Escherichia coli CFT073
cgguguaaccaccgcaggcagu

SEQ ID NO: 645643 - RNA, 23 nt, Escherichia coli CFT073
cggugguaucgaucacuuuuucu

SEQ ID NO: 645644 - RNA, 15 nt, Escherichia coli CFT073
cgguggucauaauau

SEQ ID NO: 645645 - RNA, 15 nt, Escherichia coli CFT073
cgguggugaaaagag

SEQ ID NO: 645646 - RNA, 14 nt, Escherichia coli CFT073
cgguguacgcugca

SEQ ID NO: 645647 - RNA, 23 nt, Escherichia coli CFT073
cggugucgauacgacaacggcag

SEQ ID NO: 645648 - RNA, 15 nt, Escherichia coli CFT073
cggugccggagcgcg

SEQ ID NO: 645649 - RNA, 23 nt, Escherichia coli CFT073
cggugcggcucucuuucuccagc

SEQ ID NO: 645650 - RNA, 15 nt, Escherichia coli CFT073
cggugcuccagugcg

SEQ ID NO: 645651 - RNA, 12 nt, Escherichia coli CFT073
cggugccaucac

SEQ ID NO: 645652 - RNA, 17 nt, Escherichia coli CFT073
cggugccaucauacagc

SEQ ID NO: 645653 - RNA, 13 nt, Escherichia coli CFT073
cggugccaucucc

SEQ ID NO: 645654 - RNA, 14 nt, Escherichia coli CFT073
cggugccaucucca

SEQ ID NO: 645655 - RNA, 16 nt, Escherichia coli CFT073
cggugcaucuucacac

SEQ ID NO: 645656 - RNA, 20 nt, Escherichia coli CFT073
cggugcaucuucacacugau

SEQ ID NO: 645657 - RNA, 18 nt, Escherichia coli CFT073
cggugauuuccgccgcca

SEQ ID NO: 645658 - RNA, 22 nt, Escherichia coli CFT073
cggugauuuccgccgccagcag

SEQ ID NO: 645659 - RNA, 15 nt, Escherichia coli CFT073
cggugauuuccgccg

SEQ ID NO: 645660 - RNA, 16 nt, Escherichia coli CFT073
cgucaaucugcuccau

SEQ ID NO: 645661 - RNA, 15 nt, Escherichia coli CFT073
cgucacaguuaacca

SEQ ID NO: 645662 - RNA, 17 nt, Escherichia coli CFT073
cgucacaguuaaccagu

SEQ ID NO: 645663 - RNA, 13 nt, Escherichia coli CFT073
cgucacaccuuca

SEQ ID NO: 645664 - RNA, 13 nt, Escherichia coli CFT073
cgucaccagcauc

SEQ ID NO: 645665 - RNA, 17 nt, Escherichia coli CFT073
cgucaccaccucacccg

SEQ ID NO: 645666 - RNA, 16 nt, Escherichia coli CFT073
cgucaauaaucaugca

SEQ ID NO: 645667 - RNA, 13 nt, Escherichia coli CFT073
cgucaauccagcc

SEQ ID NO: 645668 - RNA, 15 nt, Escherichia coli CFT073
cgucaaucacacuga

SEQ ID NO: 645669 - RNA, 16 nt, Escherichia coli CFT073
cgucaaucacacugac

SEQ ID NO: 645670 - RNA, 21 nt, Escherichia coli CFT073
cgucaagaaaacuauuacuga

SEQ ID NO: 645671 - RNA, 21 nt, Escherichia coli CFT073
cgucagcggcuggcacucuuc

SEQ ID NO: 645672 - RNA, 22 nt, Escherichia coli CFT073
cgucagcggcuggcacucuucc

SEQ ID NO: 645673 - RNA, 14 nt, Escherichia coli CFT073
cgucagcggcagcu

SEQ ID NO: 645674 - RNA, 20 nt, Escherichia coli CFT073
cgucagcgaacggucgccgc

SEQ ID NO: 645675 - RNA, 12 nt, Escherichia coli CFT073
cgucagcgccgc

SEQ ID NO: 645676 - RNA, 12 nt, Escherichia coli CFT073
cgucagcgccuc

SEQ ID NO: 645677 - RNA, 18 nt, Escherichia coli CFT073
cgucaguagcgcaauaac

SEQ ID NO: 645678 - RNA, 17 nt, Escherichia coli CFT073
cgucagugacugcuuuu

SEQ ID NO: 645679 - RNA, 14 nt, Escherichia coli CFT073
cgucaguucucugg

SEQ ID NO: 645680 - RNA, 18 nt, Escherichia coli CFT073
cgucagugucuuaucugg

SEQ ID NO: 645681 - RNA, 19 nt, Escherichia coli CFT073
cgucacgguuucaaagaaa

SEQ ID NO: 645682 - RNA, 16 nt, Escherichia coli CFT073
cgucacggacucggcg

SEQ ID NO: 645683 - RNA, 18 nt, Escherichia coli CFT073
cgucacgccgaccagacc

SEQ ID NO: 645684 - RNA, 23 nt, Escherichia coli CFT073
cgucagccaaaucgccccgcagc

SEQ ID NO: 645685 - RNA, 19 nt, Escherichia coli CFT073
cgucagccacaacaaacga

SEQ ID NO: 645686 - RNA, 14 nt, Escherichia coli CFT073
cgucacucacgcug

SEQ ID NO: 645687 - RNA, 22 nt, Escherichia coli CFT073
cgucacguugcgacaaaccagg

SEQ ID NO: 645688 - RNA, 14 nt, Escherichia coli CFT073
cguaauagccugau

SEQ ID NO: 645689 - RNA, 16 nt, Escherichia coli CFT073
cguaauccguaaagcc

SEQ ID NO: 645690 - RNA, 14 nt, Escherichia coli CFT073
cguaauaucuuccu

SEQ ID NO: 645691 - RNA, 17 nt, Escherichia coli CFT073
cguaauaucuuccugaa

SEQ ID NO: 645692 - RNA, 16 nt, Escherichia coli CFT073
cguaagucaccgcuuu

SEQ ID NO: 645693 - RNA, 17 nt, Escherichia coli CFT073
cguaagucaccgcuuuu

SEQ ID NO: 645694 - RNA, 18 nt, Escherichia coli CFT073
cguaagguggauuacucu

SEQ ID NO: 645695 - RNA, 17 nt, Escherichia coli CFT073
cguagcucaucuucaua

SEQ ID NO: 645696 - RNA, 16 nt, Escherichia coli CFT073
cguagcguuuuuucau

SEQ ID NO: 645697 - RNA, 18 nt, Escherichia coli CFT073
cguaugcagccaggccau

SEQ ID NO: 645698 - RNA, 19 nt, Escherichia coli CFT073
cguaguguggggaaugaua

SEQ ID NO: 645699 - RNA, 20 nt, Escherichia coli CFT073
cguaguuuuugcccaucaug

SEQ ID NO: 645700 - RNA, 19 nt, Escherichia coli CFT073
cguauuccaccguacgcca

SEQ ID NO: 645701 - RNA, 15 nt, Escherichia coli CFT073
cgucaaaaccgggcu

SEQ ID NO: 645702 - RNA, 16 nt, Escherichia coli CFT073
cgucaaaauucauaaa

SEQ ID NO: 645703 - RNA, 20 nt, Escherichia coli CFT073
cgucaaaauucauaaagcua

SEQ ID NO: 645704 - RNA, 19 nt, Escherichia coli CFT073
cguccaguaaugcaacacu

SEQ ID NO: 645705 - RNA, 20 nt, Escherichia coli CFT073
cguccagcgaaccuuccauc

SEQ ID NO: 645706 - RNA, 20 nt, Escherichia coli CFT073
cgucaucaauccugcagcag

SEQ ID NO: 645707 - RNA, 15 nt, Escherichia coli CFT073
cgucauacuccaguc

SEQ ID NO: 645708 - RNA, 13 nt, Escherichia coli CFT073
cguccagcugccu

SEQ ID NO: 645709 - RNA, 16 nt, Escherichia coli CFT073
cguccagcgccugaau

SEQ ID NO: 645710 - RNA, 18 nt, Escherichia coli CFT073
cgucccagucgucauccc

SEQ ID NO: 645711 - RNA, 17 nt, Escherichia coli CFT073
cgucccaugaugcgcgg

SEQ ID NO: 645712 - RNA, 16 nt, Escherichia coli CFT073
cguccgggaaauccuc

SEQ ID NO: 645713 - RNA, 20 nt, Escherichia coli CFT073
cguccgcucggucacugaca

SEQ ID NO: 645714 - RNA, 21 nt, Escherichia coli CFT073
cguccggcaucgcaaaccaga

SEQ ID NO: 645715 - RNA, 20 nt, Escherichia coli CFT073
cguccggcaucgcaaaccag

SEQ ID NO: 645716 - RNA, 14 nt, Escherichia coli CFT073
cgucgagagauucc

SEQ ID NO: 645717 - RNA, 21 nt, Escherichia coli CFT073
cgucgauaauaucggccuggg

SEQ ID NO: 645718 - RNA, 21 nt, Escherichia coli CFT073
cgucgauucgccgaugcauau

SEQ ID NO: 645719 - RNA, 16 nt, Escherichia coli CFT073
cgucgaucucuuccac

SEQ ID NO: 645720 - RNA, 14 nt, Escherichia coli CFT073
cggguaaaaccauu

SEQ ID NO: 645721 - RNA, 12 nt, Escherichia coli CFT073
cgggguuuugcu

SEQ ID NO: 645722 - RNA, 14 nt, Escherichia coli CFT073
cggggucgugcaga

SEQ ID NO: 645723 - RNA, 23 nt, Escherichia coli CFT073
cgggggcgaccugugccgccgcc

SEQ ID NO: 645724 - RNA, 15 nt, Escherichia coli CFT073
cggggguaaaaccgg

SEQ ID NO: 645725 - RNA, 22 nt, Escherichia coli CFT073
cgggggcggcaaucgcugcuaa

SEQ ID NO: 645726 - RNA, 15 nt, Escherichia coli CFT073
cgggcuuccggcaau

SEQ ID NO: 645727 - RNA, 24 nt, Escherichia coli CFT073
cgggcuggcggggccgcgucgccc

SEQ ID NO: 645728 - RNA, 15 nt, Escherichia coli CFT073
cgggcuacaacgcac

SEQ ID NO: 645729 - RNA, 18 nt, Escherichia coli CFT073
cgggcuaucaugcccgga

SEQ ID NO: 645730 - RNA, 19 nt, Escherichia coli CFT073
cggggagauauuccccaga

SEQ ID NO: 645731 - RNA, 19 nt, Escherichia coli CFT073
cggggccagcacauagccg

SEQ ID NO: 645732 - RNA, 14 nt, Escherichia coli CFT073
cgguaacaggaaac

SEQ ID NO: 645733 - RNA, 14 nt, Escherichia coli CFT073
cgguaaaucaccau

SEQ ID NO: 645734 - RNA, 17 nt, Escherichia coli CFT073
cgguaaaucgacccuga

SEQ ID NO: 645735 - RNA, 22 nt, Escherichia coli CFT073
cggguuuucgcugccacaccau

SEQ ID NO: 645736 - RNA, 23 nt, Escherichia coli CFT073
cgguaaaaccgugcuucagccaa

SEQ ID NO: 645737 - RNA, 19 nt, Escherichia coli CFT073
cgguaaaagcccaucauug

SEQ ID NO: 645738 - RNA, 13 nt, Escherichia coli CFT073
cgguaaaaucauc

SEQ ID NO: 645739 - RNA, 16 nt, Escherichia coli CFT073
cgguaaaaucauccug

SEQ ID NO: 645740 - RNA, 20 nt, Escherichia coli CFT073
cgguaaaaucauccugcugc

SEQ ID NO: 645741 - RNA, 15 nt, Escherichia coli CFT073
cggguuggagcgcgu

SEQ ID NO: 645742 - RNA, 18 nt, Escherichia coli CFT073
cggguuuacuuccccggc

SEQ ID NO: 645743 - RNA, 19 nt, Escherichia coli CFT073
cggguuuaagcccggcauu

SEQ ID NO: 645744 - RNA, 18 nt, Escherichia coli CFT073
cggguucgccaucccugc

SEQ ID NO: 645745 - RNA, 16 nt, Escherichia coli CFT073
cggguuaaccagcacc

SEQ ID NO: 645746 - RNA, 19 nt, Escherichia coli CFT073
cgggugguggcuggcaaca

SEQ ID NO: 645747 - RNA, 12 nt, Escherichia coli CFT073
cggguggccagc

SEQ ID NO: 645748 - RNA, 14 nt, Escherichia coli CFT073
cgggugccucccgg

SEQ ID NO: 645749 - RNA, 19 nt, Escherichia coli CFT073
cgggugcgacaggagccgc

SEQ ID NO: 645750 - RNA, 20 nt, Escherichia coli CFT073
cgggugcgaugcauccggca

SEQ ID NO: 645751 - RNA, 21 nt, Escherichia coli CFT073
cggguauuuaaacuucacgcu

SEQ ID NO: 645752 - RNA, 16 nt, Escherichia coli CFT073
cggguauauaaagccc

SEQ ID NO: 645753 - RNA, 21 nt, Escherichia coli CFT073
cgggucuguaaaagccccuuc

SEQ ID NO: 645754 - RNA, 12 nt, Escherichia coli CFT073
cgggucggcaca

SEQ ID NO: 645755 - RNA, 13 nt, Escherichia coli CFT073
cgggucggcggca

SEQ ID NO: 645756 - RNA, 16 nt, Escherichia coli CFT073
cggugaccgagcgccc

SEQ ID NO: 645757 - RNA, 18 nt, Escherichia coli CFT073
cggugaccgagcgcccgc

SEQ ID NO: 645758 - RNA, 23 nt, Escherichia coli CFT073
cggugaauuucacuuucugacca

SEQ ID NO: 645759 - RNA, 14 nt, Escherichia coli CFT073
cggugacacuuugu

SEQ ID NO: 645760 - RNA, 24 nt, Escherichia coli CFT073
cggugacacuuugugccaucgcca

SEQ ID NO: 645761 - RNA, 13 nt, Escherichia coli CFT073
cggugacuagcag

SEQ ID NO: 645762 - RNA, 19 nt, Escherichia coli CFT073
cggucuuguuaccggcauu

SEQ ID NO: 645763 - RNA, 24 nt, Escherichia coli CFT073
cggugaaaaaccaaucucccagcc

SEQ ID NO: 645764 - RNA, 19 nt, Escherichia coli CFT073
cggucuguauuuggcugcc

SEQ ID NO: 645765 - RNA, 20 nt, Escherichia coli CFT073
cggucuaccgauccggcacc

SEQ ID NO: 645766 - RNA, 21 nt, Escherichia coli CFT073
cggucaguuuucgcccccagc

SEQ ID NO: 645767 - RNA, 23 nt, Escherichia coli CFT073
cggucauaaucauuaacggccac

SEQ ID NO: 645768 - RNA, 18 nt, Escherichia coli CFT073
cggucauaugcaaaccau

SEQ ID NO: 645769 - RNA, 13 nt, Escherichia coli CFT073
cgguccacuuccu

SEQ ID NO: 645770 - RNA, 13 nt, Escherichia coli CFT073
cggucauggucac

SEQ ID NO: 645771 - RNA, 15 nt, Escherichia coli CFT073
cgguccaauggucau

SEQ ID NO: 645772 - RNA, 19 nt, Escherichia coli CFT073
cggucgaggcaaccagcac

SEQ ID NO: 645773 - RNA, 18 nt, Escherichia coli CFT073
cgguccuggcgaucgggc

SEQ ID NO: 645774 - RNA, 15 nt, Escherichia coli CFT073
cgguccuucaucuuc

SEQ ID NO: 645775 - RNA, 23 nt, Escherichia coli CFT073
cggucagcagcaccaccgcccgu

SEQ ID NO: 645776 - RNA, 16 nt, Escherichia coli CFT073
cggucagcagcaccac

SEQ ID NO: 645777 - RNA, 20 nt, Escherichia coli CFT073
cggucacggcuguagccagc

SEQ ID NO: 645778 - RNA, 13 nt, Escherichia coli CFT073
cgguaucaaacac

SEQ ID NO: 645779 - RNA, 14 nt, Escherichia coli CFT073
cgguaucaccaccc

SEQ ID NO: 645780 - RNA, 16 nt, Escherichia coli CFT073
cgguaucaccacccag

SEQ ID NO: 645781 - RNA, 17 nt, Escherichia coli CFT073
cgguaucaccacccagc

SEQ ID NO: 645782 - RNA, 17 nt, Escherichia coli CFT073
cgguaguggcaaccagc

SEQ ID NO: 645783 - RNA, 14 nt, Escherichia coli CFT073
cgguauaacccagu

SEQ ID NO: 645784 - RNA, 15 nt, Escherichia coli CFT073
cgguauaaggcauca

SEQ ID NO: 645785 - RNA, 14 nt, Escherichia coli CFT073
cgguauuaucacua

SEQ ID NO: 645786 - RNA, 19 nt, Escherichia coli CFT073
cgguaucuuuccagccugc

SEQ ID NO: 645787 - RNA, 21 nt, Escherichia coli CFT073
cgguaucugccagcacugcca

SEQ ID NO: 645788 - RNA, 13 nt, Escherichia coli CFT073
cgguaugcgugcu

SEQ ID NO: 645789 - RNA, 15 nt, Escherichia coli CFT073
cggucaaaagcugca

SEQ ID NO: 645790 - RNA, 20 nt, Escherichia coli CFT073
cggucaacccaaccugccag

SEQ ID NO: 645791 - RNA, 18 nt, Escherichia coli CFT073
cggucaaguaaucaauca

SEQ ID NO: 645792 - RNA, 20 nt, Escherichia coli CFT073
cggucaaguaaucaaucacc

SEQ ID NO: 645793 - RNA, 15 nt, Escherichia coli CFT073
cgguacucgcgcagu

SEQ ID NO: 645794 - RNA, 20 nt, Escherichia coli CFT073
cgguacggauagccgcccca

SEQ ID NO: 645795 - RNA, 20 nt, Escherichia coli CFT073
cgguaccuuugaacugcuga

SEQ ID NO: 645796 - RNA, 23 nt, Escherichia coli CFT073
cgguagcaccaguuggucggcga

SEQ ID NO: 645797 - RNA, 20 nt, Escherichia coli CFT073
cgguagccccgcgaacgggg

SEQ ID NO: 645798 - RNA, 15 nt, Escherichia coli CFT073
cgguaggcugacggc

SEQ ID NO: 645799 - RNA, 21 nt, Escherichia coli CFT073
cgguagucaggaagccccagc

SEQ ID NO: 645800 - RNA, 21 nt, Escherichia coli CFT073
cgguaauuugacgugauuggu

SEQ ID NO: 645801 - RNA, 23 nt, Escherichia coli CFT073
cgguacaaacaucauccagugcc

SEQ ID NO: 645802 - RNA, 21 nt, Escherichia coli CFT073
cgguacaaucagacgcaaugu

SEQ ID NO: 645803 - RNA, 14 nt, Escherichia coli CFT073
cgguaaucaccagc

SEQ ID NO: 645804 - RNA, 13 nt, Escherichia coli CFT073
cgguacaggcauc

SEQ ID NO: 645805 - RNA, 16 nt, Escherichia coli CFT073
cgguaccaugacgcac

SEQ ID NO: 645806 - RNA, 18 nt, Escherichia coli CFT073
cgguaaguuaccggcaau

SEQ ID NO: 645807 - RNA, 17 nt, Escherichia coli CFT073
cgguaagccggagcugg

SEQ ID NO: 645808 - RNA, 23 nt, Escherichia coli CFT073
cgguaagaguaaagcccgccauc

SEQ ID NO: 645809 - RNA, 13 nt, Escherichia coli CFT073
cgguaacucugau

SEQ ID NO: 645810 - RNA, 16 nt, Escherichia coli CFT073
cgguaacucugaugac

SEQ ID NO: 645811 - RNA, 23 nt, Escherichia coli CFT073
cgggccacgcugcgcuugcugcc

SEQ ID NO: 645812 - RNA, 19 nt, Escherichia coli CFT073
cgggcaggcuucaacacag

SEQ ID NO: 645813 - RNA, 17 nt, Escherichia coli CFT073
cgggcaaccucuggugu

SEQ ID NO: 645814 - RNA, 13 nt, Escherichia coli CFT073
cgggcaacugcug

SEQ ID NO: 645815 - RNA, 14 nt, Escherichia coli CFT073
cgggcaacugcugc

SEQ ID NO: 645816 - RNA, 22 nt, Escherichia coli CFT073
cgggauguacguucgcgggcgu

SEQ ID NO: 645817 - RNA, 23 nt, Escherichia coli CFT073
cgggauguugcugcgagcuguau

SEQ ID NO: 645818 - RNA, 13 nt, Escherichia coli CFT073
cgggauuccugcg

SEQ ID NO: 645819 - RNA, 14 nt, Escherichia coli CFT073
cgggcaaucggcug

SEQ ID NO: 645820 - RNA, 19 nt, Escherichia coli CFT073
cgggaugaccgacagagga

SEQ ID NO: 645821 - RNA, 11 nt, Escherichia coli CFT073
cgggauaaacg

SEQ ID NO: 645822 - RNA, 18 nt, Escherichia coli CFT073
cgggaucaccagaccaau

SEQ ID NO: 645823 - RNA, 21 nt, Escherichia coli CFT073
cgggauauaugucaccagcau

SEQ ID NO: 645824 - RNA, 19 nt, Escherichia coli CFT073
cgggauagcguagugaugg

SEQ ID NO: 645825 - RNA, 17 nt, Escherichia coli CFT073
cgggauauucagcucaa

SEQ ID NO: 645826 - RNA, 19 nt, Escherichia coli CFT073
cgggaauucaacuaacuga

SEQ ID NO: 645827 - RNA, 19 nt, Escherichia coli CFT073
cgggaauagcucaguuggu

SEQ ID NO: 645828 - RNA, 15 nt, Escherichia coli CFT073
cgggaauaaaagcca

SEQ ID NO: 645829 - RNA, 14 nt, Escherichia coli CFT073
cgggaagugcgccc

SEQ ID NO: 645830 - RNA, 22 nt, Escherichia coli CFT073
cgggagaucgcguucccgacca

SEQ ID NO: 645831 - RNA, 21 nt, Escherichia coli CFT073
cgggagaaacccggccacagc

SEQ ID NO: 645832 - RNA, 15 nt, Escherichia coli CFT073
cgggagagccccagc

SEQ ID NO: 645833 - RNA, 13 nt, Escherichia coli CFT073
cgggccucgcagc

SEQ ID NO: 645834 - RNA, 22 nt, Escherichia coli CFT073
cgggcggcguauuuaaugacag

SEQ ID NO: 645835 - RNA, 14 nt, Escherichia coli CFT073
cgggcuaaucguca

SEQ ID NO: 645836 - RNA, 15 nt, Escherichia coli CFT073
cgggcuaaucgucau

SEQ ID NO: 645837 - RNA, 14 nt, Escherichia coli CFT073
cgggcgugcugccu

SEQ ID NO: 645838 - RNA, 16 nt, Escherichia coli CFT073
cgggcgucgaaaauau

SEQ ID NO: 645839 - RNA, 15 nt, Escherichia coli CFT073
cgggcguaacucagg

SEQ ID NO: 645840 - RNA, 18 nt, Escherichia coli CFT073
cgggcgauacaccuucac

SEQ ID NO: 645841 - RNA, 21 nt, Escherichia coli CFT073
cgggcgaacucuuccggcagg

SEQ ID NO: 645842 - RNA, 22 nt, Escherichia coli CFT073
cggcuguuccggcacaccuuca

SEQ ID NO: 645843 - RNA, 22 nt, Escherichia coli CFT073
cggcuguugauguccaguuccc

SEQ ID NO: 645844 - RNA, 19 nt, Escherichia coli CFT073
cggcuuccuuaagccgcug

SEQ ID NO: 645845 - RNA, 19 nt, Escherichia coli CFT073
cggcuugaggaagcgcgcc

SEQ ID NO: 645846 - RNA, 21 nt, Escherichia coli CFT073
cggcuugaggaagcgcgccgu

SEQ ID NO: 645847 - RNA, 17 nt, Escherichia coli CFT073
cggcuugcaccagcagc

SEQ ID NO: 645848 - RNA, 21 nt, Escherichia coli CFT073
cggcuuuuuuauugcugcacc

SEQ ID NO: 645849 - RNA, 22 nt, Escherichia coli CFT073
cgggaaagcaguuuauaaaauu

SEQ ID NO: 645850 - RNA, 14 nt, Escherichia coli CFT073
cgggaaaagaaaua

SEQ ID NO: 645851 - RNA, 13 nt, Escherichia coli CFT073
cgggaacagccac

SEQ ID NO: 645852 - RNA, 19 nt, Escherichia coli CFT073
cgggaacggcaucgcacca

SEQ ID NO: 645853 - RNA, 22 nt, Escherichia coli CFT073
cggcuuuaccaccgucaauaaa

SEQ ID NO: 645854 - RNA, 13 nt, Escherichia coli CFT073
cggcuuucaacac

SEQ ID NO: 645855 - RNA, 17 nt, Escherichia coli CFT073
cggcuuugcagguucug

SEQ ID NO: 645856 - RNA, 16 nt, Escherichia coli CFT073
cggcucuggcggcgcu

SEQ ID NO: 645857 - RNA, 14 nt, Escherichia coli CFT073
cggcugcugccagc

SEQ ID NO: 645858 - RNA, 12 nt, Escherichia coli CFT073
cggcugccugga

SEQ ID NO: 645859 - RNA, 23 nt, Escherichia coli CFT073
cggcuggcgcaauauucaagaua

SEQ ID NO: 645860 - RNA, 18 nt, Escherichia coli CFT073
cggcuggccuuccggcac

SEQ ID NO: 645861 - RNA, 21 nt, Escherichia coli CFT073
cggcuggguagcuuccugcug

SEQ ID NO: 645862 - RNA, 15 nt, Escherichia coli CFT073
cggcuaagcaauuac

SEQ ID NO: 645863 - RNA, 13 nt, Escherichia coli CFT073
cggcguuuugcuu

SEQ ID NO: 645864 - RNA, 23 nt, Escherichia coli CFT073
cggcguuuuuucaucacugcgcu

SEQ ID NO: 645865 - RNA, 16 nt, Escherichia coli CFT073
cggcuacgccaccagc

SEQ ID NO: 645866 - RNA, 16 nt, Escherichia coli CFT073
cggcguuaccggcaau

SEQ ID NO: 645867 - RNA, 16 nt, Escherichia coli CFT073
cggcguucaccagcgc

SEQ ID NO: 645868 - RNA, 17 nt, Escherichia coli CFT073
cggcuccagacgcccgc

SEQ ID NO: 645869 - RNA, 21 nt, Escherichia coli CFT073
cggcuccagacgcccgcgccc

SEQ ID NO: 645870 - RNA, 11 nt, Escherichia coli CFT073
cggcuccagau

SEQ ID NO: 645871 - RNA, 13 nt, Escherichia coli CFT073
cggcucagcaaua

SEQ ID NO: 645872 - RNA, 17 nt, Escherichia coli CFT073
cggcucaaccccagcca

SEQ ID NO: 645873 - RNA, 23 nt, Escherichia coli CFT073
cggcuccaguuaacgccgcgccc

SEQ ID NO: 645874 - RNA, 24 nt, Escherichia coli CFT073
cggcuccaguuaacgccgcgcccg

SEQ ID NO: 645875 - RNA, 16 nt, Escherichia coli CFT073
cggcuccccgcccuga

SEQ ID NO: 645876 - RNA, 14 nt, Escherichia coli CFT073
cggcuccagcaaug

SEQ ID NO: 645877 - RNA, 18 nt, Escherichia coli CFT073
cggcgugcgcgcccauac

SEQ ID NO: 645878 - RNA, 17 nt, Escherichia coli CFT073
cggcgugcaucucuuca

SEQ ID NO: 645879 - RNA, 19 nt, Escherichia coli CFT073
cggcgucuuguugaacaga

SEQ ID NO: 645880 - RNA, 17 nt, Escherichia coli CFT073
cggcguguagcccauca

SEQ ID NO: 645881 - RNA, 15 nt, Escherichia coli CFT073
cggcguggugcagcc

SEQ ID NO: 645882 - RNA, 19 nt, Escherichia coli CFT073
cggcguggugcagccgcca

SEQ ID NO: 645883 - RNA, 19 nt, Escherichia coli CFT073
cuucaaaauuuaacauuac

SEQ ID NO: 645884 - RNA, 21 nt, Escherichia coli CFT073
cuucaaccguuucuuuuucga

SEQ ID NO: 645885 - RNA, 18 nt, Escherichia coli CFT073
cuucaagaauccuuauuu

SEQ ID NO: 645886 - RNA, 22 nt, Escherichia coli CFT073
cuucaagaaucgagcaauaaac

SEQ ID NO: 645887 - RNA, 18 nt, Escherichia coli CFT073
cuucaagaauuaaaauau

SEQ ID NO: 645888 - RNA, 19 nt, Escherichia coli CFT073
cuucaacguuaggcggaaa

SEQ ID NO: 645889 - RNA, 19 nt, Escherichia coli CFT073
cuucaacuacggcuuuuuu

SEQ ID NO: 645890 - RNA, 12 nt, Escherichia coli CFT073
cuucaaucaaua

SEQ ID NO: 645891 - RNA, 13 nt, Escherichia coli CFT073
cuucaaucaauaa

SEQ ID NO: 645892 - RNA, 20 nt, Escherichia coli CFT073
cuucaaucaauaacagcgca

SEQ ID NO: 645893 - RNA, 17 nt, Escherichia coli CFT073
cuucaaucaacauauuu

SEQ ID NO: 645894 - RNA, 23 nt, Escherichia coli CFT073
cuucacggcugcuaauauuuucg

SEQ ID NO: 645895 - RNA, 17 nt, Escherichia coli CFT073
cuucaccgacaucuuuc

SEQ ID NO: 645896 - RNA, 15 nt, Escherichia coli CFT073
cuucacccgcagcac

SEQ ID NO: 645897 - RNA, 16 nt, Escherichia coli CFT073
cuucacccgcagcacg

SEQ ID NO: 645898 - RNA, 20 nt, Escherichia coli CFT073
cuucacccguugaucuucuc

SEQ ID NO: 645899 - RNA, 21 nt, Escherichia coli CFT073
cuucacccguugaucuucucu

SEQ ID NO: 645900 - RNA, 22 nt, Escherichia coli CFT073
cuucacccucacgcauucucuu

SEQ ID NO: 645901 - RNA, 16 nt, Escherichia coli CFT073
cuucacggaucgcuuu

SEQ ID NO: 645902 - RNA, 16 nt, Escherichia coli CFT073
cuucacggcugcuaau

SEQ ID NO: 645903 - RNA, 18 nt, Escherichia coli CFT073
cuucacauuguuaaagcc

SEQ ID NO: 645904 - RNA, 17 nt, Escherichia coli CFT073
cuucaaucgccaccacg

SEQ ID NO: 645905 - RNA, 18 nt, Escherichia coli CFT073
cuucaccaauguucaguu

SEQ ID NO: 645906 - RNA, 15 nt, Escherichia coli CFT073
cuucaccaccagaaa

SEQ ID NO: 645907 - RNA, 14 nt, Escherichia coli CFT073
cuucagucaggcga

SEQ ID NO: 645908 - RNA, 16 nt, Escherichia coli CFT073
cuucagucaggcgauu

SEQ ID NO: 645909 - RNA, 16 nt, Escherichia coli CFT073
cuucaucacgcagugu

SEQ ID NO: 645910 - RNA, 21 nt, Escherichia coli CFT073
cuucauugcucucuucuccuu

SEQ ID NO: 645911 - RNA, 15 nt, Escherichia coli CFT073
cuucauugacgccaa

SEQ ID NO: 645912 - RNA, 17 nt, Escherichia coli CFT073
cuucauuggcuugcacc

SEQ ID NO: 645913 - RNA, 14 nt, Escherichia coli CFT073
cuucauuaucuucu

SEQ ID NO: 645914 - RNA, 15 nt, Escherichia coli CFT073
cuucauucagccuuc

SEQ ID NO: 645915 - RNA, 19 nt, Escherichia coli CFT073
cuucauucagguauugugu

SEQ ID NO: 645916 - RNA, 14 nt, Escherichia coli CFT073
cuucaucccugaaa

SEQ ID NO: 645917 - RNA, 18 nt, Escherichia coli CFT073
cuucauccagggugagga

SEQ ID NO: 645918 - RNA, 20 nt, Escherichia coli CFT073
cuucagcaagaguuuuaaaa

SEQ ID NO: 645919 - RNA, 23 nt, Escherichia coli CFT073
cuucagcaagaguuuuaaaacca

SEQ ID NO: 645920 - RNA, 14 nt, Escherichia coli CFT073
cuucagcaguucag

SEQ ID NO: 645921 - RNA, 24 nt, Escherichia coli CFT073
cuucagccaaagcgacacaaucaa

SEQ ID NO: 645922 - RNA, 12 nt, Escherichia coli CFT073
cuucagcaucaa

SEQ ID NO: 645923 - RNA, 14 nt, Escherichia coli CFT073
cuucacucucuuuu

SEQ ID NO: 645924 - RNA, 11 nt, Escherichia coli CFT073
cuucagguuca

SEQ ID NO: 645925 - RNA, 21 nt, Escherichia coli CFT073
cuucagggcgcacgcacggcg

SEQ ID NO: 645926 - RNA, 15 nt, Escherichia coli CFT073
cuucaggauugguaa

SEQ ID NO: 645927 - RNA, 23 nt, Escherichia coli CFT073
cuucagcuguuucaguaacuggc

SEQ ID NO: 645928 - RNA, 23 nt, Escherichia coli CFT073
cuucagcuucggcgacuauuuca

SEQ ID NO: 645929 - RNA, 21 nt, Escherichia coli CFT073
cuucgacguucuuuaccggau

SEQ ID NO: 645930 - RNA, 16 nt, Escherichia coli CFT073
cuucgaguacauccac

SEQ ID NO: 645931 - RNA, 14 nt, Escherichia coli CFT073
cuucgcgcaccaau

SEQ ID NO: 645932 - RNA, 17 nt, Escherichia coli CFT073
cuucgcgccauccagcu

SEQ ID NO: 645933 - RNA, 14 nt, Escherichia coli CFT073
cuucggucagcacg

SEQ ID NO: 645934 - RNA, 17 nt, Escherichia coli CFT073
cuucggugcgacaaaca

SEQ ID NO: 645935 - RNA, 18 nt, Escherichia coli CFT073
cuuccuacaagaggucaa

SEQ ID NO: 645936 - RNA, 21 nt, Escherichia coli CFT073
cuuccuauggcuucuauuuuu

SEQ ID NO: 645937 - RNA, 16 nt, Escherichia coli CFT073
cuuccuccaccacuuu

SEQ ID NO: 645938 - RNA, 16 nt, Escherichia coli CFT073
cuuccgggcuauacac

SEQ ID NO: 645939 - RNA, 14 nt, Escherichia coli CFT073
cuuccggugcgauc

SEQ ID NO: 645940 - RNA, 19 nt, Escherichia coli CFT073
cuuccugcggcagacgcuc

SEQ ID NO: 645941 - RNA, 23 nt, Escherichia coli CFT073
cuuccugccucuuugccgcuuuu

SEQ ID NO: 645942 - RNA, 18 nt, Escherichia coli CFT073
cuuccugcaaucuuuccu

SEQ ID NO: 645943 - RNA, 23 nt, Escherichia coli CFT073
cuuccugcagcgugauccacccu

SEQ ID NO: 645944 - RNA, 19 nt, Escherichia coli CFT073
cuuccugccagauccagug

SEQ ID NO: 645945 - RNA, 15 nt, Escherichia coli CFT073
cuuccuuaagcacaa

SEQ ID NO: 645946 - RNA, 15 nt, Escherichia coli CFT073
cuuccugucuucccu

SEQ ID NO: 645947 - RNA, 18 nt, Escherichia coli CFT073
cuuccugucuucccugcu

SEQ ID NO: 645948 - RNA, 22 nt, Escherichia coli CFT073
aaacuucauuugucucaaaacu

SEQ ID NO: 645949 - RNA, 19 nt, Escherichia coli CFT073
aaacuuccggcaagauuug

SEQ ID NO: 645950 - RNA, 16 nt, Escherichia coli CFT073
cuuccagacucaucuu

SEQ ID NO: 645951 - RNA, 17 nt, Escherichia coli CFT073
cuuccagacucaucuuc

SEQ ID NO: 645952 - RNA, 21 nt, Escherichia coli CFT073
cuuccagacucugaaacucga

SEQ ID NO: 645953 - RNA, 12 nt, Escherichia coli CFT073
cuuccacuuccu

SEQ ID NO: 645954 - RNA, 20 nt, Escherichia coli CFT073
cuuccagaaacauccccagc

SEQ ID NO: 645955 - RNA, 22 nt, Escherichia coli CFT073
cuuccagaauccguacgcuuuu

SEQ ID NO: 645956 - RNA, 15 nt, Escherichia coli CFT073
cuuccagcuccagcc

SEQ ID NO: 645957 - RNA, 18 nt, Escherichia coli CFT073
cuuccagcuccagccgcu

SEQ ID NO: 645958 - RNA, 13 nt, Escherichia coli CFT073
cuuccaccacuuc

SEQ ID NO: 645959 - RNA, 17 nt, Escherichia coli CFT073
cuuccaccacuuccugc

SEQ ID NO: 645960 - RNA, 21 nt, Escherichia coli CFT073
cuuccaccagauggcuuucca

SEQ ID NO: 645961 - RNA, 14 nt, Escherichia coli CFT073
cuuccacuucauca

SEQ ID NO: 645962 - RNA, 18 nt, Escherichia coli CFT073
cuuccacuucaucaagca

SEQ ID NO: 645963 - RNA, 19 nt, Escherichia coli CFT073
cuuccgcuuuuaacaucuu

SEQ ID NO: 645964 - RNA, 21 nt, Escherichia coli CFT073
cuucccgggucgcgacugcca

SEQ ID NO: 645965 - RNA, 16 nt, Escherichia coli CFT073
cuuccggaaccaccag

SEQ ID NO: 645966 - RNA, 20 nt, Escherichia coli CFT073
cuuccggaaccaccagaucc

SEQ ID NO: 645967 - RNA, 19 nt, Escherichia coli CFT073
cuuccggacguucagccau

SEQ ID NO: 645968 - RNA, 15 nt, Escherichia coli CFT073
cuuccggagcugcuc

SEQ ID NO: 645969 - RNA, 15 nt, Escherichia coli CFT073
cuuccggcagcuuca

SEQ ID NO: 645970 - RNA, 15 nt, Escherichia coli CFT073
cuuccggcguggcgu

SEQ ID NO: 645971 - RNA, 20 nt, Escherichia coli CFT073
cuuccggcuacgccaccagc

SEQ ID NO: 645972 - RNA, 16 nt, Escherichia coli CFT073
cuuccggcuguagccc

SEQ ID NO: 645973 - RNA, 23 nt, Escherichia coli CFT073
cuuccaguggcauuuucugcccg

SEQ ID NO: 645974 - RNA, 19 nt, Escherichia coli CFT073
cuucccgcagaccuucugc

SEQ ID NO: 645975 - RNA, 22 nt, Escherichia coli CFT073
cuuccccuuuugccuucugagc

SEQ ID NO: 645976 - RNA, 23 nt, Escherichia coli CFT073
cuuccccugccaaccaacgcgcc

SEQ ID NO: 645977 - RNA, 18 nt, Escherichia coli CFT073
cuuccccguuuugccagu

SEQ ID NO: 645978 - RNA, 21 nt, Escherichia coli CFT073
cuuaaugucacaaucccuucc

SEQ ID NO: 645979 - RNA, 23 nt, Escherichia coli CFT073
cuuaaugcccaucucuucuucaa

SEQ ID NO: 645980 - RNA, 18 nt, Escherichia coli CFT073
cuuaauggaaaacuguuu

SEQ ID NO: 645981 - RNA, 12 nt, Escherichia coli CFT073
cuuaaugaaaag

SEQ ID NO: 645982 - RNA, 22 nt, Escherichia coli CFT073
cuuaaugcacggcagauaaaca

SEQ ID NO: 645983 - RNA, 13 nt, Escherichia coli CFT073
cuuacauauauua

SEQ ID NO: 645984 - RNA, 17 nt, Escherichia coli CFT073
cuuacauauauuacuca

SEQ ID NO: 645985 - RNA, 21 nt, Escherichia coli CFT073
cuuacauauauuacucauuaa

SEQ ID NO: 645986 - RNA, 16 nt, Escherichia coli CFT073
cuuacauucugucuca

SEQ ID NO: 645987 - RNA, 15 nt, Escherichia coli CFT073
cuuaccaaccgcaau

SEQ ID NO: 645988 - RNA, 22 nt, Escherichia coli CFT073
cuuaccacuaccgcacggacaa

SEQ ID NO: 645989 - RNA, 16 nt, Escherichia coli CFT073
cuuaccauccacacca

SEQ ID NO: 645990 - RNA, 14 nt, Escherichia coli CFT073
cuuaccccgcccga

SEQ ID NO: 645991 - RNA, 15 nt, Escherichia coli CFT073
cuuacgcaacugcca

SEQ ID NO: 645992 - RNA, 17 nt, Escherichia coli CFT073
cuuacgcaacugccagu

SEQ ID NO: 645993 - RNA, 17 nt, Escherichia coli CFT073
cuuacgcaccggaaauu

SEQ ID NO: 645994 - RNA, 22 nt, Escherichia coli CFT073
cuuacucauuaaugcacuucca

SEQ ID NO: 645995 - RNA, 16 nt, Escherichia coli CFT073
cuuaccguaggccagc

SEQ ID NO: 645996 - RNA, 14 nt, Escherichia coli CFT073
cuuaccuaccugcu

SEQ ID NO: 645997 - RNA, 12 nt, Escherichia coli CFT073
cuuaccuccugu

SEQ ID NO: 645998 - RNA, 21 nt, Escherichia coli CFT073
cuuacgaaaaagauauguugc

SEQ ID NO: 645999 - RNA, 22 nt, Escherichia coli CFT073
cuuauccggccuccauaagagu

SEQ ID NO: 646000 - RNA, 17 nt, Escherichia coli CFT073
cuuaucgcccugcucca

SEQ ID NO: 646001 - RNA, 18 nt, Escherichia coli CFT073
cuuaucgcccugcuccag

SEQ ID NO: 646002 - RNA, 20 nt, Escherichia coli CFT073
cuuaucgcccugcuccagca

SEQ ID NO: 646003 - RNA, 20 nt, Escherichia coli CFT073
cuuaugcugcgccaguugcu

SEQ ID NO: 646004 - RNA, 20 nt, Escherichia coli CFT073
cuuaugcugcuuacauaguu

SEQ ID NO: 646005 - RNA, 16 nt, Escherichia coli CFT073
cuuauuaaagaucuua

SEQ ID NO: 646006 - RNA, 14 nt, Escherichia coli CFT073
cuuagcgcaaguuu

SEQ ID NO: 646007 - RNA, 16 nt, Escherichia coli CFT073
cuuaggggacauuuag

SEQ ID NO: 646008 - RNA, 17 nt, Escherichia coli CFT073
cuuaucaaucucugcaa

SEQ ID NO: 646009 - RNA, 19 nt, Escherichia coli CFT073
cuuaucaaucucugcaaga

SEQ ID NO: 646010 - RNA, 22 nt, Escherichia coli CFT073
cuuauccggccuacgggaacag

SEQ ID NO: 646011 - RNA, 12 nt, Escherichia coli CFT073
cuuauauaaaac

SEQ ID NO: 646012 - RNA, 17 nt, Escherichia coli CFT073
cuuauauacucuaaaua

SEQ ID NO: 646013 - RNA, 14 nt, Escherichia coli CFT073
cuguucgccgcagc

SEQ ID NO: 646014 - RNA, 18 nt, Escherichia coli CFT073
cuguucgccgccgcuuuc

SEQ ID NO: 646015 - RNA, 17 nt, Escherichia coli CFT073
cuguucgagguaaucca

SEQ ID NO: 646016 - RNA, 22 nt, Escherichia coli CFT073
cuguuccuuauucugugaacuu

SEQ ID NO: 646017 - RNA, 13 nt, Escherichia coli CFT073
cuguuccucaacu

SEQ ID NO: 646018 - RNA, 12 nt, Escherichia coli CFT073
cuguuccucccg

SEQ ID NO: 646019 - RNA, 16 nt, Escherichia coli CFT073
cuguuccggcagaaac

SEQ ID NO: 646020 - RNA, 15 nt, Escherichia coli CFT073
cuguuccggcuuugu

SEQ ID NO: 646021 - RNA, 14 nt, Escherichia coli CFT073
cuguuguuccagcu

SEQ ID NO: 646022 - RNA, 21 nt, Escherichia coli CFT073
cuguuuaagcgaaagcgugag

SEQ ID NO: 646023 - RNA, 20 nt, Escherichia coli CFT073
cuguuucacgcccagaucca

SEQ ID NO: 646024 - RNA, 14 nt, Escherichia coli CFT073
cuguuuccaguuac

SEQ ID NO: 646025 - RNA, 12 nt, Escherichia coli CFT073
cuguuauauauu

SEQ ID NO: 646026 - RNA, 13 nt, Escherichia coli CFT073
cuguuacuacaga

SEQ ID NO: 646027 - RNA, 23 nt, Escherichia coli CFT073
cuguuacuacagaggguuuuuua

SEQ ID NO: 646028 - RNA, 19 nt, Escherichia coli CFT073
cuguucaaaugcgcucaga

SEQ ID NO: 646029 - RNA, 16 nt, Escherichia coli CFT073
cuggccccaccugcuc

SEQ ID NO: 646030 - RNA, 19 nt, Escherichia coli CFT073
cuggccccuggcuggucag

SEQ ID NO: 646031 - RNA, 15 nt, Escherichia coli CFT073
cuggcccauagacag

SEQ ID NO: 646032 - RNA, 18 nt, Escherichia coli CFT073
cuggcccauugccagcgc

SEQ ID NO: 646033 - RNA, 18 nt, Escherichia coli CFT073
cuuaacgcgggcuucuuc

SEQ ID NO: 646034 - RNA, 19 nt, Escherichia coli CFT073
cuuaacgcgggcuucuucu

SEQ ID NO: 646035 - RNA, 19 nt, Escherichia coli CFT073
cuuaacgauuacagcaucg

SEQ ID NO: 646036 - RNA, 16 nt, Escherichia coli CFT073
cuuaacggcagcgccu

SEQ ID NO: 646037 - RNA, 16 nt, Escherichia coli CFT073
cuuaacccaaauccgc

SEQ ID NO: 646038 - RNA, 18 nt, Escherichia coli CFT073
cuuaaccggcuucguuuu

SEQ ID NO: 646039 - RNA, 22 nt, Escherichia coli CFT073
cuuaaucaucaaugccagcaua

SEQ ID NO: 646040 - RNA, 20 nt, Escherichia coli CFT073
cuuaacaccggcgcacuggc

SEQ ID NO: 646041 - RNA, 23 nt, Escherichia coli CFT073
cuuaacagauugagaauaaugcc

SEQ ID NO: 646042 - RNA, 17 nt, Escherichia coli CFT073
cuguuugaucugcugcc

SEQ ID NO: 646043 - RNA, 12 nt, Escherichia coli CFT073
cuguuucugucg

SEQ ID NO: 646044 - RNA, 21 nt, Escherichia coli CFT073
cuguuucugucgagcaucacu

SEQ ID NO: 646045 - RNA, 14 nt, Escherichia coli CFT073
cuguuuuuccagcu

SEQ ID NO: 646046 - RNA, 15 nt, Escherichia coli CFT073
cuguuuuugcgaugg

SEQ ID NO: 646047 - RNA, 16 nt, Escherichia coli CFT073
cuuaaaaaccagagaa

SEQ ID NO: 646048 - RNA, 13 nt, Escherichia coli CFT073
cuguuuuuucauc

SEQ ID NO: 646049 - RNA, 22 nt, Escherichia coli CFT073
cuguuuuuuaccugucgcuuug

SEQ ID NO: 646050 - RNA, 19 nt, Escherichia coli CFT073
cuugcguacaccaacauca

SEQ ID NO: 646051 - RNA, 13 nt, Escherichia coli CFT073
cuugcggccagca

SEQ ID NO: 646052 - RNA, 14 nt, Escherichia coli CFT073
cuugcggaaacugu

SEQ ID NO: 646053 - RNA, 22 nt, Escherichia coli CFT073
cuugcgcggauggccucugcca

SEQ ID NO: 646054 - RNA, 15 nt, Escherichia coli CFT073
cuugcgcgcaaucag

SEQ ID NO: 646055 - RNA, 13 nt, Escherichia coli CFT073
cuugcgccgcccg

SEQ ID NO: 646056 - RNA, 18 nt, Escherichia coli CFT073
cuugcgauuacguucggc

SEQ ID NO: 646057 - RNA, 17 nt, Escherichia coli CFT073
cuugcgauccugcagau

SEQ ID NO: 646058 - RNA, 15 nt, Escherichia coli CFT073
cuugcugcuccagcg

SEQ ID NO: 646059 - RNA, 21 nt, Escherichia coli CFT073
cuugcugcuccagcgggcgaa

SEQ ID NO: 646060 - RNA, 15 nt, Escherichia coli CFT073
cuugcuggucacuga

SEQ ID NO: 646061 - RNA, 12 nt, Escherichia coli CFT073
cuugcucagugu

SEQ ID NO: 646062 - RNA, 22 nt, Escherichia coli CFT073
cuugcucgcgcaccuacagcca

SEQ ID NO: 646063 - RNA, 14 nt, Escherichia coli CFT073
cuugcugacguaaa

SEQ ID NO: 646064 - RNA, 13 nt, Escherichia coli CFT073
aaacuuuuaaauu

SEQ ID NO: 646065 - RNA, 19 nt, Escherichia coli CFT073
aaacuuuuaaauugaagag

SEQ ID NO: 646066 - RNA, 12 nt, Escherichia coli CFT073
aaacuuuuaaau

SEQ ID NO: 646067 - RNA, 18 nt, Escherichia coli CFT073
aaacuugguuacgcaccg

SEQ ID NO: 646068 - RNA, 18 nt, Escherichia coli CFT073
aaacuugcgugauauuac

SEQ ID NO: 646069 - RNA, 23 nt, Escherichia coli CFT073
cuugccgcgucuuaucaggccua

SEQ ID NO: 646070 - RNA, 14 nt, Escherichia coli CFT073
cuugcgacagccau

SEQ ID NO: 646071 - RNA, 17 nt, Escherichia coli CFT073
cuugcgauauggcugcg

SEQ ID NO: 646072 - RNA, 17 nt, Escherichia coli CFT073
cuugccuucacaggccg

SEQ ID NO: 646073 - RNA, 16 nt, Escherichia coli CFT073
cuugccuccagcgacg

SEQ ID NO: 646074 - RNA, 13 nt, Escherichia coli CFT073
cuugccucccugc

SEQ ID NO: 646075 - RNA, 18 nt, Escherichia coli CFT073
cuugccgucuucuuccca

SEQ ID NO: 646076 - RNA, 14 nt, Escherichia coli CFT073
cuugccugcaggaa

SEQ ID NO: 646077 - RNA, 20 nt, Escherichia coli CFT073
cuugccaccgcuaaacguua

SEQ ID NO: 646078 - RNA, 15 nt, Escherichia coli CFT073
cuugccauuccacaa

SEQ ID NO: 646079 - RNA, 20 nt, Escherichia coli CFT073
cuugccauuccacaaaaacc

SEQ ID NO: 646080 - RNA, 18 nt, Escherichia coli CFT073
cuugccagugacaugaau

SEQ ID NO: 646081 - RNA, 20 nt, Escherichia coli CFT073
cuugccagauuuucuucagc

SEQ ID NO: 646082 - RNA, 21 nt, Escherichia coli CFT073
cuugccagauuuucuucagcu

SEQ ID NO: 646083 - RNA, 16 nt, Escherichia coli CFT073
cuugccagcaggguuu

SEQ ID NO: 646084 - RNA, 23 nt, Escherichia coli CFT073
cuugcagccagaacucaucuucu

SEQ ID NO: 646085 - RNA, 12 nt, Escherichia coli CFT073
cuugaucuuccu

SEQ ID NO: 646086 - RNA, 17 nt, Escherichia coli CFT073
cuugauucuguucagua

SEQ ID NO: 646087 - RNA, 23 nt, Escherichia coli CFT073
cuugcaacuccggcgaaaauccc

SEQ ID NO: 646088 - RNA, 13 nt, Escherichia coli CFT073
cuugaguaauuaa

SEQ ID NO: 646089 - RNA, 17 nt, Escherichia coli CFT073
cuugaguaccgagaaaa

SEQ ID NO: 646090 - RNA, 20 nt, Escherichia coli CFT073
cuugagacagaaacaaauga

SEQ ID NO: 646091 - RNA, 19 nt, Escherichia coli CFT073
cuugacucuguagcgggaa

SEQ ID NO: 646092 - RNA, 20 nt, Escherichia coli CFT073
cuugacucuguggcgggaaa

SEQ ID NO: 646093 - RNA, 14 nt, Escherichia coli CFT073
cuugacuaucacuc

SEQ ID NO: 646094 - RNA, 16 nt, Escherichia coli CFT073
cuugaacuuaucauca

SEQ ID NO: 646095 - RNA, 20 nt, Escherichia coli CFT073
cuugaauaaauuggcugggg

SEQ ID NO: 646096 - RNA, 21 nt, Escherichia coli CFT073
cuugaauaaauuggcuggggu

SEQ ID NO: 646097 - RNA, 18 nt, Escherichia coli CFT073
cuugaaggguuuaauaau

SEQ ID NO: 646098 - RNA, 15 nt, Escherichia coli CFT073
cuugaagccuucgcc

SEQ ID NO: 646099 - RNA, 21 nt, Escherichia coli CFT073
cuugacccguuuuaaaucgcc

SEQ ID NO: 646100 - RNA, 20 nt, Escherichia coli CFT073
cuugaauuuaucuucaccaa

SEQ ID NO: 646101 - RNA, 18 nt, Escherichia coli CFT073
cuucuuucucggccaccg

SEQ ID NO: 646102 - RNA, 16 nt, Escherichia coli CFT073
cuucuuucucuuucuu

SEQ ID NO: 646103 - RNA, 20 nt, Escherichia coli CFT073
cuucuuuaguugagcuuuuu

SEQ ID NO: 646104 - RNA, 17 nt, Escherichia coli CFT073
cuucuuuugucgcuuua

SEQ ID NO: 646105 - RNA, 21 nt, Escherichia coli CFT073
cuugaaaccgguuuguaggcc

SEQ ID NO: 646106 - RNA, 19 nt, Escherichia coli CFT073
cuugaaaucaccguagccc

SEQ ID NO: 646107 - RNA, 17 nt, Escherichia coli CFT073
cuucuucauucauccgc

SEQ ID NO: 646108 - RNA, 20 nt, Escherichia coli CFT073
cuucuucccagacccaguuu

SEQ ID NO: 646109 - RNA, 22 nt, Escherichia coli CFT073
cuucuuccgcgccaaacauuuc

SEQ ID NO: 646110 - RNA, 18 nt, Escherichia coli CFT073
cuucuuccgggcuauaca

SEQ ID NO: 646111 - RNA, 16 nt, Escherichia coli CFT073
cuucuuccugcgccag

SEQ ID NO: 646112 - RNA, 16 nt, Escherichia coli CFT073
cuucuucuggcugcca

SEQ ID NO: 646113 - RNA, 16 nt, Escherichia coli CFT073
cuucuucuuucgccag

SEQ ID NO: 646114 - RNA, 19 nt, Escherichia coli CFT073
cuucuucgucgucuucguc

SEQ ID NO: 646115 - RNA, 14 nt, Escherichia coli CFT073
cuucuucuaugcca

SEQ ID NO: 646116 - RNA, 14 nt, Escherichia coli CFT073
cuucuucucagcca

SEQ ID NO: 646117 - RNA, 13 nt, Escherichia coli CFT073
cuucuucaaaaaa

SEQ ID NO: 646118 - RNA, 19 nt, Escherichia coli CFT073
cuucuucacaucaauauuc

SEQ ID NO: 646119 - RNA, 13 nt, Escherichia coli CFT073
cuucuguuuuauc

SEQ ID NO: 646120 - RNA, 23 nt, Escherichia coli CFT073
cuucuuaaugcccaucucuucuu

SEQ ID NO: 646121 - RNA, 19 nt, Escherichia coli CFT073
cuucuggaucaaagucauc

SEQ ID NO: 646122 - RNA, 15 nt, Escherichia coli CFT073
cuucuggcggcggca

SEQ ID NO: 646123 - RNA, 12 nt, Escherichia coli CFT073
cuucguugauca

SEQ ID NO: 646124 - RNA, 12 nt, Escherichia coli CFT073
cuucguucaucu

SEQ ID NO: 646125 - RNA, 17 nt, Escherichia coli CFT073
cuucguuuuccgcuucg

SEQ ID NO: 646126 - RNA, 16 nt, Escherichia coli CFT073
cuucguuuucugcgcu

SEQ ID NO: 646127 - RNA, 23 nt, Escherichia coli CFT073
cuucguuuugcuguuccagcauc

SEQ ID NO: 646128 - RNA, 14 nt, Escherichia coli CFT073
cuucguucagccaa

SEQ ID NO: 646129 - RNA, 18 nt, Escherichia coli CFT073
cuucgugcggcugcaucu

SEQ ID NO: 646130 - RNA, 18 nt, Escherichia coli CFT073
cuucguaccaaaugaacc

SEQ ID NO: 646131 - RNA, 21 nt, Escherichia coli CFT073
cuucguacuacgcgccgccag

SEQ ID NO: 646132 - RNA, 23 nt, Escherichia coli CFT073
cuucgguuuuguugccgcccguu

SEQ ID NO: 646133 - RNA, 14 nt, Escherichia coli CFT073
cuucgucaaagaua

SEQ ID NO: 646134 - RNA, 16 nt, Escherichia coli CFT073
cuucgucgucuucguc

SEQ ID NO: 646135 - RNA, 19 nt, Escherichia coli CFT073
cuucguccaucccacacug

SEQ ID NO: 646136 - RNA, 13 nt, Escherichia coli CFT073
cuucgucccaguc

SEQ ID NO: 646137 - RNA, 22 nt, Escherichia coli CFT073
cuucgucccagucgucauccca

SEQ ID NO: 646138 - RNA, 15 nt, Escherichia coli CFT073
cuucgucgccagcuc

SEQ ID NO: 646139 - RNA, 18 nt, Escherichia coli CFT073
cuucgucgccagcucuuc

SEQ ID NO: 646140 - RNA, 21 nt, Escherichia coli CFT073
cuucuaauucgacacaacgag

SEQ ID NO: 646141 - RNA, 12 nt, Escherichia coli CFT073
cuucuaaaucgu

SEQ ID NO: 646142 - RNA, 13 nt, Escherichia coli CFT073
cuucuacauuucu

SEQ ID NO: 646143 - RNA, 21 nt, Escherichia coli CFT073
cuucuaccugaugcuuuuuuc

SEQ ID NO: 646144 - RNA, 17 nt, Escherichia coli CFT073
cuucuaauugugcugca

SEQ ID NO: 646145 - RNA, 14 nt, Escherichia coli CFT073
cuucuaucuucauc

SEQ ID NO: 646146 - RNA, 14 nt, Escherichia coli CFT073
cuucuauaucuccc

SEQ ID NO: 646147 - RNA, 20 nt, Escherichia coli CFT073
cuucuaguucauguauuuuu

SEQ ID NO: 646148 - RNA, 17 nt, Escherichia coli CFT073
cuucuacugcaugauua

SEQ ID NO: 646149 - RNA, 16 nt, Escherichia coli CFT073
cuucuacuucacggcu

SEQ ID NO: 646150 - RNA, 17 nt, Escherichia coli CFT073
cuucuagcaugaugaua

SEQ ID NO: 646151 - RNA, 13 nt, Escherichia coli CFT073
cuucucagccaaa

SEQ ID NO: 646152 - RNA, 15 nt, Escherichia coli CFT073
cuucucaaucccuuu

SEQ ID NO: 646153 - RNA, 19 nt, Escherichia coli CFT073
cuucucaaucccuuucucc

SEQ ID NO: 646154 - RNA, 19 nt, Escherichia coli CFT073
cuucucacugcccugcaac

SEQ ID NO: 646155 - RNA, 18 nt, Escherichia coli CFT073
cuucucacggauccagaa

SEQ ID NO: 646156 - RNA, 20 nt, Escherichia coli CFT073
cuucucgucaaucugcucca

SEQ ID NO: 646157 - RNA, 22 nt, Escherichia coli CFT073
cuucucggacaauaguuucaau

SEQ ID NO: 646158 - RNA, 15 nt, Escherichia coli CFT073
cuucucgugaaauuc

SEQ ID NO: 646159 - RNA, 18 nt, Escherichia coli CFT073
cuucucuacgcaaagaga

SEQ ID NO: 646160 - RNA, 22 nt, Escherichia coli CFT073
cuucucucccgcauuccauugu

SEQ ID NO: 646161 - RNA, 15 nt, Escherichia coli CFT073
cuucucuucuuccgc

SEQ ID NO: 646162 - RNA, 16 nt, Escherichia coli CFT073
cuucucugaaaauuaa

SEQ ID NO: 646163 - RNA, 16 nt, Escherichia coli CFT073
cuucugaaucagauca

SEQ ID NO: 646164 - RNA, 18 nt, Escherichia coli CFT073
cuucugauaaaugaagaa

SEQ ID NO: 646165 - RNA, 14 nt, Escherichia coli CFT073
cuucugcaaucaac

SEQ ID NO: 646166 - RNA, 23 nt, Escherichia coli CFT073
cuucugcaaucaacacuucuuug

SEQ ID NO: 646167 - RNA, 22 nt, Escherichia coli CFT073
cuucugcacgguuuuuccagcu

SEQ ID NO: 646168 - RNA, 15 nt, Escherichia coli CFT073
cuucuggccauugaa

SEQ ID NO: 646169 - RNA, 16 nt, Escherichia coli CFT073
cuucuggccucgcuuu

SEQ ID NO: 646170 - RNA, 22 nt, Escherichia coli CFT073
cuucuggcgacccguuuuucuu

SEQ ID NO: 646171 - RNA, 22 nt, Escherichia coli CFT073
cuucugcuuuacccacgcuuuu

SEQ ID NO: 646172 - RNA, 14 nt, Escherichia coli CFT073
cuucugccgcuucc

SEQ ID NO: 646173 - RNA, 20 nt, Escherichia coli CFT073
cuucugccaggugcagccca

SEQ ID NO: 646174 - RNA, 16 nt, Escherichia coli CFT073
cuucugcgcuggcaag

SEQ ID NO: 646175 - RNA, 18 nt, Escherichia coli CFT073
cuuuauuuuccagauucu

SEQ ID NO: 646176 - RNA, 14 nt, Escherichia coli CFT073
cuuucaccucuuca

SEQ ID NO: 646177 - RNA, 16 nt, Escherichia coli CFT073
cuuucacgcccagucc

SEQ ID NO: 646178 - RNA, 17 nt, Escherichia coli CFT073
cuuucacgcccaguccg

SEQ ID NO: 646179 - RNA, 15 nt, Escherichia coli CFT073
cuuucacgccgccaa

SEQ ID NO: 646180 - RNA, 22 nt, Escherichia coli CFT073
cuuucacgcgcugaccuucuuc

SEQ ID NO: 646181 - RNA, 19 nt, Escherichia coli CFT073
cuuucagagaagcaccgcc

SEQ ID NO: 646182 - RNA, 20 nt, Escherichia coli CFT073
cuuucagaguuguaccaccc

SEQ ID NO: 646183 - RNA, 21 nt, Escherichia coli CFT073
cuuucagaguuguaccacccu

SEQ ID NO: 646184 - RNA, 15 nt, Escherichia coli CFT073
cuuucagcaaaccac

SEQ ID NO: 646185 - RNA, 17 nt, Escherichia coli CFT073
cuuuccaccugcaacgu

SEQ ID NO: 646186 - RNA, 17 nt, Escherichia coli CFT073
cuuuccagccacaguuc

SEQ ID NO: 646187 - RNA, 20 nt, Escherichia coli CFT073
cuuuccagcuguaccagcaa

SEQ ID NO: 646188 - RNA, 14 nt, Escherichia coli CFT073
cuuuauaaaguaaa

SEQ ID NO: 646189 - RNA, 20 nt, Escherichia coli CFT073
cuuuauaaauugcaauuuuu

SEQ ID NO: 646190 - RNA, 15 nt, Escherichia coli CFT073
cuuuauagaacagag

SEQ ID NO: 646191 - RNA, 15 nt, Escherichia coli CFT073
cuuuaugcgaugaaa

SEQ ID NO: 646192 - RNA, 18 nt, Escherichia coli CFT073
cuuuaucgucgcuggaaa

SEQ ID NO: 646193 - RNA, 19 nt, Escherichia coli CFT073
cuuuaucgucgcuggaaau

SEQ ID NO: 646194 - RNA, 13 nt, Escherichia coli CFT073
cuuuaugcagcuc

SEQ ID NO: 646195 - RNA, 18 nt, Escherichia coli CFT073
cuuuaucugccagccagu

SEQ ID NO: 646196 - RNA, 13 nt, Escherichia coli CFT073
cuuuaucugcccu

SEQ ID NO: 646197 - RNA, 12 nt, Escherichia coli CFT073
cuuuaauuucau

SEQ ID NO: 646198 - RNA, 14 nt, Escherichia coli CFT073
cuuuaagauauggc

SEQ ID NO: 646199 - RNA, 19 nt, Escherichia coli CFT073
cuuuaauuuugugcagcac

SEQ ID NO: 646200 - RNA, 18 nt, Escherichia coli CFT073
cuuuaauuuugugcagca

SEQ ID NO: 646201 - RNA, 18 nt, Escherichia coli CFT073
cuuuacuaaaaagugaua

SEQ ID NO: 646202 - RNA, 14 nt, Escherichia coli CFT073
cuuuacucaacucc

SEQ ID NO: 646203 - RNA, 13 nt, Escherichia coli CFT073
cuuuacucauccc

SEQ ID NO: 646204 - RNA, 11 nt, Escherichia coli CFT073
cuuuacugccu

SEQ ID NO: 646205 - RNA, 12 nt, Escherichia coli CFT073
aaagaauugcag

SEQ ID NO: 646206 - RNA, 13 nt, Escherichia coli CFT073
aaagaaugacacu

SEQ ID NO: 646207 - RNA, 20 nt, Escherichia coli CFT073
aaagaaucuauuaaccaaua

SEQ ID NO: 646208 - RNA, 16 nt, Escherichia coli CFT073
aaagaaugcagucagu

SEQ ID NO: 646209 - RNA, 17 nt, Escherichia coli CFT073
cuuuggcaccuucgcca

SEQ ID NO: 646210 - RNA, 20 nt, Escherichia coli CFT073
cuuuggcaccguuagugauu

SEQ ID NO: 646211 - RNA, 16 nt, Escherichia coli CFT073
cuuuggcccauugcac

SEQ ID NO: 646212 - RNA, 18 nt, Escherichia coli CFT073
cuuuuaaugguauccaca

SEQ ID NO: 646213 - RNA, 14 nt, Escherichia coli CFT073
cuuuuaauuucauc

SEQ ID NO: 646214 - RNA, 22 nt, Escherichia coli CFT073
cuuuuaauaauucaaaaaccug

SEQ ID NO: 646215 - RNA, 14 nt, Escherichia coli CFT073
cuuugcgcaggcaa

SEQ ID NO: 646216 - RNA, 15 nt, Escherichia coli CFT073
cuuugcgccagcggg

SEQ ID NO: 646217 - RNA, 15 nt, Escherichia coli CFT073
cuuugccgucugcca

SEQ ID NO: 646218 - RNA, 14 nt, Escherichia coli CFT073
cuuugccugccgcc

SEQ ID NO: 646219 - RNA, 11 nt, Escherichia coli CFT073
cuuugccuggc

SEQ ID NO: 646220 - RNA, 18 nt, Escherichia coli CFT073
cuuugaucgcguuuuuug

SEQ ID NO: 646221 - RNA, 21 nt, Escherichia coli CFT073
cuuugagucaacauauuaaaa

SEQ ID NO: 646222 - RNA, 23 nt, Escherichia coli CFT073
cuuugagcaucaaacuuuuaaau

SEQ ID NO: 646223 - RNA, 18 nt, Escherichia coli CFT073
cuuucgagcaauuuuccu

SEQ ID NO: 646224 - RNA, 20 nt, Escherichia coli CFT073
cuuucgacagcgauuccagu

SEQ ID NO: 646225 - RNA, 23 nt, Escherichia coli CFT073
cuuucgacggcauaagaaacaca

SEQ ID NO: 646226 - RNA, 18 nt, Escherichia coli CFT073
cuuucgcuuuaucgccca

SEQ ID NO: 646227 - RNA, 14 nt, Escherichia coli CFT073
cuuucgcuucaagc

SEQ ID NO: 646228 - RNA, 15 nt, Escherichia coli CFT073
cuuucgcuucaagca

SEQ ID NO: 646229 - RNA, 18 nt, Escherichia coli CFT073
cuuucgccgguuuuucaa

SEQ ID NO: 646230 - RNA, 18 nt, Escherichia coli CFT073
cuuuccugcacaaugccu

SEQ ID NO: 646231 - RNA, 18 nt, Escherichia coli CFT073
cuuuccugcucggcaaac

SEQ ID NO: 646232 - RNA, 16 nt, Escherichia coli CFT073
cuuuccuuaacaaaaa

SEQ ID NO: 646233 - RNA, 20 nt, Escherichia coli CFT073
cuuuccaggcgugcuccuuc

SEQ ID NO: 646234 - RNA, 17 nt, Escherichia coli CFT073
cuuuccagucuccuugc

SEQ ID NO: 646235 - RNA, 21 nt, Escherichia coli CFT073
cuuuccguuuucacccucgcc

SEQ ID NO: 646236 - RNA, 15 nt, Escherichia coli CFT073
cuuuccucacuccuu

SEQ ID NO: 646237 - RNA, 17 nt, Escherichia coli CFT073
cuuucugcaaccagaaa

SEQ ID NO: 646238 - RNA, 16 nt, Escherichia coli CFT073
cuuucugauuguuauu

SEQ ID NO: 646239 - RNA, 13 nt, Escherichia coli CFT073
cuuucugcugcuu

SEQ ID NO: 646240 - RNA, 18 nt, Escherichia coli CFT073
cuuucugcugcuuuauca

SEQ ID NO: 646241 - RNA, 19 nt, Escherichia coli CFT073
cuuucgggcgcaaaaacau

SEQ ID NO: 646242 - RNA, 16 nt, Escherichia coli CFT073
cuuucggcaguuuuac

SEQ ID NO: 646243 - RNA, 20 nt, Escherichia coli CFT073
cuuucggauuacugccagcu

SEQ ID NO: 646244 - RNA, 19 nt, Escherichia coli CFT073
cuuucggguggccagcaac

SEQ ID NO: 646245 - RNA, 23 nt, Escherichia coli CFT073
cuuucgguucauaaacacucaca

SEQ ID NO: 646246 - RNA, 13 nt, Escherichia coli CFT073
cuuucuucagcgu

SEQ ID NO: 646247 - RNA, 18 nt, Escherichia coli CFT073
cuuucuuaauauuucccg

SEQ ID NO: 646248 - RNA, 14 nt, Escherichia coli CFT073
cuuucugugcaauc

SEQ ID NO: 646249 - RNA, 18 nt, Escherichia coli CFT073
cuuggcagagcgacauac

SEQ ID NO: 646250 - RNA, 17 nt, Escherichia coli CFT073
cuuggcugcaaauauug

SEQ ID NO: 646251 - RNA, 20 nt, Escherichia coli CFT073
cuuguaacgaguacaaaaau

SEQ ID NO: 646252 - RNA, 23 nt, Escherichia coli CFT073
cuuguaacgaguacaaaaauaag

SEQ ID NO: 646253 - RNA, 16 nt, Escherichia coli CFT073
cuuguacggcuccgcc

SEQ ID NO: 646254 - RNA, 17 nt, Escherichia coli CFT073
cuugucauuaccacaac

SEQ ID NO: 646255 - RNA, 20 nt, Escherichia coli CFT073
cuugucauuaccacaacaaa

SEQ ID NO: 646256 - RNA, 23 nt, Escherichia coli CFT073
cuugucacgucucaucaggccug

SEQ ID NO: 646257 - RNA, 15 nt, Escherichia coli CFT073
cuugucaggccugug

SEQ ID NO: 646258 - RNA, 23 nt, Escherichia coli CFT073
cuuguauuaauaccagaauaagg

SEQ ID NO: 646259 - RNA, 21 nt, Escherichia coli CFT073
cuugguuacgcaccgggcagg

SEQ ID NO: 646260 - RNA, 16 nt, Escherichia coli CFT073
cuuguaaaacagccaa

SEQ ID NO: 646261 - RNA, 17 nt, Escherichia coli CFT073
cuuguaaaacagccaau

SEQ ID NO: 646262 - RNA, 14 nt, Escherichia coli CFT073
aaacuuuugucauu

SEQ ID NO: 646263 - RNA, 17 nt, Escherichia coli CFT073
aaagaaaagaacuauug

SEQ ID NO: 646264 - RNA, 11 nt, Escherichia coli CFT073
aaagaaacugu

SEQ ID NO: 646265 - RNA, 15 nt, Escherichia coli CFT073
cuugucucuggucaa

SEQ ID NO: 646266 - RNA, 16 nt, Escherichia coli CFT073
cuuguccgucaaccca

SEQ ID NO: 646267 - RNA, 22 nt, Escherichia coli CFT073
cuuguggcucgccauccaguga

SEQ ID NO: 646268 - RNA, 13 nt, Escherichia coli CFT073
cuuguucaagagc

SEQ ID NO: 646269 - RNA, 20 nt, Escherichia coli CFT073
cuuguucagccguuuaauug

SEQ ID NO: 646270 - RNA, 21 nt, Escherichia coli CFT073
cuuguucauaauguuauguca

SEQ ID NO: 646271 - RNA, 21 nt, Escherichia coli CFT073
cuuuaaaauuauccagcgccc

SEQ ID NO: 646272 - RNA, 20 nt, Escherichia coli CFT073
cuuuaaagcguuccagcagc

SEQ ID NO: 646273 - RNA, 22 nt, Escherichia coli CFT073
cuuuaaaauaagcacaaagcaa

SEQ ID NO: 646274 - RNA, 11 nt, Escherichia coli CFT073
cuuuaaacaga

SEQ ID NO: 646275 - RNA, 13 nt, Escherichia coli CFT073
cuuguuuuuuucg

SEQ ID NO: 646276 - RNA, 18 nt, Escherichia coli CFT073
cuuguuugaagucaacgc

SEQ ID NO: 646277 - RNA, 21 nt, Escherichia coli CFT073
cuuguuugcccagaaucgcca

SEQ ID NO: 646278 - RNA, 14 nt, Escherichia coli CFT073
cuuguuuaaggaaa

SEQ ID NO: 646279 - RNA, 17 nt, Escherichia coli CFT073
cuuguugccuguuucau

SEQ ID NO: 646280 - RNA, 13 nt, Escherichia coli CFT073
cuuguugaacaga

SEQ ID NO: 646281 - RNA, 18 nt, Escherichia coli CFT073
aaagaagaucaucaccag

SEQ ID NO: 646282 - RNA, 12 nt, Escherichia coli CFT073
aaagaacacaac

SEQ ID NO: 646283 - RNA, 12 nt, Escherichia coli CFT073
aaagaacaccag

SEQ ID NO: 646284 - RNA, 14 nt, Escherichia coli CFT073
aaagaacaccagca

SEQ ID NO: 646285 - RNA, 13 nt, Escherichia coli CFT073
aaagaaccaaugc

SEQ ID NO: 646286 - RNA, 14 nt, Escherichia coli CFT073
aaagaaauuuccca

SEQ ID NO: 646287 - RNA, 16 nt, Escherichia coli CFT073
cuuuugucgcuuuaac

SEQ ID NO: 646288 - RNA, 22 nt, Escherichia coli CFT073
cuuuugucgcuuuaacgcccug

SEQ ID NO: 646289 - RNA, 14 nt, Escherichia coli CFT073
cuuuuggcucauca

SEQ ID NO: 646290 - RNA, 16 nt, Escherichia coli CFT073
cuuuuuaauuugccag

SEQ ID NO: 646291 - RNA, 13 nt, Escherichia coli CFT073
cuuuuuacugccg

SEQ ID NO: 646292 - RNA, 23 nt, Escherichia coli CFT073
cuuuuggcgcguucccuuguugu

SEQ ID NO: 646293 - RNA, 19 nt, Escherichia coli CFT073
cuuuugcaaacaacgcuuc

SEQ ID NO: 646294 - RNA, 18 nt, Escherichia coli CFT073
cuuuugaaggaauuaauc

SEQ ID NO: 646295 - RNA, 15 nt, Escherichia coli CFT073
cuuuuauauaaugaa

SEQ ID NO: 646296 - RNA, 21 nt, Escherichia coli CFT073
cuuuuagcgacaaaucuuuca

SEQ ID NO: 646297 - RNA, 17 nt, Escherichia coli CFT073
gaaaaaccguauucauc

SEQ ID NO: 646298 - RNA, 22 nt, Escherichia coli CFT073
gaaaaaccuuaaagcgaaacag

SEQ ID NO: 646299 - RNA, 21 nt, Escherichia coli CFT073
gaaaaacguuucaaacaggcu

SEQ ID NO: 646300 - RNA, 23 nt, Escherichia coli CFT073
gaaaaacguuucaaacaggcugc

SEQ ID NO: 646301 - RNA, 21 nt, Escherichia coli CFT073
gaaaaaagcaagauuaaaaua

SEQ ID NO: 646302 - RNA, 19 nt, Escherichia coli CFT073
cuuuuugugggccugauaa

SEQ ID NO: 646303 - RNA, 21 nt, Escherichia coli CFT073
cuuuuugugggccugauaaga

SEQ ID NO: 646304 - RNA, 14 nt, Escherichia coli CFT073
cuuuuuucaucucu

SEQ ID NO: 646305 - RNA, 13 nt, Escherichia coli CFT073
cuuuuuucauuuc

SEQ ID NO: 646306 - RNA, 14 nt, Escherichia coli CFT073
cuuuuuucauuucc

SEQ ID NO: 646307 - RNA, 16 nt, Escherichia coli CFT073
cuuuuuucauuucccg

SEQ ID NO: 646308 - RNA, 12 nt, Escherichia coli CFT073
cuuuuugcucuc

SEQ ID NO: 646309 - RNA, 18 nt, Escherichia coli CFT073
cuuuuuccaucacccaac

SEQ ID NO: 646310 - RNA, 15 nt, Escherichia coli CFT073
cuuuuuccgggccaa

SEQ ID NO: 646311 - RNA, 19 nt, Escherichia coli CFT073
cuuuuuccgggccaaaaac

SEQ ID NO: 646312 - RNA, 20 nt, Escherichia coli CFT073
cuuuuuccugagucagcagc

SEQ ID NO: 646313 - RNA, 13 nt, Escherichia coli CFT073
cuuuuucaaucca

SEQ ID NO: 646314 - RNA, 22 nt, Escherichia coli CFT073
cuuuuucaucagguuggaucaa

SEQ ID NO: 646315 - RNA, 15 nt, Escherichia coli CFT073
gaaacgaaacccaaa

SEQ ID NO: 646316 - RNA, 17 nt, Escherichia coli CFT073
gaaaccugaauccacug

SEQ ID NO: 646317 - RNA, 22 nt, Escherichia coli CFT073
gaaaccgugucgacggcgcggu

SEQ ID NO: 646318 - RNA, 16 nt, Escherichia coli CFT073
gaaaccgaauccuuug

SEQ ID NO: 646319 - RNA, 21 nt, Escherichia coli CFT073
gaaaccgagauaaaugccaaa

SEQ ID NO: 646320 - RNA, 12 nt, Escherichia coli CFT073
gaaaccauauua

SEQ ID NO: 646321 - RNA, 21 nt, Escherichia coli CFT073
gaaaccaagaccaauccgcca

SEQ ID NO: 646322 - RNA, 19 nt, Escherichia coli CFT073
gaaacccggccacagcgcc

SEQ ID NO: 646323 - RNA, 22 nt, Escherichia coli CFT073
gaaacaccggugaccaucagca

SEQ ID NO: 646324 - RNA, 12 nt, Escherichia coli CFT073
gaaacaccagaa

SEQ ID NO: 646325 - RNA, 22 nt, Escherichia coli CFT073
gaaaauuuuuucagauaaaagc

SEQ ID NO: 646326 - RNA, 13 nt, Escherichia coli CFT073
gaaacaaaugaaa

SEQ ID NO: 646327 - RNA, 19 nt, Escherichia coli CFT073
gaaacagauaaaaguuaca

SEQ ID NO: 646328 - RNA, 14 nt, Escherichia coli CFT073
gaaacaggcggcgc

SEQ ID NO: 646329 - RNA, 13 nt, Escherichia coli CFT073
gaaacagccaccc

SEQ ID NO: 646330 - RNA, 19 nt, Escherichia coli CFT073
gaaacauccccagcgucag

SEQ ID NO: 646331 - RNA, 12 nt, Escherichia coli CFT073
gaaacaugaaca

SEQ ID NO: 646332 - RNA, 22 nt, Escherichia coli CFT073
gaaaaauucaggggaagccaga

SEQ ID NO: 646333 - RNA, 16 nt, Escherichia coli CFT073
gaaaagcuucuuccuc

SEQ ID NO: 646334 - RNA, 22 nt, Escherichia coli CFT073
gaaaagcuguaaggugaaagca

SEQ ID NO: 646335 - RNA, 13 nt, Escherichia coli CFT073
gaaaaaucccucu

SEQ ID NO: 646336 - RNA, 22 nt, Escherichia coli CFT073
gaaaaauaaugccaccagugcc

SEQ ID NO: 646337 - RNA, 17 nt, Escherichia coli CFT073
gaaaaaucaaaaacucu

SEQ ID NO: 646338 - RNA, 21 nt, Escherichia coli CFT073
gaaaauugucuuuuucaaagu

SEQ ID NO: 646339 - RNA, 19 nt, Escherichia coli CFT073
gaaaauuauuuuaaauuuc

SEQ ID NO: 646340 - RNA, 13 nt, Escherichia coli CFT073
gaaaauucaguuc

SEQ ID NO: 646341 - RNA, 20 nt, Escherichia coli CFT073
gaaaauuaacgggcagguca

SEQ ID NO: 646342 - RNA, 16 nt, Escherichia coli CFT073
gaaaauuacgaaagca

SEQ ID NO: 646343 - RNA, 12 nt, Escherichia coli CFT073
gaaaauaucggu

SEQ ID NO: 646344 - RNA, 17 nt, Escherichia coli CFT073
gaaaauaugcccauguu

SEQ ID NO: 646345 - RNA, 18 nt, Escherichia coli CFT073
gaaaagugcuguaaagca

SEQ ID NO: 646346 - RNA, 15 nt, Escherichia coli CFT073
gaaagcccaucaucc

SEQ ID NO: 646347 - RNA, 18 nt, Escherichia coli CFT073
gaaagcgagcaguacagc

SEQ ID NO: 646348 - RNA, 12 nt, Escherichia coli CFT073
gaaagccccagc

SEQ ID NO: 646349 - RNA, 18 nt, Escherichia coli CFT073
gaaagagccgauaaacac

SEQ ID NO: 646350 - RNA, 20 nt, Escherichia coli CFT073
gaaacgacaguaucgugaca

SEQ ID NO: 646351 - RNA, 19 nt, Escherichia coli CFT073
gaaacgcaguuuaaucguu

SEQ ID NO: 646352 - RNA, 17 nt, Escherichia coli CFT073
gaaacgcggcguaacca

SEQ ID NO: 646353 - RNA, 19 nt, Escherichia coli CFT073
gaaacgccaucucuuuaug

SEQ ID NO: 646354 - RNA, 15 nt, Escherichia coli CFT073
gaaacgccaucugaa

SEQ ID NO: 646355 - RNA, 23 nt, Escherichia coli CFT073
gaaagcuuugcguuucuuccugc

SEQ ID NO: 646356 - RNA, 14 nt, Escherichia coli CFT073
gaaagggaagaaca

SEQ ID NO: 646357 - RNA, 21 nt, Escherichia coli CFT073
gaaaguuggcguucacugccg

SEQ ID NO: 646358 - RNA, 15 nt, Escherichia coli CFT073
gaaaguuguuuuuug

SEQ ID NO: 646359 - RNA, 16 nt, Escherichia coli CFT073
gaaagugacagcccgg

SEQ ID NO: 646360 - RNA, 18 nt, Escherichia coli CFT073
gaaagugacagcccggca

SEQ ID NO: 646361 - RNA, 17 nt, Escherichia coli CFT073
gaaagugcuguaaagca

SEQ ID NO: 646362 - RNA, 19 nt, Escherichia coli CFT073
gaaaguuuacgucgccagu

SEQ ID NO: 646363 - RNA, 14 nt, Escherichia coli CFT073
gaaauaaaaucagc

SEQ ID NO: 646364 - RNA, 15 nt, Escherichia coli CFT073
gaaauaucagcagca

SEQ ID NO: 646365 - RNA, 15 nt, Escherichia coli CFT073
gaaauauuaucuaac

SEQ ID NO: 646366 - RNA, 22 nt, Escherichia coli CFT073
gaaauaucgccuggggcuuuug

SEQ ID NO: 646367 - RNA, 20 nt, Escherichia coli CFT073
gaaauaucggcgucguugua

SEQ ID NO: 646368 - RNA, 20 nt, Escherichia coli CFT073
gaaaucagcagcuuugcccg

SEQ ID NO: 646369 - RNA, 18 nt, Escherichia coli CFT073
gaaaucauucgcagcugc

SEQ ID NO: 646370 - RNA, 22 nt, Escherichia coli CFT073
gaacacaacguacaccgcagcc

SEQ ID NO: 646371 - RNA, 19 nt, Escherichia coli CFT073
gaacaccaaucuucaacac

SEQ ID NO: 646372 - RNA, 19 nt, Escherichia coli CFT073
gaacaaggcaauuaaaaau

SEQ ID NO: 646373 - RNA, 23 nt, Escherichia coli CFT073
gaacagaccacauuccaggcccg

SEQ ID NO: 646374 - RNA, 16 nt, Escherichia coli CFT073
gaacacuuugccgucu

SEQ ID NO: 646375 - RNA, 14 nt, Escherichia coli CFT073
gaacagaaaucuga

SEQ ID NO: 646376 - RNA, 16 nt, Escherichia coli CFT073
gaacagugccagacaa

SEQ ID NO: 646377 - RNA, 22 nt, Escherichia coli CFT073
gaacaggcuggccguauuuuug

SEQ ID NO: 646378 - RNA, 20 nt, Escherichia coli CFT073
gaacagccugugccugagcc

SEQ ID NO: 646379 - RNA, 16 nt, Escherichia coli CFT073
gaacagcaacucagcc

SEQ ID NO: 646380 - RNA, 17 nt, Escherichia coli CFT073
gaacagagucugaccac

SEQ ID NO: 646381 - RNA, 19 nt, Escherichia coli CFT073
gaacagaucccacauaugu

SEQ ID NO: 646382 - RNA, 23 nt, Escherichia coli CFT073
gaaauuuaucuacuacccagcaa

SEQ ID NO: 646383 - RNA, 16 nt, Escherichia coli CFT073
gaaauuuaguauuuua

SEQ ID NO: 646384 - RNA, 16 nt, Escherichia coli CFT073
gaaauuguaggccuga

SEQ ID NO: 646385 - RNA, 17 nt, Escherichia coli CFT073
gaaauugugauaaaaau

SEQ ID NO: 646386 - RNA, 21 nt, Escherichia coli CFT073
gaaauuaccgcaccaccagca

SEQ ID NO: 646387 - RNA, 19 nt, Escherichia coli CFT073
gaaauggcuggcagcagac

SEQ ID NO: 646388 - RNA, 12 nt, Escherichia coli CFT073
gaaauggcuggu

SEQ ID NO: 646389 - RNA, 16 nt, Escherichia coli CFT073
gaaauggcuggucagg

SEQ ID NO: 646390 - RNA, 20 nt, Escherichia coli CFT073
gaaauguaaaaguugcaguc

SEQ ID NO: 646391 - RNA, 21 nt, Escherichia coli CFT073
gaaauggugugcaugguguuc

SEQ ID NO: 646392 - RNA, 13 nt, Escherichia coli CFT073
gaaaucuuccagu

SEQ ID NO: 646393 - RNA, 17 nt, Escherichia coli CFT073
gaaaucugaucguguaa

SEQ ID NO: 646394 - RNA, 18 nt, Escherichia coli CFT073
gaaaugccaguaacucau

SEQ ID NO: 646395 - RNA, 14 nt, Escherichia coli CFT073
gaaaucuccagaua

SEQ ID NO: 646396 - RNA, 20 nt, Escherichia coli CFT073
gaaaucucuuccagcgacac

SEQ ID NO: 646397 - RNA, 13 nt, Escherichia coli CFT073
gauauuccccaga

SEQ ID NO: 646398 - RNA, 17 nt, Escherichia coli CFT073
gauauucccccaccgcc

SEQ ID NO: 646399 - RNA, 20 nt, Escherichia coli CFT073
gauauuaguggcaaccgcaa

SEQ ID NO: 646400 - RNA, 17 nt, Escherichia coli CFT073
gauauuaucgaaaccaa

SEQ ID NO: 646401 - RNA, 19 nt, Escherichia coli CFT073
gauaucgugcgggaccagc

SEQ ID NO: 646402 - RNA, 20 nt, Escherichia coli CFT073
gauaucgugcgggaccagca

SEQ ID NO: 646403 - RNA, 21 nt, Escherichia coli CFT073
gauaucgugcgggaccagcac

SEQ ID NO: 646404 - RNA, 13 nt, Escherichia coli CFT073
gauaucguugauu

SEQ ID NO: 646405 - RNA, 14 nt, Escherichia coli CFT073
gauauccuggucaa

SEQ ID NO: 646406 - RNA, 23 nt, Escherichia coli CFT073
gauaucgcggauaugcagcagcc

SEQ ID NO: 646407 - RNA, 13 nt, Escherichia coli CFT073
gauaucgcuggca

SEQ ID NO: 646408 - RNA, 22 nt, Escherichia coli CFT073
gauaucccaggcaaaauccuuc

SEQ ID NO: 646409 - RNA, 15 nt, Escherichia coli CFT073
gauaucccauuuacu

SEQ ID NO: 646410 - RNA, 16 nt, Escherichia coli CFT073
gauaucccgccagcac

SEQ ID NO: 646411 - RNA, 19 nt, Escherichia coli CFT073
gauauccacccgcagccau

SEQ ID NO: 646412 - RNA, 22 nt, Escherichia coli CFT073
gaucaauaaucucuuuacccag

SEQ ID NO: 646413 - RNA, 17 nt, Escherichia coli CFT073
gaucaaauucaaugaca

SEQ ID NO: 646414 - RNA, 12 nt, Escherichia coli CFT073
gaucaaaccuca

SEQ ID NO: 646415 - RNA, 19 nt, Escherichia coli CFT073
gaucaaaccucaccucaau

SEQ ID NO: 646416 - RNA, 21 nt, Escherichia coli CFT073
gauauuuucccaacgugacca

SEQ ID NO: 646417 - RNA, 21 nt, Escherichia coli CFT073
gauauuuuguucaaaggcaga

SEQ ID NO: 646418 - RNA, 21 nt, Escherichia coli CFT073
gauauuuuucccugaagguug

SEQ ID NO: 646419 - RNA, 20 nt, Escherichia coli CFT073
gauauucugguaaucgcaaa

SEQ ID NO: 646420 - RNA, 21 nt, Escherichia coli CFT073
gauauugcccguuauucccac

SEQ ID NO: 646421 - RNA, 19 nt, Escherichia coli CFT073
gauauugcccuucacuuca

SEQ ID NO: 646422 - RNA, 18 nt, Escherichia coli CFT073
gauauugcuccagacguu

SEQ ID NO: 646423 - RNA, 19 nt, Escherichia coli CFT073
gauauugcugcaguuuacg

SEQ ID NO: 646424 - RNA, 13 nt, Escherichia coli CFT073
gauauuuacaucc

SEQ ID NO: 646425 - RNA, 18 nt, Escherichia coli CFT073
gauauuuagccagcagcu

SEQ ID NO: 646426 - RNA, 16 nt, Escherichia coli CFT073
gauauuuauuuccuuc

SEQ ID NO: 646427 - RNA, 13 nt, Escherichia coli CFT073
gauauuugccgcg

SEQ ID NO: 646428 - RNA, 21 nt, Escherichia coli CFT073
gauagccagguuuaccagcag

SEQ ID NO: 646429 - RNA, 17 nt, Escherichia coli CFT073
gauacucaacucacaca

SEQ ID NO: 646430 - RNA, 16 nt, Escherichia coli CFT073
gauacucaagcaacca

SEQ ID NO: 646431 - RNA, 21 nt, Escherichia coli CFT073
gauacucauuguuaucagcaa

SEQ ID NO: 646432 - RNA, 21 nt, Escherichia coli CFT073
gauacuccacgcuaugugcuu

SEQ ID NO: 646433 - RNA, 20 nt, Escherichia coli CFT073
gauagcccaacgaucccaac

SEQ ID NO: 646434 - RNA, 20 nt, Escherichia coli CFT073
gauacguagcgcaacaggca

SEQ ID NO: 646435 - RNA, 18 nt, Escherichia coli CFT073
gauacuacguucgaucac

SEQ ID NO: 646436 - RNA, 13 nt, Escherichia coli CFT073
gauacuauucauu

SEQ ID NO: 646437 - RNA, 20 nt, Escherichia coli CFT073
gauacgguuuuuugaacaga

SEQ ID NO: 646438 - RNA, 21 nt, Escherichia coli CFT073
gauacgguuuuuugaacagac

SEQ ID NO: 646439 - RNA, 22 nt, Escherichia coli CFT073
gauacgguuuuuugaacagacc

SEQ ID NO: 646440 - RNA, 17 nt, Escherichia coli CFT073
gauacggucaggauaau

SEQ ID NO: 646441 - RNA, 18 nt, Escherichia coli CFT073
gauauaugucaccagcau

SEQ ID NO: 646442 - RNA, 21 nt, Escherichia coli CFT073
gauauaugucaccagcauuag

SEQ ID NO: 646443 - RNA, 15 nt, Escherichia coli CFT073
gauauaaaaauaaca

SEQ ID NO: 646444 - RNA, 20 nt, Escherichia coli CFT073
gauaguuucacggcaccagc

SEQ ID NO: 646445 - RNA, 22 nt, Escherichia coli CFT073
gauauaaacggucuacauugcu

SEQ ID NO: 646446 - RNA, 14 nt, Escherichia coli CFT073
gauauaaauuccac

SEQ ID NO: 646447 - RNA, 22 nt, Escherichia coli CFT073
gauagcuaacugccuccugcaa

SEQ ID NO: 646448 - RNA, 16 nt, Escherichia coli CFT073
gauagcuaaucaucug

SEQ ID NO: 646449 - RNA, 19 nt, Escherichia coli CFT073
gauagccgaccgcaaggaa

SEQ ID NO: 646450 - RNA, 15 nt, Escherichia coli CFT073
gauagccgccccaga

SEQ ID NO: 646451 - RNA, 15 nt, Escherichia coli CFT073
gauagcgaaccgcag

SEQ ID NO: 646452 - RNA, 21 nt, Escherichia coli CFT073
gauagcgaccaguuugccuuu

SEQ ID NO: 646453 - RNA, 17 nt, Escherichia coli CFT073
gauaccagauuaauuau

SEQ ID NO: 646454 - RNA, 20 nt, Escherichia coli CFT073
gauaccgcguuggcgcagca

SEQ ID NO: 646455 - RNA, 18 nt, Escherichia coli CFT073
gauaccgccgcacaauac

SEQ ID NO: 646456 - RNA, 19 nt, Escherichia coli CFT073
gauaccccgcaucguggcc

SEQ ID NO: 646457 - RNA, 21 nt, Escherichia coli CFT073
gauacccgacagauaaaucau

SEQ ID NO: 646458 - RNA, 23 nt, Escherichia coli CFT073
gauacccuuuuugauucaccacc

SEQ ID NO: 646459 - RNA, 20 nt, Escherichia coli CFT073
gauacaggccaccaggccac

SEQ ID NO: 646460 - RNA, 19 nt, Escherichia coli CFT073
gauacagccaaaucaucag

SEQ ID NO: 646461 - RNA, 15 nt, Escherichia coli CFT073
gauacagccaaauca

SEQ ID NO: 646462 - RNA, 12 nt, Escherichia coli CFT073
gauacagaaagu

SEQ ID NO: 646463 - RNA, 12 nt, Escherichia coli CFT073
gauaccaacgca

SEQ ID NO: 646464 - RNA, 13 nt, Escherichia coli CFT073
aaagccaacagca

SEQ ID NO: 646465 - RNA, 14 nt, Escherichia coli CFT073
aaagccaacagcag

SEQ ID NO: 646466 - RNA, 14 nt, Escherichia coli CFT073
aaagccaaccugca

SEQ ID NO: 646467 - RNA, 20 nt, Escherichia coli CFT073
gauacacaccgagcguggcg

SEQ ID NO: 646468 - RNA, 22 nt, Escherichia coli CFT073
aaagccaauuaacgaaaucuca

SEQ ID NO: 646469 - RNA, 23 nt, Escherichia coli CFT073
gauacacagcccaguuuuucagg

SEQ ID NO: 646470 - RNA, 16 nt, Escherichia coli CFT073
gauacacggugcgaug

SEQ ID NO: 646471 - RNA, 18 nt, Escherichia coli CFT073
gauacaagccacaucgcc

SEQ ID NO: 646472 - RNA, 18 nt, Escherichia coli CFT073
aaagcauagccccagcgc

SEQ ID NO: 646473 - RNA, 16 nt, Escherichia coli CFT073
aaagcauacaaugcaa

SEQ ID NO: 646474 - RNA, 17 nt, Escherichia coli CFT073
aaagcauacaaugcaau

SEQ ID NO: 646475 - RNA, 23 nt, Escherichia coli CFT073
aaagcaucagacugcuuuucccu

SEQ ID NO: 646476 - RNA, 15 nt, Escherichia coli CFT073
gauacaaaagcaccg

SEQ ID NO: 646477 - RNA, 22 nt, Escherichia coli CFT073
gauacaacucgcuuaagccauc

SEQ ID NO: 646478 - RNA, 20 nt, Escherichia coli CFT073
gauaauuagugcugcuggaa

SEQ ID NO: 646479 - RNA, 18 nt, Escherichia coli CFT073
gauaauuaugagcaagag

SEQ ID NO: 646480 - RNA, 11 nt, Escherichia coli CFT073
gauaauguccg

SEQ ID NO: 646481 - RNA, 16 nt, Escherichia coli CFT073
gauaauguuaaccugc

SEQ ID NO: 646482 - RNA, 20 nt, Escherichia coli CFT073
gauaauguuaaccugcagga

SEQ ID NO: 646483 - RNA, 15 nt, Escherichia coli CFT073
gauaauucaacagau

SEQ ID NO: 646484 - RNA, 16 nt, Escherichia coli CFT073
gauaauucaacagauu

SEQ ID NO: 646485 - RNA, 14 nt, Escherichia coli CFT073
gauaauucagcaga

SEQ ID NO: 646486 - RNA, 16 nt, Escherichia coli CFT073
gauaauucucaucauc

SEQ ID NO: 646487 - RNA, 22 nt, Escherichia coli CFT073
gauaauggagccagaucugcuu

SEQ ID NO: 646488 - RNA, 14 nt, Escherichia coli CFT073
gauaauggcaaugg

SEQ ID NO: 646489 - RNA, 12 nt, Escherichia coli CFT073
gauaauggcugu

SEQ ID NO: 646490 - RNA, 13 nt, Escherichia coli CFT073
gauaauggcuguu

SEQ ID NO: 646491 - RNA, 13 nt, Escherichia coli CFT073
gauaauccaggac

SEQ ID NO: 646492 - RNA, 17 nt, Escherichia coli CFT073
gauaaucguuugcaucc

SEQ ID NO: 646493 - RNA, 15 nt, Escherichia coli CFT073
gauaaucuucaaaua

SEQ ID NO: 646494 - RNA, 18 nt, Escherichia coli CFT073
gauaaucuucaaauaaac

SEQ ID NO: 646495 - RNA, 12 nt, Escherichia coli CFT073
gauaaucaacaa

SEQ ID NO: 646496 - RNA, 16 nt, Escherichia coli CFT073
gauaaucaacaaacca

SEQ ID NO: 646497 - RNA, 21 nt, Escherichia coli CFT073
gauaauauugaugcacaccau

SEQ ID NO: 646498 - RNA, 12 nt, Escherichia coli CFT073
gauaaucaaaug

SEQ ID NO: 646499 - RNA, 11 nt, Escherichia coli CFT073
gauaaguaauc

SEQ ID NO: 646500 - RNA, 15 nt, Escherichia coli CFT073
gauaaguaaucauaa

SEQ ID NO: 646501 - RNA, 16 nt, Escherichia coli CFT073
gauaagucgcccaaac

SEQ ID NO: 646502 - RNA, 18 nt, Escherichia coli CFT073
gauaaggcaacgccccuu

SEQ ID NO: 646503 - RNA, 18 nt, Escherichia coli CFT073
gauaagguauagucacaa

SEQ ID NO: 646504 - RNA, 22 nt, Escherichia coli CFT073
gauaagcugauaacgccacgcc

SEQ ID NO: 646505 - RNA, 15 nt, Escherichia coli CFT073
gauaauaaaaagaau

SEQ ID NO: 646506 - RNA, 11 nt, Escherichia coli CFT073
gauaauaacgu

SEQ ID NO: 646507 - RNA, 15 nt, Escherichia coli CFT073
gauaaguucaaguuu

SEQ ID NO: 646508 - RNA, 13 nt, Escherichia coli CFT073
gauaaaaacucaa

SEQ ID NO: 646509 - RNA, 23 nt, Escherichia coli CFT073
gauaaaaacucaaaaaaaauuuu

SEQ ID NO: 646510 - RNA, 15 nt, Escherichia coli CFT073
gauaaagcgauccag

SEQ ID NO: 646511 - RNA, 16 nt, Escherichia coli CFT073
gauaaagcgauccagu

SEQ ID NO: 646512 - RNA, 18 nt, Escherichia coli CFT073
gauaaagcgaccaaccau

SEQ ID NO: 646513 - RNA, 13 nt, Escherichia coli CFT073
gauaaaacccaga

SEQ ID NO: 646514 - RNA, 20 nt, Escherichia coli CFT073
gauaaagcccccacaacauu

SEQ ID NO: 646515 - RNA, 14 nt, Escherichia coli CFT073
gauaaaacacauca

SEQ ID NO: 646516 - RNA, 16 nt, Escherichia coli CFT073
gauaacaaucaccaaa

SEQ ID NO: 646517 - RNA, 21 nt, Escherichia coli CFT073
gauaaaucaacgccagauaaa

SEQ ID NO: 646518 - RNA, 16 nt, Escherichia coli CFT073
gauaaaggucaucaca

SEQ ID NO: 646519 - RNA, 16 nt, Escherichia coli CFT073
gaguugaaaaucucac

SEQ ID NO: 646520 - RNA, 12 nt, Escherichia coli CFT073
gaguugcagauu

SEQ ID NO: 646521 - RNA, 17 nt, Escherichia coli CFT073
gaguugauuuuguucaa

SEQ ID NO: 646522 - RNA, 15 nt, Escherichia coli CFT073
gaguugcaccagcaa

SEQ ID NO: 646523 - RNA, 22 nt, Escherichia coli CFT073
gaguugcaccagcaauaagcca

SEQ ID NO: 646524 - RNA, 15 nt, Escherichia coli CFT073
gaguugaucgccaga

SEQ ID NO: 646525 - RNA, 17 nt, Escherichia coli CFT073
gaguuagaagccaguac

SEQ ID NO: 646526 - RNA, 19 nt, Escherichia coli CFT073
gaguuaccagcggccagac

SEQ ID NO: 646527 - RNA, 15 nt, Escherichia coli CFT073
gaguggaagcccaaa

SEQ ID NO: 646528 - RNA, 15 nt, Escherichia coli CFT073
gagucauuguaaauu

SEQ ID NO: 646529 - RNA, 16 nt, Escherichia coli CFT073
gagucuuucagacuga

SEQ ID NO: 646530 - RNA, 22 nt, Escherichia coli CFT073
gagugcgaaacuucuuaaaaug

SEQ ID NO: 646531 - RNA, 17 nt, Escherichia coli CFT073
gaguagcucaccagcag

SEQ ID NO: 646532 - RNA, 16 nt, Escherichia coli CFT073
gaguaaaaaaacauca

SEQ ID NO: 646533 - RNA, 17 nt, Escherichia coli CFT073
gaguaaaaaaacaucau

SEQ ID NO: 646534 - RNA, 13 nt, Escherichia coli CFT073
gaguauauauucg

SEQ ID NO: 646535 - RNA, 15 nt, Escherichia coli CFT073
gaguauauucuguaa

SEQ ID NO: 646536 - RNA, 15 nt, Escherichia coli CFT073
gaguaguggaaaccg

SEQ ID NO: 646537 - RNA, 22 nt, Escherichia coli CFT073
gagguuuccgggucggcagauu

SEQ ID NO: 646538 - RNA, 23 nt, Escherichia coli CFT073
gaggcuuuaauaccugccuggua

SEQ ID NO: 646539 - RNA, 18 nt, Escherichia coli CFT073
gaggcuuugccuccgcaa

SEQ ID NO: 646540 - RNA, 17 nt, Escherichia coli CFT073
gaggcacaauggccagc

SEQ ID NO: 646541 - RNA, 15 nt, Escherichia coli CFT073
gaggcguuucaacuc

SEQ ID NO: 646542 - RNA, 19 nt, Escherichia coli CFT073
gagggcgauuauccgccag

SEQ ID NO: 646543 - RNA, 18 nt, Escherichia coli CFT073
gaggucgguauuguccgu

SEQ ID NO: 646544 - RNA, 16 nt, Escherichia coli CFT073
gaggucugaccguucg

SEQ ID NO: 646545 - RNA, 21 nt, Escherichia coli CFT073
gaggugcugaagggcaucagc

SEQ ID NO: 646546 - RNA, 17 nt, Escherichia coli CFT073
gagguggagucagggga

SEQ ID NO: 646547 - RNA, 21 nt, Escherichia coli CFT073
gagcgaauaaaccacaccgcc

SEQ ID NO: 646548 - RNA, 14 nt, Escherichia coli CFT073
gagcgaacaauaaa

SEQ ID NO: 646549 - RNA, 18 nt, Escherichia coli CFT073
gagcgaauuaagaauuuc

SEQ ID NO: 646550 - RNA, 16 nt, Escherichia coli CFT073
gagcgaauaucauugc

SEQ ID NO: 646551 - RNA, 18 nt, Escherichia coli CFT073
gagcugcucggaauaaau

SEQ ID NO: 646552 - RNA, 19 nt, Escherichia coli CFT073
gagcuggaaguuacucaaa

SEQ ID NO: 646553 - RNA, 18 nt, Escherichia coli CFT073
gagcuucacccgcagcac

SEQ ID NO: 646554 - RNA, 13 nt, Escherichia coli CFT073
gagcuuauauacu

SEQ ID NO: 646555 - RNA, 21 nt, Escherichia coli CFT073
gagcuuauuuguugagcugga

SEQ ID NO: 646556 - RNA, 19 nt, Escherichia coli CFT073
gaggaucacaaugccgcca

SEQ ID NO: 646557 - RNA, 12 nt, Escherichia coli CFT073
gaggaucaccag

SEQ ID NO: 646558 - RNA, 19 nt, Escherichia coli CFT073
gaggaucgauaucaccaau

SEQ ID NO: 646559 - RNA, 18 nt, Escherichia coli CFT073
gaggauucgaaccucgga

SEQ ID NO: 646560 - RNA, 23 nt, Escherichia coli CFT073
gaggauucgaaccucggaaugcc

SEQ ID NO: 646561 - RNA, 21 nt, Escherichia coli CFT073
gaggauguuacaaccuccucc

SEQ ID NO: 646562 - RNA, 23 nt, Escherichia coli CFT073
gaggauuaccggugucuuuuugc

SEQ ID NO: 646563 - RNA, 20 nt, Escherichia coli CFT073
gaggaccugcgucugaugaa

SEQ ID NO: 646564 - RNA, 22 nt, Escherichia coli CFT073
gagcuuuggcggccuucuucca

SEQ ID NO: 646565 - RNA, 22 nt, Escherichia coli CFT073
gagcuuuuuuaauguggcuggg

SEQ ID NO: 646566 - RNA, 13 nt, Escherichia coli CFT073
gagcuuucuucca

SEQ ID NO: 646567 - RNA, 13 nt, Escherichia coli CFT073
gagccaucaccau

SEQ ID NO: 646568 - RNA, 22 nt, Escherichia coli CFT073
gagccaguuggcguaccauuaa

SEQ ID NO: 646569 - RNA, 15 nt, Escherichia coli CFT073
gagccaucccugcag

SEQ ID NO: 646570 - RNA, 22 nt, Escherichia coli CFT073
gagcauuacuuucggugacuuc

SEQ ID NO: 646571 - RNA, 17 nt, Escherichia coli CFT073
gagcaugcuccggccuu

SEQ ID NO: 646572 - RNA, 15 nt, Escherichia coli CFT073
aaagcaggagcaauu

SEQ ID NO: 646573 - RNA, 15 nt, Escherichia coli CFT073
aaagcagcaagaacu

SEQ ID NO: 646574 - RNA, 17 nt, Escherichia coli CFT073
gagcaucgguaucaucc

SEQ ID NO: 646575 - RNA, 21 nt, Escherichia coli CFT073
gagcaucgguaucaucccagc

SEQ ID NO: 646576 - RNA, 17 nt, Escherichia coli CFT073
gagccggaugccucucc

SEQ ID NO: 646577 - RNA, 18 nt, Escherichia coli CFT073
gagccggauggcauacca

SEQ ID NO: 646578 - RNA, 17 nt, Escherichia coli CFT073
gagccuucggggcucgu

SEQ ID NO: 646579 - RNA, 21 nt, Escherichia coli CFT073
gagccauugcccgaugcgcaa

SEQ ID NO: 646580 - RNA, 20 nt, Escherichia coli CFT073
gagcacuaacaugacaccaa

SEQ ID NO: 646581 - RNA, 19 nt, Escherichia coli CFT073
gagcacugcgcccgccagc

SEQ ID NO: 646582 - RNA, 21 nt, Escherichia coli CFT073
gagcacugcgcccgccagcau

SEQ ID NO: 646583 - RNA, 14 nt, Escherichia coli CFT073
gagcaguauugaua

SEQ ID NO: 646584 - RNA, 17 nt, Escherichia coli CFT073
gagcaguaauccagcaa

SEQ ID NO: 646585 - RNA, 21 nt, Escherichia coli CFT073
gagcagggugaauaaaagaaa

SEQ ID NO: 646586 - RNA, 22 nt, Escherichia coli CFT073
gagcaauuuuuugcgccagcgc

SEQ ID NO: 646587 - RNA, 22 nt, Escherichia coli CFT073
gagcacaaagccgugccagaug

SEQ ID NO: 646588 - RNA, 22 nt, Escherichia coli CFT073
gagcacgacuuucucuucaucu

SEQ ID NO: 646589 - RNA, 14 nt, Escherichia coli CFT073
gagacggggauacu

SEQ ID NO: 646590 - RNA, 15 nt, Escherichia coli CFT073
gagacggggauacuc

SEQ ID NO: 646591 - RNA, 21 nt, Escherichia coli CFT073
gagacgguuaaaaacagccag

SEQ ID NO: 646592 - RNA, 23 nt, Escherichia coli CFT073
gagagcaaacaccgcuucaacag

SEQ ID NO: 646593 - RNA, 17 nt, Escherichia coli CFT073
gagagcaaccagcaaug

SEQ ID NO: 646594 - RNA, 14 nt, Escherichia coli CFT073
gagagcgccgggca

SEQ ID NO: 646595 - RNA, 19 nt, Escherichia coli CFT073
gagaguugcaccagcaaua

SEQ ID NO: 646596 - RNA, 20 nt, Escherichia coli CFT073
gagauaaaugccaaagaaug

SEQ ID NO: 646597 - RNA, 12 nt, Escherichia coli CFT073
gagagcggaggu

SEQ ID NO: 646598 - RNA, 21 nt, Escherichia coli CFT073
gagauacucaagcaaccaggu

SEQ ID NO: 646599 - RNA, 22 nt, Escherichia coli CFT073
gagauaaccacguucauuucgu

SEQ ID NO: 646600 - RNA, 15 nt, Escherichia coli CFT073
gagauaagcaacaaa

SEQ ID NO: 646601 - RNA, 18 nt, Escherichia coli CFT073
gagauacaggccaccgcc

SEQ ID NO: 646602 - RNA, 16 nt, Escherichia coli CFT073
gagaucagauaauauu

SEQ ID NO: 646603 - RNA, 20 nt, Escherichia coli CFT073
gagaugaaauacuaaauaug

SEQ ID NO: 646604 - RNA, 18 nt, Escherichia coli CFT073
gagauccagcuucgccag

SEQ ID NO: 646605 - RNA, 16 nt, Escherichia coli CFT073
gagauauuccccagac

SEQ ID NO: 646606 - RNA, 18 nt, Escherichia coli CFT073
gagauauuuccuuguuaa

SEQ ID NO: 646607 - RNA, 18 nt, Escherichia coli CFT073
gagaucaccacauacugc

SEQ ID NO: 646608 - RNA, 21 nt, Escherichia coli CFT073
gagaucaccuugcaguuguaa

SEQ ID NO: 646609 - RNA, 12 nt, Escherichia coli CFT073
gagauauucccc

SEQ ID NO: 646610 - RNA, 14 nt, Escherichia coli CFT073
gagaauuaaccaga

SEQ ID NO: 646611 - RNA, 16 nt, Escherichia coli CFT073
gagaauguagauauua

SEQ ID NO: 646612 - RNA, 14 nt, Escherichia coli CFT073
gagacaacccgcca

SEQ ID NO: 646613 - RNA, 13 nt, Escherichia coli CFT073
gagacaacucauu

SEQ ID NO: 646614 - RNA, 20 nt, Escherichia coli CFT073
gagacacugcgaucgcccgc

SEQ ID NO: 646615 - RNA, 13 nt, Escherichia coli CFT073
gagacagauuuau

SEQ ID NO: 646616 - RNA, 19 nt, Escherichia coli CFT073
gagacauuacguccaucac

SEQ ID NO: 646617 - RNA, 19 nt, Escherichia coli CFT073
gagacauuggcaaaaccaa

SEQ ID NO: 646618 - RNA, 19 nt, Escherichia coli CFT073
gagacgaggauuucgccgc

SEQ ID NO: 646619 - RNA, 14 nt, Escherichia coli CFT073
gagacgaucgccac

SEQ ID NO: 646620 - RNA, 15 nt, Escherichia coli CFT073
gagacgaucgccacu

SEQ ID NO: 646621 - RNA, 16 nt, Escherichia coli CFT073
gagaacuucggcagag

SEQ ID NO: 646622 - RNA, 14 nt, Escherichia coli CFT073
gagaacugaaccaa

SEQ ID NO: 646623 - RNA, 15 nt, Escherichia coli CFT073
gagaagccagguaga

SEQ ID NO: 646624 - RNA, 13 nt, Escherichia coli CFT073
gagaauccagccc

SEQ ID NO: 646625 - RNA, 21 nt, Escherichia coli CFT073
gagaauccagccccaccagca

SEQ ID NO: 646626 - RNA, 23 nt, Escherichia coli CFT073
gagaauccagccccaccagcaaa

SEQ ID NO: 646627 - RNA, 20 nt, Escherichia coli CFT073
gagaaugacgacaaagaccu

SEQ ID NO: 646628 - RNA, 22 nt, Escherichia coli CFT073
gagaauauguuuuuaaaccaac

SEQ ID NO: 646629 - RNA, 22 nt, Escherichia coli CFT073
gagaauaccguugaccauauca

SEQ ID NO: 646630 - RNA, 15 nt, Escherichia coli CFT073
gagaauaaaacaagc

SEQ ID NO: 646631 - RNA, 13 nt, Escherichia coli CFT073
aaagcaaaaauaa

SEQ ID NO: 646632 - RNA, 21 nt, Escherichia coli CFT073
aaagcaaaaaagaaggaaaau

SEQ ID NO: 646633 - RNA, 22 nt, Escherichia coli CFT073
aaagcaaaaaagaaggaaaaua

SEQ ID NO: 646634 - RNA, 14 nt, Escherichia coli CFT073
aaagcaauaaacca

SEQ ID NO: 646635 - RNA, 16 nt, Escherichia coli CFT073
aaagcaagaccaacac

SEQ ID NO: 646636 - RNA, 13 nt, Escherichia coli CFT073
aaagcaagauuaa

SEQ ID NO: 646637 - RNA, 21 nt, Escherichia coli CFT073
aaagcaagauuaaaauauaag

SEQ ID NO: 646638 - RNA, 17 nt, Escherichia coli CFT073
gagaacggaucaggcag

SEQ ID NO: 646639 - RNA, 12 nt, Escherichia coli CFT073
gagaacgaugcu

SEQ ID NO: 646640 - RNA, 16 nt, Escherichia coli CFT073
gagaacauucaucauu

SEQ ID NO: 646641 - RNA, 14 nt, Escherichia coli CFT073
gagaaccagcgcac

SEQ ID NO: 646642 - RNA, 14 nt, Escherichia coli CFT073
gagaaccagcugcc

SEQ ID NO: 646643 - RNA, 18 nt, Escherichia coli CFT073
gagaacaucaauccaaac

SEQ ID NO: 646644 - RNA, 13 nt, Escherichia coli CFT073
gagaacaucaucc

SEQ ID NO: 646645 - RNA, 18 nt, Escherichia coli CFT073
gagaacaucauccccaca

SEQ ID NO: 646646 - RNA, 20 nt, Escherichia coli CFT073
gagaaauucugcauuagcau

SEQ ID NO: 646647 - RNA, 17 nt, Escherichia coli CFT073
gagaacaccgaaccaaa

SEQ ID NO: 646648 - RNA, 23 nt, Escherichia coli CFT073
gagaacaccgaaccaaaguagau

SEQ ID NO: 646649 - RNA, 16 nt, Escherichia coli CFT073
gagaacacgaccugcc

SEQ ID NO: 646650 - RNA, 22 nt, Escherichia coli CFT073
gagaacacgaccugccagagcu

SEQ ID NO: 646651 - RNA, 14 nt, Escherichia coli CFT073
gagaaaaagcgaag

SEQ ID NO: 646652 - RNA, 18 nt, Escherichia coli CFT073
gagaaaaucggccagaga

SEQ ID NO: 646653 - RNA, 19 nt, Escherichia coli CFT073
gagaaaaugccgcacauca

SEQ ID NO: 646654 - RNA, 21 nt, Escherichia coli CFT073
gacuuuuuauuuauggggugg

SEQ ID NO: 646655 - RNA, 23 nt, Escherichia coli CFT073
gacuuuuuccaguccacguucaa

SEQ ID NO: 646656 - RNA, 10 nt, Escherichia coli CFT073
gagaaaaagc

SEQ ID NO: 646657 - RNA, 15 nt, Escherichia coli CFT073
gacuuuuacugucug

SEQ ID NO: 646658 - RNA, 23 nt, Escherichia coli CFT073
gacuuuuacugucugcucggaaa

SEQ ID NO: 646659 - RNA, 13 nt, Escherichia coli CFT073
aaagauuuuacca

SEQ ID NO: 646660 - RNA, 23 nt, Escherichia coli CFT073
gagaaaguuucaaaggugccaau

SEQ ID NO: 646661 - RNA, 15 nt, Escherichia coli CFT073
gagaaauagagaaau

SEQ ID NO: 646662 - RNA, 17 nt, Escherichia coli CFT073
gagaaauaucagcagca

SEQ ID NO: 646663 - RNA, 21 nt, Escherichia coli CFT073
gagaaagagugcgccagucac

SEQ ID NO: 646664 - RNA, 17 nt, Escherichia coli CFT073
gagaaagcaaaaauaaa

SEQ ID NO: 646665 - RNA, 13 nt, Escherichia coli CFT073
gacuuauucuuca

SEQ ID NO: 646666 - RNA, 15 nt, Escherichia coli CFT073
gacuuauaagucuca

SEQ ID NO: 646667 - RNA, 19 nt, Escherichia coli CFT073
gacuuauaagucucagaaa

SEQ ID NO: 646668 - RNA, 21 nt, Escherichia coli CFT073
gacuuacuuccugucuucccu

SEQ ID NO: 646669 - RNA, 17 nt, Escherichia coli CFT073
gacuguuuuuccagcuu

SEQ ID NO: 646670 - RNA, 20 nt, Escherichia coli CFT073
gacuuaaaaggaaaaucaca

SEQ ID NO: 646671 - RNA, 23 nt, Escherichia coli CFT073
gacuguuggaaucacucaucaug

SEQ ID NO: 646672 - RNA, 20 nt, Escherichia coli CFT073
gacuucaucggugacuucca

SEQ ID NO: 646673 - RNA, 17 nt, Escherichia coli CFT073
gacuucaugcgcagcau

SEQ ID NO: 646674 - RNA, 13 nt, Escherichia coli CFT073
gacuuccacuucc

SEQ ID NO: 646675 - RNA, 16 nt, Escherichia coli CFT073
gacuuccacuuccugc

SEQ ID NO: 646676 - RNA, 18 nt, Escherichia coli CFT073
gacuuccugagcucgugc

SEQ ID NO: 646677 - RNA, 20 nt, Escherichia coli CFT073
gacuuccccacaaaauaacc

SEQ ID NO: 646678 - RNA, 17 nt, Escherichia coli CFT073
gacuucuucauucaucc

SEQ ID NO: 646679 - RNA, 21 nt, Escherichia coli CFT073
gacuucuucauucauccgccg

SEQ ID NO: 646680 - RNA, 17 nt, Escherichia coli CFT073
gacuuucucuggcuguu

SEQ ID NO: 646681 - RNA, 18 nt, Escherichia coli CFT073
gacuuugccuggcggcag

SEQ ID NO: 646682 - RNA, 16 nt, Escherichia coli CFT073
gacuuuaccugccuga

SEQ ID NO: 646683 - RNA, 19 nt, Escherichia coli CFT073
gacuuuacuaauagcaaaa

SEQ ID NO: 646684 - RNA, 21 nt, Escherichia coli CFT073
gacuuuauagaucaggaaaaa

SEQ ID NO: 646685 - RNA, 23 nt, Escherichia coli CFT073
gacuuuaucugauuuaaaaaugc

SEQ ID NO: 646686 - RNA, 23 nt, Escherichia coli CFT073
gacuuguggcgcaggggcagaaa

SEQ ID NO: 646687 - RNA, 12 nt, Escherichia coli CFT073
gacugacagacu

SEQ ID NO: 646688 - RNA, 16 nt, Escherichia coli CFT073
gacugacgcucugcuu

SEQ ID NO: 646689 - RNA, 16 nt, Escherichia coli CFT073
gacugaagguaagcaa

SEQ ID NO: 646690 - RNA, 14 nt, Escherichia coli CFT073
gacugacaaucaau

SEQ ID NO: 646691 - RNA, 13 nt, Escherichia coli CFT073
gacugaugcuuuc

SEQ ID NO: 646692 - RNA, 15 nt, Escherichia coli CFT073
gacugaugcuuuccg

SEQ ID NO: 646693 - RNA, 20 nt, Escherichia coli CFT073
gacugaugugcuccaucagg

SEQ ID NO: 646694 - RNA, 21 nt, Escherichia coli CFT073
gacugaugugcuccaucaggu

SEQ ID NO: 646695 - RNA, 19 nt, Escherichia coli CFT073
gacugccagcaucuccugu

SEQ ID NO: 646696 - RNA, 13 nt, Escherichia coli CFT073
gacugccugcaua

SEQ ID NO: 646697 - RNA, 19 nt, Escherichia coli CFT073
gacugucgcuauucaacgu

SEQ ID NO: 646698 - RNA, 15 nt, Escherichia coli CFT073
gacugucuuccugcg

SEQ ID NO: 646699 - RNA, 19 nt, Escherichia coli CFT073
gacugguuaguuucagcgc

SEQ ID NO: 646700 - RNA, 23 nt, Escherichia coli CFT073
gacugguugauuggcuuuaaaag

SEQ ID NO: 646701 - RNA, 18 nt, Escherichia coli CFT073
gacuggaaaucaaauaca

SEQ ID NO: 646702 - RNA, 18 nt, Escherichia coli CFT073
gacuggaacaagccaaau

SEQ ID NO: 646703 - RNA, 18 nt, Escherichia coli CFT073
gacuggccauggauucaa

SEQ ID NO: 646704 - RNA, 20 nt, Escherichia coli CFT073
gacuggccauggauucaagc

SEQ ID NO: 646705 - RNA, 15 nt, Escherichia coli CFT073
gacuccagcgccagc

SEQ ID NO: 646706 - RNA, 20 nt, Escherichia coli CFT073
gacuccagcgccagcgcgcg

SEQ ID NO: 646707 - RNA, 18 nt, Escherichia coli CFT073
gacucccgcgccgcagcc

SEQ ID NO: 646708 - RNA, 15 nt, Escherichia coli CFT073
gacuccgccgccauu

SEQ ID NO: 646709 - RNA, 19 nt, Escherichia coli CFT073
gacguugauaaccacggcg

SEQ ID NO: 646710 - RNA, 13 nt, Escherichia coli CFT073
gacguucugccaa

SEQ ID NO: 646711 - RNA, 14 nt, Escherichia coli CFT073
gacguucugccaaa

SEQ ID NO: 646712 - RNA, 23 nt, Escherichia coli CFT073
gacgugcguaccauuaucaccaa

SEQ ID NO: 646713 - RNA, 20 nt, Escherichia coli CFT073
gacgugcaccgucacuucuu

SEQ ID NO: 646714 - RNA, 15 nt, Escherichia coli CFT073
gacgugcagcaucga

SEQ ID NO: 646715 - RNA, 18 nt, Escherichia coli CFT073
gacgugcaguagcagcag

SEQ ID NO: 646716 - RNA, 15 nt, Escherichia coli CFT073
gacucuguggcggga

SEQ ID NO: 646717 - RNA, 23 nt, Escherichia coli CFT073
gacucuccccugacguaaggcau

SEQ ID NO: 646718 - RNA, 13 nt, Escherichia coli CFT073
gacguccagaacc

SEQ ID NO: 646719 - RNA, 15 nt, Escherichia coli CFT073
gacgguuugccuucc

SEQ ID NO: 646720 - RNA, 15 nt, Escherichia coli CFT073
gacguaaucaugaac

SEQ ID NO: 646721 - RNA, 23 nt, Escherichia coli CFT073
gacgggcauuucgucuugcagga

SEQ ID NO: 646722 - RNA, 21 nt, Escherichia coli CFT073
gacgggcuaaucgucaucagc

SEQ ID NO: 646723 - RNA, 19 nt, Escherichia coli CFT073
gacggggauucccacuuca

SEQ ID NO: 646724 - RNA, 22 nt, Escherichia coli CFT073
gacgggaaacucugcuggcgga

SEQ ID NO: 646725 - RNA, 15 nt, Escherichia coli CFT073
gacggcaccaaaaau

SEQ ID NO: 646726 - RNA, 14 nt, Escherichia coli CFT073
gacgcuaaaccgcu

SEQ ID NO: 646727 - RNA, 16 nt, Escherichia coli CFT073
gacgcgguaaaagccc

SEQ ID NO: 646728 - RNA, 17 nt, Escherichia coli CFT073
gacgcgguaaaagccca

SEQ ID NO: 646729 - RNA, 15 nt, Escherichia coli CFT073
gacgcguaaauccag

SEQ ID NO: 646730 - RNA, 22 nt, Escherichia coli CFT073
gacgcguaaauccagcaccgcu

SEQ ID NO: 646731 - RNA, 12 nt, Escherichia coli CFT073
gacgcgucagug

SEQ ID NO: 646732 - RNA, 18 nt, Escherichia coli CFT073
gacgcgucuuauccggcc

SEQ ID NO: 646733 - RNA, 16 nt, Escherichia coli CFT073
gacgcugagcacgcuu

SEQ ID NO: 646734 - RNA, 22 nt, Escherichia coli CFT073
gacgcugaagucagcacaucca

SEQ ID NO: 646735 - RNA, 16 nt, Escherichia coli CFT073
gacgcugacgauugua

SEQ ID NO: 646736 - RNA, 16 nt, Escherichia coli CFT073
gacgcugcauaucucc

SEQ ID NO: 646737 - RNA, 15 nt, Escherichia coli CFT073
gacgcugcucaggcg

SEQ ID NO: 646738 - RNA, 16 nt, Escherichia coli CFT073
gacgcuggcagaaagu

SEQ ID NO: 646739 - RNA, 14 nt, Escherichia coli CFT073
gacgcuggcagcag

SEQ ID NO: 646740 - RNA, 15 nt, Escherichia coli CFT073
gacgcagaucccacu

SEQ ID NO: 646741 - RNA, 23 nt, Escherichia coli CFT073
gacgcagaccaaagucaaacugg

SEQ ID NO: 646742 - RNA, 19 nt, Escherichia coli CFT073
gacgccugcuccaucaucc

SEQ ID NO: 646743 - RNA, 22 nt, Escherichia coli CFT073
gacgcaaccagcgucgcaucag

SEQ ID NO: 646744 - RNA, 22 nt, Escherichia coli CFT073
gacgcaaaacgcgcucacugca

SEQ ID NO: 646745 - RNA, 12 nt, Escherichia coli CFT073
gacgcaaacaac

SEQ ID NO: 646746 - RNA, 14 nt, Escherichia coli CFT073
gacgauuguagaaa

SEQ ID NO: 646747 - RNA, 14 nt, Escherichia coli CFT073
gacgcgcugaguca

SEQ ID NO: 646748 - RNA, 17 nt, Escherichia coli CFT073
gacgcggcacuccgcca

SEQ ID NO: 646749 - RNA, 12 nt, Escherichia coli CFT073
gacgcgccaggu

SEQ ID NO: 646750 - RNA, 18 nt, Escherichia coli CFT073
gacgcgccgccaccgcca

SEQ ID NO: 646751 - RNA, 22 nt, Escherichia coli CFT073
gacgcgcaggagcggcggaggc

SEQ ID NO: 646752 - RNA, 23 nt, Escherichia coli CFT073
gacgaugccgucgccauugcagc

SEQ ID NO: 646753 - RNA, 20 nt, Escherichia coli CFT073
gacgaugauugucccugcca

SEQ ID NO: 646754 - RNA, 14 nt, Escherichia coli CFT073
gacgaucgcgcagg

SEQ ID NO: 646755 - RNA, 13 nt, Escherichia coli CFT073
gacgaccaguccg

SEQ ID NO: 646756 - RNA, 15 nt, Escherichia coli CFT073
gacgaccuuuuccau

SEQ ID NO: 646757 - RNA, 14 nt, Escherichia coli CFT073
gacgagagugacga

SEQ ID NO: 646758 - RNA, 20 nt, Escherichia coli CFT073
gaccucuucggcaaguguug

SEQ ID NO: 646759 - RNA, 18 nt, Escherichia coli CFT073
gacgacaucgacucacca

SEQ ID NO: 646760 - RNA, 19 nt, Escherichia coli CFT073
gacgaccagcggcaacauc

SEQ ID NO: 646761 - RNA, 22 nt, Escherichia coli CFT073
gaccgucgagcagagaaacgcc

SEQ ID NO: 646762 - RNA, 17 nt, Escherichia coli CFT073
gaccgucgccuucaacg

SEQ ID NO: 646763 - RNA, 21 nt, Escherichia coli CFT073
gaccgucuuuauccagcacca

SEQ ID NO: 646764 - RNA, 15 nt, Escherichia coli CFT073
gaccguuuucaccag

SEQ ID NO: 646765 - RNA, 18 nt, Escherichia coli CFT073
gaccuaaaaauucccacu

SEQ ID NO: 646766 - RNA, 22 nt, Escherichia coli CFT073
gaccguuagcauauugcaggcu

SEQ ID NO: 646767 - RNA, 18 nt, Escherichia coli CFT073
gaccggcgguacuuggca

SEQ ID NO: 646768 - RNA, 15 nt, Escherichia coli CFT073
gaccgguccacuucc

SEQ ID NO: 646769 - RNA, 14 nt, Escherichia coli CFT073
gacccgcacacuca

SEQ ID NO: 646770 - RNA, 18 nt, Escherichia coli CFT073
gacccacgccuuuuucuc

SEQ ID NO: 646771 - RNA, 21 nt, Escherichia coli CFT073
gacccacggauagauuuuuaa

SEQ ID NO: 646772 - RNA, 20 nt, Escherichia coli CFT073
gaccagugcagauaccacca

SEQ ID NO: 646773 - RNA, 21 nt, Escherichia coli CFT073
gaccaguuguaaucugcacca

SEQ ID NO: 646774 - RNA, 14 nt, Escherichia coli CFT073
gaccagugaaaaug

SEQ ID NO: 646775 - RNA, 19 nt, Escherichia coli CFT073
gacccguuuacggcuaaaa

SEQ ID NO: 646776 - RNA, 15 nt, Escherichia coli CFT073
gacccggaauaaaug

SEQ ID NO: 646777 - RNA, 17 nt, Escherichia coli CFT073
gacauugaccagugcag

SEQ ID NO: 646778 - RNA, 15 nt, Escherichia coli CFT073
gaccaaccaucaucc

SEQ ID NO: 646779 - RNA, 20 nt, Escherichia coli CFT073
gaccacggccauauccagcc

SEQ ID NO: 646780 - RNA, 18 nt, Escherichia coli CFT073
gaccaauaaacgccaggu

SEQ ID NO: 646781 - RNA, 22 nt, Escherichia coli CFT073
gaccacggacaugaaccguguc

SEQ ID NO: 646782 - RNA, 15 nt, Escherichia coli CFT073
gaccagauugaacuc

SEQ ID NO: 646783 - RNA, 15 nt, Escherichia coli CFT073
gaccagccagcaaug

SEQ ID NO: 646784 - RNA, 16 nt, Escherichia coli CFT073
gaccagccaggccgcc

SEQ ID NO: 646785 - RNA, 22 nt, Escherichia coli CFT073
gaccagcgccgcaacuaccagc

SEQ ID NO: 646786 - RNA, 15 nt, Escherichia coli CFT073
gaccaggaugcuuca

SEQ ID NO: 646787 - RNA, 20 nt, Escherichia coli CFT073
gaccaggauuugauggucuc

SEQ ID NO: 646788 - RNA, 16 nt, Escherichia coli CFT073
gaccaggcaaaccagu

SEQ ID NO: 646789 - RNA, 23 nt, Escherichia coli CFT073
gacaucuuucugcgcaucuuccc

SEQ ID NO: 646790 - RNA, 13 nt, Escherichia coli CFT073
gacaugacccggc

SEQ ID NO: 646791 - RNA, 16 nt, Escherichia coli CFT073
gacauucaccucacga

SEQ ID NO: 646792 - RNA, 14 nt, Escherichia coli CFT073
gacauauaaccggc

SEQ ID NO: 646793 - RNA, 15 nt, Escherichia coli CFT073
gacaucaaagaaaag

SEQ ID NO: 646794 - RNA, 22 nt, Escherichia coli CFT073
gacaucaacagaagagcggcuc

SEQ ID NO: 646795 - RNA, 19 nt, Escherichia coli CFT073
gacaucaacgaugccuuau

SEQ ID NO: 646796 - RNA, 16 nt, Escherichia coli CFT073
gacaucaacgccugau

SEQ ID NO: 646797 - RNA, 16 nt, Escherichia coli CFT073
gacauaaacaccagca

SEQ ID NO: 646798 - RNA, 19 nt, Escherichia coli CFT073
gacauacagcaccgcccgu

SEQ ID NO: 646799 - RNA, 22 nt, Escherichia coli CFT073
gacaguuucaguuaaccggcuu

SEQ ID NO: 646800 - RNA, 16 nt, Escherichia coli CFT073
gacaggagccgcagua

SEQ ID NO: 646801 - RNA, 17 nt, Escherichia coli CFT073
gacagcuuuuacaaaau

SEQ ID NO: 646802 - RNA, 14 nt, Escherichia coli CFT073
gacagcgccaggcu

SEQ ID NO: 646803 - RNA, 18 nt, Escherichia coli CFT073
gacagcguaauagccuga

SEQ ID NO: 646804 - RNA, 17 nt, Escherichia coli CFT073
gacagaaacaaaugaaa

SEQ ID NO: 646805 - RNA, 22 nt, Escherichia coli CFT073
gacagaaagugaucccacauca

SEQ ID NO: 646806 - RNA, 21 nt, Escherichia coli CFT073
gacagaaaaccaaaaccggcu

SEQ ID NO: 646807 - RNA, 13 nt, Escherichia coli CFT073
gacacuuuccugc

SEQ ID NO: 646808 - RNA, 22 nt, Escherichia coli CFT073
gacacugacgcgucuuaucugg

SEQ ID NO: 646809 - RNA, 15 nt, Escherichia coli CFT073
gacacuggcagugug

SEQ ID NO: 646810 - RNA, 23 nt, Escherichia coli CFT073
gacacugccgccgucaucugggc

SEQ ID NO: 646811 - RNA, 21 nt, Escherichia coli CFT073
gacagcaccccgacagcaugc

SEQ ID NO: 646812 - RNA, 18 nt, Escherichia coli CFT073
gacagcgcaauagccuga

SEQ ID NO: 646813 - RNA, 21 nt, Escherichia coli CFT073
gacagcgaaaacgacgagcca

SEQ ID NO: 646814 - RNA, 14 nt, Escherichia coli CFT073
gacacauucagaau

SEQ ID NO: 646815 - RNA, 16 nt, Escherichia coli CFT073
gacacaggcagcaauc

SEQ ID NO: 646816 - RNA, 14 nt, Escherichia coli CFT073
gacacaugcugacu

SEQ ID NO: 646817 - RNA, 18 nt, Escherichia coli CFT073
gacacucacgcauacagu

SEQ ID NO: 646818 - RNA, 14 nt, Escherichia coli CFT073
gacacggcucgccu

SEQ ID NO: 646819 - RNA, 16 nt, Escherichia coli CFT073
gacacgcgcgcauggu

SEQ ID NO: 646820 - RNA, 20 nt, Escherichia coli CFT073
gaauggaaacagcaccaucc

SEQ ID NO: 646821 - RNA, 14 nt, Escherichia coli CFT073
gaauggcauacugu

SEQ ID NO: 646822 - RNA, 14 nt, Escherichia coli CFT073
gaauggcugcacuu

SEQ ID NO: 646823 - RNA, 19 nt, Escherichia coli CFT073
gaauggcugcacuuucagu

SEQ ID NO: 646824 - RNA, 17 nt, Escherichia coli CFT073
gaauggguaaacccgcg

SEQ ID NO: 646825 - RNA, 16 nt, Escherichia coli CFT073
gaauucaguaccagca

SEQ ID NO: 646826 - RNA, 17 nt, Escherichia coli CFT073
gaauucaguaccagcac

SEQ ID NO: 646827 - RNA, 21 nt, Escherichia coli CFT073
gaauucaguaccagcaccuga

SEQ ID NO: 646828 - RNA, 14 nt, Escherichia coli CFT073
gaauggucaccaca

SEQ ID NO: 646829 - RNA, 11 nt, Escherichia coli CFT073
gaauggucagu

SEQ ID NO: 646830 - RNA, 14 nt, Escherichia coli CFT073
gaauggugaccugc

SEQ ID NO: 646831 - RNA, 14 nt, Escherichia coli CFT073
gaauuugaggaagc

SEQ ID NO: 646832 - RNA, 22 nt, Escherichia coli CFT073
gaauuuccgguuguuuugguua

SEQ ID NO: 646833 - RNA, 15 nt, Escherichia coli CFT073
gaauucgacuuucuc

SEQ ID NO: 646834 - RNA, 17 nt, Escherichia coli CFT073
gaauucgacuuucucug

SEQ ID NO: 646835 - RNA, 21 nt, Escherichia coli CFT073
gaauucgguagucauuaacua

SEQ ID NO: 646836 - RNA, 16 nt, Escherichia coli CFT073
gaauuccggcagagaa

SEQ ID NO: 646837 - RNA, 22 nt, Escherichia coli CFT073
gaauuccggcagagaaagcaaa

SEQ ID NO: 646838 - RNA, 17 nt, Escherichia coli CFT073
gaauuccgugccagcac

SEQ ID NO: 646839 - RNA, 20 nt, Escherichia coli CFT073
gaauuucaucaucacgaaau

SEQ ID NO: 646840 - RNA, 13 nt, Escherichia coli CFT073
gaauuuccagaaa

SEQ ID NO: 646841 - RNA, 15 nt, Escherichia coli CFT073
gaauuuccagaaagu

SEQ ID NO: 646842 - RNA, 19 nt, Escherichia coli CFT073
gaauuuccugcgcuuucug

SEQ ID NO: 646843 - RNA, 20 nt, Escherichia coli CFT073
gacaaaugucagaaagaaau

SEQ ID NO: 646844 - RNA, 22 nt, Escherichia coli CFT073
gacaacagucaaccgccugaau

SEQ ID NO: 646845 - RNA, 20 nt, Escherichia coli CFT073
gacaacaacaucacaccugc

SEQ ID NO: 646846 - RNA, 22 nt, Escherichia coli CFT073
gacaacaaacgcaaacaccagc

SEQ ID NO: 646847 - RNA, 19 nt, Escherichia coli CFT073
gacaaaguggcggcagcgg

SEQ ID NO: 646848 - RNA, 15 nt, Escherichia coli CFT073
gacaaaguugaagcc

SEQ ID NO: 646849 - RNA, 23 nt, Escherichia coli CFT073
gacaaaguuugucccuugucugg

SEQ ID NO: 646850 - RNA, 18 nt, Escherichia coli CFT073
gacaaauaacccgccaug

SEQ ID NO: 646851 - RNA, 13 nt, Escherichia coli CFT073
gacaagaauauug

SEQ ID NO: 646852 - RNA, 21 nt, Escherichia coli CFT073
gacaagcguuagcgugaucuc

SEQ ID NO: 646853 - RNA, 17 nt, Escherichia coli CFT073
gacaagcucauuuccca

SEQ ID NO: 646854 - RNA, 14 nt, Escherichia coli CFT073
gacaauaucaucau

SEQ ID NO: 646855 - RNA, 13 nt, Escherichia coli CFT073
gacaaucaauccg

SEQ ID NO: 646856 - RNA, 21 nt, Escherichia coli CFT073
gacaaucaauccggcaaucaa

SEQ ID NO: 646857 - RNA, 13 nt, Escherichia coli CFT073
gacaaucgccagu

SEQ ID NO: 646858 - RNA, 19 nt, Escherichia coli CFT073
gacaauccagcgaaauaaa

SEQ ID NO: 646859 - RNA, 16 nt, Escherichia coli CFT073
gacaauccccgccagc

SEQ ID NO: 646860 - RNA, 15 nt, Escherichia coli CFT073
gacacaacuggcgca

SEQ ID NO: 646861 - RNA, 15 nt, Escherichia coli CFT073
gacacaaucaaaucc

SEQ ID NO: 646862 - RNA, 19 nt, Escherichia coli CFT073
gacacaaucaaauccugca

SEQ ID NO: 646863 - RNA, 20 nt, Escherichia coli CFT073
gaaucggugcgcgaugguca

SEQ ID NO: 646864 - RNA, 16 nt, Escherichia coli CFT073
gaaucggaucaauccc

SEQ ID NO: 646865 - RNA, 18 nt, Escherichia coli CFT073
gaauccggugauugcugc

SEQ ID NO: 646866 - RNA, 21 nt, Escherichia coli CFT073
gaauccguuaacguaccggcg

SEQ ID NO: 646867 - RNA, 18 nt, Escherichia coli CFT073
gaaucacuucaucgccgc

SEQ ID NO: 646868 - RNA, 19 nt, Escherichia coli CFT073
gaaucagcaaacugguuga

SEQ ID NO: 646869 - RNA, 23 nt, Escherichia coli CFT073
gaaucagcaaacugguugaaaua

SEQ ID NO: 646870 - RNA, 18 nt, Escherichia coli CFT073
gaauccgcaccaacucca

SEQ ID NO: 646871 - RNA, 16 nt, Escherichia coli CFT073
gaaugcaggcgcgccu

SEQ ID NO: 646872 - RNA, 17 nt, Escherichia coli CFT073
gaaugccaaauccggca

SEQ ID NO: 646873 - RNA, 16 nt, Escherichia coli CFT073
gaaugccaauuucccg

SEQ ID NO: 646874 - RNA, 15 nt, Escherichia coli CFT073
gaaucucaggcaaau

SEQ ID NO: 646875 - RNA, 15 nt, Escherichia coli CFT073
gaaucugccgcagua

SEQ ID NO: 646876 - RNA, 22 nt, Escherichia coli CFT073
gaaugaucagcgguuuugccag

SEQ ID NO: 646877 - RNA, 12 nt, Escherichia coli CFT073
aaagaucuuugc

SEQ ID NO: 646878 - RNA, 14 nt, Escherichia coli CFT073
gaauaguacauugu

SEQ ID NO: 646879 - RNA, 14 nt, Escherichia coli CFT073
gaauauacgccaga

SEQ ID NO: 646880 - RNA, 14 nt, Escherichia coli CFT073
gaauauaucagccu

SEQ ID NO: 646881 - RNA, 17 nt, Escherichia coli CFT073
gaauaucaacaaaacca

SEQ ID NO: 646882 - RNA, 12 nt, Escherichia coli CFT073
gaauaucaucac

SEQ ID NO: 646883 - RNA, 18 nt, Escherichia coli CFT073
gaauaucaucacccugcg

SEQ ID NO: 646884 - RNA, 23 nt, Escherichia coli CFT073
gaauaucaccacugaugccacug

SEQ ID NO: 646885 - RNA, 19 nt, Escherichia coli CFT073
gaauaucccauuucuccac

SEQ ID NO: 646886 - RNA, 15 nt, Escherichia coli CFT073
gaauauccugacuuu

SEQ ID NO: 646887 - RNA, 21 nt, Escherichia coli CFT073
gaauaucuucgaccgucacca

SEQ ID NO: 646888 - RNA, 15 nt, Escherichia coli CFT073
gaauauggcggcggc

SEQ ID NO: 646889 - RNA, 17 nt, Escherichia coli CFT073
gaauauggcggcggcuu

SEQ ID NO: 646890 - RNA, 13 nt, Escherichia coli CFT073
gaauauuccaguu

SEQ ID NO: 646891 - RNA, 16 nt, Escherichia coli CFT073
gaaucacgaggcacaa

SEQ ID NO: 646892 - RNA, 22 nt, Escherichia coli CFT073
gaaucacgauacuggcgucuuu

SEQ ID NO: 646893 - RNA, 20 nt, Escherichia coli CFT073
gaauauugccgaagaccaga

SEQ ID NO: 646894 - RNA, 16 nt, Escherichia coli CFT073
gaaucaccgccacgcc

SEQ ID NO: 646895 - RNA, 13 nt, Escherichia coli CFT073
gaaguggcugacc

SEQ ID NO: 646896 - RNA, 23 nt, Escherichia coli CFT073
gaagugauccgccgugcgguggg

SEQ ID NO: 646897 - RNA, 16 nt, Escherichia coli CFT073
gaaggugagggggcga

SEQ ID NO: 646898 - RNA, 12 nt, Escherichia coli CFT073
gaaggugccuuu

SEQ ID NO: 646899 - RNA, 14 nt, Escherichia coli CFT073
gaaguaguugcugu

SEQ ID NO: 646900 - RNA, 14 nt, Escherichia coli CFT073
gaaggucagguuug

SEQ ID NO: 646901 - RNA, 17 nt, Escherichia coli CFT073
gaagcugaacagucgcu

SEQ ID NO: 646902 - RNA, 18 nt, Escherichia coli CFT073
gaagcuggucagcaucgu

SEQ ID NO: 646903 - RNA, 21 nt, Escherichia coli CFT073
gaagcugguguaacugcgcca

SEQ ID NO: 646904 - RNA, 13 nt, Escherichia coli CFT073
gaauacacaucag

SEQ ID NO: 646905 - RNA, 16 nt, Escherichia coli CFT073
gaauaaauuggcuggg

SEQ ID NO: 646906 - RNA, 21 nt, Escherichia coli CFT073
gaauaacaaacggcgguaaaa

SEQ ID NO: 646907 - RNA, 15 nt, Escherichia coli CFT073
gaauaaugcaaaaag

SEQ ID NO: 646908 - RNA, 17 nt, Escherichia coli CFT073
gaauaaucguaaucagc

SEQ ID NO: 646909 - RNA, 14 nt, Escherichia coli CFT073
aaagauaaugccag

SEQ ID NO: 646910 - RNA, 14 nt, Escherichia coli CFT073
aaagauacaaaaca

SEQ ID NO: 646911 - RNA, 17 nt, Escherichia coli CFT073
gaaguuauuaaugacaa

SEQ ID NO: 646912 - RNA, 14 nt, Escherichia coli CFT073
gaaguggugauuga

SEQ ID NO: 646913 - RNA, 16 nt, Escherichia coli CFT073
gaaguuuaauucuuug

SEQ ID NO: 646914 - RNA, 15 nt, Escherichia coli CFT073
gaauaaagacacugc

SEQ ID NO: 646915 - RNA, 15 nt, Escherichia coli CFT073
gaauaaagcuuuaau

SEQ ID NO: 646916 - RNA, 14 nt, Escherichia coli CFT073
gaagcauaccgauc

SEQ ID NO: 646917 - RNA, 14 nt, Escherichia coli CFT073
gaagccagacaaau

SEQ ID NO: 646918 - RNA, 17 nt, Escherichia coli CFT073
gaagccagacaaauguc

SEQ ID NO: 646919 - RNA, 13 nt, Escherichia coli CFT073
gaagccagacgug

SEQ ID NO: 646920 - RNA, 15 nt, Escherichia coli CFT073
gaagccaccuggggc

SEQ ID NO: 646921 - RNA, 20 nt, Escherichia coli CFT073
gaagccgaccagcaccgcca

SEQ ID NO: 646922 - RNA, 20 nt, Escherichia coli CFT073
gaagcaguuucaccagcagu

SEQ ID NO: 646923 - RNA, 17 nt, Escherichia coli CFT073
gaagaugcguucaccua

SEQ ID NO: 646924 - RNA, 15 nt, Escherichia coli CFT073
gaagauuugcagauc

SEQ ID NO: 646925 - RNA, 18 nt, Escherichia coli CFT073
gaagauuuuaccgucacc

SEQ ID NO: 646926 - RNA, 21 nt, Escherichia coli CFT073
gaagccuuccgcaaacaggcg

SEQ ID NO: 646927 - RNA, 14 nt, Escherichia coli CFT073
gaagcguugaucca

SEQ ID NO: 646928 - RNA, 16 nt, Escherichia coli CFT073
gaagcguugauccagc

SEQ ID NO: 646929 - RNA, 22 nt, Escherichia coli CFT073
gaagcgagugcgaaacuucuua

SEQ ID NO: 646930 - RNA, 20 nt, Escherichia coli CFT073
gaagccgcuccggcagcagc

SEQ ID NO: 646931 - RNA, 13 nt, Escherichia coli CFT073
gaagagauaaacu

SEQ ID NO: 646932 - RNA, 20 nt, Escherichia coli CFT073
gaagaccguacagaguauua

SEQ ID NO: 646933 - RNA, 17 nt, Escherichia coli CFT073
gaagacgaguagaagcg

SEQ ID NO: 646934 - RNA, 15 nt, Escherichia coli CFT073
gaagaucaucaccag

SEQ ID NO: 646935 - RNA, 18 nt, Escherichia coli CFT073
gaagaucaucaccaggcc

SEQ ID NO: 646936 - RNA, 16 nt, Escherichia coli CFT073
gaagagcgacaauccc

SEQ ID NO: 646937 - RNA, 16 nt, Escherichia coli CFT073
gaagaucuucagucuu

SEQ ID NO: 646938 - RNA, 14 nt, Escherichia coli CFT073
gaagaugaaaaacg

SEQ ID NO: 646939 - RNA, 12 nt, Escherichia coli CFT073
gaagaagcccau

SEQ ID NO: 646940 - RNA, 20 nt, Escherichia coli CFT073
gaacaugcgggucuuacugg

SEQ ID NO: 646941 - RNA, 23 nt, Escherichia coli CFT073
gaacauccuuuccuuaagccagc

SEQ ID NO: 646942 - RNA, 12 nt, Escherichia coli CFT073
gaacaucgccau

SEQ ID NO: 646943 - RNA, 16 nt, Escherichia coli CFT073
gaagacaucaucguga

SEQ ID NO: 646944 - RNA, 21 nt, Escherichia coli CFT073
gaagacaucgcagggaucauc

SEQ ID NO: 646945 - RNA, 12 nt, Escherichia coli CFT073
ggcguaaacgcc

SEQ ID NO: 646946 - RNA, 13 nt, Escherichia coli CFT073
ggcguaccgcaca

SEQ ID NO: 646947 - RNA, 14 nt, Escherichia coli CFT073
ggcguacagcuggc

SEQ ID NO: 646948 - RNA, 16 nt, Escherichia coli CFT073
ggcgucaugcucgcag

SEQ ID NO: 646949 - RNA, 11 nt, Escherichia coli CFT073
ggcgucccaga

SEQ ID NO: 646950 - RNA, 21 nt, Escherichia coli CFT073
ggcggucccacaacagguauc

SEQ ID NO: 646951 - RNA, 19 nt, Escherichia coli CFT073
ggcggcuugcaccagcagc

SEQ ID NO: 646952 - RNA, 12 nt, Escherichia coli CFT073
ggcggucuggcg

SEQ ID NO: 646953 - RNA, 20 nt, Escherichia coli CFT073
ggcggucgccgucaauagcg

SEQ ID NO: 646954 - RNA, 19 nt, Escherichia coli CFT073
ggcggucuguauuuggcug

SEQ ID NO: 646955 - RNA, 17 nt, Escherichia coli CFT073
ggcggugacuagcagca

SEQ ID NO: 646956 - RNA, 18 nt, Escherichia coli CFT073
ggcggcguuuugucgccg

SEQ ID NO: 646957 - RNA, 20 nt, Escherichia coli CFT073
ggcggcguguuauccggcug

SEQ ID NO: 646958 - RNA, 15 nt, Escherichia coli CFT073
ggcgcuuggcuucca

SEQ ID NO: 646959 - RNA, 20 nt, Escherichia coli CFT073
ggcgcuuaucgucccaggca

SEQ ID NO: 646960 - RNA, 12 nt, Escherichia coli CFT073
ggcgcuggccau

SEQ ID NO: 646961 - RNA, 14 nt, Escherichia coli CFT073
ggcuacgugccggg

SEQ ID NO: 646962 - RNA, 14 nt, Escherichia coli CFT073
ggcuaucaugcccg

SEQ ID NO: 646963 - RNA, 14 nt, Escherichia coli CFT073
ggcuaucgaaauca

SEQ ID NO: 646964 - RNA, 14 nt, Escherichia coli CFT073
ggcucaccugcaca

SEQ ID NO: 646965 - RNA, 15 nt, Escherichia coli CFT073
ggcuaagcaggcugg

SEQ ID NO: 646966 - RNA, 14 nt, Escherichia coli CFT073
ggcuaauaaacagg

SEQ ID NO: 646967 - RNA, 18 nt, Escherichia coli CFT073
ggcuaaucgucaucgaca

SEQ ID NO: 646968 - RNA, 16 nt, Escherichia coli CFT073
ggcuaaccuuauggug

SEQ ID NO: 646969 - RNA, 13 nt, Escherichia coli CFT073
ggcguuucuucac

SEQ ID NO: 646970 - RNA, 23 nt, Escherichia coli CFT073
ggcguuuugauuuucaccagcau

SEQ ID NO: 646971 - RNA, 13 nt, Escherichia coli CFT073
ggcguucacugcc

SEQ ID NO: 646972 - RNA, 19 nt, Escherichia coli CFT073
ggcguguuauugccgagaa

SEQ ID NO: 646973 - RNA, 13 nt, Escherichia coli CFT073
ggcguuaaaacca

SEQ ID NO: 646974 - RNA, 21 nt, Escherichia coli CFT073
ggcguuaauauaaacgacagc

SEQ ID NO: 646975 - RNA, 21 nt, Escherichia coli CFT073
ggcguuaaugauaucccugcu

SEQ ID NO: 646976 - RNA, 15 nt, Escherichia coli CFT073
ggcguuacagcugga

SEQ ID NO: 646977 - RNA, 15 nt, Escherichia coli CFT073
ggcgugccuucacgg

SEQ ID NO: 646978 - RNA, 15 nt, Escherichia coli CFT073
ggcgugaaagaaaau

SEQ ID NO: 646979 - RNA, 12 nt, Escherichia coli CFT073
ggcgugaacacc

SEQ ID NO: 646980 - RNA, 17 nt, Escherichia coli CFT073
ggcgugaaugcgccaau

SEQ ID NO: 646981 - RNA, 21 nt, Escherichia coli CFT073
ggcgucuaaaucguaccagga

SEQ ID NO: 646982 - RNA, 13 nt, Escherichia coli CFT073
ggcgucuccaccu

SEQ ID NO: 646983 - RNA, 23 nt, Escherichia coli CFT073
ggcgucguucgccagucuccagg

SEQ ID NO: 646984 - RNA, 23 nt, Escherichia coli CFT073
ggcgucgaaaauaucgagcagcu

SEQ ID NO: 646985 - RNA, 21 nt, Escherichia coli CFT073
ggcgcgcggauuucggcggcu

SEQ ID NO: 646986 - RNA, 11 nt, Escherichia coli CFT073
ggcgcggcggu

SEQ ID NO: 646987 - RNA, 14 nt, Escherichia coli CFT073
ggcgcggcggcggg

SEQ ID NO: 646988 - RNA, 17 nt, Escherichia coli CFT073
ggcgcucaggcgaucag

SEQ ID NO: 646989 - RNA, 17 nt, Escherichia coli CFT073
ggcgcucaucaggccaa

SEQ ID NO: 646990 - RNA, 14 nt, Escherichia coli CFT073
ggcgcgugaugugg

SEQ ID NO: 646991 - RNA, 16 nt, Escherichia coli CFT073
ggcgcugauaaauccc

SEQ ID NO: 646992 - RNA, 15 nt, Escherichia coli CFT073
ggcgcucgcgccgca

SEQ ID NO: 646993 - RNA, 19 nt, Escherichia coli CFT073
ggcgcuccugcgggagcgc

SEQ ID NO: 646994 - RNA, 18 nt, Escherichia coli CFT073
ggcgcgagcgccuuaucc

SEQ ID NO: 646995 - RNA, 15 nt, Escherichia coli CFT073
ggcgccgaagcgccu

SEQ ID NO: 646996 - RNA, 14 nt, Escherichia coli CFT073
ggcgaucgucgccg

SEQ ID NO: 646997 - RNA, 20 nt, Escherichia coli CFT073
ggcgcaacacccugaugugc

SEQ ID NO: 646998 - RNA, 21 nt, Escherichia coli CFT073
ggcgcaaugauaucgcuggca

SEQ ID NO: 646999 - RNA, 18 nt, Escherichia coli CFT073
ggcgcacacgaucugaca

SEQ ID NO: 647000 - RNA, 21 nt, Escherichia coli CFT073
ggcgagcuuauauacucuaaa

SEQ ID NO: 647001 - RNA, 19 nt, Escherichia coli CFT073
ggcgaauucugcagacugu

SEQ ID NO: 647002 - RNA, 20 nt, Escherichia coli CFT073
ggcgaggggaccgaucgcgc

SEQ ID NO: 647003 - RNA, 14 nt, Escherichia coli CFT073
ggcgauaaacagca

SEQ ID NO: 647004 - RNA, 20 nt, Escherichia coli CFT073
ggcgauaaaguguugagcuu

SEQ ID NO: 647005 - RNA, 19 nt, Escherichia coli CFT073
ggcgcaggggcagaaacaa

SEQ ID NO: 647006 - RNA, 13 nt, Escherichia coli CFT073
ggcgcagggugua

SEQ ID NO: 647007 - RNA, 18 nt, Escherichia coli CFT073
ggcgcagacggucuggug

SEQ ID NO: 647008 - RNA, 20 nt, Escherichia coli CFT073
ggcgcauuaacucacuggcg

SEQ ID NO: 647009 - RNA, 13 nt, Escherichia coli CFT073
aaauaaacaccag

SEQ ID NO: 647010 - RNA, 15 nt, Escherichia coli CFT073
aaauaaacaacaaaa

SEQ ID NO: 647011 - RNA, 16 nt, Escherichia coli CFT073
aaauaaacaacaaaau

SEQ ID NO: 647012 - RNA, 13 nt, Escherichia coli CFT073
aaauaaacaauga

SEQ ID NO: 647013 - RNA, 20 nt, Escherichia coli CFT073
ggccugauauaucaccuucc

SEQ ID NO: 647014 - RNA, 16 nt, Escherichia coli CFT073
ggccugauuaaacgcc

SEQ ID NO: 647015 - RNA, 23 nt, Escherichia coli CFT073
ggccugauuaagaucgugcagca

SEQ ID NO: 647016 - RNA, 13 nt, Escherichia coli CFT073
ggccugcaggugu

SEQ ID NO: 647017 - RNA, 18 nt, Escherichia coli CFT073
ggccuuaauuggccaccg

SEQ ID NO: 647018 - RNA, 15 nt, Escherichia coli CFT073
ggccuggggaaugag

SEQ ID NO: 647019 - RNA, 19 nt, Escherichia coli CFT073
aaauaaauaccguucauua

SEQ ID NO: 647020 - RNA, 22 nt, Escherichia coli CFT073
aaauaaaucaaagucagaucaa

SEQ ID NO: 647021 - RNA, 14 nt, Escherichia coli CFT073
aaauaaaggguaau

SEQ ID NO: 647022 - RNA, 18 nt, Escherichia coli CFT073
aaauaaaggguaauauau

SEQ ID NO: 647023 - RNA, 17 nt, Escherichia coli CFT073
ggccuucuucuuucaga

SEQ ID NO: 647024 - RNA, 13 nt, Escherichia coli CFT073
ggcgaagugcaga

SEQ ID NO: 647025 - RNA, 16 nt, Escherichia coli CFT073
ggcgaagagagcgcca

SEQ ID NO: 647026 - RNA, 12 nt, Escherichia coli CFT073
ggccugaaagcu

SEQ ID NO: 647027 - RNA, 13 nt, Escherichia coli CFT073
ggccugaacaagc

SEQ ID NO: 647028 - RNA, 16 nt, Escherichia coli CFT073
ggccucuccucgcgag

SEQ ID NO: 647029 - RNA, 16 nt, Escherichia coli CFT073
ggccucgcagcggcag

SEQ ID NO: 647030 - RNA, 17 nt, Escherichia coli CFT073
ggccuacgggacuguuc

SEQ ID NO: 647031 - RNA, 18 nt, Escherichia coli CFT073
ggccuacauauucauccc

SEQ ID NO: 647032 - RNA, 18 nt, Escherichia coli CFT073
ggccucaugugaugguaa

SEQ ID NO: 647033 - RNA, 22 nt, Escherichia coli CFT073
ggccucacuuugauuuauaguc

SEQ ID NO: 647034 - RNA, 22 nt, Escherichia coli CFT073
ggccguuuucguuacuccgcca

SEQ ID NO: 647035 - RNA, 22 nt, Escherichia coli CFT073
ggccuaaacgcuccaugcugcg

SEQ ID NO: 647036 - RNA, 21 nt, Escherichia coli CFT073
aaaguuuuuauauuuuuugcu

SEQ ID NO: 647037 - RNA, 21 nt, Escherichia coli CFT073
aaauaaaaaaacgccagaauc

SEQ ID NO: 647038 - RNA, 22 nt, Escherichia coli CFT073
ggccgguaacgcuuucucacca

SEQ ID NO: 647039 - RNA, 16 nt, Escherichia coli CFT073
ggccguacagcccagg

SEQ ID NO: 647040 - RNA, 21 nt, Escherichia coli CFT073
aaaguuuauuacucagcgcaa

SEQ ID NO: 647041 - RNA, 12 nt, Escherichia coli CFT073
aaaguuucaaag

SEQ ID NO: 647042 - RNA, 12 nt, Escherichia coli CFT073
aaaguuuaacua

SEQ ID NO: 647043 - RNA, 17 nt, Escherichia coli CFT073
ggccgcucugaaagcgg

SEQ ID NO: 647044 - RNA, 20 nt, Escherichia coli CFT073
ggccgcucugaaagcggccu

SEQ ID NO: 647045 - RNA, 21 nt, Escherichia coli CFT073
ggccgcucugaaagcggccuu

SEQ ID NO: 647046 - RNA, 21 nt, Escherichia coli CFT073
aaaguugaagccgaacagucg

SEQ ID NO: 647047 - RNA, 22 nt, Escherichia coli CFT073
aaaguugccagauaaauauuau

SEQ ID NO: 647048 - RNA, 19 nt, Escherichia coli CFT073
ggccgcgccgacugcgcca

SEQ ID NO: 647049 - RNA, 14 nt, Escherichia coli CFT073
ggccgcgcaggugg

SEQ ID NO: 647050 - RNA, 15 nt, Escherichia coli CFT073
ggccgcuguuuuuca

SEQ ID NO: 647051 - RNA, 20 nt, Escherichia coli CFT073
ggccgcuuucagagcggccu

SEQ ID NO: 647052 - RNA, 21 nt, Escherichia coli CFT073
ggccgcuuucagagcggccuu

SEQ ID NO: 647053 - RNA, 21 nt, Escherichia coli CFT073
ggccgcaggcuguuaccccug

SEQ ID NO: 647054 - RNA, 16 nt, Escherichia coli CFT073
ggccgcaugugccccc

SEQ ID NO: 647055 - RNA, 12 nt, Escherichia coli CFT073
ggccgccagcac

SEQ ID NO: 647056 - RNA, 16 nt, Escherichia coli CFT073
aaagugauuuacuuuc

SEQ ID NO: 647057 - RNA, 19 nt, Escherichia coli CFT073
aaagugccggauguucgca

SEQ ID NO: 647058 - RNA, 23 nt, Escherichia coli CFT073
aaagugcgccgaggaaacauuug

SEQ ID NO: 647059 - RNA, 18 nt, Escherichia coli CFT073
ggccgcaaaccagcgcau

SEQ ID NO: 647060 - RNA, 12 nt, Escherichia coli CFT073
ggccgcagagau

SEQ ID NO: 647061 - RNA, 19 nt, Escherichia coli CFT073
aaaguguaaaaaaucccag

SEQ ID NO: 647062 - RNA, 20 nt, Escherichia coli CFT073
aaaguggcggggaucacucc

SEQ ID NO: 647063 - RNA, 18 nt, Escherichia coli CFT073
ggccaaauaccggcgucc

SEQ ID NO: 647064 - RNA, 17 nt, Escherichia coli CFT073
ggccaacauccaucagc

SEQ ID NO: 647065 - RNA, 15 nt, Escherichia coli CFT073
ggcauguuaugaaua

SEQ ID NO: 647066 - RNA, 21 nt, Escherichia coli CFT073
ggcauuuuuuauggagaaaac

SEQ ID NO: 647067 - RNA, 22 nt, Escherichia coli CFT073
ggccaaaaccacagugacccgc

SEQ ID NO: 647068 - RNA, 19 nt, Escherichia coli CFT073
ggcaugagggugacaucaa

SEQ ID NO: 647069 - RNA, 17 nt, Escherichia coli CFT073
ggcauggggucaggugg

SEQ ID NO: 647070 - RNA, 22 nt, Escherichia coli CFT073
ggcauggggucaggugggacca

SEQ ID NO: 647071 - RNA, 16 nt, Escherichia coli CFT073
ggccaauuuggcugcc

SEQ ID NO: 647072 - RNA, 16 nt, Escherichia coli CFT073
ggcaguguucuggcuu

SEQ ID NO: 647073 - RNA, 17 nt, Escherichia coli CFT073
ggcagcgggauuuccgg

SEQ ID NO: 647074 - RNA, 14 nt, Escherichia coli CFT073
ggcagcgugccagg

SEQ ID NO: 647075 - RNA, 12 nt, Escherichia coli CFT073
ggcaugaaagcg

SEQ ID NO: 647076 - RNA, 14 nt, Escherichia coli CFT073
ggcaucuucuucau

SEQ ID NO: 647077 - RNA, 18 nt, Escherichia coli CFT073
ggcaucuucuucuggcuc

SEQ ID NO: 647078 - RNA, 19 nt, Escherichia coli CFT073
ggcaugaacaaagcucacu

SEQ ID NO: 647079 - RNA, 21 nt, Escherichia coli CFT073
ggcaugaacaaaucgcacguu

SEQ ID NO: 647080 - RNA, 15 nt, Escherichia coli CFT073
ggcaugaagaaagua

SEQ ID NO: 647081 - RNA, 20 nt, Escherichia coli CFT073
ggcaucgccagcgcggcggc

SEQ ID NO: 647082 - RNA, 19 nt, Escherichia coli CFT073
ggcauccugaucguccugc

SEQ ID NO: 647083 - RNA, 17 nt, Escherichia coli CFT073
ggcauaaaagggcagca

SEQ ID NO: 647084 - RNA, 21 nt, Escherichia coli CFT073
ggcauaaacaaagcgcacguu

SEQ ID NO: 647085 - RNA, 20 nt, Escherichia coli CFT073
ggcauaaacaagugcacuuu

SEQ ID NO: 647086 - RNA, 18 nt, Escherichia coli CFT073
ggcauaaacgccuuaucc

SEQ ID NO: 647087 - RNA, 16 nt, Escherichia coli CFT073
ggcauaagccgucccu

SEQ ID NO: 647088 - RNA, 19 nt, Escherichia coli CFT073
ggcauacaacgccaugaag

SEQ ID NO: 647089 - RNA, 20 nt, Escherichia coli CFT073
ggcauacuccggcggcagca

SEQ ID NO: 647090 - RNA, 21 nt, Escherichia coli CFT073
ggcauagccaccuggcugcgu

SEQ ID NO: 647091 - RNA, 17 nt, Escherichia coli CFT073
ggccagccagaagaaaa

SEQ ID NO: 647092 - RNA, 11 nt, Escherichia coli CFT073
ggccagcagcu

SEQ ID NO: 647093 - RNA, 13 nt, Escherichia coli CFT073
ggccacggcgacc

SEQ ID NO: 647094 - RNA, 15 nt, Escherichia coli CFT073
ggccagugccagugc

SEQ ID NO: 647095 - RNA, 18 nt, Escherichia coli CFT073
ggccagucauuuucuuca

SEQ ID NO: 647096 - RNA, 23 nt, Escherichia coli CFT073
ggccagucgcaaaucagcggcag

SEQ ID NO: 647097 - RNA, 14 nt, Escherichia coli CFT073
ggccaucagcagcg

SEQ ID NO: 647098 - RNA, 16 nt, Escherichia coli CFT073
ggccaguuccacuucu

SEQ ID NO: 647099 - RNA, 18 nt, Escherichia coli CFT073
ggccagguuuucuuucac

SEQ ID NO: 647100 - RNA, 20 nt, Escherichia coli CFT073
ggccaguauuugucugccac

SEQ ID NO: 647101 - RNA, 23 nt, Escherichia coli CFT073
ggccaguccccucgccccuccgg

SEQ ID NO: 647102 - RNA, 17 nt, Escherichia coli CFT073
ggccagguuuucuuuca

SEQ ID NO: 647103 - RNA, 12 nt, Escherichia coli CFT073
ggccaucggcag

SEQ ID NO: 647104 - RNA, 12 nt, Escherichia coli CFT073
ggccaucgccac

SEQ ID NO: 647105 - RNA, 18 nt, Escherichia coli CFT073
ggccaggcagaacgcuuu

SEQ ID NO: 647106 - RNA, 12 nt, Escherichia coli CFT073
ggcagcagacca

SEQ ID NO: 647107 - RNA, 22 nt, Escherichia coli CFT073
ggcagcagcacccgcggcugca

SEQ ID NO: 647108 - RNA, 16 nt, Escherichia coli CFT073
ggcacucaaucgccaa

SEQ ID NO: 647109 - RNA, 17 nt, Escherichia coli CFT073
ggcacuagucccuccgc

SEQ ID NO: 647110 - RNA, 17 nt, Escherichia coli CFT073
ggcacguugcugcggcg

SEQ ID NO: 647111 - RNA, 20 nt, Escherichia coli CFT073
ggcacuggguucaucuucca

SEQ ID NO: 647112 - RNA, 16 nt, Escherichia coli CFT073
ggcacugguacucaac

SEQ ID NO: 647113 - RNA, 22 nt, Escherichia coli CFT073
ggcacuguagaccaguccggcu

SEQ ID NO: 647114 - RNA, 14 nt, Escherichia coli CFT073
ggcacugcgaccag

SEQ ID NO: 647115 - RNA, 21 nt, Escherichia coli CFT073
ggcacugcgaccagugaaaau

SEQ ID NO: 647116 - RNA, 17 nt, Escherichia coli CFT073
ggcacucuuuuaauaua

SEQ ID NO: 647117 - RNA, 18 nt, Escherichia coli CFT073
ggcacucuccggcagacc

SEQ ID NO: 647118 - RNA, 13 nt, Escherichia coli CFT073
ggcacucgcugac

SEQ ID NO: 647119 - RNA, 17 nt, Escherichia coli CFT073
ggcacucgcugaccggu

SEQ ID NO: 647120 - RNA, 20 nt, Escherichia coli CFT073
ggcagcaaucacugccagaa

SEQ ID NO: 647121 - RNA, 16 nt, Escherichia coli CFT073
ggcagcaaucacugcc

SEQ ID NO: 647122 - RNA, 14 nt, Escherichia coli CFT073
ggcagaaaauccag

SEQ ID NO: 647123 - RNA, 17 nt, Escherichia coli CFT073
ggcagaaacaaccucuu

SEQ ID NO: 647124 - RNA, 23 nt, Escherichia coli CFT073
ggcagcaaggcuauucagcaguu

SEQ ID NO: 647125 - RNA, 12 nt, Escherichia coli CFT073
ggcaccaguaaa

SEQ ID NO: 647126 - RNA, 18 nt, Escherichia coli CFT073
ggcaccaguaaaacgggc

SEQ ID NO: 647127 - RNA, 19 nt, Escherichia coli CFT073
ggcaccgauucccccggug

SEQ ID NO: 647128 - RNA, 20 nt, Escherichia coli CFT073
ggcaccgccaaagauaaaau

SEQ ID NO: 647129 - RNA, 19 nt, Escherichia coli CFT073
ggcacgaaagguuccaaua

SEQ ID NO: 647130 - RNA, 13 nt, Escherichia coli CFT073
ggcacgaccagga

SEQ ID NO: 647131 - RNA, 16 nt, Escherichia coli CFT073
ggcacgaccaggaacg

SEQ ID NO: 647132 - RNA, 13 nt, Escherichia coli CFT073
ggcacgcccgcgc

SEQ ID NO: 647133 - RNA, 21 nt, Escherichia coli CFT073
ggcacgccaauuacgccugcc

SEQ ID NO: 647134 - RNA, 17 nt, Escherichia coli CFT073
ggcacguaucaacauca

SEQ ID NO: 647135 - RNA, 16 nt, Escherichia coli CFT073
ggcacguacaugcagg

SEQ ID NO: 647136 - RNA, 15 nt, Escherichia coli CFT073
ggcaaugcugucggu

SEQ ID NO: 647137 - RNA, 13 nt, Escherichia coli CFT073
ggcaauccugcuu

SEQ ID NO: 647138 - RNA, 16 nt, Escherichia coli CFT073
ggcaaugauauuaaug

SEQ ID NO: 647139 - RNA, 22 nt, Escherichia coli CFT073
ggcaaugauauuaauguuuuca

SEQ ID NO: 647140 - RNA, 17 nt, Escherichia coli CFT073
ggcaaucuuuaccgguc

SEQ ID NO: 647141 - RNA, 22 nt, Escherichia coli CFT073
ggcaaucucguggucaauauca

SEQ ID NO: 647142 - RNA, 14 nt, Escherichia coli CFT073
ggcaaucugcuggc

SEQ ID NO: 647143 - RNA, 22 nt, Escherichia coli CFT073
ggcaaucugcuggcaaacguca

SEQ ID NO: 647144 - RNA, 18 nt, Escherichia coli CFT073
ggcaauagagacaaagua

SEQ ID NO: 647145 - RNA, 11 nt, Escherichia coli CFT073
ggcaaucaaca

SEQ ID NO: 647146 - RNA, 23 nt, Escherichia coli CFT073
ggcaaucacauccaccagcgccu

SEQ ID NO: 647147 - RNA, 23 nt, Escherichia coli CFT073
ggcaaucaucaccggucgaccuu

SEQ ID NO: 647148 - RNA, 20 nt, Escherichia coli CFT073
ggcacauccagauuuuucag

SEQ ID NO: 647149 - RNA, 19 nt, Escherichia coli CFT073
ggcacauaauugagcagca

SEQ ID NO: 647150 - RNA, 16 nt, Escherichia coli CFT073
ggcacauagacgguga

SEQ ID NO: 647151 - RNA, 22 nt, Escherichia coli CFT073
ggcacauagacggugacacuuu

SEQ ID NO: 647152 - RNA, 19 nt, Escherichia coli CFT073
ggcacagucgcgacgcuga

SEQ ID NO: 647153 - RNA, 18 nt, Escherichia coli CFT073
ggcaccacauucugcauu

SEQ ID NO: 647154 - RNA, 21 nt, Escherichia coli CFT073
ggcaauugccgcacuuaaaau

SEQ ID NO: 647155 - RNA, 15 nt, Escherichia coli CFT073
ggcaauuccgucguu

SEQ ID NO: 647156 - RNA, 12 nt, Escherichia coli CFT073
ggcaauuucagu

SEQ ID NO: 647157 - RNA, 22 nt, Escherichia coli CFT073
ggcaauuuugcugugcuuuaca

SEQ ID NO: 647158 - RNA, 21 nt, Escherichia coli CFT073
ggcacacacuaccgccgagca

SEQ ID NO: 647159 - RNA, 15 nt, Escherichia coli CFT073
ggcacagccagcgca

SEQ ID NO: 647160 - RNA, 21 nt, Escherichia coli CFT073
ggcacaccagccaguagcacc

SEQ ID NO: 647161 - RNA, 19 nt, Escherichia coli CFT073
ggcaaauuggcguggcgga

SEQ ID NO: 647162 - RNA, 18 nt, Escherichia coli CFT073
ggcaacgaccgcgagcaa

SEQ ID NO: 647163 - RNA, 13 nt, Escherichia coli CFT073
ggcaacguuccag

SEQ ID NO: 647164 - RNA, 20 nt, Escherichia coli CFT073
ggcaaagcugucaccaauca

SEQ ID NO: 647165 - RNA, 20 nt, Escherichia coli CFT073
ggcaaaggucugauguugaa

SEQ ID NO: 647166 - RNA, 24 nt, Escherichia coli CFT073
ggcaaacgguucgcggugcucauc

SEQ ID NO: 647167 - RNA, 20 nt, Escherichia coli CFT073
ggcaaauuaagaagcggcua

SEQ ID NO: 647168 - RNA, 17 nt, Escherichia coli CFT073
ggaucgacucggugcgc

SEQ ID NO: 647169 - RNA, 17 nt, Escherichia coli CFT073
ggauuuaccuugcucau

SEQ ID NO: 647170 - RNA, 16 nt, Escherichia coli CFT073
ggauuuacuaaaacuu

SEQ ID NO: 647171 - RNA, 13 nt, Escherichia coli CFT073
ggcaaaauccuuc

SEQ ID NO: 647172 - RNA, 13 nt, Escherichia coli CFT073
ggcaaacgcccuu

SEQ ID NO: 647173 - RNA, 14 nt, Escherichia coli CFT073
ggagucagggagaa

SEQ ID NO: 647174 - RNA, 11 nt, Escherichia coli CFT073
ggagguggcag

SEQ ID NO: 647175 - RNA, 20 nt, Escherichia coli CFT073
ggaguaaacuuucccugagg

SEQ ID NO: 647176 - RNA, 16 nt, Escherichia coli CFT073
ggaguaagaauaaaac

SEQ ID NO: 647177 - RNA, 21 nt, Escherichia coli CFT073
ggauaucuucaaucagaugug

SEQ ID NO: 647178 - RNA, 21 nt, Escherichia coli CFT073
ggauauaaacucgccaaacca

SEQ ID NO: 647179 - RNA, 20 nt, Escherichia coli CFT073
ggauauaugucaccagcauu

SEQ ID NO: 647180 - RNA, 21 nt, Escherichia coli CFT073
ggauaucaacguuauucgcuu

SEQ ID NO: 647181 - RNA, 20 nt, Escherichia coli CFT073
ggaucaccaauaccagcauc

SEQ ID NO: 647182 - RNA, 21 nt, Escherichia coli CFT073
ggaucaccaauaccagcauca

SEQ ID NO: 647183 - RNA, 17 nt, Escherichia coli CFT073
ggaucacuccccgccgu

SEQ ID NO: 647184 - RNA, 22 nt, Escherichia coli CFT073
ggaucagaaugcgcucuuccgg

SEQ ID NO: 647185 - RNA, 17 nt, Escherichia coli CFT073
ggauccugagcaaacag

SEQ ID NO: 647186 - RNA, 15 nt, Escherichia coli CFT073
ggauccccagccgcc

SEQ ID NO: 647187 - RNA, 17 nt, Escherichia coli CFT073
ggaggcauugaacaucg

SEQ ID NO: 647188 - RNA, 19 nt, Escherichia coli CFT073
ggagggguuuuugccagca

SEQ ID NO: 647189 - RNA, 19 nt, Escherichia coli CFT073
ggagcuuacauaaguaagu

SEQ ID NO: 647190 - RNA, 17 nt, Escherichia coli CFT073
ggaggaaaguccgggcu

SEQ ID NO: 647191 - RNA, 15 nt, Escherichia coli CFT073
ggagcuaaacagagc

SEQ ID NO: 647192 - RNA, 19 nt, Escherichia coli CFT073
ggagcgcuuuuuccugccg

SEQ ID NO: 647193 - RNA, 17 nt, Escherichia coli CFT073
ggagcgauuaugaaaca

SEQ ID NO: 647194 - RNA, 21 nt, Escherichia coli CFT073
ggagcgauuaugaaacaagaa

SEQ ID NO: 647195 - RNA, 15 nt, Escherichia coli CFT073
ggagaucccgugacg

SEQ ID NO: 647196 - RNA, 14 nt, Escherichia coli CFT073
ggagauccagcauu

SEQ ID NO: 647197 - RNA, 20 nt, Escherichia coli CFT073
ggagaguaugcgcgucagag

SEQ ID NO: 647198 - RNA, 14 nt, Escherichia coli CFT073
ggagacagcuuaga

SEQ ID NO: 647199 - RNA, 19 nt, Escherichia coli CFT073
ggagaguugcaccagcaau

SEQ ID NO: 647200 - RNA, 21 nt, Escherichia coli CFT073
ggagaguugcaccagcaauaa

SEQ ID NO: 647201 - RNA, 22 nt, Escherichia coli CFT073
ggacgucgauaaacaucgccau

SEQ ID NO: 647202 - RNA, 22 nt, Escherichia coli CFT073
aaagguuuguaacucaggaacu

SEQ ID NO: 647203 - RNA, 21 nt, Escherichia coli CFT073
ggagaaauauaaagaaugaaa

SEQ ID NO: 647204 - RNA, 20 nt, Escherichia coli CFT073
aaagggcuaacgugcagguu

SEQ ID NO: 647205 - RNA, 13 nt, Escherichia coli CFT073
ggaccaacgcguu

SEQ ID NO: 647206 - RNA, 18 nt, Escherichia coli CFT073
ggaccaaagaaugacacu

SEQ ID NO: 647207 - RNA, 18 nt, Escherichia coli CFT073
ggacauaguacuggaaga

SEQ ID NO: 647208 - RNA, 22 nt, Escherichia coli CFT073
ggacauaaagcccgcuucaaac

SEQ ID NO: 647209 - RNA, 14 nt, Escherichia coli CFT073
ggacauagcucugc

SEQ ID NO: 647210 - RNA, 13 nt, Escherichia coli CFT073
ggaaucacucauc

SEQ ID NO: 647211 - RNA, 18 nt, Escherichia coli CFT073
ggaauccgggucuguaaa

SEQ ID NO: 647212 - RNA, 19 nt, Escherichia coli CFT073
ggaaggguguucauccugg

SEQ ID NO: 647213 - RNA, 22 nt, Escherichia coli CFT073
ggaauaucgcuggccuccagca

SEQ ID NO: 647214 - RNA, 18 nt, Escherichia coli CFT073
ggaauaucuucccgccgc

SEQ ID NO: 647215 - RNA, 21 nt, Escherichia coli CFT073
ggaauaucuucccgccgcuga

SEQ ID NO: 647216 - RNA, 21 nt, Escherichia coli CFT073
ggaauaugcgccacuccacug

SEQ ID NO: 647217 - RNA, 17 nt, Escherichia coli CFT073
ggaauagcuuuacccag

SEQ ID NO: 647218 - RNA, 18 nt, Escherichia coli CFT073
ggaaucaaugugcuuuca

SEQ ID NO: 647219 - RNA, 15 nt, Escherichia coli CFT073
ggaagcuuauuuaua

SEQ ID NO: 647220 - RNA, 18 nt, Escherichia coli CFT073
ggaagcuuucgcaguaga

SEQ ID NO: 647221 - RNA, 20 nt, Escherichia coli CFT073
ggaagauuauuucgcugcgg

SEQ ID NO: 647222 - RNA, 17 nt, Escherichia coli CFT073
ggaagcaggucaccaga

SEQ ID NO: 647223 - RNA, 14 nt, Escherichia coli CFT073
ggaagccagacaaa

SEQ ID NO: 647224 - RNA, 18 nt, Escherichia coli CFT073
ggaacgccgcugguggcg

SEQ ID NO: 647225 - RNA, 18 nt, Escherichia coli CFT073
ggaacggauagagcgcug

SEQ ID NO: 647226 - RNA, 15 nt, Escherichia coli CFT073
ggaaccgaucagauu

SEQ ID NO: 647227 - RNA, 14 nt, Escherichia coli CFT073
ggaacuuaaccugc

SEQ ID NO: 647228 - RNA, 18 nt, Escherichia coli CFT073
ggaagaaacgcuuaaagc

SEQ ID NO: 647229 - RNA, 21 nt, Escherichia coli CFT073
ggaagagcgacaaucccugca

SEQ ID NO: 647230 - RNA, 18 nt, Escherichia coli CFT073
ggaagaauagucaucacu

SEQ ID NO: 647231 - RNA, 16 nt, Escherichia coli CFT073
ggaaaauaucaccaau

SEQ ID NO: 647232 - RNA, 13 nt, Escherichia coli CFT073
ggaaaagcaacaa

SEQ ID NO: 647233 - RNA, 18 nt, Escherichia coli CFT073
ggaaaaugaucaauaauu

SEQ ID NO: 647234 - RNA, 20 nt, Escherichia coli CFT073
ggaaaauuuuuucagauaaa

SEQ ID NO: 647235 - RNA, 16 nt, Escherichia coli CFT073
ggaaaccggcaucccg

SEQ ID NO: 647236 - RNA, 17 nt, Escherichia coli CFT073
ggaaaccaacuccagug

SEQ ID NO: 647237 - RNA, 14 nt, Escherichia coli CFT073
ggaaacccaacgca

SEQ ID NO: 647238 - RNA, 18 nt, Escherichia coli CFT073
ggaaacauucaauaagcu

SEQ ID NO: 647239 - RNA, 22 nt, Escherichia coli CFT073
ggaaauaaucgggaauacagaa

SEQ ID NO: 647240 - RNA, 17 nt, Escherichia coli CFT073
ggaaauagauuuucaga

SEQ ID NO: 647241 - RNA, 18 nt, Escherichia coli CFT073
ggaaauagcggguuuguu

SEQ ID NO: 647242 - RNA, 18 nt, Escherichia coli CFT073
ggaaagcagauaacccag

SEQ ID NO: 647243 - RNA, 19 nt, Escherichia coli CFT073
ggaaagcagauaacccagc

SEQ ID NO: 647244 - RNA, 12 nt, Escherichia coli CFT073
ggaaagcaacaa

SEQ ID NO: 647245 - RNA, 15 nt, Escherichia coli CFT073
ggaaaucgauaaaag

SEQ ID NO: 647246 - RNA, 17 nt, Escherichia coli CFT073
ggaaaucaccaccagca

SEQ ID NO: 647247 - RNA, 12 nt, Escherichia coli CFT073
ggaaaucaaaua

SEQ ID NO: 647248 - RNA, 13 nt, Escherichia coli CFT073
ggaaauccgggcu

SEQ ID NO: 647249 - RNA, 15 nt, Escherichia coli CFT073
ggaaaucauccagca

SEQ ID NO: 647250 - RNA, 17 nt, Escherichia coli CFT073
ggaaaucauccagcacg

SEQ ID NO: 647251 - RNA, 20 nt, Escherichia coli CFT073
ggaaaucaugcuccgcacgc

SEQ ID NO: 647252 - RNA, 16 nt, Escherichia coli CFT073
ggaaauccaggucaga

SEQ ID NO: 647253 - RNA, 20 nt, Escherichia coli CFT073
gcuuuguccagugcaacuuu

SEQ ID NO: 647254 - RNA, 18 nt, Escherichia coli CFT073
gcuuuguuuaugccagau

SEQ ID NO: 647255 - RNA, 18 nt, Escherichia coli CFT073
gcuuuggugccagauuua

SEQ ID NO: 647256 - RNA, 17 nt, Escherichia coli CFT073
gcuuugcugccuuccuc

SEQ ID NO: 647257 - RNA, 19 nt, Escherichia coli CFT073
gcuuugcugugaagcaccu

SEQ ID NO: 647258 - RNA, 17 nt, Escherichia coli CFT073
gcuuugcuguuuccagu

SEQ ID NO: 647259 - RNA, 17 nt, Escherichia coli CFT073
gcugugcgacuucauuc

SEQ ID NO: 647260 - RNA, 15 nt, Escherichia coli CFT073
gcugugauuaagcag

SEQ ID NO: 647261 - RNA, 21 nt, Escherichia coli CFT073
gcugugcuccuucucugagcu

SEQ ID NO: 647262 - RNA, 22 nt, Escherichia coli CFT073
gcugugcuccuucucugagcug

SEQ ID NO: 647263 - RNA, 23 nt, Escherichia coli CFT073
gcugugcuccuucucugagcugg

SEQ ID NO: 647264 - RNA, 23 nt, Escherichia coli CFT073
gcuuucuucucagauauaaacgg

SEQ ID NO: 647265 - RNA, 20 nt, Escherichia coli CFT073
gcuuucuuugcuuuguaaag

SEQ ID NO: 647266 - RNA, 23 nt, Escherichia coli CFT073
gcuuucuucgcagcaaaucucac

SEQ ID NO: 647267 - RNA, 17 nt, Escherichia coli CFT073
gcuuucgucgagaaugu

SEQ ID NO: 647268 - RNA, 18 nt, Escherichia coli CFT073
gcuuucuccagcuuuucg

SEQ ID NO: 647269 - RNA, 14 nt, Escherichia coli CFT073
gcuuucucuuccag

SEQ ID NO: 647270 - RNA, 18 nt, Escherichia coli CFT073
gcuuucugcaaccagaaa

SEQ ID NO: 647271 - RNA, 20 nt, Escherichia coli CFT073
gcuuucugcaaccagaaagu

SEQ ID NO: 647272 - RNA, 13 nt, Escherichia coli CFT073
ggaaaacaaccgc

SEQ ID NO: 647273 - RNA, 12 nt, Escherichia coli CFT073
ggaaaacgugcc

SEQ ID NO: 647274 - RNA, 15 nt, Escherichia coli CFT073
ggaaaacgugccacu

SEQ ID NO: 647275 - RNA, 20 nt, Escherichia coli CFT073
gcuuuuuuaugcaccuuuac

SEQ ID NO: 647276 - RNA, 15 nt, Escherichia coli CFT073
gcuuuuuucaucucu

SEQ ID NO: 647277 - RNA, 14 nt, Escherichia coli CFT073
gcuuuuuuguuugu

SEQ ID NO: 647278 - RNA, 22 nt, Escherichia coli CFT073
gcuuuuugugggccugauaaga

SEQ ID NO: 647279 - RNA, 16 nt, Escherichia coli CFT073
gcuuuuucugcacaca

SEQ ID NO: 647280 - RNA, 17 nt, Escherichia coli CFT073
gcuuuuucugcuucugc

SEQ ID NO: 647281 - RNA, 21 nt, Escherichia coli CFT073
gcuuuuucagcguuuucuuca

SEQ ID NO: 647282 - RNA, 16 nt, Escherichia coli CFT073
gcuuuuggaaaucacg

SEQ ID NO: 647283 - RNA, 22 nt, Escherichia coli CFT073
gcuuuugcgccaucgacauggc

SEQ ID NO: 647284 - RNA, 19 nt, Escherichia coli CFT073
gcuuuuggugcccagggua

SEQ ID NO: 647285 - RNA, 18 nt, Escherichia coli CFT073
gcuuuuaauucacuucug

SEQ ID NO: 647286 - RNA, 23 nt, Escherichia coli CFT073
gcuuuuagcgacaaaucuuucac

SEQ ID NO: 647287 - RNA, 19 nt, Escherichia coli CFT073
gcuuuuauucauguugauu

SEQ ID NO: 647288 - RNA, 21 nt, Escherichia coli CFT073
gcuuuucgcccaggucuccca

SEQ ID NO: 647289 - RNA, 16 nt, Escherichia coli CFT073
gcuuuuccccaucgga

SEQ ID NO: 647290 - RNA, 16 nt, Escherichia coli CFT073
gcugcugaagcaacag

SEQ ID NO: 647291 - RNA, 21 nt, Escherichia coli CFT073
gcugcucuucacgcccgcccc

SEQ ID NO: 647292 - RNA, 15 nt, Escherichia coli CFT073
gcugcuucaguaaua

SEQ ID NO: 647293 - RNA, 17 nt, Escherichia coli CFT073
gcugcuucggucagcac

SEQ ID NO: 647294 - RNA, 18 nt, Escherichia coli CFT073
gcugcuguagcaguucca

SEQ ID NO: 647295 - RNA, 21 nt, Escherichia coli CFT073
gcugcguaauucgccaccggc

SEQ ID NO: 647296 - RNA, 14 nt, Escherichia coli CFT073
gcugcgggcggcuc

SEQ ID NO: 647297 - RNA, 20 nt, Escherichia coli CFT073
gcugcguaguuuguccugca

SEQ ID NO: 647298 - RNA, 16 nt, Escherichia coli CFT073
gcugcggccugcugca

SEQ ID NO: 647299 - RNA, 19 nt, Escherichia coli CFT073
gcugcggcguuccccaguu

SEQ ID NO: 647300 - RNA, 14 nt, Escherichia coli CFT073
gcuggccaucaccu

SEQ ID NO: 647301 - RNA, 20 nt, Escherichia coli CFT073
gcuggcauuacaagaaucau

SEQ ID NO: 647302 - RNA, 13 nt, Escherichia coli CFT073
gcuggcauuccgu

SEQ ID NO: 647303 - RNA, 14 nt, Escherichia coli CFT073
gcuggcaggccgcg

SEQ ID NO: 647304 - RNA, 14 nt, Escherichia coli CFT073
gcuggcaggccugc

SEQ ID NO: 647305 - RNA, 20 nt, Escherichia coli CFT073
gcuggcagcagaaccaggga

SEQ ID NO: 647306 - RNA, 21 nt, Escherichia coli CFT073
gcuggcagccagggcaccagu

SEQ ID NO: 647307 - RNA, 17 nt, Escherichia coli CFT073
gcuggcagccccguucg

SEQ ID NO: 647308 - RNA, 20 nt, Escherichia coli CFT073
gcuggcagaugcgucuucug

SEQ ID NO: 647309 - RNA, 18 nt, Escherichia coli CFT073
gcuggcgcauuaacucac

SEQ ID NO: 647310 - RNA, 15 nt, Escherichia coli CFT073
gcuggcgcagcaucu

SEQ ID NO: 647311 - RNA, 21 nt, Escherichia coli CFT073
gcuggcgcgucuuaucaggcc

SEQ ID NO: 647312 - RNA, 17 nt, Escherichia coli CFT073
gcuggcgcgucuuaucc

SEQ ID NO: 647313 - RNA, 15 nt, Escherichia coli CFT073
gcuggcgauuccacu

SEQ ID NO: 647314 - RNA, 15 nt, Escherichia coli CFT073
gcuggccuacaauuc

SEQ ID NO: 647315 - RNA, 24 nt, Escherichia coli CFT073
gcuguaccacgguucgcuggcaag

SEQ ID NO: 647316 - RNA, 20 nt, Escherichia coli CFT073
gcuguaauuucacaccauca

SEQ ID NO: 647317 - RNA, 15 nt, Escherichia coli CFT073
gcuguacacuuccca

SEQ ID NO: 647318 - RNA, 22 nt, Escherichia coli CFT073
gcuguacacuucccagccccgc

SEQ ID NO: 647319 - RNA, 18 nt, Escherichia coli CFT073
gcuguaccuggccccugg

SEQ ID NO: 647320 - RNA, 14 nt, Escherichia coli CFT073
gcuguacagcagua

SEQ ID NO: 647321 - RNA, 19 nt, Escherichia coli CFT073
gcuguacucaccaacgcag

SEQ ID NO: 647322 - RNA, 16 nt, Escherichia coli CFT073
gcuguccggcaccauu

SEQ ID NO: 647323 - RNA, 17 nt, Escherichia coli CFT073
gcugugaaacaccugca

SEQ ID NO: 647324 - RNA, 15 nt, Escherichia coli CFT073
gcugugacauccaga

SEQ ID NO: 647325 - RNA, 16 nt, Escherichia coli CFT073
gcugucuaccagcacc

SEQ ID NO: 647326 - RNA, 14 nt, Escherichia coli CFT073
gcugucggcacuga

SEQ ID NO: 647327 - RNA, 21 nt, Escherichia coli CFT073
gcugucggcacugaccaccac

SEQ ID NO: 647328 - RNA, 19 nt, Escherichia coli CFT073
aaagcuuuccggaaaaauc

SEQ ID NO: 647329 - RNA, 22 nt, Escherichia coli CFT073
gcugguggaacagcugcaacag

SEQ ID NO: 647330 - RNA, 18 nt, Escherichia coli CFT073
gcugguggcaggcaaaaa

SEQ ID NO: 647331 - RNA, 23 nt, Escherichia coli CFT073
gcugguuuucagcgaaacagcug

SEQ ID NO: 647332 - RNA, 15 nt, Escherichia coli CFT073
gcuguaauagacugc

SEQ ID NO: 647333 - RNA, 20 nt, Escherichia coli CFT073
gcuguaauagacugcacuga

SEQ ID NO: 647334 - RNA, 15 nt, Escherichia coli CFT073
aaagcuguaagguga

SEQ ID NO: 647335 - RNA, 15 nt, Escherichia coli CFT073
gcugguaaucaccac

SEQ ID NO: 647336 - RNA, 20 nt, Escherichia coli CFT073
gcugguaacaucaauaacaa

SEQ ID NO: 647337 - RNA, 19 nt, Escherichia coli CFT073
gcugguaaucaccacccac

SEQ ID NO: 647338 - RNA, 19 nt, Escherichia coli CFT073
gcuggguaaagacaucgcc

SEQ ID NO: 647339 - RNA, 19 nt, Escherichia coli CFT073
gcugggcgguaauguuuug

SEQ ID NO: 647340 - RNA, 22 nt, Escherichia coli CFT073
gcugggcgcguucggcggaugc

SEQ ID NO: 647341 - RNA, 20 nt, Escherichia coli CFT073
gcugggaucugauuuucuuc

SEQ ID NO: 647342 - RNA, 22 nt, Escherichia coli CFT073
gcuggcugcgcuugcggccagc

SEQ ID NO: 647343 - RNA, 11 nt, Escherichia coli CFT073
gcuggcugacc

SEQ ID NO: 647344 - RNA, 13 nt, Escherichia coli CFT073
gcuggcggcuggc

SEQ ID NO: 647345 - RNA, 14 nt, Escherichia coli CFT073
gcuggcgggcuggu

SEQ ID NO: 647346 - RNA, 16 nt, Escherichia coli CFT073
gcuggcgggcuggugu

SEQ ID NO: 647347 - RNA, 16 nt, Escherichia coli CFT073
gcuggcggggccgcgu

SEQ ID NO: 647348 - RNA, 18 nt, Escherichia coli CFT073
gcuggcggguaauguucg

SEQ ID NO: 647349 - RNA, 23 nt, Escherichia coli CFT073
gcugauggcgccaguuauucauu

SEQ ID NO: 647350 - RNA, 14 nt, Escherichia coli CFT073
gcugaugcuaccca

SEQ ID NO: 647351 - RNA, 16 nt, Escherichia coli CFT073
gcugauacuauucauu

SEQ ID NO: 647352 - RNA, 19 nt, Escherichia coli CFT073
gcugauacuccaugaguaa

SEQ ID NO: 647353 - RNA, 22 nt, Escherichia coli CFT073
gcugauacccggcacacaaaua

SEQ ID NO: 647354 - RNA, 22 nt, Escherichia coli CFT073
gcugaugaaguugaaaucaccg

SEQ ID NO: 647355 - RNA, 16 nt, Escherichia coli CFT073
gcugaugcagcgauga

SEQ ID NO: 647356 - RNA, 19 nt, Escherichia coli CFT073
gcugaugcagcgucaguga

SEQ ID NO: 647357 - RNA, 11 nt, Escherichia coli CFT073
gcugcaccagc

SEQ ID NO: 647358 - RNA, 14 nt, Escherichia coli CFT073
gcugcacagagcua

SEQ ID NO: 647359 - RNA, 23 nt, Escherichia coli CFT073
gcugcaucucuuugcuguugauu

SEQ ID NO: 647360 - RNA, 15 nt, Escherichia coli CFT073
gcugcaguuguuccu

SEQ ID NO: 647361 - RNA, 12 nt, Escherichia coli CFT073
gcugcauccaga

SEQ ID NO: 647362 - RNA, 21 nt, Escherichia coli CFT073
gcugcauguuuuuuaaguuca

SEQ ID NO: 647363 - RNA, 13 nt, Escherichia coli CFT073
gcugccaguaauu

SEQ ID NO: 647364 - RNA, 22 nt, Escherichia coli CFT073
gcugcccacgcgguauggucac

SEQ ID NO: 647365 - RNA, 22 nt, Escherichia coli CFT073
gcugacggugauaaucauccca

SEQ ID NO: 647366 - RNA, 21 nt, Escherichia coli CFT073
gcugacggugccagguaaaca

SEQ ID NO: 647367 - RNA, 23 nt, Escherichia coli CFT073
gcugagugcgaaaaucaauaaca

SEQ ID NO: 647368 - RNA, 19 nt, Escherichia coli CFT073
gcugaggcguaauauaaaa

SEQ ID NO: 647369 - RNA, 22 nt, Escherichia coli CFT073
gcugaggcguuucaacucccac

SEQ ID NO: 647370 - RNA, 15 nt, Escherichia coli CFT073
gcugagguauuucgu

SEQ ID NO: 647371 - RNA, 14 nt, Escherichia coli CFT073
gcugacaugugauu

SEQ ID NO: 647372 - RNA, 19 nt, Escherichia coli CFT073
gcugacaugugauuugaug

SEQ ID NO: 647373 - RNA, 18 nt, Escherichia coli CFT073
gcugaaaaggcuaaaauu

SEQ ID NO: 647374 - RNA, 15 nt, Escherichia coli CFT073
gcucuuuauccagca

SEQ ID NO: 647375 - RNA, 18 nt, Escherichia coli CFT073
gcucuuuauccagcagcc

SEQ ID NO: 647376 - RNA, 21 nt, Escherichia coli CFT073
gcucuuuauccagcagccaga

SEQ ID NO: 647377 - RNA, 15 nt, Escherichia coli CFT073
gcugacgccugccag

SEQ ID NO: 647378 - RNA, 17 nt, Escherichia coli CFT073
gcugacgcgucuuaucc

SEQ ID NO: 647379 - RNA, 22 nt, Escherichia coli CFT073
gcugaccagacuggagcacugc

SEQ ID NO: 647380 - RNA, 18 nt, Escherichia coli CFT073
gcugaccgauaaccugcc

SEQ ID NO: 647381 - RNA, 22 nt, Escherichia coli CFT073
gcucucccauuuuauccucuuc

SEQ ID NO: 647382 - RNA, 19 nt, Escherichia coli CFT073
gcucucccaaauaugaaau

SEQ ID NO: 647383 - RNA, 21 nt, Escherichia coli CFT073
gcucuaucuuauuuuccuggg

SEQ ID NO: 647384 - RNA, 20 nt, Escherichia coli CFT073
gcucuauugccguaaucgcc

SEQ ID NO: 647385 - RNA, 16 nt, Escherichia coli CFT073
gcucucaaauaucugc

SEQ ID NO: 647386 - RNA, 20 nt, Escherichia coli CFT073
gcucucacucuuucccuccu

SEQ ID NO: 647387 - RNA, 13 nt, Escherichia coli CFT073
gcucucuuccagu

SEQ ID NO: 647388 - RNA, 21 nt, Escherichia coli CFT073
gcucucuucguggcccgccag

SEQ ID NO: 647389 - RNA, 20 nt, Escherichia coli CFT073
gcucugcacuaacccucugu

SEQ ID NO: 647390 - RNA, 22 nt, Escherichia coli CFT073
gcucugacugaaccuucacgcu

SEQ ID NO: 647391 - RNA, 19 nt, Escherichia coli CFT073
gcucugcugucaccgaagc

SEQ ID NO: 647392 - RNA, 17 nt, Escherichia coli CFT073
gcucuucuggcaccagu

SEQ ID NO: 647393 - RNA, 19 nt, Escherichia coli CFT073
gcucuugcuuacgcagaca

SEQ ID NO: 647394 - RNA, 23 nt, Escherichia coli CFT073
gcucuuauacgugaaauccccug

SEQ ID NO: 647395 - RNA, 15 nt, Escherichia coli CFT073
gcucuucaucuucca

SEQ ID NO: 647396 - RNA, 14 nt, Escherichia coli CFT073
gcucuucaugcagc

SEQ ID NO: 647397 - RNA, 15 nt, Escherichia coli CFT073
gcucuguaacccugu

SEQ ID NO: 647398 - RNA, 16 nt, Escherichia coli CFT073
gcucuggcaggcgacu

SEQ ID NO: 647399 - RNA, 23 nt, Escherichia coli CFT073
gcucuggcggcgcgauauccagu

SEQ ID NO: 647400 - RNA, 19 nt, Escherichia coli CFT073
gcucugggaucgccggggc

SEQ ID NO: 647401 - RNA, 16 nt, Escherichia coli CFT073
gcucgucaaaaacaaa

SEQ ID NO: 647402 - RNA, 20 nt, Escherichia coli CFT073
gcucguaaagcaucagacug

SEQ ID NO: 647403 - RNA, 15 nt, Escherichia coli CFT073
gcucguucagcacuu

SEQ ID NO: 647404 - RNA, 19 nt, Escherichia coli CFT073
gcucgucacaucaccaaca

SEQ ID NO: 647405 - RNA, 15 nt, Escherichia coli CFT073
gcucgucauccgcua

SEQ ID NO: 647406 - RNA, 22 nt, Escherichia coli CFT073
gcucgcgccagguguuuaacca

SEQ ID NO: 647407 - RNA, 22 nt, Escherichia coli CFT073
gcucccggauaccccagcuggc

SEQ ID NO: 647408 - RNA, 20 nt, Escherichia coli CFT073
gcucacccaucgauacccag

SEQ ID NO: 647409 - RNA, 14 nt, Escherichia coli CFT073
gcucaauauauucu

SEQ ID NO: 647410 - RNA, 18 nt, Escherichia coli CFT073
gcucaaucgccucgccga

SEQ ID NO: 647411 - RNA, 17 nt, Escherichia coli CFT073
gcucacgcagcggcggc

SEQ ID NO: 647412 - RNA, 18 nt, Escherichia coli CFT073
gcucacgcagcggcggca

SEQ ID NO: 647413 - RNA, 21 nt, Escherichia coli CFT073
gcucacgucaccgcagcaucg

SEQ ID NO: 647414 - RNA, 20 nt, Escherichia coli CFT073
gcucacugcacgaugccuca

SEQ ID NO: 647415 - RNA, 17 nt, Escherichia coli CFT073
gcucacuucacgcugcc

SEQ ID NO: 647416 - RNA, 16 nt, Escherichia coli CFT073
gcucacucaucacucc

SEQ ID NO: 647417 - RNA, 19 nt, Escherichia coli CFT073
gcucacuuuguaggccuga

SEQ ID NO: 647418 - RNA, 11 nt, Escherichia coli CFT073
gcucaggcgag

SEQ ID NO: 647419 - RNA, 22 nt, Escherichia coli CFT073
gcucaggcgcacgccaacaaaa

SEQ ID NO: 647420 - RNA, 20 nt, Escherichia coli CFT073
gcuccagaguaacuucacca

SEQ ID NO: 647421 - RNA, 21 nt, Escherichia coli CFT073
gcuccagauaacaaucaucaa

SEQ ID NO: 647422 - RNA, 13 nt, Escherichia coli CFT073
gcucccagcgcau

SEQ ID NO: 647423 - RNA, 17 nt, Escherichia coli CFT073
gcucccauaaugcccca

SEQ ID NO: 647424 - RNA, 22 nt, Escherichia coli CFT073
gcucccauaaugccccagcgca

SEQ ID NO: 647425 - RNA, 24 nt, Escherichia coli CFT073
gcucccauaaugccccagcgcacu

SEQ ID NO: 647426 - RNA, 15 nt, Escherichia coli CFT073
gcuccagugccuggc

SEQ ID NO: 647427 - RNA, 13 nt, Escherichia coli CFT073
gcucccagcagug

SEQ ID NO: 647428 - RNA, 12 nt, Escherichia coli CFT073
gcucccagcccg

SEQ ID NO: 647429 - RNA, 18 nt, Escherichia coli CFT073
gcucauuauucaaucggg

SEQ ID NO: 647430 - RNA, 14 nt, Escherichia coli CFT073
gcucauuccgccgc

SEQ ID NO: 647431 - RNA, 17 nt, Escherichia coli CFT073
gcucauuccgccgccca

SEQ ID NO: 647432 - RNA, 22 nt, Escherichia coli CFT073
gcucauguagccgcuuuuucug

SEQ ID NO: 647433 - RNA, 15 nt, Escherichia coli CFT073
gcucaguugguuaga

SEQ ID NO: 647434 - RNA, 18 nt, Escherichia coli CFT073
gcucaugcaacacaagcc

SEQ ID NO: 647435 - RNA, 20 nt, Escherichia coli CFT073
gcucaugccguagaacagca

SEQ ID NO: 647436 - RNA, 13 nt, Escherichia coli CFT073
gcucaaccuucuu

SEQ ID NO: 647437 - RNA, 17 nt, Escherichia coli CFT073
gcucaagaaucucuucu

SEQ ID NO: 647438 - RNA, 13 nt, Escherichia coli CFT073
gcucaacaauaaa

SEQ ID NO: 647439 - RNA, 18 nt, Escherichia coli CFT073
gcucaacaucgcgcuggc

SEQ ID NO: 647440 - RNA, 23 nt, Escherichia coli CFT073
gcucaaccgccaguucccccugc

SEQ ID NO: 647441 - RNA, 10 nt, Escherichia coli CFT073
gcucaaaucc

SEQ ID NO: 647442 - RNA, 15 nt, Escherichia coli CFT073
gcucaaacuggcuga

SEQ ID NO: 647443 - RNA, 13 nt, Escherichia coli CFT073
gcuauguguaaga

SEQ ID NO: 647444 - RNA, 18 nt, Escherichia coli CFT073
gcuauuaacccgcaacag

SEQ ID NO: 647445 - RNA, 20 nt, Escherichia coli CFT073
gcuauugcuuuagacagcuu

SEQ ID NO: 647446 - RNA, 14 nt, Escherichia coli CFT073
gcuagauauauauu

SEQ ID NO: 647447 - RNA, 18 nt, Escherichia coli CFT073
gcuagcgucgcauccggc

SEQ ID NO: 647448 - RNA, 21 nt, Escherichia coli CFT073
gcuauagacaccuugcaacuc

SEQ ID NO: 647449 - RNA, 14 nt, Escherichia coli CFT073
gcuauaucgcugau

SEQ ID NO: 647450 - RNA, 14 nt, Escherichia coli CFT073
gcuauacagcagcc

SEQ ID NO: 647451 - RNA, 16 nt, Escherichia coli CFT073
gcuaucaguccauggc

SEQ ID NO: 647452 - RNA, 14 nt, Escherichia coli CFT073
gcuaucgaaaucaa

SEQ ID NO: 647453 - RNA, 21 nt, Escherichia coli CFT073
gcuaucgaaaucaaaguaccg

SEQ ID NO: 647454 - RNA, 22 nt, Escherichia coli CFT073
gcguucccuuguugugccagac

SEQ ID NO: 647455 - RNA, 11 nt, Escherichia coli CFT073
gcguuccccag

SEQ ID NO: 647456 - RNA, 20 nt, Escherichia coli CFT073
gcguuccacgucacaggcca

SEQ ID NO: 647457 - RNA, 13 nt, Escherichia coli CFT073
gcguuccagcagc

SEQ ID NO: 647458 - RNA, 21 nt, Escherichia coli CFT073
gcguucgauagcgcgccagcc

SEQ ID NO: 647459 - RNA, 16 nt, Escherichia coli CFT073
gcguuacgcagcuuuu

SEQ ID NO: 647460 - RNA, 18 nt, Escherichia coli CFT073
gcguuagacgcguuuaca

SEQ ID NO: 647461 - RNA, 15 nt, Escherichia coli CFT073
gcguucaaucugucc

SEQ ID NO: 647462 - RNA, 23 nt, Escherichia coli CFT073
gcguucacuguaguuauccgcaa

SEQ ID NO: 647463 - RNA, 21 nt, Escherichia coli CFT073
gcguucaucaguuccaguuca

SEQ ID NO: 647464 - RNA, 20 nt, Escherichia coli CFT073
gcguggucguuggugaagug

SEQ ID NO: 647465 - RNA, 19 nt, Escherichia coli CFT073
gcgugucgagcauugccag

SEQ ID NO: 647466 - RNA, 13 nt, Escherichia coli CFT073
gcgugucggacgg

SEQ ID NO: 647467 - RNA, 19 nt, Escherichia coli CFT073
gcguggugcagccgccauc

SEQ ID NO: 647468 - RNA, 14 nt, Escherichia coli CFT073
gcguguaagcauac

SEQ ID NO: 647469 - RNA, 13 nt, Escherichia coli CFT073
gcguguggugagg

SEQ ID NO: 647470 - RNA, 13 nt, Escherichia coli CFT073
gcguguuccagcg

SEQ ID NO: 647471 - RNA, 20 nt, Escherichia coli CFT073
gcguguuucaucucaucaau

SEQ ID NO: 647472 - RNA, 14 nt, Escherichia coli CFT073
gcguuaacuuguug

SEQ ID NO: 647473 - RNA, 14 nt, Escherichia coli CFT073
gcguuaagcauucg

SEQ ID NO: 647474 - RNA, 19 nt, Escherichia coli CFT073
gcguuaaauccugccaacg

SEQ ID NO: 647475 - RNA, 15 nt, Escherichia coli CFT073
gcguuaacaauaaga

SEQ ID NO: 647476 - RNA, 13 nt, Escherichia coli CFT073
gcguucuguggca

SEQ ID NO: 647477 - RNA, 20 nt, Escherichia coli CFT073
gcguugcaccaaguucuuca

SEQ ID NO: 647478 - RNA, 21 nt, Escherichia coli CFT073
gcguugcagauggcauccagc

SEQ ID NO: 647479 - RNA, 20 nt, Escherichia coli CFT073
gcguugauugccggaugcgg

SEQ ID NO: 647480 - RNA, 17 nt, Escherichia coli CFT073
gcguuuuuaucuucaca

SEQ ID NO: 647481 - RNA, 23 nt, Escherichia coli CFT073
gcguuuugauuuucaccagcauc

SEQ ID NO: 647482 - RNA, 12 nt, Escherichia coli CFT073
gcguuuucuuca

SEQ ID NO: 647483 - RNA, 14 nt, Escherichia coli CFT073
gcguuugcuccugc

SEQ ID NO: 647484 - RNA, 11 nt, Escherichia coli CFT073
gcguuuuccag

SEQ ID NO: 647485 - RNA, 20 nt, Escherichia coli CFT073
gcguuuuuugaucaguaauu

SEQ ID NO: 647486 - RNA, 13 nt, Escherichia coli CFT073
gcguuuuucagaa

SEQ ID NO: 647487 - RNA, 15 nt, Escherichia coli CFT073
gcguugugucauaug

SEQ ID NO: 647488 - RNA, 19 nt, Escherichia coli CFT073
gcguuuagcaguucaucaa

SEQ ID NO: 647489 - RNA, 17 nt, Escherichia coli CFT073
gcguuuccagcaccagu

SEQ ID NO: 647490 - RNA, 15 nt, Escherichia coli CFT073
gcguuucauuagcca

SEQ ID NO: 647491 - RNA, 17 nt, Escherichia coli CFT073
gcguuugaugcgagugu

SEQ ID NO: 647492 - RNA, 20 nt, Escherichia coli CFT073
gcguuucugcgcuucugcca

SEQ ID NO: 647493 - RNA, 12 nt, Escherichia coli CFT073
gcguuucuucac

SEQ ID NO: 647494 - RNA, 15 nt, Escherichia coli CFT073
gcuacucgccugcca

SEQ ID NO: 647495 - RNA, 18 nt, Escherichia coli CFT073
gcuacugauguucgccag

SEQ ID NO: 647496 - RNA, 15 nt, Escherichia coli CFT073
gcuacuggcaauccu

SEQ ID NO: 647497 - RNA, 16 nt, Escherichia coli CFT073
gcuacguucgcgagga

SEQ ID NO: 647498 - RNA, 17 nt, Escherichia coli CFT073
gcuacgcuuaucaggcc

SEQ ID NO: 647499 - RNA, 20 nt, Escherichia coli CFT073
gcuacggcguuucacuucug

SEQ ID NO: 647500 - RNA, 13 nt, Escherichia coli CFT073
gcuacgcagcaug

SEQ ID NO: 647501 - RNA, 19 nt, Escherichia coli CFT073
gcuacgccacagccgagcg

SEQ ID NO: 647502 - RNA, 16 nt, Escherichia coli CFT073
gcuacccggcguuuuu

SEQ ID NO: 647503 - RNA, 15 nt, Escherichia coli CFT073
gcuaccgcccugagc

SEQ ID NO: 647504 - RNA, 20 nt, Escherichia coli CFT073
gcuaccgcccugagcaucaa

SEQ ID NO: 647505 - RNA, 21 nt, Escherichia coli CFT073
gcuaccgcgcaggguuauuug

SEQ ID NO: 647506 - RNA, 21 nt, Escherichia coli CFT073
gcuaccggcgacuuccugagc

SEQ ID NO: 647507 - RNA, 12 nt, Escherichia coli CFT073
gcuacaaaaugc

SEQ ID NO: 647508 - RNA, 18 nt, Escherichia coli CFT073
gcuacaccgucauuagcg

SEQ ID NO: 647509 - RNA, 12 nt, Escherichia coli CFT073
gcuaccaaccag

SEQ ID NO: 647510 - RNA, 14 nt, Escherichia coli CFT073
gcuaccacuuccca

SEQ ID NO: 647511 - RNA, 18 nt, Escherichia coli CFT073
gcuaccagaaagcgaccc

SEQ ID NO: 647512 - RNA, 22 nt, Escherichia coli CFT073
gcuaccagaauugaccaguaau

SEQ ID NO: 647513 - RNA, 13 nt, Escherichia coli CFT073
gcuaccagcaaag

SEQ ID NO: 647514 - RNA, 15 nt, Escherichia coli CFT073
gcuaccagcaaagag

SEQ ID NO: 647515 - RNA, 19 nt, Escherichia coli CFT073
gcuacccgcgcagugcagg

SEQ ID NO: 647516 - RNA, 18 nt, Escherichia coli CFT073
gcuaaagacuuugcugcc

SEQ ID NO: 647517 - RNA, 16 nt, Escherichia coli CFT073
gcuaaaggcaacaucu

SEQ ID NO: 647518 - RNA, 13 nt, Escherichia coli CFT073
gcuaaaaauaguu

SEQ ID NO: 647519 - RNA, 16 nt, Escherichia coli CFT073
gcuaaauccgccgcca

SEQ ID NO: 647520 - RNA, 21 nt, Escherichia coli CFT073
gcuaacacuuucgccugcggc

SEQ ID NO: 647521 - RNA, 17 nt, Escherichia coli CFT073
gcuaacagcgcaucucu

SEQ ID NO: 647522 - RNA, 22 nt, Escherichia coli CFT073
gcuaaauugccggaugcggggc

SEQ ID NO: 647523 - RNA, 20 nt, Escherichia coli CFT073
gcuaacaguuugccaaacca

SEQ ID NO: 647524 - RNA, 18 nt, Escherichia coli CFT073
gcuaacaugguuaaaauc

SEQ ID NO: 647525 - RNA, 21 nt, Escherichia coli CFT073
gcuaacaugguuaaaaucucc

SEQ ID NO: 647526 - RNA, 12 nt, Escherichia coli CFT073
gcuaaccacugu

SEQ ID NO: 647527 - RNA, 21 nt, Escherichia coli CFT073
gcuaagccccugagcgaauac

SEQ ID NO: 647528 - RNA, 23 nt, Escherichia coli CFT073
gcuaagcucucagcauauucuug

SEQ ID NO: 647529 - RNA, 15 nt, Escherichia coli CFT073
gcuaagauaccccag

SEQ ID NO: 647530 - RNA, 21 nt, Escherichia coli CFT073
gcuaacggagaauccagcccc

SEQ ID NO: 647531 - RNA, 12 nt, Escherichia coli CFT073
gcuaacgugcag

SEQ ID NO: 647532 - RNA, 14 nt, Escherichia coli CFT073
gcuaacuccuucgu

SEQ ID NO: 647533 - RNA, 15 nt, Escherichia coli CFT073
gcuaaggcagugaua

SEQ ID NO: 647534 - RNA, 17 nt, Escherichia coli CFT073
gcuaauaaacaggauau

SEQ ID NO: 647535 - RNA, 13 nt, Escherichia coli CFT073
gcuaauaaucagc

SEQ ID NO: 647536 - RNA, 23 nt, Escherichia coli CFT073
gcuaaucaucaucagcgcuuuau

SEQ ID NO: 647537 - RNA, 18 nt, Escherichia coli CFT073
gcuaaucucuucaccaua

SEQ ID NO: 647538 - RNA, 18 nt, Escherichia coli CFT073
gcgggcaacguuccagca

SEQ ID NO: 647539 - RNA, 19 nt, Escherichia coli CFT073
gcggcuucaucuuuaucaa

SEQ ID NO: 647540 - RNA, 12 nt, Escherichia coli CFT073
gcggcuucaacu

SEQ ID NO: 647541 - RNA, 13 nt, Escherichia coli CFT073
gcggguucaguga

SEQ ID NO: 647542 - RNA, 20 nt, Escherichia coli CFT073
gcggguaauuaccccaucca

SEQ ID NO: 647543 - RNA, 15 nt, Escherichia coli CFT073
gcgguacucgcgcag

SEQ ID NO: 647544 - RNA, 20 nt, Escherichia coli CFT073
gcggucaucauauugucugc

SEQ ID NO: 647545 - RNA, 21 nt, Escherichia coli CFT073
gcgguacugaccaucagcagc

SEQ ID NO: 647546 - RNA, 23 nt, Escherichia coli CFT073
gcgggcgguaagccggagcuggc

SEQ ID NO: 647547 - RNA, 14 nt, Escherichia coli CFT073
gcggguaaccagcc

SEQ ID NO: 647548 - RNA, 17 nt, Escherichia coli CFT073
gcgguguaaaccagcuc

SEQ ID NO: 647549 - RNA, 23 nt, Escherichia coli CFT073
gcgguucuucaucuucaucaucu

SEQ ID NO: 647550 - RNA, 13 nt, Escherichia coli CFT073
gcguaaaauauug

SEQ ID NO: 647551 - RNA, 12 nt, Escherichia coli CFT073
gcguaaccaccc

SEQ ID NO: 647552 - RNA, 13 nt, Escherichia coli CFT073
gcgguuguagcca

SEQ ID NO: 647553 - RNA, 21 nt, Escherichia coli CFT073
gcgguuuucucuuuaaacaga

SEQ ID NO: 647554 - RNA, 14 nt, Escherichia coli CFT073
gcgguuuucuucca

SEQ ID NO: 647555 - RNA, 23 nt, Escherichia coli CFT073
gcgguuuucuuccagccacugcg

SEQ ID NO: 647556 - RNA, 13 nt, Escherichia coli CFT073
gcguacaccaaca

SEQ ID NO: 647557 - RNA, 15 nt, Escherichia coli CFT073
gcguacaccaacauc

SEQ ID NO: 647558 - RNA, 16 nt, Escherichia coli CFT073
gcguaccauuucuucu

SEQ ID NO: 647559 - RNA, 17 nt, Escherichia coli CFT073
gcggucuggcagcuaau

SEQ ID NO: 647560 - RNA, 22 nt, Escherichia coli CFT073
gcggucgagaaagggccccgag

SEQ ID NO: 647561 - RNA, 18 nt, Escherichia coli CFT073
gcgucuuguugaacagac

SEQ ID NO: 647562 - RNA, 15 nt, Escherichia coli CFT073
gcgugaaagaaaaug

SEQ ID NO: 647563 - RNA, 14 nt, Escherichia coli CFT073
gcgugaaucaacac

SEQ ID NO: 647564 - RNA, 15 nt, Escherichia coli CFT073
gcgugaaucaacacc

SEQ ID NO: 647565 - RNA, 18 nt, Escherichia coli CFT073
gcgugagggaaacagcac

SEQ ID NO: 647566 - RNA, 15 nt, Escherichia coli CFT073
gcgugaguggcgcgc

SEQ ID NO: 647567 - RNA, 20 nt, Escherichia coli CFT073
gcgugcaauaucaaccugau

SEQ ID NO: 647568 - RNA, 19 nt, Escherichia coli CFT073
gcguggauacaggcgggcg

SEQ ID NO: 647569 - RNA, 19 nt, Escherichia coli CFT073
gcgugcgccaccgcuuccg

SEQ ID NO: 647570 - RNA, 19 nt, Escherichia coli CFT073
gcgucgcugaaccgccaac

SEQ ID NO: 647571 - RNA, 16 nt, Escherichia coli CFT073
gcgucgccggucagga

SEQ ID NO: 647572 - RNA, 14 nt, Escherichia coli CFT073
gcgucguucgccag

SEQ ID NO: 647573 - RNA, 20 nt, Escherichia coli CFT073
gcgucguucgcgccaacagc

SEQ ID NO: 647574 - RNA, 23 nt, Escherichia coli CFT073
gcgucucaucuuuaucggugaga

SEQ ID NO: 647575 - RNA, 14 nt, Escherichia coli CFT073
gcgucucaucuuua

SEQ ID NO: 647576 - RNA, 17 nt, Escherichia coli CFT073
gcgucuucaucguccag

SEQ ID NO: 647577 - RNA, 11 nt, Escherichia coli CFT073
gcgucuuccac

SEQ ID NO: 647578 - RNA, 16 nt, Escherichia coli CFT073
gcgucuuccgugccug

SEQ ID NO: 647579 - RNA, 14 nt, Escherichia coli CFT073
gcgucuuaucaggc

SEQ ID NO: 647580 - RNA, 17 nt, Escherichia coli CFT073
gcgucaauuugcuccgc

SEQ ID NO: 647581 - RNA, 19 nt, Escherichia coli CFT073
gcgucacaaauaccccugc

SEQ ID NO: 647582 - RNA, 22 nt, Escherichia coli CFT073
gcgucaaugccgcuucgagcug

SEQ ID NO: 647583 - RNA, 16 nt, Escherichia coli CFT073
gcgucaaguuaagcau

SEQ ID NO: 647584 - RNA, 15 nt, Escherichia coli CFT073
gcgucaagauggcuc

SEQ ID NO: 647585 - RNA, 19 nt, Escherichia coli CFT073
gcgucaacaacacucucug

SEQ ID NO: 647586 - RNA, 19 nt, Escherichia coli CFT073
gcgucacgguuucaaagaa

SEQ ID NO: 647587 - RNA, 20 nt, Escherichia coli CFT073
gcgucacgguuucaaagaaa

SEQ ID NO: 647588 - RNA, 13 nt, Escherichia coli CFT073
gcgucagccacaa

SEQ ID NO: 647589 - RNA, 19 nt, Escherichia coli CFT073
gcgucaucaauccugcagc

SEQ ID NO: 647590 - RNA, 19 nt, Escherichia coli CFT073
gcguaugcagccaggccau

SEQ ID NO: 647591 - RNA, 15 nt, Escherichia coli CFT073
gcguaucgcccugcc

SEQ ID NO: 647592 - RNA, 18 nt, Escherichia coli CFT073
gcguaucguucgccagcu

SEQ ID NO: 647593 - RNA, 16 nt, Escherichia coli CFT073
gcguagcugcugcuca

SEQ ID NO: 647594 - RNA, 16 nt, Escherichia coli CFT073
gcguagauucgaaaug

SEQ ID NO: 647595 - RNA, 18 nt, Escherichia coli CFT073
gcgucauugacgcuggcu

SEQ ID NO: 647596 - RNA, 22 nt, Escherichia coli CFT073
gcgucauuuucauugcuuucuu

SEQ ID NO: 647597 - RNA, 15 nt, Escherichia coli CFT073
gcguccagaggaucu

SEQ ID NO: 647598 - RNA, 17 nt, Escherichia coli CFT073
gcguccaucacuaccag

SEQ ID NO: 647599 - RNA, 18 nt, Escherichia coli CFT073
gcgucccuacugcacuca

SEQ ID NO: 647600 - RNA, 15 nt, Escherichia coli CFT073
gcgucccaucggcaa

SEQ ID NO: 647601 - RNA, 18 nt, Escherichia coli CFT073
gcgucccagauagcuguc

SEQ ID NO: 647602 - RNA, 13 nt, Escherichia coli CFT073
gcgucccaucggc

SEQ ID NO: 647603 - RNA, 14 nt, Escherichia coli CFT073
gcgucgaucucuuc

SEQ ID NO: 647604 - RNA, 15 nt, Escherichia coli CFT073
gcgucgcaucuggca

SEQ ID NO: 647605 - RNA, 16 nt, Escherichia coli CFT073
gcgucgcccguggagu

SEQ ID NO: 647606 - RNA, 14 nt, Escherichia coli CFT073
gcgucgccagcagc

SEQ ID NO: 647607 - RNA, 18 nt, Escherichia coli CFT073
gcguccuuguaacgcgcu

SEQ ID NO: 647608 - RNA, 18 nt, Escherichia coli CFT073
gcguccugaucgacgcgc

SEQ ID NO: 647609 - RNA, 18 nt, Escherichia coli CFT073
gcguccggcgucgcuucu

SEQ ID NO: 647610 - RNA, 21 nt, Escherichia coli CFT073
gcggaugaggcguuaacagcg

SEQ ID NO: 647611 - RNA, 16 nt, Escherichia coli CFT073
gcggauggccucugcc

SEQ ID NO: 647612 - RNA, 22 nt, Escherichia coli CFT073
gcggcaagcgucgcaucaggca

SEQ ID NO: 647613 - RNA, 15 nt, Escherichia coli CFT073
gcggcaaucgcugcu

SEQ ID NO: 647614 - RNA, 12 nt, Escherichia coli CFT073
gcggcaaucauc

SEQ ID NO: 647615 - RNA, 13 nt, Escherichia coli CFT073
gcggcaaucgcca

SEQ ID NO: 647616 - RNA, 14 nt, Escherichia coli CFT073
gcggcaaucgccag

SEQ ID NO: 647617 - RNA, 13 nt, Escherichia coli CFT073
gcggcaauguucg

SEQ ID NO: 647618 - RNA, 19 nt, Escherichia coli CFT073
gcggcaauguucgccggga

SEQ ID NO: 647619 - RNA, 23 nt, Escherichia coli CFT073
gcggcaauuagcggccagcgggc

SEQ ID NO: 647620 - RNA, 24 nt, Escherichia coli CFT073
gcggcacugcucuuuaacaauuua

SEQ ID NO: 647621 - RNA, 22 nt, Escherichia coli CFT073
gcggcacugguacucaaccgcc

SEQ ID NO: 647622 - RNA, 18 nt, Escherichia coli CFT073
gcggcacuguuucgccag

SEQ ID NO: 647623 - RNA, 20 nt, Escherichia coli CFT073
gcggcacuguuucgccaggu

SEQ ID NO: 647624 - RNA, 14 nt, Escherichia coli CFT073
gcggcacagccagc

SEQ ID NO: 647625 - RNA, 12 nt, Escherichia coli CFT073
gcggcagcaggu

SEQ ID NO: 647626 - RNA, 17 nt, Escherichia coli CFT073
gcggcagcaauggcacu

SEQ ID NO: 647627 - RNA, 15 nt, Escherichia coli CFT073
gcggcagauccacca

SEQ ID NO: 647628 - RNA, 18 nt, Escherichia coli CFT073
gcggcagaacguccgcag

SEQ ID NO: 647629 - RNA, 13 nt, Escherichia coli CFT073
gcggaugacccag

SEQ ID NO: 647630 - RNA, 17 nt, Escherichia coli CFT073
gcggauaaggcuuuugc

SEQ ID NO: 647631 - RNA, 19 nt, Escherichia coli CFT073
gcggauagccauccccgcc

SEQ ID NO: 647632 - RNA, 13 nt, Escherichia coli CFT073
gcggaggggagga

SEQ ID NO: 647633 - RNA, 21 nt, Escherichia coli CFT073
gcggaauuaaccgcccaccgc

SEQ ID NO: 647634 - RNA, 23 nt, Escherichia coli CFT073
gcgcuuuuacugcacucgccagu

SEQ ID NO: 647635 - RNA, 21 nt, Escherichia coli CFT073
gcgcuuugaugcguucuucaa

SEQ ID NO: 647636 - RNA, 13 nt, Escherichia coli CFT073
gcgcuuucugcuu

SEQ ID NO: 647637 - RNA, 20 nt, Escherichia coli CFT073
gcgcuuucagcacgacauaa

SEQ ID NO: 647638 - RNA, 16 nt, Escherichia coli CFT073
gcggacuucuggcaga

SEQ ID NO: 647639 - RNA, 15 nt, Escherichia coli CFT073
gcggacacuuuccug

SEQ ID NO: 647640 - RNA, 14 nt, Escherichia coli CFT073
gcggacaucugguc

SEQ ID NO: 647641 - RNA, 12 nt, Escherichia coli CFT073
gcgcugaccuuc

SEQ ID NO: 647642 - RNA, 15 nt, Escherichia coli CFT073
gcgcugacgcgucuu

SEQ ID NO: 647643 - RNA, 23 nt, Escherichia coli CFT073
gcgcugaaaccgugcaucuguug

SEQ ID NO: 647644 - RNA, 17 nt, Escherichia coli CFT073
gcgcuuccggcagcuuc

SEQ ID NO: 647645 - RNA, 17 nt, Escherichia coli CFT073
gcgcuuccagccaugcc

SEQ ID NO: 647646 - RNA, 17 nt, Escherichia coli CFT073
gcgcuugcggccagcac

SEQ ID NO: 647647 - RNA, 18 nt, Escherichia coli CFT073
gcgcuugcggccagcaca

SEQ ID NO: 647648 - RNA, 13 nt, Escherichia coli CFT073
gcgcuucugccac

SEQ ID NO: 647649 - RNA, 20 nt, Escherichia coli CFT073
gcgcuucggcgccuuuuuca

SEQ ID NO: 647650 - RNA, 18 nt, Escherichia coli CFT073
gcgcuucggcuuucauuu

SEQ ID NO: 647651 - RNA, 16 nt, Escherichia coli CFT073
gcgcuugcauccggca

SEQ ID NO: 647652 - RNA, 19 nt, Escherichia coli CFT073
gcggcagguugaugaugac

SEQ ID NO: 647653 - RNA, 15 nt, Escherichia coli CFT073
gcggcaguaaauauu

SEQ ID NO: 647654 - RNA, 20 nt, Escherichia coli CFT073
gcggcagguugaaguugaug

SEQ ID NO: 647655 - RNA, 14 nt, Escherichia coli CFT073
gcggcagguugaug

SEQ ID NO: 647656 - RNA, 22 nt, Escherichia coli CFT073
gcggccaguagcuugaaaucac

SEQ ID NO: 647657 - RNA, 14 nt, Escherichia coli CFT073
gcggcgcaaccauc

SEQ ID NO: 647658 - RNA, 18 nt, Escherichia coli CFT073
gcggcgcaacccccacac

SEQ ID NO: 647659 - RNA, 14 nt, Escherichia coli CFT073
gcggcgauuaagaa

SEQ ID NO: 647660 - RNA, 17 nt, Escherichia coli CFT073
gcggcgauuaauccagu

SEQ ID NO: 647661 - RNA, 21 nt, Escherichia coli CFT073
gcggcgauaauacccagcaac

SEQ ID NO: 647662 - RNA, 21 nt, Escherichia coli CFT073
gcggcgauaauauugaugcac

SEQ ID NO: 647663 - RNA, 14 nt, Escherichia coli CFT073
gcggcgacaauaau

SEQ ID NO: 647664 - RNA, 16 nt, Escherichia coli CFT073
gcggcgaaccagccgu

SEQ ID NO: 647665 - RNA, 14 nt, Escherichia coli CFT073
gcggccuucuucca

SEQ ID NO: 647666 - RNA, 23 nt, Escherichia coli CFT073
gcgcgcuaacggagaauccagcc

SEQ ID NO: 647667 - RNA, 20 nt, Escherichia coli CFT073
gcgcgcgucaucggcgcggu

SEQ ID NO: 647668 - RNA, 18 nt, Escherichia coli CFT073
gcgcggauccacaccuga

SEQ ID NO: 647669 - RNA, 14 nt, Escherichia coli CFT073
gcgcggcccacuuc

SEQ ID NO: 647670 - RNA, 17 nt, Escherichia coli CFT073
gcgcggauuucggcggc

SEQ ID NO: 647671 - RNA, 17 nt, Escherichia coli CFT073
gcgcgccuggcgugccc

SEQ ID NO: 647672 - RNA, 17 nt, Escherichia coli CFT073
gcgaucaguugcucggc

SEQ ID NO: 647673 - RNA, 18 nt, Escherichia coli CFT073
gcgaucccagagcgggca

SEQ ID NO: 647674 - RNA, 23 nt, Escherichia coli CFT073
gcgcgaaccaucaccucuucacc

SEQ ID NO: 647675 - RNA, 15 nt, Escherichia coli CFT073
gcgcgaaucuucaua

SEQ ID NO: 647676 - RNA, 14 nt, Escherichia coli CFT073
gcgcgaggaauaug

SEQ ID NO: 647677 - RNA, 15 nt, Escherichia coli CFT073
gcgcgaggguaaaca

SEQ ID NO: 647678 - RNA, 22 nt, Escherichia coli CFT073
gcgcgagguggaacaucaggau

SEQ ID NO: 647679 - RNA, 15 nt, Escherichia coli CFT073
gcgcgauauccaguu

SEQ ID NO: 647680 - RNA, 22 nt, Escherichia coli CFT073
gcgcgccaguaaucagcgcgga

SEQ ID NO: 647681 - RNA, 16 nt, Escherichia coli CFT073
gcgcgucaucggcgcg

SEQ ID NO: 647682 - RNA, 15 nt, Escherichia coli CFT073
gcgcgggcuggcgua

SEQ ID NO: 647683 - RNA, 17 nt, Escherichia coli CFT073
gcgcuaaaagcauagcc

SEQ ID NO: 647684 - RNA, 15 nt, Escherichia coli CFT073
gcgcuaaaauuucuu

SEQ ID NO: 647685 - RNA, 21 nt, Escherichia coli CFT073
gcgcuaaaauuucuuuuuuuc

SEQ ID NO: 647686 - RNA, 14 nt, Escherichia coli CFT073
gcgcguuugucagc

SEQ ID NO: 647687 - RNA, 17 nt, Escherichia coli CFT073
gcgcguuuuauccggcc

SEQ ID NO: 647688 - RNA, 16 nt, Escherichia coli CFT073
gcgcuaccagagccgc

SEQ ID NO: 647689 - RNA, 22 nt, Escherichia coli CFT073
gcgcguugauaccgugcagcac

SEQ ID NO: 647690 - RNA, 14 nt, Escherichia coli CFT073
gcgcguuacuggca

SEQ ID NO: 647691 - RNA, 12 nt, Escherichia coli CFT073
gcgcgugccgga

SEQ ID NO: 647692 - RNA, 15 nt, Escherichia coli CFT073
gcgcuacugaagcga

SEQ ID NO: 647693 - RNA, 13 nt, Escherichia coli CFT073
gcgcuaucgccug

SEQ ID NO: 647694 - RNA, 15 nt, Escherichia coli CFT073
gcgcuaugaugaaaa

SEQ ID NO: 647695 - RNA, 14 nt, Escherichia coli CFT073
gcgcucccgcagga

SEQ ID NO: 647696 - RNA, 23 nt, Escherichia coli CFT073
gcgcuccaucagauucagcagcg

SEQ ID NO: 647697 - RNA, 12 nt, Escherichia coli CFT073
gccuuuuuucac

SEQ ID NO: 647698 - RNA, 19 nt, Escherichia coli CFT073
gccuuuaucaacaauaaaa

SEQ ID NO: 647699 - RNA, 18 nt, Escherichia coli CFT073
gccuuuaucuuucaguau

SEQ ID NO: 647700 - RNA, 17 nt, Escherichia coli CFT073
gccuuuaccgccacagc

SEQ ID NO: 647701 - RNA, 16 nt, Escherichia coli CFT073
gccuuuaccgccacag

SEQ ID NO: 647702 - RNA, 19 nt, Escherichia coli CFT073
gccuugcgauuacguucgg

SEQ ID NO: 647703 - RNA, 14 nt, Escherichia coli CFT073
gccuucuucuuuca

SEQ ID NO: 647704 - RNA, 18 nt, Escherichia coli CFT073
gccuucuucuuucagagu

SEQ ID NO: 647705 - RNA, 14 nt, Escherichia coli CFT073
gccuucuucaucca

SEQ ID NO: 647706 - RNA, 12 nt, Escherichia coli CFT073
gccuucugcggu

SEQ ID NO: 647707 - RNA, 16 nt, Escherichia coli CFT073
gccuucuucauccagc

SEQ ID NO: 647708 - RNA, 22 nt, Escherichia coli CFT073
gccuuccugauaacacagcggc

SEQ ID NO: 647709 - RNA, 19 nt, Escherichia coli CFT073
gccuuccggguuuucucca

SEQ ID NO: 647710 - RNA, 20 nt, Escherichia coli CFT073
gccuuccggguuuucuccaa

SEQ ID NO: 647711 - RNA, 17 nt, Escherichia coli CFT073
gccuucccuucucuuca

SEQ ID NO: 647712 - RNA, 15 nt, Escherichia coli CFT073
gccuucccuuucagc

SEQ ID NO: 647713 - RNA, 18 nt, Escherichia coli CFT073
gccuuccgcaaacaggcg

SEQ ID NO: 647714 - RNA, 22 nt, Escherichia coli CFT073
gccuguggcgcgaccagacgca

SEQ ID NO: 647715 - RNA, 20 nt, Escherichia coli CFT073
gccuguuaaugcuacccggc

SEQ ID NO: 647716 - RNA, 16 nt, Escherichia coli CFT073
gccugugccugagccg

SEQ ID NO: 647717 - RNA, 16 nt, Escherichia coli CFT073
gccugugccacggcuu

SEQ ID NO: 647718 - RNA, 16 nt, Escherichia coli CFT073
gccuuacccugaccgu

SEQ ID NO: 647719 - RNA, 22 nt, Escherichia coli CFT073
gccuuacccugaccgucuuuuu

SEQ ID NO: 647720 - RNA, 19 nt, Escherichia coli CFT073
gccuucauacgacgacggu

SEQ ID NO: 647721 - RNA, 16 nt, Escherichia coli CFT073
gccuuauccgaccuac

SEQ ID NO: 647722 - RNA, 22 nt, Escherichia coli CFT073
gccuuauccggccuacggguga

SEQ ID NO: 647723 - RNA, 13 nt, Escherichia coli CFT073
gccuucauaauga

SEQ ID NO: 647724 - RNA, 17 nt, Escherichia coli CFT073
gccugcuuuaucgaaca

SEQ ID NO: 647725 - RNA, 16 nt, Escherichia coli CFT073
gccugcuccucgguga

SEQ ID NO: 647726 - RNA, 18 nt, Escherichia coli CFT073
gccuggcacucuuuuaau

SEQ ID NO: 647727 - RNA, 16 nt, Escherichia coli CFT073
gccuguaccagcggcu

SEQ ID NO: 647728 - RNA, 15 nt, Escherichia coli CFT073
gccuguacuuccugu

SEQ ID NO: 647729 - RNA, 20 nt, Escherichia coli CFT073
gccugaacaccagaaccagc

SEQ ID NO: 647730 - RNA, 16 nt, Escherichia coli CFT073
gccugaauauccagau

SEQ ID NO: 647731 - RNA, 12 nt, Escherichia coli CFT073
gccugaaaaaug

SEQ ID NO: 647732 - RNA, 14 nt, Escherichia coli CFT073
gccugaaaaaugag

SEQ ID NO: 647733 - RNA, 21 nt, Escherichia coli CFT073
gccugaaaacgaaaucguugu

SEQ ID NO: 647734 - RNA, 13 nt, Escherichia coli CFT073
gccugaaacagaa

SEQ ID NO: 647735 - RNA, 20 nt, Escherichia coli CFT073
gccucuuugcgguuaaagca

SEQ ID NO: 647736 - RNA, 22 nt, Escherichia coli CFT073
gccucaagcuuacugagcagau

SEQ ID NO: 647737 - RNA, 20 nt, Escherichia coli CFT073
gccucaagcacccaaugcca

SEQ ID NO: 647738 - RNA, 20 nt, Escherichia coli CFT073
gccucaagcacccgccgcua

SEQ ID NO: 647739 - RNA, 13 nt, Escherichia coli CFT073
gccuauugcucua

SEQ ID NO: 647740 - RNA, 21 nt, Escherichia coli CFT073
gccuauugcucuaaaaaguuc

SEQ ID NO: 647741 - RNA, 17 nt, Escherichia coli CFT073
gccucaaaauaaggcug

SEQ ID NO: 647742 - RNA, 20 nt, Escherichia coli CFT073
gccucaacauacaaauagcc

SEQ ID NO: 647743 - RNA, 16 nt, Escherichia coli CFT073
gccugauguugauaaa

SEQ ID NO: 647744 - RNA, 22 nt, Escherichia coli CFT073
gccugauucaaugaguuauaca

SEQ ID NO: 647745 - RNA, 12 nt, Escherichia coli CFT073
gccugaugcgcu

SEQ ID NO: 647746 - RNA, 14 nt, Escherichia coli CFT073
gccugcaaaauaau

SEQ ID NO: 647747 - RNA, 13 nt, Escherichia coli CFT073
gccugcaaaaucu

SEQ ID NO: 647748 - RNA, 14 nt, Escherichia coli CFT073
gccugcaaauaaau

SEQ ID NO: 647749 - RNA, 15 nt, Escherichia coli CFT073
gccugcaacaggagc

SEQ ID NO: 647750 - RNA, 16 nt, Escherichia coli CFT073
gccugcaacuggcaau

SEQ ID NO: 647751 - RNA, 21 nt, Escherichia coli CFT073
gccugaugcgacgcugguugc

SEQ ID NO: 647752 - RNA, 22 nt, Escherichia coli CFT073
gccugaugcgacgcuugccgcg

SEQ ID NO: 647753 - RNA, 22 nt, Escherichia coli CFT073
gccugaugagcggagcacauca

SEQ ID NO: 647754 - RNA, 22 nt, Escherichia coli CFT073
gccugauacagccaaaucauca

SEQ ID NO: 647755 - RNA, 21 nt, Escherichia coli CFT073
gccugauagcccgcacaaagc

SEQ ID NO: 647756 - RNA, 16 nt, Escherichia coli CFT073
gccugaucaaucauca

SEQ ID NO: 647757 - RNA, 16 nt, Escherichia coli CFT073
gccugaucagcgaagc

SEQ ID NO: 647758 - RNA, 14 nt, Escherichia coli CFT073
gccugaucgcgcaa

SEQ ID NO: 647759 - RNA, 17 nt, Escherichia coli CFT073
gccugaccacccgcugg

SEQ ID NO: 647760 - RNA, 16 nt, Escherichia coli CFT073
gccugaccauuaucaa

SEQ ID NO: 647761 - RNA, 21 nt, Escherichia coli CFT073
gccugacggaaaucauccagc

SEQ ID NO: 647762 - RNA, 14 nt, Escherichia coli CFT073
gccugccagcucuu

SEQ ID NO: 647763 - RNA, 17 nt, Escherichia coli CFT073
gccugcagucagccagc

SEQ ID NO: 647764 - RNA, 12 nt, Escherichia coli CFT073
gccugcacucag

SEQ ID NO: 647765 - RNA, 13 nt, Escherichia coli CFT073
gccugcacugcag

SEQ ID NO: 647766 - RNA, 17 nt, Escherichia coli CFT073
gccugcacugcaggccg

SEQ ID NO: 647767 - RNA, 19 nt, Escherichia coli CFT073
gccugcagaggccgccgca

SEQ ID NO: 647768 - RNA, 16 nt, Escherichia coli CFT073
gccugcacaaagcgcc

SEQ ID NO: 647769 - RNA, 22 nt, Escherichia coli CFT073
gccugcacgaccggguuuucaa

SEQ ID NO: 647770 - RNA, 15 nt, Escherichia coli CFT073
gccugcgccaucccc

SEQ ID NO: 647771 - RNA, 23 nt, Escherichia coli CFT073
gccugcuaccgggaucuccucca

SEQ ID NO: 647772 - RNA, 13 nt, Escherichia coli CFT073
gccugcucaaccg

SEQ ID NO: 647773 - RNA, 17 nt, Escherichia coli CFT073
gccugcucaaccgccag

SEQ ID NO: 647774 - RNA, 17 nt, Escherichia coli CFT073
gcgacgacuggcgcggc

SEQ ID NO: 647775 - RNA, 19 nt, Escherichia coli CFT073
gcgaccugugccgccgccc

SEQ ID NO: 647776 - RNA, 20 nt, Escherichia coli CFT073
gcgaccuacacaccuucucc

SEQ ID NO: 647777 - RNA, 18 nt, Escherichia coli CFT073
gcgaccgucuuuauccag

SEQ ID NO: 647778 - RNA, 23 nt, Escherichia coli CFT073
gcgaccgucuuuauccagcacca

SEQ ID NO: 647779 - RNA, 15 nt, Escherichia coli CFT073
gcgaccguuuucacc

SEQ ID NO: 647780 - RNA, 16 nt, Escherichia coli CFT073
gcgaccauuggugcug

SEQ ID NO: 647781 - RNA, 20 nt, Escherichia coli CFT073
gcgacccguuuacggcuaaa

SEQ ID NO: 647782 - RNA, 14 nt, Escherichia coli CFT073
gcgacaggagccgc

SEQ ID NO: 647783 - RNA, 14 nt, Escherichia coli CFT073
gcgacagccagccc

SEQ ID NO: 647784 - RNA, 17 nt, Escherichia coli CFT073
gcgacagccauccccac

SEQ ID NO: 647785 - RNA, 12 nt, Escherichia coli CFT073
gcgacaccagcc

SEQ ID NO: 647786 - RNA, 18 nt, Escherichia coli CFT073
gcgacacaaucaaauccu

SEQ ID NO: 647787 - RNA, 20 nt, Escherichia coli CFT073
gcgacaaucgcccccaucac

SEQ ID NO: 647788 - RNA, 14 nt, Escherichia coli CFT073
gcgacaacggguuu

SEQ ID NO: 647789 - RNA, 13 nt, Escherichia coli CFT073
gcgacagcaaaau

SEQ ID NO: 647790 - RNA, 19 nt, Escherichia coli CFT073
gcgaauuaacaccaccagc

SEQ ID NO: 647791 - RNA, 22 nt, Escherichia coli CFT073
gcgaauuuauuugugauugaug

SEQ ID NO: 647792 - RNA, 16 nt, Escherichia coli CFT073
gcgaauuuccugccag

SEQ ID NO: 647793 - RNA, 16 nt, Escherichia coli CFT073
gcgaaucuaaaucagg

SEQ ID NO: 647794 - RNA, 13 nt, Escherichia coli CFT073
gcgaaugaaagau

SEQ ID NO: 647795 - RNA, 16 nt, Escherichia coli CFT073
gcgaaugaaagaugaa

SEQ ID NO: 647796 - RNA, 23 nt, Escherichia coli CFT073
gcgaaaccugaauccacuggcug

SEQ ID NO: 647797 - RNA, 12 nt, Escherichia coli CFT073
gcgaaaccuuac

SEQ ID NO: 647798 - RNA, 23 nt, Escherichia coli CFT073
gcgagaucuuuaucaaucaccgc

SEQ ID NO: 647799 - RNA, 18 nt, Escherichia coli CFT073
gcgagauauccacauuaa

SEQ ID NO: 647800 - RNA, 20 nt, Escherichia coli CFT073
gcgagauauucccccaccgc

SEQ ID NO: 647801 - RNA, 22 nt, Escherichia coli CFT073
gcgacugaaaggucaucaucac

SEQ ID NO: 647802 - RNA, 15 nt, Escherichia coli CFT073
gcgacugccagcauc

SEQ ID NO: 647803 - RNA, 18 nt, Escherichia coli CFT073
gcgacgauuaagccgccu

SEQ ID NO: 647804 - RNA, 12 nt, Escherichia coli CFT073
gcgacgcugaag

SEQ ID NO: 647805 - RNA, 13 nt, Escherichia coli CFT073
gcgacgcggcagc

SEQ ID NO: 647806 - RNA, 20 nt, Escherichia coli CFT073
gcgacgguugcggaacccag

SEQ ID NO: 647807 - RNA, 17 nt, Escherichia coli CFT073
gcgacgguuuccaggca

SEQ ID NO: 647808 - RNA, 21 nt, Escherichia coli CFT073
gcgaggggaccgaucgcgcuc

SEQ ID NO: 647809 - RNA, 16 nt, Escherichia coli CFT073
gcgagguaacaauaaa

SEQ ID NO: 647810 - RNA, 16 nt, Escherichia coli CFT073
gcgauaccacccgcag

SEQ ID NO: 647811 - RNA, 21 nt, Escherichia coli CFT073
gcgauacgcuucaaccaguuu

SEQ ID NO: 647812 - RNA, 21 nt, Escherichia coli CFT073
gcgauaauuuuucgauaacug

SEQ ID NO: 647813 - RNA, 22 nt, Escherichia coli CFT073
gcgauaauauugaugcacacca

SEQ ID NO: 647814 - RNA, 17 nt, Escherichia coli CFT073
gcgauaauacccagcaa

SEQ ID NO: 647815 - RNA, 17 nt, Escherichia coli CFT073
gcgauaaucagcgccag

SEQ ID NO: 647816 - RNA, 17 nt, Escherichia coli CFT073
gcgagugaauccccagg

SEQ ID NO: 647817 - RNA, 15 nt, Escherichia coli CFT073
gcgagucaggccagg

SEQ ID NO: 647818 - RNA, 23 nt, Escherichia coli CFT073
gccggauucacgccaaccagcug

SEQ ID NO: 647819 - RNA, 22 nt, Escherichia coli CFT073
gccggaugguaugccauccggc

SEQ ID NO: 647820 - RNA, 15 nt, Escherichia coli CFT073
gccggaugcaucaca

SEQ ID NO: 647821 - RNA, 16 nt, Escherichia coli CFT073
gccggaugccgcugcu

SEQ ID NO: 647822 - RNA, 23 nt, Escherichia coli CFT073
gccggaugccucuccuguucuca

SEQ ID NO: 647823 - RNA, 23 nt, Escherichia coli CFT073
gccggaugaguauuucauccggc

SEQ ID NO: 647824 - RNA, 18 nt, Escherichia coli CFT073
gccggaugaucauccggc

SEQ ID NO: 647825 - RNA, 18 nt, Escherichia coli CFT073
gccggaugcgaugcugac

SEQ ID NO: 647826 - RNA, 23 nt, Escherichia coli CFT073
gccggaugcggcgcgagcgccuu

SEQ ID NO: 647827 - RNA, 23 nt, Escherichia coli CFT073
gccggaugcggcgugaacaccuu

SEQ ID NO: 647828 - RNA, 20 nt, Escherichia coli CFT073
gccggauggaaacauccggc

SEQ ID NO: 647829 - RNA, 18 nt, Escherichia coli CFT073
gccggauaauuccccggc

SEQ ID NO: 647830 - RNA, 18 nt, Escherichia coli CFT073
gccggauacgcuuuaucc

SEQ ID NO: 647831 - RNA, 21 nt, Escherichia coli CFT073
gccggagagcaauuuccggca

SEQ ID NO: 647832 - RNA, 13 nt, Escherichia coli CFT073
gccggacuccagc

SEQ ID NO: 647833 - RNA, 17 nt, Escherichia coli CFT073
gccggaaucaacggcaa

SEQ ID NO: 647834 - RNA, 12 nt, Escherichia coli CFT073
gccggaauaauc

SEQ ID NO: 647835 - RNA, 22 nt, Escherichia coli CFT073
gccggaauuucuuucagcaguu

SEQ ID NO: 647836 - RNA, 22 nt, Escherichia coli CFT073
gccgggauguugcugcgagcug

SEQ ID NO: 647837 - RNA, 21 nt, Escherichia coli CFT073
gccgggauauaugucaccagc

SEQ ID NO: 647838 - RNA, 15 nt, Escherichia coli CFT073
gccggcgcgcaggug

SEQ ID NO: 647839 - RNA, 18 nt, Escherichia coli CFT073
gccggucagcaggaccuu

SEQ ID NO: 647840 - RNA, 21 nt, Escherichia coli CFT073
gccgguaaucaccagcaacac

SEQ ID NO: 647841 - RNA, 15 nt, Escherichia coli CFT073
gccgggguguucccg

SEQ ID NO: 647842 - RNA, 18 nt, Escherichia coli CFT073
gccggggucaaaccuggc

SEQ ID NO: 647843 - RNA, 21 nt, Escherichia coli CFT073
gccgggugcgaugcauccggc

SEQ ID NO: 647844 - RNA, 14 nt, Escherichia coli CFT073
gccuacaggugauu

SEQ ID NO: 647845 - RNA, 14 nt, Escherichia coli CFT073
gccuaccaccagcu

SEQ ID NO: 647846 - RNA, 21 nt, Escherichia coli CFT073
gccuaccaccagcuuguuauc

SEQ ID NO: 647847 - RNA, 20 nt, Escherichia coli CFT073
gccuaccaugaucugcaaau

SEQ ID NO: 647848 - RNA, 18 nt, Escherichia coli CFT073
gccuaacgacaaaucaua

SEQ ID NO: 647849 - RNA, 16 nt, Escherichia coli CFT073
gccuacauagccccug

SEQ ID NO: 647850 - RNA, 14 nt, Escherichia coli CFT073
gccuacauauccgc

SEQ ID NO: 647851 - RNA, 19 nt, Escherichia coli CFT073
gccuacauauucauccccg

SEQ ID NO: 647852 - RNA, 17 nt, Escherichia coli CFT073
gccuaacaacugcugga

SEQ ID NO: 647853 - RNA, 14 nt, Escherichia coli CFT073
gccuaacaccauca

SEQ ID NO: 647854 - RNA, 16 nt, Escherichia coli CFT073
gccguugaguucaaau

SEQ ID NO: 647855 - RNA, 18 nt, Escherichia coli CFT073
gccguucuggugggcgaa

SEQ ID NO: 647856 - RNA, 13 nt, Escherichia coli CFT073
gccguucuucccg

SEQ ID NO: 647857 - RNA, 17 nt, Escherichia coli CFT073
gccguugauuucacagu

SEQ ID NO: 647858 - RNA, 21 nt, Escherichia coli CFT073
gccguugaucugccccauaga

SEQ ID NO: 647859 - RNA, 14 nt, Escherichia coli CFT073
gccguuuucgucaa

SEQ ID NO: 647860 - RNA, 20 nt, Escherichia coli CFT073
gccguuuuuacccagcagca

SEQ ID NO: 647861 - RNA, 14 nt, Escherichia coli CFT073
gccguggcgcucgc

SEQ ID NO: 647862 - RNA, 20 nt, Escherichia coli CFT073
gccguguuauccgccgcaua

SEQ ID NO: 647863 - RNA, 17 nt, Escherichia coli CFT073
gccgugucggugcucau

SEQ ID NO: 647864 - RNA, 20 nt, Escherichia coli CFT073
gccguaacugugccaaaucu

SEQ ID NO: 647865 - RNA, 15 nt, Escherichia coli CFT073
gccguacagcccagg

SEQ ID NO: 647866 - RNA, 14 nt, Escherichia coli CFT073
gccguacaggcaga

SEQ ID NO: 647867 - RNA, 14 nt, Escherichia coli CFT073
gccguacaggcagc

SEQ ID NO: 647868 - RNA, 18 nt, Escherichia coli CFT073
gccguaaacaucauccag

SEQ ID NO: 647869 - RNA, 19 nt, Escherichia coli CFT073
gccguaaacaucauccaga

SEQ ID NO: 647870 - RNA, 19 nt, Escherichia coli CFT073
gccguaaccagcgcagaca

SEQ ID NO: 647871 - RNA, 16 nt, Escherichia coli CFT073
gccgguugugugcugg

SEQ ID NO: 647872 - RNA, 19 nt, Escherichia coli CFT073
gccgguugugugcuggcca

SEQ ID NO: 647873 - RNA, 20 nt, Escherichia coli CFT073
gccgguugugugcuggccau

SEQ ID NO: 647874 - RNA, 18 nt, Escherichia coli CFT073
gccgucgagaaucaacac

SEQ ID NO: 647875 - RNA, 22 nt, Escherichia coli CFT073
gccgucgaugucuggcugagca

SEQ ID NO: 647876 - RNA, 16 nt, Escherichia coli CFT073
gccgucaucgacuucg

SEQ ID NO: 647877 - RNA, 20 nt, Escherichia coli CFT073
gccgcgacgauacgcccgga

SEQ ID NO: 647878 - RNA, 19 nt, Escherichia coli CFT073
gccgccgucagacgcgcgg

SEQ ID NO: 647879 - RNA, 16 nt, Escherichia coli CFT073
gccgccgacaguuauc

SEQ ID NO: 647880 - RNA, 15 nt, Escherichia coli CFT073
gccgccgagcaaacc

SEQ ID NO: 647881 - RNA, 22 nt, Escherichia coli CFT073
gccgccgagcaaaccacaggcc

SEQ ID NO: 647882 - RNA, 17 nt, Escherichia coli CFT073
gccgcccguuuucucca

SEQ ID NO: 647883 - RNA, 18 nt, Escherichia coli CFT073
gccgccccagacuccagc

SEQ ID NO: 647884 - RNA, 11 nt, Escherichia coli CFT073
gccgcccagcg

SEQ ID NO: 647885 - RNA, 21 nt, Escherichia coli CFT073
gccgccauugacguucccuuc

SEQ ID NO: 647886 - RNA, 21 nt, Escherichia coli CFT073
gccgacgcgaagcacacauac

SEQ ID NO: 647887 - RNA, 13 nt, Escherichia coli CFT073
gccgacggucagg

SEQ ID NO: 647888 - RNA, 16 nt, Escherichia coli CFT073
gccgaguaaaaaaaca

SEQ ID NO: 647889 - RNA, 18 nt, Escherichia coli CFT073
gccgaugucauggcugac

SEQ ID NO: 647890 - RNA, 21 nt, Escherichia coli CFT073
gccgauuucaugaagcugaca

SEQ ID NO: 647891 - RNA, 16 nt, Escherichia coli CFT073
gccgauuaaucuucca

SEQ ID NO: 647892 - RNA, 15 nt, Escherichia coli CFT073
gccgaugucgcugca

SEQ ID NO: 647893 - RNA, 18 nt, Escherichia coli CFT073
gccgcacaagucagcaac

SEQ ID NO: 647894 - RNA, 18 nt, Escherichia coli CFT073
gccgcacaauacauagaa

SEQ ID NO: 647895 - RNA, 16 nt, Escherichia coli CFT073
gccgcaaucagccgga

SEQ ID NO: 647896 - RNA, 21 nt, Escherichia coli CFT073
gccgcacauuucccggccacg

SEQ ID NO: 647897 - RNA, 18 nt, Escherichia coli CFT073
gccgcaggcuguuacccc

SEQ ID NO: 647898 - RNA, 16 nt, Escherichia coli CFT073
gccgccaaacugugca

SEQ ID NO: 647899 - RNA, 17 nt, Escherichia coli CFT073
gccgcagguagcagcag

SEQ ID NO: 647900 - RNA, 19 nt, Escherichia coli CFT073
gccgccaaacgccgcaugu

SEQ ID NO: 647901 - RNA, 20 nt, Escherichia coli CFT073
gccgccauuccagccagaaa

SEQ ID NO: 647902 - RNA, 15 nt, Escherichia coli CFT073
gccgccauaaacagc

SEQ ID NO: 647903 - RNA, 15 nt, Escherichia coli CFT073
gccgccaucaccagu

SEQ ID NO: 647904 - RNA, 21 nt, Escherichia coli CFT073
gccgccauccugaaucaccug

SEQ ID NO: 647905 - RNA, 21 nt, Escherichia coli CFT073
gcccuuuuuuugucuguuugc

SEQ ID NO: 647906 - RNA, 18 nt, Escherichia coli CFT073
gcccuuuuuucuuacggu

SEQ ID NO: 647907 - RNA, 14 nt, Escherichia coli CFT073
gccgaagcagcugc

SEQ ID NO: 647908 - RNA, 13 nt, Escherichia coli CFT073
gccgaagaguuuu

SEQ ID NO: 647909 - RNA, 21 nt, Escherichia coli CFT073
gccgaagaguuuuaaacgcag

SEQ ID NO: 647910 - RNA, 23 nt, Escherichia coli CFT073
gccgaagccguuggucaucauca

SEQ ID NO: 647911 - RNA, 16 nt, Escherichia coli CFT073
gccgaagcgagcuuuu

SEQ ID NO: 647912 - RNA, 20 nt, Escherichia coli CFT073
aaagcggugauaaacccaac

SEQ ID NO: 647913 - RNA, 14 nt, Escherichia coli CFT073
aaagcggguuuuuu

SEQ ID NO: 647914 - RNA, 21 nt, Escherichia coli CFT073
aaagcguuuaucaauuaacug

SEQ ID NO: 647915 - RNA, 16 nt, Escherichia coli CFT073
aaagcguuccagcagc

SEQ ID NO: 647916 - RNA, 16 nt, Escherichia coli CFT073
aaagcguauccaucac

SEQ ID NO: 647917 - RNA, 23 nt, Escherichia coli CFT073
aaagcgucaagauggcucucauc

SEQ ID NO: 647918 - RNA, 22 nt, Escherichia coli CFT073
aaagcgucgccgccgccagcgc

SEQ ID NO: 647919 - RNA, 15 nt, Escherichia coli CFT073
gccgacagguggugu

SEQ ID NO: 647920 - RNA, 22 nt, Escherichia coli CFT073
gcccuuucugcauccguucuuc

SEQ ID NO: 647921 - RNA, 17 nt, Escherichia coli CFT073
gcccuuugcuggcauga

SEQ ID NO: 647922 - RNA, 13 nt, Escherichia coli CFT073
gcccuguucugca

SEQ ID NO: 647923 - RNA, 23 nt, Escherichia coli CFT073
gcccugggcuucauccagcagcg

SEQ ID NO: 647924 - RNA, 16 nt, Escherichia coli CFT073
gcccuuaccauuccca

SEQ ID NO: 647925 - RNA, 16 nt, Escherichia coli CFT073
gcccugauggcgcgcc

SEQ ID NO: 647926 - RNA, 16 nt, Escherichia coli CFT073
gcccugcaacugcugc

SEQ ID NO: 647927 - RNA, 22 nt, Escherichia coli CFT073
gcccugaucacccacaccaccg

SEQ ID NO: 647928 - RNA, 17 nt, Escherichia coli CFT073
gcccugaugcaucaaca

SEQ ID NO: 647929 - RNA, 12 nt, Escherichia coli CFT073
gcccugcaggga

SEQ ID NO: 647930 - RNA, 14 nt, Escherichia coli CFT073
gcccugccagcgau

SEQ ID NO: 647931 - RNA, 14 nt, Escherichia coli CFT073
gcccucugaauaac

SEQ ID NO: 647932 - RNA, 14 nt, Escherichia coli CFT073
gcccugaccgucaa

SEQ ID NO: 647933 - RNA, 21 nt, Escherichia coli CFT073
gcccuaacaggcgcacacgau

SEQ ID NO: 647934 - RNA, 12 nt, Escherichia coli CFT073
gcccguguuucu

SEQ ID NO: 647935 - RNA, 13 nt, Escherichia coli CFT073
gcccguucuuccu

SEQ ID NO: 647936 - RNA, 22 nt, Escherichia coli CFT073
gcccguucuucgccauaacaaa

SEQ ID NO: 647937 - RNA, 14 nt, Escherichia coli CFT073
gcccgugacgggug

SEQ ID NO: 647938 - RNA, 18 nt, Escherichia coli CFT073
gcccgccagugcaucagc

SEQ ID NO: 647939 - RNA, 14 nt, Escherichia coli CFT073
gcccgccgcugguc

SEQ ID NO: 647940 - RNA, 18 nt, Escherichia coli CFT073
gcccggucgggugcucau

SEQ ID NO: 647941 - RNA, 15 nt, Escherichia coli CFT073
gcccgguauccauca

SEQ ID NO: 647942 - RNA, 15 nt, Escherichia coli CFT073
gcccggugccgcguu

SEQ ID NO: 647943 - RNA, 22 nt, Escherichia coli CFT073
gcccguagcuucccauauguuc

SEQ ID NO: 647944 - RNA, 14 nt, Escherichia coli CFT073
gcccguaaacgggc

SEQ ID NO: 647945 - RNA, 22 nt, Escherichia coli CFT073
gccccaaugcguuccagcaugu

SEQ ID NO: 647946 - RNA, 15 nt, Escherichia coli CFT073
gccccacaagcccgc

SEQ ID NO: 647947 - RNA, 16 nt, Escherichia coli CFT073
gccccacagaguggug

SEQ ID NO: 647948 - RNA, 22 nt, Escherichia coli CFT073
gccccagaacucacgcacuucc

SEQ ID NO: 647949 - RNA, 20 nt, Escherichia coli CFT073
gccccacgccauaaccggcc

SEQ ID NO: 647950 - RNA, 19 nt, Escherichia coli CFT073
gccccagaauuuucccuuu

SEQ ID NO: 647951 - RNA, 16 nt, Escherichia coli CFT073
gccccagaccugaauu

SEQ ID NO: 647952 - RNA, 15 nt, Escherichia coli CFT073
gcccaugacaaacuc

SEQ ID NO: 647953 - RNA, 16 nt, Escherichia coli CFT073
gcccaugacaaacuca

SEQ ID NO: 647954 - RNA, 16 nt, Escherichia coli CFT073
gcccaugacaggcaga

SEQ ID NO: 647955 - RNA, 17 nt, Escherichia coli CFT073
gcccaugacaggcagac

SEQ ID NO: 647956 - RNA, 17 nt, Escherichia coli CFT073
gcccaugacauccccau

SEQ ID NO: 647957 - RNA, 16 nt, Escherichia coli CFT073
gcccaucguugaaaaa

SEQ ID NO: 647958 - RNA, 15 nt, Escherichia coli CFT073
gcccaguucagcggc

SEQ ID NO: 647959 - RNA, 15 nt, Escherichia coli CFT073
gcccagugccagcac

SEQ ID NO: 647960 - RNA, 22 nt, Escherichia coli CFT073
gcccagccgaagggaaagagcg

SEQ ID NO: 647961 - RNA, 18 nt, Escherichia coli CFT073
gcccagcgcggcagcggc

SEQ ID NO: 647962 - RNA, 19 nt, Escherichia coli CFT073
gcccagaccgugcgcagca

SEQ ID NO: 647963 - RNA, 13 nt, Escherichia coli CFT073
gcccaaucaaacu

SEQ ID NO: 647964 - RNA, 20 nt, Escherichia coli CFT073
gcccaaucaaacuuccggca

SEQ ID NO: 647965 - RNA, 19 nt, Escherichia coli CFT073
gcccagauacggcggacgu

SEQ ID NO: 647966 - RNA, 20 nt, Escherichia coli CFT073
gcccagaguggcgauauucu

SEQ ID NO: 647967 - RNA, 12 nt, Escherichia coli CFT073
gcccagaucacu

SEQ ID NO: 647968 - RNA, 14 nt, Escherichia coli CFT073
gcccagaucagacc

SEQ ID NO: 647969 - RNA, 14 nt, Escherichia coli CFT073
gcccccgccagcgc

SEQ ID NO: 647970 - RNA, 17 nt, Escherichia coli CFT073
gcccccaggagcgcggc

SEQ ID NO: 647971 - RNA, 12 nt, Escherichia coli CFT073
gccccaguuccu

SEQ ID NO: 647972 - RNA, 11 nt, Escherichia coli CFT073
gccccgcagcc

SEQ ID NO: 647973 - RNA, 13 nt, Escherichia coli CFT073
gccccgcagccga

SEQ ID NO: 647974 - RNA, 15 nt, Escherichia coli CFT073
gccccgcgcggcgca

SEQ ID NO: 647975 - RNA, 20 nt, Escherichia coli CFT073
gccccgcgcggcgcaggcgc

SEQ ID NO: 647976 - RNA, 19 nt, Escherichia coli CFT073
gccccauaugcagcacuug

SEQ ID NO: 647977 - RNA, 20 nt, Escherichia coli CFT073
gccccauaauauugccggga

SEQ ID NO: 647978 - RNA, 16 nt, Escherichia coli CFT073
gccccagucuuccugc

SEQ ID NO: 647979 - RNA, 18 nt, Escherichia coli CFT073
gccccaggcauagaaaaa

SEQ ID NO: 647980 - RNA, 14 nt, Escherichia coli CFT073
gccccagcguucgg

SEQ ID NO: 647981 - RNA, 17 nt, Escherichia coli CFT073
gccccuccgcacagggg

SEQ ID NO: 647982 - RNA, 17 nt, Escherichia coli CFT073
gccccggcaauaaaaca

SEQ ID NO: 647983 - RNA, 23 nt, Escherichia coli CFT073
gccccuggcgaugcccccaggag

SEQ ID NO: 647984 - RNA, 13 nt, Escherichia coli CFT073
gccccuggcgcag

SEQ ID NO: 647985 - RNA, 17 nt, Escherichia coli CFT073
gccccuggucgcgcggc

SEQ ID NO: 647986 - RNA, 21 nt, Escherichia coli CFT073
gccccuggaaaaaaugcccca

SEQ ID NO: 647987 - RNA, 23 nt, Escherichia coli CFT073
gccccuggaaaaaaugccccagu

SEQ ID NO: 647988 - RNA, 22 nt, Escherichia coli CFT073
gccccugagcgaauaccccagc

SEQ ID NO: 647989 - RNA, 16 nt, Escherichia coli CFT073
gcccgcauagcccagc

SEQ ID NO: 647990 - RNA, 19 nt, Escherichia coli CFT073
gcccgcagcguccagcgcc

SEQ ID NO: 647991 - RNA, 18 nt, Escherichia coli CFT073
gcccgcacaaagcacguu

SEQ ID NO: 647992 - RNA, 14 nt, Escherichia coli CFT073
gcccgcacaaagca

SEQ ID NO: 647993 - RNA, 22 nt, Escherichia coli CFT073
gccaucaccaguugugaugcca

SEQ ID NO: 647994 - RNA, 20 nt, Escherichia coli CFT073
gccaucacuauucagaucuu

SEQ ID NO: 647995 - RNA, 17 nt, Escherichia coli CFT073
gccauccaccagugacu

SEQ ID NO: 647996 - RNA, 15 nt, Escherichia coli CFT073
gccaucauuuugcua

SEQ ID NO: 647997 - RNA, 20 nt, Escherichia coli CFT073
gccaucaaucacuuugcgcu

SEQ ID NO: 647998 - RNA, 15 nt, Escherichia coli CFT073
gccauccagcucaag

SEQ ID NO: 647999 - RNA, 20 nt, Escherichia coli CFT073
gccauccccgccgguggcau

SEQ ID NO: 648000 - RNA, 22 nt, Escherichia coli CFT073
gccauccccgaagcuuguucag

SEQ ID NO: 648001 - RNA, 19 nt, Escherichia coli CFT073
gccauaaccugccagcagu

SEQ ID NO: 648002 - RNA, 19 nt, Escherichia coli CFT073
gccauaccaugcaccaacc

SEQ ID NO: 648003 - RNA, 15 nt, Escherichia coli CFT073
gccauaaucugcggg

SEQ ID NO: 648004 - RNA, 23 nt, Escherichia coli CFT073
gccauagacgagugguucaccag

SEQ ID NO: 648005 - RNA, 18 nt, Escherichia coli CFT073
gccauacccgccagugcc

SEQ ID NO: 648006 - RNA, 19 nt, Escherichia coli CFT073
gccauaaagaaaucaccug

SEQ ID NO: 648007 - RNA, 20 nt, Escherichia coli CFT073
gccauaaaaacgauaaauaa

SEQ ID NO: 648008 - RNA, 21 nt, Escherichia coli CFT073
gccaguuugcaggccaaacag

SEQ ID NO: 648009 - RNA, 17 nt, Escherichia coli CFT073
gccaguuugcgcgugcu

SEQ ID NO: 648010 - RNA, 22 nt, Escherichia coli CFT073
gccaguuuuucagcgccagcgc

SEQ ID NO: 648011 - RNA, 11 nt, Escherichia coli CFT073
gccauaaaagu

SEQ ID NO: 648012 - RNA, 16 nt, Escherichia coli CFT073
gccauaaaaucacagg

SEQ ID NO: 648013 - RNA, 20 nt, Escherichia coli CFT073
gccauaaacaccagcagcag

SEQ ID NO: 648014 - RNA, 14 nt, Escherichia coli CFT073
gccauaaacagcag

SEQ ID NO: 648015 - RNA, 19 nt, Escherichia coli CFT073
gccaguuucggacgcggca

SEQ ID NO: 648016 - RNA, 21 nt, Escherichia coli CFT073
gccaguuucgggaucaucuca

SEQ ID NO: 648017 - RNA, 16 nt, Escherichia coli CFT073
gccaguuucugcccaa

SEQ ID NO: 648018 - RNA, 21 nt, Escherichia coli CFT073
gccaguuucugcccaaucaaa

SEQ ID NO: 648019 - RNA, 18 nt, Escherichia coli CFT073
gccaguugcgcuucacga

SEQ ID NO: 648020 - RNA, 23 nt, Escherichia coli CFT073
gccaguuguugauaagccccagu

SEQ ID NO: 648021 - RNA, 19 nt, Escherichia coli CFT073
gccaguuuacccagugaau

SEQ ID NO: 648022 - RNA, 16 nt, Escherichia coli CFT073
gccauuugggcggcuu

SEQ ID NO: 648023 - RNA, 13 nt, Escherichia coli CFT073
gccauuuucauuu

SEQ ID NO: 648024 - RNA, 20 nt, Escherichia coli CFT073
gccauuuucauuuaagccac

SEQ ID NO: 648025 - RNA, 19 nt, Escherichia coli CFT073
gccauuucuggcuucucuu

SEQ ID NO: 648026 - RNA, 12 nt, Escherichia coli CFT073
gccauuugcucu

SEQ ID NO: 648027 - RNA, 19 nt, Escherichia coli CFT073
gccauuuuacucauggaau

SEQ ID NO: 648028 - RNA, 21 nt, Escherichia coli CFT073
gccauuuugcaccuucagaau

SEQ ID NO: 648029 - RNA, 11 nt, Escherichia coli CFT073
gccauuuucac

SEQ ID NO: 648030 - RNA, 15 nt, Escherichia coli CFT073
gccauuuuucagacg

SEQ ID NO: 648031 - RNA, 21 nt, Escherichia coli CFT073
gccauuuuuucgauaaucaaa

SEQ ID NO: 648032 - RNA, 20 nt, Escherichia coli CFT073
gccauuuuuuuaugcuucag

SEQ ID NO: 648033 - RNA, 13 nt, Escherichia coli CFT073
gccauuuccagcg

SEQ ID NO: 648034 - RNA, 20 nt, Escherichia coli CFT073
gccauuuccccaaucuucuc

SEQ ID NO: 648035 - RNA, 14 nt, Escherichia coli CFT073
gccauucuggcgca

SEQ ID NO: 648036 - RNA, 15 nt, Escherichia coli CFT073
gccauugaauuaaaa

SEQ ID NO: 648037 - RNA, 22 nt, Escherichia coli CFT073
gccauuccuggggucaucagca

SEQ ID NO: 648038 - RNA, 14 nt, Escherichia coli CFT073
gccauucacuucau

SEQ ID NO: 648039 - RNA, 18 nt, Escherichia coli CFT073
gccaugaccgcuccgcca

SEQ ID NO: 648040 - RNA, 14 nt, Escherichia coli CFT073
gccaugacgcacuu

SEQ ID NO: 648041 - RNA, 19 nt, Escherichia coli CFT073
gccaugaucguuaaaucca

SEQ ID NO: 648042 - RNA, 21 nt, Escherichia coli CFT073
gccaugauaagagagcaacag

SEQ ID NO: 648043 - RNA, 19 nt, Escherichia coli CFT073
gccaucgugcuucacuuca

SEQ ID NO: 648044 - RNA, 17 nt, Escherichia coli CFT073
gccaucguugaugcaua

SEQ ID NO: 648045 - RNA, 21 nt, Escherichia coli CFT073
gccaucucaguggugaguuua

SEQ ID NO: 648046 - RNA, 21 nt, Escherichia coli CFT073
gccauggcugcgauaguggaa

SEQ ID NO: 648047 - RNA, 16 nt, Escherichia coli CFT073
gccauggcauccaagc

SEQ ID NO: 648048 - RNA, 18 nt, Escherichia coli CFT073
gccauggcauccaagcug

SEQ ID NO: 648049 - RNA, 13 nt, Escherichia coli CFT073
gccaugccacgcu

SEQ ID NO: 648050 - RNA, 12 nt, Escherichia coli CFT073
gccaugcauauc

SEQ ID NO: 648051 - RNA, 21 nt, Escherichia coli CFT073
gccaggugaucccccugggcc

SEQ ID NO: 648052 - RNA, 17 nt, Escherichia coli CFT073
gccagguuuaccagcag

SEQ ID NO: 648053 - RNA, 20 nt, Escherichia coli CFT073
gccagguuuuagaucccacg

SEQ ID NO: 648054 - RNA, 18 nt, Escherichia coli CFT073
gccaggucgcuugccgcc

SEQ ID NO: 648055 - RNA, 21 nt, Escherichia coli CFT073
gccaggucgcuugccgccagu

SEQ ID NO: 648056 - RNA, 16 nt, Escherichia coli CFT073
gccaggucagagagcc

SEQ ID NO: 648057 - RNA, 14 nt, Escherichia coli CFT073
gccagguagcguuu

SEQ ID NO: 648058 - RNA, 20 nt, Escherichia coli CFT073
gccagguagcguuucaccuc

SEQ ID NO: 648059 - RNA, 16 nt, Escherichia coli CFT073
gccagguacucaugcc

SEQ ID NO: 648060 - RNA, 18 nt, Escherichia coli CFT073
gccacuucuggcggcggc

SEQ ID NO: 648061 - RNA, 19 nt, Escherichia coli CFT073
gccacuucuggcggcggca

SEQ ID NO: 648062 - RNA, 21 nt, Escherichia coli CFT073
gccacuucaaccagcggcgca

SEQ ID NO: 648063 - RNA, 15 nt, Escherichia coli CFT073
gccacuucauuuaug

SEQ ID NO: 648064 - RNA, 21 nt, Escherichia coli CFT073
gccagggauaagccagaccac

SEQ ID NO: 648065 - RNA, 21 nt, Escherichia coli CFT073
gccaggcuuuccgucagcggc

SEQ ID NO: 648066 - RNA, 21 nt, Escherichia coli CFT073
gccaggcuguucggaugaguc

SEQ ID NO: 648067 - RNA, 23 nt, Escherichia coli CFT073
gccaguguuuaucaucucggguu

SEQ ID NO: 648068 - RNA, 21 nt, Escherichia coli CFT073
gccaguguuucgacaauaauc

SEQ ID NO: 648069 - RNA, 16 nt, Escherichia coli CFT073
gccaguuaaccugcgc

SEQ ID NO: 648070 - RNA, 22 nt, Escherichia coli CFT073
gccaguuccacuucugcacggu

SEQ ID NO: 648071 - RNA, 17 nt, Escherichia coli CFT073
gccaguugacuuugaca

SEQ ID NO: 648072 - RNA, 14 nt, Escherichia coli CFT073
gccaguucucacca

SEQ ID NO: 648073 - RNA, 22 nt, Escherichia coli CFT073
gccaguucggaugugaaccuca

SEQ ID NO: 648074 - RNA, 18 nt, Escherichia coli CFT073
gccagugccugacgaaug

SEQ ID NO: 648075 - RNA, 16 nt, Escherichia coli CFT073
gccagugcgccccagg

SEQ ID NO: 648076 - RNA, 22 nt, Escherichia coli CFT073
gccagugcuacccccagacgac

SEQ ID NO: 648077 - RNA, 16 nt, Escherichia coli CFT073
gccagucuuccgccgg

SEQ ID NO: 648078 - RNA, 23 nt, Escherichia coli CFT073
gccagucguaaugaaucagcaga

SEQ ID NO: 648079 - RNA, 19 nt, Escherichia coli CFT073
gccaguaauccggcuuccu

SEQ ID NO: 648080 - RNA, 20 nt, Escherichia coli CFT073
gccaguaaucggcugaacgu

SEQ ID NO: 648081 - RNA, 20 nt, Escherichia coli CFT073
gccaguaaauggcgcuaaaa

SEQ ID NO: 648082 - RNA, 16 nt, Escherichia coli CFT073
gccaguaagguaacgc

SEQ ID NO: 648083 - RNA, 14 nt, Escherichia coli CFT073
gccaguaccagcag

SEQ ID NO: 648084 - RNA, 15 nt, Escherichia coli CFT073
gccaguaccagcagc

SEQ ID NO: 648085 - RNA, 18 nt, Escherichia coli CFT073
gccaguaccagcagcgcc

SEQ ID NO: 648086 - RNA, 17 nt, Escherichia coli CFT073
gccaguacagcccgccg

SEQ ID NO: 648087 - RNA, 21 nt, Escherichia coli CFT073
gccaguaccaucaaucuucac

SEQ ID NO: 648088 - RNA, 22 nt, Escherichia coli CFT073
gccaguagcaccucuccacgca

SEQ ID NO: 648089 - RNA, 14 nt, Escherichia coli CFT073
gccaguacgcgccc

SEQ ID NO: 648090 - RNA, 19 nt, Escherichia coli CFT073
gccaguaccgccgcaguca

SEQ ID NO: 648091 - RNA, 14 nt, Escherichia coli CFT073
gccaguagaacaau

SEQ ID NO: 648092 - RNA, 17 nt, Escherichia coli CFT073
gccaguagaacaauuaa

SEQ ID NO: 648093 - RNA, 22 nt, Escherichia coli CFT073
gccagucauuuucuucagcagu

SEQ ID NO: 648094 - RNA, 15 nt, Escherichia coli CFT073
gccagucauaauuca

SEQ ID NO: 648095 - RNA, 16 nt, Escherichia coli CFT073
gccagucccuuucagg

SEQ ID NO: 648096 - RNA, 13 nt, Escherichia coli CFT073
gccaguccagguu

SEQ ID NO: 648097 - RNA, 16 nt, Escherichia coli CFT073
gccaguccuucaauau

SEQ ID NO: 648098 - RNA, 23 nt, Escherichia coli CFT073
gccagucgcaaaucagcggcaga

SEQ ID NO: 648099 - RNA, 22 nt, Escherichia coli CFT073
gccaauaccgaucaguaccagc

SEQ ID NO: 648100 - RNA, 16 nt, Escherichia coli CFT073
gccaaucacaucaggc

SEQ ID NO: 648101 - RNA, 13 nt, Escherichia coli CFT073
gccaagcgccgcc

SEQ ID NO: 648102 - RNA, 20 nt, Escherichia coli CFT073
gccaagcgccgccucagcca

SEQ ID NO: 648103 - RNA, 12 nt, Escherichia coli CFT073
gccacaaagcua

SEQ ID NO: 648104 - RNA, 16 nt, Escherichia coli CFT073
gccaauguguuuauaa

SEQ ID NO: 648105 - RNA, 14 nt, Escherichia coli CFT073
gccaauuaagucaa

SEQ ID NO: 648106 - RNA, 13 nt, Escherichia coli CFT073
gccaauuacaaaa

SEQ ID NO: 648107 - RNA, 17 nt, Escherichia coli CFT073
gccaauuacgccugccc

SEQ ID NO: 648108 - RNA, 14 nt, Escherichia coli CFT073
gccaaucgacaggu

SEQ ID NO: 648109 - RNA, 12 nt, Escherichia coli CFT073
gccaaucggcaa

SEQ ID NO: 648110 - RNA, 22 nt, Escherichia coli CFT073
gccaauggaauagcgaagaaua

SEQ ID NO: 648111 - RNA, 13 nt, Escherichia coli CFT073
gccaaugauuuug

SEQ ID NO: 648112 - RNA, 18 nt, Escherichia coli CFT073
gccaaugcaggcaucggu

SEQ ID NO: 648113 - RNA, 13 nt, Escherichia coli CFT073
gccaacagcagcc

SEQ ID NO: 648114 - RNA, 12 nt, Escherichia coli CFT073
gccaacagcagc

SEQ ID NO: 648115 - RNA, 20 nt, Escherichia coli CFT073
gccaacagcgacaucaaauu

SEQ ID NO: 648116 - RNA, 21 nt, Escherichia coli CFT073
gccaacagugccgaugccgcu

SEQ ID NO: 648117 - RNA, 20 nt, Escherichia coli CFT073
gccaacauccaucagcguuu

SEQ ID NO: 648118 - RNA, 16 nt, Escherichia coli CFT073
gccaaaaccuuucacc

SEQ ID NO: 648119 - RNA, 19 nt, Escherichia coli CFT073
gccaaaaaggggaaaaauu

SEQ ID NO: 648120 - RNA, 11 nt, Escherichia coli CFT073
gccaaaaugcu

SEQ ID NO: 648121 - RNA, 14 nt, Escherichia coli CFT073
gccaaacaccaggc

SEQ ID NO: 648122 - RNA, 18 nt, Escherichia coli CFT073
gccaaacgcucccagcca

SEQ ID NO: 648123 - RNA, 19 nt, Escherichia coli CFT073
gccaaauuuggugcucagu

SEQ ID NO: 648124 - RNA, 16 nt, Escherichia coli CFT073
gccaacucaacgccug

SEQ ID NO: 648125 - RNA, 15 nt, Escherichia coli CFT073
gccaacuccaccaau

SEQ ID NO: 648126 - RNA, 19 nt, Escherichia coli CFT073
gccaacuccaccaauaaug

SEQ ID NO: 648127 - RNA, 14 nt, Escherichia coli CFT073
gccaacguuucugg

SEQ ID NO: 648128 - RNA, 15 nt, Escherichia coli CFT073
gccaagaaacaccag

SEQ ID NO: 648129 - RNA, 16 nt, Escherichia coli CFT073
gccaagauagaaccac

SEQ ID NO: 648130 - RNA, 19 nt, Escherichia coli CFT073
gccaacggggccagcacau

SEQ ID NO: 648131 - RNA, 16 nt, Escherichia coli CFT073
gccaacgcaaaugucu

SEQ ID NO: 648132 - RNA, 15 nt, Escherichia coli CFT073
gccaacgccugcggc

SEQ ID NO: 648133 - RNA, 18 nt, Escherichia coli CFT073
gccaacgccuuuaccacc

SEQ ID NO: 648134 - RNA, 22 nt, Escherichia coli CFT073
gccaacgaucuggcgucagcgg

SEQ ID NO: 648135 - RNA, 22 nt, Escherichia coli CFT073
gccaaccgcgacaauaucauca

SEQ ID NO: 648136 - RNA, 21 nt, Escherichia coli CFT073
gccaaccuugcggaagcguca

SEQ ID NO: 648137 - RNA, 21 nt, Escherichia coli CFT073
gccaacgaacacaugcccugc

SEQ ID NO: 648138 - RNA, 14 nt, Escherichia coli CFT073
gccacuaagcaggg

SEQ ID NO: 648139 - RNA, 14 nt, Escherichia coli CFT073
gccacuacccgcau

SEQ ID NO: 648140 - RNA, 19 nt, Escherichia coli CFT073
gccacucagcccauaccgu

SEQ ID NO: 648141 - RNA, 15 nt, Escherichia coli CFT073
gccacucaggcaaag

SEQ ID NO: 648142 - RNA, 21 nt, Escherichia coli CFT073
gccacucaggcaaagcuguuu

SEQ ID NO: 648143 - RNA, 14 nt, Escherichia coli CFT073
gccacuaucgccau

SEQ ID NO: 648144 - RNA, 19 nt, Escherichia coli CFT073
gccacguucaaucugguga

SEQ ID NO: 648145 - RNA, 13 nt, Escherichia coli CFT073
gccacgucaucag

SEQ ID NO: 648146 - RNA, 16 nt, Escherichia coli CFT073
gccacugccagcaaaa

SEQ ID NO: 648147 - RNA, 13 nt, Escherichia coli CFT073
gccacuggcuggg

SEQ ID NO: 648148 - RNA, 13 nt, Escherichia coli CFT073
gccacugcgccau

SEQ ID NO: 648149 - RNA, 14 nt, Escherichia coli CFT073
gccaccuuucuguu

SEQ ID NO: 648150 - RNA, 17 nt, Escherichia coli CFT073
gccacggcaugaaagcg

SEQ ID NO: 648151 - RNA, 18 nt, Escherichia coli CFT073
gccacgacgucgggcgga

SEQ ID NO: 648152 - RNA, 21 nt, Escherichia coli CFT073
gccacgguaucaagcccgccg

SEQ ID NO: 648153 - RNA, 15 nt, Escherichia coli CFT073
gccacgggccgaaug

SEQ ID NO: 648154 - RNA, 14 nt, Escherichia coli CFT073
gccacggcuccagc

SEQ ID NO: 648155 - RNA, 11 nt, Escherichia coli CFT073
gccacagcaag

SEQ ID NO: 648156 - RNA, 20 nt, Escherichia coli CFT073
gccacagcgccagacacugg

SEQ ID NO: 648157 - RNA, 14 nt, Escherichia coli CFT073
gccacagccuggga

SEQ ID NO: 648158 - RNA, 15 nt, Escherichia coli CFT073
gccaccauucccugg

SEQ ID NO: 648159 - RNA, 15 nt, Escherichia coli CFT073
gccacaggccgcugu

SEQ ID NO: 648160 - RNA, 19 nt, Escherichia coli CFT073
gccacagaauggcauuauu

SEQ ID NO: 648161 - RNA, 21 nt, Escherichia coli CFT073
gccacacgagucauuccugcc

SEQ ID NO: 648162 - RNA, 15 nt, Escherichia coli CFT073
gccaccccacaccag

SEQ ID NO: 648163 - RNA, 16 nt, Escherichia coli CFT073
gccacccacaccgcag

SEQ ID NO: 648164 - RNA, 18 nt, Escherichia coli CFT073
gccaccgaccaggcaaac

SEQ ID NO: 648165 - RNA, 21 nt, Escherichia coli CFT073
gccaccgaacaaaacagcgag

SEQ ID NO: 648166 - RNA, 18 nt, Escherichia coli CFT073
gccaccgccagaagaacc

SEQ ID NO: 648167 - RNA, 20 nt, Escherichia coli CFT073
gccaccgccagaagaaccgc

SEQ ID NO: 648168 - RNA, 15 nt, Escherichia coli CFT073
gccaccgcccagaga

SEQ ID NO: 648169 - RNA, 23 nt, Escherichia coli CFT073
gccaccggcuuucgcuucaacca

SEQ ID NO: 648170 - RNA, 17 nt, Escherichia coli CFT073
gccaccggcacauccag

SEQ ID NO: 648171 - RNA, 22 nt, Escherichia coli CFT073
gcauacgggauuuuacuuccca

SEQ ID NO: 648172 - RNA, 22 nt, Escherichia coli CFT073
gcauacuaauaucauugaaguu

SEQ ID NO: 648173 - RNA, 15 nt, Escherichia coli CFT073
gcauacucuccucca

SEQ ID NO: 648174 - RNA, 16 nt, Escherichia coli CFT073
gcauacucuccuccag

SEQ ID NO: 648175 - RNA, 23 nt, Escherichia coli CFT073
gcauacagcuuuuacagccaaug

SEQ ID NO: 648176 - RNA, 17 nt, Escherichia coli CFT073
gcauacauugccgcagu

SEQ ID NO: 648177 - RNA, 21 nt, Escherichia coli CFT073
gcauacauuuauuucaacgac

SEQ ID NO: 648178 - RNA, 16 nt, Escherichia coli CFT073
gcauaccuauuuaaau

SEQ ID NO: 648179 - RNA, 16 nt, Escherichia coli CFT073
gcauacaacgccauga

SEQ ID NO: 648180 - RNA, 20 nt, Escherichia coli CFT073
gcaguagcgucgccagcagu

SEQ ID NO: 648181 - RNA, 19 nt, Escherichia coli CFT073
gcaguacgucgagcaguug

SEQ ID NO: 648182 - RNA, 19 nt, Escherichia coli CFT073
gcauauagccaaagcacca

SEQ ID NO: 648183 - RNA, 18 nt, Escherichia coli CFT073
gcauauaugaauauugcu

SEQ ID NO: 648184 - RNA, 13 nt, Escherichia coli CFT073
gcauauccaggcu

SEQ ID NO: 648185 - RNA, 16 nt, Escherichia coli CFT073
gcauagugaucagccu

SEQ ID NO: 648186 - RNA, 23 nt, Escherichia coli CFT073
gcauagugaucagccucucucug

SEQ ID NO: 648187 - RNA, 17 nt, Escherichia coli CFT073
gcauagguugaaauaaa

SEQ ID NO: 648188 - RNA, 23 nt, Escherichia coli CFT073
gcauacugcgugucguaagccac

SEQ ID NO: 648189 - RNA, 14 nt, Escherichia coli CFT073
gcauacugauuacc

SEQ ID NO: 648190 - RNA, 15 nt, Escherichia coli CFT073
gcaucacuuccagua

SEQ ID NO: 648191 - RNA, 12 nt, Escherichia coli CFT073
gcaucacuccag

SEQ ID NO: 648192 - RNA, 21 nt, Escherichia coli CFT073
gcaucacugacaucacgccac

SEQ ID NO: 648193 - RNA, 20 nt, Escherichia coli CFT073
gcaucacgguaccuaccggu

SEQ ID NO: 648194 - RNA, 17 nt, Escherichia coli CFT073
gcaucacgacagcacca

SEQ ID NO: 648195 - RNA, 19 nt, Escherichia coli CFT073
gcaucacgacagcaccacu

SEQ ID NO: 648196 - RNA, 19 nt, Escherichia coli CFT073
gcaucacauugcguaaauc

SEQ ID NO: 648197 - RNA, 17 nt, Escherichia coli CFT073
gcaucaauuacuucugg

SEQ ID NO: 648198 - RNA, 17 nt, Escherichia coli CFT073
gcaucaaguugauuuuu

SEQ ID NO: 648199 - RNA, 14 nt, Escherichia coli CFT073
gcaucccggcagga

SEQ ID NO: 648200 - RNA, 16 nt, Escherichia coli CFT073
gcauccgacuuugaag

SEQ ID NO: 648201 - RNA, 21 nt, Escherichia coli CFT073
gcaucccgguaucaaagcgcc

SEQ ID NO: 648202 - RNA, 23 nt, Escherichia coli CFT073
gcaucccgguaucaaagcgccag

SEQ ID NO: 648203 - RNA, 17 nt, Escherichia coli CFT073
gcauccggcaaucaacg

SEQ ID NO: 648204 - RNA, 19 nt, Escherichia coli CFT073
gcauccggcaauccgugca

SEQ ID NO: 648205 - RNA, 16 nt, Escherichia coli CFT073
gcauccgccagcagcu

SEQ ID NO: 648206 - RNA, 20 nt, Escherichia coli CFT073
gcauccggcaguauuaccag

SEQ ID NO: 648207 - RNA, 14 nt, Escherichia coli CFT073
gcauccggcaugaa

SEQ ID NO: 648208 - RNA, 20 nt, Escherichia coli CFT073
gcauccggcaugaacaaagc

SEQ ID NO: 648209 - RNA, 20 nt, Escherichia coli CFT073
gcauccggcauuugagcagg

SEQ ID NO: 648210 - RNA, 21 nt, Escherichia coli CFT073
gcauccggcauuugagcagga

SEQ ID NO: 648211 - RNA, 22 nt, Escherichia coli CFT073
gcaucagcagauaccaacccug

SEQ ID NO: 648212 - RNA, 21 nt, Escherichia coli CFT073
gcaucagacccacccaacaug

SEQ ID NO: 648213 - RNA, 13 nt, Escherichia coli CFT073
gcaucccaggcau

SEQ ID NO: 648214 - RNA, 18 nt, Escherichia coli CFT073
gcaucccauugcgugcag

SEQ ID NO: 648215 - RNA, 15 nt, Escherichia coli CFT073
gcaucaggcaaaaga

SEQ ID NO: 648216 - RNA, 13 nt, Escherichia coli CFT073
gcauccaguucca

SEQ ID NO: 648217 - RNA, 21 nt, Escherichia coli CFT073
gcauccaguugcauacauaaa

SEQ ID NO: 648218 - RNA, 22 nt, Escherichia coli CFT073
gcauccauaucgccauugcugg

SEQ ID NO: 648219 - RNA, 16 nt, Escherichia coli CFT073
gcaucagcgcuaccag

SEQ ID NO: 648220 - RNA, 22 nt, Escherichia coli CFT073
gcaucggcaacgaaauagccag

SEQ ID NO: 648221 - RNA, 21 nt, Escherichia coli CFT073
gcaucgcuaaucuggcggauc

SEQ ID NO: 648222 - RNA, 13 nt, Escherichia coli CFT073
gcaucggcaucaa

SEQ ID NO: 648223 - RNA, 23 nt, Escherichia coli CFT073
gcaucgcgacagugcauaaauac

SEQ ID NO: 648224 - RNA, 15 nt, Escherichia coli CFT073
gcaucgcgcaccagc

SEQ ID NO: 648225 - RNA, 18 nt, Escherichia coli CFT073
gcauccgguuaucgccug

SEQ ID NO: 648226 - RNA, 17 nt, Escherichia coli CFT073
gcauccggccaucagua

SEQ ID NO: 648227 - RNA, 22 nt, Escherichia coli CFT073
gcauccggcuuaaauccaaacu

SEQ ID NO: 648228 - RNA, 20 nt, Escherichia coli CFT073
gcauuuuuuauggagaaaac

SEQ ID NO: 648229 - RNA, 15 nt, Escherichia coli CFT073
gcauuuaaacgagaa

SEQ ID NO: 648230 - RNA, 14 nt, Escherichia coli CFT073
gcauugaaguuuaa

SEQ ID NO: 648231 - RNA, 22 nt, Escherichia coli CFT073
gcauuguauauugcagcaacga

SEQ ID NO: 648232 - RNA, 22 nt, Escherichia coli CFT073
gcauugacgauaucgauaaaga

SEQ ID NO: 648233 - RNA, 12 nt, Escherichia coli CFT073
gcauucuucuga

SEQ ID NO: 648234 - RNA, 22 nt, Escherichia coli CFT073
gcauuaaaaagcccugcaggga

SEQ ID NO: 648235 - RNA, 19 nt, Escherichia coli CFT073
gcauuaaauaccaagccaa

SEQ ID NO: 648236 - RNA, 17 nt, Escherichia coli CFT073
gcauguuguuuucaacu

SEQ ID NO: 648237 - RNA, 23 nt, Escherichia coli CFT073
gcauuaacaguagagccgccagu

SEQ ID NO: 648238 - RNA, 13 nt, Escherichia coli CFT073
gcauuacugcuau

SEQ ID NO: 648239 - RNA, 17 nt, Escherichia coli CFT073
gcauuagcaaugcccug

SEQ ID NO: 648240 - RNA, 15 nt, Escherichia coli CFT073
gcauuagcaguuacu

SEQ ID NO: 648241 - RNA, 19 nt, Escherichia coli CFT073
gcauuagcaucaagaaaaa

SEQ ID NO: 648242 - RNA, 20 nt, Escherichia coli CFT073
gcaugucuugccucccugca

SEQ ID NO: 648243 - RNA, 19 nt, Escherichia coli CFT073
gcauguuaccgauagauuu

SEQ ID NO: 648244 - RNA, 22 nt, Escherichia coli CFT073
gcauguucauaucaaaaccuaa

SEQ ID NO: 648245 - RNA, 22 nt, Escherichia coli CFT073
gcauucucccgccugcggggag

SEQ ID NO: 648246 - RNA, 22 nt, Escherichia coli CFT073
gcauuaacgcgaaauaaucaaa

SEQ ID NO: 648247 - RNA, 18 nt, Escherichia coli CFT073
gcauuacuggcuguauau

SEQ ID NO: 648248 - RNA, 16 nt, Escherichia coli CFT073
gcauuagcauuaacag

SEQ ID NO: 648249 - RNA, 17 nt, Escherichia coli CFT073
gcauuauccucaaugaa

SEQ ID NO: 648250 - RNA, 19 nt, Escherichia coli CFT073
gcauuauccucaaugaauc

SEQ ID NO: 648251 - RNA, 14 nt, Escherichia coli CFT073
gcauuaucgagcug

SEQ ID NO: 648252 - RNA, 22 nt, Escherichia coli CFT073
gcaucgucacgcgcgccaagcc

SEQ ID NO: 648253 - RNA, 22 nt, Escherichia coli CFT073
gcaucguaguuuuugcccauca

SEQ ID NO: 648254 - RNA, 22 nt, Escherichia coli CFT073
gcaucguauuggugcauaacac

SEQ ID NO: 648255 - RNA, 18 nt, Escherichia coli CFT073
gcaucguauuucagaccu

SEQ ID NO: 648256 - RNA, 19 nt, Escherichia coli CFT073
gcaucguauuucagaccug

SEQ ID NO: 648257 - RNA, 13 nt, Escherichia coli CFT073
gcaucuuuuucaa

SEQ ID NO: 648258 - RNA, 16 nt, Escherichia coli CFT073
gcaugaacauugcugc

SEQ ID NO: 648259 - RNA, 16 nt, Escherichia coli CFT073
gcaugaacaaagcuca

SEQ ID NO: 648260 - RNA, 16 nt, Escherichia coli CFT073
gcaugaacaaaucgca

SEQ ID NO: 648261 - RNA, 22 nt, Escherichia coli CFT073
gcaugaacgccugauucggccu

SEQ ID NO: 648262 - RNA, 19 nt, Escherichia coli CFT073
gcaugaauaucaaguuuau

SEQ ID NO: 648263 - RNA, 17 nt, Escherichia coli CFT073
gcaugagugccagauug

SEQ ID NO: 648264 - RNA, 15 nt, Escherichia coli CFT073
gcaugguauaaggag

SEQ ID NO: 648265 - RNA, 19 nt, Escherichia coli CFT073
gcagcgcauaagccacaau

SEQ ID NO: 648266 - RNA, 17 nt, Escherichia coli CFT073
gcagcgcaaucgccucc

SEQ ID NO: 648267 - RNA, 14 nt, Escherichia coli CFT073
gcagccuccccagc

SEQ ID NO: 648268 - RNA, 17 nt, Escherichia coli CFT073
gcagccuuucacaucag

SEQ ID NO: 648269 - RNA, 23 nt, Escherichia coli CFT073
gcagccgucgccaguaccagcag

SEQ ID NO: 648270 - RNA, 14 nt, Escherichia coli CFT073
gcagccccagcgca

SEQ ID NO: 648271 - RNA, 16 nt, Escherichia coli CFT073
gcagcgugccaggcgc

SEQ ID NO: 648272 - RNA, 19 nt, Escherichia coli CFT073
gcagcgugccaggcgcgcu

SEQ ID NO: 648273 - RNA, 23 nt, Escherichia coli CFT073
gcagcguucauaaauacagagca

SEQ ID NO: 648274 - RNA, 18 nt, Escherichia coli CFT073
gcagcgugcucucaaaua

SEQ ID NO: 648275 - RNA, 19 nt, Escherichia coli CFT073
gcagcgugcucucaaauau

SEQ ID NO: 648276 - RNA, 23 nt, Escherichia coli CFT073
gcagcgucgcauccaacaauaaa

SEQ ID NO: 648277 - RNA, 15 nt, Escherichia coli CFT073
gcagcggcggcacug

SEQ ID NO: 648278 - RNA, 18 nt, Escherichia coli CFT073
gcagcggaggcgauaaug

SEQ ID NO: 648279 - RNA, 17 nt, Escherichia coli CFT073
gcagcggcuuccccaac

SEQ ID NO: 648280 - RNA, 16 nt, Escherichia coli CFT073
gcagcgcauuguuucu

SEQ ID NO: 648281 - RNA, 24 nt, Escherichia coli CFT073
gcagcgccacacgagucauuccug

SEQ ID NO: 648282 - RNA, 17 nt, Escherichia coli CFT073
gcagcgcgugcgccacc

SEQ ID NO: 648283 - RNA, 21 nt, Escherichia coli CFT073
gcagcgcuggagagcgccggg

SEQ ID NO: 648284 - RNA, 23 nt, Escherichia coli CFT073
gcagcgcuggagagcgccgggca

SEQ ID NO: 648285 - RNA, 17 nt, Escherichia coli CFT073
gcaggccaggguaaaaa

SEQ ID NO: 648286 - RNA, 16 nt, Escherichia coli CFT073
gcaggccccgucagca

SEQ ID NO: 648287 - RNA, 14 nt, Escherichia coli CFT073
gcaggcgcugaaaa

SEQ ID NO: 648288 - RNA, 19 nt, Escherichia coli CFT073
gcaggcguaacacucgugc

SEQ ID NO: 648289 - RNA, 14 nt, Escherichia coli CFT073
gcaggcuucaacac

SEQ ID NO: 648290 - RNA, 14 nt, Escherichia coli CFT073
gcaggcaucgguga

SEQ ID NO: 648291 - RNA, 19 nt, Escherichia coli CFT073
gcaggcaucggugaugcuc

SEQ ID NO: 648292 - RNA, 15 nt, Escherichia coli CFT073
gcaggcacuugguuu

SEQ ID NO: 648293 - RNA, 16 nt, Escherichia coli CFT073
gcaggcaauuucgccu

SEQ ID NO: 648294 - RNA, 18 nt, Escherichia coli CFT073
gcaggcacaaaaccugcc

SEQ ID NO: 648295 - RNA, 20 nt, Escherichia coli CFT073
gcaggcaaaucgcucccucu

SEQ ID NO: 648296 - RNA, 16 nt, Escherichia coli CFT073
gcaggcaaauuauuaa

SEQ ID NO: 648297 - RNA, 15 nt, Escherichia coli CFT073
gcagcuccugcucug

SEQ ID NO: 648298 - RNA, 15 nt, Escherichia coli CFT073
gcagcucuaucugca

SEQ ID NO: 648299 - RNA, 19 nt, Escherichia coli CFT073
gcagcucuuuauccagcag

SEQ ID NO: 648300 - RNA, 18 nt, Escherichia coli CFT073
gcagguuggaauaaacaa

SEQ ID NO: 648301 - RNA, 20 nt, Escherichia coli CFT073
gcaguaccagauaaucaccc

SEQ ID NO: 648302 - RNA, 21 nt, Escherichia coli CFT073
gcaguaccagauaaucacccg

SEQ ID NO: 648303 - RNA, 14 nt, Escherichia coli CFT073
gcaggcuucaauuu

SEQ ID NO: 648304 - RNA, 15 nt, Escherichia coli CFT073
gcagggcaaacagca

SEQ ID NO: 648305 - RNA, 18 nt, Escherichia coli CFT073
gcagguacgguacugaaa

SEQ ID NO: 648306 - RNA, 20 nt, Escherichia coli CFT073
gcagguaagaguuucaacau

SEQ ID NO: 648307 - RNA, 14 nt, Escherichia coli CFT073
gcagguaaucugcc

SEQ ID NO: 648308 - RNA, 18 nt, Escherichia coli CFT073
gcagguccacgaccagcg

SEQ ID NO: 648309 - RNA, 13 nt, Escherichia coli CFT073
gcaggucaagguc

SEQ ID NO: 648310 - RNA, 22 nt, Escherichia coli CFT073
gcagguagcgccuuuacugaca

SEQ ID NO: 648311 - RNA, 17 nt, Escherichia coli CFT073
gcagccaacucuucuuc

SEQ ID NO: 648312 - RNA, 21 nt, Escherichia coli CFT073
gcagcauuucaaaacggucac

SEQ ID NO: 648313 - RNA, 15 nt, Escherichia coli CFT073
gcagcauuuccucaa

SEQ ID NO: 648314 - RNA, 17 nt, Escherichia coli CFT073
gcagcauucaucacaaa

SEQ ID NO: 648315 - RNA, 13 nt, Escherichia coli CFT073
gcagcauggguaa

SEQ ID NO: 648316 - RNA, 19 nt, Escherichia coli CFT073
gcagcauggucgcagcggc

SEQ ID NO: 648317 - RNA, 16 nt, Escherichia coli CFT073
gcagccagaacucauc

SEQ ID NO: 648318 - RNA, 18 nt, Escherichia coli CFT073
gcagccagcacugccgca

SEQ ID NO: 648319 - RNA, 19 nt, Escherichia coli CFT073
gcagccaggccauuuuuuc

SEQ ID NO: 648320 - RNA, 14 nt, Escherichia coli CFT073
gcagcauagaagaa

SEQ ID NO: 648321 - RNA, 17 nt, Escherichia coli CFT073
gcagcaguccuggcgcu

SEQ ID NO: 648322 - RNA, 17 nt, Escherichia coli CFT073
gcagcaggaucagaccg

SEQ ID NO: 648323 - RNA, 14 nt, Escherichia coli CFT073
gcagcagcgccaac

SEQ ID NO: 648324 - RNA, 16 nt, Escherichia coli CFT073
gcagcagcgccaggca

SEQ ID NO: 648325 - RNA, 18 nt, Escherichia coli CFT073
gcagcagcgccaggcaca

SEQ ID NO: 648326 - RNA, 17 nt, Escherichia coli CFT073
gcagcacucgauuccaa

SEQ ID NO: 648327 - RNA, 17 nt, Escherichia coli CFT073
gcagcacggugcgggcu

SEQ ID NO: 648328 - RNA, 15 nt, Escherichia coli CFT073
gcagcacuugcagca

SEQ ID NO: 648329 - RNA, 13 nt, Escherichia coli CFT073
gcagcagaugauc

SEQ ID NO: 648330 - RNA, 21 nt, Escherichia coli CFT073
gcagcagacgcaucgcccagc

SEQ ID NO: 648331 - RNA, 19 nt, Escherichia coli CFT073
gcagcacccugaguuuuca

SEQ ID NO: 648332 - RNA, 13 nt, Escherichia coli CFT073
gcagcacgcugga

SEQ ID NO: 648333 - RNA, 18 nt, Escherichia coli CFT073
gcagcaacaucacgcuga

SEQ ID NO: 648334 - RNA, 17 nt, Escherichia coli CFT073
gcagcaaacgguuauga

SEQ ID NO: 648335 - RNA, 22 nt, Escherichia coli CFT073
gcagcaaagacgaugaaugcaa

SEQ ID NO: 648336 - RNA, 22 nt, Escherichia coli CFT073
gcagcaaagcccgggcacauca

SEQ ID NO: 648337 - RNA, 23 nt, Escherichia coli CFT073
gcagcaaagcccgggcacaucac

SEQ ID NO: 648338 - RNA, 13 nt, Escherichia coli CFT073
gcagauuugccag

SEQ ID NO: 648339 - RNA, 17 nt, Escherichia coli CFT073
gcagauuuuuauuaaua

SEQ ID NO: 648340 - RNA, 15 nt, Escherichia coli CFT073
gcagcaaaagcaggc

SEQ ID NO: 648341 - RNA, 18 nt, Escherichia coli CFT073
gcagcaaaagcaggcacc

SEQ ID NO: 648342 - RNA, 18 nt, Escherichia coli CFT073
gcagcaacuuaaucauca

SEQ ID NO: 648343 - RNA, 19 nt, Escherichia coli CFT073
gcagcacccagaacgccga

SEQ ID NO: 648344 - RNA, 17 nt, Escherichia coli CFT073
gcagcacacgauuccaa

SEQ ID NO: 648345 - RNA, 18 nt, Escherichia coli CFT073
gcagcaaugcuuacuugc

SEQ ID NO: 648346 - RNA, 16 nt, Escherichia coli CFT073
gcagcaauggcacugu

SEQ ID NO: 648347 - RNA, 13 nt, Escherichia coli CFT073
gcagcaaguauuc

SEQ ID NO: 648348 - RNA, 20 nt, Escherichia coli CFT073
gcagcaaguauucacucugc

SEQ ID NO: 648349 - RNA, 21 nt, Escherichia coli CFT073
gcagcaauauagcgcauggca

SEQ ID NO: 648350 - RNA, 16 nt, Escherichia coli CFT073
gcagcaaucacugcca

SEQ ID NO: 648351 - RNA, 22 nt, Escherichia coli CFT073
gcagaaugaaugauacagaaag

SEQ ID NO: 648352 - RNA, 20 nt, Escherichia coli CFT073
gcagaaugguaacaccagag

SEQ ID NO: 648353 - RNA, 22 nt, Escherichia coli CFT073
gcagaaaccaggucaaugcaac

SEQ ID NO: 648354 - RNA, 15 nt, Escherichia coli CFT073
gcagaacauccagcu

SEQ ID NO: 648355 - RNA, 22 nt, Escherichia coli CFT073
gcagaaauaccccgccagcaga

SEQ ID NO: 648356 - RNA, 23 nt, Escherichia coli CFT073
gcagaagcgauaaccuucaccgu

SEQ ID NO: 648357 - RNA, 20 nt, Escherichia coli CFT073
gcagaacggugcgaccaaac

SEQ ID NO: 648358 - RNA, 17 nt, Escherichia coli CFT073
gcagaacguccgcagga

SEQ ID NO: 648359 - RNA, 17 nt, Escherichia coli CFT073
gcagacaugaccacaaa

SEQ ID NO: 648360 - RNA, 13 nt, Escherichia coli CFT073
gcagaccagagcu

SEQ ID NO: 648361 - RNA, 15 nt, Escherichia coli CFT073
gcagaccaucgucag

SEQ ID NO: 648362 - RNA, 17 nt, Escherichia coli CFT073
gcagaccaucgucagua

SEQ ID NO: 648363 - RNA, 19 nt, Escherichia coli CFT073
gcagagaaacgccagcagc

SEQ ID NO: 648364 - RNA, 21 nt, Escherichia coli CFT073
gcagagaaacgccagcagcag

SEQ ID NO: 648365 - RNA, 17 nt, Escherichia coli CFT073
gcagagauacaggccac

SEQ ID NO: 648366 - RNA, 21 nt, Escherichia coli CFT073
gcagacugugccguggcgcuc

SEQ ID NO: 648367 - RNA, 13 nt, Escherichia coli CFT073
gcagacggcuguc

SEQ ID NO: 648368 - RNA, 14 nt, Escherichia coli CFT073
gcagacggcuuucu

SEQ ID NO: 648369 - RNA, 20 nt, Escherichia coli CFT073
gcagacguucuucugcuuca

SEQ ID NO: 648370 - RNA, 13 nt, Escherichia coli CFT073
gcagauaaccacu

SEQ ID NO: 648371 - RNA, 13 nt, Escherichia coli CFT073
gcagauaacccag

SEQ ID NO: 648372 - RNA, 14 nt, Escherichia coli CFT073
gcagauaacccagc

SEQ ID NO: 648373 - RNA, 16 nt, Escherichia coli CFT073
gcagauaacccagcag

SEQ ID NO: 648374 - RNA, 20 nt, Escherichia coli CFT073
gcagauagggcgagaaauug

SEQ ID NO: 648375 - RNA, 17 nt, Escherichia coli CFT073
gcagauaucccgccagc

SEQ ID NO: 648376 - RNA, 23 nt, Escherichia coli CFT073
gcagaggugccugucagcccaaa

SEQ ID NO: 648377 - RNA, 17 nt, Escherichia coli CFT073
gcagaguaaaccgccug

SEQ ID NO: 648378 - RNA, 15 nt, Escherichia coli CFT073
gcagaguaucgccau

SEQ ID NO: 648379 - RNA, 20 nt, Escherichia coli CFT073
gcagagauacaggccaccgc

SEQ ID NO: 648380 - RNA, 23 nt, Escherichia coli CFT073
gcagagaucauacagaugcugcu

SEQ ID NO: 648381 - RNA, 20 nt, Escherichia coli CFT073
gcagagcauccuuguacucu

SEQ ID NO: 648382 - RNA, 14 nt, Escherichia coli CFT073
gcagauauugcacc

SEQ ID NO: 648383 - RNA, 16 nt, Escherichia coli CFT073
gcagauccaucgccug

SEQ ID NO: 648384 - RNA, 20 nt, Escherichia coli CFT073
gcagauccauugcgaauaag

SEQ ID NO: 648385 - RNA, 16 nt, Escherichia coli CFT073
gcagaucccacucauc

SEQ ID NO: 648386 - RNA, 15 nt, Escherichia coli CFT073
gcagaucgcggccua

SEQ ID NO: 648387 - RNA, 23 nt, Escherichia coli CFT073
gcagaugcgucuucugcagucac

SEQ ID NO: 648388 - RNA, 14 nt, Escherichia coli CFT073
gcagaugcucuuca

SEQ ID NO: 648389 - RNA, 23 nt, Escherichia coli CFT073
gcagaugcugugccuccugcggc

SEQ ID NO: 648390 - RNA, 22 nt, Escherichia coli CFT073
gcagaugacucgccgcaaaacc

SEQ ID NO: 648391 - RNA, 17 nt, Escherichia coli CFT073
gcagaaaauccagcaga

SEQ ID NO: 648392 - RNA, 11 nt, Escherichia coli CFT073
gcagaaacaac

SEQ ID NO: 648393 - RNA, 13 nt, Escherichia coli CFT073
gcacuuuuucauc

SEQ ID NO: 648394 - RNA, 21 nt, Escherichia coli CFT073
gcacuuucuccggcagcuuua

SEQ ID NO: 648395 - RNA, 12 nt, Escherichia coli CFT073
gcacuugcagga

SEQ ID NO: 648396 - RNA, 19 nt, Escherichia coli CFT073
gcacuucacccaucgccag

SEQ ID NO: 648397 - RNA, 20 nt, Escherichia coli CFT073
gcacuucacccaucgccaga

SEQ ID NO: 648398 - RNA, 10 nt, Escherichia coli CFT073
gcacuucuga

SEQ ID NO: 648399 - RNA, 20 nt, Escherichia coli CFT073
gcacuggguucaucuuccag

SEQ ID NO: 648400 - RNA, 17 nt, Escherichia coli CFT073
gcacuuacuuuccuaaa

SEQ ID NO: 648401 - RNA, 15 nt, Escherichia coli CFT073
gcacuucaaauuuca

SEQ ID NO: 648402 - RNA, 12 nt, Escherichia coli CFT073
gcacuucaacuu

SEQ ID NO: 648403 - RNA, 16 nt, Escherichia coli CFT073
gcacuguuucgccagg

SEQ ID NO: 648404 - RNA, 19 nt, Escherichia coli CFT073
gcacugcuuaaauuucuua

SEQ ID NO: 648405 - RNA, 22 nt, Escherichia coli CFT073
gcacuggcaagaaacgcuccac

SEQ ID NO: 648406 - RNA, 14 nt, Escherichia coli CFT073
gcacuggcgagcgc

SEQ ID NO: 648407 - RNA, 14 nt, Escherichia coli CFT073
gcacuggcgcgccu

SEQ ID NO: 648408 - RNA, 19 nt, Escherichia coli CFT073
gcacuggcgcgccuguugc

SEQ ID NO: 648409 - RNA, 16 nt, Escherichia coli CFT073
gcacugcgcccgccag

SEQ ID NO: 648410 - RNA, 18 nt, Escherichia coli CFT073
gcacugcgcccgccagca

SEQ ID NO: 648411 - RNA, 22 nt, Escherichia coli CFT073
gcacugcauucggcgaccagcg

SEQ ID NO: 648412 - RNA, 15 nt, Escherichia coli CFT073
gcacguccaguggca

SEQ ID NO: 648413 - RNA, 16 nt, Escherichia coli CFT073
gcacuaagaaucgccg

SEQ ID NO: 648414 - RNA, 21 nt, Escherichia coli CFT073
gcacuaaucgggccgacaaaa

SEQ ID NO: 648415 - RNA, 16 nt, Escherichia coli CFT073
gcacuaccuugcuucu

SEQ ID NO: 648416 - RNA, 19 nt, Escherichia coli CFT073
gcacuaccuugcuucuuac

SEQ ID NO: 648417 - RNA, 17 nt, Escherichia coli CFT073
gcacuacgcagggauau

SEQ ID NO: 648418 - RNA, 17 nt, Escherichia coli CFT073
gcacguuuugcggaugu

SEQ ID NO: 648419 - RNA, 16 nt, Escherichia coli CFT073
gcacguugccagcaac

SEQ ID NO: 648420 - RNA, 22 nt, Escherichia coli CFT073
gcacugauauugugagcaugug

SEQ ID NO: 648421 - RNA, 16 nt, Escherichia coli CFT073
gcacugaccaccacca

SEQ ID NO: 648422 - RNA, 21 nt, Escherichia coli CFT073
gcacugacugacagacugcuu

SEQ ID NO: 648423 - RNA, 22 nt, Escherichia coli CFT073
gcacugaguuacguccauguag

SEQ ID NO: 648424 - RNA, 20 nt, Escherichia coli CFT073
gcacugauaaucccggcggc

SEQ ID NO: 648425 - RNA, 22 nt, Escherichia coli CFT073
gcacucugugcgucugcuuuua

SEQ ID NO: 648426 - RNA, 19 nt, Escherichia coli CFT073
gcacugaaagagucgccag

SEQ ID NO: 648427 - RNA, 23 nt, Escherichia coli CFT073
gcacucuccuccguuaaccugga

SEQ ID NO: 648428 - RNA, 14 nt, Escherichia coli CFT073
gcacuccgccgcac

SEQ ID NO: 648429 - RNA, 15 nt, Escherichia coli CFT073
gcacuccgccgcaca

SEQ ID NO: 648430 - RNA, 15 nt, Escherichia coli CFT073
gcacucacgccaggc

SEQ ID NO: 648431 - RNA, 16 nt, Escherichia coli CFT073
gcacucacgccaggca

SEQ ID NO: 648432 - RNA, 16 nt, Escherichia coli CFT073
gcacucauuuucucuu

SEQ ID NO: 648433 - RNA, 18 nt, Escherichia coli CFT073
gcacucagguaacaggga

SEQ ID NO: 648434 - RNA, 15 nt, Escherichia coli CFT073
gcacggucacuacac

SEQ ID NO: 648435 - RNA, 14 nt, Escherichia coli CFT073
gcacgguggcuggc

SEQ ID NO: 648436 - RNA, 17 nt, Escherichia coli CFT073
gcacgguggcuggcgcg

SEQ ID NO: 648437 - RNA, 14 nt, Escherichia coli CFT073
gcacggcguuuauu

SEQ ID NO: 648438 - RNA, 19 nt, Escherichia coli CFT073
gcacggcgcaccgcacugg

SEQ ID NO: 648439 - RNA, 12 nt, Escherichia coli CFT073
gcacggcagcaa

SEQ ID NO: 648440 - RNA, 16 nt, Escherichia coli CFT073
gcacggaguaacaaau

SEQ ID NO: 648441 - RNA, 16 nt, Escherichia coli CFT073
gcacgcuggagaauaa

SEQ ID NO: 648442 - RNA, 18 nt, Escherichia coli CFT073
gcacgcguaauauccagc

SEQ ID NO: 648443 - RNA, 20 nt, Escherichia coli CFT073
gcacgcguaauauccagcgu

SEQ ID NO: 648444 - RNA, 12 nt, Escherichia coli CFT073
gcacgcggaggg

SEQ ID NO: 648445 - RNA, 19 nt, Escherichia coli CFT073
gcaccuucauucaggccaa

SEQ ID NO: 648446 - RNA, 23 nt, Escherichia coli CFT073
gcaccuucauucaggccaaagcc

SEQ ID NO: 648447 - RNA, 20 nt, Escherichia coli CFT073
gcaccuuuaaccccagaggc

SEQ ID NO: 648448 - RNA, 18 nt, Escherichia coli CFT073
gcacgaagaggccgccgu

SEQ ID NO: 648449 - RNA, 14 nt, Escherichia coli CFT073
gcacgaaagguucc

SEQ ID NO: 648450 - RNA, 14 nt, Escherichia coli CFT073
gcacgaccaggaac

SEQ ID NO: 648451 - RNA, 19 nt, Escherichia coli CFT073
gcacgaccaggaacgccau

SEQ ID NO: 648452 - RNA, 20 nt, Escherichia coli CFT073
gcacgacauaagcgcaugaa

SEQ ID NO: 648453 - RNA, 20 nt, Escherichia coli CFT073
gcacgaccuugccaaggucg

SEQ ID NO: 648454 - RNA, 22 nt, Escherichia coli CFT073
gcacgauaacgguauaaaucga

SEQ ID NO: 648455 - RNA, 19 nt, Escherichia coli CFT073
  misc_feature (10)..(10): n is a, c, g or u
gcacgauaangcuugcgca

SEQ ID NO: 648456 - RNA, 16 nt, Escherichia coli CFT073
gcacgaugcugcgcag

SEQ ID NO: 648457 - RNA, 20 nt, Escherichia coli CFT073
gcacgcccauacauaccagc

SEQ ID NO: 648458 - RNA, 17 nt, Escherichia coli CFT073
gcacgcaggccacgaau

SEQ ID NO: 648459 - RNA, 16 nt, Escherichia coli CFT073
gcaccaguaauacggc

SEQ ID NO: 648460 - RNA, 21 nt, Escherichia coli CFT073
gcaccaguucgccguacugac

SEQ ID NO: 648461 - RNA, 14 nt, Escherichia coli CFT073
gcaccaguucgccu

SEQ ID NO: 648462 - RNA, 20 nt, Escherichia coli CFT073
gcaccaucaggcauauucac

SEQ ID NO: 648463 - RNA, 17 nt, Escherichia coli CFT073
gcaccaucccuaugcau

SEQ ID NO: 648464 - RNA, 11 nt, Escherichia coli CFT073
gcaccauucca

SEQ ID NO: 648465 - RNA, 12 nt, Escherichia coli CFT073
gcacccagcaau

SEQ ID NO: 648466 - RNA, 18 nt, Escherichia coli CFT073
gcacccagcaauccugca

SEQ ID NO: 648467 - RNA, 15 nt, Escherichia coli CFT073
gcaccccacaaacag

SEQ ID NO: 648468 - RNA, 23 nt, Escherichia coli CFT073
gcaccccacaaacagaauggugc

SEQ ID NO: 648469 - RNA, 22 nt, Escherichia coli CFT073
gcacccauuuauccagcggcag

SEQ ID NO: 648470 - RNA, 15 nt, Escherichia coli CFT073
gcacccaucgccagc

SEQ ID NO: 648471 - RNA, 20 nt, Escherichia coli CFT073
gcacccauuuauccagcggc

SEQ ID NO: 648472 - RNA, 18 nt, Escherichia coli CFT073
gcaccccugaagcggcag

SEQ ID NO: 648473 - RNA, 15 nt, Escherichia coli CFT073
gcacccgcggcugca

SEQ ID NO: 648474 - RNA, 12 nt, Escherichia coli CFT073
gcacccgccaga

SEQ ID NO: 648475 - RNA, 19 nt, Escherichia coli CFT073
gcaccacgcagaaaaaucc

SEQ ID NO: 648476 - RNA, 14 nt, Escherichia coli CFT073
gcaccaccgcccgu

SEQ ID NO: 648477 - RNA, 14 nt, Escherichia coli CFT073
gcaccaccagcagc

SEQ ID NO: 648478 - RNA, 19 nt, Escherichia coli CFT073
gcaccaccagcagcugcuc

SEQ ID NO: 648479 - RNA, 18 nt, Escherichia coli CFT073
gcaccacaccgucgccuu

SEQ ID NO: 648480 - RNA, 14 nt, Escherichia coli CFT073
gcaccacauaagau

SEQ ID NO: 648481 - RNA, 17 nt, Escherichia coli CFT073
gcaccacauucugcauu

SEQ ID NO: 648482 - RNA, 22 nt, Escherichia coli CFT073
gcaccaacccuaacccaacauu

SEQ ID NO: 648483 - RNA, 11 nt, Escherichia coli CFT073
gcaccaacaaa

SEQ ID NO: 648484 - RNA, 15 nt, Escherichia coli CFT073
gcaccacuguuuuuc

SEQ ID NO: 648485 - RNA, 20 nt, Escherichia coli CFT073
gcaccacuguuuuucagcac

SEQ ID NO: 648486 - RNA, 15 nt, Escherichia coli CFT073
gcaccacuuccggca

SEQ ID NO: 648487 - RNA, 22 nt, Escherichia coli CFT073
gcaccagaauaccuugcugcuc

SEQ ID NO: 648488 - RNA, 17 nt, Escherichia coli CFT073
gcaccagcaauaagcca

SEQ ID NO: 648489 - RNA, 13 nt, Escherichia coli CFT073
gcaccaggcgaaa

SEQ ID NO: 648490 - RNA, 17 nt, Escherichia coli CFT073
gcaccagcuccggcacu

SEQ ID NO: 648491 - RNA, 20 nt, Escherichia coli CFT073
gcaccguaucuucauugugc

SEQ ID NO: 648492 - RNA, 17 nt, Escherichia coli CFT073
gcaccgucacuucuucg

SEQ ID NO: 648493 - RNA, 17 nt, Escherichia coli CFT073
gcaccggguagggcgaa

SEQ ID NO: 648494 - RNA, 21 nt, Escherichia coli CFT073
gcaccgguaucugccagcacu

SEQ ID NO: 648495 - RNA, 22 nt, Escherichia coli CFT073
gcaccgguaucugccagcacug

SEQ ID NO: 648496 - RNA, 18 nt, Escherichia coli CFT073
gcaccggcgauaucccag

SEQ ID NO: 648497 - RNA, 15 nt, Escherichia coli CFT073
gcaccggaucgaugc

SEQ ID NO: 648498 - RNA, 16 nt, Escherichia coli CFT073
gcaccggaagcgugca

SEQ ID NO: 648499 - RNA, 18 nt, Escherichia coli CFT073
gcaccggaaauugcugcc

SEQ ID NO: 648500 - RNA, 22 nt, Escherichia coli CFT073
gcaccucauccugacaggcccc

SEQ ID NO: 648501 - RNA, 22 nt, Escherichia coli CFT073
gcaccguuuugcguccagugac

SEQ ID NO: 648502 - RNA, 14 nt, Escherichia coli CFT073
gcaccuacagccau

SEQ ID NO: 648503 - RNA, 16 nt, Escherichia coli CFT073
gcaccgugaccaccca

SEQ ID NO: 648504 - RNA, 17 nt, Escherichia coli CFT073
gcaccgugaccacccau

SEQ ID NO: 648505 - RNA, 16 nt, Escherichia coli CFT073
gcaccugauccagcuc

SEQ ID NO: 648506 - RNA, 14 nt, Escherichia coli CFT073
gcaccugccagcau

SEQ ID NO: 648507 - RNA, 16 nt, Escherichia coli CFT073
gcaccugaaccagacc

SEQ ID NO: 648508 - RNA, 17 nt, Escherichia coli CFT073
gcaccugaaccagaccg

SEQ ID NO: 648509 - RNA, 15 nt, Escherichia coli CFT073
gcaccugccagcgcc

SEQ ID NO: 648510 - RNA, 15 nt, Escherichia coli CFT073
gcaccgacaauccag

SEQ ID NO: 648511 - RNA, 16 nt, Escherichia coli CFT073
gcaccgacaauccagu

SEQ ID NO: 648512 - RNA, 19 nt, Escherichia coli CFT073
gcaccgacaucgacauacu

SEQ ID NO: 648513 - RNA, 21 nt, Escherichia coli CFT073
gcaccgaggccaaaaccacag

SEQ ID NO: 648514 - RNA, 18 nt, Escherichia coli CFT073
gcaccgaggaugaauaac

SEQ ID NO: 648515 - RNA, 20 nt, Escherichia coli CFT073
gcaccgaggccaaaaccaca

SEQ ID NO: 648516 - RNA, 13 nt, Escherichia coli CFT073
gcaccgcagagau

SEQ ID NO: 648517 - RNA, 12 nt, Escherichia coli CFT073
gcaccgccgcca

SEQ ID NO: 648518 - RNA, 15 nt, Escherichia coli CFT073
gcaccgcauccggca

SEQ ID NO: 648519 - RNA, 13 nt, Escherichia coli CFT073
gcaccgcauguug

SEQ ID NO: 648520 - RNA, 15 nt, Escherichia coli CFT073
gcaccgccagcagga

SEQ ID NO: 648521 - RNA, 17 nt, Escherichia coli CFT073
gcaccgccagcaggaac

SEQ ID NO: 648522 - RNA, 19 nt, Escherichia coli CFT073
gcaccgcgccacuggcgga

SEQ ID NO: 648523 - RNA, 14 nt, Escherichia coli CFT073
gcacagaaccggag

SEQ ID NO: 648524 - RNA, 18 nt, Escherichia coli CFT073
gcacagaaugugaugcca

SEQ ID NO: 648525 - RNA, 19 nt, Escherichia coli CFT073
gcacagacuccgguuuuug

SEQ ID NO: 648526 - RNA, 21 nt, Escherichia coli CFT073
gcacagacuuaauauugccgu

SEQ ID NO: 648527 - RNA, 17 nt, Escherichia coli CFT073
gcacaccgucagccagc

SEQ ID NO: 648528 - RNA, 17 nt, Escherichia coli CFT073
gcacaccauagaccaug

SEQ ID NO: 648529 - RNA, 19 nt, Escherichia coli CFT073
gcacaccaucgcauacggu

SEQ ID NO: 648530 - RNA, 14 nt, Escherichia coli CFT073
gcacaccagcaaua

SEQ ID NO: 648531 - RNA, 21 nt, Escherichia coli CFT073
gcacaccagccaguagcaccu

SEQ ID NO: 648532 - RNA, 17 nt, Escherichia coli CFT073
gcacaccaaccgcuucc

SEQ ID NO: 648533 - RNA, 11 nt, Escherichia coli CFT073
gcacaccaacu

SEQ ID NO: 648534 - RNA, 18 nt, Escherichia coli CFT073
gcacacaaaauugccgcu

SEQ ID NO: 648535 - RNA, 14 nt, Escherichia coli CFT073
gcacaaugccugau

SEQ ID NO: 648536 - RNA, 16 nt, Escherichia coli CFT073
gcacaagucagcaacg

SEQ ID NO: 648537 - RNA, 14 nt, Escherichia coli CFT073
gcacaagcggcagu

SEQ ID NO: 648538 - RNA, 16 nt, Escherichia coli CFT073
gcacaauccgccagga

SEQ ID NO: 648539 - RNA, 22 nt, Escherichia coli CFT073
gcacaauccgccaggacaucag

SEQ ID NO: 648540 - RNA, 13 nt, Escherichia coli CFT073
gcacaaccaucag

SEQ ID NO: 648541 - RNA, 17 nt, Escherichia coli CFT073
gcacaaacgcaauccag

SEQ ID NO: 648542 - RNA, 14 nt, Escherichia coli CFT073
gcacaaagccgugc

SEQ ID NO: 648543 - RNA, 18 nt, Escherichia coli CFT073
gcacaaauccccaguugu

SEQ ID NO: 648544 - RNA, 15 nt, Escherichia coli CFT073
gcacaaauuugccgu

SEQ ID NO: 648545 - RNA, 15 nt, Escherichia coli CFT073
gcacaucgcugugcu

SEQ ID NO: 648546 - RNA, 16 nt, Escherichia coli CFT073
gcacaucaucaaagcc

SEQ ID NO: 648547 - RNA, 19 nt, Escherichia coli CFT073
gcacauagccgaaaaugcu

SEQ ID NO: 648548 - RNA, 19 nt, Escherichia coli CFT073
gcaccaaauccauuuucga

SEQ ID NO: 648549 - RNA, 17 nt, Escherichia coli CFT073
gcaccaaacgggcaagc

SEQ ID NO: 648550 - RNA, 12 nt, Escherichia coli CFT073
gcacauugccgu

SEQ ID NO: 648551 - RNA, 22 nt, Escherichia coli CFT073
gcacauugccguaauggucugc

SEQ ID NO: 648552 - RNA, 13 nt, Escherichia coli CFT073
gcacauuguccgc

SEQ ID NO: 648553 - RNA, 14 nt, Escherichia coli CFT073
gcacauuguccgcu

SEQ ID NO: 648554 - RNA, 16 nt, Escherichia coli CFT073
gcacauugugcgccau

SEQ ID NO: 648555 - RNA, 21 nt, Escherichia coli CFT073
gcacaugucaguugcauacca

SEQ ID NO: 648556 - RNA, 16 nt, Escherichia coli CFT073
gcacauuccagaugcg

SEQ ID NO: 648557 - RNA, 13 nt, Escherichia coli CFT073
gcacaucucccac

SEQ ID NO: 648558 - RNA, 17 nt, Escherichia coli CFT073
gcacaugaugauggcua

SEQ ID NO: 648559 - RNA, 19 nt, Escherichia coli CFT073
gcacauggccgggguuuug

SEQ ID NO: 648560 - RNA, 20 nt, Escherichia coli CFT073
gcacaguacgcgcccgccgc

SEQ ID NO: 648561 - RNA, 13 nt, Escherichia coli CFT073
gcacaguggucaa

SEQ ID NO: 648562 - RNA, 13 nt, Escherichia coli CFT073
gcacauaaccagu

SEQ ID NO: 648563 - RNA, 16 nt, Escherichia coli CFT073
gcacaggcggcccagu

SEQ ID NO: 648564 - RNA, 21 nt, Escherichia coli CFT073
gcacagggggauucaccaugc

SEQ ID NO: 648565 - RNA, 23 nt, Escherichia coli CFT073
gcacagggggauucaccaugcca

SEQ ID NO: 648566 - RNA, 16 nt, Escherichia coli CFT073
gcacagccgcauuuug

SEQ ID NO: 648567 - RNA, 15 nt, Escherichia coli CFT073
gcacagccagcgcag

SEQ ID NO: 648568 - RNA, 18 nt, Escherichia coli CFT073
gcaauuucagugcugacu

SEQ ID NO: 648569 - RNA, 20 nt, Escherichia coli CFT073
gcaauuuccgcuuucaacgc

SEQ ID NO: 648570 - RNA, 22 nt, Escherichia coli CFT073
gcaauuuugcguuuggcaucag

SEQ ID NO: 648571 - RNA, 13 nt, Escherichia coli CFT073
gcaauuuuuugcg

SEQ ID NO: 648572 - RNA, 17 nt, Escherichia coli CFT073
gcaauucggauguuagu

SEQ ID NO: 648573 - RNA, 17 nt, Escherichia coli CFT073
gcaauugccauaaaaac

SEQ ID NO: 648574 - RNA, 12 nt, Escherichia coli CFT073
gcaauugccgca

SEQ ID NO: 648575 - RNA, 19 nt, Escherichia coli CFT073
gcaauugcugccccucaac

SEQ ID NO: 648576 - RNA, 18 nt, Escherichia coli CFT073
gcaauuggugcacgaugc

SEQ ID NO: 648577 - RNA, 15 nt, Escherichia coli CFT073
gcaaugcccgcagua

SEQ ID NO: 648578 - RNA, 15 nt, Escherichia coli CFT073
gcaauggaaaaaguu

SEQ ID NO: 648579 - RNA, 20 nt, Escherichia coli CFT073
gcaauggccguuccggcaac

SEQ ID NO: 648580 - RNA, 15 nt, Escherichia coli CFT073
gcaaugugcagcagu

SEQ ID NO: 648581 - RNA, 14 nt, Escherichia coli CFT073
gcaauguuauccgg

SEQ ID NO: 648582 - RNA, 20 nt, Escherichia coli CFT073
gcaauguuauccggcuauau

SEQ ID NO: 648583 - RNA, 21 nt, Escherichia coli CFT073
gcaauguugcuggcgagugca

SEQ ID NO: 648584 - RNA, 16 nt, Escherichia coli CFT073
gcaauuccagcgccag

SEQ ID NO: 648585 - RNA, 15 nt, Escherichia coli CFT073
gcaaucaaauuugcc

SEQ ID NO: 648586 - RNA, 17 nt, Escherichia coli CFT073
gcaaucaaauuugccag

SEQ ID NO: 648587 - RNA, 19 nt, Escherichia coli CFT073
gcaauauuguagcaacucc

SEQ ID NO: 648588 - RNA, 11 nt, Escherichia coli CFT073
gcaaucaacag

SEQ ID NO: 648589 - RNA, 16 nt, Escherichia coli CFT073
gcaaucaacgccugau

SEQ ID NO: 648590 - RNA, 23 nt, Escherichia coli CFT073
gcaaucacauccaccagcgccuc

SEQ ID NO: 648591 - RNA, 18 nt, Escherichia coli CFT073
gcaaucacaucguagaca

SEQ ID NO: 648592 - RNA, 19 nt, Escherichia coli CFT073
gcaaucacugccaccagga

SEQ ID NO: 648593 - RNA, 20 nt, Escherichia coli CFT073
gcaaucacugccaccaggaa

SEQ ID NO: 648594 - RNA, 20 nt, Escherichia coli CFT073
gcaaucacugccagaauagc

SEQ ID NO: 648595 - RNA, 23 nt, Escherichia coli CFT073
gcaaucacugccagaauagccgc

SEQ ID NO: 648596 - RNA, 19 nt, Escherichia coli CFT073
gcaaucagcggugccgcga

SEQ ID NO: 648597 - RNA, 18 nt, Escherichia coli CFT073
gcaaucaggucuuucagg

SEQ ID NO: 648598 - RNA, 13 nt, Escherichia coli CFT073
gcaaucaucaucg

SEQ ID NO: 648599 - RNA, 19 nt, Escherichia coli CFT073
gcaaucauuuuuuccccuu

SEQ ID NO: 648600 - RNA, 14 nt, Escherichia coli CFT073
gcaauccaguccac

SEQ ID NO: 648601 - RNA, 18 nt, Escherichia coli CFT073
gcaauccagcuaaccauc

SEQ ID NO: 648602 - RNA, 19 nt, Escherichia coli CFT073
gcaauccagcuaaccaucc

SEQ ID NO: 648603 - RNA, 21 nt, Escherichia coli CFT073
gcaaucgaauccggauuguau

SEQ ID NO: 648604 - RNA, 14 nt, Escherichia coli CFT073
gcaaucgaccaggc

SEQ ID NO: 648605 - RNA, 20 nt, Escherichia coli CFT073
gcaauccgugcaaaugccag

SEQ ID NO: 648606 - RNA, 15 nt, Escherichia coli CFT073
gcaauccggaaacca

SEQ ID NO: 648607 - RNA, 21 nt, Escherichia coli CFT073
gcaaugccauucacaaaaaca

SEQ ID NO: 648608 - RNA, 14 nt, Escherichia coli CFT073
gcaaugcaaucaaa

SEQ ID NO: 648609 - RNA, 16 nt, Escherichia coli CFT073
gcaaugccaucaccaa

SEQ ID NO: 648610 - RNA, 17 nt, Escherichia coli CFT073
gcaaugccaucaccaac

SEQ ID NO: 648611 - RNA, 18 nt, Escherichia coli CFT073
gcaaugccaucaccaacg

SEQ ID NO: 648612 - RNA, 18 nt, Escherichia coli CFT073
gcaaucuuuccugcacaa

SEQ ID NO: 648613 - RNA, 22 nt, Escherichia coli CFT073
gcaaugacauacagcaccgccc

SEQ ID NO: 648614 - RNA, 17 nt, Escherichia coli CFT073
gcaaugauauuaauguu

SEQ ID NO: 648615 - RNA, 14 nt, Escherichia coli CFT073
gcaaugaucucaau

SEQ ID NO: 648616 - RNA, 22 nt, Escherichia coli CFT073
gcaaucgcuuugacuaaagaaa

SEQ ID NO: 648617 - RNA, 23 nt, Escherichia coli CFT073
gcaaucgaccaggccaucagcag

SEQ ID NO: 648618 - RNA, 19 nt, Escherichia coli CFT073
gcaaucgccagacucacca

SEQ ID NO: 648619 - RNA, 17 nt, Escherichia coli CFT073
gcaaucgccagcggcag

SEQ ID NO: 648620 - RNA, 16 nt, Escherichia coli CFT073
gcaaucggcugcaccu

SEQ ID NO: 648621 - RNA, 17 nt, Escherichia coli CFT073
gcaaucucuucaagcug

SEQ ID NO: 648622 - RNA, 22 nt, Escherichia coli CFT073
gcaaucuguuuauuugacagcc

SEQ ID NO: 648623 - RNA, 23 nt, Escherichia coli CFT073
gcaaucugcuucuuaccaccuuc

SEQ ID NO: 648624 - RNA, 14 nt, Escherichia coli CFT073
gcaauacauaagca

SEQ ID NO: 648625 - RNA, 22 nt, Escherichia coli CFT073
gcaauacgauccugagcagcaa

SEQ ID NO: 648626 - RNA, 15 nt, Escherichia coli CFT073
gcaauaauaauaagu

SEQ ID NO: 648627 - RNA, 19 nt, Escherichia coli CFT073
gcaauaaucuuuacaccaa

SEQ ID NO: 648628 - RNA, 20 nt, Escherichia coli CFT073
gcaauaugguuauuaccaaa

SEQ ID NO: 648629 - RNA, 14 nt, Escherichia coli CFT073
gcaauauuacuuca

SEQ ID NO: 648630 - RNA, 17 nt, Escherichia coli CFT073
gcaauauuauggugaca

SEQ ID NO: 648631 - RNA, 18 nt, Escherichia coli CFT073
gcaauauucuuuugcagc

SEQ ID NO: 648632 - RNA, 21 nt, Escherichia coli CFT073
gcaauauauugaauuagcaag

SEQ ID NO: 648633 - RNA, 15 nt, Escherichia coli CFT073
gcaauagcaaagccu

SEQ ID NO: 648634 - RNA, 12 nt, Escherichia coli CFT073
gcaauaaacagc

SEQ ID NO: 648635 - RNA, 20 nt, Escherichia coli CFT073
gcaauaaacauccuuuucac

SEQ ID NO: 648636 - RNA, 19 nt, Escherichia coli CFT073
gcaaguuucgugcuuagau

SEQ ID NO: 648637 - RNA, 20 nt, Escherichia coli CFT073
gcaaguucggcggcgugccu

SEQ ID NO: 648638 - RNA, 16 nt, Escherichia coli CFT073
gcaaguaguccgcaau

SEQ ID NO: 648639 - RNA, 16 nt, Escherichia coli CFT073
gcaaguaguggaugaa

SEQ ID NO: 648640 - RNA, 13 nt, Escherichia coli CFT073
gcaaguacuuuug

SEQ ID NO: 648641 - RNA, 19 nt, Escherichia coli CFT073
gcaaguaauuguuucaucg

SEQ ID NO: 648642 - RNA, 24 nt, Escherichia coli CFT073
gcaagguggucagacggaacaucu

SEQ ID NO: 648643 - RNA, 11 nt, Escherichia coli CFT073
gcaagcaaauu

SEQ ID NO: 648644 - RNA, 22 nt, Escherichia coli CFT073
gcaagaucggagccaaaaucaa

SEQ ID NO: 648645 - RNA, 15 nt, Escherichia coli CFT073
gcaagaucgcgauga

SEQ ID NO: 648646 - RNA, 15 nt, Escherichia coli CFT073
gcaagaguuuuaaaa

SEQ ID NO: 648647 - RNA, 17 nt, Escherichia coli CFT073
gcaagaccugccgggcu

SEQ ID NO: 648648 - RNA, 21 nt, Escherichia coli CFT073
gcaagccuuacuucacaucau

SEQ ID NO: 648649 - RNA, 17 nt, Escherichia coli CFT073
gcaagcgucgcaucagg

SEQ ID NO: 648650 - RNA, 13 nt, Escherichia coli CFT073
gcaaggccaauac

SEQ ID NO: 648651 - RNA, 21 nt, Escherichia coli CFT073
gcaaggugagcguggcuggcu

SEQ ID NO: 648652 - RNA, 14 nt, Escherichia coli CFT073
gcaaccuucgccag

SEQ ID NO: 648653 - RNA, 22 nt, Escherichia coli CFT073
gcaaccguucgggaaaauauau

SEQ ID NO: 648654 - RNA, 17 nt, Escherichia coli CFT073
gcaacgauaacaaucac

SEQ ID NO: 648655 - RNA, 23 nt, Escherichia coli CFT073
gcaacgacgguaaaccacgccag

SEQ ID NO: 648656 - RNA, 18 nt, Escherichia coli CFT073
gaucaauucgagcaucau

SEQ ID NO: 648657 - RNA, 14 nt, Escherichia coli CFT073
gaucaaugugguga

SEQ ID NO: 648658 - RNA, 21 nt, Escherichia coli CFT073
gaucacauaauacguuuaugu

SEQ ID NO: 648659 - RNA, 21 nt, Escherichia coli CFT073
gcaaccggaauguuccauacc

SEQ ID NO: 648660 - RNA, 22 nt, Escherichia coli CFT073
gcaaccggggcauucaugaaca

SEQ ID NO: 648661 - RNA, 21 nt, Escherichia coli CFT073
gcaacgcuucguagaagccau

SEQ ID NO: 648662 - RNA, 23 nt, Escherichia coli CFT073
gcaacgccuuugucgggcaggcu

SEQ ID NO: 648663 - RNA, 12 nt, Escherichia coli CFT073
gcaacgcgcuuu

SEQ ID NO: 648664 - RNA, 23 nt, Escherichia coli CFT073
gcaacgccuaaacugaucgacag

SEQ ID NO: 648665 - RNA, 21 nt, Escherichia coli CFT073
gcaacgccuuccagacucauc

SEQ ID NO: 648666 - RNA, 21 nt, Escherichia coli CFT073
gcaacgccagcgaagccagcu

SEQ ID NO: 648667 - RNA, 19 nt, Escherichia coli CFT073
gcaacgugcuucgcgcugu

SEQ ID NO: 648668 - RNA, 12 nt, Escherichia coli CFT073
gcaacgucaguc

SEQ ID NO: 648669 - RNA, 19 nt, Escherichia coli CFT073
gcaacgucagucccaacug

SEQ ID NO: 648670 - RNA, 20 nt, Escherichia coli CFT073
gcaacggcacauauugcacc

SEQ ID NO: 648671 - RNA, 16 nt, Escherichia coli CFT073
gcaacggccaaaagca

SEQ ID NO: 648672 - RNA, 18 nt, Escherichia coli CFT073
gcaacuggcuugccagca

SEQ ID NO: 648673 - RNA, 20 nt, Escherichia coli CFT073
gcaacuggcuugccagcagg

SEQ ID NO: 648674 - RNA, 22 nt, Escherichia coli CFT073
gcaacuguaacgcagaagguua

SEQ ID NO: 648675 - RNA, 13 nt, Escherichia coli CFT073
gcaacuggcugcc

SEQ ID NO: 648676 - RNA, 15 nt, Escherichia coli CFT073
gcaacuuuacucauc

SEQ ID NO: 648677 - RNA, 18 nt, Escherichia coli CFT073
gcaacuuucaauaaccgc

SEQ ID NO: 648678 - RNA, 20 nt, Escherichia coli CFT073
gcaacuuucaauaaccgcug

SEQ ID NO: 648679 - RNA, 22 nt, Escherichia coli CFT073
gcaacuuucgccgguuuuucaa

SEQ ID NO: 648680 - RNA, 18 nt, Escherichia coli CFT073
gcaagaaacugaucauua

SEQ ID NO: 648681 - RNA, 22 nt, Escherichia coli CFT073
gcaagaaauaccgaagaguaac

SEQ ID NO: 648682 - RNA, 22 nt, Escherichia coli CFT073
aaagcgcauccaggcaaaguac

SEQ ID NO: 648683 - RNA, 14 nt, Escherichia coli CFT073
aaagcgccaaaucu

SEQ ID NO: 648684 - RNA, 23 nt, Escherichia coli CFT073
aaagcgcaauauuucucucuccg

SEQ ID NO: 648685 - RNA, 19 nt, Escherichia coli CFT073
aaagcgacuuugccuggcg

SEQ ID NO: 648686 - RNA, 22 nt, Escherichia coli CFT073
gcaacugcgccgcgagcauuuc

SEQ ID NO: 648687 - RNA, 17 nt, Escherichia coli CFT073
gcaacuacagcauuuug

SEQ ID NO: 648688 - RNA, 14 nt, Escherichia coli CFT073
gcaacuaccagcag

SEQ ID NO: 648689 - RNA, 13 nt, Escherichia coli CFT073
gcaacuccagcuu

SEQ ID NO: 648690 - RNA, 17 nt, Escherichia coli CFT073
guaaauuuuuugaucaa

SEQ ID NO: 648691 - RNA, 17 nt, Escherichia coli CFT073
guaacaccuguaaaguc

SEQ ID NO: 648692 - RNA, 20 nt, Escherichia coli CFT073
guaacaauaucuaaaauguc

SEQ ID NO: 648693 - RNA, 23 nt, Escherichia coli CFT073
guaacaggauggcauuugcaaca

SEQ ID NO: 648694 - RNA, 15 nt, Escherichia coli CFT073
guaaccaguuuauca

SEQ ID NO: 648695 - RNA, 21 nt, Escherichia coli CFT073
guaacaguaguuacgcggaga

SEQ ID NO: 648696 - RNA, 18 nt, Escherichia coli CFT073
guaaauaugccccacaga

SEQ ID NO: 648697 - RNA, 17 nt, Escherichia coli CFT073
guaaauaguauuauucu

SEQ ID NO: 648698 - RNA, 18 nt, Escherichia coli CFT073
guaaaugcucauaccauu

SEQ ID NO: 648699 - RNA, 20 nt, Escherichia coli CFT073
guaaaucgcuguuguucuuu

SEQ ID NO: 648700 - RNA, 19 nt, Escherichia coli CFT073
guaaagacuauccgccaua

SEQ ID NO: 648701 - RNA, 23 nt, Escherichia coli CFT073
guaaagacuucauuaucgauccu

SEQ ID NO: 648702 - RNA, 20 nt, Escherichia coli CFT073
guaaacgucgcaucugacca

SEQ ID NO: 648703 - RNA, 15 nt, Escherichia coli CFT073
guaaacgccagggca

SEQ ID NO: 648704 - RNA, 18 nt, Escherichia coli CFT073
guaaagccugcuggcagc

SEQ ID NO: 648705 - RNA, 17 nt, Escherichia coli CFT073
guaaagcaauaaaccau

SEQ ID NO: 648706 - RNA, 12 nt, Escherichia coli CFT073
guaaagcaucag

SEQ ID NO: 648707 - RNA, 13 nt, Escherichia coli CFT073
guaaagccgauua

SEQ ID NO: 648708 - RNA, 21 nt, Escherichia coli CFT073
guaaaauuauccucuucagga

SEQ ID NO: 648709 - RNA, 20 nt, Escherichia coli CFT073
guaaaacgguggccacagca

SEQ ID NO: 648710 - RNA, 14 nt, Escherichia coli CFT073
guaaaacugcauuu

SEQ ID NO: 648711 - RNA, 19 nt, Escherichia coli CFT073
guaaaagccauucuggcgc

SEQ ID NO: 648712 - RNA, 16 nt, Escherichia coli CFT073
guaaaagcgcauuuau

SEQ ID NO: 648713 - RNA, 19 nt, Escherichia coli CFT073
guaaaagcgcauuuaucuu

SEQ ID NO: 648714 - RNA, 16 nt, Escherichia coli CFT073
guaaacagggggaggc

SEQ ID NO: 648715 - RNA, 11 nt, Escherichia coli CFT073
guaaacaucag

SEQ ID NO: 648716 - RNA, 21 nt, Escherichia coli CFT073
guaaacaucuucuuaggcauu

SEQ ID NO: 648717 - RNA, 16 nt, Escherichia coli CFT073
guaaaccacaucagcg

SEQ ID NO: 648718 - RNA, 18 nt, Escherichia coli CFT073
guaaaccacccaccagcg

SEQ ID NO: 648719 - RNA, 21 nt, Escherichia coli CFT073
guaaacccgcgaugaccaaaa

SEQ ID NO: 648720 - RNA, 19 nt, Escherichia coli CFT073
guaaacccuaacaucaucc

SEQ ID NO: 648721 - RNA, 13 nt, Escherichia coli CFT073
guaaacaaacaug

SEQ ID NO: 648722 - RNA, 15 nt, Escherichia coli CFT073
guaaacacccaggcc

SEQ ID NO: 648723 - RNA, 23 nt, Escherichia coli CFT073
guaaacaccuucguccagcauca

SEQ ID NO: 648724 - RNA, 17 nt, Escherichia coli CFT073
guaacccgccugacgga

SEQ ID NO: 648725 - RNA, 12 nt, Escherichia coli CFT073
guaacccugugg

SEQ ID NO: 648726 - RNA, 19 nt, Escherichia coli CFT073
guaacccuguggaucuucc

SEQ ID NO: 648727 - RNA, 22 nt, Escherichia coli CFT073
guaaccuuuaucacgcagcaga

SEQ ID NO: 648728 - RNA, 17 nt, Escherichia coli CFT073
guaaccugcgaaaauca

SEQ ID NO: 648729 - RNA, 17 nt, Escherichia coli CFT073
guaacgaacacgaauca

SEQ ID NO: 648730 - RNA, 19 nt, Escherichia coli CFT073
guaacgaguacaaaaauaa

SEQ ID NO: 648731 - RNA, 23 nt, Escherichia coli CFT073
guaacgauggcgauucagcaaca

SEQ ID NO: 648732 - RNA, 20 nt, Escherichia coli CFT073
guaacgucgcaucuggucag

SEQ ID NO: 648733 - RNA, 19 nt, Escherichia coli CFT073
guaacgcucccuggaucac

SEQ ID NO: 648734 - RNA, 15 nt, Escherichia coli CFT073
guaacgcggauaaac

SEQ ID NO: 648735 - RNA, 14 nt, Escherichia coli CFT073
guaacggccaggcg

SEQ ID NO: 648736 - RNA, 15 nt, Escherichia coli CFT073
guaagagaacagaua

SEQ ID NO: 648737 - RNA, 13 nt, Escherichia coli CFT073
guaagcauacugc

SEQ ID NO: 648738 - RNA, 17 nt, Escherichia coli CFT073
guaagcaguccagcgcc

SEQ ID NO: 648739 - RNA, 14 nt, Escherichia coli CFT073
guaacuuuugccca

SEQ ID NO: 648740 - RNA, 20 nt, Escherichia coli CFT073
guaacuuuugcccauaugca

SEQ ID NO: 648741 - RNA, 14 nt, Escherichia coli CFT073
guaagaaaggcaga

SEQ ID NO: 648742 - RNA, 11 nt, Escherichia coli CFT073
guaacugcgcc

SEQ ID NO: 648743 - RNA, 20 nt, Escherichia coli CFT073
guaacugcuugaauuuaucu

SEQ ID NO: 648744 - RNA, 14 nt, Escherichia coli CFT073
guaacucgauuuua

SEQ ID NO: 648745 - RNA, 17 nt, Escherichia coli CFT073
guaaggcaucuucuuca

SEQ ID NO: 648746 - RNA, 16 nt, Escherichia coli CFT073
guaaggcuucaaucaa

SEQ ID NO: 648747 - RNA, 17 nt, Escherichia coli CFT073
guaaggauaaaaaaggg

SEQ ID NO: 648748 - RNA, 20 nt, Escherichia coli CFT073
guaaggauaaaaaaggguga

SEQ ID NO: 648749 - RNA, 14 nt, Escherichia coli CFT073
guaagcgauaacgc

SEQ ID NO: 648750 - RNA, 13 nt, Escherichia coli CFT073
guaagcccaggga

SEQ ID NO: 648751 - RNA, 18 nt, Escherichia coli CFT073
guaagcccuuaagaaaac

SEQ ID NO: 648752 - RNA, 13 nt, Escherichia coli CFT073
guaagccucuuuc

SEQ ID NO: 648753 - RNA, 20 nt, Escherichia coli CFT073
guaaguuaccggcaaugguu

SEQ ID NO: 648754 - RNA, 14 nt, Escherichia coli CFT073
guaaguaagauaaa

SEQ ID NO: 648755 - RNA, 20 nt, Escherichia coli CFT073
guaauaagggggcuuuugug

SEQ ID NO: 648756 - RNA, 18 nt, Escherichia coli CFT073
guaauaaugcccaucgug

SEQ ID NO: 648757 - RNA, 16 nt, Escherichia coli CFT073
guaauaaaaucuauua

SEQ ID NO: 648758 - RNA, 12 nt, Escherichia coli CFT073
guaauagccuga

SEQ ID NO: 648759 - RNA, 20 nt, Escherichia coli CFT073
guaauaggcaggcaucauca

SEQ ID NO: 648760 - RNA, 22 nt, Escherichia coli CFT073
guaauauauaacagaagguuua

SEQ ID NO: 648761 - RNA, 17 nt, Escherichia coli CFT073
guaauauuguaauacaa

SEQ ID NO: 648762 - RNA, 13 nt, Escherichia coli CFT073
guaauauccagcg

SEQ ID NO: 648763 - RNA, 17 nt, Escherichia coli CFT073
guacaaagccaacagca

SEQ ID NO: 648764 - RNA, 20 nt, Escherichia coli CFT073
guacaaagccaacagcagcc

SEQ ID NO: 648765 - RNA, 20 nt, Escherichia coli CFT073
guacaaagugccgccagcuu

SEQ ID NO: 648766 - RNA, 22 nt, Escherichia coli CFT073
guacaaucgccacauugcugca

SEQ ID NO: 648767 - RNA, 23 nt, Escherichia coli CFT073
guacaauggagcuaaacagagcu

SEQ ID NO: 648768 - RNA, 11 nt, Escherichia coli CFT073
guacaccaaca

SEQ ID NO: 648769 - RNA, 12 nt, Escherichia coli CFT073
guacaccaacau

SEQ ID NO: 648770 - RNA, 14 nt, Escherichia coli CFT073
guacaccaacauca

SEQ ID NO: 648771 - RNA, 17 nt, Escherichia coli CFT073
guacaccaauuguggua

SEQ ID NO: 648772 - RNA, 22 nt, Escherichia coli CFT073
guaauuacggggucaauaagga

SEQ ID NO: 648773 - RNA, 17 nt, Escherichia coli CFT073
guaauuaguggcuaacc

SEQ ID NO: 648774 - RNA, 22 nt, Escherichia coli CFT073
guaauuaagcgcaaaggccagc

SEQ ID NO: 648775 - RNA, 13 nt, Escherichia coli CFT073
guaauguugcgcc

SEQ ID NO: 648776 - RNA, 21 nt, Escherichia coli CFT073
guaaugucggugaaaguaacu

SEQ ID NO: 648777 - RNA, 14 nt, Escherichia coli CFT073
guaauguccauaua

SEQ ID NO: 648778 - RNA, 19 nt, Escherichia coli CFT073
guaauguccauauauaaaa

SEQ ID NO: 648779 - RNA, 22 nt, Escherichia coli CFT073
guaaugucucgguagagaaaac

SEQ ID NO: 648780 - RNA, 17 nt, Escherichia coli CFT073
guaauugaucucacaau

SEQ ID NO: 648781 - RNA, 19 nt, Escherichia coli CFT073
guaauugcgaaccuucggg

SEQ ID NO: 648782 - RNA, 12 nt, Escherichia coli CFT073
guaauuuccugc

SEQ ID NO: 648783 - RNA, 14 nt, Escherichia coli CFT073
guaauuuaaaucau

SEQ ID NO: 648784 - RNA, 19 nt, Escherichia coli CFT073
guaauuuaacaacucacca

SEQ ID NO: 648785 - RNA, 18 nt, Escherichia coli CFT073
guaaugcacuccgccgca

SEQ ID NO: 648786 - RNA, 14 nt, Escherichia coli CFT073
guaauggagauugu

SEQ ID NO: 648787 - RNA, 15 nt, Escherichia coli CFT073
guaaugggaucgaaa

SEQ ID NO: 648788 - RNA, 15 nt, Escherichia coli CFT073
guaaucgguuuuaac

SEQ ID NO: 648789 - RNA, 15 nt, Escherichia coli CFT073
aaauagauuuucaga

SEQ ID NO: 648790 - RNA, 12 nt, Escherichia coli CFT073
aaauagcaaagu

SEQ ID NO: 648791 - RNA, 14 nt, Escherichia coli CFT073
guaaugacaacauu

SEQ ID NO: 648792 - RNA, 16 nt, Escherichia coli CFT073
aaauagaucgccagaa

SEQ ID NO: 648793 - RNA, 21 nt, Escherichia coli CFT073
aaauagacauuacgcauuuga

SEQ ID NO: 648794 - RNA, 22 nt, Escherichia coli CFT073
guaaucaacgccgggccuguua

SEQ ID NO: 648795 - RNA, 14 nt, Escherichia coli CFT073
guaaucagccccgg

SEQ ID NO: 648796 - RNA, 17 nt, Escherichia coli CFT073
guaaucagcuuauccag

SEQ ID NO: 648797 - RNA, 17 nt, Escherichia coli CFT073
guaauccguaugacaaa

SEQ ID NO: 648798 - RNA, 19 nt, Escherichia coli CFT073
guaaucgccagcaaaauca

SEQ ID NO: 648799 - RNA, 14 nt, Escherichia coli CFT073
guaauccugcaaau

SEQ ID NO: 648800 - RNA, 19 nt, Escherichia coli CFT073
guaauccugccagugcaaa

SEQ ID NO: 648801 - RNA, 21 nt, Escherichia coli CFT073
guaauccaccguuggcagaua

SEQ ID NO: 648802 - RNA, 15 nt, Escherichia coli CFT073
guacagccgccagac

SEQ ID NO: 648803 - RNA, 14 nt, Escherichia coli CFT073
guacagccgccaga

SEQ ID NO: 648804 - RNA, 21 nt, Escherichia coli CFT073
guacaggcagcuuagaaagga

SEQ ID NO: 648805 - RNA, 21 nt, Escherichia coli CFT073
guacacugguucccaacaaca

SEQ ID NO: 648806 - RNA, 13 nt, Escherichia coli CFT073
guacaguuuccuu

SEQ ID NO: 648807 - RNA, 15 nt, Escherichia coli CFT073
guacaguuuccuucu

SEQ ID NO: 648808 - RNA, 15 nt, Escherichia coli CFT073
guacaguacugggau

SEQ ID NO: 648809 - RNA, 23 nt, Escherichia coli CFT073
guacagucacccgcugcgaacac

SEQ ID NO: 648810 - RNA, 16 nt, Escherichia coli CFT073
guacagguaagcacac

SEQ ID NO: 648811 - RNA, 19 nt, Escherichia coli CFT073
guacagguaagcacacauc

SEQ ID NO: 648812 - RNA, 21 nt, Escherichia coli CFT073
guacaucacgauuuuuccgcu

SEQ ID NO: 648813 - RNA, 15 nt, Escherichia coli CFT073
guacaucaauaccau

SEQ ID NO: 648814 - RNA, 19 nt, Escherichia coli CFT073
guacaucaauaccauuauc

SEQ ID NO: 648815 - RNA, 18 nt, Escherichia coli CFT073
guacauuguuuuccagac

SEQ ID NO: 648816 - RNA, 20 nt, Escherichia coli CFT073
guaccaaugaccaccaaaua

SEQ ID NO: 648817 - RNA, 20 nt, Escherichia coli CFT073
guaccaccagaaucgccagc

SEQ ID NO: 648818 - RNA, 19 nt, Escherichia coli CFT073
guaccaccagaaucgccag

SEQ ID NO: 648819 - RNA, 14 nt, Escherichia coli CFT073
guaccaggcauauu

SEQ ID NO: 648820 - RNA, 17 nt, Escherichia coli CFT073
guaccagugcagaugca

SEQ ID NO: 648821 - RNA, 20 nt, Escherichia coli CFT073
guaccagugcagaugcacaa

SEQ ID NO: 648822 - RNA, 15 nt, Escherichia coli CFT073
guaccaguggcggca

SEQ ID NO: 648823 - RNA, 23 nt, Escherichia coli CFT073
guaccaguggcggcauugacauc

SEQ ID NO: 648824 - RNA, 15 nt, Escherichia coli CFT073
guaccagcccgccga

SEQ ID NO: 648825 - RNA, 17 nt, Escherichia coli CFT073
guaccagacgcgggcaa

SEQ ID NO: 648826 - RNA, 23 nt, Escherichia coli CFT073
guaccuggccccuggcuggucag

SEQ ID NO: 648827 - RNA, 13 nt, Escherichia coli CFT073
guacgaaauaacu

SEQ ID NO: 648828 - RNA, 16 nt, Escherichia coli CFT073
guacgaccgcaaaggu

SEQ ID NO: 648829 - RNA, 15 nt, Escherichia coli CFT073
guacgcaggcggcug

SEQ ID NO: 648830 - RNA, 14 nt, Escherichia coli CFT073
guacgcauaaccgg

SEQ ID NO: 648831 - RNA, 18 nt, Escherichia coli CFT073
guacgauaauggcuucca

SEQ ID NO: 648832 - RNA, 14 nt, Escherichia coli CFT073
guacgacuuccugg

SEQ ID NO: 648833 - RNA, 15 nt, Escherichia coli CFT073
guacgcugcaaaaag

SEQ ID NO: 648834 - RNA, 19 nt, Escherichia coli CFT073
guacgcgggaauagcucag

SEQ ID NO: 648835 - RNA, 21 nt, Escherichia coli CFT073
guacgcgggcaacgccuucca

SEQ ID NO: 648836 - RNA, 14 nt, Escherichia coli CFT073
guaccguugcugcc

SEQ ID NO: 648837 - RNA, 17 nt, Escherichia coli CFT073
guaccggcguuucacau

SEQ ID NO: 648838 - RNA, 16 nt, Escherichia coli CFT073
guaccauuucuucugc

SEQ ID NO: 648839 - RNA, 22 nt, Escherichia coli CFT073
guacccagucgcgcgcgguggc

SEQ ID NO: 648840 - RNA, 19 nt, Escherichia coli CFT073
guacccgcugcaacucuuu

SEQ ID NO: 648841 - RNA, 17 nt, Escherichia coli CFT073
guaccgacgaucaacag

SEQ ID NO: 648842 - RNA, 23 nt, Escherichia coli CFT073
guaccgauaccuaacgccagcgc

SEQ ID NO: 648843 - RNA, 14 nt, Escherichia coli CFT073
gguugacgccccug

SEQ ID NO: 648844 - RNA, 23 nt, Escherichia coli CFT073
gguucugcacagcuuaaaaugcu

SEQ ID NO: 648845 - RNA, 23 nt, Escherichia coli CFT073
gguucuccuggcauaaacacggc

SEQ ID NO: 648846 - RNA, 21 nt, Escherichia coli CFT073
gguucuucaucuucaucaucu

SEQ ID NO: 648847 - RNA, 22 nt, Escherichia coli CFT073
gguugaggugcugaagggcauc

SEQ ID NO: 648848 - RNA, 13 nt, Escherichia coli CFT073
gguugaggaacuu

SEQ ID NO: 648849 - RNA, 13 nt, Escherichia coli CFT073
gguuggcgugcgg

SEQ ID NO: 648850 - RNA, 17 nt, Escherichia coli CFT073
gguuggcccgauagaca

SEQ ID NO: 648851 - RNA, 15 nt, Escherichia coli CFT073
gguuggaauugaagc

SEQ ID NO: 648852 - RNA, 15 nt, Escherichia coli CFT073
gguuuaauaaucgca

SEQ ID NO: 648853 - RNA, 22 nt, Escherichia coli CFT073
gguugugugcuggccaucaccu

SEQ ID NO: 648854 - RNA, 19 nt, Escherichia coli CFT073
gguugucuuggcgugcuca

SEQ ID NO: 648855 - RNA, 12 nt, Escherichia coli CFT073
gguuuucaacug

SEQ ID NO: 648856 - RNA, 14 nt, Escherichia coli CFT073
gguuugucaucauu

SEQ ID NO: 648857 - RNA, 23 nt, Escherichia coli CFT073
gguuuuauuauuccauccugcuc

SEQ ID NO: 648858 - RNA, 14 nt, Escherichia coli CFT073
gguuugaaaauggc

SEQ ID NO: 648859 - RNA, 19 nt, Escherichia coli CFT073
gguuugacauaaauuccgc

SEQ ID NO: 648860 - RNA, 13 nt, Escherichia coli CFT073
gguuuguaggccg

SEQ ID NO: 648861 - RNA, 14 nt, Escherichia coli CFT073
gguuugccagcaga

SEQ ID NO: 648862 - RNA, 18 nt, Escherichia coli CFT073
gguuuccacuuccaccac

SEQ ID NO: 648863 - RNA, 15 nt, Escherichia coli CFT073
gguuuagaaaagagu

SEQ ID NO: 648864 - RNA, 19 nt, Escherichia coli CFT073
gguuuauggaggguggcac

SEQ ID NO: 648865 - RNA, 23 nt, Escherichia coli CFT073
gguuucaaagauuuuaccaaugg

SEQ ID NO: 648866 - RNA, 16 nt, Escherichia coli CFT073
gguuucacuaagaugu

SEQ ID NO: 648867 - RNA, 16 nt, Escherichia coli CFT073
guaaaaaaucccagcg

SEQ ID NO: 648868 - RNA, 16 nt, Escherichia coli CFT073
gguuuuuuaucagaca

SEQ ID NO: 648869 - RNA, 22 nt, Escherichia coli CFT073
gguuuuuugaacagaccacauu

SEQ ID NO: 648870 - RNA, 12 nt, Escherichia coli CFT073
guaaaaccugcc

SEQ ID NO: 648871 - RNA, 21 nt, Escherichia coli CFT073
guaaaaccgacuuaaaaggaa

SEQ ID NO: 648872 - RNA, 17 nt, Escherichia coli CFT073
gguuaaaucaggaaaac

SEQ ID NO: 648873 - RNA, 16 nt, Escherichia coli CFT073
gguuaaauugaaauuu

SEQ ID NO: 648874 - RNA, 12 nt, Escherichia coli CFT073
gguuaaccagca

SEQ ID NO: 648875 - RNA, 18 nt, Escherichia coli CFT073
gguguuguugaguccggu

SEQ ID NO: 648876 - RNA, 16 nt, Escherichia coli CFT073
gguguuuaaccaacac

SEQ ID NO: 648877 - RNA, 20 nt, Escherichia coli CFT073
ggugucgucgauaauaucgg

SEQ ID NO: 648878 - RNA, 19 nt, Escherichia coli CFT073
ggugucguuacgccgcaga

SEQ ID NO: 648879 - RNA, 17 nt, Escherichia coli CFT073
gguguggcauggcgaau

SEQ ID NO: 648880 - RNA, 19 nt, Escherichia coli CFT073
gguguuaauggaauaacga

SEQ ID NO: 648881 - RNA, 15 nt, Escherichia coli CFT073
gguuauuuguaacug

SEQ ID NO: 648882 - RNA, 18 nt, Escherichia coli CFT073
gguucaagauuagccccc

SEQ ID NO: 648883 - RNA, 19 nt, Escherichia coli CFT073
gguucaagauuagcccccg

SEQ ID NO: 648884 - RNA, 23 nt, Escherichia coli CFT073
gguuaugcucaacggugaccuca

SEQ ID NO: 648885 - RNA, 11 nt, Escherichia coli CFT073
gguuauugguu

SEQ ID NO: 648886 - RNA, 16 nt, Escherichia coli CFT073
gguuaccgccagcacc

SEQ ID NO: 648887 - RNA, 15 nt, Escherichia coli CFT073
gguuaccaguacacc

SEQ ID NO: 648888 - RNA, 23 nt, Escherichia coli CFT073
gguuaccgaauccagcaagcugu

SEQ ID NO: 648889 - RNA, 19 nt, Escherichia coli CFT073
gguuaauaccgagcguuca

SEQ ID NO: 648890 - RNA, 21 nt, Escherichia coli CFT073
gguuaaucggaugaucaucca

SEQ ID NO: 648891 - RNA, 16 nt, Escherichia coli CFT073
gguuaaucggcaggga

SEQ ID NO: 648892 - RNA, 19 nt, Escherichia coli CFT073
gguuaaucucccguaagug

SEQ ID NO: 648893 - RNA, 22 nt, Escherichia coli CFT073
gguuacgcaccgguuccgggcu

SEQ ID NO: 648894 - RNA, 16 nt, Escherichia coli CFT073
gguuacgcgcaguuuc

SEQ ID NO: 648895 - RNA, 14 nt, Escherichia coli CFT073
gguuacucccggau

SEQ ID NO: 648896 - RNA, 11 nt, Escherichia coli CFT073
gguuagccugu

SEQ ID NO: 648897 - RNA, 19 nt, Escherichia coli CFT073
gguuaggcugagaaccgca

SEQ ID NO: 648898 - RNA, 15 nt, Escherichia coli CFT073
gguuaguaaauggac

SEQ ID NO: 648899 - RNA, 15 nt, Escherichia coli CFT073
gguuagucgcuguga

SEQ ID NO: 648900 - RNA, 22 nt, Escherichia coli CFT073
gguucuccacucugccaggcag

SEQ ID NO: 648901 - RNA, 16 nt, Escherichia coli CFT073
gguucgucuucgauua

SEQ ID NO: 648902 - RNA, 16 nt, Escherichia coli CFT073
gguucggauaaaugac

SEQ ID NO: 648903 - RNA, 16 nt, Escherichia coli CFT073
gguucgaauccuuccc

SEQ ID NO: 648904 - RNA, 14 nt, Escherichia coli CFT073
ggugaugguuucau

SEQ ID NO: 648905 - RNA, 23 nt, Escherichia coli CFT073
ggugauuuugccugugcaaccuu

SEQ ID NO: 648906 - RNA, 14 nt, Escherichia coli CFT073
ggugcaagccgcgg

SEQ ID NO: 648907 - RNA, 21 nt, Escherichia coli CFT073
ggugcaauccacaagcacagg

SEQ ID NO: 648908 - RNA, 17 nt, Escherichia coli CFT073
ggugaugaccacagaca

SEQ ID NO: 648909 - RNA, 15 nt, Escherichia coli CFT073
ggugauauuuucacu

SEQ ID NO: 648910 - RNA, 14 nt, Escherichia coli CFT073
ggugagucuggaag

SEQ ID NO: 648911 - RNA, 22 nt, Escherichia coli CFT073
ggugaguuugucgggcaggagc

SEQ ID NO: 648912 - RNA, 20 nt, Escherichia coli CFT073
ggugauaaucaucccacaug

SEQ ID NO: 648913 - RNA, 23 nt, Escherichia coli CFT073
ggugcauaggccaucggcagcau

SEQ ID NO: 648914 - RNA, 18 nt, Escherichia coli CFT073
ggugcagcagacgcugca

SEQ ID NO: 648915 - RNA, 22 nt, Escherichia coli CFT073
ggugcaggaauggcugggguug

SEQ ID NO: 648916 - RNA, 22 nt, Escherichia coli CFT073
ggugcaccuuguuucagcacga

SEQ ID NO: 648917 - RNA, 18 nt, Escherichia coli CFT073
ggugcacgaugcauuguc

SEQ ID NO: 648918 - RNA, 20 nt, Escherichia coli CFT073
ggugcauugaaggcaauugc

SEQ ID NO: 648919 - RNA, 22 nt, Escherichia coli CFT073
ggugcaucggggaauugugcuu

SEQ ID NO: 648920 - RNA, 18 nt, Escherichia coli CFT073
ggugccagcgccagcacu

SEQ ID NO: 648921 - RNA, 15 nt, Escherichia coli CFT073
ggcucauaccuucca

SEQ ID NO: 648922 - RNA, 23 nt, Escherichia coli CFT073
ggcucagcucuggcacaugcaua

SEQ ID NO: 648923 - RNA, 16 nt, Escherichia coli CFT073
ggcucaggcuggcuga

SEQ ID NO: 648924 - RNA, 14 nt, Escherichia coli CFT073
ggugacaaacacag

SEQ ID NO: 648925 - RNA, 16 nt, Escherichia coli CFT073
ggugacaagugccugu

SEQ ID NO: 648926 - RNA, 20 nt, Escherichia coli CFT073
ggcuccgggugugacaacaa

SEQ ID NO: 648927 - RNA, 19 nt, Escherichia coli CFT073
ggcuccgggcagggcggga

SEQ ID NO: 648928 - RNA, 18 nt, Escherichia coli CFT073
ggcuccgggcgcaccagu

SEQ ID NO: 648929 - RNA, 13 nt, Escherichia coli CFT073
ggugaccugcaau

SEQ ID NO: 648930 - RNA, 13 nt, Escherichia coli CFT073
ggugaccucaggu

SEQ ID NO: 648931 - RNA, 14 nt, Escherichia coli CFT073
ggugaccgagcgcc

SEQ ID NO: 648932 - RNA, 17 nt, Escherichia coli CFT073
ggugacgcuggcagcag

SEQ ID NO: 648933 - RNA, 19 nt, Escherichia coli CFT073
ggugacuggcuuaauaauu

SEQ ID NO: 648934 - RNA, 15 nt, Escherichia coli CFT073
ggugagcgaugcugc

SEQ ID NO: 648935 - RNA, 14 nt, Escherichia coli CFT073
ggugagcgugcggu

SEQ ID NO: 648936 - RNA, 18 nt, Escherichia coli CFT073
ggugcgaccaaacugcuc

SEQ ID NO: 648937 - RNA, 19 nt, Escherichia coli CFT073
ggugcgcaccaggcgugga

SEQ ID NO: 648938 - RNA, 16 nt, Escherichia coli CFT073
ggugccugcuaccggg

SEQ ID NO: 648939 - RNA, 16 nt, Escherichia coli CFT073
ggugggcuacggcaug

SEQ ID NO: 648940 - RNA, 15 nt, Escherichia coli CFT073
gguggcggcgucagc

SEQ ID NO: 648941 - RNA, 16 nt, Escherichia coli CFT073
gguggcguacagcugg

SEQ ID NO: 648942 - RNA, 17 nt, Escherichia coli CFT073
gguggcguacagcuggc

SEQ ID NO: 648943 - RNA, 23 nt, Escherichia coli CFT073
gguggcgauugaagcagcgcugg

SEQ ID NO: 648944 - RNA, 16 nt, Escherichia coli CFT073
ggugcuguuuucuccc

SEQ ID NO: 648945 - RNA, 15 nt, Escherichia coli CFT073
gguggaacagcugca

SEQ ID NO: 648946 - RNA, 15 nt, Escherichia coli CFT073
gguggccauccgcgu

SEQ ID NO: 648947 - RNA, 14 nt, Escherichia coli CFT073
gguggccaaauuca

SEQ ID NO: 648948 - RNA, 20 nt, Escherichia coli CFT073
gucguaccagugcagaugca

SEQ ID NO: 648949 - RNA, 21 nt, Escherichia coli CFT073
gucggcgagauauucccccac

SEQ ID NO: 648950 - RNA, 17 nt, Escherichia coli CFT073
gucuaagcggccucgau

SEQ ID NO: 648951 - RNA, 12 nt, Escherichia coli CFT073
gucuaccagcac

SEQ ID NO: 648952 - RNA, 17 nt, Escherichia coli CFT073
gucuaccagcaccugcu

SEQ ID NO: 648953 - RNA, 23 nt, Escherichia coli CFT073
gucuaccaguuuggugacgccac

SEQ ID NO: 648954 - RNA, 19 nt, Escherichia coli CFT073
gucgucgccaaugcgcaau

SEQ ID NO: 648955 - RNA, 17 nt, Escherichia coli CFT073
gucgucaucccaguccu

SEQ ID NO: 648956 - RNA, 15 nt, Escherichia coli CFT073
gucggauaagacgcg

SEQ ID NO: 648957 - RNA, 16 nt, Escherichia coli CFT073
gucggauaagacgcgc

SEQ ID NO: 648958 - RNA, 23 nt, Escherichia coli CFT073
gucggauaaggcguuuacgccgc

SEQ ID NO: 648959 - RNA, 21 nt, Escherichia coli CFT073
gucggacgcuguuccggcggc

SEQ ID NO: 648960 - RNA, 23 nt, Escherichia coli CFT073
gucgcucacuucacgcugccagc

SEQ ID NO: 648961 - RNA, 14 nt, Escherichia coli CFT073
gucggaugcggcgc

SEQ ID NO: 648962 - RNA, 19 nt, Escherichia coli CFT073
gucggaugcggcgcgagcg

SEQ ID NO: 648963 - RNA, 14 nt, Escherichia coli CFT073
gucggaugcggcuc

SEQ ID NO: 648964 - RNA, 19 nt, Escherichia coli CFT073
gucggaugcggcucgagcg

SEQ ID NO: 648965 - RNA, 15 nt, Escherichia coli CFT073
gucggcaaagcgggc

SEQ ID NO: 648966 - RNA, 14 nt, Escherichia coli CFT073
gucgccagcucuuc

SEQ ID NO: 648967 - RNA, 15 nt, Escherichia coli CFT073
gucgccaaugcgcaa

SEQ ID NO: 648968 - RNA, 18 nt, Escherichia coli CFT073
gucgcgcaauugccagac

SEQ ID NO: 648969 - RNA, 23 nt, Escherichia coli CFT073
gucgccaucguuaaaaaacagug

SEQ ID NO: 648970 - RNA, 16 nt, Escherichia coli CFT073
gucgccagucccuuuc

SEQ ID NO: 648971 - RNA, 17 nt, Escherichia coli CFT073
gucgcgcgaaucuucau

SEQ ID NO: 648972 - RNA, 16 nt, Escherichia coli CFT073
gucgcguagccaggcg

SEQ ID NO: 648973 - RNA, 19 nt, Escherichia coli CFT073
gucgcguagccaggcggca

SEQ ID NO: 648974 - RNA, 19 nt, Escherichia coli CFT073
gucgagguuauaaaccccc

SEQ ID NO: 648975 - RNA, 21 nt, Escherichia coli CFT073
gucgaguagcccuucagcuug

SEQ ID NO: 648976 - RNA, 14 nt, Escherichia coli CFT073
gucgcaucaggcau

SEQ ID NO: 648977 - RNA, 22 nt, Escherichia coli CFT073
gucgcaucaggcauugugucug

SEQ ID NO: 648978 - RNA, 13 nt, Escherichia coli CFT073
gucgcauccggca

SEQ ID NO: 648979 - RNA, 18 nt, Escherichia coli CFT073
gucgcauccggcaauuac

SEQ ID NO: 648980 - RNA, 17 nt, Escherichia coli CFT073
gucgcauccggcaucaa

SEQ ID NO: 648981 - RNA, 18 nt, Escherichia coli CFT073
gucgcauccggcauuauc

SEQ ID NO: 648982 - RNA, 13 nt, Escherichia coli CFT073
gucgcaucuggca

SEQ ID NO: 648983 - RNA, 21 nt, Escherichia coli CFT073
gucgcaucuggucagaugcga

SEQ ID NO: 648984 - RNA, 14 nt, Escherichia coli CFT073
gucgccaacuucau

SEQ ID NO: 648985 - RNA, 18 nt, Escherichia coli CFT073
gucgagauugugcucaau

SEQ ID NO: 648986 - RNA, 18 nt, Escherichia coli CFT073
gucgagaauguagauauu

SEQ ID NO: 648987 - RNA, 20 nt, Escherichia coli CFT073
gucgaggccaauuuggcugc

SEQ ID NO: 648988 - RNA, 14 nt, Escherichia coli CFT073
gucgaggcugacgu

SEQ ID NO: 648989 - RNA, 12 nt, Escherichia coli CFT073
gucgaaggccuc

SEQ ID NO: 648990 - RNA, 20 nt, Escherichia coli CFT073
guccgcaaacguaaaugcca

SEQ ID NO: 648991 - RNA, 22 nt, Escherichia coli CFT073
guccgcgcgcaccguccagcgu

SEQ ID NO: 648992 - RNA, 19 nt, Escherichia coli CFT073
guccuggguauaaaacuca

SEQ ID NO: 648993 - RNA, 18 nt, Escherichia coli CFT073
gucgaaagcccaucaucc

SEQ ID NO: 648994 - RNA, 17 nt, Escherichia coli CFT073
guccccaaaaaagccac

SEQ ID NO: 648995 - RNA, 16 nt, Escherichia coli CFT073
gucccaccaucagacc

SEQ ID NO: 648996 - RNA, 15 nt, Escherichia coli CFT073
guccauucccuggca

SEQ ID NO: 648997 - RNA, 20 nt, Escherichia coli CFT073
guccauaaauuauagaugca

SEQ ID NO: 648998 - RNA, 17 nt, Escherichia coli CFT073
guccagugcaacuuuac

SEQ ID NO: 648999 - RNA, 22 nt, Escherichia coli CFT073
guccagugcaacuuuacuaaaa

SEQ ID NO: 649000 - RNA, 18 nt, Escherichia coli CFT073
guccaguucccaaccauu

SEQ ID NO: 649001 - RNA, 15 nt, Escherichia coli CFT073
gucccuuugccugcc

SEQ ID NO: 649002 - RNA, 16 nt, Escherichia coli CFT073
gucccugcucuuucag

SEQ ID NO: 649003 - RNA, 23 nt, Escherichia coli CFT073
gucccuaauaccguuccaacgcc

SEQ ID NO: 649004 - RNA, 14 nt, Escherichia coli CFT073
gucccguccuucau

SEQ ID NO: 649005 - RNA, 17 nt, Escherichia coli CFT073
gucccccaagacugagu

SEQ ID NO: 649006 - RNA, 17 nt, Escherichia coli CFT073
gucauaauaugaccuga

SEQ ID NO: 649007 - RNA, 21 nt, Escherichia coli CFT073
gucaguuuaaacagaauaccc

SEQ ID NO: 649008 - RNA, 14 nt, Escherichia coli CFT073
gucaguuucaccuc

SEQ ID NO: 649009 - RNA, 23 nt, Escherichia coli CFT073
gucauaaaaaugaggggcuaaaa

SEQ ID NO: 649010 - RNA, 16 nt, Escherichia coli CFT073
gucaguuggcuguggu

SEQ ID NO: 649011 - RNA, 15 nt, Escherichia coli CFT073
gucaguugcggcagg

SEQ ID NO: 649012 - RNA, 13 nt, Escherichia coli CFT073
gucaguuggcugu

SEQ ID NO: 649013 - RNA, 21 nt, Escherichia coli CFT073
gucauacuccagucgcugcug

SEQ ID NO: 649014 - RNA, 20 nt, Escherichia coli CFT073
gucauuagcgcuaucaaagu

SEQ ID NO: 649015 - RNA, 15 nt, Escherichia coli CFT073
gucauuaucgcugac

SEQ ID NO: 649016 - RNA, 15 nt, Escherichia coli CFT073
gucaugccuuucuua

SEQ ID NO: 649017 - RNA, 21 nt, Escherichia coli CFT073
guccagacggagcugccaggc

SEQ ID NO: 649018 - RNA, 14 nt, Escherichia coli CFT073
guccagauguucuu

SEQ ID NO: 649019 - RNA, 13 nt, Escherichia coli CFT073
guccacggugcga

SEQ ID NO: 649020 - RNA, 14 nt, Escherichia coli CFT073
gucauugacgcugg

SEQ ID NO: 649021 - RNA, 15 nt, Escherichia coli CFT073
guccacgacagaacc

SEQ ID NO: 649022 - RNA, 15 nt, Escherichia coli CFT073
guccaccuggccugc

SEQ ID NO: 649023 - RNA, 11 nt, Escherichia coli CFT073
gucauuuccag

SEQ ID NO: 649024 - RNA, 17 nt, Escherichia coli CFT073
gucagcgucucaacaaa

SEQ ID NO: 649025 - RNA, 18 nt, Escherichia coli CFT073
gucagcucgcugccaucg

SEQ ID NO: 649026 - RNA, 13 nt, Escherichia coli CFT073
gucagcugcuguu

SEQ ID NO: 649027 - RNA, 22 nt, Escherichia coli CFT073
gucagcgucgcaucuggcauaa

SEQ ID NO: 649028 - RNA, 20 nt, Escherichia coli CFT073
gucagaccggcaaccagcac

SEQ ID NO: 649029 - RNA, 12 nt, Escherichia coli CFT073
gucagaaagaaa

SEQ ID NO: 649030 - RNA, 22 nt, Escherichia coli CFT073
gucagaucgccccggucaucaa

SEQ ID NO: 649031 - RNA, 17 nt, Escherichia coli CFT073
gucagaugcugugcaau

SEQ ID NO: 649032 - RNA, 21 nt, Escherichia coli CFT073
gucagcaaaauacugaacagg

SEQ ID NO: 649033 - RNA, 20 nt, Escherichia coli CFT073
gucaguacaaacauccaucu

SEQ ID NO: 649034 - RNA, 14 nt, Escherichia coli CFT073
gucaggaagaagcc

SEQ ID NO: 649035 - RNA, 21 nt, Escherichia coli CFT073
gucagucccugcucuuucagc

SEQ ID NO: 649036 - RNA, 23 nt, Escherichia coli CFT073
gucagucccugcucuuucagcac

SEQ ID NO: 649037 - RNA, 14 nt, Escherichia coli CFT073
gucagucaucacuu

SEQ ID NO: 649038 - RNA, 14 nt, Escherichia coli CFT073
gucaguagcgcaau

SEQ ID NO: 649039 - RNA, 16 nt, Escherichia coli CFT073
gucaguagcgcaauaa

SEQ ID NO: 649040 - RNA, 17 nt, Escherichia coli CFT073
gucaguaguuuuugcag

SEQ ID NO: 649041 - RNA, 19 nt, Escherichia coli CFT073
gucaguauuccagagcuuu

SEQ ID NO: 649042 - RNA, 13 nt, Escherichia coli CFT073
gucaguauuuucc

SEQ ID NO: 649043 - RNA, 21 nt, Escherichia coli CFT073
gucagugucuuaucuggcauu

SEQ ID NO: 649044 - RNA, 15 nt, Escherichia coli CFT073
gucaacccaaccugc

SEQ ID NO: 649045 - RNA, 14 nt, Escherichia coli CFT073
gucacaaacaucau

SEQ ID NO: 649046 - RNA, 20 nt, Escherichia coli CFT073
gucaauaguuacgaaaagga

SEQ ID NO: 649047 - RNA, 19 nt, Escherichia coli CFT073
gucaauaucaucgauuuuc

SEQ ID NO: 649048 - RNA, 23 nt, Escherichia coli CFT073
gucaauaucaucgauuuucugcu

SEQ ID NO: 649049 - RNA, 21 nt, Escherichia coli CFT073
gucaauuuuucaggaucaagc

SEQ ID NO: 649050 - RNA, 12 nt, Escherichia coli CFT073
gucacaguuaac

SEQ ID NO: 649051 - RNA, 14 nt, Escherichia coli CFT073
gucacaguuaacca

SEQ ID NO: 649052 - RNA, 16 nt, Escherichia coli CFT073
gucacaggccaucaca

SEQ ID NO: 649053 - RNA, 17 nt, Escherichia coli CFT073
gucacaucaccaacacc

SEQ ID NO: 649054 - RNA, 16 nt, Escherichia coli CFT073
gucacaucaggccauc

SEQ ID NO: 649055 - RNA, 12 nt, Escherichia coli CFT073
gucaccaguccc

SEQ ID NO: 649056 - RNA, 18 nt, Escherichia coli CFT073
gucaccaggaagccuucc

SEQ ID NO: 649057 - RNA, 17 nt, Escherichia coli CFT073
gucaccagagauaaaau

SEQ ID NO: 649058 - RNA, 11 nt, Escherichia coli CFT073
gucaccacaaa

SEQ ID NO: 649059 - RNA, 15 nt, Escherichia coli CFT073
gucaccacccugccc

SEQ ID NO: 649060 - RNA, 16 nt, Escherichia coli CFT073
gucaccuucuggcgac

SEQ ID NO: 649061 - RNA, 21 nt, Escherichia coli CFT073
gucacugcgguguaaaccagc

SEQ ID NO: 649062 - RNA, 20 nt, Escherichia coli CFT073
gucacuuccugauccgcuuu

SEQ ID NO: 649063 - RNA, 23 nt, Escherichia coli CFT073
gucacuggugugucaucugcgac

SEQ ID NO: 649064 - RNA, 18 nt, Escherichia coli CFT073
guauuuuuuccgcacguu

SEQ ID NO: 649065 - RNA, 19 nt, Escherichia coli CFT073
gucaaaaagcucaaucgaa

SEQ ID NO: 649066 - RNA, 16 nt, Escherichia coli CFT073
gucaaaagcacucaga

SEQ ID NO: 649067 - RNA, 17 nt, Escherichia coli CFT073
gucaaaaucauccgucg

SEQ ID NO: 649068 - RNA, 20 nt, Escherichia coli CFT073
gucaacaccagggaaauaau

SEQ ID NO: 649069 - RNA, 17 nt, Escherichia coli CFT073
gucaacaauccauucau

SEQ ID NO: 649070 - RNA, 12 nt, Escherichia coli CFT073
gucaacagggca

SEQ ID NO: 649071 - RNA, 16 nt, Escherichia coli CFT073
gucaacagggcagaca

SEQ ID NO: 649072 - RNA, 17 nt, Escherichia coli CFT073
gucaaauacgccggguu

SEQ ID NO: 649073 - RNA, 18 nt, Escherichia coli CFT073
gucaaacauugagcuuug

SEQ ID NO: 649074 - RNA, 23 nt, Escherichia coli CFT073
gucaaacucauaaaccagcggca

SEQ ID NO: 649075 - RNA, 17 nt, Escherichia coli CFT073
guauuucgaaugcucau

SEQ ID NO: 649076 - RNA, 14 nt, Escherichia coli CFT073
guauuucacuguuc

SEQ ID NO: 649077 - RNA, 13 nt, Escherichia coli CFT073
guauuuccagggc

SEQ ID NO: 649078 - RNA, 22 nt, Escherichia coli CFT073
guauuucgcgaggcguuuucca

SEQ ID NO: 649079 - RNA, 21 nt, Escherichia coli CFT073
guauuguuagcaauccagcua

SEQ ID NO: 649080 - RNA, 21 nt, Escherichia coli CFT073
guauuuagcccuucaugcacu

SEQ ID NO: 649081 - RNA, 20 nt, Escherichia coli CFT073
guauugcuaagcucucagca

SEQ ID NO: 649082 - RNA, 20 nt, Escherichia coli CFT073
guauuauugaugcuuuucaa

SEQ ID NO: 649083 - RNA, 19 nt, Escherichia coli CFT073
guauucaaccguuuccagu

SEQ ID NO: 649084 - RNA, 19 nt, Escherichia coli CFT073
guauggagcaggaauauac

SEQ ID NO: 649085 - RNA, 15 nt, Escherichia coli CFT073
guauggaaaucaccc

SEQ ID NO: 649086 - RNA, 22 nt, Escherichia coli CFT073
guauuaauuugccagcguaaau

SEQ ID NO: 649087 - RNA, 20 nt, Escherichia coli CFT073
guaugguauaucguuuuuca

SEQ ID NO: 649088 - RNA, 19 nt, Escherichia coli CFT073
guaucacguagccacggcg

SEQ ID NO: 649089 - RNA, 14 nt, Escherichia coli CFT073
guaucaaggcugau

SEQ ID NO: 649090 - RNA, 19 nt, Escherichia coli CFT073
guaucagggcgaaacagag

SEQ ID NO: 649091 - RNA, 14 nt, Escherichia coli CFT073
guaucaucgcugaa

SEQ ID NO: 649092 - RNA, 22 nt, Escherichia coli CFT073
guaucaugcaguaccagauaau

SEQ ID NO: 649093 - RNA, 13 nt, Escherichia coli CFT073
guaucccagugca

SEQ ID NO: 649094 - RNA, 19 nt, Escherichia coli CFT073
guauccaacugugaauccu

SEQ ID NO: 649095 - RNA, 20 nt, Escherichia coli CFT073
guauccacacugguucccag

SEQ ID NO: 649096 - RNA, 21 nt, Escherichia coli CFT073
guauccaccgacacuacaaau

SEQ ID NO: 649097 - RNA, 19 nt, Escherichia coli CFT073
guauccagacccagcuuca

SEQ ID NO: 649098 - RNA, 20 nt, Escherichia coli CFT073
guauccaggccacucaugcc

SEQ ID NO: 649099 - RNA, 11 nt, Escherichia coli CFT073
guauccagugu

SEQ ID NO: 649100 - RNA, 22 nt, Escherichia coli CFT073
guaucuucgccguguucuuacc

SEQ ID NO: 649101 - RNA, 20 nt, Escherichia coli CFT073
guaucuuuccagccucuguc

SEQ ID NO: 649102 - RNA, 23 nt, Escherichia coli CFT073
guaucuuugccaggucgcuugcc

SEQ ID NO: 649103 - RNA, 17 nt, Escherichia coli CFT073
guaucuucaugcuccag

SEQ ID NO: 649104 - RNA, 20 nt, Escherichia coli CFT073
guaucgaacguuuucaccac

SEQ ID NO: 649105 - RNA, 23 nt, Escherichia coli CFT073
guaucgaacguuuucaccacuuu

SEQ ID NO: 649106 - RNA, 21 nt, Escherichia coli CFT073
guauccuguuuuuaagugaug

SEQ ID NO: 649107 - RNA, 14 nt, Escherichia coli CFT073
guauccuguuuuua

SEQ ID NO: 649108 - RNA, 18 nt, Escherichia coli CFT073
guaucuaccacugccuga

SEQ ID NO: 649109 - RNA, 15 nt, Escherichia coli CFT073
guaucuaccccagau

SEQ ID NO: 649110 - RNA, 14 nt, Escherichia coli CFT073
guaucguucgccag

SEQ ID NO: 649111 - RNA, 21 nt, Escherichia coli CFT073
guaucggcaucgauauugugc

SEQ ID NO: 649112 - RNA, 16 nt, Escherichia coli CFT073
guaucgcgaaaaaaaa

SEQ ID NO: 649113 - RNA, 20 nt, Escherichia coli CFT073
guauaggcuccacugauggc

SEQ ID NO: 649114 - RNA, 19 nt, Escherichia coli CFT073
guauauuauccaucaaagg

SEQ ID NO: 649115 - RNA, 22 nt, Escherichia coli CFT073
guauauuauccaucaaagguuu

SEQ ID NO: 649116 - RNA, 20 nt, Escherichia coli CFT073
guaucaaaaacuuucgccag

SEQ ID NO: 649117 - RNA, 16 nt, Escherichia coli CFT073
guauauugcagaaauc

SEQ ID NO: 649118 - RNA, 17 nt, Escherichia coli CFT073
guauauugcugauuuuc

SEQ ID NO: 649119 - RNA, 13 nt, Escherichia coli CFT073
guaucaaacacag

SEQ ID NO: 649120 - RNA, 17 nt, Escherichia coli CFT073
guauacgggcuuuuuaa

SEQ ID NO: 649121 - RNA, 13 nt, Escherichia coli CFT073
guauacugcaaau

SEQ ID NO: 649122 - RNA, 15 nt, Escherichia coli CFT073
guauacugcaaauau

SEQ ID NO: 649123 - RNA, 13 nt, Escherichia coli CFT073
guauacugcagcg

SEQ ID NO: 649124 - RNA, 14 nt, Escherichia coli CFT073
guauaaaaagaaga

SEQ ID NO: 649125 - RNA, 14 nt, Escherichia coli CFT073
guaguugcugucga

SEQ ID NO: 649126 - RNA, 15 nt, Escherichia coli CFT073
guauaacacaucccg

SEQ ID NO: 649127 - RNA, 20 nt, Escherichia coli CFT073
guauaacucgccuucagguu

SEQ ID NO: 649128 - RNA, 15 nt, Escherichia coli CFT073
guagcgucgccagca

SEQ ID NO: 649129 - RNA, 14 nt, Escherichia coli CFT073
guagcucuggguaa

SEQ ID NO: 649130 - RNA, 22 nt, Escherichia coli CFT073
guagcugcugcucaaucugcgc

SEQ ID NO: 649131 - RNA, 16 nt, Escherichia coli CFT073
guagccgccaaacgcc

SEQ ID NO: 649132 - RNA, 19 nt, Escherichia coli CFT073
guagcgaucgucaaaggca

SEQ ID NO: 649133 - RNA, 21 nt, Escherichia coli CFT073
guagcgauggcccgcuugcca

SEQ ID NO: 649134 - RNA, 22 nt, Escherichia coli CFT073
guaguauuugaguucacugccg

SEQ ID NO: 649135 - RNA, 15 nt, Escherichia coli CFT073
guaguacgugaagua

SEQ ID NO: 649136 - RNA, 14 nt, Escherichia coli CFT073
guagucaggaagcc

SEQ ID NO: 649137 - RNA, 19 nt, Escherichia coli CFT073
guagucaggaagccccagc

SEQ ID NO: 649138 - RNA, 15 nt, Escherichia coli CFT073
guaguguaaaugcaa

SEQ ID NO: 649139 - RNA, 17 nt, Escherichia coli CFT073
guaguguaaaugcaaau

SEQ ID NO: 649140 - RNA, 14 nt, Escherichia coli CFT073
guaguuaagauuca

SEQ ID NO: 649141 - RNA, 20 nt, Escherichia coli CFT073
guaguguuuuauaccaacaa

SEQ ID NO: 649142 - RNA, 19 nt, Escherichia coli CFT073
guagugaugcaucauaugc

SEQ ID NO: 649143 - RNA, 15 nt, Escherichia coli CFT073
guagucugaccucuu

SEQ ID NO: 649144 - RNA, 15 nt, Escherichia coli CFT073
guagugaaggcaaac

SEQ ID NO: 649145 - RNA, 16 nt, Escherichia coli CFT073
guaguacccucugcac

SEQ ID NO: 649146 - RNA, 17 nt, Escherichia coli CFT073
guaguacccucugcacc

SEQ ID NO: 649147 - RNA, 22 nt, Escherichia coli CFT073
guagguuccggcaaucaacaga

SEQ ID NO: 649148 - RNA, 23 nt, Escherichia coli CFT073
guaggucgcauaaggugcgaccu

SEQ ID NO: 649149 - RNA, 16 nt, Escherichia coli CFT073
guaggggaacugcagg

SEQ ID NO: 649150 - RNA, 22 nt, Escherichia coli CFT073
guagauugcacaugcuaaaaau

SEQ ID NO: 649151 - RNA, 12 nt, Escherichia coli CFT073
guagaugcccau

SEQ ID NO: 649152 - RNA, 16 nt, Escherichia coli CFT073
guagcagcagcgccag

SEQ ID NO: 649153 - RNA, 18 nt, Escherichia coli CFT073
guagcagcagcgccaggc

SEQ ID NO: 649154 - RNA, 19 nt, Escherichia coli CFT073
guagcagcaggaauaauca

SEQ ID NO: 649155 - RNA, 19 nt, Escherichia coli CFT073
guagcagguaaucugccau

SEQ ID NO: 649156 - RNA, 12 nt, Escherichia coli CFT073
guagcaggaaau

SEQ ID NO: 649157 - RNA, 18 nt, Escherichia coli CFT073
guagccccagucuuccug

SEQ ID NO: 649158 - RNA, 20 nt, Escherichia coli CFT073
guagccaaucccggaagcca

SEQ ID NO: 649159 - RNA, 23 nt, Escherichia coli CFT073
guagccaaucccggaagccacca

SEQ ID NO: 649160 - RNA, 13 nt, Escherichia coli CFT073
guagacagcaucg

SEQ ID NO: 649161 - RNA, 12 nt, Escherichia coli CFT073
guagagaaaacc

SEQ ID NO: 649162 - RNA, 15 nt, Escherichia coli CFT073
guagagagauuaaug

SEQ ID NO: 649163 - RNA, 13 nt, Escherichia coli CFT073
guagagcagcacg

SEQ ID NO: 649164 - RNA, 16 nt, Escherichia coli CFT073
guacugguaagcaaag

SEQ ID NO: 649165 - RNA, 20 nt, Escherichia coli CFT073
guacuggcgacugccagcca

SEQ ID NO: 649166 - RNA, 17 nt, Escherichia coli CFT073
guacugacuauccacug

SEQ ID NO: 649167 - RNA, 22 nt, Escherichia coli CFT073
guacuacgcgccgccagccaca

SEQ ID NO: 649168 - RNA, 22 nt, Escherichia coli CFT073
guacgucgagcaguugcugaau

SEQ ID NO: 649169 - RNA, 19 nt, Escherichia coli CFT073
guacgguacugaaaccuga

SEQ ID NO: 649170 - RNA, 15 nt, Escherichia coli CFT073
guacucaccaacgca

SEQ ID NO: 649171 - RNA, 21 nt, Escherichia coli CFT073
guacucccgaggaucacaaug

SEQ ID NO: 649172 - RNA, 22 nt, Escherichia coli CFT073
guacuuucugauuguuauucau

SEQ ID NO: 649173 - RNA, 14 nt, Escherichia coli CFT073
guacuuuaaaauaa

SEQ ID NO: 649174 - RNA, 20 nt, Escherichia coli CFT073
guacuuuaaaauaagcacaa

SEQ ID NO: 649175 - RNA, 18 nt, Escherichia coli CFT073
guacuucaccucauguaa

SEQ ID NO: 649176 - RNA, 21 nt, Escherichia coli CFT073
guacuuaaaacucacccugau

SEQ ID NO: 649177 - RNA, 14 nt, Escherichia coli CFT073
guagaacaccuguc

SEQ ID NO: 649178 - RNA, 12 nt, Escherichia coli CFT073
uaaaauccucaa

SEQ ID NO: 649179 - RNA, 23 nt, Escherichia coli CFT073
uaaaaucgagcguugcuucgcca

SEQ ID NO: 649180 - RNA, 16 nt, Escherichia coli CFT073
uaaaaucccauaagug

SEQ ID NO: 649181 - RNA, 14 nt, Escherichia coli CFT073
uaaaauccaacucc

SEQ ID NO: 649182 - RNA, 18 nt, Escherichia coli CFT073
uaaaaucagaaaucacca

SEQ ID NO: 649183 - RNA, 21 nt, Escherichia coli CFT073
uaaaaucaucacgcgguuacg

SEQ ID NO: 649184 - RNA, 20 nt, Escherichia coli CFT073
uaaaaugucaccuaauuuaa

SEQ ID NO: 649185 - RNA, 19 nt, Escherichia coli CFT073
uaaaauacuggcgauuuca

SEQ ID NO: 649186 - RNA, 14 nt, Escherichia coli CFT073
uaaaauaagcacaa

SEQ ID NO: 649187 - RNA, 21 nt, Escherichia coli CFT073
uaaaagcuuaugcuguacuuu

SEQ ID NO: 649188 - RNA, 22 nt, Escherichia coli CFT073
uaaaagcuuuccggaaaaauca

SEQ ID NO: 649189 - RNA, 21 nt, Escherichia coli CFT073
uaaaaggauuggguuaagccg

SEQ ID NO: 649190 - RNA, 16 nt, Escherichia coli CFT073
uaaaagggcagcagga

SEQ ID NO: 649191 - RNA, 17 nt, Escherichia coli CFT073
uaaaaggcgucauguaa

SEQ ID NO: 649192 - RNA, 21 nt, Escherichia coli CFT073
uaaaaggcgucauguaaugca

SEQ ID NO: 649193 - RNA, 14 nt, Escherichia coli CFT073
uaaaaguuauuaaa

SEQ ID NO: 649194 - RNA, 18 nt, Escherichia coli CFT073
uaaaaauauauuccuaua

SEQ ID NO: 649195 - RNA, 17 nt, Escherichia coli CFT073
uaaaaauccuguuccau

SEQ ID NO: 649196 - RNA, 16 nt, Escherichia coli CFT073
uaaaaaucggcaacau

SEQ ID NO: 649197 - RNA, 15 nt, Escherichia coli CFT073
uaaaacaaauaucug

SEQ ID NO: 649198 - RNA, 15 nt, Escherichia coli CFT073
uaaaacaagcagcug

SEQ ID NO: 649199 - RNA, 15 nt, Escherichia coli CFT073
uaaaaccgacuuaaa

SEQ ID NO: 649200 - RNA, 13 nt, Escherichia coli CFT073
uaaaacagcagug

SEQ ID NO: 649201 - RNA, 15 nt, Escherichia coli CFT073
uaaaacagccaaugc

SEQ ID NO: 649202 - RNA, 21 nt, Escherichia coli CFT073
uaaaagcgugaaacaaaucac

SEQ ID NO: 649203 - RNA, 22 nt, Escherichia coli CFT073
uaaaagcgugaaacaaaucacu

SEQ ID NO: 649204 - RNA, 13 nt, Escherichia coli CFT073
uaaaaccugccaa

SEQ ID NO: 649205 - RNA, 21 nt, Escherichia coli CFT073
uaaaacgccgcuggugauuca

SEQ ID NO: 649206 - RNA, 20 nt, Escherichia coli CFT073
uaaaacgacucucauagacu

SEQ ID NO: 649207 - RNA, 16 nt, Escherichia coli CFT073
uaaaacgggauagcgu

SEQ ID NO: 649208 - RNA, 15 nt, Escherichia coli CFT073
uaaaacggaauaucc

SEQ ID NO: 649209 - RNA, 18 nt, Escherichia coli CFT073
uaaaacuaacgccaggaa

SEQ ID NO: 649210 - RNA, 16 nt, Escherichia coli CFT073
uaaaacucacaaccag

SEQ ID NO: 649211 - RNA, 21 nt, Escherichia coli CFT073
guuuguagcagaaaagaacca

SEQ ID NO: 649212 - RNA, 17 nt, Escherichia coli CFT073
guuuguagccgccaaac

SEQ ID NO: 649213 - RNA, 13 nt, Escherichia coli CFT073
guuuuaagcaaau

SEQ ID NO: 649214 - RNA, 14 nt, Escherichia coli CFT073
guuuuaaauauugu

SEQ ID NO: 649215 - RNA, 22 nt, Escherichia coli CFT073
guuuuaauagugguaccaggau

SEQ ID NO: 649216 - RNA, 19 nt, Escherichia coli CFT073
aaaucagcacagagauaaa

SEQ ID NO: 649217 - RNA, 16 nt, Escherichia coli CFT073
aaaucagccauaauaa

SEQ ID NO: 649218 - RNA, 14 nt, Escherichia coli CFT073
aaaucagccuuaau

SEQ ID NO: 649219 - RNA, 18 nt, Escherichia coli CFT073
aaaucagccuuaaucuuc

SEQ ID NO: 649220 - RNA, 14 nt, Escherichia coli CFT073
guuucaaacaggcu

SEQ ID NO: 649221 - RNA, 16 nt, Escherichia coli CFT073
guuucaaaaacaaaga

SEQ ID NO: 649222 - RNA, 17 nt, Escherichia coli CFT073
guuucaaaggugccaau

SEQ ID NO: 649223 - RNA, 18 nt, Escherichia coli CFT073
guuugaucgcuuccauug

SEQ ID NO: 649224 - RNA, 22 nt, Escherichia coli CFT073
guuugaugguggucgcaucauc

SEQ ID NO: 649225 - RNA, 13 nt, Escherichia coli CFT073
guuugcagcagaa

SEQ ID NO: 649226 - RNA, 21 nt, Escherichia coli CFT073
guuugcagugaucgugugcca

SEQ ID NO: 649227 - RNA, 16 nt, Escherichia coli CFT073
guuugccaaaccagcu

SEQ ID NO: 649228 - RNA, 16 nt, Escherichia coli CFT073
guuugccaccugugca

SEQ ID NO: 649229 - RNA, 12 nt, Escherichia coli CFT073
guuugccagcag

SEQ ID NO: 649230 - RNA, 14 nt, Escherichia coli CFT073
guuugccagcagag

SEQ ID NO: 649231 - RNA, 19 nt, Escherichia coli CFT073
guuugcccgucugcugcug

SEQ ID NO: 649232 - RNA, 16 nt, Escherichia coli CFT073
guuuuauccagugccg

SEQ ID NO: 649233 - RNA, 14 nt, Escherichia coli CFT073
aaauccagccagcg

SEQ ID NO: 649234 - RNA, 16 nt, Escherichia coli CFT073
guuuuauuauuccauc

SEQ ID NO: 649235 - RNA, 19 nt, Escherichia coli CFT073
guuuuauuauuccauccug

SEQ ID NO: 649236 - RNA, 22 nt, Escherichia coli CFT073
guuuuauuauuccauccugcuc

SEQ ID NO: 649237 - RNA, 16 nt, Escherichia coli CFT073
aaaucaugcaaauuca

SEQ ID NO: 649238 - RNA, 23 nt, Escherichia coli CFT073
aaaucaucugguuccuaaauaac

SEQ ID NO: 649239 - RNA, 17 nt, Escherichia coli CFT073
aaaucaguccacggcug

SEQ ID NO: 649240 - RNA, 14 nt, Escherichia coli CFT073
aaaucauccagcac

SEQ ID NO: 649241 - RNA, 16 nt, Escherichia coli CFT073
aaaucauccugcugca

SEQ ID NO: 649242 - RNA, 17 nt, Escherichia coli CFT073
guuuugucggcaugaua

SEQ ID NO: 649243 - RNA, 15 nt, Escherichia coli CFT073
guuuucuucaaugaa

SEQ ID NO: 649244 - RNA, 14 nt, Escherichia coli CFT073
guuuucuuccagcc

SEQ ID NO: 649245 - RNA, 17 nt, Escherichia coli CFT073
guuuucuuguuccugca

SEQ ID NO: 649246 - RNA, 16 nt, Escherichia coli CFT073
guuuucuuguugccug

SEQ ID NO: 649247 - RNA, 19 nt, Escherichia coli CFT073
guuuucuuuaccaccaaau

SEQ ID NO: 649248 - RNA, 15 nt, Escherichia coli CFT073
guuuucucccggcac

SEQ ID NO: 649249 - RNA, 15 nt, Escherichia coli CFT073
guuuucuggcugaca

SEQ ID NO: 649250 - RNA, 14 nt, Escherichia coli CFT073
guuuucugccagac

SEQ ID NO: 649251 - RNA, 19 nt, Escherichia coli CFT073
guuuucugccagacaaaac

SEQ ID NO: 649252 - RNA, 21 nt, Escherichia coli CFT073
guuuucuccaaccagcuguuc

SEQ ID NO: 649253 - RNA, 16 nt, Escherichia coli CFT073
guuuucucguccagcu

SEQ ID NO: 649254 - RNA, 17 nt, Escherichia coli CFT073
guuuucucguccagcuu

SEQ ID NO: 649255 - RNA, 23 nt, Escherichia coli CFT073
guuuucgucgccaucaauaacca

SEQ ID NO: 649256 - RNA, 12 nt, Escherichia coli CFT073
guuuuccuuuuc

SEQ ID NO: 649257 - RNA, 21 nt, Escherichia coli CFT073
guuuucgauuuuuuccagcgc

SEQ ID NO: 649258 - RNA, 14 nt, Escherichia coli CFT073
guuuuccagguuau

SEQ ID NO: 649259 - RNA, 22 nt, Escherichia coli CFT073
guuuuccauccuccgcagccau

SEQ ID NO: 649260 - RNA, 15 nt, Escherichia coli CFT073
guuuucgauuuuuuc

SEQ ID NO: 649261 - RNA, 14 nt, Escherichia coli CFT073
guuuuugguuucac

SEQ ID NO: 649262 - RNA, 15 nt, Escherichia coli CFT073
guuuuuguugauaaa

SEQ ID NO: 649263 - RNA, 15 nt, Escherichia coli CFT073
guuuuuuaagguuua

SEQ ID NO: 649264 - RNA, 18 nt, Escherichia coli CFT073
guuuuuugcgaaaaauaa

SEQ ID NO: 649265 - RNA, 15 nt, Escherichia coli CFT073
guuuuuuguugccug

SEQ ID NO: 649266 - RNA, 21 nt, Escherichia coli CFT073
guuuuuugggaugauagccau

SEQ ID NO: 649267 - RNA, 17 nt, Escherichia coli CFT073
guuuuuuuauagcuuau

SEQ ID NO: 649268 - RNA, 11 nt, Escherichia coli CFT073
guuuuuuauuu

SEQ ID NO: 649269 - RNA, 17 nt, Escherichia coli CFT073
guuuuuacccagcagca

SEQ ID NO: 649270 - RNA, 19 nt, Escherichia coli CFT073
guuuuuguaucgaacaaga

SEQ ID NO: 649271 - RNA, 19 nt, Escherichia coli CFT073
guuuuucuuccggcagcaa

SEQ ID NO: 649272 - RNA, 15 nt, Escherichia coli CFT073
guuuuucuuuuucaa

SEQ ID NO: 649273 - RNA, 19 nt, Escherichia coli CFT073
uaaaaaaggcagccaucug

SEQ ID NO: 649274 - RNA, 20 nt, Escherichia coli CFT073
uaaaaaaacaucauaauaau

SEQ ID NO: 649275 - RNA, 17 nt, Escherichia coli CFT073
uaaaaaaacgccagaau

SEQ ID NO: 649276 - RNA, 20 nt, Escherichia coli CFT073
guuuuuuuauaucucagaua

SEQ ID NO: 649277 - RNA, 23 nt, Escherichia coli CFT073
uaaaaacaguaccagaccaacau

SEQ ID NO: 649278 - RNA, 21 nt, Escherichia coli CFT073
uaaaaaccagagaauauuaac

SEQ ID NO: 649279 - RNA, 19 nt, Escherichia coli CFT073
uaaaaaguuguuaauaagu

SEQ ID NO: 649280 - RNA, 20 nt, Escherichia coli CFT073
uaaaaaguuguuaauaaguu

SEQ ID NO: 649281 - RNA, 12 nt, Escherichia coli CFT073
uaaaaagcggca

SEQ ID NO: 649282 - RNA, 16 nt, Escherichia coli CFT073
uaaccaaugccaccca

SEQ ID NO: 649283 - RNA, 21 nt, Escherichia coli CFT073
uaaccaugacgucgaaucggu

SEQ ID NO: 649284 - RNA, 16 nt, Escherichia coli CFT073
uaaccaugcagcgccg

SEQ ID NO: 649285 - RNA, 19 nt, Escherichia coli CFT073
uaacccacagcgcaccaac

SEQ ID NO: 649286 - RNA, 13 nt, Escherichia coli CFT073
uaaccaaacuuca

SEQ ID NO: 649287 - RNA, 14 nt, Escherichia coli CFT073
uaaccaaacuucag

SEQ ID NO: 649288 - RNA, 21 nt, Escherichia coli CFT073
uaaccaacaauacaaaauagg

SEQ ID NO: 649289 - RNA, 22 nt, Escherichia coli CFT073
uaacccaccaccgcuaacugcu

SEQ ID NO: 649290 - RNA, 20 nt, Escherichia coli CFT073
uaacccagcaccaacaaagc

SEQ ID NO: 649291 - RNA, 21 nt, Escherichia coli CFT073
uaacccagcaccaacaaagcc

SEQ ID NO: 649292 - RNA, 17 nt, Escherichia coli CFT073
uaaccgccagcacagcc

SEQ ID NO: 649293 - RNA, 15 nt, Escherichia coli CFT073
uaaccgcccaccgcc

SEQ ID NO: 649294 - RNA, 17 nt, Escherichia coli CFT073
uaaccgccguucuucag

SEQ ID NO: 649295 - RNA, 13 nt, Escherichia coli CFT073
uaaccuuccagcu

SEQ ID NO: 649296 - RNA, 22 nt, Escherichia coli CFT073
uaaccuguuuucgauuuuuucc

SEQ ID NO: 649297 - RNA, 14 nt, Escherichia coli CFT073
uaaccgcugccagg

SEQ ID NO: 649298 - RNA, 18 nt, Escherichia coli CFT073
uaaccgcuucgcuggcag

SEQ ID NO: 649299 - RNA, 14 nt, Escherichia coli CFT073
uaacgaacgcagug

SEQ ID NO: 649300 - RNA, 17 nt, Escherichia coli CFT073
uaacgaauaauccagcg

SEQ ID NO: 649301 - RNA, 22 nt, Escherichia coli CFT073
uaaccuuuucccgauauaacca

SEQ ID NO: 649302 - RNA, 21 nt, Escherichia coli CFT073
uaacgaaggugaacgccacca

SEQ ID NO: 649303 - RNA, 21 nt, Escherichia coli CFT073
uaacgaagucguuaguaacca

SEQ ID NO: 649304 - RNA, 23 nt, Escherichia coli CFT073
uaacgaagucguuaguaaccacu

SEQ ID NO: 649305 - RNA, 17 nt, Escherichia coli CFT073
uaaccuucuucauuaug

SEQ ID NO: 649306 - RNA, 21 nt, Escherichia coli CFT073
uaaccuuuaucacgcagcaga

SEQ ID NO: 649307 - RNA, 16 nt, Escherichia coli CFT073
uaaccuuugaacagcc

SEQ ID NO: 649308 - RNA, 18 nt, Escherichia coli CFT073
uaaccuuugaacagccag

SEQ ID NO: 649309 - RNA, 18 nt, Escherichia coli CFT073
uaacaguuugccaaacca

SEQ ID NO: 649310 - RNA, 20 nt, Escherichia coli CFT073
uaacaguuccagcaaaucaa

SEQ ID NO: 649311 - RNA, 17 nt, Escherichia coli CFT073
uaacaguugcaguuauu

SEQ ID NO: 649312 - RNA, 20 nt, Escherichia coli CFT073
uaacaguugcaguuauuaua

SEQ ID NO: 649313 - RNA, 15 nt, Escherichia coli CFT073
uaacaggcgauuuca

SEQ ID NO: 649314 - RNA, 16 nt, Escherichia coli CFT073
uaacaggcgcacacga

SEQ ID NO: 649315 - RNA, 21 nt, Escherichia coli CFT073
uaacagcgcaccagaaacaau

SEQ ID NO: 649316 - RNA, 22 nt, Escherichia coli CFT073
uaacagcggugcaccugccagc

SEQ ID NO: 649317 - RNA, 14 nt, Escherichia coli CFT073
uaacagcagcagcg

SEQ ID NO: 649318 - RNA, 16 nt, Escherichia coli CFT073
uaacagcaucgcauca

SEQ ID NO: 649319 - RNA, 20 nt, Escherichia coli CFT073
uaacaauguugucgccagua

SEQ ID NO: 649320 - RNA, 22 nt, Escherichia coli CFT073
uaacaauguugucgccaguaau

SEQ ID NO: 649321 - RNA, 14 nt, Escherichia coli CFT073
uaacaaucaucaac

SEQ ID NO: 649322 - RNA, 20 nt, Escherichia coli CFT073
uaacaaucaccaaaccaaca

SEQ ID NO: 649323 - RNA, 20 nt, Escherichia coli CFT073
uaacaauaucuaaaauguca

SEQ ID NO: 649324 - RNA, 17 nt, Escherichia coli CFT073
uaacauuacuaaacauu

SEQ ID NO: 649325 - RNA, 13 nt, Escherichia coli CFT073
uaacauuugcagc

SEQ ID NO: 649326 - RNA, 17 nt, Escherichia coli CFT073
uaacauaccuaaaagca

SEQ ID NO: 649327 - RNA, 22 nt, Escherichia coli CFT073
uaacaucaauaacaaagggaaa

SEQ ID NO: 649328 - RNA, 17 nt, Escherichia coli CFT073
uaacauauucacccgcg

SEQ ID NO: 649329 - RNA, 19 nt, Escherichia coli CFT073
uaacauauccccagggaag

SEQ ID NO: 649330 - RNA, 22 nt, Escherichia coli CFT073
uaaaugcacaggagacaccagc

SEQ ID NO: 649331 - RNA, 21 nt, Escherichia coli CFT073
uaaaugucaugacauucauaa

SEQ ID NO: 649332 - RNA, 17 nt, Escherichia coli CFT073
uaaaugcccgacaaaaa

SEQ ID NO: 649333 - RNA, 21 nt, Escherichia coli CFT073
uaaaugcccgacaaaaauuau

SEQ ID NO: 649334 - RNA, 22 nt, Escherichia coli CFT073
uaaauggcuuaaccccguaucc

SEQ ID NO: 649335 - RNA, 19 nt, Escherichia coli CFT073
uaaaugccggguaaagauu

SEQ ID NO: 649336 - RNA, 21 nt, Escherichia coli CFT073
uaaaugccggguaaagauugu

SEQ ID NO: 649337 - RNA, 16 nt, Escherichia coli CFT073
uaaaucguugcccgca

SEQ ID NO: 649338 - RNA, 20 nt, Escherichia coli CFT073
uaaaucaagcgccgccaguc

SEQ ID NO: 649339 - RNA, 16 nt, Escherichia coli CFT073
uaaaucaacgccagau

SEQ ID NO: 649340 - RNA, 21 nt, Escherichia coli CFT073
uaaaucugccgucaucgacuu

SEQ ID NO: 649341 - RNA, 14 nt, Escherichia coli CFT073
uaaaucugcuuuuc

SEQ ID NO: 649342 - RNA, 17 nt, Escherichia coli CFT073
uaaaucugcuuuucaua

SEQ ID NO: 649343 - RNA, 19 nt, Escherichia coli CFT073
uaaaucugcuuuucauaca

SEQ ID NO: 649344 - RNA, 22 nt, Escherichia coli CFT073
uaaaucugccgucaucgacuuc

SEQ ID NO: 649345 - RNA, 14 nt, Escherichia coli CFT073
uaaaucuucaagca

SEQ ID NO: 649346 - RNA, 13 nt, Escherichia coli CFT073
uaaaugaagaaaa

SEQ ID NO: 649347 - RNA, 14 nt, Escherichia coli CFT073
uaaaugaagaaaaa

SEQ ID NO: 649348 - RNA, 15 nt, Escherichia coli CFT073
uaaaugaagaaaaac

SEQ ID NO: 649349 - RNA, 22 nt, Escherichia coli CFT073
uaaaugaagaaaaaccguauuc

SEQ ID NO: 649350 - RNA, 16 nt, Escherichia coli CFT073
uaaauuaccaccagcg

SEQ ID NO: 649351 - RNA, 18 nt, Escherichia coli CFT073
uaaauugccccagacaca

SEQ ID NO: 649352 - RNA, 19 nt, Escherichia coli CFT073
uaaauugcaauuuuuauau

SEQ ID NO: 649353 - RNA, 15 nt, Escherichia coli CFT073
uaaauugcagcgauu

SEQ ID NO: 649354 - RNA, 14 nt, Escherichia coli CFT073
uaaauuauagaugc

SEQ ID NO: 649355 - RNA, 22 nt, Escherichia coli CFT073
uaaauugcugugauuaagcagc

SEQ ID NO: 649356 - RNA, 19 nt, Escherichia coli CFT073
uaacaauagcgaacagaca

SEQ ID NO: 649357 - RNA, 23 nt, Escherichia coli CFT073
uaacaauagcgaacagacaaaaa

SEQ ID NO: 649358 - RNA, 14 nt, Escherichia coli CFT073
uaaauaaaauaacc

SEQ ID NO: 649359 - RNA, 14 nt, Escherichia coli CFT073
uaaauaaucgauca

SEQ ID NO: 649360 - RNA, 19 nt, Escherichia coli CFT073
uaaauaauuugaacugguu

SEQ ID NO: 649361 - RNA, 24 nt, Escherichia coli CFT073
uaaauaccaagccaagccagagca

SEQ ID NO: 649362 - RNA, 13 nt, Escherichia coli CFT073
uaaauacagagca

SEQ ID NO: 649363 - RNA, 22 nt, Escherichia coli CFT073
uaaauauuauuggcaucguauu

SEQ ID NO: 649364 - RNA, 15 nt, Escherichia coli CFT073
uaaauaccguucauu

SEQ ID NO: 649365 - RNA, 21 nt, Escherichia coli CFT073
uaaauacgccucuucauacau

SEQ ID NO: 649366 - RNA, 14 nt, Escherichia coli CFT073
uaaauacugcgcau

SEQ ID NO: 649367 - RNA, 16 nt, Escherichia coli CFT073
uaaaggugucaauaau

SEQ ID NO: 649368 - RNA, 14 nt, Escherichia coli CFT073
uaaaggucaucaca

SEQ ID NO: 649369 - RNA, 23 nt, Escherichia coli CFT073
uaaagcgcguaguuugucuucaa

SEQ ID NO: 649370 - RNA, 19 nt, Escherichia coli CFT073
uaaagccuuuuaccgccuu

SEQ ID NO: 649371 - RNA, 19 nt, Escherichia coli CFT073
uaaaggaguaacagauugu

SEQ ID NO: 649372 - RNA, 22 nt, Escherichia coli CFT073
uaaagccggugcggucaggcau

SEQ ID NO: 649373 - RNA, 19 nt, Escherichia coli CFT073
uaaagcacugguggaaugg

SEQ ID NO: 649374 - RNA, 14 nt, Escherichia coli CFT073
uaaagcaauaaacc

SEQ ID NO: 649375 - RNA, 16 nt, Escherichia coli CFT073
uaaagacuauccgcca

SEQ ID NO: 649376 - RNA, 15 nt, Escherichia coli CFT073
uaaagagaucaaagu

SEQ ID NO: 649377 - RNA, 23 nt, Escherichia coli CFT073
uaaagacgguggcacauaauuga

SEQ ID NO: 649378 - RNA, 23 nt, Escherichia coli CFT073
uaaaauugauaaccaauaguagu

SEQ ID NO: 649379 - RNA, 13 nt, Escherichia coli CFT073
uaaaauuauccag

SEQ ID NO: 649380 - RNA, 16 nt, Escherichia coli CFT073
uaaacaaacagcgcgc

SEQ ID NO: 649381 - RNA, 14 nt, Escherichia coli CFT073
uaaacaauacagcg

SEQ ID NO: 649382 - RNA, 21 nt, Escherichia coli CFT073
uaaacaauugcauaucaauua

SEQ ID NO: 649383 - RNA, 14 nt, Escherichia coli CFT073
uaaacacaccacag

SEQ ID NO: 649384 - RNA, 12 nt, Escherichia coli CFT073
uaaacaccagca

SEQ ID NO: 649385 - RNA, 21 nt, Escherichia coli CFT073
uaaacaccugggcaaugguga

SEQ ID NO: 649386 - RNA, 14 nt, Escherichia coli CFT073
uaaacaucuucuua

SEQ ID NO: 649387 - RNA, 23 nt, Escherichia coli CFT073
uaaacaucuucuuaggcauugcc

SEQ ID NO: 649388 - RNA, 19 nt, Escherichia coli CFT073
uaaacaucaggcaaaguca

SEQ ID NO: 649389 - RNA, 14 nt, Escherichia coli CFT073
uaaacgugaauuuu

SEQ ID NO: 649390 - RNA, 22 nt, Escherichia coli CFT073
uaaagaaauuucccaccgaaac

SEQ ID NO: 649391 - RNA, 16 nt, Escherichia coli CFT073
uaaagaacccggcaau

SEQ ID NO: 649392 - RNA, 14 nt, Escherichia coli CFT073
uaaagaaacugguu

SEQ ID NO: 649393 - RNA, 22 nt, Escherichia coli CFT073
uaaagaaacugguugcaacauc

SEQ ID NO: 649394 - RNA, 19 nt, Escherichia coli CFT073
uaaacccgaccacuuccac

SEQ ID NO: 649395 - RNA, 18 nt, Escherichia coli CFT073
uaaacccuaacaucaucc

SEQ ID NO: 649396 - RNA, 15 nt, Escherichia coli CFT073
uaaacccguugcuuc

SEQ ID NO: 649397 - RNA, 18 nt, Escherichia coli CFT073
uaaacccguugcuucacg

SEQ ID NO: 649398 - RNA, 16 nt, Escherichia coli CFT073
uaaacccuucacugua

SEQ ID NO: 649399 - RNA, 14 nt, Escherichia coli CFT073
uaaacccuuucugc

SEQ ID NO: 649400 - RNA, 14 nt, Escherichia coli CFT073
uaaaccgagccaaa

SEQ ID NO: 649401 - RNA, 20 nt, Escherichia coli CFT073
uaaacgguguaaaauucaca

SEQ ID NO: 649402 - RNA, 20 nt, Escherichia coli CFT073
uaaacguagcggaaaucaca

SEQ ID NO: 649403 - RNA, 18 nt, Escherichia coli CFT073
uaaaccuuguuuaaucuc

SEQ ID NO: 649404 - RNA, 19 nt, Escherichia coli CFT073
uaaaccuuguuuaaucucg

SEQ ID NO: 649405 - RNA, 14 nt, Escherichia coli CFT073
uaaaccugcucacc

SEQ ID NO: 649406 - RNA, 23 nt, Escherichia coli CFT073
uaaaccugcucaccagucacuaa

SEQ ID NO: 649407 - RNA, 22 nt, Escherichia coli CFT073
guuggcagcggcaagcuggcga

SEQ ID NO: 649408 - RNA, 18 nt, Escherichia coli CFT073
guuggcaucaagaaaacu

SEQ ID NO: 649409 - RNA, 22 nt, Escherichia coli CFT073
guuggcagaucgguuaucuugc

SEQ ID NO: 649410 - RNA, 19 nt, Escherichia coli CFT073
guugccacguugguggcaa

SEQ ID NO: 649411 - RNA, 17 nt, Escherichia coli CFT073
guugccacucaggcaaa

SEQ ID NO: 649412 - RNA, 19 nt, Escherichia coli CFT073
guugccaccgguacaaaca

SEQ ID NO: 649413 - RNA, 15 nt, Escherichia coli CFT073
guugccagcgccagc

SEQ ID NO: 649414 - RNA, 22 nt, Escherichia coli CFT073
guuguaguuggaugacauugau

SEQ ID NO: 649415 - RNA, 15 nt, Escherichia coli CFT073
guugucuggcuggug

SEQ ID NO: 649416 - RNA, 23 nt, Escherichia coli CFT073
guugugaauauugccgcugacac

SEQ ID NO: 649417 - RNA, 22 nt, Escherichia coli CFT073
guugugccagaccgaacagcau

SEQ ID NO: 649418 - RNA, 20 nt, Escherichia coli CFT073
guuguaccagcuucagaaua

SEQ ID NO: 649419 - RNA, 22 nt, Escherichia coli CFT073
guuguacggcaauaucugcacc

SEQ ID NO: 649420 - RNA, 21 nt, Escherichia coli CFT073
guuguagguacccggaaugua

SEQ ID NO: 649421 - RNA, 14 nt, Escherichia coli CFT073
guuggguuagccaa

SEQ ID NO: 649422 - RNA, 15 nt, Escherichia coli CFT073
guuguaaucaccacu

SEQ ID NO: 649423 - RNA, 20 nt, Escherichia coli CFT073
guuuauaacggugcugcaca

SEQ ID NO: 649424 - RNA, 16 nt, Escherichia coli CFT073
guuuauaacggugcug

SEQ ID NO: 649425 - RNA, 15 nt, Escherichia coli CFT073
guuuauuagcccagc

SEQ ID NO: 649426 - RNA, 18 nt, Escherichia coli CFT073
guuuauagccuguccaca

SEQ ID NO: 649427 - RNA, 18 nt, Escherichia coli CFT073
guuuauucuuuacugcca

SEQ ID NO: 649428 - RNA, 14 nt, Escherichia coli CFT073
guuuaccagcagcc

SEQ ID NO: 649429 - RNA, 23 nt, Escherichia coli CFT073
guuuaccgcccaugccaguaaua

SEQ ID NO: 649430 - RNA, 18 nt, Escherichia coli CFT073
guuuaccucgucaccacc

SEQ ID NO: 649431 - RNA, 20 nt, Escherichia coli CFT073
guuuagccgcuucugcagcu

SEQ ID NO: 649432 - RNA, 17 nt, Escherichia coli CFT073
guuuagcaguucaucaa

SEQ ID NO: 649433 - RNA, 15 nt, Escherichia coli CFT073
guuuagacgcugcgg

SEQ ID NO: 649434 - RNA, 19 nt, Escherichia coli CFT073
guuguugcaggaacagaau

SEQ ID NO: 649435 - RNA, 23 nt, Escherichia coli CFT073
guuuaaaaauacacaauccgcug

SEQ ID NO: 649436 - RNA, 19 nt, Escherichia coli CFT073
guugauuggcgcgaaccau

SEQ ID NO: 649437 - RNA, 16 nt, Escherichia coli CFT073
guugauuuaacagcaa

SEQ ID NO: 649438 - RNA, 11 nt, Escherichia coli CFT073
guugauuucca

SEQ ID NO: 649439 - RNA, 22 nt, Escherichia coli CFT073
guugaugguguagaaccgguug

SEQ ID NO: 649440 - RNA, 15 nt, Escherichia coli CFT073
guugauuuuguucaa

SEQ ID NO: 649441 - RNA, 19 nt, Escherichia coli CFT073
guugauuuuucguuuuaau

SEQ ID NO: 649442 - RNA, 14 nt, Escherichia coli CFT073
guugcauuccagau

SEQ ID NO: 649443 - RNA, 22 nt, Escherichia coli CFT073
guugaucaggugauggcagcca

SEQ ID NO: 649444 - RNA, 20 nt, Escherichia coli CFT073
guugaucgcuuucagcgucu

SEQ ID NO: 649445 - RNA, 17 nt, Escherichia coli CFT073
guugaucugccccauag

SEQ ID NO: 649446 - RNA, 14 nt, Escherichia coli CFT073
guugaugauguuca

SEQ ID NO: 649447 - RNA, 18 nt, Escherichia coli CFT073
guugaauugcagggugca

SEQ ID NO: 649448 - RNA, 22 nt, Escherichia coli CFT073
guugaauuucagguucugacca

SEQ ID NO: 649449 - RNA, 19 nt, Escherichia coli CFT073
guugaagaucaugaugaug

SEQ ID NO: 649450 - RNA, 12 nt, Escherichia coli CFT073
guugaagucagg

SEQ ID NO: 649451 - RNA, 12 nt, Escherichia coli CFT073
guugaacagacg

SEQ ID NO: 649452 - RNA, 16 nt, Escherichia coli CFT073
guugagagaagaaacg

SEQ ID NO: 649453 - RNA, 20 nt, Escherichia coli CFT073
guugagcaacaacuucaggu

SEQ ID NO: 649454 - RNA, 18 nt, Escherichia coli CFT073
guugacguccagcccuuc

SEQ ID NO: 649455 - RNA, 13 nt, Escherichia coli CFT073
guugaccgcccgg

SEQ ID NO: 649456 - RNA, 13 nt, Escherichia coli CFT073
guugaccaagaac

SEQ ID NO: 649457 - RNA, 12 nt, Escherichia coli CFT073
guucuuacccac

SEQ ID NO: 649458 - RNA, 20 nt, Escherichia coli CFT073
guucugucgauaaacucaug

SEQ ID NO: 649459 - RNA, 18 nt, Escherichia coli CFT073
guucugcggcguaacgca

SEQ ID NO: 649460 - RNA, 19 nt, Escherichia coli CFT073
guucugcgucuuauuggca

SEQ ID NO: 649461 - RNA, 12 nt, Escherichia coli CFT073
guucugauuuug

SEQ ID NO: 649462 - RNA, 14 nt, Escherichia coli CFT073
guucucuucugcuu

SEQ ID NO: 649463 - RNA, 16 nt, Escherichia coli CFT073
guucguugauaauaaa

SEQ ID NO: 649464 - RNA, 15 nt, Escherichia coli CFT073
guucuuccgccagac

SEQ ID NO: 649465 - RNA, 13 nt, Escherichia coli CFT073
guucuuuuuuuaa

SEQ ID NO: 649466 - RNA, 12 nt, Escherichia coli CFT073
guucuuuccugc

SEQ ID NO: 649467 - RNA, 19 nt, Escherichia coli CFT073
guucuuucggugcaucgug

SEQ ID NO: 649468 - RNA, 15 nt, Escherichia coli CFT073
guugaaauaaaccag

SEQ ID NO: 649469 - RNA, 21 nt, Escherichia coli CFT073
guucagaucaucaaagaacag

SEQ ID NO: 649470 - RNA, 19 nt, Escherichia coli CFT073
guucagaugaccaauaacc

SEQ ID NO: 649471 - RNA, 15 nt, Escherichia coli CFT073
guucacuuuucuucu

SEQ ID NO: 649472 - RNA, 14 nt, Escherichia coli CFT073
guucagaaagcgcc

SEQ ID NO: 649473 - RNA, 20 nt, Escherichia coli CFT073
guucaauuuccaguuucaca

SEQ ID NO: 649474 - RNA, 16 nt, Escherichia coli CFT073
guucaaugauaauuca

SEQ ID NO: 649475 - RNA, 14 nt, Escherichia coli CFT073
guucaagagcuuca

SEQ ID NO: 649476 - RNA, 22 nt, Escherichia coli CFT073
guucaaaugcgcucagaguacc

SEQ ID NO: 649477 - RNA, 20 nt, Escherichia coli CFT073
guucaacaagccacgcacca

SEQ ID NO: 649478 - RNA, 13 nt, Escherichia coli CFT073
guucaaguaaaac

SEQ ID NO: 649479 - RNA, 22 nt, Escherichia coli CFT073
guucaauacgcaguuuugucuu

SEQ ID NO: 649480 - RNA, 18 nt, Escherichia coli CFT073
guucauauaauuccaccc

SEQ ID NO: 649481 - RNA, 20 nt, Escherichia coli CFT073
guucauauuaaccucucaga

SEQ ID NO: 649482 - RNA, 23 nt, Escherichia coli CFT073
guucauauugcggcauuugucug

SEQ ID NO: 649483 - RNA, 11 nt, Escherichia coli CFT073
guucagugaau

SEQ ID NO: 649484 - RNA, 16 nt, Escherichia coli CFT073
guucaugguuagccug

SEQ ID NO: 649485 - RNA, 21 nt, Escherichia coli CFT073
guucauuuuuaggauaaauca

SEQ ID NO: 649486 - RNA, 14 nt, Escherichia coli CFT073
guuccagcaaauca

SEQ ID NO: 649487 - RNA, 18 nt, Escherichia coli CFT073
guuccagcaaaucaaucu

SEQ ID NO: 649488 - RNA, 12 nt, Escherichia coli CFT073
guuccagcagaa

SEQ ID NO: 649489 - RNA, 13 nt, Escherichia coli CFT073
guuccagcagcuc

SEQ ID NO: 649490 - RNA, 15 nt, Escherichia coli CFT073
guucgagaaaaccga

SEQ ID NO: 649491 - RNA, 19 nt, Escherichia coli CFT073
guucgaucaccgcacggcg

SEQ ID NO: 649492 - RNA, 15 nt, Escherichia coli CFT073
guucgauuucauuca

SEQ ID NO: 649493 - RNA, 17 nt, Escherichia coli CFT073
guucgcaccaaauccaa

SEQ ID NO: 649494 - RNA, 19 nt, Escherichia coli CFT073
guucgcgguuuucuuccag

SEQ ID NO: 649495 - RNA, 20 nt, Escherichia coli CFT073
guucgcguagcugcugcuca

SEQ ID NO: 649496 - RNA, 15 nt, Escherichia coli CFT073
guucgcguccagcuu

SEQ ID NO: 649497 - RNA, 19 nt, Escherichia coli CFT073
guucgcuuucgcgaaugcg

SEQ ID NO: 649498 - RNA, 13 nt, Escherichia coli CFT073
guucggcaucauc

SEQ ID NO: 649499 - RNA, 15 nt, Escherichia coli CFT073
guucccgcggcgcag

SEQ ID NO: 649500 - RNA, 16 nt, Escherichia coli CFT073
guuccgggaucaccag

SEQ ID NO: 649501 - RNA, 20 nt, Escherichia coli CFT073
guuccgggcuguuuuccagc

SEQ ID NO: 649502 - RNA, 18 nt, Escherichia coli CFT073
guuccggguuuucaacug

SEQ ID NO: 649503 - RNA, 21 nt, Escherichia coli CFT073
guuccgguaaaucgacccuga

SEQ ID NO: 649504 - RNA, 15 nt, Escherichia coli CFT073
guuccguuuccagcc

SEQ ID NO: 649505 - RNA, 21 nt, Escherichia coli CFT073
guucccaccucgugcaccgcc

SEQ ID NO: 649506 - RNA, 13 nt, Escherichia coli CFT073
guucccagagaau

SEQ ID NO: 649507 - RNA, 22 nt, Escherichia coli CFT073
guuccagcauguuauucaugcc

SEQ ID NO: 649508 - RNA, 20 nt, Escherichia coli CFT073
guuccagggccuccugcagc

SEQ ID NO: 649509 - RNA, 14 nt, Escherichia coli CFT073
guuagagcacagau

SEQ ID NO: 649510 - RNA, 18 nt, Escherichia coli CFT073
guuagacgcguuuacaga

SEQ ID NO: 649511 - RNA, 20 nt, Escherichia coli CFT073
guuagacgcguuuacagagc

SEQ ID NO: 649512 - RNA, 14 nt, Escherichia coli CFT073
guuacggaaacucu

SEQ ID NO: 649513 - RNA, 18 nt, Escherichia coli CFT073
guuacuaaaaguaaauaa

SEQ ID NO: 649514 - RNA, 13 nt, Escherichia coli CFT073
guuauaaaacaca

SEQ ID NO: 649515 - RNA, 21 nt, Escherichia coli CFT073
guuauaaacgcucggcaacac

SEQ ID NO: 649516 - RNA, 19 nt, Escherichia coli CFT073
guuagccgcguacauugcu

SEQ ID NO: 649517 - RNA, 18 nt, Escherichia coli CFT073
guuagcggcgguaaaauc

SEQ ID NO: 649518 - RNA, 22 nt, Escherichia coli CFT073
guuauuacugcgaauuuccugc

SEQ ID NO: 649519 - RNA, 20 nt, Escherichia coli CFT073
guuauucgcuuccuccacca

SEQ ID NO: 649520 - RNA, 15 nt, Escherichia coli CFT073
guuauucgcuuccuc

SEQ ID NO: 649521 - RNA, 15 nt, Escherichia coli CFT073
guuauucccguggcc

SEQ ID NO: 649522 - RNA, 19 nt, Escherichia coli CFT073
guuauucccguggccugca

SEQ ID NO: 649523 - RNA, 18 nt, Escherichia coli CFT073
guucaaacaccaguucac

SEQ ID NO: 649524 - RNA, 18 nt, Escherichia coli CFT073
guucaaaccguaaagcac

SEQ ID NO: 649525 - RNA, 23 nt, Escherichia coli CFT073
guucaaacuucgccacagcggca

SEQ ID NO: 649526 - RNA, 14 nt, Escherichia coli CFT073
guuauccugcaaau

SEQ ID NO: 649527 - RNA, 16 nt, Escherichia coli CFT073
guuaucgccugcgcca

SEQ ID NO: 649528 - RNA, 18 nt, Escherichia coli CFT073
guuaucguaccaggcgac

SEQ ID NO: 649529 - RNA, 17 nt, Escherichia coli CFT073
guuauacaccuguucca

SEQ ID NO: 649530 - RNA, 13 nt, Escherichia coli CFT073
guuauacaucgcu

SEQ ID NO: 649531 - RNA, 19 nt, Escherichia coli CFT073
guuauacaucgcuuuccag

SEQ ID NO: 649532 - RNA, 15 nt, Escherichia coli CFT073
guuauccagcaacca

SEQ ID NO: 649533 - RNA, 15 nt, Escherichia coli CFT073
guuaucccauuccac

SEQ ID NO: 649534 - RNA, 19 nt, Escherichia coli CFT073
guguuucaucucaucaaug

SEQ ID NO: 649535 - RNA, 19 nt, Escherichia coli CFT073
guuaaagagaucaaagucu

SEQ ID NO: 649536 - RNA, 19 nt, Escherichia coli CFT073
guuaaacuuucauaaacac

SEQ ID NO: 649537 - RNA, 18 nt, Escherichia coli CFT073
guuaaaggugucaauaau

SEQ ID NO: 649538 - RNA, 15 nt, Escherichia coli CFT073
gugucgccgaagcag

SEQ ID NO: 649539 - RNA, 19 nt, Escherichia coli CFT073
guguuuaucuuccagcauu

SEQ ID NO: 649540 - RNA, 21 nt, Escherichia coli CFT073
guguugguaaacgcauagauc

SEQ ID NO: 649541 - RNA, 15 nt, Escherichia coli CFT073
gugucgccugcagga

SEQ ID NO: 649542 - RNA, 14 nt, Escherichia coli CFT073
guuacaaccuccuc

SEQ ID NO: 649543 - RNA, 20 nt, Escherichia coli CFT073
guuaccaguaaccagaaacc

SEQ ID NO: 649544 - RNA, 14 nt, Escherichia coli CFT073
guuacauugugaug

SEQ ID NO: 649545 - RNA, 21 nt, Escherichia coli CFT073
guuaccagccgggcgguuaac

SEQ ID NO: 649546 - RNA, 22 nt, Escherichia coli CFT073
guuacgccggugauuaaaccaa

SEQ ID NO: 649547 - RNA, 17 nt, Escherichia coli CFT073
guuaauccgcucugccc

SEQ ID NO: 649548 - RNA, 13 nt, Escherichia coli CFT073
guuaauauuuccc

SEQ ID NO: 649549 - RNA, 16 nt, Escherichia coli CFT073
guuaauaccugcacca

SEQ ID NO: 649550 - RNA, 14 nt, Escherichia coli CFT073
guuaaauugaaauu

SEQ ID NO: 649551 - RNA, 18 nt, Escherichia coli CFT073
guggucgguaaacaucag

SEQ ID NO: 649552 - RNA, 15 nt, Escherichia coli CFT073
guggucgcaucaucc

SEQ ID NO: 649553 - RNA, 16 nt, Escherichia coli CFT073
guggugauacaccuca

SEQ ID NO: 649554 - RNA, 22 nt, Escherichia coli CFT073
guggugcaauccacaagcacag

SEQ ID NO: 649555 - RNA, 13 nt, Escherichia coli CFT073
gugguaucaaaau

SEQ ID NO: 649556 - RNA, 15 nt, Escherichia coli CFT073
gugguaugaauuuuc

SEQ ID NO: 649557 - RNA, 22 nt, Escherichia coli CFT073
gugguaccaggaucagcaaaau

SEQ ID NO: 649558 - RNA, 13 nt, Escherichia coli CFT073
guggucagcacaa

SEQ ID NO: 649559 - RNA, 14 nt, Escherichia coli CFT073
guguauuaccuccg

SEQ ID NO: 649560 - RNA, 19 nt, Escherichia coli CFT073
guguaagaaugcuccccag

SEQ ID NO: 649561 - RNA, 23 nt, Escherichia coli CFT073
guguaguauuugaguucacugcc

SEQ ID NO: 649562 - RNA, 12 nt, Escherichia coli CFT073
guguaucuucau

SEQ ID NO: 649563 - RNA, 21 nt, Escherichia coli CFT073
guggugcgguuuuuggagaga

SEQ ID NO: 649564 - RNA, 17 nt, Escherichia coli CFT073
guguaaaaaaucccagc

SEQ ID NO: 649565 - RNA, 17 nt, Escherichia coli CFT073
gugggcuaacacugcca

SEQ ID NO: 649566 - RNA, 11 nt, Escherichia coli CFT073
guggcuggggu

SEQ ID NO: 649567 - RNA, 18 nt, Escherichia coli CFT073
guggcugggguacgagga

SEQ ID NO: 649568 - RNA, 14 nt, Escherichia coli CFT073
gugcugagaguaac

SEQ ID NO: 649569 - RNA, 19 nt, Escherichia coli CFT073
gugcugaugucaguauucc

SEQ ID NO: 649570 - RNA, 19 nt, Escherichia coli CFT073
gugcugcaccaacaucaug

SEQ ID NO: 649571 - RNA, 17 nt, Escherichia coli CFT073
gugcugcuggaaaaggu

SEQ ID NO: 649572 - RNA, 18 nt, Escherichia coli CFT073
gugcuucgaaacagaaau

SEQ ID NO: 649573 - RNA, 19 nt, Escherichia coli CFT073
gugcuuuuccucauuuaaa

SEQ ID NO: 649574 - RNA, 17 nt, Escherichia coli CFT073
guggaaugauuaaacga

SEQ ID NO: 649575 - RNA, 15 nt, Escherichia coli CFT073
gugcucuggcaggcg

SEQ ID NO: 649576 - RNA, 12 nt, Escherichia coli CFT073
gugcucuuccuu

SEQ ID NO: 649577 - RNA, 19 nt, Escherichia coli CFT073
gugcugaagggcaucagcc

SEQ ID NO: 649578 - RNA, 20 nt, Escherichia coli CFT073
gugcuccuucucugagcugg

SEQ ID NO: 649579 - RNA, 17 nt, Escherichia coli CFT073
gugcucccugagcaaca

SEQ ID NO: 649580 - RNA, 16 nt, Escherichia coli CFT073
gugcuccagugcgcuu

SEQ ID NO: 649581 - RNA, 14 nt, Escherichia coli CFT073
gugcucgcuuucca

SEQ ID NO: 649582 - RNA, 17 nt, Escherichia coli CFT073
gugcuaaaugucauccc

SEQ ID NO: 649583 - RNA, 14 nt, Escherichia coli CFT073
gugcucauagacca

SEQ ID NO: 649584 - RNA, 15 nt, Escherichia coli CFT073
gugcucauccuucag

SEQ ID NO: 649585 - RNA, 16 nt, Escherichia coli CFT073
gugcggguaaccagcc

SEQ ID NO: 649586 - RNA, 14 nt, Escherichia coli CFT073
gugcgguaagcugc

SEQ ID NO: 649587 - RNA, 20 nt, Escherichia coli CFT073
gugcgucgcauccggcaauu

SEQ ID NO: 649588 - RNA, 12 nt, Escherichia coli CFT073
gugcgucagggc

SEQ ID NO: 649589 - RNA, 15 nt, Escherichia coli CFT073
gugcgcguggcaauu

SEQ ID NO: 649590 - RNA, 16 nt, Escherichia coli CFT073
gugcgcgaaccagaga

SEQ ID NO: 649591 - RNA, 19 nt, Escherichia coli CFT073
gugcgcgaaccagagacag

SEQ ID NO: 649592 - RNA, 19 nt, Escherichia coli CFT073
gugcgcccuguucugcaag

SEQ ID NO: 649593 - RNA, 24 nt, Escherichia coli CFT073
gugcgauggcaggccccgucagca

SEQ ID NO: 649594 - RNA, 23 nt, Escherichia coli CFT073
gugcgagcgccuuauccggccug

SEQ ID NO: 649595 - RNA, 12 nt, Escherichia coli CFT073
gugcgccagcaa

SEQ ID NO: 649596 - RNA, 17 nt, Escherichia coli CFT073
gucucaauuuauauuca

SEQ ID NO: 649597 - RNA, 16 nt, Escherichia coli CFT073
gugaugcggaaauauc

SEQ ID NO: 649598 - RNA, 18 nt, Escherichia coli CFT073
gugaugcggcaucuguac

SEQ ID NO: 649599 - RNA, 17 nt, Escherichia coli CFT073
gugaugcccugaugcgu

SEQ ID NO: 649600 - RNA, 15 nt, Escherichia coli CFT073
gugaugacgccagcc

SEQ ID NO: 649601 - RNA, 21 nt, Escherichia coli CFT073
gugauggccagauaacccagg

SEQ ID NO: 649602 - RNA, 21 nt, Escherichia coli CFT073
gugauguagucaucugcaccg

SEQ ID NO: 649603 - RNA, 12 nt, Escherichia coli CFT073
gugcauccagug

SEQ ID NO: 649604 - RNA, 15 nt, Escherichia coli CFT073
gugcaucaacauaua

SEQ ID NO: 649605 - RNA, 20 nt, Escherichia coli CFT073
gugcagcgcaugauuuucau

SEQ ID NO: 649606 - RNA, 13 nt, Escherichia coli CFT073
aaauauagcugaa

SEQ ID NO: 649607 - RNA, 20 nt, Escherichia coli CFT073
gugcauuaugcgcauagcua

SEQ ID NO: 649608 - RNA, 20 nt, Escherichia coli CFT073
gugcauuccagcauuuguug

SEQ ID NO: 649609 - RNA, 23 nt, Escherichia coli CFT073
gugcagccggagcuucacccgca

SEQ ID NO: 649610 - RNA, 13 nt, Escherichia coli CFT073
gugcagccgugga

SEQ ID NO: 649611 - RNA, 14 nt, Escherichia coli CFT073
gugcagccaaaaau

SEQ ID NO: 649612 - RNA, 14 nt, Escherichia coli CFT073
gugcagcagcuucg

SEQ ID NO: 649613 - RNA, 18 nt, Escherichia coli CFT073
gugcaccgcgcuggcuga

SEQ ID NO: 649614 - RNA, 11 nt, Escherichia coli CFT073
gugcaccugcc

SEQ ID NO: 649615 - RNA, 17 nt, Escherichia coli CFT073
gugcacagguaaacgca

SEQ ID NO: 649616 - RNA, 12 nt, Escherichia coli CFT073
gugcaaaaaaau

SEQ ID NO: 649617 - RNA, 13 nt, Escherichia coli CFT073
gugcccuuucagu

SEQ ID NO: 649618 - RNA, 19 nt, Escherichia coli CFT073
gugccgcaaccuucgccag

SEQ ID NO: 649619 - RNA, 17 nt, Escherichia coli CFT073
gugccgcaccagcuuuc

SEQ ID NO: 649620 - RNA, 16 nt, Escherichia coli CFT073
gugccaggaccauuca

SEQ ID NO: 649621 - RNA, 23 nt, Escherichia coli CFT073
gugccagcgauuuugccagccgc

SEQ ID NO: 649622 - RNA, 12 nt, Escherichia coli CFT073
gugccaggacca

SEQ ID NO: 649623 - RNA, 15 nt, Escherichia coli CFT073
gugccagcgccagca

SEQ ID NO: 649624 - RNA, 16 nt, Escherichia coli CFT073
gugccagcgccagcac

SEQ ID NO: 649625 - RNA, 20 nt, Escherichia coli CFT073
gugccagcgccagcacuuua

SEQ ID NO: 649626 - RNA, 12 nt, Escherichia coli CFT073
gugccaucccag

SEQ ID NO: 649627 - RNA, 15 nt, Escherichia coli CFT073
gugccagacaaacca

SEQ ID NO: 649628 - RNA, 12 nt, Escherichia coli CFT073
gugccagauuga

SEQ ID NO: 649629 - RNA, 21 nt, Escherichia coli CFT073
gugcauuuuucgcuuuucacc

SEQ ID NO: 649630 - RNA, 17 nt, Escherichia coli CFT073
gugccaacaccacaaau

SEQ ID NO: 649631 - RNA, 19 nt, Escherichia coli CFT073
gugccggucugaauacgcc

SEQ ID NO: 649632 - RNA, 18 nt, Escherichia coli CFT073
gugccgguugugugcugg

SEQ ID NO: 649633 - RNA, 16 nt, Escherichia coli CFT073
gugccggaagucucuu

SEQ ID NO: 649634 - RNA, 16 nt, Escherichia coli CFT073
gugccgccgcccggca

SEQ ID NO: 649635 - RNA, 20 nt, Escherichia coli CFT073
gugccgcgauaccacccgca

SEQ ID NO: 649636 - RNA, 12 nt, Escherichia coli CFT073
gugccuucacgg

SEQ ID NO: 649637 - RNA, 22 nt, Escherichia coli CFT073
gugcgaaaaaaauuacucauac

SEQ ID NO: 649638 - RNA, 19 nt, Escherichia coli CFT073
gugccgucugccccgccgc

SEQ ID NO: 649639 - RNA, 16 nt, Escherichia coli CFT073
gugccguggcgcucgc

SEQ ID NO: 649640 - RNA, 20 nt, Escherichia coli CFT073
gugccucguucacauauugc

SEQ ID NO: 649641 - RNA, 23 nt, Escherichia coli CFT073
uacacggugcgaugcaaaaucag

SEQ ID NO: 649642 - RNA, 21 nt, Escherichia coli CFT073
uacaccuuuccccggcagcau

SEQ ID NO: 649643 - RNA, 17 nt, Escherichia coli CFT073
uacacgcacggcauauu

SEQ ID NO: 649644 - RNA, 12 nt, Escherichia coli CFT073
uacaccuucauc

SEQ ID NO: 649645 - RNA, 17 nt, Escherichia coli CFT073
uacacgaaacgaaaccc

SEQ ID NO: 649646 - RNA, 18 nt, Escherichia coli CFT073
uacaccgccguugauuuc

SEQ ID NO: 649647 - RNA, 21 nt, Escherichia coli CFT073
uacaccaucacgccccaaugc

SEQ ID NO: 649648 - RNA, 20 nt, Escherichia coli CFT073
uacaccauuuaaugacaaaa

SEQ ID NO: 649649 - RNA, 18 nt, Escherichia coli CFT073
uacaccaaucgucaaugc

SEQ ID NO: 649650 - RNA, 19 nt, Escherichia coli CFT073
uacacccaaucccugaccu

SEQ ID NO: 649651 - RNA, 23 nt, Escherichia coli CFT073
uacacccagccccgguuuuucug

SEQ ID NO: 649652 - RNA, 14 nt, Escherichia coli CFT073
uacaccccagccgg

SEQ ID NO: 649653 - RNA, 14 nt, Escherichia coli CFT073
uacagaaaguagcg

SEQ ID NO: 649654 - RNA, 21 nt, Escherichia coli CFT073
uacacugguucccaacaacag

SEQ ID NO: 649655 - RNA, 15 nt, Escherichia coli CFT073
uacagauacauuuca

SEQ ID NO: 649656 - RNA, 15 nt, Escherichia coli CFT073
uacagacucaaacca

SEQ ID NO: 649657 - RNA, 17 nt, Escherichia coli CFT073
uacagacaccaaucagc

SEQ ID NO: 649658 - RNA, 17 nt, Escherichia coli CFT073
uacagaccccggcauug

SEQ ID NO: 649659 - RNA, 15 nt, Escherichia coli CFT073
uacaaccgcgaacug

SEQ ID NO: 649660 - RNA, 18 nt, Escherichia coli CFT073
uacaaccguuucaugcca

SEQ ID NO: 649661 - RNA, 17 nt, Escherichia coli CFT073
uacaacguccuuucaug

SEQ ID NO: 649662 - RNA, 18 nt, Escherichia coli CFT073
uacaacguccuuucaugc

SEQ ID NO: 649663 - RNA, 17 nt, Escherichia coli CFT073
uacaauaaaaguuuccu

SEQ ID NO: 649664 - RNA, 17 nt, Escherichia coli CFT073
uacacacuuuccaggcg

SEQ ID NO: 649665 - RNA, 21 nt, Escherichia coli CFT073
uacacagauaaacuacagaug

SEQ ID NO: 649666 - RNA, 14 nt, Escherichia coli CFT073
uacaccaaagcggu

SEQ ID NO: 649667 - RNA, 19 nt, Escherichia coli CFT073
uacacagcccaguuuuuca

SEQ ID NO: 649668 - RNA, 19 nt, Escherichia coli CFT073
uacaaugcaauauuuugaa

SEQ ID NO: 649669 - RNA, 16 nt, Escherichia coli CFT073
uacaaucaggccaauc

SEQ ID NO: 649670 - RNA, 13 nt, Escherichia coli CFT073
uacaauauccagc

SEQ ID NO: 649671 - RNA, 15 nt, Escherichia coli CFT073
uacauaguucuucaa

SEQ ID NO: 649672 - RNA, 14 nt, Escherichia coli CFT073
uacauauauuacuc

SEQ ID NO: 649673 - RNA, 22 nt, Escherichia coli CFT073
uacauuaaccgccguucuucag

SEQ ID NO: 649674 - RNA, 18 nt, Escherichia coli CFT073
uacauugguacagagaac

SEQ ID NO: 649675 - RNA, 15 nt, Escherichia coli CFT073
uacauuucuguaguc

SEQ ID NO: 649676 - RNA, 21 nt, Escherichia coli CFT073
uaccaaaaucaucaauugcca

SEQ ID NO: 649677 - RNA, 15 nt, Escherichia coli CFT073
uaccaauaaucaauu

SEQ ID NO: 649678 - RNA, 17 nt, Escherichia coli CFT073
uacagcggaacuuuuuu

SEQ ID NO: 649679 - RNA, 13 nt, Escherichia coli CFT073
uacagccggaacg

SEQ ID NO: 649680 - RNA, 19 nt, Escherichia coli CFT073
uacagccaugcgaaugcca

SEQ ID NO: 649681 - RNA, 18 nt, Escherichia coli CFT073
uacagccaaaucaucagu

SEQ ID NO: 649682 - RNA, 21 nt, Escherichia coli CFT073
uacagcaguacgccgagaaua

SEQ ID NO: 649683 - RNA, 18 nt, Escherichia coli CFT073
  misc_feature (8)..(8): n is a, c, g or u
uacagcanuaucgucugg

SEQ ID NO: 649684 - RNA, 20 nt, Escherichia coli CFT073
uacagcaauggaaaaaguuu

SEQ ID NO: 649685 - RNA, 13 nt, Escherichia coli CFT073
uacagcaccgccc

SEQ ID NO: 649686 - RNA, 21 nt, Escherichia coli CFT073
uacagcagccagcgcuuugau

SEQ ID NO: 649687 - RNA, 20 nt, Escherichia coli CFT073
uacagcagccauucauucaa

SEQ ID NO: 649688 - RNA, 14 nt, Escherichia coli CFT073
uacaguuaagcccu

SEQ ID NO: 649689 - RNA, 21 nt, Escherichia coli CFT073
uacaggcuacucccaguagug

SEQ ID NO: 649690 - RNA, 19 nt, Escherichia coli CFT073
uacaggcuaucggccaggu

SEQ ID NO: 649691 - RNA, 18 nt, Escherichia coli CFT073
uacaggccaccaggccac

SEQ ID NO: 649692 - RNA, 23 nt, Escherichia coli CFT073
uacaggcagcuuagaaaggaaca

SEQ ID NO: 649693 - RNA, 15 nt, Escherichia coli CFT073
uacaggaaaccggcg

SEQ ID NO: 649694 - RNA, 14 nt, Escherichia coli CFT073
uacaggauauauuu

SEQ ID NO: 649695 - RNA, 17 nt, Escherichia coli CFT073
uacaggauauauuucau

SEQ ID NO: 649696 - RNA, 22 nt, Escherichia coli CFT073
uacaggauauauuucaucaacu

SEQ ID NO: 649697 - RNA, 14 nt, Escherichia coli CFT073
uacaggauuacuua

SEQ ID NO: 649698 - RNA, 20 nt, Escherichia coli CFT073
uacagcguuuugccaucggc

SEQ ID NO: 649699 - RNA, 13 nt, Escherichia coli CFT073
uacagcuggagua

SEQ ID NO: 649700 - RNA, 13 nt, Escherichia coli CFT073
uacagcucgguau

SEQ ID NO: 649701 - RNA, 13 nt, Escherichia coli CFT073
uaauuaagacuga

SEQ ID NO: 649702 - RNA, 19 nt, Escherichia coli CFT073
uaauuaauaauauaaauua

SEQ ID NO: 649703 - RNA, 19 nt, Escherichia coli CFT073
uaauuagcuguuggcaacg

SEQ ID NO: 649704 - RNA, 20 nt, Escherichia coli CFT073
uaauuagcuuaucaaucucu

SEQ ID NO: 649705 - RNA, 12 nt, Escherichia coli CFT073
uaauuagcuguu

SEQ ID NO: 649706 - RNA, 13 nt, Escherichia coli CFT073
uaaugguuugccc

SEQ ID NO: 649707 - RNA, 14 nt, Escherichia coli CFT073
uaaugguauuaagc

SEQ ID NO: 649708 - RNA, 18 nt, Escherichia coli CFT073
uaaugguauuaagccagu

SEQ ID NO: 649709 - RNA, 19 nt, Escherichia coli CFT073
uaauggcuuccaguacugg

SEQ ID NO: 649710 - RNA, 21 nt, Escherichia coli CFT073
uaauggccucagccacacuua

SEQ ID NO: 649711 - RNA, 19 nt, Escherichia coli CFT073
uaauggccuuuucgccacc

SEQ ID NO: 649712 - RNA, 14 nt, Escherichia coli CFT073
uaauucauuguaug

SEQ ID NO: 649713 - RNA, 14 nt, Escherichia coli CFT073
uaauucucccugcg

SEQ ID NO: 649714 - RNA, 22 nt, Escherichia coli CFT073
uaauucaccguucaauuccgca

SEQ ID NO: 649715 - RNA, 23 nt, Escherichia coli CFT073
uaauugacaagguaguagaaauc

SEQ ID NO: 649716 - RNA, 24 nt, Escherichia coli CFT073
uaauuggcagugguaucaauaucc

SEQ ID NO: 649717 - RNA, 20 nt, Escherichia coli CFT073
uaauuuacaaucacuucauu

SEQ ID NO: 649718 - RNA, 13 nt, Escherichia coli CFT073
uaauuuccugcca

SEQ ID NO: 649719 - RNA, 16 nt, Escherichia coli CFT073
uaauuucucgcacguu

SEQ ID NO: 649720 - RNA, 15 nt, Escherichia coli CFT073
uaauuuccagcagug

SEQ ID NO: 649721 - RNA, 15 nt, Escherichia coli CFT073
uaaugacgauaaaag

SEQ ID NO: 649722 - RNA, 13 nt, Escherichia coli CFT073
uaaugcaugacug

SEQ ID NO: 649723 - RNA, 17 nt, Escherichia coli CFT073
uaaugacggacaguacu

SEQ ID NO: 649724 - RNA, 13 nt, Escherichia coli CFT073
uaaugacguguau

SEQ ID NO: 649725 - RNA, 14 nt, Escherichia coli CFT073
uaaugcauggccug

SEQ ID NO: 649726 - RNA, 13 nt, Escherichia coli CFT073
uaaugccaguccc

SEQ ID NO: 649727 - RNA, 20 nt, Escherichia coli CFT073
uaaugccauuaacaucccuu

SEQ ID NO: 649728 - RNA, 22 nt, Escherichia coli CFT073
uaaugccauuaacaucccuuca

SEQ ID NO: 649729 - RNA, 23 nt, Escherichia coli CFT073
uaaugcuucuaucgcauuauccu

SEQ ID NO: 649730 - RNA, 15 nt, Escherichia coli CFT073
uaaugccgcaacuuu

SEQ ID NO: 649731 - RNA, 16 nt, Escherichia coli CFT073
uaaugccggacuccag

SEQ ID NO: 649732 - RNA, 17 nt, Escherichia coli CFT073
uaaugccggacuccagc

SEQ ID NO: 649733 - RNA, 16 nt, Escherichia coli CFT073
uaaugccccagcgcac

SEQ ID NO: 649734 - RNA, 13 nt, Escherichia coli CFT073
uaaucuucacuac

SEQ ID NO: 649735 - RNA, 20 nt, Escherichia coli CFT073
uaaucuguugauuuaacagc

SEQ ID NO: 649736 - RNA, 20 nt, Escherichia coli CFT073
uaaucuggcggaucugauca

SEQ ID NO: 649737 - RNA, 21 nt, Escherichia coli CFT073
uaaugaaucgucggaauggca

SEQ ID NO: 649738 - RNA, 21 nt, Escherichia coli CFT073
uaacgauuucaucgcccaggc

SEQ ID NO: 649739 - RNA, 15 nt, Escherichia coli CFT073
uaauccgcauuggca

SEQ ID NO: 649740 - RNA, 17 nt, Escherichia coli CFT073
uaauccguaugacaaac

SEQ ID NO: 649741 - RNA, 22 nt, Escherichia coli CFT073
uaauccggguucggauaaauga

SEQ ID NO: 649742 - RNA, 21 nt, Escherichia coli CFT073
uaacgauaccaacgcauuuau

SEQ ID NO: 649743 - RNA, 21 nt, Escherichia coli CFT073
uaacgaggcgacgguuuccag

SEQ ID NO: 649744 - RNA, 18 nt, Escherichia coli CFT073
uaaucgcgccgcgauacu

SEQ ID NO: 649745 - RNA, 14 nt, Escherichia coli CFT073
uaaucgccuuaccc

SEQ ID NO: 649746 - RNA, 16 nt, Escherichia coli CFT073
uaaucgcgaaauaacu

SEQ ID NO: 649747 - RNA, 16 nt, Escherichia coli CFT073
uaaucgcccucgccuu

SEQ ID NO: 649748 - RNA, 15 nt, Escherichia coli CFT073
uaaucgaaaacauca

SEQ ID NO: 649749 - RNA, 13 nt, Escherichia coli CFT073
uaaucgaaccaaa

SEQ ID NO: 649750 - RNA, 13 nt, Escherichia coli CFT073
uaauccuggcagc

SEQ ID NO: 649751 - RNA, 17 nt, Escherichia coli CFT073
uaauccuggccauacca

SEQ ID NO: 649752 - RNA, 14 nt, Escherichia coli CFT073
uaaucgcuuuauag

SEQ ID NO: 649753 - RNA, 15 nt, Escherichia coli CFT073
uaaucgggccgacaa

SEQ ID NO: 649754 - RNA, 18 nt, Escherichia coli CFT073
uaaucgggggaggcgaua

SEQ ID NO: 649755 - RNA, 22 nt, Escherichia coli CFT073
uaaucguuggcagacguuuuuu

SEQ ID NO: 649756 - RNA, 12 nt, Escherichia coli CFT073
uaaucucaccau

SEQ ID NO: 649757 - RNA, 18 nt, Escherichia coli CFT073
uaaucucaccauuuuuug

SEQ ID NO: 649758 - RNA, 14 nt, Escherichia coli CFT073
uaaucuauauaugu

SEQ ID NO: 649759 - RNA, 19 nt, Escherichia coli CFT073
uaaucuauauauguuuuuu

SEQ ID NO: 649760 - RNA, 15 nt, Escherichia coli CFT073
uaaucuauauuucug

SEQ ID NO: 649761 - RNA, 12 nt, Escherichia coli CFT073
uaaucucaccaa

SEQ ID NO: 649762 - RNA, 15 nt, Escherichia coli CFT073
uaaucucgccuuauc

SEQ ID NO: 649763 - RNA, 16 nt, Escherichia coli CFT073
uaaucucgccuuauca

SEQ ID NO: 649764 - RNA, 16 nt, Escherichia coli CFT073
uaaucucuucaccaua

SEQ ID NO: 649765 - RNA, 18 nt, Escherichia coli CFT073
uaaucucuuuccauucuu

SEQ ID NO: 649766 - RNA, 21 nt, Escherichia coli CFT073
uacuuguuuuugaucuccuuu

SEQ ID NO: 649767 - RNA, 20 nt, Escherichia coli CFT073
uacuuucugauuguuauuca

SEQ ID NO: 649768 - RNA, 16 nt, Escherichia coli CFT073
uacuuuccauuuugga

SEQ ID NO: 649769 - RNA, 19 nt, Escherichia coli CFT073
uacuuuccauuuuggaaua

SEQ ID NO: 649770 - RNA, 18 nt, Escherichia coli CFT073
uacuguaucgaugcuguu

SEQ ID NO: 649771 - RNA, 18 nt, Escherichia coli CFT073
uacugguugauuuuaaag

SEQ ID NO: 649772 - RNA, 19 nt, Escherichia coli CFT073
uacuguaaauaguauuauu

SEQ ID NO: 649773 - RNA, 18 nt, Escherichia coli CFT073
uagaaaguugccagauaa

SEQ ID NO: 649774 - RNA, 18 nt, Escherichia coli CFT073
uagaaaauuauuuuaaau

SEQ ID NO: 649775 - RNA, 20 nt, Escherichia coli CFT073
uacuuuugaaggaauuaauc

SEQ ID NO: 649776 - RNA, 19 nt, Escherichia coli CFT073
uacuuugaccguaauagcu

SEQ ID NO: 649777 - RNA, 15 nt, Escherichia coli CFT073
uagaaaagaguauua

SEQ ID NO: 649778 - RNA, 23 nt, Escherichia coli CFT073
uagaaaagaguauuacaucacuu

SEQ ID NO: 649779 - RNA, 16 nt, Escherichia coli CFT073
uagacagcuucggguu

SEQ ID NO: 649780 - RNA, 20 nt, Escherichia coli CFT073
uagacaucaaaauuaccuuu

SEQ ID NO: 649781 - RNA, 22 nt, Escherichia coli CFT073
uagaccaguccggcuuaucugc

SEQ ID NO: 649782 - RNA, 23 nt, Escherichia coli CFT073
uagacaauguaucuuucaucauu

SEQ ID NO: 649783 - RNA, 15 nt, Escherichia coli CFT073
uagacagccacaucc

SEQ ID NO: 649784 - RNA, 18 nt, Escherichia coli CFT073
uagacggugacacuuugu

SEQ ID NO: 649785 - RNA, 19 nt, Escherichia coli CFT073
uagaaggcgacaaagccuc

SEQ ID NO: 649786 - RNA, 17 nt, Escherichia coli CFT073
uagaaccaaaguuugca

SEQ ID NO: 649787 - RNA, 17 nt, Escherichia coli CFT073
uagaacauaauguaaac

SEQ ID NO: 649788 - RNA, 20 nt, Escherichia coli CFT073
uagaacggcagagaaaccac

SEQ ID NO: 649789 - RNA, 16 nt, Escherichia coli CFT073
uagaaccuaagaacca

SEQ ID NO: 649790 - RNA, 23 nt, Escherichia coli CFT073
uagaagccauuaaacaccaguac

SEQ ID NO: 649791 - RNA, 22 nt, Escherichia coli CFT073
uagaagcuccgguacucaucag

SEQ ID NO: 649792 - RNA, 18 nt, Escherichia coli CFT073
uagaagccagagaacaga

SEQ ID NO: 649793 - RNA, 19 nt, Escherichia coli CFT073
uagaagccauuaaacacca

SEQ ID NO: 649794 - RNA, 22 nt, Escherichia coli CFT073
uagaagccauuaaacaccagua

SEQ ID NO: 649795 - RNA, 21 nt, Escherichia coli CFT073
uacuaugauuuuccugaggag

SEQ ID NO: 649796 - RNA, 17 nt, Escherichia coli CFT073
uacuauggauauaauuu

SEQ ID NO: 649797 - RNA, 19 nt, Escherichia coli CFT073
uacucaacucacacaacga

SEQ ID NO: 649798 - RNA, 13 nt, Escherichia coli CFT073
uacucaaaaugcc

SEQ ID NO: 649799 - RNA, 21 nt, Escherichia coli CFT073
uacucacaucugacaaaauca

SEQ ID NO: 649800 - RNA, 13 nt, Escherichia coli CFT073
uacucaccguuga

SEQ ID NO: 649801 - RNA, 15 nt, Escherichia coli CFT073
uacucagcaacuucc

SEQ ID NO: 649802 - RNA, 20 nt, Escherichia coli CFT073
uacucagcaacuuccugcuu

SEQ ID NO: 649803 - RNA, 14 nt, Escherichia coli CFT073
uacucagcgccugc

SEQ ID NO: 649804 - RNA, 11 nt, Escherichia coli CFT073
uacucauccau

SEQ ID NO: 649805 - RNA, 15 nt, Escherichia coli CFT073
uacucaucuuccauu

SEQ ID NO: 649806 - RNA, 14 nt, Escherichia coli CFT073
uacucauuaaugua

SEQ ID NO: 649807 - RNA, 18 nt, Escherichia coli CFT073
uacucagcgccugcugca

SEQ ID NO: 649808 - RNA, 18 nt, Escherichia coli CFT073
uacucaguccgguauucu

SEQ ID NO: 649809 - RNA, 20 nt, Escherichia coli CFT073
uacguugcaaauauuccauc

SEQ ID NO: 649810 - RNA, 22 nt, Escherichia coli CFT073
uacguucauggcgugacauggc

SEQ ID NO: 649811 - RNA, 22 nt, Escherichia coli CFT073
uacguucucacuuggguaacag

SEQ ID NO: 649812 - RNA, 18 nt, Escherichia coli CFT073
uacguuucgccugcaaau

SEQ ID NO: 649813 - RNA, 12 nt, Escherichia coli CFT073
uacuaaaaagcg

SEQ ID NO: 649814 - RNA, 13 nt, Escherichia coli CFT073
uacuaaaaguaaa

SEQ ID NO: 649815 - RNA, 20 nt, Escherichia coli CFT073
uacuaaaaagugauaaaagu

SEQ ID NO: 649816 - RNA, 13 nt, Escherichia coli CFT073
uacguuauuuauu

SEQ ID NO: 649817 - RNA, 19 nt, Escherichia coli CFT073
uacguaaaaacccgcuucg

SEQ ID NO: 649818 - RNA, 21 nt, Escherichia coli CFT073
uacggucgccguaaacaucau

SEQ ID NO: 649819 - RNA, 23 nt, Escherichia coli CFT073
uacgguaaggauauucauuaaua

SEQ ID NO: 649820 - RNA, 21 nt, Escherichia coli CFT073
uacggucaguuuucgccccca

SEQ ID NO: 649821 - RNA, 18 nt, Escherichia coli CFT073
uacggaagaguuuuucag

SEQ ID NO: 649822 - RNA, 15 nt, Escherichia coli CFT073
uacggaucgacagca

SEQ ID NO: 649823 - RNA, 22 nt, Escherichia coli CFT073
uacgauccaccaccgcaaaaua

SEQ ID NO: 649824 - RNA, 22 nt, Escherichia coli CFT073
uacgaucgagauugaucccggc

SEQ ID NO: 649825 - RNA, 20 nt, Escherichia coli CFT073
uacgauaaucaggaaugugg

SEQ ID NO: 649826 - RNA, 17 nt, Escherichia coli CFT073
uacgcucauuuucuuuc

SEQ ID NO: 649827 - RNA, 20 nt, Escherichia coli CFT073
uacgaucuucgccugaaaca

SEQ ID NO: 649828 - RNA, 22 nt, Escherichia coli CFT073
uacgcuuuuccacucacacagc

SEQ ID NO: 649829 - RNA, 17 nt, Escherichia coli CFT073
uacgcuucacgcaccau

SEQ ID NO: 649830 - RNA, 14 nt, Escherichia coli CFT073
uacgcuguucgcca

SEQ ID NO: 649831 - RNA, 22 nt, Escherichia coli CFT073
uacgcugacgugcugcaucucu

SEQ ID NO: 649832 - RNA, 17 nt, Escherichia coli CFT073
uacgcugauuggcccca

SEQ ID NO: 649833 - RNA, 13 nt, Escherichia coli CFT073
uaccugauccacu

SEQ ID NO: 649834 - RNA, 18 nt, Escherichia coli CFT073
uaccugucgcgucaauca

SEQ ID NO: 649835 - RNA, 19 nt, Escherichia coli CFT073
uaccuguuaauucucccug

SEQ ID NO: 649836 - RNA, 20 nt, Escherichia coli CFT073
uaccuguuaauucucccugc

SEQ ID NO: 649837 - RNA, 18 nt, Escherichia coli CFT073
uaccuggucgauaauaau

SEQ ID NO: 649838 - RNA, 14 nt, Escherichia coli CFT073
uaccugcauuagca

SEQ ID NO: 649839 - RNA, 20 nt, Escherichia coli CFT073
uaccuggagcaguauugaua

SEQ ID NO: 649840 - RNA, 16 nt, Escherichia coli CFT073
uaccuuuugcugucuc

SEQ ID NO: 649841 - RNA, 20 nt, Escherichia coli CFT073
uaccuuucgcaacuucuguc

SEQ ID NO: 649842 - RNA, 16 nt, Escherichia coli CFT073
uaccuuuccagucucc

SEQ ID NO: 649843 - RNA, 19 nt, Escherichia coli CFT073
uaccuuuaaacuguuucca

SEQ ID NO: 649844 - RNA, 17 nt, Escherichia coli CFT073
uaccuucaauacuggca

SEQ ID NO: 649845 - RNA, 18 nt, Escherichia coli CFT073
uaccuucaauacuggcaa

SEQ ID NO: 649846 - RNA, 14 nt, Escherichia coli CFT073
uaccuucaucccuu

SEQ ID NO: 649847 - RNA, 17 nt, Escherichia coli CFT073
uaccuuccacaauggca

SEQ ID NO: 649848 - RNA, 14 nt, Escherichia coli CFT073
uaccaaucugcucu

SEQ ID NO: 649849 - RNA, 22 nt, Escherichia coli CFT073
uaccaccgccagauugcugcug

SEQ ID NO: 649850 - RNA, 18 nt, Escherichia coli CFT073
uaccacgauauucauuuu

SEQ ID NO: 649851 - RNA, 17 nt, Escherichia coli CFT073
uaccacgcaaagcacgc

SEQ ID NO: 649852 - RNA, 21 nt, Escherichia coli CFT073
uaccaccuuacuuacacauca

SEQ ID NO: 649853 - RNA, 15 nt, Escherichia coli CFT073
uaccaccuuccucuu

SEQ ID NO: 649854 - RNA, 13 nt, Escherichia coli CFT073
uaccgcgccaugu

SEQ ID NO: 649855 - RNA, 16 nt, Escherichia coli CFT073
uaccggcauccagacc

SEQ ID NO: 649856 - RNA, 13 nt, Escherichia coli CFT073
uaccgccgcacaa

SEQ ID NO: 649857 - RNA, 13 nt, Escherichia coli CFT073
uaccacuucaucc

SEQ ID NO: 649858 - RNA, 15 nt, Escherichia coli CFT073
uaccacuucccaacg

SEQ ID NO: 649859 - RNA, 14 nt, Escherichia coli CFT073
uaccgccagaccac

SEQ ID NO: 649860 - RNA, 21 nt, Escherichia coli CFT073
uaccuaaaagcacgccagaca

SEQ ID NO: 649861 - RNA, 19 nt, Escherichia coli CFT073
uaccggucaguucaaccgg

SEQ ID NO: 649862 - RNA, 19 nt, Escherichia coli CFT073
uaccggcccaccaaagaac

SEQ ID NO: 649863 - RNA, 21 nt, Escherichia coli CFT073
uaccggcgacuuccugagcuc

SEQ ID NO: 649864 - RNA, 16 nt, Escherichia coli CFT073
uaccggcugcaaaccc

SEQ ID NO: 649865 - RNA, 19 nt, Escherichia coli CFT073
uaccggcuggcgcauacca

SEQ ID NO: 649866 - RNA, 21 nt, Escherichia coli CFT073
uagauuaccagagaaaagaua

SEQ ID NO: 649867 - RNA, 21 nt, Escherichia coli CFT073
uagauuaauuucccaccacua

SEQ ID NO: 649868 - RNA, 16 nt, Escherichia coli CFT073
uagauucgggcuaauu

SEQ ID NO: 649869 - RNA, 20 nt, Escherichia coli CFT073
uagauggcggaaauaacgcu

SEQ ID NO: 649870 - RNA, 16 nt, Escherichia coli CFT073
uagauagcguucuuua

SEQ ID NO: 649871 - RNA, 12 nt, Escherichia coli CFT073
uagauauauauu

SEQ ID NO: 649872 - RNA, 13 nt, Escherichia coli CFT073
uagauauauauua

SEQ ID NO: 649873 - RNA, 16 nt, Escherichia coli CFT073
uagauauauauuauau

SEQ ID NO: 649874 - RNA, 22 nt, Escherichia coli CFT073
uagauauucaucaaaaugaaca

SEQ ID NO: 649875 - RNA, 13 nt, Escherichia coli CFT073
uagaucacugaaa

SEQ ID NO: 649876 - RNA, 21 nt, Escherichia coli CFT073
uagaucacugaaauuguaggc

SEQ ID NO: 649877 - RNA, 14 nt, Escherichia coli CFT073
uagaucgccagaaa

SEQ ID NO: 649878 - RNA, 21 nt, Escherichia coli CFT073
uagaguauccugacgcuguuu

SEQ ID NO: 649879 - RNA, 18 nt, Escherichia coli CFT073
uagaggcguuccugcaac

SEQ ID NO: 649880 - RNA, 19 nt, Escherichia coli CFT073
uagagcuugugcaccagcu

SEQ ID NO: 649881 - RNA, 13 nt, Escherichia coli CFT073
uagagcucaucag

SEQ ID NO: 649882 - RNA, 17 nt, Escherichia coli CFT073
uagagagauguugcugc

SEQ ID NO: 649883 - RNA, 14 nt, Escherichia coli CFT073
uagagaucuucaua

SEQ ID NO: 649884 - RNA, 18 nt, Escherichia coli CFT073
uagagaucuugcgcuacc

SEQ ID NO: 649885 - RNA, 20 nt, Escherichia coli CFT073
uagagccgguuuugguuuuc

SEQ ID NO: 649886 - RNA, 21 nt, Escherichia coli CFT073
uagauaccgcuuuugccagca

SEQ ID NO: 649887 - RNA, 14 nt, Escherichia coli CFT073
uagauaauuuugaa

SEQ ID NO: 649888 - RNA, 21 nt, Escherichia coli CFT073
uagauaauuuugaaauaaaau

SEQ ID NO: 649889 - RNA, 22 nt, Escherichia coli CFT073
uagauacccggauacaacucgc

SEQ ID NO: 649890 - RNA, 11 nt, Escherichia coli CFT073
uagccaauucc

SEQ ID NO: 649891 - RNA, 22 nt, Escherichia coli CFT073
uagccaaagcaccacuccucaa

SEQ ID NO: 649892 - RNA, 20 nt, Escherichia coli CFT073
uagccaaccucaaaaagaaa

SEQ ID NO: 649893 - RNA, 21 nt, Escherichia coli CFT073
uagcaugcaggcuggccccug

SEQ ID NO: 649894 - RNA, 16 nt, Escherichia coli CFT073
uagcaucagcgcuacc

SEQ ID NO: 649895 - RNA, 13 nt, Escherichia coli CFT073
uagcaguuccagc

SEQ ID NO: 649896 - RNA, 23 nt, Escherichia coli CFT073
uagcagugauuuauuuuuacucu

SEQ ID NO: 649897 - RNA, 15 nt, Escherichia coli CFT073
uagcagcuccgccag

SEQ ID NO: 649898 - RNA, 14 nt, Escherichia coli CFT073
uagcaggaaauaua

SEQ ID NO: 649899 - RNA, 16 nt, Escherichia coli CFT073
uagcagcacaccacau

SEQ ID NO: 649900 - RNA, 13 nt, Escherichia coli CFT073
uagcagcaggaau

SEQ ID NO: 649901 - RNA, 20 nt, Escherichia coli CFT073
uagcaaacuaucuguguaau

SEQ ID NO: 649902 - RNA, 22 nt, Escherichia coli CFT073
uagcaaaacucaccauccugau

SEQ ID NO: 649903 - RNA, 16 nt, Escherichia coli CFT073
uagcaacaaaaaaacc

SEQ ID NO: 649904 - RNA, 14 nt, Escherichia coli CFT073
uagauuguuuucaa

SEQ ID NO: 649905 - RNA, 19 nt, Escherichia coli CFT073
uagauuuugcagaucacca

SEQ ID NO: 649906 - RNA, 22 nt, Escherichia coli CFT073
uagauuuugcagaucaccaaua

SEQ ID NO: 649907 - RNA, 23 nt, Escherichia coli CFT073
uagcacaagauuaucgcuucgcu

SEQ ID NO: 649908 - RNA, 19 nt, Escherichia coli CFT073
uagcacauaaaauggccau

SEQ ID NO: 649909 - RNA, 20 nt, Escherichia coli CFT073
uagcacccgguaaacaaaaa

SEQ ID NO: 649910 - RNA, 14 nt, Escherichia coli CFT073
uagcacgauuuugu

SEQ ID NO: 649911 - RNA, 23 nt, Escherichia coli CFT073
uagcaccucuccacgcaucugca

SEQ ID NO: 649912 - RNA, 21 nt, Escherichia coli CFT073
uagcaauaaaugccuggauga

SEQ ID NO: 649913 - RNA, 17 nt, Escherichia coli CFT073
uagcaagacuuuguagg

SEQ ID NO: 649914 - RNA, 24 nt, Escherichia coli CFT073
uagcaaccggggcauucaugaaca

SEQ ID NO: 649915 - RNA, 21 nt, Escherichia coli CFT073
uagcaacgauaacaaucacca

SEQ ID NO: 649916 - RNA, 23 nt, Escherichia coli CFT073
uagcaacgauaacaaucaccaaa

SEQ ID NO: 649917 - RNA, 21 nt, Escherichia coli CFT073
uagcaacgauauccauaucua

SEQ ID NO: 649918 - RNA, 11 nt, Escherichia coli CFT073
uaggaaaucag

SEQ ID NO: 649919 - RNA, 20 nt, Escherichia coli CFT073
uaggaauccgggucuguaaa

SEQ ID NO: 649920 - RNA, 17 nt, Escherichia coli CFT073
uagcuuggcagagcgac

SEQ ID NO: 649921 - RNA, 12 nt, Escherichia coli CFT073
uagcuuccugcu

SEQ ID NO: 649922 - RNA, 17 nt, Escherichia coli CFT073
uaggagguuuccggguc

SEQ ID NO: 649923 - RNA, 15 nt, Escherichia coli CFT073
uagcguuuuuucauu

SEQ ID NO: 649924 - RNA, 14 nt, Escherichia coli CFT073
uagcuaaaaauaau

SEQ ID NO: 649925 - RNA, 16 nt, Escherichia coli CFT073
uagcguuucaccucuu

SEQ ID NO: 649926 - RNA, 22 nt, Escherichia coli CFT073
uagcguuucaccucuuucacca

SEQ ID NO: 649927 - RNA, 18 nt, Escherichia coli CFT073
uagcgugauggccagaua

SEQ ID NO: 649928 - RNA, 13 nt, Escherichia coli CFT073
uagcgugauuuug

SEQ ID NO: 649929 - RNA, 13 nt, Escherichia coli CFT073
uagcgugauuuuu

SEQ ID NO: 649930 - RNA, 20 nt, Escherichia coli CFT073
uagcgucgcaucaggcaaug

SEQ ID NO: 649931 - RNA, 17 nt, Escherichia coli CFT073
uagcguuauauuauuau

SEQ ID NO: 649932 - RNA, 16 nt, Escherichia coli CFT073
uagcucaucugacguu

SEQ ID NO: 649933 - RNA, 20 nt, Escherichia coli CFT073
uagcucaacaguaaggccug

SEQ ID NO: 649934 - RNA, 20 nt, Escherichia coli CFT073
uagcucaauccuacauccag

SEQ ID NO: 649935 - RNA, 22 nt, Escherichia coli CFT073
uagcuuauucuuauuauauugu

SEQ ID NO: 649936 - RNA, 22 nt, Escherichia coli CFT073
uagcuuaucaaucucugcaaga

SEQ ID NO: 649937 - RNA, 15 nt, Escherichia coli CFT073
uagcuggaauaauaa

SEQ ID NO: 649938 - RNA, 19 nt, Escherichia coli CFT073
uagcuguguggcgcuuuuu

SEQ ID NO: 649939 - RNA, 19 nt, Escherichia coli CFT073
uagcucauaaccuguuccu

SEQ ID NO: 649940 - RNA, 16 nt, Escherichia coli CFT073
uagcgcaucacuucca

SEQ ID NO: 649941 - RNA, 20 nt, Escherichia coli CFT073
uagcgcaggggcaaucagca

SEQ ID NO: 649942 - RNA, 20 nt, Escherichia coli CFT073
uagcgauaaaacgccgcugg

SEQ ID NO: 649943 - RNA, 18 nt, Escherichia coli CFT073
uagcgcaaucgcuguacu

SEQ ID NO: 649944 - RNA, 19 nt, Escherichia coli CFT073
uagccuucaucagaugaag

SEQ ID NO: 649945 - RNA, 12 nt, Escherichia coli CFT073
uagcgccugcug

SEQ ID NO: 649946 - RNA, 15 nt, Escherichia coli CFT073
uagcgccguuuuuau

SEQ ID NO: 649947 - RNA, 15 nt, Escherichia coli CFT073
uagcgccucuuccau

SEQ ID NO: 649948 - RNA, 18 nt, Escherichia coli CFT073
uagcgccucuuuauaaau

SEQ ID NO: 649949 - RNA, 19 nt, Escherichia coli CFT073
uagcggaaagcguuucauu

SEQ ID NO: 649950 - RNA, 16 nt, Escherichia coli CFT073
uagcgggcgcaaugcc

SEQ ID NO: 649951 - RNA, 23 nt, Escherichia coli CFT073
uagcggcgacuugcucaggagua

SEQ ID NO: 649952 - RNA, 16 nt, Escherichia coli CFT073
uagcggcggcagauug

SEQ ID NO: 649953 - RNA, 15 nt, Escherichia coli CFT073
uagcggcugcgcagc

SEQ ID NO: 649954 - RNA, 20 nt, Escherichia coli CFT073
uagcccugucgaggccaauu

SEQ ID NO: 649955 - RNA, 23 nt, Escherichia coli CFT073
uagccgaccgcaaggaagccuga

SEQ ID NO: 649956 - RNA, 22 nt, Escherichia coli CFT073
uagccgaccgcaaggaagccug

SEQ ID NO: 649957 - RNA, 17 nt, Escherichia coli CFT073
uagccgaugucgcugca

SEQ ID NO: 649958 - RNA, 16 nt, Escherichia coli CFT073
uagccgccccagacuc

SEQ ID NO: 649959 - RNA, 22 nt, Escherichia coli CFT073
uagccgccccagacuccagcag

SEQ ID NO: 649960 - RNA, 18 nt, Escherichia coli CFT073
uagccggagguuuuucaa

SEQ ID NO: 649961 - RNA, 15 nt, Escherichia coli CFT073
uagccuccggccacg

SEQ ID NO: 649962 - RNA, 16 nt, Escherichia coli CFT073
uagccucccugccucc

SEQ ID NO: 649963 - RNA, 19 nt, Escherichia coli CFT073
uagccucuuuauuuccugc

SEQ ID NO: 649964 - RNA, 18 nt, Escherichia coli CFT073
uagccauuaccaggucga

SEQ ID NO: 649965 - RNA, 12 nt, Escherichia coli CFT073
uagccaucugcc

SEQ ID NO: 649966 - RNA, 13 nt, Escherichia coli CFT073
uagccauauggcu

SEQ ID NO: 649967 - RNA, 17 nt, Escherichia coli CFT073
uagccacggaucacacg

SEQ ID NO: 649968 - RNA, 22 nt, Escherichia coli CFT073
uagccacgucugccacggcaga

SEQ ID NO: 649969 - RNA, 22 nt, Escherichia coli CFT073
uagccagcgaccgcgccauaaa

SEQ ID NO: 649970 - RNA, 20 nt, Escherichia coli CFT073
uagcccaacgaucccaacug

SEQ ID NO: 649971 - RNA, 13 nt, Escherichia coli CFT073
uagccauuuuuug

SEQ ID NO: 649972 - RNA, 22 nt, Escherichia coli CFT073
uagcccguucuucgccauaaca

SEQ ID NO: 649973 - RNA, 12 nt, Escherichia coli CFT073
uagcccggcaau

SEQ ID NO: 649974 - RNA, 22 nt, Escherichia coli CFT073
uauccaacugugaauccugcau

SEQ ID NO: 649975 - RNA, 14 nt, Escherichia coli CFT073
uauccaacuuuucc

SEQ ID NO: 649976 - RNA, 15 nt, Escherichia coli CFT073
uaucauuuugcugcc

SEQ ID NO: 649977 - RNA, 19 nt, Escherichia coli CFT073
uaucauuuuuaguuuugug

SEQ ID NO: 649978 - RNA, 20 nt, Escherichia coli CFT073
uauccaccgacacuacaaau

SEQ ID NO: 649979 - RNA, 15 nt, Escherichia coli CFT073
uauccauauacagcg

SEQ ID NO: 649980 - RNA, 13 nt, Escherichia coli CFT073
uauccauauuuuu

SEQ ID NO: 649981 - RNA, 21 nt, Escherichia coli CFT073
uauccacucggcacauagacg

SEQ ID NO: 649982 - RNA, 18 nt, Escherichia coli CFT073
uaucaggccugcaaaauc

SEQ ID NO: 649983 - RNA, 17 nt, Escherichia coli CFT073
uaucaggucgaaaauaa

SEQ ID NO: 649984 - RNA, 15 nt, Escherichia coli CFT073
uaucacguagccacg

SEQ ID NO: 649985 - RNA, 13 nt, Escherichia coli CFT073
uaucacucugccg

SEQ ID NO: 649986 - RNA, 18 nt, Escherichia coli CFT073
uaucauuaacgauaauuu

SEQ ID NO: 649987 - RNA, 19 nt, Escherichia coli CFT073
uaucaugcucugccagcgu

SEQ ID NO: 649988 - RNA, 23 nt, Escherichia coli CFT073
uaucaucccagccaaugcaggca

SEQ ID NO: 649989 - RNA, 20 nt, Escherichia coli CFT073
uaucaucgcggcacacagca

SEQ ID NO: 649990 - RNA, 17 nt, Escherichia coli CFT073
uaucaaaaccuaacucu

SEQ ID NO: 649991 - RNA, 23 nt, Escherichia coli CFT073
uauaucagccugaaugcuuucau

SEQ ID NO: 649992 - RNA, 18 nt, Escherichia coli CFT073
uaucaaugacaucugcau

SEQ ID NO: 649993 - RNA, 22 nt, Escherichia coli CFT073
uaucaauuaacugugccagcgu

SEQ ID NO: 649994 - RNA, 17 nt, Escherichia coli CFT073
uaucaauucuuuuucug

SEQ ID NO: 649995 - RNA, 15 nt, Escherichia coli CFT073
uaucaauuaucuguu

SEQ ID NO: 649996 - RNA, 19 nt, Escherichia coli CFT073
uaucaauugcuucaauaau

SEQ ID NO: 649997 - RNA, 17 nt, Escherichia coli CFT073
uaucacuauaaauauac

SEQ ID NO: 649998 - RNA, 18 nt, Escherichia coli CFT073
uaucacgauacaccagau

SEQ ID NO: 649999 - RNA, 15 nt, Escherichia coli CFT073
uaucaaacugaccuu

SEQ ID NO: 650000 - RNA, 16 nt, Escherichia coli CFT073
uaucaaauucauugcg

SEQ ID NO: 650001 - RNA, 15 nt, Escherichia coli CFT073
uauacagccuuaaca

SEQ ID NO: 650002 - RNA, 17 nt, Escherichia coli CFT073
uauacagacucaaacca

SEQ ID NO: 650003 - RNA, 12 nt, Escherichia coli CFT073
uauacagcagcc

SEQ ID NO: 650004 - RNA, 18 nt, Escherichia coli CFT073
uauaacuuuaguaucacc

SEQ ID NO: 650005 - RNA, 18 nt, Escherichia coli CFT073
uauacaucgcuuuccagg

SEQ ID NO: 650006 - RNA, 17 nt, Escherichia coli CFT073
uauacgaaaauuuggau

SEQ ID NO: 650007 - RNA, 22 nt, Escherichia coli CFT073
uauacgaucuucgccugaaaca

SEQ ID NO: 650008 - RNA, 21 nt, Escherichia coli CFT073
uauaccgccgaagacaaacau

SEQ ID NO: 650009 - RNA, 18 nt, Escherichia coli CFT073
uauaccggcguuucuggc

SEQ ID NO: 650010 - RNA, 21 nt, Escherichia coli CFT073
uauaccauaucugguuaaaaa

SEQ ID NO: 650011 - RNA, 21 nt, Escherichia coli CFT073
uauacgggcuuuuuaauuccu

SEQ ID NO: 650012 - RNA, 22 nt, Escherichia coli CFT073
uauacguguacguugauggaua

SEQ ID NO: 650013 - RNA, 16 nt, Escherichia coli CFT073
uauacugaccccauau

SEQ ID NO: 650014 - RNA, 15 nt, Escherichia coli CFT073
uauacugcaaauauu

SEQ ID NO: 650015 - RNA, 16 nt, Escherichia coli CFT073
uauacugcaaauauug

SEQ ID NO: 650016 - RNA, 17 nt, Escherichia coli CFT073
uauagaucaggaaaaac

SEQ ID NO: 650017 - RNA, 17 nt, Escherichia coli CFT073
uauagaucauaucgucc

SEQ ID NO: 650018 - RNA, 17 nt, Escherichia coli CFT073
uauagauucuacgaacu

SEQ ID NO: 650019 - RNA, 15 nt, Escherichia coli CFT073
uauagcacccgccag

SEQ ID NO: 650020 - RNA, 13 nt, Escherichia coli CFT073
uauagcauagcgu

SEQ ID NO: 650021 - RNA, 20 nt, Escherichia coli CFT073
uauagcgcaucacuuccagu

SEQ ID NO: 650022 - RNA, 14 nt, Escherichia coli CFT073
uauagcugaacgcu

SEQ ID NO: 650023 - RNA, 21 nt, Escherichia coli CFT073
uauagccccaugcuggcuguu

SEQ ID NO: 650024 - RNA, 14 nt, Escherichia coli CFT073
uauauacucuaaau

SEQ ID NO: 650025 - RNA, 18 nt, Escherichia coli CFT073
uauauacucuaaauaauu

SEQ ID NO: 650026 - RNA, 21 nt, Escherichia coli CFT073
uauaaaacacauuaaacuuaa

SEQ ID NO: 650027 - RNA, 21 nt, Escherichia coli CFT073
uauaaacccccugaccggaaa

SEQ ID NO: 650028 - RNA, 21 nt, Escherichia coli CFT073
uauaacgaugggcguuuucua

SEQ ID NO: 650029 - RNA, 17 nt, Escherichia coli CFT073
uauaaagaaugaaauuc

SEQ ID NO: 650030 - RNA, 18 nt, Escherichia coli CFT073
uauaaagaaugaaauucg

SEQ ID NO: 650031 - RNA, 18 nt, Escherichia coli CFT073
uagugcggcgugguuccg

SEQ ID NO: 650032 - RNA, 19 nt, Escherichia coli CFT073
uagugcuucaaauauugau

SEQ ID NO: 650033 - RNA, 14 nt, Escherichia coli CFT073
uagugccugcacaa

SEQ ID NO: 650034 - RNA, 17 nt, Escherichia coli CFT073
uagucaaaagcacucag

SEQ ID NO: 650035 - RNA, 13 nt, Escherichia coli CFT073
uagugaucagccu

SEQ ID NO: 650036 - RNA, 13 nt, Escherichia coli CFT073
uaguccgccagaa

SEQ ID NO: 650037 - RNA, 13 nt, Escherichia coli CFT073
uaguguuccugcg

SEQ ID NO: 650038 - RNA, 16 nt, Escherichia coli CFT073
uaguucauccccucuu

SEQ ID NO: 650039 - RNA, 18 nt, Escherichia coli CFT073
uaguucauccccucuucc

SEQ ID NO: 650040 - RNA, 16 nt, Escherichia coli CFT073
uaguuguacaacugcu

SEQ ID NO: 650041 - RNA, 20 nt, Escherichia coli CFT073
uaguauggagcaggaauaua

SEQ ID NO: 650042 - RNA, 16 nt, Escherichia coli CFT073
uaguaucgcucaauau

SEQ ID NO: 650043 - RNA, 16 nt, Escherichia coli CFT073
uaguaguucauccccu

SEQ ID NO: 650044 - RNA, 14 nt, Escherichia coli CFT073
uaggggauuuugac

SEQ ID NO: 650045 - RNA, 17 nt, Escherichia coli CFT073
uaggggauuuugacuuu

SEQ ID NO: 650046 - RNA, 14 nt, Escherichia coli CFT073
uagguacaaagcca

SEQ ID NO: 650047 - RNA, 18 nt, Escherichia coli CFT073
uaggguggggaaaaaaca

SEQ ID NO: 650048 - RNA, 16 nt, Escherichia coli CFT073
uagguaaacaucacau

SEQ ID NO: 650049 - RNA, 13 nt, Escherichia coli CFT073
uagguaaacaucc

SEQ ID NO: 650050 - RNA, 15 nt, Escherichia coli CFT073
uaggucauuggcgua

SEQ ID NO: 650051 - RNA, 16 nt, Escherichia coli CFT073
uaggucauaucaucaa

SEQ ID NO: 650052 - RNA, 14 nt, Escherichia coli CFT073
uagggcgaaaccau

SEQ ID NO: 650053 - RNA, 17 nt, Escherichia coli CFT073
uagggaaacuccagccc

SEQ ID NO: 650054 - RNA, 16 nt, Escherichia coli CFT073
uaggcauacacaucac

SEQ ID NO: 650055 - RNA, 17 nt, Escherichia coli CFT073
uaggcacgaaagguucc

SEQ ID NO: 650056 - RNA, 12 nt, Escherichia coli CFT073
uaggccggauaa

SEQ ID NO: 650057 - RNA, 13 nt, Escherichia coli CFT073
uaggccugauaag

SEQ ID NO: 650058 - RNA, 22 nt, Escherichia coli CFT073
uaggcgacucguugugugaguu

SEQ ID NO: 650059 - RNA, 23 nt, Escherichia coli CFT073
ucagcccaaaaauugcccccagu

SEQ ID NO: 650060 - RNA, 15 nt, Escherichia coli CFT073
ucagcccaaagagca

SEQ ID NO: 650061 - RNA, 19 nt, Escherichia coli CFT073
ucagccaucgccaccgcuu

SEQ ID NO: 650062 - RNA, 20 nt, Escherichia coli CFT073
ucagccaugguuuaaucgcc

SEQ ID NO: 650063 - RNA, 19 nt, Escherichia coli CFT073
ucagccaguaaaccaauca

SEQ ID NO: 650064 - RNA, 10 nt, Escherichia coli CFT073
ucagccaguc

SEQ ID NO: 650065 - RNA, 20 nt, Escherichia coli CFT073
ucagccagucauaauucaga

SEQ ID NO: 650066 - RNA, 20 nt, Escherichia coli CFT073
ucagccagugcuucgcggac

SEQ ID NO: 650067 - RNA, 17 nt, Escherichia coli CFT073
ucagccguauccaggcc

SEQ ID NO: 650068 - RNA, 14 nt, Escherichia coli CFT073
ucagccgcaaacuc

SEQ ID NO: 650069 - RNA, 13 nt, Escherichia coli CFT073
ucagcccaaccac

SEQ ID NO: 650070 - RNA, 19 nt, Escherichia coli CFT073
ucagcgaguuuuucagucc

SEQ ID NO: 650071 - RNA, 21 nt, Escherichia coli CFT073
ucagccuucuguaaccuuuuc

SEQ ID NO: 650072 - RNA, 14 nt, Escherichia coli CFT073
ucagcgaagucaca

SEQ ID NO: 650073 - RNA, 16 nt, Escherichia coli CFT073
ucagcgaagucacaaa

SEQ ID NO: 650074 - RNA, 13 nt, Escherichia coli CFT073
ucagccacuuccu

SEQ ID NO: 650075 - RNA, 22 nt, Escherichia coli CFT073
ucagccagggauaagccagacc

SEQ ID NO: 650076 - RNA, 17 nt, Escherichia coli CFT073
ucacucggggcuuuucu

SEQ ID NO: 650077 - RNA, 14 nt, Escherichia coli CFT073
ucacugauuaacgu

SEQ ID NO: 650078 - RNA, 18 nt, Escherichia coli CFT073
ucagcguuucuuccagcc

SEQ ID NO: 650079 - RNA, 15 nt, Escherichia coli CFT073
ucagcguuccccaga

SEQ ID NO: 650080 - RNA, 16 nt, Escherichia coli CFT073
ucagcguuaauucaaa

SEQ ID NO: 650081 - RNA, 21 nt, Escherichia coli CFT073
ucagcgccguagccauuacca

SEQ ID NO: 650082 - RNA, 15 nt, Escherichia coli CFT073
ucagcuuucaccaga

SEQ ID NO: 650083 - RNA, 12 nt, Escherichia coli CFT073
ucagcuuucaga

SEQ ID NO: 650084 - RNA, 14 nt, Escherichia coli CFT073
ucagcuuuuccaua

SEQ ID NO: 650085 - RNA, 23 nt, Escherichia coli CFT073
ucagcuugagguuggagaucccg

SEQ ID NO: 650086 - RNA, 20 nt, Escherichia coli CFT073
ucagcuuccuugcugauuuu

SEQ ID NO: 650087 - RNA, 22 nt, Escherichia coli CFT073
ucagcuuccuugcugauuuuau

SEQ ID NO: 650088 - RNA, 20 nt, Escherichia coli CFT073
ucagcuucagauugcaccac

SEQ ID NO: 650089 - RNA, 15 nt, Escherichia coli CFT073
ucaggaaggcgauau

SEQ ID NO: 650090 - RNA, 17 nt, Escherichia coli CFT073
ucaggauauuuauauuu

SEQ ID NO: 650091 - RNA, 16 nt, Escherichia coli CFT073
ucaggaacugcauacu

SEQ ID NO: 650092 - RNA, 15 nt, Escherichia coli CFT073
ucaggaaccacaacc

SEQ ID NO: 650093 - RNA, 20 nt, Escherichia coli CFT073
ucaggaacagcgacagauuc

SEQ ID NO: 650094 - RNA, 16 nt, Escherichia coli CFT073
ucaggaaauaaauaau

SEQ ID NO: 650095 - RNA, 17 nt, Escherichia coli CFT073
ucaggcaacggcaucaa

SEQ ID NO: 650096 - RNA, 22 nt, Escherichia coli CFT073
ucaggcaagccgcuaacagcag

SEQ ID NO: 650097 - RNA, 21 nt, Escherichia coli CFT073
ucaggaucagccauuuugcac

SEQ ID NO: 650098 - RNA, 18 nt, Escherichia coli CFT073
ucaggaugugagcuggcg

SEQ ID NO: 650099 - RNA, 13 nt, Escherichia coli CFT073
ucaggggagugag

SEQ ID NO: 650100 - RNA, 21 nt, Escherichia coli CFT073
ucaggggcuuccagcaaaucc

SEQ ID NO: 650101 - RNA, 22 nt, Escherichia coli CFT073
ucagggucgugcggcacggcgu

SEQ ID NO: 650102 - RNA, 19 nt, Escherichia coli CFT073
ucagggccaucauuuugcu

SEQ ID NO: 650103 - RNA, 20 nt, Escherichia coli CFT073
ucagggcgcacgcacggcgu

SEQ ID NO: 650104 - RNA, 18 nt, Escherichia coli CFT073
ucaguaaucgcgccagcc

SEQ ID NO: 650105 - RNA, 22 nt, Escherichia coli CFT073
ucaguaaaguaucaaacagaaa

SEQ ID NO: 650106 - RNA, 15 nt, Escherichia coli CFT073
ucagguugccggaug

SEQ ID NO: 650107 - RNA, 20 nt, Escherichia coli CFT073
ucagguuguuuucuggcuga

SEQ ID NO: 650108 - RNA, 18 nt, Escherichia coli CFT073
ucagguuuuucagcugcc

SEQ ID NO: 650109 - RNA, 22 nt, Escherichia coli CFT073
ucagguaagcgauaaaaauacc

SEQ ID NO: 650110 - RNA, 12 nt, Escherichia coli CFT073
ucagguaauuuu

SEQ ID NO: 650111 - RNA, 23 nt, Escherichia coli CFT073
ucagguaauuuugcuuauuuaaa

SEQ ID NO: 650112 - RNA, 17 nt, Escherichia coli CFT073
ucaggugauggcagcca

SEQ ID NO: 650113 - RNA, 18 nt, Escherichia coli CFT073
ucagguuacgcccuuccc

SEQ ID NO: 650114 - RNA, 17 nt, Escherichia coli CFT073
ucagguguuacgccgca

SEQ ID NO: 650115 - RNA, 16 nt, Escherichia coli CFT073
ucaguauuuucccuga

SEQ ID NO: 650116 - RNA, 13 nt, Escherichia coli CFT073
ucagucagcagug

SEQ ID NO: 650117 - RNA, 20 nt, Escherichia coli CFT073
ucagucauaacguucagcac

SEQ ID NO: 650118 - RNA, 22 nt, Escherichia coli CFT073
ucagucccugaaucgccacgcc

SEQ ID NO: 650119 - RNA, 14 nt, Escherichia coli CFT073
ucaguccacaucuc

SEQ ID NO: 650120 - RNA, 17 nt, Escherichia coli CFT073
ucaguuaacaauaacaa

SEQ ID NO: 650121 - RNA, 20 nt, Escherichia coli CFT073
ucaguuugccgcucaguucc

SEQ ID NO: 650122 - RNA, 22 nt, Escherichia coli CFT073
ucaguuuuuguugauaaacaaa

SEQ ID NO: 650123 - RNA, 14 nt, Escherichia coli CFT073
ucaguucagcugcc

SEQ ID NO: 650124 - RNA, 15 nt, Escherichia coli CFT073
ucaguucaaauucau

SEQ ID NO: 650125 - RNA, 23 nt, Escherichia coli CFT073
ucauaagcgauaccgguacggaa

SEQ ID NO: 650126 - RNA, 19 nt, Escherichia coli CFT073
ucauaaauuaccaccagcg

SEQ ID NO: 650127 - RNA, 21 nt, Escherichia coli CFT073
ucauaaacacgguuuuucauu

SEQ ID NO: 650128 - RNA, 14 nt, Escherichia coli CFT073
ucauaaauacagag

SEQ ID NO: 650129 - RNA, 20 nt, Escherichia coli CFT073
ucauccaggcuuuaaacccg

SEQ ID NO: 650130 - RNA, 15 nt, Escherichia coli CFT073
ucauccagugccgcc

SEQ ID NO: 650131 - RNA, 17 nt, Escherichia coli CFT073
ucauccaucaaauuacc

SEQ ID NO: 650132 - RNA, 20 nt, Escherichia coli CFT073
ucauccaucggcgcuucaau

SEQ ID NO: 650133 - RNA, 14 nt, Escherichia coli CFT073
ucauccccucuucc

SEQ ID NO: 650134 - RNA, 23 nt, Escherichia coli CFT073
ucauccccaucgccgcacuauuu

SEQ ID NO: 650135 - RNA, 22 nt, Escherichia coli CFT073
ucauccccgcgcggaacaugaa

SEQ ID NO: 650136 - RNA, 15 nt, Escherichia coli CFT073
ucauccuucagugcc

SEQ ID NO: 650137 - RNA, 22 nt, Escherichia coli CFT073
ucaucgaacgggugauuucccc

SEQ ID NO: 650138 - RNA, 17 nt, Escherichia coli CFT073
ucauccugcugcacgcc

SEQ ID NO: 650139 - RNA, 19 nt, Escherichia coli CFT073
ucauccuguaugacaaaag

SEQ ID NO: 650140 - RNA, 22 nt, Escherichia coli CFT073
ucauccuguaugacaaaagaau

SEQ ID NO: 650141 - RNA, 16 nt, Escherichia coli CFT073
ucaucgacaguaccag

SEQ ID NO: 650142 - RNA, 16 nt, Escherichia coli CFT073
ucaucgacgucagcag

SEQ ID NO: 650143 - RNA, 17 nt, Escherichia coli CFT073
ucaucgacgucagcaga

SEQ ID NO: 650144 - RNA, 14 nt, Escherichia coli CFT073
ucaucgagaucgac

SEQ ID NO: 650145 - RNA, 17 nt, Escherichia coli CFT073
ucaucgagcagcauaau

SEQ ID NO: 650146 - RNA, 15 nt, Escherichia coli CFT073
ucaucgcaucguaca

SEQ ID NO: 650147 - RNA, 19 nt, Escherichia coli CFT073
ucaucgcagauuucuucug

SEQ ID NO: 650148 - RNA, 15 nt, Escherichia coli CFT073
ucaucgccagcgaau

SEQ ID NO: 650149 - RNA, 15 nt, Escherichia coli CFT073
ucaucgcccaggcaa

SEQ ID NO: 650150 - RNA, 14 nt, Escherichia coli CFT073
ucaucgauuuucug

SEQ ID NO: 650151 - RNA, 22 nt, Escherichia coli CFT073
ucaucgcaaaggacaucccggc

SEQ ID NO: 650152 - RNA, 12 nt, Escherichia coli CFT073
ucaucgcaaaug

SEQ ID NO: 650153 - RNA, 16 nt, Escherichia coli CFT073
ucaucgcgauccccca

SEQ ID NO: 650154 - RNA, 22 nt, Escherichia coli CFT073
ucaucgcgcaaaauuucuauca

SEQ ID NO: 650155 - RNA, 19 nt, Escherichia coli CFT073
ucaucgcccuguuccuguu

SEQ ID NO: 650156 - RNA, 15 nt, Escherichia coli CFT073
ucaucgccuuccagu

SEQ ID NO: 650157 - RNA, 15 nt, Escherichia coli CFT073
ucaucggcaucuucu

SEQ ID NO: 650158 - RNA, 16 nt, Escherichia coli CFT073
ucaucggaucauuagu

SEQ ID NO: 650159 - RNA, 15 nt, Escherichia coli CFT073
ucaucgcugaauuuc

SEQ ID NO: 650160 - RNA, 22 nt, Escherichia coli CFT073
ucaucgcugacaugugauuuga

SEQ ID NO: 650161 - RNA, 21 nt, Escherichia coli CFT073
ucaucgcuacaacaugaccuc

SEQ ID NO: 650162 - RNA, 14 nt, Escherichia coli CFT073
ucaucgcuuaaccc

SEQ ID NO: 650163 - RNA, 17 nt, Escherichia coli CFT073
ucaucggaaugcacagc

SEQ ID NO: 650164 - RNA, 22 nt, Escherichia coli CFT073
ucaucaucgcagauuucuucug

SEQ ID NO: 650165 - RNA, 13 nt, Escherichia coli CFT073
ucaucaugaacug

SEQ ID NO: 650166 - RNA, 19 nt, Escherichia coli CFT073
ucaucaugggcaagguauu

SEQ ID NO: 650167 - RNA, 16 nt, Escherichia coli CFT073
ucaucauguggcugga

SEQ ID NO: 650168 - RNA, 21 nt, Escherichia coli CFT073
ucauccagcugccaggcaccg

SEQ ID NO: 650169 - RNA, 19 nt, Escherichia coli CFT073
ucaucagcggcgaagccua

SEQ ID NO: 650170 - RNA, 16 nt, Escherichia coli CFT073
ucaucagcguuuccgc

SEQ ID NO: 650171 - RNA, 15 nt, Escherichia coli CFT073
ucaucagaagggaau

SEQ ID NO: 650172 - RNA, 21 nt, Escherichia coli CFT073
ucaucacgcgguuacgcaccg

SEQ ID NO: 650173 - RNA, 15 nt, Escherichia coli CFT073
ucaucacuugcuccc

SEQ ID NO: 650174 - RNA, 15 nt, Escherichia coli CFT073
ucaucacuuuuuccg

SEQ ID NO: 650175 - RNA, 22 nt, Escherichia coli CFT073
ucaucagguauugcuaagcucu

SEQ ID NO: 650176 - RNA, 15 nt, Escherichia coli CFT073
ucaucaguaccaguc

SEQ ID NO: 650177 - RNA, 18 nt, Escherichia coli CFT073
ucaucagucuuaagcggc

SEQ ID NO: 650178 - RNA, 18 nt, Escherichia coli CFT073
ucaucaggcuacgcagca

SEQ ID NO: 650179 - RNA, 16 nt, Escherichia coli CFT073
ucaucauauugucugc

SEQ ID NO: 650180 - RNA, 21 nt, Escherichia coli CFT073
ucaucaucgcagauuucuucu

SEQ ID NO: 650181 - RNA, 13 nt, Escherichia coli CFT073
ucaucaucacgaa

SEQ ID NO: 650182 - RNA, 11 nt, Escherichia coli CFT073
ucaucaucagg

SEQ ID NO: 650183 - RNA, 11 nt, Escherichia coli CFT073
ucaucaucagu

SEQ ID NO: 650184 - RNA, 13 nt, Escherichia coli CFT073
ucauaauaguagg

SEQ ID NO: 650185 - RNA, 23 nt, Escherichia coli CFT073
ucauaaugauggggucacagguu

SEQ ID NO: 650186 - RNA, 18 nt, Escherichia coli CFT073
ucauauacccugccagaa

SEQ ID NO: 650187 - RNA, 15 nt, Escherichia coli CFT073
ucauauaucccuucc

SEQ ID NO: 650188 - RNA, 22 nt, Escherichia coli CFT073
ucauaguaaguguuguauuaua

SEQ ID NO: 650189 - RNA, 13 nt, Escherichia coli CFT073
ucauacugaacuu

SEQ ID NO: 650190 - RNA, 14 nt, Escherichia coli CFT073
ucauacucccagcg

SEQ ID NO: 650191 - RNA, 17 nt, Escherichia coli CFT073
ucauacugauuguacug

SEQ ID NO: 650192 - RNA, 24 nt, Escherichia coli CFT073
ucauacugccgaccaucuguucug

SEQ ID NO: 650193 - RNA, 22 nt, Escherichia coli CFT073
ucauagauuaauuucccaccac

SEQ ID NO: 650194 - RNA, 16 nt, Escherichia coli CFT073
ucauagagcgcaucca

SEQ ID NO: 650195 - RNA, 15 nt, Escherichia coli CFT073
ucauagcaaauuccu

SEQ ID NO: 650196 - RNA, 15 nt, Escherichia coli CFT073
ucauaugauucauau

SEQ ID NO: 650197 - RNA, 16 nt, Escherichia coli CFT073
ucauaugauaggcuuc

SEQ ID NO: 650198 - RNA, 13 nt, Escherichia coli CFT073
ucauaucaucauc

SEQ ID NO: 650199 - RNA, 17 nt, Escherichia coli CFT073
ucauauccggcauuuuu

SEQ ID NO: 650200 - RNA, 23 nt, Escherichia coli CFT073
ucaucaaacaacggcacuucaau

SEQ ID NO: 650201 - RNA, 21 nt, Escherichia coli CFT073
ucaucaaggcugauaacgucc

SEQ ID NO: 650202 - RNA, 21 nt, Escherichia coli CFT073
ucaucaacugacuauccugga

SEQ ID NO: 650203 - RNA, 20 nt, Escherichia coli CFT073
ucaucaauccugcagcaggu

SEQ ID NO: 650204 - RNA, 17 nt, Escherichia coli CFT073
ucaucacaucccagcag

SEQ ID NO: 650205 - RNA, 21 nt, Escherichia coli CFT073
ucaucaccccgcgcucacacc

SEQ ID NO: 650206 - RNA, 16 nt, Escherichia coli CFT073
ucaucacgacauaauu

SEQ ID NO: 650207 - RNA, 17 nt, Escherichia coli CFT073
ucaucacgcacugcaau

SEQ ID NO: 650208 - RNA, 17 nt, Escherichia coli CFT073
ucaucacgcaggcugua

SEQ ID NO: 650209 - RNA, 16 nt, Escherichia coli CFT073
ucaucaccaggccaua

SEQ ID NO: 650210 - RNA, 20 nt, Escherichia coli CFT073
ucaucuuuugcgauauauuu

SEQ ID NO: 650211 - RNA, 21 nt, Escherichia coli CFT073
ucaucuuuugcgauauauuuu

SEQ ID NO: 650212 - RNA, 16 nt, Escherichia coli CFT073
ucaucuuucaucuguu

SEQ ID NO: 650213 - RNA, 18 nt, Escherichia coli CFT073
ucaucuuccauucuccgc

SEQ ID NO: 650214 - RNA, 16 nt, Escherichia coli CFT073
ucaucuuccacuuugu

SEQ ID NO: 650215 - RNA, 19 nt, Escherichia coli CFT073
ucaucuucauaacuuugau

SEQ ID NO: 650216 - RNA, 19 nt, Escherichia coli CFT073
ucaucugguuccuaaauaa

SEQ ID NO: 650217 - RNA, 21 nt, Escherichia coli CFT073
ucaucugguuccuaaauaacc

SEQ ID NO: 650218 - RNA, 16 nt, Escherichia coli CFT073
ucaucgguauaaccaa

SEQ ID NO: 650219 - RNA, 20 nt, Escherichia coli CFT073
ucaucggucaguuugcccca

SEQ ID NO: 650220 - RNA, 22 nt, Escherichia coli CFT073
ucaucggugguguaaccuucac

SEQ ID NO: 650221 - RNA, 18 nt, Escherichia coli CFT073
ucaucguaguaguucauc

SEQ ID NO: 650222 - RNA, 23 nt, Escherichia coli CFT073
ucaucguaguaguucauccccuc

SEQ ID NO: 650223 - RNA, 15 nt, Escherichia coli CFT073
ucaucucagucagau

SEQ ID NO: 650224 - RNA, 22 nt, Escherichia coli CFT073
ucaucuccaguuucgagaaauu

SEQ ID NO: 650225 - RNA, 12 nt, Escherichia coli CFT073
ucaucucuucaa

SEQ ID NO: 650226 - RNA, 16 nt, Escherichia coli CFT073
ucaucugaccacggcc

SEQ ID NO: 650227 - RNA, 17 nt, Escherichia coli CFT073
ucaugcccuuuuuucuu

SEQ ID NO: 650228 - RNA, 13 nt, Escherichia coli CFT073
ucaugccagugau

SEQ ID NO: 650229 - RNA, 21 nt, Escherichia coli CFT073
ucaugcgccagguaacgaaga

SEQ ID NO: 650230 - RNA, 17 nt, Escherichia coli CFT073
ucaugcggcgcgcccca

SEQ ID NO: 650231 - RNA, 17 nt, Escherichia coli CFT073
ucaugcucaagcugacc

SEQ ID NO: 650232 - RNA, 22 nt, Escherichia coli CFT073
ucaugcugcggcuguccggcac

SEQ ID NO: 650233 - RNA, 22 nt, Escherichia coli CFT073
ucaugcuucaucgugacaaucu

SEQ ID NO: 650234 - RNA, 16 nt, Escherichia coli CFT073
ucauggcagucuuaau

SEQ ID NO: 650235 - RNA, 17 nt, Escherichia coli CFT073
ucaugauacagccgaca

SEQ ID NO: 650236 - RNA, 13 nt, Escherichia coli CFT073
ucaugcagcgcag

SEQ ID NO: 650237 - RNA, 17 nt, Escherichia coli CFT073
ucaugaacacacccgga

SEQ ID NO: 650238 - RNA, 12 nt, Escherichia coli CFT073
ucaugaauaaaa

SEQ ID NO: 650239 - RNA, 20 nt, Escherichia coli CFT073
ucauucugcaaggcaaaaua

SEQ ID NO: 650240 - RNA, 18 nt, Escherichia coli CFT073
ucauugcuauuucccccu

SEQ ID NO: 650241 - RNA, 15 nt, Escherichia coli CFT073
ucauugcguaaccaa

SEQ ID NO: 650242 - RNA, 12 nt, Escherichia coli CFT073
ucauuucauuug

SEQ ID NO: 650243 - RNA, 21 nt, Escherichia coli CFT073
ucauuucauuuggauggaaaa

SEQ ID NO: 650244 - RNA, 22 nt, Escherichia coli CFT073
ucauuucauuuggauggaaaau

SEQ ID NO: 650245 - RNA, 23 nt, Escherichia coli CFT073
ucauuuacaucacgcagcugcgc

SEQ ID NO: 650246 - RNA, 15 nt, Escherichia coli CFT073
ucauuguaaauaauu

SEQ ID NO: 650247 - RNA, 19 nt, Escherichia coli CFT073
ucauuuuugccaucaauca

SEQ ID NO: 650248 - RNA, 22 nt, Escherichia coli CFT073
ucauuuuucgcuaccagcaaag

SEQ ID NO: 650249 - RNA, 12 nt, Escherichia coli CFT073
ucauuuucaggg

SEQ ID NO: 650250 - RNA, 16 nt, Escherichia coli CFT073
ucauuuucagggcaac

SEQ ID NO: 650251 - RNA, 24 nt, Escherichia coli CFT073
ucauuuuauugcguaaucuuuuca

SEQ ID NO: 650252 - RNA, 15 nt, Escherichia coli CFT073
uccaaaaaacaaacc

SEQ ID NO: 650253 - RNA, 22 nt, Escherichia coli CFT073
ucauuaugagugaugugcucua

SEQ ID NO: 650254 - RNA, 13 nt, Escherichia coli CFT073
ucauuaugcugga

SEQ ID NO: 650255 - RNA, 15 nt, Escherichia coli CFT073
ucauuacgccagucg

SEQ ID NO: 650256 - RNA, 19 nt, Escherichia coli CFT073
ucauuacgaaguuuaauuc

SEQ ID NO: 650257 - RNA, 16 nt, Escherichia coli CFT073
ucauuaauuucaggcu

SEQ ID NO: 650258 - RNA, 22 nt, Escherichia coli CFT073
ucauuaauuucaggcugucagu

SEQ ID NO: 650259 - RNA, 16 nt, Escherichia coli CFT073
ucauuaccacaacaaa

SEQ ID NO: 650260 - RNA, 17 nt, Escherichia coli CFT073
ucauuaccacaacaaau

SEQ ID NO: 650261 - RNA, 18 nt, Escherichia coli CFT073
ucauucaacuuaagucuc

SEQ ID NO: 650262 - RNA, 13 nt, Escherichia coli CFT073
ucauucaccaguu

SEQ ID NO: 650263 - RNA, 21 nt, Escherichia coli CFT073
ucauuauucauuguucuccca

SEQ ID NO: 650264 - RNA, 18 nt, Escherichia coli CFT073
ucauuauucccccggcuu

SEQ ID NO: 650265 - RNA, 20 nt, Escherichia coli CFT073
ucauuauucccccggcuuca

SEQ ID NO: 650266 - RNA, 21 nt, Escherichia coli CFT073
ucauucgacgcgcgcacacaa

SEQ ID NO: 650267 - RNA, 15 nt, Escherichia coli CFT073
ucauguaacgcugca

SEQ ID NO: 650268 - RNA, 16 nt, Escherichia coli CFT073
ucauguaguaaugcuu

SEQ ID NO: 650269 - RNA, 17 nt, Escherichia coli CFT073
ucauguagucggacaaa

SEQ ID NO: 650270 - RNA, 15 nt, Escherichia coli CFT073
ucauguauuuuuucc

SEQ ID NO: 650271 - RNA, 19 nt, Escherichia coli CFT073
ucaugucagaugcggcaug

SEQ ID NO: 650272 - RNA, 20 nt, Escherichia coli CFT073
ucaugguuacgccggugauu

SEQ ID NO: 650273 - RNA, 16 nt, Escherichia coli CFT073
ucauggcguuuuuccc

SEQ ID NO: 650274 - RNA, 11 nt, Escherichia coli CFT073
ucauuaauaac

SEQ ID NO: 650275 - RNA, 14 nt, Escherichia coli CFT073
ucauuaauguaugu

SEQ ID NO: 650276 - RNA, 16 nt, Escherichia coli CFT073
ucauuaaucaccaguc

SEQ ID NO: 650277 - RNA, 17 nt, Escherichia coli CFT073
ucauuaaucaccaguca

SEQ ID NO: 650278 - RNA, 19 nt, Escherichia coli CFT073
ucauuaacccguuuacaua

SEQ ID NO: 650279 - RNA, 23 nt, Escherichia coli CFT073
ucauuaacgcagaaucuucuucu

SEQ ID NO: 650280 - RNA, 22 nt, Escherichia coli CFT073
uccaccaccgcaaaauagguau

SEQ ID NO: 650281 - RNA, 13 nt, Escherichia coli CFT073
uccaccagcacca

SEQ ID NO: 650282 - RNA, 20 nt, Escherichia coli CFT073
uccaccagccccagaacuca

SEQ ID NO: 650283 - RNA, 14 nt, Escherichia coli CFT073
uccaccagaacgac

SEQ ID NO: 650284 - RNA, 19 nt, Escherichia coli CFT073
uccaccagacgauggcucc

SEQ ID NO: 650285 - RNA, 20 nt, Escherichia coli CFT073
uccaccacuuuaucgagaau

SEQ ID NO: 650286 - RNA, 19 nt, Escherichia coli CFT073
uccacauuuucagccaggg

SEQ ID NO: 650287 - RNA, 21 nt, Escherichia coli CFT073
uccacaugguuuucaauuauc

SEQ ID NO: 650288 - RNA, 17 nt, Escherichia coli CFT073
uccacauccagaugucu

SEQ ID NO: 650289 - RNA, 15 nt, Escherichia coli CFT073
uccacauaaaguagc

SEQ ID NO: 650290 - RNA, 19 nt, Escherichia coli CFT073
uccaaauagcucaaugaaa

SEQ ID NO: 650291 - RNA, 18 nt, Escherichia coli CFT073
uccacaguaagccgguaa

SEQ ID NO: 650292 - RNA, 15 nt, Escherichia coli CFT073
uccacaagaaugccu

SEQ ID NO: 650293 - RNA, 14 nt, Escherichia coli CFT073
uccacucacacagc

SEQ ID NO: 650294 - RNA, 15 nt, Escherichia coli CFT073
uccacucacacagcu

SEQ ID NO: 650295 - RNA, 22 nt, Escherichia coli CFT073
uccacugggaguuuuucuacua

SEQ ID NO: 650296 - RNA, 17 nt, Escherichia coli CFT073
uccacucugccaggcag

SEQ ID NO: 650297 - RNA, 14 nt, Escherichia coli CFT073
uccacugcaucagu

SEQ ID NO: 650298 - RNA, 15 nt, Escherichia coli CFT073
uccaccgucaaaucc

SEQ ID NO: 650299 - RNA, 20 nt, Escherichia coli CFT073
uccaccugaggggcaaaauc

SEQ ID NO: 650300 - RNA, 18 nt, Escherichia coli CFT073
uccaccuucuguaacugg

SEQ ID NO: 650301 - RNA, 16 nt, Escherichia coli CFT073
uccagaccuaaaaauu

SEQ ID NO: 650302 - RNA, 14 nt, Escherichia coli CFT073
uccagaauauguuc

SEQ ID NO: 650303 - RNA, 13 nt, Escherichia coli CFT073
uccagacugcugc

SEQ ID NO: 650304 - RNA, 20 nt, Escherichia coli CFT073
uccagagagguuuucaacuc

SEQ ID NO: 650305 - RNA, 14 nt, Escherichia coli CFT073
uccagauucucaua

SEQ ID NO: 650306 - RNA, 22 nt, Escherichia coli CFT073
uccagauucucauauaucccuu

SEQ ID NO: 650307 - RNA, 16 nt, Escherichia coli CFT073
uccagauucuccaccu

SEQ ID NO: 650308 - RNA, 19 nt, Escherichia coli CFT073
uccagauaacaaucaucaa

SEQ ID NO: 650309 - RNA, 21 nt, Escherichia coli CFT073
uccagauaacaaucaucaacc

SEQ ID NO: 650310 - RNA, 19 nt, Escherichia coli CFT073
uccagauaauuaugccgau

SEQ ID NO: 650311 - RNA, 23 nt, Escherichia coli CFT073
uccagauauguaucuaccccaga

SEQ ID NO: 650312 - RNA, 13 nt, Escherichia coli CFT073
uccagauauucau

SEQ ID NO: 650313 - RNA, 20 nt, Escherichia coli CFT073
uccagcucgcguucugucag

SEQ ID NO: 650314 - RNA, 16 nt, Escherichia coli CFT073
uccagcuguaccagca

SEQ ID NO: 650315 - RNA, 19 nt, Escherichia coli CFT073
uccagcuguaccagcaacu

SEQ ID NO: 650316 - RNA, 14 nt, Escherichia coli CFT073
uccagcuuaauucu

SEQ ID NO: 650317 - RNA, 17 nt, Escherichia coli CFT073
uccagcuuagcggcgcg

SEQ ID NO: 650318 - RNA, 15 nt, Escherichia coli CFT073
uccagcuucagacgg

SEQ ID NO: 650319 - RNA, 15 nt, Escherichia coli CFT073
uccagcuucgccagc

SEQ ID NO: 650320 - RNA, 23 nt, Escherichia coli CFT073
uccaggaaccguccgcauucuuc

SEQ ID NO: 650321 - RNA, 23 nt, Escherichia coli CFT073
uccagcuuuucgauaacccugcg

SEQ ID NO: 650322 - RNA, 13 nt, Escherichia coli CFT073
uccaggggcuggu

SEQ ID NO: 650323 - RNA, 24 nt, Escherichia coli CFT073
uccaggggcuggugccugcacugg

SEQ ID NO: 650324 - RNA, 20 nt, Escherichia coli CFT073
uccagggguuguuauuuccg

SEQ ID NO: 650325 - RNA, 15 nt, Escherichia coli CFT073
uccaguccaccccca

SEQ ID NO: 650326 - RNA, 17 nt, Escherichia coli CFT073
uccaguuugcucaaauc

SEQ ID NO: 650327 - RNA, 23 nt, Escherichia coli CFT073
uccaguagaauaaugaucccuuc

SEQ ID NO: 650328 - RNA, 22 nt, Escherichia coli CFT073
uccaguacgcggacacuuuccu

SEQ ID NO: 650329 - RNA, 19 nt, Escherichia coli CFT073
uccauaauugccagcuugc

SEQ ID NO: 650330 - RNA, 13 nt, Escherichia coli CFT073
uccauaaauuaua

SEQ ID NO: 650331 - RNA, 14 nt, Escherichia coli CFT073
uccagauuuuucag

SEQ ID NO: 650332 - RNA, 19 nt, Escherichia coli CFT073
uccagcaaagcgucaagau

SEQ ID NO: 650333 - RNA, 15 nt, Escherichia coli CFT073
uccagcaacaacagc

SEQ ID NO: 650334 - RNA, 13 nt, Escherichia coli CFT073
uccagcaccaguu

SEQ ID NO: 650335 - RNA, 23 nt, Escherichia coli CFT073
uccagcaccaguucgccuucauu

SEQ ID NO: 650336 - RNA, 11 nt, Escherichia coli CFT073
uccagcaccac

SEQ ID NO: 650337 - RNA, 13 nt, Escherichia coli CFT073
uccagcaccacua

SEQ ID NO: 650338 - RNA, 20 nt, Escherichia coli CFT073
uccagcaccacuuccggcaa

SEQ ID NO: 650339 - RNA, 20 nt, Escherichia coli CFT073
uccagccaccgcguggcaga

SEQ ID NO: 650340 - RNA, 21 nt, Escherichia coli CFT073
uccagccaccgcguggcagac

SEQ ID NO: 650341 - RNA, 17 nt, Escherichia coli CFT073
uccagcagcuccggcuc

SEQ ID NO: 650342 - RNA, 19 nt, Escherichia coli CFT073
uccagcagcuccggcucua

SEQ ID NO: 650343 - RNA, 23 nt, Escherichia coli CFT073
uccagcagcuuaagcgaccaguu

SEQ ID NO: 650344 - RNA, 20 nt, Escherichia coli CFT073
uccagcagcuugcgccgccc

SEQ ID NO: 650345 - RNA, 14 nt, Escherichia coli CFT073
uccagcagccagag

SEQ ID NO: 650346 - RNA, 17 nt, Escherichia coli CFT073
uccagcguuaccggcuu

SEQ ID NO: 650347 - RNA, 13 nt, Escherichia coli CFT073
uccagcucaacca

SEQ ID NO: 650348 - RNA, 22 nt, Escherichia coli CFT073
uccagccucugucuuccgggaa

SEQ ID NO: 650349 - RNA, 21 nt, Escherichia coli CFT073
uccagccuacagaacgcugca

SEQ ID NO: 650350 - RNA, 18 nt, Escherichia coli CFT073
uccagccccaccagcaaa

SEQ ID NO: 650351 - RNA, 16 nt, Escherichia coli CFT073
uccagcccuccucacu

SEQ ID NO: 650352 - RNA, 12 nt, Escherichia coli CFT073
uccagccaggcg

SEQ ID NO: 650353 - RNA, 19 nt, Escherichia coli CFT073
ucacuccccgcaacaguga

SEQ ID NO: 650354 - RNA, 21 nt, Escherichia coli CFT073
ucacuccauugucuuuucgcu

SEQ ID NO: 650355 - RNA, 14 nt, Escherichia coli CFT073
ucacucacgcugcg

SEQ ID NO: 650356 - RNA, 14 nt, Escherichia coli CFT073
ucacucaucagcuu

SEQ ID NO: 650357 - RNA, 13 nt, Escherichia coli CFT073
ucacuauucagau

SEQ ID NO: 650358 - RNA, 23 nt, Escherichia coli CFT073
ucacuaccugauucgcaccacgu

SEQ ID NO: 650359 - RNA, 13 nt, Escherichia coli CFT073
ucacuacaaucag

SEQ ID NO: 650360 - RNA, 19 nt, Escherichia coli CFT073
ucacuaccaccuuuuuaau

SEQ ID NO: 650361 - RNA, 15 nt, Escherichia coli CFT073
ucacuaaauucagcu

SEQ ID NO: 650362 - RNA, 16 nt, Escherichia coli CFT073
ucacgcagugucagca

SEQ ID NO: 650363 - RNA, 19 nt, Escherichia coli CFT073
ucacgcaguuuauccaucu

SEQ ID NO: 650364 - RNA, 19 nt, Escherichia coli CFT073
ucacgcacucgacgcagca

SEQ ID NO: 650365 - RNA, 13 nt, Escherichia coli CFT073
ucacgcacuuccg

SEQ ID NO: 650366 - RNA, 16 nt, Escherichia coli CFT073
ucacgcagagcaucau

SEQ ID NO: 650367 - RNA, 19 nt, Escherichia coli CFT073
ucacgcagauacuggaaaa

SEQ ID NO: 650368 - RNA, 20 nt, Escherichia coli CFT073
ucacgcagcgugaagcuacc

SEQ ID NO: 650369 - RNA, 16 nt, Escherichia coli CFT073
ucacgcagcucacgca

SEQ ID NO: 650370 - RNA, 18 nt, Escherichia coli CFT073
ucacgcagcuucucguga

SEQ ID NO: 650371 - RNA, 18 nt, Escherichia coli CFT073
ucacgauuguuaaucaca

SEQ ID NO: 650372 - RNA, 21 nt, Escherichia coli CFT073
ucacgauuguuaaucacaucg

SEQ ID NO: 650373 - RNA, 16 nt, Escherichia coli CFT073
ucacgauuguuaauca

SEQ ID NO: 650374 - RNA, 17 nt, Escherichia coli CFT073
ucacgauuguuaaucac

SEQ ID NO: 650375 - RNA, 15 nt, Escherichia coli CFT073
ucacgcaauugcugc

SEQ ID NO: 650376 - RNA, 20 nt, Escherichia coli CFT073
ucacgcaccaacuccucuuu

SEQ ID NO: 650377 - RNA, 15 nt, Escherichia coli CFT073
ucacgcaccauaaua

SEQ ID NO: 650378 - RNA, 17 nt, Escherichia coli CFT073
ucacgcugacaacuccu

SEQ ID NO: 650379 - RNA, 19 nt, Escherichia coli CFT073
ucacgcgcgguauuuucaa

SEQ ID NO: 650380 - RNA, 23 nt, Escherichia coli CFT073
ucacgcuggcaucaaucgcuccc

SEQ ID NO: 650381 - RNA, 14 nt, Escherichia coli CFT073
ucacgacacauaaa

SEQ ID NO: 650382 - RNA, 16 nt, Escherichia coli CFT073
ucacgaccaucaaccu

SEQ ID NO: 650383 - RNA, 17 nt, Escherichia coli CFT073
ucacgacccauuacgua

SEQ ID NO: 650384 - RNA, 14 nt, Escherichia coli CFT073
ucacgaauccgcac

SEQ ID NO: 650385 - RNA, 14 nt, Escherichia coli CFT073
ucacgaaucgccuc

SEQ ID NO: 650386 - RNA, 22 nt, Escherichia coli CFT073
ucacgaacguuccccggaaaau

SEQ ID NO: 650387 - RNA, 23 nt, Escherichia coli CFT073
ucaccuuuuguugcuuuggcuuu

SEQ ID NO: 650388 - RNA, 16 nt, Escherichia coli CFT073
ucaccuuucagccacu

SEQ ID NO: 650389 - RNA, 20 nt, Escherichia coli CFT073
ucaccuuucagccacuucau

SEQ ID NO: 650390 - RNA, 16 nt, Escherichia coli CFT073
ucaccuuguaugacaa

SEQ ID NO: 650391 - RNA, 19 nt, Escherichia coli CFT073
ucaccuuacuggaguaaau

SEQ ID NO: 650392 - RNA, 15 nt, Escherichia coli CFT073
ucaccuucaaaauuu

SEQ ID NO: 650393 - RNA, 23 nt, Escherichia coli CFT073
ucaccugauuuacguaaaaaccc

SEQ ID NO: 650394 - RNA, 15 nt, Escherichia coli CFT073
ucaccugcccuccgg

SEQ ID NO: 650395 - RNA, 14 nt, Escherichia coli CFT073
ucaccucuuuguac

SEQ ID NO: 650396 - RNA, 15 nt, Escherichia coli CFT073
ucaccucuucaccgu

SEQ ID NO: 650397 - RNA, 22 nt, Escherichia coli CFT073
ucaccucuucaccguccaucca

SEQ ID NO: 650398 - RNA, 19 nt, Escherichia coli CFT073
ucaccucuucauuaaacca

SEQ ID NO: 650399 - RNA, 19 nt, Escherichia coli CFT073
ucaccucuccgggcggcgu

SEQ ID NO: 650400 - RNA, 20 nt, Escherichia coli CFT073
ucaccuacagccacaccuuc

SEQ ID NO: 650401 - RNA, 20 nt, Escherichia coli CFT073
ucaccguuuaauaacagcug

SEQ ID NO: 650402 - RNA, 15 nt, Escherichia coli CFT073
ucaccuacgcuggca

SEQ ID NO: 650403 - RNA, 17 nt, Escherichia coli CFT073
ucacccagucccaccau

SEQ ID NO: 650404 - RNA, 18 nt, Escherichia coli CFT073
ucacccaucgauacccag

SEQ ID NO: 650405 - RNA, 19 nt, Escherichia coli CFT073
ucacccaucgauacccaga

SEQ ID NO: 650406 - RNA, 20 nt, Escherichia coli CFT073
ucacccgagagaacugcugc

SEQ ID NO: 650407 - RNA, 23 nt, Escherichia coli CFT073
ucacccgagagaacugcugcauc

SEQ ID NO: 650408 - RNA, 19 nt, Escherichia coli CFT073
ucaccgaugacagaaucag

SEQ ID NO: 650409 - RNA, 17 nt, Escherichia coli CFT073
ucaccgaugaucgccau

SEQ ID NO: 650410 - RNA, 19 nt, Escherichia coli CFT073
ucaccgaugcacagaaccg

SEQ ID NO: 650411 - RNA, 23 nt, Escherichia coli CFT073
ucaccgcagcaucgucaucagcu

SEQ ID NO: 650412 - RNA, 13 nt, Escherichia coli CFT073
ucaccgccaggcc

SEQ ID NO: 650413 - RNA, 15 nt, Escherichia coli CFT073
ucaccggaacuuuca

SEQ ID NO: 650414 - RNA, 14 nt, Escherichia coli CFT073
ucaccgcgaccaga

SEQ ID NO: 650415 - RNA, 20 nt, Escherichia coli CFT073
ucaccgccgagacauccacu

SEQ ID NO: 650416 - RNA, 21 nt, Escherichia coli CFT073
ucaccgccgagacauccacuu

SEQ ID NO: 650417 - RNA, 20 nt, Escherichia coli CFT073
ucaccgguccccggaugagu

SEQ ID NO: 650418 - RNA, 18 nt, Escherichia coli CFT073
ucaccguaaccaccagca

SEQ ID NO: 650419 - RNA, 16 nt, Escherichia coli CFT073
ucaccgugauccccac

SEQ ID NO: 650420 - RNA, 13 nt, Escherichia coli CFT073
ucacccaacucuc

SEQ ID NO: 650421 - RNA, 22 nt, Escherichia coli CFT073
ucaccacuucggcaaaaaaguc

SEQ ID NO: 650422 - RNA, 18 nt, Escherichia coli CFT073
ucaccacauucagcagcc

SEQ ID NO: 650423 - RNA, 19 nt, Escherichia coli CFT073
ucaccacauucagcagccc

SEQ ID NO: 650424 - RNA, 18 nt, Escherichia coli CFT073
ucaccacguuagcaaaug

SEQ ID NO: 650425 - RNA, 18 nt, Escherichia coli CFT073
ucaccacuaccgugucug

SEQ ID NO: 650426 - RNA, 11 nt, Escherichia coli CFT073
ucaccacaccg

SEQ ID NO: 650427 - RNA, 17 nt, Escherichia coli CFT073
ucaccacagacaaacag

SEQ ID NO: 650428 - RNA, 14 nt, Escherichia coli CFT073
ucaccaaugacagc

SEQ ID NO: 650429 - RNA, 21 nt, Escherichia coli CFT073
ucaccaaugauaaguuucacu

SEQ ID NO: 650430 - RNA, 13 nt, Escherichia coli CFT073
ucaccaauuuuaa

SEQ ID NO: 650431 - RNA, 13 nt, Escherichia coli CFT073
ucaccagcaaaac

SEQ ID NO: 650432 - RNA, 16 nt, Escherichia coli CFT073
ucaccagcaaaacggu

SEQ ID NO: 650433 - RNA, 18 nt, Escherichia coli CFT073
ucaccacuuuauagcuuu

SEQ ID NO: 650434 - RNA, 21 nt, Escherichia coli CFT073
ucaccagaauagcggcuucau

SEQ ID NO: 650435 - RNA, 17 nt, Escherichia coli CFT073
ucaccagagauaaaauu

SEQ ID NO: 650436 - RNA, 19 nt, Escherichia coli CFT073
ucacagaggucuuuucucg

SEQ ID NO: 650437 - RNA, 16 nt, Escherichia coli CFT073
ucacagaccaaaacuc

SEQ ID NO: 650438 - RNA, 18 nt, Escherichia coli CFT073
ucacacugacgcgcagug

SEQ ID NO: 650439 - RNA, 22 nt, Escherichia coli CFT073
ucacacugacgcgcagugccug

SEQ ID NO: 650440 - RNA, 20 nt, Escherichia coli CFT073
ucacacugacuuuaccugcc

SEQ ID NO: 650441 - RNA, 19 nt, Escherichia coli CFT073
ucacacugaugauccugga

SEQ ID NO: 650442 - RNA, 14 nt, Escherichia coli CFT073
ucacagaaaaaaca

SEQ ID NO: 650443 - RNA, 14 nt, Escherichia coli CFT073
ucaccaaaggcaca

SEQ ID NO: 650444 - RNA, 21 nt, Escherichia coli CFT073
ucaccaacugugccgcgacca

SEQ ID NO: 650445 - RNA, 18 nt, Escherichia coli CFT073
ucaccaaucugaaaccag

SEQ ID NO: 650446 - RNA, 21 nt, Escherichia coli CFT073
ucacauuguuaaagcccugcu

SEQ ID NO: 650447 - RNA, 14 nt, Escherichia coli CFT073
ucaccaaacugcuc

SEQ ID NO: 650448 - RNA, 21 nt, Escherichia coli CFT073
ucaccaaaugccugcuguugc

SEQ ID NO: 650449 - RNA, 20 nt, Escherichia coli CFT073
ucaauuaaugccuucaaauc

SEQ ID NO: 650450 - RNA, 20 nt, Escherichia coli CFT073
ucaauuacgcggcuucaacu

SEQ ID NO: 650451 - RNA, 20 nt, Escherichia coli CFT073
ucaauuuccgucgcaugggg

SEQ ID NO: 650452 - RNA, 13 nt, Escherichia coli CFT073
ucaauuucuucag

SEQ ID NO: 650453 - RNA, 22 nt, Escherichia coli CFT073
ucaauuugcuccgccagugacu

SEQ ID NO: 650454 - RNA, 14 nt, Escherichia coli CFT073
ucaauuuuucagga

SEQ ID NO: 650455 - RNA, 16 nt, Escherichia coli CFT073
ucacaccauccagcaa

SEQ ID NO: 650456 - RNA, 16 nt, Escherichia coli CFT073
ucacaccaugccagaa

SEQ ID NO: 650457 - RNA, 12 nt, Escherichia coli CFT073
ucacacacauca

SEQ ID NO: 650458 - RNA, 17 nt, Escherichia coli CFT073
ucacacagugaaucucu

SEQ ID NO: 650459 - RNA, 19 nt, Escherichia coli CFT073
ucaaucuguccuuccagua

SEQ ID NO: 650460 - RNA, 16 nt, Escherichia coli CFT073
ucaaucuggcugauga

SEQ ID NO: 650461 - RNA, 13 nt, Escherichia coli CFT073
ucaaucuucucuu

SEQ ID NO: 650462 - RNA, 17 nt, Escherichia coli CFT073
ucaaucuuuacacacaa

SEQ ID NO: 650463 - RNA, 21 nt, Escherichia coli CFT073
ucaaucuuuuucaugcuauuc

SEQ ID NO: 650464 - RNA, 17 nt, Escherichia coli CFT073
ucaaucugcuccauuaa

SEQ ID NO: 650465 - RNA, 18 nt, Escherichia coli CFT073
ucaaucucgcugaucuua

SEQ ID NO: 650466 - RNA, 18 nt, Escherichia coli CFT073
ucaaucgcggugauuuua

SEQ ID NO: 650467 - RNA, 14 nt, Escherichia coli CFT073
ucaaugccaccaga

SEQ ID NO: 650468 - RNA, 15 nt, Escherichia coli CFT073
ucaaugcuuuuugca

SEQ ID NO: 650469 - RNA, 17 nt, Escherichia coli CFT073
ucaaugcuuuuugcauu

SEQ ID NO: 650470 - RNA, 21 nt, Escherichia coli CFT073
ucaaugcuuuuugcauuuccg

SEQ ID NO: 650471 - RNA, 19 nt, Escherichia coli CFT073
ucaauggaugcaucuucau

SEQ ID NO: 650472 - RNA, 17 nt, Escherichia coli CFT073
ucaauggcagcaucacg

SEQ ID NO: 650473 - RNA, 12 nt, Escherichia coli CFT073
ucaaugcauauc

SEQ ID NO: 650474 - RNA, 19 nt, Escherichia coli CFT073
ucaaugcauaucauugcgu

SEQ ID NO: 650475 - RNA, 18 nt, Escherichia coli CFT073
ucaaugccgucaccagca

SEQ ID NO: 650476 - RNA, 18 nt, Escherichia coli CFT073
ucaaugccggacuguaaa

SEQ ID NO: 650477 - RNA, 17 nt, Escherichia coli CFT073
ucaaugccccaccacuc

SEQ ID NO: 650478 - RNA, 16 nt, Escherichia coli CFT073
ucaaguuccguuucca

SEQ ID NO: 650479 - RNA, 21 nt, Escherichia coli CFT073
ucaauauuccagucagcacca

SEQ ID NO: 650480 - RNA, 18 nt, Escherichia coli CFT073
ucaagugaacuuucucug

SEQ ID NO: 650481 - RNA, 15 nt, Escherichia coli CFT073
ucaaucgcaaucugg

SEQ ID NO: 650482 - RNA, 20 nt, Escherichia coli CFT073
ucaauccgucccaauucuuc

SEQ ID NO: 650483 - RNA, 22 nt, Escherichia coli CFT073
ucaauccgucccaauucuuccu

SEQ ID NO: 650484 - RNA, 21 nt, Escherichia coli CFT073
ucaaucccuucgacuuucagu

SEQ ID NO: 650485 - RNA, 13 nt, Escherichia coli CFT073
ucaaucacacuga

SEQ ID NO: 650486 - RNA, 16 nt, Escherichia coli CFT073
ucaaucacccgauacu

SEQ ID NO: 650487 - RNA, 15 nt, Escherichia coli CFT073
ucaagccacuuccuu

SEQ ID NO: 650488 - RNA, 21 nt, Escherichia coli CFT073
ucaagccagauauuaagcggc

SEQ ID NO: 650489 - RNA, 19 nt, Escherichia coli CFT073
ucaagcgguaaccauccau

SEQ ID NO: 650490 - RNA, 22 nt, Escherichia coli CFT073
ucaagcgccgaguaaaaaaaca

SEQ ID NO: 650491 - RNA, 20 nt, Escherichia coli CFT073
ucaagauggcucucauccaa

SEQ ID NO: 650492 - RNA, 18 nt, Escherichia coli CFT073
ucaagauggggaauaagc

SEQ ID NO: 650493 - RNA, 21 nt, Escherichia coli CFT073
ucaagcaaggccagguuuucu

SEQ ID NO: 650494 - RNA, 14 nt, Escherichia coli CFT073
ucaagcaaccaggu

SEQ ID NO: 650495 - RNA, 23 nt, Escherichia coli CFT073
ucaaggcugauaacguccauucc

SEQ ID NO: 650496 - RNA, 19 nt, Escherichia coli CFT073
ucaaggucaugaugcuccg

SEQ ID NO: 650497 - RNA, 18 nt, Escherichia coli CFT073
ucaaggucaacaguucau

SEQ ID NO: 650498 - RNA, 14 nt, Escherichia coli CFT073
ucaaggucaacauu

SEQ ID NO: 650499 - RNA, 21 nt, Escherichia coli CFT073
ucaaguaaucaaucaccucuu

SEQ ID NO: 650500 - RNA, 18 nt, Escherichia coli CFT073
ucaagguugcacaaccaa

SEQ ID NO: 650501 - RNA, 13 nt, Escherichia coli CFT073
ucaaguaaccuuu

SEQ ID NO: 650502 - RNA, 17 nt, Escherichia coli CFT073
ucaagcucaucaaugau

SEQ ID NO: 650503 - RNA, 15 nt, Escherichia coli CFT073
ucaagcuaaaccaau

SEQ ID NO: 650504 - RNA, 18 nt, Escherichia coli CFT073
ucaagcuaaaccaauaaa

SEQ ID NO: 650505 - RNA, 18 nt, Escherichia coli CFT073
ucaagcuggugcuuuaug

SEQ ID NO: 650506 - RNA, 18 nt, Escherichia coli CFT073
ucaagcugugccugaaua

SEQ ID NO: 650507 - RNA, 18 nt, Escherichia coli CFT073
ucaacggcgucagccaca

SEQ ID NO: 650508 - RNA, 16 nt, Escherichia coli CFT073
ucaacggugccaucac

SEQ ID NO: 650509 - RNA, 22 nt, Escherichia coli CFT073
ucaacggugcuuuaauuucaug

SEQ ID NO: 650510 - RNA, 18 nt, Escherichia coli CFT073
ucaaaucuucucacugcc

SEQ ID NO: 650511 - RNA, 16 nt, Escherichia coli CFT073
ucaaauccagccagcg

SEQ ID NO: 650512 - RNA, 17 nt, Escherichia coli CFT073
ucaacguuaccaagaaa

SEQ ID NO: 650513 - RNA, 15 nt, Escherichia coli CFT073
ucaacguagaauaaa

SEQ ID NO: 650514 - RNA, 18 nt, Escherichia coli CFT073
ucaacguaguaucguaau

SEQ ID NO: 650515 - RNA, 23 nt, Escherichia coli CFT073
ucaagacaugauguuuuaacaca

SEQ ID NO: 650516 - RNA, 23 nt, Escherichia coli CFT073
ucaagaaugcucgcuggcaggcc

SEQ ID NO: 650517 - RNA, 23 nt, Escherichia coli CFT073
ucaagaaagcuuugcguuucuuc

SEQ ID NO: 650518 - RNA, 11 nt, Escherichia coli CFT073
ucaagaaaaau

SEQ ID NO: 650519 - RNA, 12 nt, Escherichia coli CFT073
ucaagaaaugca

SEQ ID NO: 650520 - RNA, 19 nt, Escherichia coli CFT073
ucaacuuaagucuccauuu

SEQ ID NO: 650521 - RNA, 19 nt, Escherichia coli CFT073
uauuuuccccacaaucggc

SEQ ID NO: 650522 - RNA, 14 nt, Escherichia coli CFT073
uauuuuguauuguu

SEQ ID NO: 650523 - RNA, 14 nt, Escherichia coli CFT073
uauuuugaaucggu

SEQ ID NO: 650524 - RNA, 20 nt, Escherichia coli CFT073
uauuuugccggacgcugagc

SEQ ID NO: 650525 - RNA, 23 nt, Escherichia coli CFT073
uauuuugccaggcuaaccaguaa

SEQ ID NO: 650526 - RNA, 20 nt, Escherichia coli CFT073
uauuuuaucgcuaucagucc

SEQ ID NO: 650527 - RNA, 16 nt, Escherichia coli CFT073
uauuuuaccauauaaa

SEQ ID NO: 650528 - RNA, 11 nt, Escherichia coli CFT073
uauuuccaggg

SEQ ID NO: 650529 - RNA, 21 nt, Escherichia coli CFT073
uauuuccccaauucauacaug

SEQ ID NO: 650530 - RNA, 18 nt, Escherichia coli CFT073
uauuucccuguugccugc

SEQ ID NO: 650531 - RNA, 16 nt, Escherichia coli CFT073
uauuucuguuugcguc

SEQ ID NO: 650532 - RNA, 13 nt, Escherichia coli CFT073
uauuuuuccagcu

SEQ ID NO: 650533 - RNA, 20 nt, Escherichia coli CFT073
uauuuuuguugaaauaauac

SEQ ID NO: 650534 - RNA, 12 nt, Escherichia coli CFT073
ucaaaaagcuca

SEQ ID NO: 650535 - RNA, 18 nt, Escherichia coli CFT073
ucaaaaacaaauuuugaa

SEQ ID NO: 650536 - RNA, 13 nt, Escherichia coli CFT073
ucaaaaacaaaau

SEQ ID NO: 650537 - RNA, 14 nt, Escherichia coli CFT073
ucaaaaacaaagaa

SEQ ID NO: 650538 - RNA, 15 nt, Escherichia coli CFT073
ucaaaaacaaagaau

SEQ ID NO: 650539 - RNA, 16 nt, Escherichia coli CFT073
ucaaaaccuaacucuu

SEQ ID NO: 650540 - RNA, 17 nt, Escherichia coli CFT073
ucaaaaucaucauugcu

SEQ ID NO: 650541 - RNA, 19 nt, Escherichia coli CFT073
ucaaaauaucgacauucaa

SEQ ID NO: 650542 - RNA, 20 nt, Escherichia coli CFT073
ucaaaauaucgacauucaau

SEQ ID NO: 650543 - RNA, 17 nt, Escherichia coli CFT073
ucaaacgguugauaaau

SEQ ID NO: 650544 - RNA, 20 nt, Escherichia coli CFT073
ucaaacuuuuaaauugaaga

SEQ ID NO: 650545 - RNA, 20 nt, Escherichia coli CFT073
ucaaacgauucggcaaucac

SEQ ID NO: 650546 - RNA, 16 nt, Escherichia coli CFT073
ucaaacgguugauaaa

SEQ ID NO: 650547 - RNA, 13 nt, Escherichia coli CFT073
ucaaaguuuugug

SEQ ID NO: 650548 - RNA, 21 nt, Escherichia coli CFT073
ucaaauaaauaaucucuuccg

SEQ ID NO: 650549 - RNA, 15 nt, Escherichia coli CFT073
ucaaaguuaguaaaa

SEQ ID NO: 650550 - RNA, 22 nt, Escherichia coli CFT073
ucaaaguuugcccgucugcugc

SEQ ID NO: 650551 - RNA, 16 nt, Escherichia coli CFT073
ucaaagguaaugguua

SEQ ID NO: 650552 - RNA, 17 nt, Escherichia coli CFT073
ucaaaggucuuaauuuu

SEQ ID NO: 650553 - RNA, 21 nt, Escherichia coli CFT073
ucaaaggugccaaugauuuug

SEQ ID NO: 650554 - RNA, 14 nt, Escherichia coli CFT073
ucaaagaugaaaua

SEQ ID NO: 650555 - RNA, 16 nt, Escherichia coli CFT073
ucaaagagagcagucc

SEQ ID NO: 650556 - RNA, 19 nt, Escherichia coli CFT073
ucaaagacgcuuucacccg

SEQ ID NO: 650557 - RNA, 14 nt, Escherichia coli CFT073
uaucccuucuccac

SEQ ID NO: 650558 - RNA, 23 nt, Escherichia coli CFT073
uaucccuugucuuuuauuauaau

SEQ ID NO: 650559 - RNA, 22 nt, Escherichia coli CFT073
uauccauguaccagacugacau

SEQ ID NO: 650560 - RNA, 14 nt, Escherichia coli CFT073
uauccauuaaaacu

SEQ ID NO: 650561 - RNA, 22 nt, Escherichia coli CFT073
uauccgaaacgcggguaaucag

SEQ ID NO: 650562 - RNA, 19 nt, Escherichia coli CFT073
uauccgacauuucugcugc

SEQ ID NO: 650563 - RNA, 21 nt, Escherichia coli CFT073
uauccgccagcgccaaagcca

SEQ ID NO: 650564 - RNA, 24 nt, Escherichia coli CFT073
uauuacucuccagacugcugcgca

SEQ ID NO: 650565 - RNA, 16 nt, Escherichia coli CFT073
uauccgcuguuauugu

SEQ ID NO: 650566 - RNA, 19 nt, Escherichia coli CFT073
uauuacgggcgauacaccu

SEQ ID NO: 650567 - RNA, 22 nt, Escherichia coli CFT073
uauuacgggucacaaacaucau

SEQ ID NO: 650568 - RNA, 20 nt, Escherichia coli CFT073
uauuacgguaaggauauuca

SEQ ID NO: 650569 - RNA, 13 nt, Escherichia coli CFT073
uauuaucaauuuu

SEQ ID NO: 650570 - RNA, 23 nt, Escherichia coli CFT073
uauuauaucuucacgauuauuaa

SEQ ID NO: 650571 - RNA, 22 nt, Escherichia coli CFT073
uauuauccggcaaccaccguuu

SEQ ID NO: 650572 - RNA, 22 nt, Escherichia coli CFT073
uauuaucccccgauaaaacauu

SEQ ID NO: 650573 - RNA, 14 nt, Escherichia coli CFT073
uauuauuccauccu

SEQ ID NO: 650574 - RNA, 19 nt, Escherichia coli CFT073
uauuauugaugcuuuucaa

SEQ ID NO: 650575 - RNA, 15 nt, Escherichia coli CFT073
uauuauuauuccugc

SEQ ID NO: 650576 - RNA, 13 nt, Escherichia coli CFT073
uauuauuauuuuu

SEQ ID NO: 650577 - RNA, 16 nt, Escherichia coli CFT073
uauuauucauaaugcc

SEQ ID NO: 650578 - RNA, 18 nt, Escherichia coli CFT073
uauuauucauaaugccca

SEQ ID NO: 650579 - RNA, 20 nt, Escherichia coli CFT073
uauuagcaacgauauccaua

SEQ ID NO: 650580 - RNA, 12 nt, Escherichia coli CFT073
uauuagcccguu

SEQ ID NO: 650581 - RNA, 18 nt, Escherichia coli CFT073
uauucaggauugaauaau

SEQ ID NO: 650582 - RNA, 11 nt, Escherichia coli CFT073
uauucagcaga

SEQ ID NO: 650583 - RNA, 13 nt, Escherichia coli CFT073
uauucauuaauaa

SEQ ID NO: 650584 - RNA, 18 nt, Escherichia coli CFT073
uauucauugcuauuuccc

SEQ ID NO: 650585 - RNA, 18 nt, Escherichia coli CFT073
uauucauuguucucccau

SEQ ID NO: 650586 - RNA, 12 nt, Escherichia coli CFT073
uauucaugcccu

SEQ ID NO: 650587 - RNA, 22 nt, Escherichia coli CFT073
uauucagcguuugcugaaaauc

SEQ ID NO: 650588 - RNA, 16 nt, Escherichia coli CFT073
uauucaguucaucuac

SEQ ID NO: 650589 - RNA, 23 nt, Escherichia coli CFT073
uauucaguggcauuuagaucuau

SEQ ID NO: 650590 - RNA, 16 nt, Escherichia coli CFT073
uauuccugaaucagcc

SEQ ID NO: 650591 - RNA, 15 nt, Escherichia coli CFT073
uauuccaguuaucac

SEQ ID NO: 650592 - RNA, 22 nt, Escherichia coli CFT073
uauucugccgcuuaaauuggcg

SEQ ID NO: 650593 - RNA, 15 nt, Escherichia coli CFT073
uauucucacguugca

SEQ ID NO: 650594 - RNA, 22 nt, Escherichia coli CFT073
uauucucgcuccaguuuucuuu

SEQ ID NO: 650595 - RNA, 16 nt, Escherichia coli CFT073
uauucucggcugccug

SEQ ID NO: 650596 - RNA, 21 nt, Escherichia coli CFT073
uauucgcuuccuccaccacuu

SEQ ID NO: 650597 - RNA, 14 nt, Escherichia coli CFT073
uauuuauucagaau

SEQ ID NO: 650598 - RNA, 19 nt, Escherichia coli CFT073
uauuucacauaacugccuc

SEQ ID NO: 650599 - RNA, 13 nt, Escherichia coli CFT073
uauuucaucauca

SEQ ID NO: 650600 - RNA, 14 nt, Escherichia coli CFT073
uauuucagaccugu

SEQ ID NO: 650601 - RNA, 17 nt, Escherichia coli CFT073
uauuuaguucauauaau

SEQ ID NO: 650602 - RNA, 23 nt, Escherichia coli CFT073
uauuuaguucauauaauuauuuu

SEQ ID NO: 650603 - RNA, 17 nt, Escherichia coli CFT073
uauuuagauaaacggaa

SEQ ID NO: 650604 - RNA, 18 nt, Escherichia coli CFT073
uauuuacagauuucccau

SEQ ID NO: 650605 - RNA, 13 nt, Escherichia coli CFT073
uauugagaucgcu

SEQ ID NO: 650606 - RNA, 18 nt, Escherichia coli CFT073
uauugauauccgcaggug

SEQ ID NO: 650607 - RNA, 18 nt, Escherichia coli CFT073
uauugccccggagaaauc

SEQ ID NO: 650608 - RNA, 13 nt, Escherichia coli CFT073
uauucuguaccaa

SEQ ID NO: 650609 - RNA, 16 nt, Escherichia coli CFT073
aaaucgaacagguugg

SEQ ID NO: 650610 - RNA, 21 nt, Escherichia coli CFT073
uauugucgcccuguaauucgu

SEQ ID NO: 650611 - RNA, 20 nt, Escherichia coli CFT073
uauuggugcuaauuugaaau

SEQ ID NO: 650612 - RNA, 22 nt, Escherichia coli CFT073
uauugcuaugguccguucucac

SEQ ID NO: 650613 - RNA, 18 nt, Escherichia coli CFT073
uauugcuccauaauugcc

SEQ ID NO: 650614 - RNA, 18 nt, Escherichia coli CFT073
uauugcgaaguauggaaa

SEQ ID NO: 650615 - RNA, 15 nt, Escherichia coli CFT073
uauugccuugaugaa

SEQ ID NO: 650616 - RNA, 17 nt, Escherichia coli CFT073
uauugcgcaugacacac

SEQ ID NO: 650617 - RNA, 16 nt, Escherichia coli CFT073
ucuaaugauucauaaa

SEQ ID NO: 650618 - RNA, 18 nt, Escherichia coli CFT073
ucuaaugauucauaaaca

SEQ ID NO: 650619 - RNA, 17 nt, Escherichia coli CFT073
ucuaaugccauuaacau

SEQ ID NO: 650620 - RNA, 22 nt, Escherichia coli CFT073
ucuaaugccauuaacaucccuu

SEQ ID NO: 650621 - RNA, 15 nt, Escherichia coli CFT073
ucuaaugacaaacgc

SEQ ID NO: 650622 - RNA, 21 nt, Escherichia coli CFT073
ucuacaaccaguuuaugccug

SEQ ID NO: 650623 - RNA, 15 nt, Escherichia coli CFT073
ucuacauguguucug

SEQ ID NO: 650624 - RNA, 21 nt, Escherichia coli CFT073
ucuacaguagccuuuuuuaau

SEQ ID NO: 650625 - RNA, 11 nt, Escherichia coli CFT073
ucuacaguacg

SEQ ID NO: 650626 - RNA, 19 nt, Escherichia coli CFT073
aaaugacgggccaagcagg

SEQ ID NO: 650627 - RNA, 18 nt, Escherichia coli CFT073
aaaugacgcuuuauucau

SEQ ID NO: 650628 - RNA, 14 nt, Escherichia coli CFT073
aaaugacucguuau

SEQ ID NO: 650629 - RNA, 23 nt, Escherichia coli CFT073
ucuaccgggcugagucccccaag

SEQ ID NO: 650630 - RNA, 22 nt, Escherichia coli CFT073
ucuaccuguucgcgguuuucuu

SEQ ID NO: 650631 - RNA, 13 nt, Escherichia coli CFT073
aaaugagaaaacu

SEQ ID NO: 650632 - RNA, 13 nt, Escherichia coli CFT073
ucuaccagcaccu

SEQ ID NO: 650633 - RNA, 16 nt, Escherichia coli CFT073
ucuaccaguuccagcg

SEQ ID NO: 650634 - RNA, 20 nt, Escherichia coli CFT073
ucuacugaaggcgcauugcu

SEQ ID NO: 650635 - RNA, 12 nt, Escherichia coli CFT073
ucuacuucuuuc

SEQ ID NO: 650636 - RNA, 16 nt, Escherichia coli CFT073
ucuacuuauucaccac

SEQ ID NO: 650637 - RNA, 13 nt, Escherichia coli CFT073
aaaugaguaugug

SEQ ID NO: 650638 - RNA, 21 nt, Escherichia coli CFT073
aaaugagucaguaaauugugc

SEQ ID NO: 650639 - RNA, 15 nt, Escherichia coli CFT073
ucuacuuuuucuuaa

SEQ ID NO: 650640 - RNA, 23 nt, Escherichia coli CFT073
aaaugagaaaacuaucugaaaau

SEQ ID NO: 650641 - RNA, 16 nt, Escherichia coli CFT073
ucuacgccaucaguuu

SEQ ID NO: 650642 - RNA, 20 nt, Escherichia coli CFT073
ucuacggaagaguuuuucag

SEQ ID NO: 650643 - RNA, 23 nt, Escherichia coli CFT073
ucuacggaagaguuuuucaggcu

SEQ ID NO: 650644 - RNA, 16 nt, Escherichia coli CFT073
ucuacuaacuggcaau

SEQ ID NO: 650645 - RNA, 17 nt, Escherichia coli CFT073
ucguuuucgccggaacc

SEQ ID NO: 650646 - RNA, 20 nt, Escherichia coli CFT073
ucguuuugcuguuccagcau

SEQ ID NO: 650647 - RNA, 18 nt, Escherichia coli CFT073
ucuaaaaacaauucuucg

SEQ ID NO: 650648 - RNA, 19 nt, Escherichia coli CFT073
aaaucuuucacuuuugcca

SEQ ID NO: 650649 - RNA, 14 nt, Escherichia coli CFT073
aaaucuuucagagu

SEQ ID NO: 650650 - RNA, 14 nt, Escherichia coli CFT073
aaaucuuugaaaua

SEQ ID NO: 650651 - RNA, 22 nt, Escherichia coli CFT073
ucuaagucuuucugugcaauca

SEQ ID NO: 650652 - RNA, 14 nt, Escherichia coli CFT073
aaaugaacugggca

SEQ ID NO: 650653 - RNA, 15 nt, Escherichia coli CFT073
ucuaacgaugccagc

SEQ ID NO: 650654 - RNA, 22 nt, Escherichia coli CFT073
ucuaagcugacuugcucaaucu

SEQ ID NO: 650655 - RNA, 17 nt, Escherichia coli CFT073
aaaucuucaagcaucgg

SEQ ID NO: 650656 - RNA, 21 nt, Escherichia coli CFT073
aaaugccagcccauacuuaau

SEQ ID NO: 650657 - RNA, 13 nt, Escherichia coli CFT073
aaaugccgcacau

SEQ ID NO: 650658 - RNA, 16 nt, Escherichia coli CFT073
aaaugcccgacaaaaa

SEQ ID NO: 650659 - RNA, 16 nt, Escherichia coli CFT073
aaaugccgcacaucac

SEQ ID NO: 650660 - RNA, 18 nt, Escherichia coli CFT073
aaaugccguacagcagaa

SEQ ID NO: 650661 - RNA, 21 nt, Escherichia coli CFT073
ucucaccaucaaacagccccu

SEQ ID NO: 650662 - RNA, 17 nt, Escherichia coli CFT073
aaaugcgcuuaaucaau

SEQ ID NO: 650663 - RNA, 14 nt, Escherichia coli CFT073
ucucacucuuuccc

SEQ ID NO: 650664 - RNA, 19 nt, Escherichia coli CFT073
ucucacguccaccaaugcc

SEQ ID NO: 650665 - RNA, 21 nt, Escherichia coli CFT073
ucucacgacgcugguuacauc

SEQ ID NO: 650666 - RNA, 16 nt, Escherichia coli CFT073
ucucaccuacaugacc

SEQ ID NO: 650667 - RNA, 17 nt, Escherichia coli CFT073
ucucaccuacaugaccg

SEQ ID NO: 650668 - RNA, 18 nt, Escherichia coli CFT073
ucucagacucauuaaaac

SEQ ID NO: 650669 - RNA, 15 nt, Escherichia coli CFT073
ucucagauaaaugca

SEQ ID NO: 650670 - RNA, 13 nt, Escherichia coli CFT073
ucucagccaaauc

SEQ ID NO: 650671 - RNA, 20 nt, Escherichia coli CFT073
ucucauagacuuuacuaaua

SEQ ID NO: 650672 - RNA, 13 nt, Escherichia coli CFT073
ucucaucagauau

SEQ ID NO: 650673 - RNA, 13 nt, Escherichia coli CFT073
ucucauccaucaa

SEQ ID NO: 650674 - RNA, 24 nt, Escherichia coli CFT073
ucucaguuguuugcggaauaugcu

SEQ ID NO: 650675 - RNA, 14 nt, Escherichia coli CFT073
ucuauuaaccaaua

SEQ ID NO: 650676 - RNA, 14 nt, Escherichia coli CFT073
ucuauucaccagca

SEQ ID NO: 650677 - RNA, 21 nt, Escherichia coli CFT073
ucuauugcaggggcuuauaua

SEQ ID NO: 650678 - RNA, 22 nt, Escherichia coli CFT073
ucuauugcaggggcuuauauag

SEQ ID NO: 650679 - RNA, 12 nt, Escherichia coli CFT073
ucucaaaacuga

SEQ ID NO: 650680 - RNA, 21 nt, Escherichia coli CFT073
ucucaacgcccuguaaaaaag

SEQ ID NO: 650681 - RNA, 18 nt, Escherichia coli CFT073
ucucaauaccaaugaauu

SEQ ID NO: 650682 - RNA, 18 nt, Escherichia coli CFT073
ucucaauauacgaaaauu

SEQ ID NO: 650683 - RNA, 17 nt, Escherichia coli CFT073
ucucaaucccuuucucc

SEQ ID NO: 650684 - RNA, 18 nt, Escherichia coli CFT073
ucucaauguauucccgua

SEQ ID NO: 650685 - RNA, 17 nt, Escherichia coli CFT073
ucucaauuccuuugcug

SEQ ID NO: 650686 - RNA, 14 nt, Escherichia coli CFT073
ucucaauuuucacu

SEQ ID NO: 650687 - RNA, 15 nt, Escherichia coli CFT073
ucucaauuuucacuu

SEQ ID NO: 650688 - RNA, 20 nt, Escherichia coli CFT073
aaaugccaaauauuucuuua

SEQ ID NO: 650689 - RNA, 22 nt, Escherichia coli CFT073
aaaugccaaauguauccaucac

SEQ ID NO: 650690 - RNA, 22 nt, Escherichia coli CFT073
ucuaucccuucaagcguccauu

SEQ ID NO: 650691 - RNA, 17 nt, Escherichia coli CFT073
ucuaucgcauuauccuu

SEQ ID NO: 650692 - RNA, 18 nt, Escherichia coli CFT073
ucuaucgcauuauccuuu

SEQ ID NO: 650693 - RNA, 20 nt, Escherichia coli CFT073
ucuaugagaucguuaugcaa

SEQ ID NO: 650694 - RNA, 10 nt, Escherichia coli CFT073
ucuaucugcc

SEQ ID NO: 650695 - RNA, 16 nt, Escherichia coli CFT073
ucuaucuugauuugcu

SEQ ID NO: 650696 - RNA, 22 nt, Escherichia coli CFT073
ucuagcaugaugauaucacugg

SEQ ID NO: 650697 - RNA, 18 nt, Escherichia coli CFT073
ucuacuuuuucuuaacgu

SEQ ID NO: 650698 - RNA, 17 nt, Escherichia coli CFT073
aaaugaucaauaauuaa

SEQ ID NO: 650699 - RNA, 16 nt, Escherichia coli CFT073
ucuaggcucuuucucu

SEQ ID NO: 650700 - RNA, 21 nt, Escherichia coli CFT073
aaaugaugucaaccauccgaa

SEQ ID NO: 650701 - RNA, 21 nt, Escherichia coli CFT073
aaaugauuacucccuugccug

SEQ ID NO: 650702 - RNA, 23 nt, Escherichia coli CFT073
ucugcuucguuaacgugucauaa

SEQ ID NO: 650703 - RNA, 18 nt, Escherichia coli CFT073
ucugccagcguaccauga

SEQ ID NO: 650704 - RNA, 21 nt, Escherichia coli CFT073
ucugccaggcagcgauuaacu

SEQ ID NO: 650705 - RNA, 23 nt, Escherichia coli CFT073
ucugccaggcagcgauuaacugc

SEQ ID NO: 650706 - RNA, 17 nt, Escherichia coli CFT073
ucugccagcugcucaua

SEQ ID NO: 650707 - RNA, 13 nt, Escherichia coli CFT073
ucugcauuuucuc

SEQ ID NO: 650708 - RNA, 20 nt, Escherichia coli CFT073
ucugccaccguguauuucug

SEQ ID NO: 650709 - RNA, 15 nt, Escherichia coli CFT073
ucugcaucccggcag

SEQ ID NO: 650710 - RNA, 23 nt, Escherichia coli CFT073
ucuggcugacauaaacaccagca

SEQ ID NO: 650711 - RNA, 17 nt, Escherichia coli CFT073
ucuggucaacaaccagu

SEQ ID NO: 650712 - RNA, 14 nt, Escherichia coli CFT073
ucuggucuggugaa

SEQ ID NO: 650713 - RNA, 13 nt, Escherichia coli CFT073
ucuggugaauauc

SEQ ID NO: 650714 - RNA, 14 nt, Escherichia coli CFT073
ucuggcaaaaauaa

SEQ ID NO: 650715 - RNA, 15 nt, Escherichia coli CFT073
ucuggaugccaucgc

SEQ ID NO: 650716 - RNA, 19 nt, Escherichia coli CFT073
ucuggauggcgcuccagca

SEQ ID NO: 650717 - RNA, 21 nt, Escherichia coli CFT073
ucuggauggcgcuccagcauc

SEQ ID NO: 650718 - RNA, 21 nt, Escherichia coli CFT073
ucuggcaccgguacacaaccg

SEQ ID NO: 650719 - RNA, 16 nt, Escherichia coli CFT073
ucuggcagauccugaa

SEQ ID NO: 650720 - RNA, 17 nt, Escherichia coli CFT073
ucuggcacugccgacaa

SEQ ID NO: 650721 - RNA, 20 nt, Escherichia coli CFT073
ucuggcagcaccacgcagaa

SEQ ID NO: 650722 - RNA, 19 nt, Escherichia coli CFT073
ucuggcucaucgccuucca

SEQ ID NO: 650723 - RNA, 18 nt, Escherichia coli CFT073
ucuggcucauuaguuaau

SEQ ID NO: 650724 - RNA, 23 nt, Escherichia coli CFT073
ucuggcucgaauauaacuaauca

SEQ ID NO: 650725 - RNA, 20 nt, Escherichia coli CFT073
ucuguaagcaauuauucaua

SEQ ID NO: 650726 - RNA, 13 nt, Escherichia coli CFT073
ucuguaacaaggu

SEQ ID NO: 650727 - RNA, 21 nt, Escherichia coli CFT073
ucugguuaaaaaaagaacaac

SEQ ID NO: 650728 - RNA, 23 nt, Escherichia coli CFT073
ucugguucgccaaaugucaccag

SEQ ID NO: 650729 - RNA, 15 nt, Escherichia coli CFT073
ucuguaccaaaauug

SEQ ID NO: 650730 - RNA, 15 nt, Escherichia coli CFT073
ucuguccugaaaauu

SEQ ID NO: 650731 - RNA, 20 nt, Escherichia coli CFT073
ucuguccuuccaguaaccag

SEQ ID NO: 650732 - RNA, 15 nt, Escherichia coli CFT073
ucugucguuaucagg

SEQ ID NO: 650733 - RNA, 18 nt, Escherichia coli CFT073
ucugucaguuggcugugg

SEQ ID NO: 650734 - RNA, 15 nt, Escherichia coli CFT073
ucugucucaacucug

SEQ ID NO: 650735 - RNA, 18 nt, Escherichia coli CFT073
ucugucugauaaaaaacc

SEQ ID NO: 650736 - RNA, 16 nt, Escherichia coli CFT073
ucuuccagcgacaccu

SEQ ID NO: 650737 - RNA, 23 nt, Escherichia coli CFT073
ucuuccagcgcaaggaaauaacg

SEQ ID NO: 650738 - RNA, 14 nt, Escherichia coli CFT073
ucuuccagcauuuc

SEQ ID NO: 650739 - RNA, 16 nt, Escherichia coli CFT073
ucuuccagccacugcg

SEQ ID NO: 650740 - RNA, 15 nt, Escherichia coli CFT073
ucuuccagaaugccu

SEQ ID NO: 650741 - RNA, 21 nt, Escherichia coli CFT073
ucuuccagcagcggcagauca

SEQ ID NO: 650742 - RNA, 21 nt, Escherichia coli CFT073
ucuuccaccguauccagugug

SEQ ID NO: 650743 - RNA, 13 nt, Escherichia coli CFT073
ucuuccacuuugu

SEQ ID NO: 650744 - RNA, 22 nt, Escherichia coli CFT073
ucuucacggaugauuaccggag

SEQ ID NO: 650745 - RNA, 23 nt, Escherichia coli CFT073
ucuucacgacccggcguuuucag

SEQ ID NO: 650746 - RNA, 23 nt, Escherichia coli CFT073
ucuucacugaauaccguaaaacu

SEQ ID NO: 650747 - RNA, 18 nt, Escherichia coli CFT073
ucuucacccguugaucuu

SEQ ID NO: 650748 - RNA, 12 nt, Escherichia coli CFT073
ucuucacccuuu

SEQ ID NO: 650749 - RNA, 22 nt, Escherichia coli CFT073
ucuucaccguccauccacagag

SEQ ID NO: 650750 - RNA, 15 nt, Escherichia coli CFT073
ucuucacaucaucau

SEQ ID NO: 650751 - RNA, 19 nt, Escherichia coli CFT073
ucuucaccaaaugccugcu

SEQ ID NO: 650752 - RNA, 14 nt, Escherichia coli CFT073
ucuucacaucauca

SEQ ID NO: 650753 - RNA, 12 nt, Escherichia coli CFT073
ucuuccauucuc

SEQ ID NO: 650754 - RNA, 22 nt, Escherichia coli CFT073
ucuuccauugcuuugguaaaug

SEQ ID NO: 650755 - RNA, 23 nt, Escherichia coli CFT073
ucuuccaguuucgccaguuuuuc

SEQ ID NO: 650756 - RNA, 17 nt, Escherichia coli CFT073
ucuuccagcucuuccga

SEQ ID NO: 650757 - RNA, 13 nt, Escherichia coli CFT073
ucuuccagcggca

SEQ ID NO: 650758 - RNA, 19 nt, Escherichia coli CFT073
ucuuccagcgucuccagac

SEQ ID NO: 650759 - RNA, 11 nt, Escherichia coli CFT073
ucuucccagcc

SEQ ID NO: 650760 - RNA, 15 nt, Escherichia coli CFT073
ucuuccgggcaacaa

SEQ ID NO: 650761 - RNA, 20 nt, Escherichia coli CFT073
ucuuccgggcaacaaucgcu

SEQ ID NO: 650762 - RNA, 16 nt, Escherichia coli CFT073
ucuuccggcagcaaau

SEQ ID NO: 650763 - RNA, 22 nt, Escherichia coli CFT073
ucuucgcguuacggaucagagu

SEQ ID NO: 650764 - RNA, 19 nt, Escherichia coli CFT073
ucuuccugccagcacuuug

SEQ ID NO: 650765 - RNA, 14 nt, Escherichia coli CFT073
ucuuccgucaaggu

SEQ ID NO: 650766 - RNA, 15 nt, Escherichia coli CFT073
ucuuccgugccugac

SEQ ID NO: 650767 - RNA, 17 nt, Escherichia coli CFT073
ucuguuaugguacuuuc

SEQ ID NO: 650768 - RNA, 14 nt, Escherichia coli CFT073
ucuguugauaaaac

SEQ ID NO: 650769 - RNA, 19 nt, Escherichia coli CFT073
ucuguugccagcaguucaa

SEQ ID NO: 650770 - RNA, 13 nt, Escherichia coli CFT073
ucuguucaugcaa

SEQ ID NO: 650771 - RNA, 20 nt, Escherichia coli CFT073
ucuguugugaaguucaugca

SEQ ID NO: 650772 - RNA, 14 nt, Escherichia coli CFT073
ucuguugugccaca

SEQ ID NO: 650773 - RNA, 13 nt, Escherichia coli CFT073
ucuuacauucugu

SEQ ID NO: 650774 - RNA, 14 nt, Escherichia coli CFT073
ucuuacauucuguc

SEQ ID NO: 650775 - RNA, 18 nt, Escherichia coli CFT073
ucuuaccaccuuccucuu

SEQ ID NO: 650776 - RNA, 16 nt, Escherichia coli CFT073
ucuuaccuaccugcuc

SEQ ID NO: 650777 - RNA, 18 nt, Escherichia coli CFT073
ucuuacgcuuaagaucaa

SEQ ID NO: 650778 - RNA, 21 nt, Escherichia coli CFT073
ucuuacuauauaaaccuucug

SEQ ID NO: 650779 - RNA, 17 nt, Escherichia coli CFT073
ucuucaacuucagcagc

SEQ ID NO: 650780 - RNA, 22 nt, Escherichia coli CFT073
ucuucaaggcagagucaucucu

SEQ ID NO: 650781 - RNA, 12 nt, Escherichia coli CFT073
ucuuauccgacc

SEQ ID NO: 650782 - RNA, 13 nt, Escherichia coli CFT073
ucuuauccggccu

SEQ ID NO: 650783 - RNA, 17 nt, Escherichia coli CFT073
ucuuaucuaacaaucuu

SEQ ID NO: 650784 - RNA, 22 nt, Escherichia coli CFT073
ucuucaaccgcagugauuucaa

SEQ ID NO: 650785 - RNA, 10 nt, Escherichia coli CFT073
ucuuaucagg

SEQ ID NO: 650786 - RNA, 13 nt, Escherichia coli CFT073
ucuuaucaggccu

SEQ ID NO: 650787 - RNA, 17 nt, Escherichia coli CFT073
ucuuaucaggccuacaa

SEQ ID NO: 650788 - RNA, 14 nt, Escherichia coli CFT073
ucuuauauuucauu

SEQ ID NO: 650789 - RNA, 21 nt, Escherichia coli CFT073
ucucuggcuguuucgcuucuu

SEQ ID NO: 650790 - RNA, 16 nt, Escherichia coli CFT073
ucucugguacgccugc

SEQ ID NO: 650791 - RNA, 20 nt, Escherichia coli CFT073
ucucugcaaauuaugccuga

SEQ ID NO: 650792 - RNA, 20 nt, Escherichia coli CFT073
ucucugauacucaacucaca

SEQ ID NO: 650793 - RNA, 16 nt, Escherichia coli CFT073
ucucguuuaaaugccg

SEQ ID NO: 650794 - RNA, 16 nt, Escherichia coli CFT073
ucucguuucaguuuua

SEQ ID NO: 650795 - RNA, 13 nt, Escherichia coli CFT073
ucucgugccgcca

SEQ ID NO: 650796 - RNA, 19 nt, Escherichia coli CFT073
ucucgugaaauucacgcag

SEQ ID NO: 650797 - RNA, 20 nt, Escherichia coli CFT073
ucucgcugaucuuauugguu

SEQ ID NO: 650798 - RNA, 20 nt, Escherichia coli CFT073
ucucuauuacccuauuuaaa

SEQ ID NO: 650799 - RNA, 22 nt, Escherichia coli CFT073
ucucuaacaaccucauaccaua

SEQ ID NO: 650800 - RNA, 20 nt, Escherichia coli CFT073
ucucguuggguugccagcga

SEQ ID NO: 650801 - RNA, 15 nt, Escherichia coli CFT073
ucugaccauaaguag

SEQ ID NO: 650802 - RNA, 15 nt, Escherichia coli CFT073
ucugacgaugguguu

SEQ ID NO: 650803 - RNA, 19 nt, Escherichia coli CFT073
ucugacgcgcauacucucc

SEQ ID NO: 650804 - RNA, 21 nt, Escherichia coli CFT073
ucugacgcguaccuaacaguu

SEQ ID NO: 650805 - RNA, 16 nt, Escherichia coli CFT073
ucugaccagccagcau

SEQ ID NO: 650806 - RNA, 19 nt, Escherichia coli CFT073
ucugaaagcagacuuuuug

SEQ ID NO: 650807 - RNA, 18 nt, Escherichia coli CFT073
ucugacacugccacuuuu

SEQ ID NO: 650808 - RNA, 14 nt, Escherichia coli CFT073
ucugaaaccaccau

SEQ ID NO: 650809 - RNA, 18 nt, Escherichia coli CFT073
ucucuuuauaaaguaaaa

SEQ ID NO: 650810 - RNA, 13 nt, Escherichia coli CFT073
ucucuuuauguaa

SEQ ID NO: 650811 - RNA, 23 nt, Escherichia coli CFT073
ucucuuuauguaauaaaccugcu

SEQ ID NO: 650812 - RNA, 13 nt, Escherichia coli CFT073
ucucuuuauuuga

SEQ ID NO: 650813 - RNA, 14 nt, Escherichia coli CFT073
ucucuuuauuugau

SEQ ID NO: 650814 - RNA, 15 nt, Escherichia coli CFT073
ucucuuucaccagcg

SEQ ID NO: 650815 - RNA, 17 nt, Escherichia coli CFT073
ucucuuucacuccauug

SEQ ID NO: 650816 - RNA, 21 nt, Escherichia coli CFT073
ucucuuuccauucuuucccag

SEQ ID NO: 650817 - RNA, 12 nt, Escherichia coli CFT073
ucugcagcuuua

SEQ ID NO: 650818 - RNA, 17 nt, Escherichia coli CFT073
ucugcaagucuugcugc

SEQ ID NO: 650819 - RNA, 19 nt, Escherichia coli CFT073
ucugcaccuuuaaccccag

SEQ ID NO: 650820 - RNA, 14 nt, Escherichia coli CFT073
ucugcaauuugugc

SEQ ID NO: 650821 - RNA, 16 nt, Escherichia coli CFT073
ucugcaccagaacucc

SEQ ID NO: 650822 - RNA, 16 nt, Escherichia coli CFT073
ucugcaaccagaaagu

SEQ ID NO: 650823 - RNA, 17 nt, Escherichia coli CFT073
ucugcaaccagaaaguc

SEQ ID NO: 650824 - RNA, 12 nt, Escherichia coli CFT073
ucugcaaggcga

SEQ ID NO: 650825 - RNA, 12 nt, Escherichia coli CFT073
ucuccuccaggu

SEQ ID NO: 650826 - RNA, 21 nt, Escherichia coli CFT073
ucuccgugggcuaacacugcc

SEQ ID NO: 650827 - RNA, 20 nt, Escherichia coli CFT073
ucuccgggggcgauuucaga

SEQ ID NO: 650828 - RNA, 21 nt, Escherichia coli CFT073
ucuccggugguuaacgcugcc

SEQ ID NO: 650829 - RNA, 19 nt, Escherichia coli CFT073
ucuccgcggucagcgcaau

SEQ ID NO: 650830 - RNA, 20 nt, Escherichia coli CFT073
ucuccggcgcauccaugaua

SEQ ID NO: 650831 - RNA, 23 nt, Escherichia coli CFT073
ucuccuguugugaugcaacuguu

SEQ ID NO: 650832 - RNA, 17 nt, Escherichia coli CFT073
ucuccuguucucacuaa

SEQ ID NO: 650833 - RNA, 17 nt, Escherichia coli CFT073
ucuccuguugugaugca

SEQ ID NO: 650834 - RNA, 18 nt, Escherichia coli CFT073
ucuccuguugugaugcaa

SEQ ID NO: 650835 - RNA, 12 nt, Escherichia coli CFT073
ucuccugcgcac

SEQ ID NO: 650836 - RNA, 20 nt, Escherichia coli CFT073
ucuccugcggcgacaaaugu

SEQ ID NO: 650837 - RNA, 23 nt, Escherichia coli CFT073
ucucgaaaaaccugacgcugcuc

SEQ ID NO: 650838 - RNA, 18 nt, Escherichia coli CFT073
ucucgacagccucuucca

SEQ ID NO: 650839 - RNA, 21 nt, Escherichia coli CFT073
ucucgcgguucaguucgcuua

SEQ ID NO: 650840 - RNA, 16 nt, Escherichia coli CFT073
ucucgcccgucuucca

SEQ ID NO: 650841 - RNA, 13 nt, Escherichia coli CFT073
ucucgccagcacu

SEQ ID NO: 650842 - RNA, 19 nt, Escherichia coli CFT073
ucucgccaguguucuuccg

SEQ ID NO: 650843 - RNA, 20 nt, Escherichia coli CFT073
ucucgcacguuggcagugcc

SEQ ID NO: 650844 - RNA, 20 nt, Escherichia coli CFT073
ucuccgagcauuuucagcgu

SEQ ID NO: 650845 - RNA, 13 nt, Escherichia coli CFT073
ucucccaguaagc

SEQ ID NO: 650846 - RNA, 12 nt, Escherichia coli CFT073
ucuccccggagg

SEQ ID NO: 650847 - RNA, 13 nt, Escherichia coli CFT073
ucuccauuucaau

SEQ ID NO: 650848 - RNA, 15 nt, Escherichia coli CFT073
ucuccauuucauuga

SEQ ID NO: 650849 - RNA, 19 nt, Escherichia coli CFT073
ucuccauuaccgcauuauc

SEQ ID NO: 650850 - RNA, 12 nt, Escherichia coli CFT073
ucuccaguuccc

SEQ ID NO: 650851 - RNA, 17 nt, Escherichia coli CFT073
ucuccaguuucgagaaa

SEQ ID NO: 650852 - RNA, 10 nt, Escherichia coli CFT073
ucuccacacg

SEQ ID NO: 650853 - RNA, 21 nt, Escherichia coli CFT073
ucuccacgcaggcguuucacu

SEQ ID NO: 650854 - RNA, 15 nt, Escherichia coli CFT073
ucuccaaccagcugu

SEQ ID NO: 650855 - RNA, 17 nt, Escherichia coli CFT073
ucuccaaccagcuguuc

SEQ ID NO: 650856 - RNA, 17 nt, Escherichia coli CFT073
ucuccagaugacuggcu

SEQ ID NO: 650857 - RNA, 23 nt, Escherichia coli CFT073
ucuccagaugacuggcuaacccu

SEQ ID NO: 650858 - RNA, 22 nt, Escherichia coli CFT073
ucuccagcguugacgcuuuacu

SEQ ID NO: 650859 - RNA, 19 nt, Escherichia coli CFT073
ucucauuuugauuaauauu

SEQ ID NO: 650860 - RNA, 12 nt, Escherichia coli CFT073
ucucauuuuuca

SEQ ID NO: 650861 - RNA, 13 nt, Escherichia coli CFT073
ucucauuuuucag

SEQ ID NO: 650862 - RNA, 21 nt, Escherichia coli CFT073
ucucauuucggcccacaacga

SEQ ID NO: 650863 - RNA, 15 nt, Escherichia coli CFT073
ucguucgccagcucc

SEQ ID NO: 650864 - RNA, 22 nt, Escherichia coli CFT073
ucguucauaccacgccaucaac

SEQ ID NO: 650865 - RNA, 19 nt, Escherichia coli CFT073
ucguucccaccucgugcac

SEQ ID NO: 650866 - RNA, 19 nt, Escherichia coli CFT073
ucguuaucggaaaagagua

SEQ ID NO: 650867 - RNA, 17 nt, Escherichia coli CFT073
ucguucaacaagccacg

SEQ ID NO: 650868 - RNA, 13 nt, Escherichia coli CFT073
ucguucacaaaca

SEQ ID NO: 650869 - RNA, 22 nt, Escherichia coli CFT073
ucguuaccacuuuggugaaugc

SEQ ID NO: 650870 - RNA, 16 nt, Escherichia coli CFT073
ucguuaccguguaguc

SEQ ID NO: 650871 - RNA, 14 nt, Escherichia coli CFT073
ucguuaguaaccac

SEQ ID NO: 650872 - RNA, 20 nt, Escherichia coli CFT073
ucguuaaggccgcuuucaga

SEQ ID NO: 650873 - RNA, 17 nt, Escherichia coli CFT073
ucguuaacaaauacgcu

SEQ ID NO: 650874 - RNA, 19 nt, Escherichia coli CFT073
ucguuaacaacaacuucua

SEQ ID NO: 650875 - RNA, 16 nt, Escherichia coli CFT073
ucguugaaaaaauuuu

SEQ ID NO: 650876 - RNA, 19 nt, Escherichia coli CFT073
ucguugauaauaaagcuac

SEQ ID NO: 650877 - RNA, 16 nt, Escherichia coli CFT073
ucguugauaccgugcg

SEQ ID NO: 650878 - RNA, 15 nt, Escherichia coli CFT073
ucguuguaacugucu

SEQ ID NO: 650879 - RNA, 20 nt, Escherichia coli CFT073
ucguugguacgaucagaguu

SEQ ID NO: 650880 - RNA, 22 nt, Escherichia coli CFT073
ucguuucgcccguucuuccuca

SEQ ID NO: 650881 - RNA, 20 nt, Escherichia coli CFT073
ucgugccgcuacugcuugcc

SEQ ID NO: 650882 - RNA, 17 nt, Escherichia coli CFT073
ucgugcgguaucaccac

SEQ ID NO: 650883 - RNA, 20 nt, Escherichia coli CFT073
ucgugcggguaaccagccaa

SEQ ID NO: 650884 - RNA, 13 nt, Escherichia coli CFT073
ucgugauuaaacu

SEQ ID NO: 650885 - RNA, 21 nt, Escherichia coli CFT073
ucgugcaccaauugccggaug

SEQ ID NO: 650886 - RNA, 10 nt, Escherichia coli CFT073
ucgugcagaa

SEQ ID NO: 650887 - RNA, 13 nt, Escherichia coli CFT073
ucgugguugguaa

SEQ ID NO: 650888 - RNA, 21 nt, Escherichia coli CFT073
ucguggaaaccgagauaaaug

SEQ ID NO: 650889 - RNA, 21 nt, Escherichia coli CFT073
ucguggcaaucguaacccaac

SEQ ID NO: 650890 - RNA, 16 nt, Escherichia coli CFT073
ucgucuuuauccuggc

SEQ ID NO: 650891 - RNA, 16 nt, Escherichia coli CFT073
ucgugaugcccugaug

SEQ ID NO: 650892 - RNA, 20 nt, Escherichia coli CFT073
ucgugauaaguaaucauaau

SEQ ID NO: 650893 - RNA, 16 nt, Escherichia coli CFT073
ucgucguacugaccgu

SEQ ID NO: 650894 - RNA, 14 nt, Escherichia coli CFT073
ucgucgguuuucuu

SEQ ID NO: 650895 - RNA, 18 nt, Escherichia coli CFT073
ucgucgguguccacuucc

SEQ ID NO: 650896 - RNA, 13 nt, Escherichia coli CFT073
ucguaacaggaaa

SEQ ID NO: 650897 - RNA, 22 nt, Escherichia coli CFT073
ucguaacggcauuguucugcaa

SEQ ID NO: 650898 - RNA, 23 nt, Escherichia coli CFT073
ucguaacggcauuguucugcaaa

SEQ ID NO: 650899 - RNA, 16 nt, Escherichia coli CFT073
ucguaacggccaggcg

SEQ ID NO: 650900 - RNA, 18 nt, Escherichia coli CFT073
ucguaagccgugaaaaca

SEQ ID NO: 650901 - RNA, 17 nt, Escherichia coli CFT073
ucguaagcgagaacugc

SEQ ID NO: 650902 - RNA, 19 nt, Escherichia coli CFT073
ucguaagcgagaacugccu

SEQ ID NO: 650903 - RNA, 16 nt, Escherichia coli CFT073
ucguaaucucuuucca

SEQ ID NO: 650904 - RNA, 18 nt, Escherichia coli CFT073
ucguaaucucuuuccauu

SEQ ID NO: 650905 - RNA, 16 nt, Escherichia coli CFT073
ucguaaugaaucagca

SEQ ID NO: 650906 - RNA, 23 nt, Escherichia coli CFT073
ucguaccagugcagcgcaugauu

SEQ ID NO: 650907 - RNA, 14 nt, Escherichia coli CFT073
ucguacacccgcca

SEQ ID NO: 650908 - RNA, 14 nt, Escherichia coli CFT073
ucguagccaccauc

SEQ ID NO: 650909 - RNA, 15 nt, Escherichia coli CFT073
ucguauacugcagcg

SEQ ID NO: 650910 - RNA, 22 nt, Escherichia coli CFT073
ucguauccagcguuauaaaaca

SEQ ID NO: 650911 - RNA, 14 nt, Escherichia coli CFT073
ucguaggccugaua

SEQ ID NO: 650912 - RNA, 17 nt, Escherichia coli CFT073
ucguagcguuuuuucau

SEQ ID NO: 650913 - RNA, 13 nt, Escherichia coli CFT073
ucguauuuaaaac

SEQ ID NO: 650914 - RNA, 15 nt, Escherichia coli CFT073
ucguauuuaaaaccg

SEQ ID NO: 650915 - RNA, 17 nt, Escherichia coli CFT073
ucgucaaaauucauaaa

SEQ ID NO: 650916 - RNA, 14 nt, Escherichia coli CFT073
ucgucaaagauauu

SEQ ID NO: 650917 - RNA, 17 nt, Escherichia coli CFT073
ucgucccaauggauauc

SEQ ID NO: 650918 - RNA, 17 nt, Escherichia coli CFT073
ucguccggacuggcauu

SEQ ID NO: 650919 - RNA, 19 nt, Escherichia coli CFT073
ucguccagauguucuucaa

SEQ ID NO: 650920 - RNA, 20 nt, Escherichia coli CFT073
ucguccagauguucuucaau

SEQ ID NO: 650921 - RNA, 13 nt, Escherichia coli CFT073
ucguccagcauca

SEQ ID NO: 650922 - RNA, 14 nt, Escherichia coli CFT073
ucguccagcugccu

SEQ ID NO: 650923 - RNA, 19 nt, Escherichia coli CFT073
ucgucaggaucagccauuu

SEQ ID NO: 650924 - RNA, 20 nt, Escherichia coli CFT073
ucgucaguucggcaucaucg

SEQ ID NO: 650925 - RNA, 14 nt, Escherichia coli CFT073
ucgucauaucauca

SEQ ID NO: 650926 - RNA, 15 nt, Escherichia coli CFT073
ucgucaucccagucc

SEQ ID NO: 650927 - RNA, 19 nt, Escherichia coli CFT073
ucgucaggggcauuuucca

SEQ ID NO: 650928 - RNA, 19 nt, Escherichia coli CFT073
ucgucaguagcgcaauaac

SEQ ID NO: 650929 - RNA, 15 nt, Escherichia coli CFT073
ucgucgcgcacgccc

SEQ ID NO: 650930 - RNA, 14 nt, Escherichia coli CFT073
ucguccuucacauu

SEQ ID NO: 650931 - RNA, 22 nt, Escherichia coli CFT073
ucguccggcuggguagcuuccu

SEQ ID NO: 650932 - RNA, 14 nt, Escherichia coli CFT073
ucgucgccaaugcg

SEQ ID NO: 650933 - RNA, 12 nt, Escherichia coli CFT073
ucggccaugggc

SEQ ID NO: 650934 - RNA, 20 nt, Escherichia coli CFT073
ucggccaugugcuuuuccuc

SEQ ID NO: 650935 - RNA, 22 nt, Escherichia coli CFT073
ucggccaguauuugucugccac

SEQ ID NO: 650936 - RNA, 18 nt, Escherichia coli CFT073
ucggcgaaacaauccagc

SEQ ID NO: 650937 - RNA, 22 nt, Escherichia coli CFT073
ucggcuucuaccuuauccagca

SEQ ID NO: 650938 - RNA, 18 nt, Escherichia coli CFT073
ucggcuugaguucauaua

SEQ ID NO: 650939 - RNA, 22 nt, Escherichia coli CFT073
ucggcgcuacggcguuucacuu

SEQ ID NO: 650940 - RNA, 15 nt, Escherichia coli CFT073
ucggcgcugaccacu

SEQ ID NO: 650941 - RNA, 18 nt, Escherichia coli CFT073
ucggcgggcaauacaccu

SEQ ID NO: 650942 - RNA, 18 nt, Escherichia coli CFT073
ucggcguaguuaacuggu

SEQ ID NO: 650943 - RNA, 20 nt, Escherichia coli CFT073
ucggcggugacuagcagcau

SEQ ID NO: 650944 - RNA, 15 nt, Escherichia coli CFT073
ucggugaccauccau

SEQ ID NO: 650945 - RNA, 19 nt, Escherichia coli CFT073
ucggucacugacaccagca

SEQ ID NO: 650946 - RNA, 13 nt, Escherichia coli CFT073
ucggucaccagga

SEQ ID NO: 650947 - RNA, 17 nt, Escherichia coli CFT073
ucggucagcguaaugga

SEQ ID NO: 650948 - RNA, 17 nt, Escherichia coli CFT073
ucgguguagacagcauc

SEQ ID NO: 650949 - RNA, 18 nt, Escherichia coli CFT073
ucgguuaacagcgcacca

SEQ ID NO: 650950 - RNA, 13 nt, Escherichia coli CFT073
ucgguuaacggca

SEQ ID NO: 650951 - RNA, 19 nt, Escherichia coli CFT073
ucgguuaccaguacaccaa

SEQ ID NO: 650952 - RNA, 17 nt, Escherichia coli CFT073
ucgguguauuucgaaug

SEQ ID NO: 650953 - RNA, 14 nt, Escherichia coli CFT073
ucgguguccacuuc

SEQ ID NO: 650954 - RNA, 16 nt, Escherichia coli CFT073
ucgguggaaaauagca

SEQ ID NO: 650955 - RNA, 15 nt, Escherichia coli CFT073
ucgggcagcuaacag

SEQ ID NO: 650956 - RNA, 16 nt, Escherichia coli CFT073
ucggggcaaguuucgu

SEQ ID NO: 650957 - RNA, 20 nt, Escherichia coli CFT073
ucgggcuaauuuccuggacu

SEQ ID NO: 650958 - RNA, 21 nt, Escherichia coli CFT073
ucgggcaggcuucaacacagg

SEQ ID NO: 650959 - RNA, 14 nt, Escherichia coli CFT073
ucgggcaucagaag

SEQ ID NO: 650960 - RNA, 20 nt, Escherichia coli CFT073
ucgggcaauggcuccgggug

SEQ ID NO: 650961 - RNA, 19 nt, Escherichia coli CFT073
ucggguaaauaauaucccc

SEQ ID NO: 650962 - RNA, 19 nt, Escherichia coli CFT073
ucgggggagacgggcggag

SEQ ID NO: 650963 - RNA, 23 nt, Escherichia coli CFT073
ucggguuuacgcgcgcaggcaac

SEQ ID NO: 650964 - RNA, 15 nt, Escherichia coli CFT073
ucgguagcaccaguu

SEQ ID NO: 650965 - RNA, 17 nt, Escherichia coli CFT073
ucgguacguacaaugga

SEQ ID NO: 650966 - RNA, 14 nt, Escherichia coli CFT073
ucggauguuagucu

SEQ ID NO: 650967 - RNA, 21 nt, Escherichia coli CFT073
ucggaugacccagcgccagca

SEQ ID NO: 650968 - RNA, 17 nt, Escherichia coli CFT073
ucggaucgcgugcggca

SEQ ID NO: 650969 - RNA, 21 nt, Escherichia coli CFT073
ucggauaagacgcgccagcgu

SEQ ID NO: 650970 - RNA, 13 nt, Escherichia coli CFT073
ucggauaaggcgu

SEQ ID NO: 650971 - RNA, 17 nt, Escherichia coli CFT073
ucggauaaggcguucac

SEQ ID NO: 650972 - RNA, 14 nt, Escherichia coli CFT073
ucggauaaggcuuc

SEQ ID NO: 650973 - RNA, 16 nt, Escherichia coli CFT073
ucggcaauuucagugc

SEQ ID NO: 650974 - RNA, 14 nt, Escherichia coli CFT073
ucggcaaucacaac

SEQ ID NO: 650975 - RNA, 17 nt, Escherichia coli CFT073
ucggcaacgccagcgaa

SEQ ID NO: 650976 - RNA, 18 nt, Escherichia coli CFT073
ucggcaacaccucagcca

SEQ ID NO: 650977 - RNA, 14 nt, Escherichia coli CFT073
ucggcaaaaauaau

SEQ ID NO: 650978 - RNA, 14 nt, Escherichia coli CFT073
ucggcaaagcgcug

SEQ ID NO: 650979 - RNA, 19 nt, Escherichia coli CFT073
ucggcaaagcgcugaagaa

SEQ ID NO: 650980 - RNA, 15 nt, Escherichia coli CFT073
ucggcauauuuaaaa

SEQ ID NO: 650981 - RNA, 15 nt, Escherichia coli CFT073
ucggcaguaaugguu

SEQ ID NO: 650982 - RNA, 17 nt, Escherichia coli CFT073
ucggcagcgccaaucgc

SEQ ID NO: 650983 - RNA, 15 nt, Escherichia coli CFT073
ucggcaggaaaauag

SEQ ID NO: 650984 - RNA, 12 nt, Escherichia coli CFT073
ucggcaccgccg

SEQ ID NO: 650985 - RNA, 18 nt, Escherichia coli CFT073
ucggcaccgccgccaaag

SEQ ID NO: 650986 - RNA, 22 nt, Escherichia coli CFT073
ucggcacccaucgccagcacuu

SEQ ID NO: 650987 - RNA, 19 nt, Escherichia coli CFT073
ucggaaaacaaccgccaug

SEQ ID NO: 650988 - RNA, 22 nt, Escherichia coli CFT073
ucggaacaguaaagcgcaaaau

SEQ ID NO: 650989 - RNA, 19 nt, Escherichia coli CFT073
ucggacauguuuuccagca

SEQ ID NO: 650990 - RNA, 20 nt, Escherichia coli CFT073
ucggaaucagcaguucacag

SEQ ID NO: 650991 - RNA, 16 nt, Escherichia coli CFT073
ucggagguucgaaucc

SEQ ID NO: 650992 - RNA, 21 nt, Escherichia coli CFT073
ucggagaacugcaacucaccu

SEQ ID NO: 650993 - RNA, 17 nt, Escherichia coli CFT073
ucgcuuuuauuucugcu

SEQ ID NO: 650994 - RNA, 17 nt, Escherichia coli CFT073
ucgcuuuuaugccuggc

SEQ ID NO: 650995 - RNA, 12 nt, Escherichia coli CFT073
ucgcuuucucuu

SEQ ID NO: 650996 - RNA, 19 nt, Escherichia coli CFT073
ucgcuuugacagcuuuuac

SEQ ID NO: 650997 - RNA, 20 nt, Escherichia coli CFT073
ucgcuuugccaguaauaacc

SEQ ID NO: 650998 - RNA, 16 nt, Escherichia coli CFT073
ucgcuuugugcucuuc

SEQ ID NO: 650999 - RNA, 20 nt, Escherichia coli CFT073
ucgcuuuuucugcaucaacc

SEQ ID NO: 651000 - RNA, 21 nt, Escherichia coli CFT073
ucgcuuuccagucguuaugca

SEQ ID NO: 651001 - RNA, 18 nt, Escherichia coli CFT073
ucgcuuucgcuuucucuu

SEQ ID NO: 651002 - RNA, 16 nt, Escherichia coli CFT073
ucgcuuuaaacggcug

SEQ ID NO: 651003 - RNA, 18 nt, Escherichia coli CFT073
ucgcuucaauacgcucca

SEQ ID NO: 651004 - RNA, 18 nt, Escherichia coli CFT073
ucgcuugcaggaucagcu

SEQ ID NO: 651005 - RNA, 21 nt, Escherichia coli CFT073
ucgcuucacgcagguuuugcu

SEQ ID NO: 651006 - RNA, 17 nt, Escherichia coli CFT073
ucgcuuaucaggcauug

SEQ ID NO: 651007 - RNA, 17 nt, Escherichia coli CFT073
ucgcuuagagcccaugc

SEQ ID NO: 651008 - RNA, 16 nt, Escherichia coli CFT073
ucgcuuccuccaccac

SEQ ID NO: 651009 - RNA, 18 nt, Escherichia coli CFT073
ucgcuuccuccaccacuu

SEQ ID NO: 651010 - RNA, 23 nt, Escherichia coli CFT073
ucgcuucgauucccagcuuuuaa

SEQ ID NO: 651011 - RNA, 20 nt, Escherichia coli CFT073
ucgcuguucaucuggcggua

SEQ ID NO: 651012 - RNA, 20 nt, Escherichia coli CFT073
ucgcuuaauggaaaacuguu

SEQ ID NO: 651013 - RNA, 21 nt, Escherichia coli CFT073
ucgcuuaauggaaaacuguuu

SEQ ID NO: 651014 - RNA, 14 nt, Escherichia coli CFT073
ucgcugucuuucaa

SEQ ID NO: 651015 - RNA, 18 nt, Escherichia coli CFT073
ucgcugugacauccagau

SEQ ID NO: 651016 - RNA, 15 nt, Escherichia coli CFT073
ucgcugugcugcuga

SEQ ID NO: 651017 - RNA, 12 nt, Escherichia coli CFT073
ucgcuggcagac

SEQ ID NO: 651018 - RNA, 13 nt, Escherichia coli CFT073
ucgcuggcaggcc

SEQ ID NO: 651019 - RNA, 18 nt, Escherichia coli CFT073
ucgcuggaggcaucugau

SEQ ID NO: 651020 - RNA, 14 nt, Escherichia coli CFT073
ucgcuguaauucuu

SEQ ID NO: 651021 - RNA, 16 nt, Escherichia coli CFT073
ucgcuguacucaccaa

SEQ ID NO: 651022 - RNA, 19 nt, Escherichia coli CFT073
ucgcugcucacaccaugcc

SEQ ID NO: 651023 - RNA, 22 nt, Escherichia coli CFT073
ucgcugcuaauuuaucggcguu

SEQ ID NO: 651024 - RNA, 20 nt, Escherichia coli CFT073
ucgcugauauacccuucauc

SEQ ID NO: 651025 - RNA, 19 nt, Escherichia coli CFT073
ucgcugauauugcuccaga

SEQ ID NO: 651026 - RNA, 17 nt, Escherichia coli CFT073
ucgcugauucgcuucaa

SEQ ID NO: 651027 - RNA, 11 nt, Escherichia coli CFT073
ucgcugccaca

SEQ ID NO: 651028 - RNA, 17 nt, Escherichia coli CFT073
ucgcucucuuucucgcu

SEQ ID NO: 651029 - RNA, 21 nt, Escherichia coli CFT073
ucgcugaacgggccauccauc

SEQ ID NO: 651030 - RNA, 18 nt, Escherichia coli CFT073
ucgcugaauaucuaauua

SEQ ID NO: 651031 - RNA, 17 nt, Escherichia coli CFT073
ucgcugacaucaacaau

SEQ ID NO: 651032 - RNA, 13 nt, Escherichia coli CFT073
ucgcugacaugug

SEQ ID NO: 651033 - RNA, 15 nt, Escherichia coli CFT073
ucgcugacauuaccu

SEQ ID NO: 651034 - RNA, 17 nt, Escherichia coli CFT073
ucgcucaauauccugac

SEQ ID NO: 651035 - RNA, 22 nt, Escherichia coli CFT073
ucgcucgagagagaaaauaauc

SEQ ID NO: 651036 - RNA, 16 nt, Escherichia coli CFT073
ucgcucaucugcugcg

SEQ ID NO: 651037 - RNA, 13 nt, Escherichia coli CFT073
ucgcuccggcacg

SEQ ID NO: 651038 - RNA, 19 nt, Escherichia coli CFT073
ucgcguuucuccacuggca

SEQ ID NO: 651039 - RNA, 20 nt, Escherichia coli CFT073
ucgcuacaccaaucgucaau

SEQ ID NO: 651040 - RNA, 23 nt, Escherichia coli CFT073
ucgcuauagacaccuugcaacuc

SEQ ID NO: 651041 - RNA, 16 nt, Escherichia coli CFT073
ucgcuacgccuuccgu

SEQ ID NO: 651042 - RNA, 15 nt, Escherichia coli CFT073
ucgcuagaagcuccg

SEQ ID NO: 651043 - RNA, 16 nt, Escherichia coli CFT073
ucgcuaucagcgccac

SEQ ID NO: 651044 - RNA, 16 nt, Escherichia coli CFT073
ucgcgguuagcggcuu

SEQ ID NO: 651045 - RNA, 17 nt, Escherichia coli CFT073
ucgcguugucauacgag

SEQ ID NO: 651046 - RNA, 14 nt, Escherichia coli CFT073
ucgcguucggaaau

SEQ ID NO: 651047 - RNA, 14 nt, Escherichia coli CFT073
ucgcgucuggcauu

SEQ ID NO: 651048 - RNA, 21 nt, Escherichia coli CFT073
ucgcgucaucgucacaacauu

SEQ ID NO: 651049 - RNA, 17 nt, Escherichia coli CFT073
ucgcggguaaugucucg

SEQ ID NO: 651050 - RNA, 18 nt, Escherichia coli CFT073
ucgcgguaaauugugucg

SEQ ID NO: 651051 - RNA, 18 nt, Escherichia coli CFT073
ucgcggcuauucaccacu

SEQ ID NO: 651052 - RNA, 22 nt, Escherichia coli CFT073
ucgcggcgauauccagcgcggc

SEQ ID NO: 651053 - RNA, 18 nt, Escherichia coli CFT073
ucgcggacuucuggcaga

SEQ ID NO: 651054 - RNA, 21 nt, Escherichia coli CFT073
ucgcgcuuaucgccagcgcga

SEQ ID NO: 651055 - RNA, 13 nt, Escherichia coli CFT073
ucgcgcucaucag

SEQ ID NO: 651056 - RNA, 17 nt, Escherichia coli CFT073
ucgcgcgcgguggcgua

SEQ ID NO: 651057 - RNA, 12 nt, Escherichia coli CFT073
ucgcgcgcugcc

SEQ ID NO: 651058 - RNA, 13 nt, Escherichia coli CFT073
ucgccagaaauca

SEQ ID NO: 651059 - RNA, 17 nt, Escherichia coli CFT073
ucgccagacagugucug

SEQ ID NO: 651060 - RNA, 16 nt, Escherichia coli CFT073
ucgccacugcgccacg

SEQ ID NO: 651061 - RNA, 19 nt, Escherichia coli CFT073
ucgccacgccaagaaacug

SEQ ID NO: 651062 - RNA, 16 nt, Escherichia coli CFT073
ucgccacggcaugaaa

SEQ ID NO: 651063 - RNA, 19 nt, Escherichia coli CFT073
ucgccacggcaugaaagcg

SEQ ID NO: 651064 - RNA, 23 nt, Escherichia coli CFT073
ucgccaccgcuucgcucacauca

SEQ ID NO: 651065 - RNA, 15 nt, Escherichia coli CFT073
ucgccacauugcugc

SEQ ID NO: 651066 - RNA, 22 nt, Escherichia coli CFT073
ucgccacauugcugcacauccg

SEQ ID NO: 651067 - RNA, 15 nt, Escherichia coli CFT073
uccauacgaauugcc

SEQ ID NO: 651068 - RNA, 18 nt, Escherichia coli CFT073
uccauaccagcacauaac

SEQ ID NO: 651069 - RNA, 16 nt, Escherichia coli CFT073
ucgccaaucagaaagg

SEQ ID NO: 651070 - RNA, 23 nt, Escherichia coli CFT073
ucgccaaguucgaacgccgccag

SEQ ID NO: 651071 - RNA, 23 nt, Escherichia coli CFT073
ucgccaaauacuuuuuccagcag

SEQ ID NO: 651072 - RNA, 22 nt, Escherichia coli CFT073
ucgccaucuucggcgaaaauca

SEQ ID NO: 651073 - RNA, 23 nt, Escherichia coli CFT073
ucgccaucuucggcgaaaaucau

SEQ ID NO: 651074 - RNA, 17 nt, Escherichia coli CFT073
ucgccaugaacgcgaag

SEQ ID NO: 651075 - RNA, 15 nt, Escherichia coli CFT073
ucgccaucagccacu

SEQ ID NO: 651076 - RNA, 19 nt, Escherichia coli CFT073
ucgccaucagccacuucaa

SEQ ID NO: 651077 - RNA, 15 nt, Escherichia coli CFT073
ucgccaucagcgccu

SEQ ID NO: 651078 - RNA, 14 nt, Escherichia coli CFT073
ucgccaucagcgcu

SEQ ID NO: 651079 - RNA, 17 nt, Escherichia coli CFT073
ucgccaguguucuuccg

SEQ ID NO: 651080 - RNA, 15 nt, Escherichia coli CFT073
ucgccaucaaaggcu

SEQ ID NO: 651081 - RNA, 15 nt, Escherichia coli CFT073
ucgccaucaaaucac

SEQ ID NO: 651082 - RNA, 15 nt, Escherichia coli CFT073
ucgccaucacacccu

SEQ ID NO: 651083 - RNA, 15 nt, Escherichia coli CFT073
ucgccaguaauccac

SEQ ID NO: 651084 - RNA, 16 nt, Escherichia coli CFT073
ucgccauaaaacagca

SEQ ID NO: 651085 - RNA, 18 nt, Escherichia coli CFT073
ucgccauaaaacagcagu

SEQ ID NO: 651086 - RNA, 18 nt, Escherichia coli CFT073
ucgccauaaacaccagca

SEQ ID NO: 651087 - RNA, 15 nt, Escherichia coli CFT073
ucgccagcggcagcu

SEQ ID NO: 651088 - RNA, 12 nt, Escherichia coli CFT073
ucgccagcucaa

SEQ ID NO: 651089 - RNA, 13 nt, Escherichia coli CFT073
ucgccagcucaag

SEQ ID NO: 651090 - RNA, 17 nt, Escherichia coli CFT073
ucgccagcuccagcgcu

SEQ ID NO: 651091 - RNA, 20 nt, Escherichia coli CFT073
ucgccagacgcagcaaggcu

SEQ ID NO: 651092 - RNA, 21 nt, Escherichia coli CFT073
ucgccagacucaccagcaucg

SEQ ID NO: 651093 - RNA, 13 nt, Escherichia coli CFT073
ucgccagacucuu

SEQ ID NO: 651094 - RNA, 15 nt, Escherichia coli CFT073
ucgccagagucagca

SEQ ID NO: 651095 - RNA, 17 nt, Escherichia coli CFT073
ucgccagagucagcacg

SEQ ID NO: 651096 - RNA, 20 nt, Escherichia coli CFT073
ucgcccuucggcaucacgaa

SEQ ID NO: 651097 - RNA, 20 nt, Escherichia coli CFT073
ucgcccugaauuucaauaau

SEQ ID NO: 651098 - RNA, 17 nt, Escherichia coli CFT073
ucgcccucuuucaccag

SEQ ID NO: 651099 - RNA, 18 nt, Escherichia coli CFT073
ucgcccugccaaaucagu

SEQ ID NO: 651100 - RNA, 15 nt, Escherichia coli CFT073
ucgcccuuaccauuc

SEQ ID NO: 651101 - RNA, 21 nt, Escherichia coli CFT073
ucgcccugcuccagcagcuca

SEQ ID NO: 651102 - RNA, 16 nt, Escherichia coli CFT073
ucgccgacaaucucuu

SEQ ID NO: 651103 - RNA, 20 nt, Escherichia coli CFT073
ucgccgccagcgucugagca

SEQ ID NO: 651104 - RNA, 16 nt, Escherichia coli CFT073
ucgccgccaguuccag

SEQ ID NO: 651105 - RNA, 21 nt, Escherichia coli CFT073
ucgccgccgcauaucaucaag

SEQ ID NO: 651106 - RNA, 13 nt, Escherichia coli CFT073
ucgcccacaucau

SEQ ID NO: 651107 - RNA, 15 nt, Escherichia coli CFT073
ucgccauguuuggca

SEQ ID NO: 651108 - RNA, 15 nt, Escherichia coli CFT073
ucgccauuaaacaac

SEQ ID NO: 651109 - RNA, 23 nt, Escherichia coli CFT073
ucgccauuaacaacgucguuuuc

SEQ ID NO: 651110 - RNA, 14 nt, Escherichia coli CFT073
ucgcccagccaucg

SEQ ID NO: 651111 - RNA, 22 nt, Escherichia coli CFT073
ucgcccaguugaugaccagugc

SEQ ID NO: 651112 - RNA, 16 nt, Escherichia coli CFT073
ucgcccccggagaggg

SEQ ID NO: 651113 - RNA, 12 nt, Escherichia coli CFT073
ucgcccccucuc

SEQ ID NO: 651114 - RNA, 15 nt, Escherichia coli CFT073
ucgcccgcaaucagc

SEQ ID NO: 651115 - RNA, 22 nt, Escherichia coli CFT073
ucgcccgaccaucgccagcuca

SEQ ID NO: 651116 - RNA, 15 nt, Escherichia coli CFT073
ucgcccguucuuccu

SEQ ID NO: 651117 - RNA, 14 nt, Escherichia coli CFT073
ucgcccggauuaca

SEQ ID NO: 651118 - RNA, 13 nt, Escherichia coli CFT073
ucgccuccacgcg

SEQ ID NO: 651119 - RNA, 17 nt, Escherichia coli CFT073
ucgccucguugauguuc

SEQ ID NO: 651120 - RNA, 14 nt, Escherichia coli CFT073
ucgccucgccgaaa

SEQ ID NO: 651121 - RNA, 15 nt, Escherichia coli CFT073
ucgccgguuuuucaa

SEQ ID NO: 651122 - RNA, 15 nt, Escherichia coli CFT073
ucgccguaaacauca

SEQ ID NO: 651123 - RNA, 20 nt, Escherichia coli CFT073
ucgccguaaacaucauccag

SEQ ID NO: 651124 - RNA, 15 nt, Escherichia coli CFT073
ucgccguaauuaaca

SEQ ID NO: 651125 - RNA, 22 nt, Escherichia coli CFT073
ucgccgcgcaaauccacguucc

SEQ ID NO: 651126 - RNA, 19 nt, Escherichia coli CFT073
ucgccgcugcgaucgcaaa

SEQ ID NO: 651127 - RNA, 18 nt, Escherichia coli CFT073
ucgccgcugcgauuucag

SEQ ID NO: 651128 - RNA, 21 nt, Escherichia coli CFT073
ucgccgcggcgcagcuucaca

SEQ ID NO: 651129 - RNA, 23 nt, Escherichia coli CFT073
ucgccggaauuucuuucagcagu

SEQ ID NO: 651130 - RNA, 20 nt, Escherichia coli CFT073
ucgccggaugaaaagucauc

SEQ ID NO: 651131 - RNA, 23 nt, Escherichia coli CFT073
ucgccgggauauaugucaccagc

SEQ ID NO: 651132 - RNA, 13 nt, Escherichia coli CFT073
ucgcgcaccagcg

SEQ ID NO: 651133 - RNA, 24 nt, Escherichia coli CFT073
ucgcgcaauugccagacaacauga

SEQ ID NO: 651134 - RNA, 24 nt, Escherichia coli CFT073
ucgcgcacgaggaacagcgcgcug

SEQ ID NO: 651135 - RNA, 13 nt, Escherichia coli CFT073
ucgcgcagcacuu

SEQ ID NO: 651136 - RNA, 17 nt, Escherichia coli CFT073
ucgcgccaucaaaucug

SEQ ID NO: 651137 - RNA, 14 nt, Escherichia coli CFT073
ucgcgccagccagu

SEQ ID NO: 651138 - RNA, 16 nt, Escherichia coli CFT073
ucgcgccaaacucggu

SEQ ID NO: 651139 - RNA, 15 nt, Escherichia coli CFT073
ucgcgcaugcgccua

SEQ ID NO: 651140 - RNA, 16 nt, Escherichia coli CFT073
ucgcgcaguguaaacc

SEQ ID NO: 651141 - RNA, 12 nt, Escherichia coli CFT073
ucgccugcggcg

SEQ ID NO: 651142 - RNA, 19 nt, Escherichia coli CFT073
ucgccuuugauuuucaggu

SEQ ID NO: 651143 - RNA, 19 nt, Escherichia coli CFT073
ucgccuugcguaccggcgu

SEQ ID NO: 651144 - RNA, 16 nt, Escherichia coli CFT073
ucgcgaaucgccacaa

SEQ ID NO: 651145 - RNA, 14 nt, Escherichia coli CFT073
ucgcgaauucaugu

SEQ ID NO: 651146 - RNA, 18 nt, Escherichia coli CFT073
ucgcgacaucgcccggcg

SEQ ID NO: 651147 - RNA, 23 nt, Escherichia coli CFT073
ucgcgaccgccucacgccagcgu

SEQ ID NO: 651148 - RNA, 18 nt, Escherichia coli CFT073
ucgcgaccgccuucaguc

SEQ ID NO: 651149 - RNA, 18 nt, Escherichia coli CFT073
ucgcgacgaccacccacc

SEQ ID NO: 651150 - RNA, 15 nt, Escherichia coli CFT073
ucgcgauacgcuuca

SEQ ID NO: 651151 - RNA, 18 nt, Escherichia coli CFT073
ucgcgauacgcuucaacc

SEQ ID NO: 651152 - RNA, 19 nt, Escherichia coli CFT073
ugaauaauccccacaucag

SEQ ID NO: 651153 - RNA, 18 nt, Escherichia coli CFT073
ugaauaccaagucucaag

SEQ ID NO: 651154 - RNA, 21 nt, Escherichia coli CFT073
ugaaguucguccccaccagug

SEQ ID NO: 651155 - RNA, 11 nt, Escherichia coli CFT073
ugaaguucugg

SEQ ID NO: 651156 - RNA, 19 nt, Escherichia coli CFT073
ugaaguuacugacaucgcu

SEQ ID NO: 651157 - RNA, 20 nt, Escherichia coli CFT073
ugaaguaaagaaacugguug

SEQ ID NO: 651158 - RNA, 22 nt, Escherichia coli CFT073
ugaaguaacagagugaauggug

SEQ ID NO: 651159 - RNA, 19 nt, Escherichia coli CFT073
ugaagugugcaaacgauaa

SEQ ID NO: 651160 - RNA, 22 nt, Escherichia coli CFT073
ugaagugugcaaacgauaaaag

SEQ ID NO: 651161 - RNA, 15 nt, Escherichia coli CFT073
ugaaggugcuaugca

SEQ ID NO: 651162 - RNA, 15 nt, Escherichia coli CFT073
ugaauacgcaccaca

SEQ ID NO: 651163 - RNA, 20 nt, Escherichia coli CFT073
ugaauagcggaaaucuccag

SEQ ID NO: 651164 - RNA, 22 nt, Escherichia coli CFT073
ugaauaguauccaacugugaau

SEQ ID NO: 651165 - RNA, 15 nt, Escherichia coli CFT073
ugaauaucgaauggc

SEQ ID NO: 651166 - RNA, 16 nt, Escherichia coli CFT073
ugaauauccugacuuu

SEQ ID NO: 651167 - RNA, 23 nt, Escherichia coli CFT073
ugaauaugacccacgccuuuuuc

SEQ ID NO: 651168 - RNA, 14 nt, Escherichia coli CFT073
ugaauauucagaau

SEQ ID NO: 651169 - RNA, 17 nt, Escherichia coli CFT073
ugaauauucggcuccag

SEQ ID NO: 651170 - RNA, 16 nt, Escherichia coli CFT073
ugaagccgaacagucg

SEQ ID NO: 651171 - RNA, 18 nt, Escherichia coli CFT073
ugaagcggcggucuucuc

SEQ ID NO: 651172 - RNA, 18 nt, Escherichia coli CFT073
ugaaggugauucccagca

SEQ ID NO: 651173 - RNA, 19 nt, Escherichia coli CFT073
ugaaggggucuucuuccgc

SEQ ID NO: 651174 - RNA, 15 nt, Escherichia coli CFT073
ugaagggcaucagcc

SEQ ID NO: 651175 - RNA, 14 nt, Escherichia coli CFT073
ugaagggaugcugu

SEQ ID NO: 651176 - RNA, 14 nt, Escherichia coli CFT073
ugaagaaccgcacc

SEQ ID NO: 651177 - RNA, 13 nt, Escherichia coli CFT073
ugaacuuucucug

SEQ ID NO: 651178 - RNA, 13 nt, Escherichia coli CFT073
ugaacuuuuucuu

SEQ ID NO: 651179 - RNA, 17 nt, Escherichia coli CFT073
ugaacuuuuucuucacc

SEQ ID NO: 651180 - RNA, 15 nt, Escherichia coli CFT073
ugaacgacacacagu

SEQ ID NO: 651181 - RNA, 22 nt, Escherichia coli CFT073
ugaacgccaccccacaccagug

SEQ ID NO: 651182 - RNA, 21 nt, Escherichia coli CFT073
ugaacgccacgcucacucauc

SEQ ID NO: 651183 - RNA, 18 nt, Escherichia coli CFT073
ugaacgccaaauucuuua

SEQ ID NO: 651184 - RNA, 18 nt, Escherichia coli CFT073
ugaacgcaggccgcccaa

SEQ ID NO: 651185 - RNA, 18 nt, Escherichia coli CFT073
ugaacgccugcaccagcc

SEQ ID NO: 651186 - RNA, 19 nt, Escherichia coli CFT073
ugaaauugugauaaaaauc

SEQ ID NO: 651187 - RNA, 14 nt, Escherichia coli CFT073
ugaaauugcugguu

SEQ ID NO: 651188 - RNA, 15 nt, Escherichia coli CFT073
ugaaauuucugccuc

SEQ ID NO: 651189 - RNA, 22 nt, Escherichia coli CFT073
ugaaaugugccggaugcaucac

SEQ ID NO: 651190 - RNA, 20 nt, Escherichia coli CFT073
ugaaaucaccgccaccagcg

SEQ ID NO: 651191 - RNA, 17 nt, Escherichia coli CFT073
ugaaaugagaaaacuau

SEQ ID NO: 651192 - RNA, 22 nt, Escherichia coli CFT073
ugaaaugccaaauauuucuuua

SEQ ID NO: 651193 - RNA, 17 nt, Escherichia coli CFT073
ugaacaaaacauacuuu

SEQ ID NO: 651194 - RNA, 13 nt, Escherichia coli CFT073
ugaacaauuucag

SEQ ID NO: 651195 - RNA, 16 nt, Escherichia coli CFT073
ugaacaccaaggucuu

SEQ ID NO: 651196 - RNA, 17 nt, Escherichia coli CFT073
ugaacaccaaggucuuu

SEQ ID NO: 651197 - RNA, 18 nt, Escherichia coli CFT073
ugaacacguuuucucaag

SEQ ID NO: 651198 - RNA, 14 nt, Escherichia coli CFT073
ugaacaccuuaucc

SEQ ID NO: 651199 - RNA, 22 nt, Escherichia coli CFT073
ugaacaucaagcggcgcaugca

SEQ ID NO: 651200 - RNA, 22 nt, Escherichia coli CFT073
ugaacagcagaacaucagcugg

SEQ ID NO: 651201 - RNA, 14 nt, Escherichia coli CFT073
ugaaauagacauua

SEQ ID NO: 651202 - RNA, 18 nt, Escherichia coli CFT073
ugaaagugcuguaaagca

SEQ ID NO: 651203 - RNA, 17 nt, Escherichia coli CFT073
ugaaagugacacuguca

SEQ ID NO: 651204 - RNA, 22 nt, Escherichia coli CFT073
ugaaagaucacaauguaaauca

SEQ ID NO: 651205 - RNA, 16 nt, Escherichia coli CFT073
ugaaagagaucaaagu

SEQ ID NO: 651206 - RNA, 20 nt, Escherichia coli CFT073
ugaaagagccaucauucugc

SEQ ID NO: 651207 - RNA, 21 nt, Escherichia coli CFT073
ugaaagaugcuggauauagag

SEQ ID NO: 651208 - RNA, 12 nt, Escherichia coli CFT073
ugaaacuuucca

SEQ ID NO: 651209 - RNA, 22 nt, Escherichia coli CFT073
ucuucguacugcggaaccgggu

SEQ ID NO: 651210 - RNA, 20 nt, Escherichia coli CFT073
ucuucguagcguuuuuucau

SEQ ID NO: 651211 - RNA, 15 nt, Escherichia coli CFT073
ucuucgucccagucg

SEQ ID NO: 651212 - RNA, 17 nt, Escherichia coli CFT073
ucuucggcaaguguugg

SEQ ID NO: 651213 - RNA, 18 nt, Escherichia coli CFT073
ucuucggccauugaauau

SEQ ID NO: 651214 - RNA, 21 nt, Escherichia coli CFT073
ucuucggcgcugaccacuuug

SEQ ID NO: 651215 - RNA, 20 nt, Escherichia coli CFT073
ucuucggcuucuaccuuauc

SEQ ID NO: 651216 - RNA, 23 nt, Escherichia coli CFT073
ugaaaccgaauccuuuggacuca

SEQ ID NO: 651217 - RNA, 17 nt, Escherichia coli CFT073
ugaccauuaucaaacag

SEQ ID NO: 651218 - RNA, 16 nt, Escherichia coli CFT073
ugaccaucuuccagca

SEQ ID NO: 651219 - RNA, 20 nt, Escherichia coli CFT073
ugacccacgccuuuuucucc

SEQ ID NO: 651220 - RNA, 14 nt, Escherichia coli CFT073
ugaccgcuccgcca

SEQ ID NO: 651221 - RNA, 17 nt, Escherichia coli CFT073
ugaccgcuucaucugca

SEQ ID NO: 651222 - RNA, 22 nt, Escherichia coli CFT073
ugaccgccgucguaacaggaaa

SEQ ID NO: 651223 - RNA, 23 nt, Escherichia coli CFT073
ugaccgccuaauaccagaacuga

SEQ ID NO: 651224 - RNA, 16 nt, Escherichia coli CFT073
ugaccgcgccauccau

SEQ ID NO: 651225 - RNA, 16 nt, Escherichia coli CFT073
ugacaucaaucagcgg

SEQ ID NO: 651226 - RNA, 14 nt, Escherichia coli CFT073
ugacaguugucagc

SEQ ID NO: 651227 - RNA, 22 nt, Escherichia coli CFT073
ugacauaaccgagaauuuccag

SEQ ID NO: 651228 - RNA, 14 nt, Escherichia coli CFT073
ugacauaaugcaaa

SEQ ID NO: 651229 - RNA, 16 nt, Escherichia coli CFT073
ugacauacucucucca

SEQ ID NO: 651230 - RNA, 18 nt, Escherichia coli CFT073
ugaccauauuaacgcagc

SEQ ID NO: 651231 - RNA, 19 nt, Escherichia coli CFT073
ugaccauauuaacgcagca

SEQ ID NO: 651232 - RNA, 17 nt, Escherichia coli CFT073
ugaccagcuccagcagu

SEQ ID NO: 651233 - RNA, 17 nt, Escherichia coli CFT073
ugacacgggaaaccaac

SEQ ID NO: 651234 - RNA, 14 nt, Escherichia coli CFT073
ugacacggaacaac

SEQ ID NO: 651235 - RNA, 20 nt, Escherichia coli CFT073
ugacacuauucgccagcacg

SEQ ID NO: 651236 - RNA, 14 nt, Escherichia coli CFT073
ugacacugaauggc

SEQ ID NO: 651237 - RNA, 19 nt, Escherichia coli CFT073
ugacacugccacuuuuucc

SEQ ID NO: 651238 - RNA, 16 nt, Escherichia coli CFT073
ugacacaggcagcaau

SEQ ID NO: 651239 - RNA, 14 nt, Escherichia coli CFT073
ugacaccaagcacc

SEQ ID NO: 651240 - RNA, 19 nt, Escherichia coli CFT073
ugacagccccaccagcaaa

SEQ ID NO: 651241 - RNA, 22 nt, Escherichia coli CFT073
ugacagccccaccagcaaauau

SEQ ID NO: 651242 - RNA, 16 nt, Escherichia coli CFT073
ugacaguaucaccaac

SEQ ID NO: 651243 - RNA, 16 nt, Escherichia coli CFT073
ugacagggugagcagg

SEQ ID NO: 651244 - RNA, 15 nt, Escherichia coli CFT073
ugacagaccacucuc

SEQ ID NO: 651245 - RNA, 20 nt, Escherichia coli CFT073
ugacagacugcuuugaugug

SEQ ID NO: 651246 - RNA, 22 nt, Escherichia coli CFT073
ugacagacugcuuugaugugca

SEQ ID NO: 651247 - RNA, 15 nt, Escherichia coli CFT073
ugacagaaucagcag

SEQ ID NO: 651248 - RNA, 17 nt, Escherichia coli CFT073
ugacagcauaccuucac

SEQ ID NO: 651249 - RNA, 19 nt, Escherichia coli CFT073
ugacagaggauauucugcg

SEQ ID NO: 651250 - RNA, 17 nt, Escherichia coli CFT073
ugacagauuugauuauc

SEQ ID NO: 651251 - RNA, 22 nt, Escherichia coli CFT073
ugacaaaaccgagaagcuugcc

SEQ ID NO: 651252 - RNA, 18 nt, Escherichia coli CFT073
ugacaaaccguacuucac

SEQ ID NO: 651253 - RNA, 19 nt, Escherichia coli CFT073
ugacaaacgcaaaacugcc

SEQ ID NO: 651254 - RNA, 22 nt, Escherichia coli CFT073
ugacaaacgcaaaauugccuga

SEQ ID NO: 651255 - RNA, 15 nt, Escherichia coli CFT073
ugacaacaacaucac

SEQ ID NO: 651256 - RNA, 19 nt, Escherichia coli CFT073
ugacaaucgccagugauug

SEQ ID NO: 651257 - RNA, 15 nt, Escherichia coli CFT073
ugacaaucgccgcca

SEQ ID NO: 651258 - RNA, 15 nt, Escherichia coli CFT073
ugacaauuacaaaau

SEQ ID NO: 651259 - RNA, 21 nt, Escherichia coli CFT073
ugacaauccuucccugcagua

SEQ ID NO: 651260 - RNA, 21 nt, Escherichia coli CFT073
ugaauccguuauguuucaucc

SEQ ID NO: 651261 - RNA, 18 nt, Escherichia coli CFT073
ugaauccaggccagauac

SEQ ID NO: 651262 - RNA, 19 nt, Escherichia coli CFT073
ugaauccaggccagauacu

SEQ ID NO: 651263 - RNA, 23 nt, Escherichia coli CFT073
ugaaucgcuauuaacccgcaaca

SEQ ID NO: 651264 - RNA, 20 nt, Escherichia coli CFT073
ugaaucggacgugauuccag

SEQ ID NO: 651265 - RNA, 13 nt, Escherichia coli CFT073
ugaaucgggaaug

SEQ ID NO: 651266 - RNA, 23 nt, Escherichia coli CFT073
ugaaucgguggcggcaguugccc

SEQ ID NO: 651267 - RNA, 13 nt, Escherichia coli CFT073
ugaaucaacacca

SEQ ID NO: 651268 - RNA, 22 nt, Escherichia coli CFT073
ugaaucaaauaagguuccagua

SEQ ID NO: 651269 - RNA, 20 nt, Escherichia coli CFT073
ugaauauuccaguuaucacg

SEQ ID NO: 651270 - RNA, 22 nt, Escherichia coli CFT073
ugaaucagcagauccaucgccu

SEQ ID NO: 651271 - RNA, 14 nt, Escherichia coli CFT073
ugaauccacuggcu

SEQ ID NO: 651272 - RNA, 17 nt, Escherichia coli CFT073
ugaauccacuggcuguu

SEQ ID NO: 651273 - RNA, 17 nt, Escherichia coli CFT073
ugaauggguaaacccgc

SEQ ID NO: 651274 - RNA, 14 nt, Escherichia coli CFT073
ugaaugaaaacgaa

SEQ ID NO: 651275 - RNA, 23 nt, Escherichia coli CFT073
ugaaucucuuaucauccagguga

SEQ ID NO: 651276 - RNA, 22 nt, Escherichia coli CFT073
ugaaugacuguccacgacagaa

SEQ ID NO: 651277 - RNA, 17 nt, Escherichia coli CFT073
ugaauuugucgauuucc

SEQ ID NO: 651278 - RNA, 19 nt, Escherichia coli CFT073
ugaauuuuaggaugcugca

SEQ ID NO: 651279 - RNA, 15 nt, Escherichia coli CFT073
ugaauuugcgauacu

SEQ ID NO: 651280 - RNA, 17 nt, Escherichia coli CFT073
ugaauuuaucuuucagc

SEQ ID NO: 651281 - RNA, 15 nt, Escherichia coli CFT073
ugaauuuugaaggaa

SEQ ID NO: 651282 - RNA, 19 nt, Escherichia coli CFT073
ugaauuuugaaggaaaaau

SEQ ID NO: 651283 - RNA, 15 nt, Escherichia coli CFT073
ugaauuuuuacuucu

SEQ ID NO: 651284 - RNA, 21 nt, Escherichia coli CFT073
ugacaaaaauaccauuaguca

SEQ ID NO: 651285 - RNA, 16 nt, Escherichia coli CFT073
ugaauuuauaaucauc

SEQ ID NO: 651286 - RNA, 12 nt, Escherichia coli CFT073
ugaauuucacuu

SEQ ID NO: 651287 - RNA, 19 nt, Escherichia coli CFT073
ugaauuuaaugcacuuaua

SEQ ID NO: 651288 - RNA, 20 nt, Escherichia coli CFT073
ugaauuuaauugguuuugca

SEQ ID NO: 651289 - RNA, 18 nt, Escherichia coli CFT073
ugaauuguccagaucuuu

SEQ ID NO: 651290 - RNA, 15 nt, Escherichia coli CFT073
ugaauugugaugguu

SEQ ID NO: 651291 - RNA, 19 nt, Escherichia coli CFT073
ugaauucccccauugaaac

SEQ ID NO: 651292 - RNA, 17 nt, Escherichia coli CFT073
ugaauugccagcaucag

SEQ ID NO: 651293 - RNA, 18 nt, Escherichia coli CFT073
ugaauugccagcaucaga

SEQ ID NO: 651294 - RNA, 22 nt, Escherichia coli CFT073
ugaauucaucguaaucucuuuc

SEQ ID NO: 651295 - RNA, 14 nt, Escherichia coli CFT073
ugaauuaaaaugug

SEQ ID NO: 651296 - RNA, 14 nt, Escherichia coli CFT073
ugaauuaaaaacag

SEQ ID NO: 651297 - RNA, 15 nt, Escherichia coli CFT073
ugaauuaaaaacagu

SEQ ID NO: 651298 - RNA, 22 nt, Escherichia coli CFT073
ugaaugguggcgaugauuuccg

SEQ ID NO: 651299 - RNA, 16 nt, Escherichia coli CFT073
ugaaugucggcggcga

SEQ ID NO: 651300 - RNA, 15 nt, Escherichia coli CFT073
ugaauguugcgcggu

SEQ ID NO: 651301 - RNA, 17 nt, Escherichia coli CFT073
ugauguacucaauugcu

SEQ ID NO: 651302 - RNA, 18 nt, Escherichia coli CFT073
ugaugguccuucagcacc

SEQ ID NO: 651303 - RNA, 19 nt, Escherichia coli CFT073
ugaugguaaaauaucacuc

SEQ ID NO: 651304 - RNA, 21 nt, Escherichia coli CFT073
ugaugguaacgcgccaggauc

SEQ ID NO: 651305 - RNA, 23 nt, Escherichia coli CFT073
ugaugggcaccaggcaauuggca

SEQ ID NO: 651306 - RNA, 16 nt, Escherichia coli CFT073
ugaugggcagaauaac

SEQ ID NO: 651307 - RNA, 20 nt, Escherichia coli CFT073
ugaugucugucagucugcuu

SEQ ID NO: 651308 - RNA, 21 nt, Escherichia coli CFT073
ugaugugacgcugucuuauca

SEQ ID NO: 651309 - RNA, 21 nt, Escherichia coli CFT073
ugauguccuuuauaacugucu

SEQ ID NO: 651310 - RNA, 15 nt, Escherichia coli CFT073
ugauguauccggcau

SEQ ID NO: 651311 - RNA, 22 nt, Escherichia coli CFT073
ugauguuaccaacacugaaagu

SEQ ID NO: 651312 - RNA, 12 nt, Escherichia coli CFT073
ugaugugccauu

SEQ ID NO: 651313 - RNA, 14 nt, Escherichia coli CFT073
ugaugugcuuauca

SEQ ID NO: 651314 - RNA, 22 nt, Escherichia coli CFT073
ugauguggacuguagauauuca

SEQ ID NO: 651315 - RNA, 13 nt, Escherichia coli CFT073
ugauuaaauucag

SEQ ID NO: 651316 - RNA, 13 nt, Escherichia coli CFT073
ugauuaaacuuca

SEQ ID NO: 651317 - RNA, 20 nt, Escherichia coli CFT073
ugauuaagcggguuuugaau

SEQ ID NO: 651318 - RNA, 23 nt, Escherichia coli CFT073
ugauuaacgcuuguaaaugaacu

SEQ ID NO: 651319 - RNA, 20 nt, Escherichia coli CFT073
ugauguuucugcgcgaaauu

SEQ ID NO: 651320 - RNA, 22 nt, Escherichia coli CFT073
ugauuaagaucgugcagcaccg

SEQ ID NO: 651321 - RNA, 18 nt, Escherichia coli CFT073
ugauuacgguauugcuau

SEQ ID NO: 651322 - RNA, 20 nt, Escherichia coli CFT073
ugauuacucucuuucgcuug

SEQ ID NO: 651323 - RNA, 13 nt, Escherichia coli CFT073
ugauuaccaaaac

SEQ ID NO: 651324 - RNA, 23 nt, Escherichia coli CFT073
ugauuaucaugcccuuuuuucuu

SEQ ID NO: 651325 - RNA, 14 nt, Escherichia coli CFT073
ugauuauccucugu

SEQ ID NO: 651326 - RNA, 17 nt, Escherichia coli CFT073
ugauuauccucuguaaa

SEQ ID NO: 651327 - RNA, 20 nt, Escherichia coli CFT073
ugauucauaguaagcagauu

SEQ ID NO: 651328 - RNA, 18 nt, Escherichia coli CFT073
ugauucacauccugccag

SEQ ID NO: 651329 - RNA, 13 nt, Escherichia coli CFT073
ugauucaccaccg

SEQ ID NO: 651330 - RNA, 20 nt, Escherichia coli CFT073
ugauucacgcugacaacucc

SEQ ID NO: 651331 - RNA, 23 nt, Escherichia coli CFT073
ugauuauugucgugccgcuacug

SEQ ID NO: 651332 - RNA, 13 nt, Escherichia coli CFT073
ugauuuauuucuc

SEQ ID NO: 651333 - RNA, 13 nt, Escherichia coli CFT073
ugauuuauuuuua

SEQ ID NO: 651334 - RNA, 17 nt, Escherichia coli CFT073
ugauuucaaaauuaaag

SEQ ID NO: 651335 - RNA, 21 nt, Escherichia coli CFT073
ugauuucguccauguuggaga

SEQ ID NO: 651336 - RNA, 15 nt, Escherichia coli CFT073
ugauuguaggccgga

SEQ ID NO: 651337 - RNA, 22 nt, Escherichia coli CFT073
ugauuuauaccggcauuucggc

SEQ ID NO: 651338 - RNA, 19 nt, Escherichia coli CFT073
ugauugcggucagcgcagc

SEQ ID NO: 651339 - RNA, 14 nt, Escherichia coli CFT073
ugauugcuuuuguu

SEQ ID NO: 651340 - RNA, 17 nt, Escherichia coli CFT073
ugaugaaaaaaccagaa

SEQ ID NO: 651341 - RNA, 14 nt, Escherichia coli CFT073
ugaugcaccaccug

SEQ ID NO: 651342 - RNA, 17 nt, Escherichia coli CFT073
ugaugaaagcaugucag

SEQ ID NO: 651343 - RNA, 14 nt, Escherichia coli CFT073
ugaugaagacagac

SEQ ID NO: 651344 - RNA, 13 nt, Escherichia coli CFT073
ugaugccacaaac

SEQ ID NO: 651345 - RNA, 14 nt, Escherichia coli CFT073
ugaugccaaaaugc

SEQ ID NO: 651346 - RNA, 14 nt, Escherichia coli CFT073
ugaugccacuggau

SEQ ID NO: 651347 - RNA, 17 nt, Escherichia coli CFT073
ugaugccagcacucugu

SEQ ID NO: 651348 - RNA, 19 nt, Escherichia coli CFT073
ugaugccagcacucugugc

SEQ ID NO: 651349 - RNA, 21 nt, Escherichia coli CFT073
ugaugcgacgcuuuacgcguc

SEQ ID NO: 651350 - RNA, 14 nt, Escherichia coli CFT073
ugaugcgacuuguc

SEQ ID NO: 651351 - RNA, 22 nt, Escherichia coli CFT073
ugaugccggaugcgacgcuuga

SEQ ID NO: 651352 - RNA, 15 nt, Escherichia coli CFT073
ugaugccggaugcgg

SEQ ID NO: 651353 - RNA, 14 nt, Escherichia coli CFT073
ugaugccgucuuua

SEQ ID NO: 651354 - RNA, 18 nt, Escherichia coli CFT073
ugaugcggcgcuuucagc

SEQ ID NO: 651355 - RNA, 18 nt, Escherichia coli CFT073
ugaugcggucgcugccgc

SEQ ID NO: 651356 - RNA, 18 nt, Escherichia coli CFT073
ugaugcgcugcgcuucuc

SEQ ID NO: 651357 - RNA, 20 nt, Escherichia coli CFT073
ugaugcgcugcgcuucucag

SEQ ID NO: 651358 - RNA, 14 nt, Escherichia coli CFT073
ugaugcgcuuauca

SEQ ID NO: 651359 - RNA, 19 nt, Escherichia coli CFT073
ugaugcgcuucgcuuauca

SEQ ID NO: 651360 - RNA, 17 nt, Escherichia coli CFT073
ugaugcgcuacgcuuau

SEQ ID NO: 651361 - RNA, 19 nt, Escherichia coli CFT073
ugaugcgcuccgcuuauca

SEQ ID NO: 651362 - RNA, 16 nt, Escherichia coli CFT073
ugaugcuuuucaaaca

SEQ ID NO: 651363 - RNA, 22 nt, Escherichia coli CFT073
ugauggaaaauuguuccgucag

SEQ ID NO: 651364 - RNA, 20 nt, Escherichia coli CFT073
ugaugcuccgccagcgccac

SEQ ID NO: 651365 - RNA, 18 nt, Escherichia coli CFT073
ugaugcucucccaaauau

SEQ ID NO: 651366 - RNA, 16 nt, Escherichia coli CFT073
ugauggaauuucauca

SEQ ID NO: 651367 - RNA, 17 nt, Escherichia coli CFT073
ugauggaauuucaucau

SEQ ID NO: 651368 - RNA, 21 nt, Escherichia coli CFT073
ugauggacauucuccggcagg

SEQ ID NO: 651369 - RNA, 17 nt, Escherichia coli CFT073
ugauggcaaaugcaaca

SEQ ID NO: 651370 - RNA, 21 nt, Escherichia coli CFT073
ugauggcgccaguuauucauu

SEQ ID NO: 651371 - RNA, 23 nt, Escherichia coli CFT073
ugauggcgccaguuauucauugc

SEQ ID NO: 651372 - RNA, 22 nt, Escherichia coli CFT073
ugauggcuugcucguuuucaau

SEQ ID NO: 651373 - RNA, 22 nt, Escherichia coli CFT073
ugauauucacguuuuucaucca

SEQ ID NO: 651374 - RNA, 17 nt, Escherichia coli CFT073
ugauauuacauaccagc

SEQ ID NO: 651375 - RNA, 18 nt, Escherichia coli CFT073
ugauauuacauaccagca

SEQ ID NO: 651376 - RNA, 20 nt, Escherichia coli CFT073
ugauauuuguuuucauccac

SEQ ID NO: 651377 - RNA, 14 nt, Escherichia coli CFT073
ugauauuuagccag

SEQ ID NO: 651378 - RNA, 17 nt, Escherichia coli CFT073
ugauauucucgcuccag

SEQ ID NO: 651379 - RNA, 13 nt, Escherichia coli CFT073
ugauauugugagc

SEQ ID NO: 651380 - RNA, 14 nt, Escherichia coli CFT073
ugauauuuucugcc

SEQ ID NO: 651381 - RNA, 14 nt, Escherichia coli CFT073
ugaucaaauacuuc

SEQ ID NO: 651382 - RNA, 12 nt, Escherichia coli CFT073
ugaucaacgacc

SEQ ID NO: 651383 - RNA, 21 nt, Escherichia coli CFT073
ugaucaacgaccagaaagacu

SEQ ID NO: 651384 - RNA, 17 nt, Escherichia coli CFT073
ugaucaacucaggaaca

SEQ ID NO: 651385 - RNA, 23 nt, Escherichia coli CFT073
ugaucaauaaucucuuuacccag

SEQ ID NO: 651386 - RNA, 17 nt, Escherichia coli CFT073
ugaucaagcaccgccau

SEQ ID NO: 651387 - RNA, 13 nt, Escherichia coli CFT073
ugaucacccacau

SEQ ID NO: 651388 - RNA, 21 nt, Escherichia coli CFT073
ugaucuaaaagcaaacugugc

SEQ ID NO: 651389 - RNA, 14 nt, Escherichia coli CFT073
ugaucguuaaaucc

SEQ ID NO: 651390 - RNA, 23 nt, Escherichia coli CFT073
ugaucgugccaggaccauucaca

SEQ ID NO: 651391 - RNA, 21 nt, Escherichia coli CFT073
ugaucgucagcacucacgcca

SEQ ID NO: 651392 - RNA, 17 nt, Escherichia coli CFT073
ugaucccggcuuccugc

SEQ ID NO: 651393 - RNA, 21 nt, Escherichia coli CFT073
ugaucccggcuuccugcagcg

SEQ ID NO: 651394 - RNA, 15 nt, Escherichia coli CFT073
ugaucagcacgauaa

SEQ ID NO: 651395 - RNA, 16 nt, Escherichia coli CFT073
ugaucacguuuuccuu

SEQ ID NO: 651396 - RNA, 18 nt, Escherichia coli CFT073
ugaucacgauauucugua

SEQ ID NO: 651397 - RNA, 13 nt, Escherichia coli CFT073
ugauccacccuug

SEQ ID NO: 651398 - RNA, 14 nt, Escherichia coli CFT073
ugauaaaucaccug

SEQ ID NO: 651399 - RNA, 19 nt, Escherichia coli CFT073
ugaguaucgaaaacaucaa

SEQ ID NO: 651400 - RNA, 19 nt, Escherichia coli CFT073
ugaguaucuuauugaaaga

SEQ ID NO: 651401 - RNA, 14 nt, Escherichia coli CFT073
ugaguauuaaaugu

SEQ ID NO: 651402 - RNA, 17 nt, Escherichia coli CFT073
ugauacaggaacagcca

SEQ ID NO: 651403 - RNA, 14 nt, Escherichia coli CFT073
ugauacaucaaguc

SEQ ID NO: 651404 - RNA, 19 nt, Escherichia coli CFT073
ugauacaucugguaauuga

SEQ ID NO: 651405 - RNA, 21 nt, Escherichia coli CFT073
ugauaacgucggcauauuuaa

SEQ ID NO: 651406 - RNA, 14 nt, Escherichia coli CFT073
ugauaaucaacagg

SEQ ID NO: 651407 - RNA, 19 nt, Escherichia coli CFT073
ugauaaucaacaggaacau

SEQ ID NO: 651408 - RNA, 20 nt, Escherichia coli CFT073
ugauaaucauacucccagcg

SEQ ID NO: 651409 - RNA, 14 nt, Escherichia coli CFT073
ugauaaucauccca

SEQ ID NO: 651410 - RNA, 13 nt, Escherichia coli CFT073
ugauaaccuucca

SEQ ID NO: 651411 - RNA, 22 nt, Escherichia coli CFT073
ugauaacgccacgccaccagcg

SEQ ID NO: 651412 - RNA, 14 nt, Escherichia coli CFT073
ugagcgcacauugc

SEQ ID NO: 651413 - RNA, 13 nt, Escherichia coli CFT073
ugagcgaugaagu

SEQ ID NO: 651414 - RNA, 14 nt, Escherichia coli CFT073
ugagcuucuucaaa

SEQ ID NO: 651415 - RNA, 16 nt, Escherichia coli CFT073
ugagcugucugucaaa

SEQ ID NO: 651416 - RNA, 17 nt, Escherichia coli CFT073
ugaguagaccagacgac

SEQ ID NO: 651417 - RNA, 19 nt, Escherichia coli CFT073
ugaguauauuucaggccaa

SEQ ID NO: 651418 - RNA, 21 nt, Escherichia coli CFT073
ugaguaagugccccgucuuug

SEQ ID NO: 651419 - RNA, 22 nt, Escherichia coli CFT073
ugaguacgcauccccagcgcaa

SEQ ID NO: 651420 - RNA, 23 nt, Escherichia coli CFT073
ugaguacgcgguuuuugucugcc

SEQ ID NO: 651421 - RNA, 19 nt, Escherichia coli CFT073
ugaguaaaacugcauuuuu

SEQ ID NO: 651422 - RNA, 23 nt, Escherichia coli CFT073
ugaggaugcgagucaggccagga

SEQ ID NO: 651423 - RNA, 12 nt, Escherichia coli CFT073
ugaggcaaguaa

SEQ ID NO: 651424 - RNA, 17 nt, Escherichia coli CFT073
ugagcaguccccacauc

SEQ ID NO: 651425 - RNA, 23 nt, Escherichia coli CFT073
ugagcccacuguuugaucugcug

SEQ ID NO: 651426 - RNA, 19 nt, Escherichia coli CFT073
ugagccaggacgauaaacc

SEQ ID NO: 651427 - RNA, 12 nt, Escherichia coli CFT073
ugagcacaucag

SEQ ID NO: 651428 - RNA, 15 nt, Escherichia coli CFT073
ugagauuacauuggg

SEQ ID NO: 651429 - RNA, 15 nt, Escherichia coli CFT073
ugagaugguuuugcu

SEQ ID NO: 651430 - RNA, 21 nt, Escherichia coli CFT073
ugagaugguuuugcuuuauua

SEQ ID NO: 651431 - RNA, 13 nt, Escherichia coli CFT073
ugacuuucuuuuc

SEQ ID NO: 651432 - RNA, 13 nt, Escherichia coli CFT073
ugacuuuaaaaaa

SEQ ID NO: 651433 - RNA, 21 nt, Escherichia coli CFT073
ugacuuuaaaaaaauuaauuu

SEQ ID NO: 651434 - RNA, 13 nt, Escherichia coli CFT073
ugacuugccaggu

SEQ ID NO: 651435 - RNA, 15 nt, Escherichia coli CFT073
ugacugcuguaagcc

SEQ ID NO: 651436 - RNA, 18 nt, Escherichia coli CFT073
ugacugcuuuuucaauuu

SEQ ID NO: 651437 - RNA, 22 nt, Escherichia coli CFT073
ugacugcuuuuucaauuuccag

SEQ ID NO: 651438 - RNA, 17 nt, Escherichia coli CFT073
ugacuggcagaaugaag

SEQ ID NO: 651439 - RNA, 19 nt, Escherichia coli CFT073
ugaccuuucaguuugccgc

SEQ ID NO: 651440 - RNA, 14 nt, Escherichia coli CFT073
ugaccuuuuuucag

SEQ ID NO: 651441 - RNA, 15 nt, Escherichia coli CFT073
ugacgaaaacucgcu

SEQ ID NO: 651442 - RNA, 15 nt, Escherichia coli CFT073
ugacugccgccagca

SEQ ID NO: 651443 - RNA, 21 nt, Escherichia coli CFT073
ugcgcguacuucacauacuca

SEQ ID NO: 651444 - RNA, 24 nt, Escherichia coli CFT073
ugcgcguuugggcgagaucuucuu

SEQ ID NO: 651445 - RNA, 18 nt, Escherichia coli CFT073
ugcgcggccagugccagu

SEQ ID NO: 651446 - RNA, 21 nt, Escherichia coli CFT073
ugcgcucuucaacuucagcag

SEQ ID NO: 651447 - RNA, 22 nt, Escherichia coli CFT073
ugcgcucuucaacuucagcagc

SEQ ID NO: 651448 - RNA, 12 nt, Escherichia coli CFT073
ugcgcucuuccg

SEQ ID NO: 651449 - RNA, 17 nt, Escherichia coli CFT073
ugcgcucuucgaggccg

SEQ ID NO: 651450 - RNA, 18 nt, Escherichia coli CFT073
ugcgcucaauaaucaauc

SEQ ID NO: 651451 - RNA, 20 nt, Escherichia coli CFT073
ugcggacgaccaauuaaaua

SEQ ID NO: 651452 - RNA, 15 nt, Escherichia coli CFT073
ugcgcugcaccagua

SEQ ID NO: 651453 - RNA, 18 nt, Escherichia coli CFT073
ugcgcugcgcuuaucagg

SEQ ID NO: 651454 - RNA, 19 nt, Escherichia coli CFT073
ugcggagaucaccacauac

SEQ ID NO: 651455 - RNA, 21 nt, Escherichia coli CFT073
ugcguagucugaccucuucua

SEQ ID NO: 651456 - RNA, 13 nt, Escherichia coli CFT073
ugcguacccagcg

SEQ ID NO: 651457 - RNA, 17 nt, Escherichia coli CFT073
ugcggucaaaagcugca

SEQ ID NO: 651458 - RNA, 13 nt, Escherichia coli CFT073
ugcggucacgcug

SEQ ID NO: 651459 - RNA, 14 nt, Escherichia coli CFT073
ugcguacaccaaca

SEQ ID NO: 651460 - RNA, 15 nt, Escherichia coli CFT073
ugcguacaccaacau

SEQ ID NO: 651461 - RNA, 18 nt, Escherichia coli CFT073
ugcguacaccaacaucac

SEQ ID NO: 651462 - RNA, 16 nt, Escherichia coli CFT073
ugcgguagcgggcgca

SEQ ID NO: 651463 - RNA, 22 nt, Escherichia coli CFT073
ugcggguucuggcgcagcgcag

SEQ ID NO: 651464 - RNA, 13 nt, Escherichia coli CFT073
ugcgggccaaaga

SEQ ID NO: 651465 - RNA, 13 nt, Escherichia coli CFT073
ugcggccagcagc

SEQ ID NO: 651466 - RNA, 12 nt, Escherichia coli CFT073
ugcggccagcag

SEQ ID NO: 651467 - RNA, 17 nt, Escherichia coli CFT073
ugcgggcggcucuccug

SEQ ID NO: 651468 - RNA, 15 nt, Escherichia coli CFT073
ugcgcccaucaucau

SEQ ID NO: 651469 - RNA, 12 nt, Escherichia coli CFT073
ugcgcccaggaa

SEQ ID NO: 651470 - RNA, 12 nt, Escherichia coli CFT073
aaauggcaggca

SEQ ID NO: 651471 - RNA, 17 nt, Escherichia coli CFT073
aaauggcuggcagcaga

SEQ ID NO: 651472 - RNA, 18 nt, Escherichia coli CFT073
ugcgcauggaagcgcagg

SEQ ID NO: 651473 - RNA, 17 nt, Escherichia coli CFT073
ugcgcauucuacuuugc

SEQ ID NO: 651474 - RNA, 18 nt, Escherichia coli CFT073
ugcgcauaacccaccggu

SEQ ID NO: 651475 - RNA, 20 nt, Escherichia coli CFT073
ugcgccuacggcauucugca

SEQ ID NO: 651476 - RNA, 23 nt, Escherichia coli CFT073
ugcgccucuccacacggagaggc

SEQ ID NO: 651477 - RNA, 18 nt, Escherichia coli CFT073
ugcgccugcgucuaucag

SEQ ID NO: 651478 - RNA, 21 nt, Escherichia coli CFT073
ugcgccuauaaggcucucuua

SEQ ID NO: 651479 - RNA, 16 nt, Escherichia coli CFT073
aaauggugugcauggu

SEQ ID NO: 651480 - RNA, 15 nt, Escherichia coli CFT073
aaaugggggagagcc

SEQ ID NO: 651481 - RNA, 18 nt, Escherichia coli CFT073
aaaugguacaauggagcu

SEQ ID NO: 651482 - RNA, 16 nt, Escherichia coli CFT073
ugcgcgaaccagagac

SEQ ID NO: 651483 - RNA, 22 nt, Escherichia coli CFT073
ugcgcgaaucgccccagcaccc

SEQ ID NO: 651484 - RNA, 19 nt, Escherichia coli CFT073
ugcgccuguguuuuuacgc

SEQ ID NO: 651485 - RNA, 19 nt, Escherichia coli CFT073
ugcgcgagguaacaauaaa

SEQ ID NO: 651486 - RNA, 21 nt, Escherichia coli CFT073
ugcgcgaccaacugcaaggcc

SEQ ID NO: 651487 - RNA, 24 nt, Escherichia coli CFT073
ugcgcgacguugcuucucuugcug

SEQ ID NO: 651488 - RNA, 17 nt, Escherichia coli CFT073
ugcgcgacucccugacu

SEQ ID NO: 651489 - RNA, 19 nt, Escherichia coli CFT073
ugcgacgcuugccgcgucu

SEQ ID NO: 651490 - RNA, 19 nt, Escherichia coli CFT073
ugcgacguuacaaccacau

SEQ ID NO: 651491 - RNA, 21 nt, Escherichia coli CFT073
ugcgacaugcgaucccaugcc

SEQ ID NO: 651492 - RNA, 14 nt, Escherichia coli CFT073
ugcgaccaaacugc

SEQ ID NO: 651493 - RNA, 20 nt, Escherichia coli CFT073
ugcgacaguaagcccaccac

SEQ ID NO: 651494 - RNA, 16 nt, Escherichia coli CFT073
ugcgaccguacaacca

SEQ ID NO: 651495 - RNA, 22 nt, Escherichia coli CFT073
ugcgaccguacaaccaaaucug

SEQ ID NO: 651496 - RNA, 16 nt, Escherichia coli CFT073
ugcgaccuacacaccu

SEQ ID NO: 651497 - RNA, 19 nt, Escherichia coli CFT073
ugccugcuauuuaccgcua

SEQ ID NO: 651498 - RNA, 15 nt, Escherichia coli CFT073
ugccugguuucucuc

SEQ ID NO: 651499 - RNA, 20 nt, Escherichia coli CFT073
ugccuggguuuucacagaag

SEQ ID NO: 651500 - RNA, 22 nt, Escherichia coli CFT073
ugccuggauaaggccaccagcg

SEQ ID NO: 651501 - RNA, 17 nt, Escherichia coli CFT073
ugccuggcaguucccua

SEQ ID NO: 651502 - RNA, 14 nt, Escherichia coli CFT073
ugccuggcauaacg

SEQ ID NO: 651503 - RNA, 17 nt, Escherichia coli CFT073
ugcgauuuccuucagca

SEQ ID NO: 651504 - RNA, 17 nt, Escherichia coli CFT073
ugcgcaacgcaaucccc

SEQ ID NO: 651505 - RNA, 15 nt, Escherichia coli CFT073
ugcgacuucauucag

SEQ ID NO: 651506 - RNA, 20 nt, Escherichia coli CFT073
ugcgacuucauucagacagg

SEQ ID NO: 651507 - RNA, 20 nt, Escherichia coli CFT073
ugcgacuugucaucauacug

SEQ ID NO: 651508 - RNA, 18 nt, Escherichia coli CFT073
ugcgauguucccccagcc

SEQ ID NO: 651509 - RNA, 15 nt, Escherichia coli CFT073
ugcgauguucuucac

SEQ ID NO: 651510 - RNA, 19 nt, Escherichia coli CFT073
ugcgcagcggaggcgauaa

SEQ ID NO: 651511 - RNA, 19 nt, Escherichia coli CFT073
ugcgcagcggugagccagg

SEQ ID NO: 651512 - RNA, 16 nt, Escherichia coli CFT073
ugcgcagcaucggcgc

SEQ ID NO: 651513 - RNA, 24 nt, Escherichia coli CFT073
ugcgcagccaguuaaccugcgccu

SEQ ID NO: 651514 - RNA, 21 nt, Escherichia coli CFT073
ugcgcaacuuuuucuugcuca

SEQ ID NO: 651515 - RNA, 20 nt, Escherichia coli CFT073
ugcgcagaguuuccaggcug

SEQ ID NO: 651516 - RNA, 16 nt, Escherichia coli CFT073
ugccgcucuuuuauua

SEQ ID NO: 651517 - RNA, 17 nt, Escherichia coli CFT073
ugccgcucccggcauaa

SEQ ID NO: 651518 - RNA, 21 nt, Escherichia coli CFT073
ugccgcugcgcgugaagcacg

SEQ ID NO: 651519 - RNA, 12 nt, Escherichia coli CFT073
ugccgcuuuuaa

SEQ ID NO: 651520 - RNA, 16 nt, Escherichia coli CFT073
ugccgcuuuuaugugc

SEQ ID NO: 651521 - RNA, 19 nt, Escherichia coli CFT073
ugccgcuuuuaugugcaau

SEQ ID NO: 651522 - RNA, 20 nt, Escherichia coli CFT073
ugccgcuguucugauuuuga

SEQ ID NO: 651523 - RNA, 12 nt, Escherichia coli CFT073
ugccgcuguugc

SEQ ID NO: 651524 - RNA, 14 nt, Escherichia coli CFT073
ugccgcuaucaggc

SEQ ID NO: 651525 - RNA, 20 nt, Escherichia coli CFT073
ugccggacgucaggccgcca

SEQ ID NO: 651526 - RNA, 18 nt, Escherichia coli CFT073
ugccggaggagugcgcca

SEQ ID NO: 651527 - RNA, 13 nt, Escherichia coli CFT073
ugccggaggcgcu

SEQ ID NO: 651528 - RNA, 15 nt, Escherichia coli CFT073
ugccggaggcgcugg

SEQ ID NO: 651529 - RNA, 18 nt, Escherichia coli CFT073
ugccggaauuaauaaucc

SEQ ID NO: 651530 - RNA, 14 nt, Escherichia coli CFT073
ugccgccuggugca

SEQ ID NO: 651531 - RNA, 20 nt, Escherichia coli CFT073
ugccgcgccagaucagggaa

SEQ ID NO: 651532 - RNA, 21 nt, Escherichia coli CFT073
ugccgcgccagaucagggaag

SEQ ID NO: 651533 - RNA, 18 nt, Escherichia coli CFT073
ugccgccggaaacauaaa

SEQ ID NO: 651534 - RNA, 16 nt, Escherichia coli CFT073
ugccuaccgccugcau

SEQ ID NO: 651535 - RNA, 17 nt, Escherichia coli CFT073
ugccucacgcaaauucu

SEQ ID NO: 651536 - RNA, 24 nt, Escherichia coli CFT073
ugccucaggcaacggugacuggcu

SEQ ID NO: 651537 - RNA, 14 nt, Escherichia coli CFT073
ugccguuaauaaua

SEQ ID NO: 651538 - RNA, 23 nt, Escherichia coli CFT073
ugccguuuccugggccagcacca

SEQ ID NO: 651539 - RNA, 18 nt, Escherichia coli CFT073
ugccguuugcugcaugau

SEQ ID NO: 651540 - RNA, 22 nt, Escherichia coli CFT073
ugccguuuguaggccugauaag

SEQ ID NO: 651541 - RNA, 12 nt, Escherichia coli CFT073
ugccguucccag

SEQ ID NO: 651542 - RNA, 23 nt, Escherichia coli CFT073
ugccggggaaguaaacccggcau

SEQ ID NO: 651543 - RNA, 16 nt, Escherichia coli CFT073
ugccgucaauccagcc

SEQ ID NO: 651544 - RNA, 15 nt, Escherichia coli CFT073
ugccgucaccagcau

SEQ ID NO: 651545 - RNA, 17 nt, Escherichia coli CFT073
ugccgucagggccugcg

SEQ ID NO: 651546 - RNA, 15 nt, Escherichia coli CFT073
ugccguccagcgccu

SEQ ID NO: 651547 - RNA, 17 nt, Escherichia coli CFT073
ugccggaugugaugcau

SEQ ID NO: 651548 - RNA, 20 nt, Escherichia coli CFT073
ugccggauguggcacaucau

SEQ ID NO: 651549 - RNA, 21 nt, Escherichia coli CFT073
ugccggaucaauuugccaucc

SEQ ID NO: 651550 - RNA, 20 nt, Escherichia coli CFT073
ugccggaucuuucaggaaca

SEQ ID NO: 651551 - RNA, 20 nt, Escherichia coli CFT073
ugccggaugacgccucaggc

SEQ ID NO: 651552 - RNA, 21 nt, Escherichia coli CFT073
ugccggaugcaaacgauuauc

SEQ ID NO: 651553 - RNA, 22 nt, Escherichia coli CFT073
ugccggaugcgacgcuggccgc

SEQ ID NO: 651554 - RNA, 18 nt, Escherichia coli CFT073
ugccggauggcacgcauc

SEQ ID NO: 651555 - RNA, 18 nt, Escherichia coli CFT073
ugccgccagguuauccag

SEQ ID NO: 651556 - RNA, 18 nt, Escherichia coli CFT073
ugccgccaagcauuacga

SEQ ID NO: 651557 - RNA, 18 nt, Escherichia coli CFT073
ugccgcaucagugaucag

SEQ ID NO: 651558 - RNA, 22 nt, Escherichia coli CFT073
ugccgccgcacgauaaauacuc

SEQ ID NO: 651559 - RNA, 17 nt, Escherichia coli CFT073
ugccgccccaaagggcg

SEQ ID NO: 651560 - RNA, 15 nt, Escherichia coli CFT073
ugccgauuucaacca

SEQ ID NO: 651561 - RNA, 13 nt, Escherichia coli CFT073
ugccgcaauggcc

SEQ ID NO: 651562 - RNA, 13 nt, Escherichia coli CFT073
ugccgcacaucac

SEQ ID NO: 651563 - RNA, 15 nt, Escherichia coli CFT073
ugccgcacaucaccg

SEQ ID NO: 651564 - RNA, 15 nt, Escherichia coli CFT073
ugccgcacauuuccc

SEQ ID NO: 651565 - RNA, 13 nt, Escherichia coli CFT073
ugccgcagcaccc

SEQ ID NO: 651566 - RNA, 15 nt, Escherichia coli CFT073
ugccgcacucugacc

SEQ ID NO: 651567 - RNA, 21 nt, Escherichia coli CFT073
ugccgcagacaaaauccugcc

SEQ ID NO: 651568 - RNA, 16 nt, Escherichia coli CFT073
ugccgauggcaaaagu

SEQ ID NO: 651569 - RNA, 14 nt, Escherichia coli CFT073
ugcccgugaugcaa

SEQ ID NO: 651570 - RNA, 17 nt, Escherichia coli CFT073
ugcccucaauaucuuuc

SEQ ID NO: 651571 - RNA, 17 nt, Escherichia coli CFT073
ugcccugcccgcugcca

SEQ ID NO: 651572 - RNA, 15 nt, Escherichia coli CFT073
ugcccuuuuaauaca

SEQ ID NO: 651573 - RNA, 12 nt, Escherichia coli CFT073
ugcccuuucaac

SEQ ID NO: 651574 - RNA, 14 nt, Escherichia coli CFT073
ugccgacuggcauc

SEQ ID NO: 651575 - RNA, 14 nt, Escherichia coli CFT073
ugccgaaccacuga

SEQ ID NO: 651576 - RNA, 15 nt, Escherichia coli CFT073
ugcccgucugcugcu

SEQ ID NO: 651577 - RNA, 17 nt, Escherichia coli CFT073
ugcccgggucagcgcca

SEQ ID NO: 651578 - RNA, 17 nt, Escherichia coli CFT073
ugcccggcgaaccgggc

SEQ ID NO: 651579 - RNA, 15 nt, Escherichia coli CFT073
ugcccgccgaccauc

SEQ ID NO: 651580 - RNA, 20 nt, Escherichia coli CFT073
ugcccgcguuucgcugcguc

SEQ ID NO: 651581 - RNA, 22 nt, Escherichia coli CFT073
ugcccgcguuucgcugcgucuu

SEQ ID NO: 651582 - RNA, 17 nt, Escherichia coli CFT073
ugcccgcuuaacguacu

SEQ ID NO: 651583 - RNA, 16 nt, Escherichia coli CFT073
ugcccgcugccaggau

SEQ ID NO: 651584 - RNA, 13 nt, Escherichia coli CFT073
ugcccgcugcgca

SEQ ID NO: 651585 - RNA, 22 nt, Escherichia coli CFT073
ugcccgcuuaacguacugcuga

SEQ ID NO: 651586 - RNA, 23 nt, Escherichia coli CFT073
ugcccggcacguuuuggcaggca

SEQ ID NO: 651587 - RNA, 19 nt, Escherichia coli CFT073
ugcccgaccagauaagaac

SEQ ID NO: 651588 - RNA, 12 nt, Escherichia coli CFT073
ugccccuggcug

SEQ ID NO: 651589 - RNA, 15 nt, Escherichia coli CFT073
ugccccuccgcacag

SEQ ID NO: 651590 - RNA, 22 nt, Escherichia coli CFT073
ugccccagcgcacuacgccgca

SEQ ID NO: 651591 - RNA, 16 nt, Escherichia coli CFT073
ugccccagaauuuucc

SEQ ID NO: 651592 - RNA, 21 nt, Escherichia coli CFT073
ugccccagagacaacccgcca

SEQ ID NO: 651593 - RNA, 12 nt, Escherichia coli CFT073
ugcccccagucg

SEQ ID NO: 651594 - RNA, 18 nt, Escherichia coli CFT073
ugccccauugcugaugca

SEQ ID NO: 651595 - RNA, 14 nt, Escherichia coli CFT073
ugccccagugggcu

SEQ ID NO: 651596 - RNA, 16 nt, Escherichia coli CFT073
ugcccaccgcauccag

SEQ ID NO: 651597 - RNA, 21 nt, Escherichia coli CFT073
ugccauagcgggcaaucagcg

SEQ ID NO: 651598 - RNA, 14 nt, Escherichia coli CFT073
ugccaucaccaacg

SEQ ID NO: 651599 - RNA, 18 nt, Escherichia coli CFT073
ugccaucacuauucagau

SEQ ID NO: 651600 - RNA, 17 nt, Escherichia coli CFT073
ugccauccccauucgga

SEQ ID NO: 651601 - RNA, 13 nt, Escherichia coli CFT073
ugccauccagcuu

SEQ ID NO: 651602 - RNA, 18 nt, Escherichia coli CFT073
ugccaucgcaugacgcaa

SEQ ID NO: 651603 - RNA, 13 nt, Escherichia coli CFT073
ugccaucucacuu

SEQ ID NO: 651604 - RNA, 19 nt, Escherichia coli CFT073
ugccaugaucguuaaaucc

SEQ ID NO: 651605 - RNA, 15 nt, Escherichia coli CFT073
ugccaugcacgcaaa

SEQ ID NO: 651606 - RNA, 18 nt, Escherichia coli CFT073
ugccaugcacgcaaaaac

SEQ ID NO: 651607 - RNA, 19 nt, Escherichia coli CFT073
ugccauuugaugaauuuua

SEQ ID NO: 651608 - RNA, 22 nt, Escherichia coli CFT073
ugccauuuugcaccuucagaau

SEQ ID NO: 651609 - RNA, 16 nt, Escherichia coli CFT073
ugcccaaucaaacuuc

SEQ ID NO: 651610 - RNA, 13 nt, Escherichia coli CFT073
ugcccaaagccaa

SEQ ID NO: 651611 - RNA, 14 nt, Escherichia coli CFT073
ugcccaaagccaau

SEQ ID NO: 651612 - RNA, 16 nt, Escherichia coli CFT073
ugcccaaagccaaucu

SEQ ID NO: 651613 - RNA, 14 nt, Escherichia coli CFT073
ugccauuccacaaa

SEQ ID NO: 651614 - RNA, 20 nt, Escherichia coli CFT073
ugccauuccacaaaaaccac

SEQ ID NO: 651615 - RNA, 15 nt, Escherichia coli CFT073
ugccauguuuuccuu

SEQ ID NO: 651616 - RNA, 15 nt, Escherichia coli CFT073
ugccauuaaaccaac

SEQ ID NO: 651617 - RNA, 15 nt, Escherichia coli CFT073
ugccauuaacuccac

SEQ ID NO: 651618 - RNA, 15 nt, Escherichia coli CFT073
ugccauucacuucau

SEQ ID NO: 651619 - RNA, 14 nt, Escherichia coli CFT073
ugccauucaguuug

SEQ ID NO: 651620 - RNA, 16 nt, Escherichia coli CFT073
ugccauguucaucaag

SEQ ID NO: 651621 - RNA, 23 nt, Escherichia coli CFT073
ugccagccacacugcggccagca

SEQ ID NO: 651622 - RNA, 13 nt, Escherichia coli CFT073
ugccagcagcacc

SEQ ID NO: 651623 - RNA, 16 nt, Escherichia coli CFT073
ugccagcacugccagc

SEQ ID NO: 651624 - RNA, 20 nt, Escherichia coli CFT073
ugccagcguaaauccugacg

SEQ ID NO: 651625 - RNA, 15 nt, Escherichia coli CFT073
ugccagcgacagaaa

SEQ ID NO: 651626 - RNA, 15 nt, Escherichia coli CFT073
ugccagcuuucaccu

SEQ ID NO: 651627 - RNA, 21 nt, Escherichia coli CFT073
ugccaggaccgcugaaauauc

SEQ ID NO: 651628 - RNA, 16 nt, Escherichia coli CFT073
ugccaggcaacagaua

SEQ ID NO: 651629 - RNA, 15 nt, Escherichia coli CFT073
ugccaggcuccagau

SEQ ID NO: 651630 - RNA, 17 nt, Escherichia coli CFT073
ugccaggcuccagauaa

SEQ ID NO: 651631 - RNA, 19 nt, Escherichia coli CFT073
ugccagcuugcuuuccagc

SEQ ID NO: 651632 - RNA, 19 nt, Escherichia coli CFT073
ugccagcguauaacacacc

SEQ ID NO: 651633 - RNA, 14 nt, Escherichia coli CFT073
ugccagcgugucga

SEQ ID NO: 651634 - RNA, 19 nt, Escherichia coli CFT073
ugccaguuucuuuuaacaa

SEQ ID NO: 651635 - RNA, 15 nt, Escherichia coli CFT073
ugccaguuuacccag

SEQ ID NO: 651636 - RNA, 14 nt, Escherichia coli CFT073
ugccaguuuauuuc

SEQ ID NO: 651637 - RNA, 15 nt, Escherichia coli CFT073
ugccaguuucgucag

SEQ ID NO: 651638 - RNA, 22 nt, Escherichia coli CFT073
ugccagucggggggaggcugca

SEQ ID NO: 651639 - RNA, 19 nt, Escherichia coli CFT073
ugccagucgguagugccgu

SEQ ID NO: 651640 - RNA, 14 nt, Escherichia coli CFT073
ugccagugcaaaaa

SEQ ID NO: 651641 - RNA, 15 nt, Escherichia coli CFT073
ugccagugcaaaaaa

SEQ ID NO: 651642 - RNA, 16 nt, Escherichia coli CFT073
ugccaguggagccauc

SEQ ID NO: 651643 - RNA, 18 nt, Escherichia coli CFT073
ugccaguuaccaccgcca

SEQ ID NO: 651644 - RNA, 19 nt, Escherichia coli CFT073
ugccaguaauccggcuucc

SEQ ID NO: 651645 - RNA, 16 nt, Escherichia coli CFT073
ugccaguacgcccacg

SEQ ID NO: 651646 - RNA, 14 nt, Escherichia coli CFT073
ugccaguacugcag

SEQ ID NO: 651647 - RNA, 18 nt, Escherichia coli CFT073
ugccaggugaucccccug

SEQ ID NO: 651648 - RNA, 14 nt, Escherichia coli CFT073
ugccagggugcagg

SEQ ID NO: 651649 - RNA, 16 nt, Escherichia coli CFT073
ugccaggcccaauaau

SEQ ID NO: 651650 - RNA, 23 nt, Escherichia coli CFT073
ugccaguaagcaguccagcgccu

SEQ ID NO: 651651 - RNA, 11 nt, Escherichia coli CFT073
ugccagguaac

SEQ ID NO: 651652 - RNA, 15 nt, Escherichia coli CFT073
ugccagaucggccau

SEQ ID NO: 651653 - RNA, 13 nt, Escherichia coli CFT073
ugccacuggaugu

SEQ ID NO: 651654 - RNA, 11 nt, Escherichia coli CFT073
ugccacuucau

SEQ ID NO: 651655 - RNA, 12 nt, Escherichia coli CFT073
ugccacuggccu

SEQ ID NO: 651656 - RNA, 11 nt, Escherichia coli CFT073
ugccagcagag

SEQ ID NO: 651657 - RNA, 23 nt, Escherichia coli CFT073
ugccagcagaggaauaucuuccc

SEQ ID NO: 651658 - RNA, 22 nt, Escherichia coli CFT073
ugccagcaccacuuuacgggca

SEQ ID NO: 651659 - RNA, 12 nt, Escherichia coli CFT073
ugccagcaccac

SEQ ID NO: 651660 - RNA, 18 nt, Escherichia coli CFT073
ugccagcaacuggcuugc

SEQ ID NO: 651661 - RNA, 19 nt, Escherichia coli CFT073
ugccagcaagcgcaccgau

SEQ ID NO: 651662 - RNA, 16 nt, Escherichia coli CFT073
ugccagauuuucuuca

SEQ ID NO: 651663 - RNA, 16 nt, Escherichia coli CFT073
ugccagaugcagcggu

SEQ ID NO: 651664 - RNA, 19 nt, Escherichia coli CFT073
ugccagauggcauccagag

SEQ ID NO: 651665 - RNA, 21 nt, Escherichia coli CFT073
ugccacacaggccauuucccc

SEQ ID NO: 651666 - RNA, 19 nt, Escherichia coli CFT073
ugccacaccugccgggaau

SEQ ID NO: 651667 - RNA, 16 nt, Escherichia coli CFT073
ugccacacgacgccag

SEQ ID NO: 651668 - RNA, 17 nt, Escherichia coli CFT073
ugccacacgacgccagc

SEQ ID NO: 651669 - RNA, 18 nt, Escherichia coli CFT073
ugccacacgacgccagcc

SEQ ID NO: 651670 - RNA, 23 nt, Escherichia coli CFT073
ugccacaguuuuacugcagccag

SEQ ID NO: 651671 - RNA, 16 nt, Escherichia coli CFT073
ugccacauccccuccc

SEQ ID NO: 651672 - RNA, 13 nt, Escherichia coli CFT073
ugccaccacacca

SEQ ID NO: 651673 - RNA, 15 nt, Escherichia coli CFT073
ugccaccacaccaga

SEQ ID NO: 651674 - RNA, 16 nt, Escherichia coli CFT073
ugccacgccacgcugc

SEQ ID NO: 651675 - RNA, 19 nt, Escherichia coli CFT073
ugccacaaucucgcccgcu

SEQ ID NO: 651676 - RNA, 23 nt, Escherichia coli CFT073
ugccacaaucucgcccgcuucau

SEQ ID NO: 651677 - RNA, 17 nt, Escherichia coli CFT073
ugccaaggucggggucg

SEQ ID NO: 651678 - RNA, 22 nt, Escherichia coli CFT073
ugccaaauguauccaucaccag

SEQ ID NO: 651679 - RNA, 19 nt, Escherichia coli CFT073
ugccaaccaacgcgccgca

SEQ ID NO: 651680 - RNA, 18 nt, Escherichia coli CFT073
ugcauuuucuaugcugcc

SEQ ID NO: 651681 - RNA, 14 nt, Escherichia coli CFT073
ugcauuuuucgcuu

SEQ ID NO: 651682 - RNA, 16 nt, Escherichia coli CFT073
ugcauuuuucgcuuuu

SEQ ID NO: 651683 - RNA, 16 nt, Escherichia coli CFT073
ugcauuuuuugucggc

SEQ ID NO: 651684 - RNA, 21 nt, Escherichia coli CFT073
ugccaaagaaugcagucagua

SEQ ID NO: 651685 - RNA, 22 nt, Escherichia coli CFT073
ugccaaagaaugcagucaguac

SEQ ID NO: 651686 - RNA, 20 nt, Escherichia coli CFT073
ugccaaagucaucaauugca

SEQ ID NO: 651687 - RNA, 15 nt, Escherichia coli CFT073
ugccaaauauuucuu

SEQ ID NO: 651688 - RNA, 13 nt, Escherichia coli CFT073
ugccaaauuuacu

SEQ ID NO: 651689 - RNA, 14 nt, Escherichia coli CFT073
ugcauaucaauuag

SEQ ID NO: 651690 - RNA, 13 nt, Escherichia coli CFT073
ugcauaucggcau

SEQ ID NO: 651691 - RNA, 22 nt, Escherichia coli CFT073
ugcauaugaaugccagccacga

SEQ ID NO: 651692 - RNA, 16 nt, Escherichia coli CFT073
ugcauccacuuugguu

SEQ ID NO: 651693 - RNA, 15 nt, Escherichia coli CFT073
ugcagggugagggca

SEQ ID NO: 651694 - RNA, 21 nt, Escherichia coli CFT073
ugcagggcaaacuccgagaga

SEQ ID NO: 651695 - RNA, 18 nt, Escherichia coli CFT073
ugcagggcaauagccagc

SEQ ID NO: 651696 - RNA, 21 nt, Escherichia coli CFT073
ugcagggcaauagccagcgcc

SEQ ID NO: 651697 - RNA, 17 nt, Escherichia coli CFT073
ugcaggcggcucaucac

SEQ ID NO: 651698 - RNA, 17 nt, Escherichia coli CFT073
ugcaggcgcucaccauu

SEQ ID NO: 651699 - RNA, 17 nt, Escherichia coli CFT073
ugcaucgcgaccaauca

SEQ ID NO: 651700 - RNA, 18 nt, Escherichia coli CFT073
ugcaucccggcaggaaua

SEQ ID NO: 651701 - RNA, 20 nt, Escherichia coli CFT073
ugcauccgauuguuccugcu

SEQ ID NO: 651702 - RNA, 21 nt, Escherichia coli CFT073
ugcauccugcaccacaacacc

SEQ ID NO: 651703 - RNA, 15 nt, Escherichia coli CFT073
ugcaucgagcgcagc

SEQ ID NO: 651704 - RNA, 20 nt, Escherichia coli CFT073
ugcaucgagcgcagcaacau

SEQ ID NO: 651705 - RNA, 14 nt, Escherichia coli CFT073
ugcagccaggccau

SEQ ID NO: 651706 - RNA, 22 nt, Escherichia coli CFT073
ugcagcauauucgccguuccca

SEQ ID NO: 651707 - RNA, 16 nt, Escherichia coli CFT073
ugcagcaucgggauag

SEQ ID NO: 651708 - RNA, 23 nt, Escherichia coli CFT073
ugcagcaugauuucaucaucagg

SEQ ID NO: 651709 - RNA, 16 nt, Escherichia coli CFT073
ugcagcauagaagaaa

SEQ ID NO: 651710 - RNA, 17 nt, Escherichia coli CFT073
ugcagcauagaagaaau

SEQ ID NO: 651711 - RNA, 23 nt, Escherichia coli CFT073
ugcagagagucacgcagcaucag

SEQ ID NO: 651712 - RNA, 19 nt, Escherichia coli CFT073
ugcagagaaguguacgaac

SEQ ID NO: 651713 - RNA, 19 nt, Escherichia coli CFT073
ugcagaauugcagaggcuc

SEQ ID NO: 651714 - RNA, 21 nt, Escherichia coli CFT073
ugcagacguagaaaaucaccc

SEQ ID NO: 651715 - RNA, 13 nt, Escherichia coli CFT073
ugcagacugaagc

SEQ ID NO: 651716 - RNA, 16 nt, Escherichia coli CFT073
ugcagacugaagcucc

SEQ ID NO: 651717 - RNA, 22 nt, Escherichia coli CFT073
ugcaggagcgauuaugaaacaa

SEQ ID NO: 651718 - RNA, 13 nt, Escherichia coli CFT073
ugcaggcaccagc

SEQ ID NO: 651719 - RNA, 19 nt, Escherichia coli CFT073
ugcagcgcaaucgccucca

SEQ ID NO: 651720 - RNA, 21 nt, Escherichia coli CFT073
ugcagcgcagaccauaaaugc

SEQ ID NO: 651721 - RNA, 19 nt, Escherichia coli CFT073
ugcagcuguugcgccagca

SEQ ID NO: 651722 - RNA, 22 nt, Escherichia coli CFT073
ugcagcggagaucgccagcccu

SEQ ID NO: 651723 - RNA, 23 nt, Escherichia coli CFT073
ugcaggaacaggcgauuuaaucc

SEQ ID NO: 651724 - RNA, 14 nt, Escherichia coli CFT073
ugcaggaagcucug

SEQ ID NO: 651725 - RNA, 17 nt, Escherichia coli CFT073
ugcagaaaaucuuucag

SEQ ID NO: 651726 - RNA, 23 nt, Escherichia coli CFT073
ugcagaaauaaaagccugaucaa

SEQ ID NO: 651727 - RNA, 17 nt, Escherichia coli CFT073
ugcacgguuuuuccagc

SEQ ID NO: 651728 - RNA, 14 nt, Escherichia coli CFT073
ugcacuuucaguac

SEQ ID NO: 651729 - RNA, 22 nt, Escherichia coli CFT073
ugcacgcgauggcuuuccaccu

SEQ ID NO: 651730 - RNA, 14 nt, Escherichia coli CFT073
ugcacgcugccugg

SEQ ID NO: 651731 - RNA, 18 nt, Escherichia coli CFT073
ugcacgaugccucaucac

SEQ ID NO: 651732 - RNA, 14 nt, Escherichia coli CFT073
ugcacgaugcugcg

SEQ ID NO: 651733 - RNA, 19 nt, Escherichia coli CFT073
ugcaccuuguuucagcacg

SEQ ID NO: 651734 - RNA, 15 nt, Escherichia coli CFT073
ugcaccuuuaacccc

SEQ ID NO: 651735 - RNA, 17 nt, Escherichia coli CFT073
ugcaccccacaaacaga

SEQ ID NO: 651736 - RNA, 14 nt, Escherichia coli CFT073
ugauuucuuauuca

SEQ ID NO: 651737 - RNA, 17 nt, Escherichia coli CFT073
ugauuucuuauucauau

SEQ ID NO: 651738 - RNA, 20 nt, Escherichia coli CFT073
ugauuucuuauucauaucuu

SEQ ID NO: 651739 - RNA, 13 nt, Escherichia coli CFT073
ugauuugucauau

SEQ ID NO: 651740 - RNA, 12 nt, Escherichia coli CFT073
uguuggcuuccu

SEQ ID NO: 651741 - RNA, 13 nt, Escherichia coli CFT073
uguuggcuaucua

SEQ ID NO: 651742 - RNA, 16 nt, Escherichia coli CFT073
uguuggaacccgcagc

SEQ ID NO: 651743 - RNA, 12 nt, Escherichia coli CFT073
uguuguauucag

SEQ ID NO: 651744 - RNA, 11 nt, Escherichia coli CFT073
uguugucccag

SEQ ID NO: 651745 - RNA, 21 nt, Escherichia coli CFT073
uguuguauccuguuuuuaagu

SEQ ID NO: 651746 - RNA, 23 nt, Escherichia coli CFT073
uguuuagccgcuucugcagcuuu

SEQ ID NO: 651747 - RNA, 13 nt, Escherichia coli CFT073
uguuuaaccaaca

SEQ ID NO: 651748 - RNA, 18 nt, Escherichia coli CFT073
uguuuaaggaaaaacgaa

SEQ ID NO: 651749 - RNA, 15 nt, Escherichia coli CFT073
uguugaggaagcgca

SEQ ID NO: 651750 - RNA, 21 nt, Escherichia coli CFT073
uguugacgcgugcgccgaguu

SEQ ID NO: 651751 - RNA, 18 nt, Escherichia coli CFT073
uguugacucuugucacug

SEQ ID NO: 651752 - RNA, 20 nt, Escherichia coli CFT073
uguugaauuccgaauuucau

SEQ ID NO: 651753 - RNA, 13 nt, Escherichia coli CFT073
uguugaaauacaa

SEQ ID NO: 651754 - RNA, 14 nt, Escherichia coli CFT073
uguucuuuuucaga

SEQ ID NO: 651755 - RNA, 14 nt, Escherichia coli CFT073
uguucuucaauggu

SEQ ID NO: 651756 - RNA, 13 nt, Escherichia coli CFT073
uguucuggaaaaa

SEQ ID NO: 651757 - RNA, 14 nt, Escherichia coli CFT073
uguucuggaaaaaa

SEQ ID NO: 651758 - RNA, 19 nt, Escherichia coli CFT073
uguugcugugcaccgccca

SEQ ID NO: 651759 - RNA, 19 nt, Escherichia coli CFT073
uguugcuggauccccugcc

SEQ ID NO: 651760 - RNA, 19 nt, Escherichia coli CFT073
uguugcaccaucaggcaua

SEQ ID NO: 651761 - RNA, 15 nt, Escherichia coli CFT073
uguugcaggaacaga

SEQ ID NO: 651762 - RNA, 18 nt, Escherichia coli CFT073
uguucgcauccggcacaa

SEQ ID NO: 651763 - RNA, 14 nt, Escherichia coli CFT073
uguucucuucugcu

SEQ ID NO: 651764 - RNA, 17 nt, Escherichia coli CFT073
uguucugaggugagcau

SEQ ID NO: 651765 - RNA, 14 nt, Escherichia coli CFT073
uguucguuauuggg

SEQ ID NO: 651766 - RNA, 18 nt, Escherichia coli CFT073
uguucccgcgccucaggc

SEQ ID NO: 651767 - RNA, 19 nt, Escherichia coli CFT073
uguucccacgcacagaaca

SEQ ID NO: 651768 - RNA, 19 nt, Escherichia coli CFT073
uguuccggcguggcauuaa

SEQ ID NO: 651769 - RNA, 15 nt, Escherichia coli CFT073
uguuccugcucauca

SEQ ID NO: 651770 - RNA, 20 nt, Escherichia coli CFT073
uguucauauuaaccucucag

SEQ ID NO: 651771 - RNA, 20 nt, Escherichia coli CFT073
uguucaucaugaacugggcu

SEQ ID NO: 651772 - RNA, 21 nt, Escherichia coli CFT073
uguuccacucuuucagcacca

SEQ ID NO: 651773 - RNA, 21 nt, Escherichia coli CFT073
uguucauuuuguaggccugau

SEQ ID NO: 651774 - RNA, 16 nt, Escherichia coli CFT073
uguuaucccgaugaug

SEQ ID NO: 651775 - RNA, 12 nt, Escherichia coli CFT073
uguuaugcacac

SEQ ID NO: 651776 - RNA, 15 nt, Escherichia coli CFT073
uguuauucacagaga

SEQ ID NO: 651777 - RNA, 20 nt, Escherichia coli CFT073
uguuagcgucaacuuuagca

SEQ ID NO: 651778 - RNA, 20 nt, Escherichia coli CFT073
uguuagcccugucgaggcca

SEQ ID NO: 651779 - RNA, 14 nt, Escherichia coli CFT073
uguucaaaggcaga

SEQ ID NO: 651780 - RNA, 12 nt, Escherichia coli CFT073
uguucaacaauu

SEQ ID NO: 651781 - RNA, 13 nt, Escherichia coli CFT073
uguucaagagcuu

SEQ ID NO: 651782 - RNA, 20 nt, Escherichia coli CFT073
uguucaccacugaauaacau

SEQ ID NO: 651783 - RNA, 21 nt, Escherichia coli CFT073
uguucagccguuuaauugccu

SEQ ID NO: 651784 - RNA, 18 nt, Escherichia coli CFT073
uguucacgaccaucaacc

SEQ ID NO: 651785 - RNA, 20 nt, Escherichia coli CFT073
uguucacgaccaucaaccuu

SEQ ID NO: 651786 - RNA, 17 nt, Escherichia coli CFT073
uguucagaaagcgccag

SEQ ID NO: 651787 - RNA, 11 nt, Escherichia coli CFT073
uuaaaauauaa

SEQ ID NO: 651788 - RNA, 18 nt, Escherichia coli CFT073
uuaaaaagcagguuguua

SEQ ID NO: 651789 - RNA, 14 nt, Escherichia coli CFT073
uuaaaaaacagugc

SEQ ID NO: 651790 - RNA, 16 nt, Escherichia coli CFT073
uuaaacaucucaucaa

SEQ ID NO: 651791 - RNA, 21 nt, Escherichia coli CFT073
uuaaacagaauacccagcaau

SEQ ID NO: 651792 - RNA, 18 nt, Escherichia coli CFT073
uuaaacacgggguuaaau

SEQ ID NO: 651793 - RNA, 22 nt, Escherichia coli CFT073
uuaaacacgauucguauaauuu

SEQ ID NO: 651794 - RNA, 16 nt, Escherichia coli CFT073
uuaaacagcacagcca

SEQ ID NO: 651795 - RNA, 23 nt, Escherichia coli CFT073
uuaaacagcccuuugauuugucu

SEQ ID NO: 651796 - RNA, 23 nt, Escherichia coli CFT073
uuaaaccacuuaacguuaccuuu

SEQ ID NO: 651797 - RNA, 18 nt, Escherichia coli CFT073
uuaaaccaggaacaguga

SEQ ID NO: 651798 - RNA, 15 nt, Escherichia coli CFT073
uuaaaccaucagcca

SEQ ID NO: 651799 - RNA, 22 nt, Escherichia coli CFT073
uuaaaaugaauaacuuccugua

SEQ ID NO: 651800 - RNA, 20 nt, Escherichia coli CFT073
uuaaacgggucaucaaaauc

SEQ ID NO: 651801 - RNA, 22 nt, Escherichia coli CFT073
uuaaacgcaguaaacgccaggg

SEQ ID NO: 651802 - RNA, 22 nt, Escherichia coli CFT073
uuaaacucaccuuguguuuugg

SEQ ID NO: 651803 - RNA, 13 nt, Escherichia coli CFT073
uuaaacuggaaaa

SEQ ID NO: 651804 - RNA, 15 nt, Escherichia coli CFT073
uuaaacuuucauaaa

SEQ ID NO: 651805 - RNA, 15 nt, Escherichia coli CFT073
uuaaagauaaugcca

SEQ ID NO: 651806 - RNA, 17 nt, Escherichia coli CFT073
uuaaagauaaugccagc

SEQ ID NO: 651807 - RNA, 13 nt, Escherichia coli CFT073
uuaaagaaaguaa

SEQ ID NO: 651808 - RNA, 13 nt, Escherichia coli CFT073
uguuucguucaaa

SEQ ID NO: 651809 - RNA, 16 nt, Escherichia coli CFT073
uguuucuuauucagaa

SEQ ID NO: 651810 - RNA, 14 nt, Escherichia coli CFT073
uguuucuggcaucc

SEQ ID NO: 651811 - RNA, 13 nt, Escherichia coli CFT073
uguuucucuuucu

SEQ ID NO: 651812 - RNA, 15 nt, Escherichia coli CFT073
uguuugacaacucau

SEQ ID NO: 651813 - RNA, 19 nt, Escherichia coli CFT073
uguuugcgacaaacuucca

SEQ ID NO: 651814 - RNA, 18 nt, Escherichia coli CFT073
uguuugcaguaaaccaca

SEQ ID NO: 651815 - RNA, 16 nt, Escherichia coli CFT073
uguuuauucacauaga

SEQ ID NO: 651816 - RNA, 20 nt, Escherichia coli CFT073
uguuuaucuuccagcauuuc

SEQ ID NO: 651817 - RNA, 14 nt, Escherichia coli CFT073
uguuuauaagccau

SEQ ID NO: 651818 - RNA, 19 nt, Escherichia coli CFT073
uguuucgacaauaaucaac

SEQ ID NO: 651819 - RNA, 18 nt, Escherichia coli CFT073
uguuucccccacugugca

SEQ ID NO: 651820 - RNA, 22 nt, Escherichia coli CFT073
uguuucauaguuuuaccuuucu

SEQ ID NO: 651821 - RNA, 18 nt, Escherichia coli CFT073
uguuucauccaggcacug

SEQ ID NO: 651822 - RNA, 22 nt, Escherichia coli CFT073
uguuucauccaggcacuggccu

SEQ ID NO: 651823 - RNA, 15 nt, Escherichia coli CFT073
uguuuuucucugccg

SEQ ID NO: 651824 - RNA, 22 nt, Escherichia coli CFT073
uguuuuuaaaccaacuucauac

SEQ ID NO: 651825 - RNA, 18 nt, Escherichia coli CFT073
uguuuuguccgauuucgc

SEQ ID NO: 651826 - RNA, 12 nt, Escherichia coli CFT073
uguuuuccagca

SEQ ID NO: 651827 - RNA, 13 nt, Escherichia coli CFT073
uguuuuccagcac

SEQ ID NO: 651828 - RNA, 20 nt, Escherichia coli CFT073
uguuuuaaauauuguuuuua

SEQ ID NO: 651829 - RNA, 22 nt, Escherichia coli CFT073
uguuuuaacacacaauuaccuu

SEQ ID NO: 651830 - RNA, 15 nt, Escherichia coli CFT073
uguuuggugcagaau

SEQ ID NO: 651831 - RNA, 14 nt, Escherichia coli CFT073
uguuuuaagguuuc

SEQ ID NO: 651832 - RNA, 21 nt, Escherichia coli CFT073
uuaacgccuucccuuucagca

SEQ ID NO: 651833 - RNA, 18 nt, Escherichia coli CFT073
uuaacgcgggcuucuucu

SEQ ID NO: 651834 - RNA, 19 nt, Escherichia coli CFT073
uuaacggcauuuuccagcu

SEQ ID NO: 651835 - RNA, 23 nt, Escherichia coli CFT073
uuaacgcagcaaaagcaggcacc

SEQ ID NO: 651836 - RNA, 13 nt, Escherichia coli CFT073
uuaacgcauaaua

SEQ ID NO: 651837 - RNA, 15 nt, Escherichia coli CFT073
uuaacgcauaauaaa

SEQ ID NO: 651838 - RNA, 17 nt, Escherichia coli CFT073
uuaacgcgaaauaauca

SEQ ID NO: 651839 - RNA, 23 nt, Escherichia coli CFT073
uuaacgcgaaauaaucaaaugaa

SEQ ID NO: 651840 - RNA, 19 nt, Escherichia coli CFT073
uuaacauuacuaaacauuu

SEQ ID NO: 651841 - RNA, 18 nt, Escherichia coli CFT073
uuaacagauugagaauaa

SEQ ID NO: 651842 - RNA, 23 nt, Escherichia coli CFT073
uuaacagauugagaauaaugccu

SEQ ID NO: 651843 - RNA, 16 nt, Escherichia coli CFT073
uuaacagguauagaau

SEQ ID NO: 651844 - RNA, 12 nt, Escherichia coli CFT073
uuaacaucccca

SEQ ID NO: 651845 - RNA, 13 nt, Escherichia coli CFT073
uuaacauccccau

SEQ ID NO: 651846 - RNA, 11 nt, Escherichia coli CFT073
uuaagaaaacg

SEQ ID NO: 651847 - RNA, 17 nt, Escherichia coli CFT073
uuaagaugaagaaaaua

SEQ ID NO: 651848 - RNA, 13 nt, Escherichia coli CFT073
uuaagcaaauaau

SEQ ID NO: 651849 - RNA, 18 nt, Escherichia coli CFT073
uuaagcacguuacccaau

SEQ ID NO: 651850 - RNA, 13 nt, Escherichia coli CFT073
uuaagcacuuuau

SEQ ID NO: 651851 - RNA, 16 nt, Escherichia coli CFT073
uuaagcauuggcaugc

SEQ ID NO: 651852 - RNA, 17 nt, Escherichia coli CFT073
uuaacuucaucggcaaa

SEQ ID NO: 651853 - RNA, 19 nt, Escherichia coli CFT073
uuaauaaagugcgcuuugu

SEQ ID NO: 651854 - RNA, 20 nt, Escherichia coli CFT073
uuaauaaagugcgcuuugug

SEQ ID NO: 651855 - RNA, 22 nt, Escherichia coli CFT073
uuaauaaugccgcaacgccaua

SEQ ID NO: 651856 - RNA, 15 nt, Escherichia coli CFT073
uuaauaaaacgggau

SEQ ID NO: 651857 - RNA, 20 nt, Escherichia coli CFT073
uuaagccaguucucaccaaa

SEQ ID NO: 651858 - RNA, 15 nt, Escherichia coli CFT073
uuaagccaucaucaa

SEQ ID NO: 651859 - RNA, 18 nt, Escherichia coli CFT073
uuaagccaucaucaauau

SEQ ID NO: 651860 - RNA, 13 nt, Escherichia coli CFT073
uuaaucagugcaa

SEQ ID NO: 651861 - RNA, 13 nt, Escherichia coli CFT073
uuaaucaucaaug

SEQ ID NO: 651862 - RNA, 16 nt, Escherichia coli CFT073
uuaaucaucaugcuua

SEQ ID NO: 651863 - RNA, 20 nt, Escherichia coli CFT073
uuaaucaucaugcuuaaaua

SEQ ID NO: 651864 - RNA, 23 nt, Escherichia coli CFT073
uuaaucagauaaucaacccccac

SEQ ID NO: 651865 - RNA, 15 nt, Escherichia coli CFT073
uuaauaccugccugg

SEQ ID NO: 651866 - RNA, 14 nt, Escherichia coli CFT073
uuaauauauauuau

SEQ ID NO: 651867 - RNA, 20 nt, Escherichia coli CFT073
uuaaaugacaauguggccuu

SEQ ID NO: 651868 - RNA, 17 nt, Escherichia coli CFT073
uuaaauggacgcaaaaa

SEQ ID NO: 651869 - RNA, 19 nt, Escherichia coli CFT073
uuaaaugcccgacaaaaau

SEQ ID NO: 651870 - RNA, 20 nt, Escherichia coli CFT073
uuaaaugcccgacaaaaauu

SEQ ID NO: 651871 - RNA, 17 nt, Escherichia coli CFT073
uuaaaugucauacuauu

SEQ ID NO: 651872 - RNA, 16 nt, Escherichia coli CFT073
uuaaaugucaugacau

SEQ ID NO: 651873 - RNA, 17 nt, Escherichia coli CFT073
uuaaauugccugugaag

SEQ ID NO: 651874 - RNA, 18 nt, Escherichia coli CFT073
uuaacaacauuaccgaau

SEQ ID NO: 651875 - RNA, 19 nt, Escherichia coli CFT073
uuaacaauaacaauuaucu

SEQ ID NO: 651876 - RNA, 18 nt, Escherichia coli CFT073
uuaacaauauuaacaaca

SEQ ID NO: 651877 - RNA, 21 nt, Escherichia coli CFT073
uuaacaauauuaacaacauua

SEQ ID NO: 651878 - RNA, 21 nt, Escherichia coli CFT073
uuaaauccuuagcagacguuu

SEQ ID NO: 651879 - RNA, 15 nt, Escherichia coli CFT073
uuaaaucauccugaa

SEQ ID NO: 651880 - RNA, 15 nt, Escherichia coli CFT073
uuaaauauccuugca

SEQ ID NO: 651881 - RNA, 16 nt, Escherichia coli CFT073
uuaaauauuguuuuua

SEQ ID NO: 651882 - RNA, 14 nt, Escherichia coli CFT073
uuaaauaccaagcc

SEQ ID NO: 651883 - RNA, 18 nt, Escherichia coli CFT073
uuaaaguaguaaguagca

SEQ ID NO: 651884 - RNA, 12 nt, Escherichia coli CFT073
uuaaagccggug

SEQ ID NO: 651885 - RNA, 14 nt, Escherichia coli CFT073
uuaaagcacaaaaa

SEQ ID NO: 651886 - RNA, 17 nt, Escherichia coli CFT073
uuaaaggcaccaauauu

SEQ ID NO: 651887 - RNA, 13 nt, Escherichia coli CFT073
uuacgcucccacg

SEQ ID NO: 651888 - RNA, 21 nt, Escherichia coli CFT073
uuacgccggaaaguuaauuaa

SEQ ID NO: 651889 - RNA, 16 nt, Escherichia coli CFT073
uuacgccgagcgccag

SEQ ID NO: 651890 - RNA, 23 nt, Escherichia coli CFT073
uuacgccgagcgccagccauuca

SEQ ID NO: 651891 - RNA, 22 nt, Escherichia coli CFT073
uuacgccgcaucaggccgccag

SEQ ID NO: 651892 - RNA, 19 nt, Escherichia coli CFT073
uuacgcaucgguacaauaa

SEQ ID NO: 651893 - RNA, 20 nt, Escherichia coli CFT073
uuacgcaucgguacaauaaa

SEQ ID NO: 651894 - RNA, 13 nt, Escherichia coli CFT073
uuacuacaaacaa

SEQ ID NO: 651895 - RNA, 16 nt, Escherichia coli CFT073
uuacgggcaaucuccu

SEQ ID NO: 651896 - RNA, 23 nt, Escherichia coli CFT073
uuacgggcgaaguucgccaucaa

SEQ ID NO: 651897 - RNA, 15 nt, Escherichia coli CFT073
uuacugucguuuaga

SEQ ID NO: 651898 - RNA, 17 nt, Escherichia coli CFT073
uuacuauccugaaagcu

SEQ ID NO: 651899 - RNA, 13 nt, Escherichia coli CFT073
uuacuaucuucaa

SEQ ID NO: 651900 - RNA, 16 nt, Escherichia coli CFT073
uuacucguccauagua

SEQ ID NO: 651901 - RNA, 17 nt, Escherichia coli CFT073
uuacucucguuccacuc

SEQ ID NO: 651902 - RNA, 13 nt, Escherichia coli CFT073
uuacucuuaucaa

SEQ ID NO: 651903 - RNA, 20 nt, Escherichia coli CFT073
uuacucucuuucgcuugaca

SEQ ID NO: 651904 - RNA, 19 nt, Escherichia coli CFT073
uuagaaaauuauuuuaaau

SEQ ID NO: 651905 - RNA, 16 nt, Escherichia coli CFT073
uuagacacaucagcaa

SEQ ID NO: 651906 - RNA, 20 nt, Escherichia coli CFT073
uuagacacaucagcaacgcu

SEQ ID NO: 651907 - RNA, 16 nt, Escherichia coli CFT073
uuagacaucaaaauua

SEQ ID NO: 651908 - RNA, 16 nt, Escherichia coli CFT073
uuagcguguuccagcg

SEQ ID NO: 651909 - RNA, 13 nt, Escherichia coli CFT073
uuagcaagacuuu

SEQ ID NO: 651910 - RNA, 15 nt, Escherichia coli CFT073
uuagcgccagccaga

SEQ ID NO: 651911 - RNA, 19 nt, Escherichia coli CFT073
uuagcgacaaaucuuucac

SEQ ID NO: 651912 - RNA, 21 nt, Escherichia coli CFT073
uuagcaaacgacacaugcuga

SEQ ID NO: 651913 - RNA, 20 nt, Escherichia coli CFT073
uuagcaaagaacguaaucaa

SEQ ID NO: 651914 - RNA, 22 nt, Escherichia coli CFT073
uuagauagccucaaauuccuua

SEQ ID NO: 651915 - RNA, 15 nt, Escherichia coli CFT073
uuacaccaugccacu

SEQ ID NO: 651916 - RNA, 13 nt, Escherichia coli CFT073
uuacacugaaaaa

SEQ ID NO: 651917 - RNA, 13 nt, Escherichia coli CFT073
uuacaaccacaua

SEQ ID NO: 651918 - RNA, 22 nt, Escherichia coli CFT073
uuacaagaaucaugccaaaaau

SEQ ID NO: 651919 - RNA, 19 nt, Escherichia coli CFT073
uuacacaaguccagcaccg

SEQ ID NO: 651920 - RNA, 14 nt, Escherichia coli CFT073
uuacacaaugcaag

SEQ ID NO: 651921 - RNA, 15 nt, Escherichia coli CFT073
uuacaaaaugacauu

SEQ ID NO: 651922 - RNA, 18 nt, Escherichia coli CFT073
uuaauuuuuuaauaaaaa

SEQ ID NO: 651923 - RNA, 10 nt, Escherichia coli CFT073
uuacaaaaag

SEQ ID NO: 651924 - RNA, 22 nt, Escherichia coli CFT073
uuaaucuguugaaaaaaggcuu

SEQ ID NO: 651925 - RNA, 17 nt, Escherichia coli CFT073
uuaaucuuccagaucac

SEQ ID NO: 651926 - RNA, 19 nt, Escherichia coli CFT073
uuaaucagugcaaucagcg

SEQ ID NO: 651927 - RNA, 22 nt, Escherichia coli CFT073
uuaauccagacugcgcauuaaa

SEQ ID NO: 651928 - RNA, 22 nt, Escherichia coli CFT073
uuaaucugcccguagcccauca

SEQ ID NO: 651929 - RNA, 16 nt, Escherichia coli CFT073
uuaauuuucgcccguu

SEQ ID NO: 651930 - RNA, 17 nt, Escherichia coli CFT073
uuaauuucaggcuguca

SEQ ID NO: 651931 - RNA, 13 nt, Escherichia coli CFT073
uuaccgucuuucg

SEQ ID NO: 651932 - RNA, 15 nt, Escherichia coli CFT073
uuaccuccgcuuugu

SEQ ID NO: 651933 - RNA, 15 nt, Escherichia coli CFT073
uuaccuuuaaucuua

SEQ ID NO: 651934 - RNA, 17 nt, Escherichia coli CFT073
uuaccuuuugacugaag

SEQ ID NO: 651935 - RNA, 21 nt, Escherichia coli CFT073
uuaccuuuugacugaagguaa

SEQ ID NO: 651936 - RNA, 16 nt, Escherichia coli CFT073
uuaccuuuugcugucu

SEQ ID NO: 651937 - RNA, 21 nt, Escherichia coli CFT073
uuacgauggcagggcagcaug

SEQ ID NO: 651938 - RNA, 19 nt, Escherichia coli CFT073
uuacgauccaccaccgcaa

SEQ ID NO: 651939 - RNA, 19 nt, Escherichia coli CFT073
uuacauauauuacucauua

SEQ ID NO: 651940 - RNA, 20 nt, Escherichia coli CFT073
uuacauauauuacucauuaa

SEQ ID NO: 651941 - RNA, 15 nt, Escherichia coli CFT073
uuacauacgcucuac

SEQ ID NO: 651942 - RNA, 11 nt, Escherichia coli CFT073
uuacaucauca

SEQ ID NO: 651943 - RNA, 22 nt, Escherichia coli CFT073
uuacaucaucagaaaugccagu

SEQ ID NO: 651944 - RNA, 16 nt, Escherichia coli CFT073
uuacaucauucaaugc

SEQ ID NO: 651945 - RNA, 17 nt, Escherichia coli CFT073
uuaccacgauauguuca

SEQ ID NO: 651946 - RNA, 13 nt, Escherichia coli CFT073
uuaccagcgcagg

SEQ ID NO: 651947 - RNA, 16 nt, Escherichia coli CFT073
uuaccaguacaccaau

SEQ ID NO: 651948 - RNA, 12 nt, Escherichia coli CFT073
uuacccaaucgc

SEQ ID NO: 651949 - RNA, 13 nt, Escherichia coli CFT073
uuacccagauaau

SEQ ID NO: 651950 - RNA, 22 nt, Escherichia coli CFT073
uuaccgcugucgaucagagaac

SEQ ID NO: 651951 - RNA, 19 nt, Escherichia coli CFT073
uuaccggugccagcaacug

SEQ ID NO: 651952 - RNA, 23 nt, Escherichia coli CFT073
uguguuuuuacgcaggcuggagc

SEQ ID NO: 651953 - RNA, 17 nt, Escherichia coli CFT073
ugugucuuuucaggccu

SEQ ID NO: 651954 - RNA, 17 nt, Escherichia coli CFT073
ugugucugauauuuuau

SEQ ID NO: 651955 - RNA, 14 nt, Escherichia coli CFT073
ugugugguuuugua

SEQ ID NO: 651956 - RNA, 21 nt, Escherichia coli CFT073
uguuaauuucucgcacguugg

SEQ ID NO: 651957 - RNA, 13 nt, Escherichia coli CFT073
uguuaacaauauu

SEQ ID NO: 651958 - RNA, 21 nt, Escherichia coli CFT073
uguuaccgggcuacaacgcac

SEQ ID NO: 651959 - RNA, 18 nt, Escherichia coli CFT073
uguuaccuacgcuugcug

SEQ ID NO: 651960 - RNA, 14 nt, Escherichia coli CFT073
uguuaccaacacug

SEQ ID NO: 651961 - RNA, 17 nt, Escherichia coli CFT073
uguggaucgauuucaau

SEQ ID NO: 651962 - RNA, 16 nt, Escherichia coli CFT073
ugugcugcauuauccu

SEQ ID NO: 651963 - RNA, 23 nt, Escherichia coli CFT073
ugugcguugcagcaaauaaaacu

SEQ ID NO: 651964 - RNA, 12 nt, Escherichia coli CFT073
uguggcuggggu

SEQ ID NO: 651965 - RNA, 17 nt, Escherichia coli CFT073
ugugggauuccagcgcc

SEQ ID NO: 651966 - RNA, 18 nt, Escherichia coli CFT073
ugugggagcuauuuacca

SEQ ID NO: 651967 - RNA, 21 nt, Escherichia coli CFT073
uguggcaacauaaucaaccau

SEQ ID NO: 651968 - RNA, 22 nt, Escherichia coli CFT073
uguggcgcaggggcagaaacaa

SEQ ID NO: 651969 - RNA, 13 nt, Escherichia coli CFT073
uguguaggccgga

SEQ ID NO: 651970 - RNA, 15 nt, Escherichia coli CFT073
ugugucagugucaga

SEQ ID NO: 651971 - RNA, 23 nt, Escherichia coli CFT073
ugugucauaugcuuuuuuaaaaa

SEQ ID NO: 651972 - RNA, 13 nt, Escherichia coli CFT073
uguguaauaccga

SEQ ID NO: 651973 - RNA, 21 nt, Escherichia coli CFT073
uguguacauccuaaaggcaaa

SEQ ID NO: 651974 - RNA, 16 nt, Escherichia coli CFT073
ugugggguauuuccag

SEQ ID NO: 651975 - RNA, 13 nt, Escherichia coli CFT073
ugugguaaaaccu

SEQ ID NO: 651976 - RNA, 20 nt, Escherichia coli CFT073
uguggucuuuaauaacacga

SEQ ID NO: 651977 - RNA, 13 nt, Escherichia coli CFT073
ugugguaaauuaa

SEQ ID NO: 651978 - RNA, 14 nt, Escherichia coli CFT073
uguggucaccauga

SEQ ID NO: 651979 - RNA, 19 nt, Escherichia coli CFT073
ugugauaaaaaucggcagg

SEQ ID NO: 651980 - RNA, 19 nt, Escherichia coli CFT073
ugugcauuuaagagaaacg

SEQ ID NO: 651981 - RNA, 20 nt, Escherichia coli CFT073
ugugcaucaggcaaacuuca

SEQ ID NO: 651982 - RNA, 13 nt, Escherichia coli CFT073
ugugcgagugcau

SEQ ID NO: 651983 - RNA, 12 nt, Escherichia coli CFT073
ugugccaccagc

SEQ ID NO: 651984 - RNA, 14 nt, Escherichia coli CFT073
ugugccacauccag

SEQ ID NO: 651985 - RNA, 14 nt, Escherichia coli CFT073
ugugccuuccaucc

SEQ ID NO: 651986 - RNA, 17 nt, Escherichia coli CFT073
ugugaccgcugcugccg

SEQ ID NO: 651987 - RNA, 13 nt, Escherichia coli CFT073
ugugacacuucuu

SEQ ID NO: 651988 - RNA, 13 nt, Escherichia coli CFT073
ugugacagcagcg

SEQ ID NO: 651989 - RNA, 16 nt, Escherichia coli CFT073
ugugacagcagcggca

SEQ ID NO: 651990 - RNA, 18 nt, Escherichia coli CFT073
ugugacuuuaaaaaaauu

SEQ ID NO: 651991 - RNA, 20 nt, Escherichia coli CFT073
ugugacuuuaaaaaaauuaa

SEQ ID NO: 651992 - RNA, 14 nt, Escherichia coli CFT073
ugugaaugaccagg

SEQ ID NO: 651993 - RNA, 15 nt, Escherichia coli CFT073
ugucugucagucugc

SEQ ID NO: 651994 - RNA, 14 nt, Escherichia coli CFT073
ugucugccauauaa

SEQ ID NO: 651995 - RNA, 15 nt, Escherichia coli CFT073
ugucugccauauguc

SEQ ID NO: 651996 - RNA, 15 nt, Escherichia coli CFT073
ugucuggcauaaaag

SEQ ID NO: 651997 - RNA, 22 nt, Escherichia coli CFT073
ugucuggcgaauuuauaaaacg

SEQ ID NO: 651998 - RNA, 19 nt, Escherichia coli CFT073
ugucuggcguuaagcauuc

SEQ ID NO: 651999 - RNA, 18 nt, Escherichia coli CFT073
ugucauuaccacaacaaa

SEQ ID NO: 652000 - RNA, 15 nt, Escherichia coli CFT073
ugucauuauaucuua

SEQ ID NO: 652001 - RNA, 16 nt, Escherichia coli CFT073
ugucauucauucagau

SEQ ID NO: 652002 - RNA, 14 nt, Escherichia coli CFT073
ugucauugaauguu

SEQ ID NO: 652003 - RNA, 18 nt, Escherichia coli CFT073
ugucauuguuauaauguu

SEQ ID NO: 652004 - RNA, 11 nt, Escherichia coli CFT073
uguccaaaugc

SEQ ID NO: 652005 - RNA, 19 nt, Escherichia coli CFT073
uguccagugcaacuuuacu

SEQ ID NO: 652006 - RNA, 19 nt, Escherichia coli CFT073
uguccagggcgaaaagcuu

SEQ ID NO: 652007 - RNA, 15 nt, Escherichia coli CFT073
uguccagcuuaauuc

SEQ ID NO: 652008 - RNA, 17 nt, Escherichia coli CFT073
uguccaccguugugaaa

SEQ ID NO: 652009 - RNA, 16 nt, Escherichia coli CFT073
uguccauaaauuauag

SEQ ID NO: 652010 - RNA, 12 nt, Escherichia coli CFT073
uguccauauuuc

SEQ ID NO: 652011 - RNA, 15 nt, Escherichia coli CFT073
ugucucaaaacugaa

SEQ ID NO: 652012 - RNA, 15 nt, Escherichia coli CFT073
ugucguaagcgccaa

SEQ ID NO: 652013 - RNA, 15 nt, Escherichia coli CFT073
ugucuaccagcaccu

SEQ ID NO: 652014 - RNA, 16 nt, Escherichia coli CFT073
ugucgcgucaaucacu

SEQ ID NO: 652015 - RNA, 13 nt, Escherichia coli CFT073
ugucaucagucuu

SEQ ID NO: 652016 - RNA, 16 nt, Escherichia coli CFT073
ugucauauaauguauc

SEQ ID NO: 652017 - RNA, 20 nt, Escherichia coli CFT073
ugucaucaucgcucccaaac

SEQ ID NO: 652018 - RNA, 15 nt, Escherichia coli CFT073
ugucaucgacaucaa

SEQ ID NO: 652019 - RNA, 22 nt, Escherichia coli CFT073
ugucauguauauuauccaucaa

SEQ ID NO: 652020 - RNA, 20 nt, Escherichia coli CFT073
ugucaguugcauaccauuca

SEQ ID NO: 652021 - RNA, 14 nt, Escherichia coli CFT073
ugucaguuggcugu

SEQ ID NO: 652022 - RNA, 22 nt, Escherichia coli CFT073
ugucagaagaaaaaaugcugca

SEQ ID NO: 652023 - RNA, 14 nt, Escherichia coli CFT073
ugucagaaagaaau

SEQ ID NO: 652024 - RNA, 16 nt, Escherichia coli CFT073
ugucagaaaugauggg

SEQ ID NO: 652025 - RNA, 14 nt, Escherichia coli CFT073
ugucacuggccagc

SEQ ID NO: 652026 - RNA, 21 nt, Escherichia coli CFT073
ugucagacggugccagguaau

SEQ ID NO: 652027 - RNA, 14 nt, Escherichia coli CFT073
ugucagucugcuuu

SEQ ID NO: 652028 - RNA, 18 nt, Escherichia coli CFT073
ugucacgucaucccccag

SEQ ID NO: 652029 - RNA, 16 nt, Escherichia coli CFT073
ugucacgucucaucag

SEQ ID NO: 652030 - RNA, 14 nt, Escherichia coli CFT073
ugucaauaaacgcc

SEQ ID NO: 652031 - RNA, 20 nt, Escherichia coli CFT073
ugucaacugcgccacucgau

SEQ ID NO: 652032 - RNA, 11 nt, Escherichia coli CFT073
uguauuaauac

SEQ ID NO: 652033 - RNA, 12 nt, Escherichia coli CFT073
uguaugguuuug

SEQ ID NO: 652034 - RNA, 15 nt, Escherichia coli CFT073
uguaugucauaaaaa

SEQ ID NO: 652035 - RNA, 18 nt, Escherichia coli CFT073
uguauggccuggugagug

SEQ ID NO: 652036 - RNA, 14 nt, Escherichia coli CFT073
uguaguuacauuuu

SEQ ID NO: 652037 - RNA, 14 nt, Escherichia coli CFT073
uguaguuauccgca

SEQ ID NO: 652038 - RNA, 19 nt, Escherichia coli CFT073
uguauaccaaucguccucc

SEQ ID NO: 652039 - RNA, 18 nt, Escherichia coli CFT073
uguagggcagcguugcca

SEQ ID NO: 652040 - RNA, 14 nt, Escherichia coli CFT073
uguaggguggggaa

SEQ ID NO: 652041 - RNA, 21 nt, Escherichia coli CFT073
uguaggguggggaaaaaacac

SEQ ID NO: 652042 - RNA, 20 nt, Escherichia coli CFT073
uguaguauuugaguucacug

SEQ ID NO: 652043 - RNA, 22 nt, Escherichia coli CFT073
uguagugauccugcauacugac

SEQ ID NO: 652044 - RNA, 17 nt, Escherichia coli CFT073
uguaguguuuuauacca

SEQ ID NO: 652045 - RNA, 13 nt, Escherichia coli CFT073
uguaguuaaaaaa

SEQ ID NO: 652046 - RNA, 19 nt, Escherichia coli CFT073
uguaguuaaaaaaugcagc

SEQ ID NO: 652047 - RNA, 20 nt, Escherichia coli CFT073
uguagcucgccuacaucgac

SEQ ID NO: 652048 - RNA, 17 nt, Escherichia coli CFT073
uguagauauuaaagcca

SEQ ID NO: 652049 - RNA, 17 nt, Escherichia coli CFT073
uguagauauucuuccag

SEQ ID NO: 652050 - RNA, 15 nt, Escherichia coli CFT073
uguagcgcuguaagc

SEQ ID NO: 652051 - RNA, 17 nt, Escherichia coli CFT073
uguagcggcguuuuccc

SEQ ID NO: 652052 - RNA, 15 nt, Escherichia coli CFT073
uguaggcauacacau

SEQ ID NO: 652053 - RNA, 18 nt, Escherichia coli CFT073
uguaggcauacacaucac

SEQ ID NO: 652054 - RNA, 21 nt, Escherichia coli CFT073
uguaggccugaucagcgaagc

SEQ ID NO: 652055 - RNA, 16 nt, Escherichia coli CFT073
uguaggcguuauacau

SEQ ID NO: 652056 - RNA, 20 nt, Escherichia coli CFT073
uguaacucaggaacuuagua

SEQ ID NO: 652057 - RNA, 20 nt, Escherichia coli CFT073
uguaacgaguacaaaaauaa

SEQ ID NO: 652058 - RNA, 16 nt, Escherichia coli CFT073
uguaaccuuuucccga

SEQ ID NO: 652059 - RNA, 21 nt, Escherichia coli CFT073
uguaacgcgcuaccaaccaga

SEQ ID NO: 652060 - RNA, 17 nt, Escherichia coli CFT073
uguaacggcgguacgac

SEQ ID NO: 652061 - RNA, 19 nt, Escherichia coli CFT073
uguaaccguuuguuuuuua

SEQ ID NO: 652062 - RNA, 14 nt, Escherichia coli CFT073
uguaauccauugca

SEQ ID NO: 652063 - RNA, 17 nt, Escherichia coli CFT073
uguaaucaacaaaagug

SEQ ID NO: 652064 - RNA, 19 nt, Escherichia coli CFT073
uguaauuugcguuuucacc

SEQ ID NO: 652065 - RNA, 22 nt, Escherichia coli CFT073
uguacuuccggacguucagcca

SEQ ID NO: 652066 - RNA, 14 nt, Escherichia coli CFT073
uguaccguacagau

SEQ ID NO: 652067 - RNA, 22 nt, Escherichia coli CFT073
uguagacagcaucgaccaugcu

SEQ ID NO: 652068 - RNA, 16 nt, Escherichia coli CFT073
uguaccacccugcuca

SEQ ID NO: 652069 - RNA, 20 nt, Escherichia coli CFT073
uguaccagguggguacugua

SEQ ID NO: 652070 - RNA, 14 nt, Escherichia coli CFT073
uguacacuucccag

SEQ ID NO: 652071 - RNA, 16 nt, Escherichia coli CFT073
ugguuuaccaccagcg

SEQ ID NO: 652072 - RNA, 23 nt, Escherichia coli CFT073
ugguuuauuucccggauggcaac

SEQ ID NO: 652073 - RNA, 13 nt, Escherichia coli CFT073
ugguuucaaccug

SEQ ID NO: 652074 - RNA, 14 nt, Escherichia coli CFT073
ugguuucaaccugc

SEQ ID NO: 652075 - RNA, 23 nt, Escherichia coli CFT073
ugguuuugguaaagcaauaaacc

SEQ ID NO: 652076 - RNA, 21 nt, Escherichia coli CFT073
uggucuucauagauagccagc

SEQ ID NO: 652077 - RNA, 15 nt, Escherichia coli CFT073
uggugacaccaugcc

SEQ ID NO: 652078 - RNA, 19 nt, Escherichia coli CFT073
uguaaaaguugcaguccgc

SEQ ID NO: 652079 - RNA, 19 nt, Escherichia coli CFT073
uguaaaacagccaaugcau

SEQ ID NO: 652080 - RNA, 20 nt, Escherichia coli CFT073
uguaacaguugcaguuauua

SEQ ID NO: 652081 - RNA, 15 nt, Escherichia coli CFT073
uguaacauaccuaaa

SEQ ID NO: 652082 - RNA, 20 nt, Escherichia coli CFT073
uguaacaccuguaaagucac

SEQ ID NO: 652083 - RNA, 16 nt, Escherichia coli CFT073
uguaaaccaaagccac

SEQ ID NO: 652084 - RNA, 21 nt, Escherichia coli CFT073
uggauuuaccguuaagcugga

SEQ ID NO: 652085 - RNA, 21 nt, Escherichia coli CFT073
uggcaaagcugucaccaauca

SEQ ID NO: 652086 - RNA, 19 nt, Escherichia coli CFT073
uggcaaaccaguacugacu

SEQ ID NO: 652087 - RNA, 15 nt, Escherichia coli CFT073
ugcguucgcaccacc

SEQ ID NO: 652088 - RNA, 21 nt, Escherichia coli CFT073
ugcguugacucgguaaaauca

SEQ ID NO: 652089 - RNA, 13 nt, Escherichia coli CFT073
ugcguucagcagu

SEQ ID NO: 652090 - RNA, 20 nt, Escherichia coli CFT073
ugcguucagcaguucugcca

SEQ ID NO: 652091 - RNA, 21 nt, Escherichia coli CFT073
ugcguuccagcauguuauuca

SEQ ID NO: 652092 - RNA, 22 nt, Escherichia coli CFT073
ugcguuaauauugugugccggg

SEQ ID NO: 652093 - RNA, 20 nt, Escherichia coli CFT073
ugcguuauagcgauuuuuca

SEQ ID NO: 652094 - RNA, 13 nt, Escherichia coli CFT073
ugcguuauuuuca

SEQ ID NO: 652095 - RNA, 14 nt, Escherichia coli CFT073
uggcacacaccaga

SEQ ID NO: 652096 - RNA, 14 nt, Escherichia coli CFT073
uggcacaagacuga

SEQ ID NO: 652097 - RNA, 23 nt, Escherichia coli CFT073
uggcacaagacugacaaucaauc

SEQ ID NO: 652098 - RNA, 20 nt, Escherichia coli CFT073
uggcacaugcauaaagcggu

SEQ ID NO: 652099 - RNA, 19 nt, Escherichia coli CFT073
uggcacaugcauaaagcgg

SEQ ID NO: 652100 - RNA, 14 nt, Escherichia coli CFT073
uggcaccaucagcu

SEQ ID NO: 652101 - RNA, 15 nt, Escherichia coli CFT073
uggcaccgugaaaga

SEQ ID NO: 652102 - RNA, 20 nt, Escherichia coli CFT073
uggcaaugcccgguguuccc

SEQ ID NO: 652103 - RNA, 20 nt, Escherichia coli CFT073
uggcaauuaacgcacaacca

SEQ ID NO: 652104 - RNA, 22 nt, Escherichia coli CFT073
uggcaauggucuugacauccag

SEQ ID NO: 652105 - RNA, 21 nt, Escherichia coli CFT073
uggcaauucgugaugcccuga

SEQ ID NO: 652106 - RNA, 18 nt, Escherichia coli CFT073
uggcaaucuuccucgcca

SEQ ID NO: 652107 - RNA, 13 nt, Escherichia coli CFT073
uggcaacagccau

SEQ ID NO: 652108 - RNA, 16 nt, Escherichia coli CFT073
uggcaacauaaucaac

SEQ ID NO: 652109 - RNA, 17 nt, Escherichia coli CFT073
uggccaguuccacuucu

SEQ ID NO: 652110 - RNA, 15 nt, Escherichia coli CFT073
uggccaguuuucaga

SEQ ID NO: 652111 - RNA, 21 nt, Escherichia coli CFT073
uggccaucggcccguuaacca

SEQ ID NO: 652112 - RNA, 21 nt, Escherichia coli CFT073
uggccagcggugaaaacggca

SEQ ID NO: 652113 - RNA, 22 nt, Escherichia coli CFT073
uggccagcggugaaaacggcaa

SEQ ID NO: 652114 - RNA, 14 nt, Escherichia coli CFT073
uggccgccacgcgu

SEQ ID NO: 652115 - RNA, 17 nt, Escherichia coli CFT073
uggccauggauucaagc

SEQ ID NO: 652116 - RNA, 18 nt, Escherichia coli CFT073
uggccauggauucaagca

SEQ ID NO: 652117 - RNA, 14 nt, Escherichia coli CFT073
uggccaugauuacc

SEQ ID NO: 652118 - RNA, 14 nt, Escherichia coli CFT073
uggcauuuuuauua

SEQ ID NO: 652119 - RNA, 19 nt, Escherichia coli CFT073
uggcauuuuuauuaaauau

SEQ ID NO: 652120 - RNA, 19 nt, Escherichia coli CFT073
uggccaauuggcuggcccu

SEQ ID NO: 652121 - RNA, 22 nt, Escherichia coli CFT073
uggcaggccccgucagcaaaau

SEQ ID NO: 652122 - RNA, 11 nt, Escherichia coli CFT073
uggccacagca

SEQ ID NO: 652123 - RNA, 20 nt, Escherichia coli CFT073
uggcagcgugcguugaccgc

SEQ ID NO: 652124 - RNA, 14 nt, Escherichia coli CFT073
uggcaggcaaaaau

SEQ ID NO: 652125 - RNA, 14 nt, Escherichia coli CFT073
uggcauuuucugcc

SEQ ID NO: 652126 - RNA, 18 nt, Escherichia coli CFT073
uggcagcaggaucuccag

SEQ ID NO: 652127 - RNA, 16 nt, Escherichia coli CFT073
uggcagcaucagacua

SEQ ID NO: 652128 - RNA, 14 nt, Escherichia coli CFT073
uggccucuggugca

SEQ ID NO: 652129 - RNA, 16 nt, Escherichia coli CFT073
uggccugaauauccag

SEQ ID NO: 652130 - RNA, 14 nt, Escherichia coli CFT073
uggccucugccagc

SEQ ID NO: 652131 - RNA, 20 nt, Escherichia coli CFT073
uggccucugccagcugcuca

SEQ ID NO: 652132 - RNA, 23 nt, Escherichia coli CFT073
uggcgaaauguguuggcaccauc

SEQ ID NO: 652133 - RNA, 14 nt, Escherichia coli CFT073
uggccuccagcacu

SEQ ID NO: 652134 - RNA, 20 nt, Escherichia coli CFT073
uggccuccagcacuuccuga

SEQ ID NO: 652135 - RNA, 20 nt, Escherichia coli CFT073
uggcgauaaucagcgccagc

SEQ ID NO: 652136 - RNA, 21 nt, Escherichia coli CFT073
uggcgauaaaguugaagcuga

SEQ ID NO: 652137 - RNA, 13 nt, Escherichia coli CFT073
uggcgaguauugc

SEQ ID NO: 652138 - RNA, 12 nt, Escherichia coli CFT073
uggcgaauggcg

SEQ ID NO: 652139 - RNA, 21 nt, Escherichia coli CFT073
uggcgaauuaacaccaccagc

SEQ ID NO: 652140 - RNA, 20 nt, Escherichia coli CFT073
uggcgauacugccgcccauc

SEQ ID NO: 652141 - RNA, 19 nt, Escherichia coli CFT073
uggcgcuacugaagcgacc

SEQ ID NO: 652142 - RNA, 19 nt, Escherichia coli CFT073
uggcgcuaugugccauugc

SEQ ID NO: 652143 - RNA, 20 nt, Escherichia coli CFT073
uggcgcugauaaaucccgcc

SEQ ID NO: 652144 - RNA, 16 nt, Escherichia coli CFT073
uggcggaauaccgaca

SEQ ID NO: 652145 - RNA, 20 nt, Escherichia coli CFT073
uggcggaauaccgacaucac

SEQ ID NO: 652146 - RNA, 23 nt, Escherichia coli CFT073
uggcggauccguugaucgcucau

SEQ ID NO: 652147 - RNA, 20 nt, Escherichia coli CFT073
uggcgcuggcgaucguccag

SEQ ID NO: 652148 - RNA, 14 nt, Escherichia coli CFT073
uggcgcugcucagg

SEQ ID NO: 652149 - RNA, 16 nt, Escherichia coli CFT073
uggcgcugcucaggcg

SEQ ID NO: 652150 - RNA, 18 nt, Escherichia coli CFT073
uggcggaaauaacgcuga

SEQ ID NO: 652151 - RNA, 12 nt, Escherichia coli CFT073
uggcggccaaaa

SEQ ID NO: 652152 - RNA, 18 nt, Escherichia coli CFT073
uggcggcuggcacuggca

SEQ ID NO: 652153 - RNA, 23 nt, Escherichia coli CFT073
uggucaacaaccaguugagcgga

SEQ ID NO: 652154 - RNA, 12 nt, Escherichia coli CFT073
uggucaccacgg

SEQ ID NO: 652155 - RNA, 14 nt, Escherichia coli CFT073
uggucagaacgacc

SEQ ID NO: 652156 - RNA, 13 nt, Escherichia coli CFT073
uggucaguuaaca

SEQ ID NO: 652157 - RNA, 19 nt, Escherichia coli CFT073
uggucaguuuaaacagaau

SEQ ID NO: 652158 - RNA, 13 nt, Escherichia coli CFT073
uggucaucaucag

SEQ ID NO: 652159 - RNA, 13 nt, Escherichia coli CFT073
uggucagagcauu

SEQ ID NO: 652160 - RNA, 19 nt, Escherichia coli CFT073
uggucggaaaaguaaacca

SEQ ID NO: 652161 - RNA, 13 nt, Escherichia coli CFT073
uggucgacaacca

SEQ ID NO: 652162 - RNA, 20 nt, Escherichia coli CFT073
uggucgcaucauccgucggc

SEQ ID NO: 652163 - RNA, 14 nt, Escherichia coli CFT073
ugguccaguuaagc

SEQ ID NO: 652164 - RNA, 20 nt, Escherichia coli CFT073
ugguagaaacgcugaaugcu

SEQ ID NO: 652165 - RNA, 12 nt, Escherichia coli CFT073
ugguagaaaucu

SEQ ID NO: 652166 - RNA, 12 nt, Escherichia coli CFT073
ugguaccugucg

SEQ ID NO: 652167 - RNA, 14 nt, Escherichia coli CFT073
ugguaccaggauca

SEQ ID NO: 652168 - RNA, 12 nt, Escherichia coli CFT073
ugguaucaaaau

SEQ ID NO: 652169 - RNA, 15 nt, Escherichia coli CFT073
ugguaucaaggcuga

SEQ ID NO: 652170 - RNA, 13 nt, Escherichia coli CFT073
ugguaucaauauc

SEQ ID NO: 652171 - RNA, 22 nt, Escherichia coli CFT073
ugguauccacacugguucccag

SEQ ID NO: 652172 - RNA, 21 nt, Escherichia coli CFT073
ugguauaaggagcaauaauca

SEQ ID NO: 652173 - RNA, 21 nt, Escherichia coli CFT073
ugguaugccauccggcucgca

SEQ ID NO: 652174 - RNA, 14 nt, Escherichia coli CFT073
ugguaaagcaauaa

SEQ ID NO: 652175 - RNA, 21 nt, Escherichia coli CFT073
ugguaaagcaauaaaccauaa

SEQ ID NO: 652176 - RNA, 23 nt, Escherichia coli CFT073
ugguaaagccgauuaaucuucca

SEQ ID NO: 652177 - RNA, 20 nt, Escherichia coli CFT073
ugguaacuuacugaugcgca

SEQ ID NO: 652178 - RNA, 16 nt, Escherichia coli CFT073
ugguaaccggugcaag

SEQ ID NO: 652179 - RNA, 22 nt, Escherichia coli CFT073
ugguacaccugcugugucucuu

SEQ ID NO: 652180 - RNA, 17 nt, Escherichia coli CFT073
ugguacagagaacaccc

SEQ ID NO: 652181 - RNA, 14 nt, Escherichia coli CFT073
ugguaauacccaga

SEQ ID NO: 652182 - RNA, 18 nt, Escherichia coli CFT073
uggguucgauuucauuca

SEQ ID NO: 652183 - RNA, 15 nt, Escherichia coli CFT073
ugggcguuacagcug

SEQ ID NO: 652184 - RNA, 13 nt, Escherichia coli CFT073
uggggaaguggug

SEQ ID NO: 652185 - RNA, 16 nt, Escherichia coli CFT073
ugggcgggaucuccac

SEQ ID NO: 652186 - RNA, 18 nt, Escherichia coli CFT073
ugggcgggaucuccacaa

SEQ ID NO: 652187 - RNA, 12 nt, Escherichia coli CFT073
uggggcuggcgg

SEQ ID NO: 652188 - RNA, 16 nt, Escherichia coli CFT073
ugggugcuugaggcug

SEQ ID NO: 652189 - RNA, 16 nt, Escherichia coli CFT073
ugggugagcgaugcug

SEQ ID NO: 652190 - RNA, 15 nt, Escherichia coli CFT073
ugggugcaaucagua

SEQ ID NO: 652191 - RNA, 22 nt, Escherichia coli CFT073
uggggauuuccaacgaaucuuu

SEQ ID NO: 652192 - RNA, 18 nt, Escherichia coli CFT073
uggggauggcgcugcugc

SEQ ID NO: 652193 - RNA, 23 nt, Escherichia coli CFT073
uggggagaaaaacggaaagcaac

SEQ ID NO: 652194 - RNA, 21 nt, Escherichia coli CFT073
uggcuuuaucuguacuuaaaa

SEQ ID NO: 652195 - RNA, 17 nt, Escherichia coli CFT073
uggcuuuccaccaucac

SEQ ID NO: 652196 - RNA, 17 nt, Escherichia coli CFT073
uggcuuuccaccugcaa

SEQ ID NO: 652197 - RNA, 19 nt, Escherichia coli CFT073
uggcuucgauaccguccac

SEQ ID NO: 652198 - RNA, 18 nt, Escherichia coli CFT073
uggcuuaucuuccuguuc

SEQ ID NO: 652199 - RNA, 18 nt, Escherichia coli CFT073
uggcgugaaagaaaauga

SEQ ID NO: 652200 - RNA, 20 nt, Escherichia coli CFT073
uggcguguucagaucaucaa

SEQ ID NO: 652201 - RNA, 20 nt, Escherichia coli CFT073
uggcgucuaagguaaaacaa

SEQ ID NO: 652202 - RNA, 20 nt, Escherichia coli CFT073
uggcguugccguacucuuca

SEQ ID NO: 652203 - RNA, 20 nt, Escherichia coli CFT073
ugggaugauagccaugaaaa

SEQ ID NO: 652204 - RNA, 16 nt, Escherichia coli CFT073
ugggaucugauuuucu

SEQ ID NO: 652205 - RNA, 15 nt, Escherichia coli CFT073
ugggcaauuucuuuc

SEQ ID NO: 652206 - RNA, 16 nt, Escherichia coli CFT073
uggcuuuccgggagca

SEQ ID NO: 652207 - RNA, 17 nt, Escherichia coli CFT073
uggcuuugcccuuucug

SEQ ID NO: 652208 - RNA, 19 nt, Escherichia coli CFT073
uggcuuuuuuguaguugcu

SEQ ID NO: 652209 - RNA, 13 nt, Escherichia coli CFT073
uucacuucgucag

SEQ ID NO: 652210 - RNA, 21 nt, Escherichia coli CFT073
uucacuuucaaauccagccag

SEQ ID NO: 652211 - RNA, 17 nt, Escherichia coli CFT073
uucacuuuguuccugaa

SEQ ID NO: 652212 - RNA, 17 nt, Escherichia coli CFT073
uucacuucaaccacauu

SEQ ID NO: 652213 - RNA, 21 nt, Escherichia coli CFT073
uucacuucacggccccaaaua

SEQ ID NO: 652214 - RNA, 12 nt, Escherichia coli CFT073
uucacuucauag

SEQ ID NO: 652215 - RNA, 20 nt, Escherichia coli CFT073
uucacugggcgauuaauaaa

SEQ ID NO: 652216 - RNA, 20 nt, Escherichia coli CFT073
uucacuguaggcauauuugg

SEQ ID NO: 652217 - RNA, 17 nt, Escherichia coli CFT073
uucagaugccauuuugc

SEQ ID NO: 652218 - RNA, 15 nt, Escherichia coli CFT073
uucagcaaaugaccc

SEQ ID NO: 652219 - RNA, 21 nt, Escherichia coli CFT073
uucagauuggugacaagugcc

SEQ ID NO: 652220 - RNA, 14 nt, Escherichia coli CFT073
uucagaguugcacc

SEQ ID NO: 652221 - RNA, 17 nt, Escherichia coli CFT073
uucagaguuguaccacc

SEQ ID NO: 652222 - RNA, 14 nt, Escherichia coli CFT073
uucagaucaucaaa

SEQ ID NO: 652223 - RNA, 18 nt, Escherichia coli CFT073
uucacggaucgcuuuuac

SEQ ID NO: 652224 - RNA, 17 nt, Escherichia coli CFT073
uucacggcaccagccau

SEQ ID NO: 652225 - RNA, 16 nt, Escherichia coli CFT073
uucacggccccaaaua

SEQ ID NO: 652226 - RNA, 21 nt, Escherichia coli CFT073
uucacggcgauaccaguaaua

SEQ ID NO: 652227 - RNA, 20 nt, Escherichia coli CFT073
uucacggcuuugucauuaaa

SEQ ID NO: 652228 - RNA, 17 nt, Escherichia coli CFT073
uucacucugcugccaca

SEQ ID NO: 652229 - RNA, 13 nt, Escherichia coli CFT073
uucacucugcugu

SEQ ID NO: 652230 - RNA, 12 nt, Escherichia coli CFT073
uucacuccauug

SEQ ID NO: 652231 - RNA, 16 nt, Escherichia coli CFT073
uucacugaaacagaua

SEQ ID NO: 652232 - RNA, 16 nt, Escherichia coli CFT073
uucacugacgcccguu

SEQ ID NO: 652233 - RNA, 19 nt, Escherichia coli CFT073
uucacugccguacaggcag

SEQ ID NO: 652234 - RNA, 18 nt, Escherichia coli CFT073
uucaccacugaauaacau

SEQ ID NO: 652235 - RNA, 16 nt, Escherichia coli CFT073
uucaccaccaucaaau

SEQ ID NO: 652236 - RNA, 19 nt, Escherichia coli CFT073
uucaccaccaucaaaugcg

SEQ ID NO: 652237 - RNA, 13 nt, Escherichia coli CFT073
uucaccaaaugcc

SEQ ID NO: 652238 - RNA, 21 nt, Escherichia coli CFT073
uucacgcccgccccaguaaau

SEQ ID NO: 652239 - RNA, 16 nt, Escherichia coli CFT073
uucaagcuggugcuuu

SEQ ID NO: 652240 - RNA, 17 nt, Escherichia coli CFT073
uucaaguaaaacagccu

SEQ ID NO: 652241 - RNA, 19 nt, Escherichia coli CFT073
uucaaugcauaucauugcg

SEQ ID NO: 652242 - RNA, 14 nt, Escherichia coli CFT073
uucaaugccccaca

SEQ ID NO: 652243 - RNA, 17 nt, Escherichia coli CFT073
uucaaugccccacagag

SEQ ID NO: 652244 - RNA, 23 nt, Escherichia coli CFT073
uucaaugcccacugcacaguguu

SEQ ID NO: 652245 - RNA, 22 nt, Escherichia coli CFT073
uucaaugauaaaggucaucaca

SEQ ID NO: 652246 - RNA, 22 nt, Escherichia coli CFT073
uucaaugaaugcuucgcucucu

SEQ ID NO: 652247 - RNA, 19 nt, Escherichia coli CFT073
uucaaugacaguaucacca

SEQ ID NO: 652248 - RNA, 20 nt, Escherichia coli CFT073
uucaaugacaguaucaccaa

SEQ ID NO: 652249 - RNA, 23 nt, Escherichia coli CFT073
uucaauuacgcggcuucaacuuu

SEQ ID NO: 652250 - RNA, 13 nt, Escherichia coli CFT073
uucacaaaaacag

SEQ ID NO: 652251 - RNA, 16 nt, Escherichia coli CFT073
uucacaaacagcgccu

SEQ ID NO: 652252 - RNA, 21 nt, Escherichia coli CFT073
uucacacacaucaacccagaa

SEQ ID NO: 652253 - RNA, 17 nt, Escherichia coli CFT073
uuauugcugaaaauugu

SEQ ID NO: 652254 - RNA, 14 nt, Escherichia coli CFT073
uuauugcugcacca

SEQ ID NO: 652255 - RNA, 22 nt, Escherichia coli CFT073
uuauugaucagugcacugacgc

SEQ ID NO: 652256 - RNA, 20 nt, Escherichia coli CFT073
uuauucccgggcguaacuca

SEQ ID NO: 652257 - RNA, 14 nt, Escherichia coli CFT073
uuauuuagauaaac

SEQ ID NO: 652258 - RNA, 20 nt, Escherichia coli CFT073
uuauugucauuguuauaaug

SEQ ID NO: 652259 - RNA, 15 nt, Escherichia coli CFT073
uuauucaucagcguu

SEQ ID NO: 652260 - RNA, 16 nt, Escherichia coli CFT073
uuauucacagagauaa

SEQ ID NO: 652261 - RNA, 21 nt, Escherichia coli CFT073
uuauucacagagauaaucaga

SEQ ID NO: 652262 - RNA, 15 nt, Escherichia coli CFT073
uuauucagaaaacgu

SEQ ID NO: 652263 - RNA, 18 nt, Escherichia coli CFT073
uuauucagaguauauauu

SEQ ID NO: 652264 - RNA, 18 nt, Escherichia coli CFT073
uuaggaugcugcaauaaa

SEQ ID NO: 652265 - RNA, 22 nt, Escherichia coli CFT073
uuauuaucuggcaagccugaaa

SEQ ID NO: 652266 - RNA, 16 nt, Escherichia coli CFT073
uucaaauccagucuuu

SEQ ID NO: 652267 - RNA, 16 nt, Escherichia coli CFT073
uucaaaucgaaaucaa

SEQ ID NO: 652268 - RNA, 11 nt, Escherichia coli CFT073
uuauuuuaaau

SEQ ID NO: 652269 - RNA, 22 nt, Escherichia coli CFT073
uucaaacugaagauugaacagc

SEQ ID NO: 652270 - RNA, 16 nt, Escherichia coli CFT073
uuauuuucgucagcuc

SEQ ID NO: 652271 - RNA, 18 nt, Escherichia coli CFT073
uucaacucaucaaaaaaa

SEQ ID NO: 652272 - RNA, 13 nt, Escherichia coli CFT073
uucaacucccacc

SEQ ID NO: 652273 - RNA, 13 nt, Escherichia coli CFT073
uucaacuucagca

SEQ ID NO: 652274 - RNA, 19 nt, Escherichia coli CFT073
uucaacuucugcugugacu

SEQ ID NO: 652275 - RNA, 22 nt, Escherichia coli CFT073
uucaacaguaaacucgacuuuc

SEQ ID NO: 652276 - RNA, 19 nt, Escherichia coli CFT073
uucaacgugagauaguaaa

SEQ ID NO: 652277 - RNA, 22 nt, Escherichia coli CFT073
uucaacgugagauaguaaaccu

SEQ ID NO: 652278 - RNA, 23 nt, Escherichia coli CFT073
uucaacgcugcggcgugcaggaa

SEQ ID NO: 652279 - RNA, 18 nt, Escherichia coli CFT073
uucaacuacggcuuuuuu

SEQ ID NO: 652280 - RNA, 16 nt, Escherichia coli CFT073
uucaacacaugcacau

SEQ ID NO: 652281 - RNA, 21 nt, Escherichia coli CFT073
uucaacacacugaauaaaagu

SEQ ID NO: 652282 - RNA, 16 nt, Escherichia coli CFT073
uucaacagauuuugca

SEQ ID NO: 652283 - RNA, 14 nt, Escherichia coli CFT073
uucaacaagccacg

SEQ ID NO: 652284 - RNA, 17 nt, Escherichia coli CFT073
uucaugaauaaaaaaac

SEQ ID NO: 652285 - RNA, 14 nt, Escherichia coli CFT073
uucaucuuccagcu

SEQ ID NO: 652286 - RNA, 15 nt, Escherichia coli CFT073
uucaucuucgucaaa

SEQ ID NO: 652287 - RNA, 13 nt, Escherichia coli CFT073
uucaucuucaguc

SEQ ID NO: 652288 - RNA, 14 nt, Escherichia coli CFT073
uucaucuuuauaga

SEQ ID NO: 652289 - RNA, 14 nt, Escherichia coli CFT073
uucaucucaucaau

SEQ ID NO: 652290 - RNA, 15 nt, Escherichia coli CFT073
uucaucucuucuucc

SEQ ID NO: 652291 - RNA, 16 nt, Escherichia coli CFT073
uucaucgcuuaaccca

SEQ ID NO: 652292 - RNA, 15 nt, Escherichia coli CFT073
uucaucggauaaggu

SEQ ID NO: 652293 - RNA, 22 nt, Escherichia coli CFT073
uucaucguaguaguucaucccc

SEQ ID NO: 652294 - RNA, 17 nt, Escherichia coli CFT073
uucaucgucagcuccau

SEQ ID NO: 652295 - RNA, 14 nt, Escherichia coli CFT073
uucauuaacccguu

SEQ ID NO: 652296 - RNA, 16 nt, Escherichia coli CFT073
uucauuacaccaauac

SEQ ID NO: 652297 - RNA, 15 nt, Escherichia coli CFT073
uucaugguuagccug

SEQ ID NO: 652298 - RNA, 21 nt, Escherichia coli CFT073
uucaugguggaacucuucaca

SEQ ID NO: 652299 - RNA, 20 nt, Escherichia coli CFT073
uucauggcgugacauggcga

SEQ ID NO: 652300 - RNA, 21 nt, Escherichia coli CFT073
uucaugguacgggacagcagg

SEQ ID NO: 652301 - RNA, 18 nt, Escherichia coli CFT073
uucaugggugccggauac

SEQ ID NO: 652302 - RNA, 14 nt, Escherichia coli CFT073
uucaugcuauuccu

SEQ ID NO: 652303 - RNA, 13 nt, Escherichia coli CFT073
uucauuguccguc

SEQ ID NO: 652304 - RNA, 19 nt, Escherichia coli CFT073
uucauugcguaaccaaaua

SEQ ID NO: 652305 - RNA, 16 nt, Escherichia coli CFT073
uucauuguguaucagg

SEQ ID NO: 652306 - RNA, 17 nt, Escherichia coli CFT073
uucauuguguaucaggu

SEQ ID NO: 652307 - RNA, 15 nt, Escherichia coli CFT073
uucauuguucuccca

SEQ ID NO: 652308 - RNA, 13 nt, Escherichia coli CFT073
uucauuuacauca

SEQ ID NO: 652309 - RNA, 15 nt, Escherichia coli CFT073
uucauuuaagccacu

SEQ ID NO: 652310 - RNA, 13 nt, Escherichia coli CFT073
uucauuacuuauc

SEQ ID NO: 652311 - RNA, 14 nt, Escherichia coli CFT073
uucauucaccaguu

SEQ ID NO: 652312 - RNA, 14 nt, Escherichia coli CFT073
uucauucagaaaaa

SEQ ID NO: 652313 - RNA, 15 nt, Escherichia coli CFT073
uucauucagaacacu

SEQ ID NO: 652314 - RNA, 15 nt, Escherichia coli CFT073
uucauucaggccaaa

SEQ ID NO: 652315 - RNA, 21 nt, Escherichia coli CFT073
uucauugaacgcaaaugguga

SEQ ID NO: 652316 - RNA, 12 nt, Escherichia coli CFT073
uucauuccuuga

SEQ ID NO: 652317 - RNA, 19 nt, Escherichia coli CFT073
uucauuuuuaggauaaauc

SEQ ID NO: 652318 - RNA, 22 nt, Escherichia coli CFT073
uucauuuuguaggccugauaag

SEQ ID NO: 652319 - RNA, 20 nt, Escherichia coli CFT073
uucauuugucucaaaacuga

SEQ ID NO: 652320 - RNA, 15 nt, Escherichia coli CFT073
uuccaacgaaucuuu

SEQ ID NO: 652321 - RNA, 20 nt, Escherichia coli CFT073
uuccaacgaguaagaggcua

SEQ ID NO: 652322 - RNA, 13 nt, Escherichia coli CFT073
uuccaacaggcga

SEQ ID NO: 652323 - RNA, 22 nt, Escherichia coli CFT073
uucaucauccgugaauaaugca

SEQ ID NO: 652324 - RNA, 14 nt, Escherichia coli CFT073
uucaucaccagcuc

SEQ ID NO: 652325 - RNA, 16 nt, Escherichia coli CFT073
uucaucacgcacugca

SEQ ID NO: 652326 - RNA, 15 nt, Escherichia coli CFT073
uucaucagaagggaa

SEQ ID NO: 652327 - RNA, 16 nt, Escherichia coli CFT073
uucauccccucuucca

SEQ ID NO: 652328 - RNA, 15 nt, Escherichia coli CFT073
uucaucgauccccug

SEQ ID NO: 652329 - RNA, 19 nt, Escherichia coli CFT073
uucauccuggcacagcagu

SEQ ID NO: 652330 - RNA, 19 nt, Escherichia coli CFT073
uucauccuguaugacaaaa

SEQ ID NO: 652331 - RNA, 23 nt, Escherichia coli CFT073
uucauccuguaugacaaaagaau

SEQ ID NO: 652332 - RNA, 14 nt, Escherichia coli CFT073
uucaucgagcagca

SEQ ID NO: 652333 - RNA, 15 nt, Escherichia coli CFT073
uucaucgagcagcau

SEQ ID NO: 652334 - RNA, 19 nt, Escherichia coli CFT073
uucaucgccuucuugaacc

SEQ ID NO: 652335 - RNA, 21 nt, Escherichia coli CFT073
uucaucgcgcaaaauuucuau

SEQ ID NO: 652336 - RNA, 13 nt, Escherichia coli CFT073
uucauaucugcca

SEQ ID NO: 652337 - RNA, 19 nt, Escherichia coli CFT073
uucauaugcuuguuugccc

SEQ ID NO: 652338 - RNA, 15 nt, Escherichia coli CFT073
uucauauuaaccucu

SEQ ID NO: 652339 - RNA, 18 nt, Escherichia coli CFT073
uucauauuaaccucucag

SEQ ID NO: 652340 - RNA, 12 nt, Escherichia coli CFT073
uucauacugccg

SEQ ID NO: 652341 - RNA, 21 nt, Escherichia coli CFT073
uucauacugccgaccaucugu

SEQ ID NO: 652342 - RNA, 18 nt, Escherichia coli CFT073
uucauaggcuuccacuuc

SEQ ID NO: 652343 - RNA, 17 nt, Escherichia coli CFT073
uucauagguaaacauca

SEQ ID NO: 652344 - RNA, 18 nt, Escherichia coli CFT073
uucaggucaucacucugu

SEQ ID NO: 652345 - RNA, 16 nt, Escherichia coli CFT073
uucagcguuccccaga

SEQ ID NO: 652346 - RNA, 15 nt, Escherichia coli CFT073
uucagcgacagauua

SEQ ID NO: 652347 - RNA, 22 nt, Escherichia coli CFT073
uucagcguaucccagugcagca

SEQ ID NO: 652348 - RNA, 16 nt, Escherichia coli CFT073
uucagugcauaagucc

SEQ ID NO: 652349 - RNA, 17 nt, Escherichia coli CFT073
uucaguauauugcagaa

SEQ ID NO: 652350 - RNA, 17 nt, Escherichia coli CFT073
uucaguaugaucuugcc

SEQ ID NO: 652351 - RNA, 15 nt, Escherichia coli CFT073
uucaguauugagcaa

SEQ ID NO: 652352 - RNA, 22 nt, Escherichia coli CFT073
uucagguuacgcccuuccccca

SEQ ID NO: 652353 - RNA, 16 nt, Escherichia coli CFT073
uucagguuguuuucug

SEQ ID NO: 652354 - RNA, 14 nt, Escherichia coli CFT073
uucaguaaucaacg

SEQ ID NO: 652355 - RNA, 21 nt, Escherichia coli CFT073
uucaguaccagcaccugaauc

SEQ ID NO: 652356 - RNA, 21 nt, Escherichia coli CFT073
uucaguacguucacgcagcuc

SEQ ID NO: 652357 - RNA, 19 nt, Escherichia coli CFT073
uucauaaucaagaccucau

SEQ ID NO: 652358 - RNA, 15 nt, Escherichia coli CFT073
uucauaaacaauaca

SEQ ID NO: 652359 - RNA, 11 nt, Escherichia coli CFT073
uucaguucugg

SEQ ID NO: 652360 - RNA, 18 nt, Escherichia coli CFT073
uucagugcguuacacaga

SEQ ID NO: 652361 - RNA, 21 nt, Escherichia coli CFT073
uucaguguuuccccacuauug

SEQ ID NO: 652362 - RNA, 18 nt, Escherichia coli CFT073
uucaguucaucuacuacu

SEQ ID NO: 652363 - RNA, 17 nt, Escherichia coli CFT073
uucaguuugcccagguc

SEQ ID NO: 652364 - RNA, 16 nt, Escherichia coli CFT073
uucaguuuccagcaaa

SEQ ID NO: 652365 - RNA, 22 nt, Escherichia coli CFT073
uucuucgucgucuucgucccag

SEQ ID NO: 652366 - RNA, 14 nt, Escherichia coli CFT073
uucuucccagaccc

SEQ ID NO: 652367 - RNA, 22 nt, Escherichia coli CFT073
uucuuccggcagcaaauucacc

SEQ ID NO: 652368 - RNA, 21 nt, Escherichia coli CFT073
uucuuccgggcuauacacccu

SEQ ID NO: 652369 - RNA, 21 nt, Escherichia coli CFT073
uucuucaugcgucaaaugcag

SEQ ID NO: 652370 - RNA, 18 nt, Escherichia coli CFT073
uucuuccagguuaaccca

SEQ ID NO: 652371 - RNA, 15 nt, Escherichia coli CFT073
uucuuccagcggcag

SEQ ID NO: 652372 - RNA, 16 nt, Escherichia coli CFT073
uucuucgcagcaaauc

SEQ ID NO: 652373 - RNA, 20 nt, Escherichia coli CFT073
uucuucgcgccauccagcuc

SEQ ID NO: 652374 - RNA, 21 nt, Escherichia coli CFT073
uucuucgcgccauccagcuca

SEQ ID NO: 652375 - RNA, 13 nt, Escherichia coli CFT073
uucuuauucagaa

SEQ ID NO: 652376 - RNA, 17 nt, Escherichia coli CFT073
uucuucaacaauugaag

SEQ ID NO: 652377 - RNA, 19 nt, Escherichia coli CFT073
uucuucaaguguggccgcc

SEQ ID NO: 652378 - RNA, 16 nt, Escherichia coli CFT073
uucuucauuccaguca

SEQ ID NO: 652379 - RNA, 21 nt, Escherichia coli CFT073
uucuucauucccggaaauugc

SEQ ID NO: 652380 - RNA, 23 nt, Escherichia coli CFT073
uucuucauucccggaaauugcca

SEQ ID NO: 652381 - RNA, 11 nt, Escherichia coli CFT073
uucuuccagca

SEQ ID NO: 652382 - RNA, 21 nt, Escherichia coli CFT073
uucuguuaaaucauccuguuc

SEQ ID NO: 652383 - RNA, 16 nt, Escherichia coli CFT073
uucuguggcagggcag

SEQ ID NO: 652384 - RNA, 15 nt, Escherichia coli CFT073
uucuguugauaaaac

SEQ ID NO: 652385 - RNA, 20 nt, Escherichia coli CFT073
uucugucuuaacgcaccaug

SEQ ID NO: 652386 - RNA, 19 nt, Escherichia coli CFT073
uucugugcagccaaaaaug

SEQ ID NO: 652387 - RNA, 13 nt, Escherichia coli CFT073
uucuguccugaaa

SEQ ID NO: 652388 - RNA, 20 nt, Escherichia coli CFT073
uucugucgauaaacucaugg

SEQ ID NO: 652389 - RNA, 22 nt, Escherichia coli CFT073
uucuguaacucgaauuauucag

SEQ ID NO: 652390 - RNA, 13 nt, Escherichia coli CFT073
uucuguaauccau

SEQ ID NO: 652391 - RNA, 18 nt, Escherichia coli CFT073
uucuggcuugcugccccc

SEQ ID NO: 652392 - RNA, 14 nt, Escherichia coli CFT073
uucuggugaugcau

SEQ ID NO: 652393 - RNA, 13 nt, Escherichia coli CFT073
uucuuaauugcac

SEQ ID NO: 652394 - RNA, 16 nt, Escherichia coli CFT073
uucuuaagauaagaau

SEQ ID NO: 652395 - RNA, 19 nt, Escherichia coli CFT073
uucuuaagguuuuuuccuu

SEQ ID NO: 652396 - RNA, 12 nt, Escherichia coli CFT073
uucucauuuuga

SEQ ID NO: 652397 - RNA, 17 nt, Escherichia coli CFT073
uucucaaagguaauggu

SEQ ID NO: 652398 - RNA, 20 nt, Escherichia coli CFT073
uucucaauauacgaaaauuu

SEQ ID NO: 652399 - RNA, 16 nt, Escherichia coli CFT073
uucucaaucccuuucu

SEQ ID NO: 652400 - RNA, 16 nt, Escherichia coli CFT073
uucucaaucugcuugc

SEQ ID NO: 652401 - RNA, 19 nt, Escherichia coli CFT073
uucuaucgcauuauccuuu

SEQ ID NO: 652402 - RNA, 15 nt, Escherichia coli CFT073
uucuaucaucauauc

SEQ ID NO: 652403 - RNA, 17 nt, Escherichia coli CFT073
uucguuuuaaugcgauc

SEQ ID NO: 652404 - RNA, 21 nt, Escherichia coli CFT073
uucguuuuacgcacuucuucc

SEQ ID NO: 652405 - RNA, 19 nt, Escherichia coli CFT073
uucugagaucaaugcgcca

SEQ ID NO: 652406 - RNA, 14 nt, Escherichia coli CFT073
uucugagcaucaca

SEQ ID NO: 652407 - RNA, 23 nt, Escherichia coli CFT073
uucugacacugccacuuuuuccc

SEQ ID NO: 652408 - RNA, 13 nt, Escherichia coli CFT073
uucugaccagcca

SEQ ID NO: 652409 - RNA, 21 nt, Escherichia coli CFT073
uucugauaaaugaagaaaaac

SEQ ID NO: 652410 - RNA, 22 nt, Escherichia coli CFT073
uucugauaaaugaagaaaaacc

SEQ ID NO: 652411 - RNA, 23 nt, Escherichia coli CFT073
uucugcggccauuuuuuuaccca

SEQ ID NO: 652412 - RNA, 21 nt, Escherichia coli CFT073
uucugcgguugugcaaaaaaa

SEQ ID NO: 652413 - RNA, 19 nt, Escherichia coli CFT073
uucuggcaauuaacgcaca

SEQ ID NO: 652414 - RNA, 13 nt, Escherichia coli CFT073
uucuggcaccagu

SEQ ID NO: 652415 - RNA, 16 nt, Escherichia coli CFT073
uucuggaguaaugcau

SEQ ID NO: 652416 - RNA, 16 nt, Escherichia coli CFT073
uucuggagucggagcc

SEQ ID NO: 652417 - RNA, 21 nt, Escherichia coli CFT073
uucuggauauacgcuuucagc

SEQ ID NO: 652418 - RNA, 23 nt, Escherichia coli CFT073
uucuggcauccagcguucuauca

SEQ ID NO: 652419 - RNA, 19 nt, Escherichia coli CFT073
uucuggaaguaaucacgaa

SEQ ID NO: 652420 - RNA, 20 nt, Escherichia coli CFT073
uucugcuguucuucugccga

SEQ ID NO: 652421 - RNA, 14 nt, Escherichia coli CFT073
uucucuuuccagca

SEQ ID NO: 652422 - RNA, 20 nt, Escherichia coli CFT073
uucucuuugggcucacccau

SEQ ID NO: 652423 - RNA, 14 nt, Escherichia coli CFT073
uucugaauauguuu

SEQ ID NO: 652424 - RNA, 16 nt, Escherichia coli CFT073
uucuccggcagcuuua

SEQ ID NO: 652425 - RNA, 17 nt, Escherichia coli CFT073
uucggcauuaauuagua

SEQ ID NO: 652426 - RNA, 18 nt, Escherichia coli CFT073
uucggcagugaaaacgca

SEQ ID NO: 652427 - RNA, 22 nt, Escherichia coli CFT073
uucggccuaccaugaucugcaa

SEQ ID NO: 652428 - RNA, 17 nt, Escherichia coli CFT073
uucggcccaugacaaac

SEQ ID NO: 652429 - RNA, 13 nt, Escherichia coli CFT073
uucggcaaucaca

SEQ ID NO: 652430 - RNA, 17 nt, Escherichia coli CFT073
uucggcagaaaauccac

SEQ ID NO: 652431 - RNA, 22 nt, Escherichia coli CFT073
uucgcuaaagacuuugcugccu

SEQ ID NO: 652432 - RNA, 18 nt, Escherichia coli CFT073
uucguuuccccacauguu

SEQ ID NO: 652433 - RNA, 22 nt, Escherichia coli CFT073
uucguugugucgccagcaauac

SEQ ID NO: 652434 - RNA, 13 nt, Escherichia coli CFT073
uucguugcaguaa

SEQ ID NO: 652435 - RNA, 22 nt, Escherichia coli CFT073
uucgucgaguuuauagccuguc

SEQ ID NO: 652436 - RNA, 15 nt, Escherichia coli CFT073
uucgucgccaucaau

SEQ ID NO: 652437 - RNA, 15 nt, Escherichia coli CFT073
uucgucgaacucauc

SEQ ID NO: 652438 - RNA, 18 nt, Escherichia coli CFT073
uucguccccaguuuucca

SEQ ID NO: 652439 - RNA, 22 nt, Escherichia coli CFT073
uucguccccaguuuuccauccu

SEQ ID NO: 652440 - RNA, 14 nt, Escherichia coli CFT073
uucggucaugguga

SEQ ID NO: 652441 - RNA, 13 nt, Escherichia coli CFT073
uucguccauccca

SEQ ID NO: 652442 - RNA, 15 nt, Escherichia coli CFT073
uucggguuauugguu

SEQ ID NO: 652443 - RNA, 21 nt, Escherichia coli CFT073
uucggguuauugguuaacaag

SEQ ID NO: 652444 - RNA, 18 nt, Escherichia coli CFT073
uucgacuuccaccagcgg

SEQ ID NO: 652445 - RNA, 16 nt, Escherichia coli CFT073
uucgagcaauuuuccu

SEQ ID NO: 652446 - RNA, 23 nt, Escherichia coli CFT073
uucgaguacauccacugcauacu

SEQ ID NO: 652447 - RNA, 22 nt, Escherichia coli CFT073
uucgagugucacuggccagcgg

SEQ ID NO: 652448 - RNA, 17 nt, Escherichia coli CFT073
uucgauaaacucaauca

SEQ ID NO: 652449 - RNA, 14 nt, Escherichia coli CFT073
uucgauaaucaaau

SEQ ID NO: 652450 - RNA, 15 nt, Escherichia coli CFT073
uucgauaaaggccau

SEQ ID NO: 652451 - RNA, 16 nt, Escherichia coli CFT073
uucgauguggcucagc

SEQ ID NO: 652452 - RNA, 14 nt, Escherichia coli CFT073
uucgaugagagcgg

SEQ ID NO: 652453 - RNA, 15 nt, Escherichia coli CFT073
uucgcaccaaaucca

SEQ ID NO: 652454 - RNA, 19 nt, Escherichia coli CFT073
uucgccaauggcugccgcc

SEQ ID NO: 652455 - RNA, 21 nt, Escherichia coli CFT073
uucgcaauaaucaucucuccu

SEQ ID NO: 652456 - RNA, 11 nt, Escherichia coli CFT073
uucgccagguc

SEQ ID NO: 652457 - RNA, 21 nt, Escherichia coli CFT073
uucgaugcguaccauuucuuc

SEQ ID NO: 652458 - RNA, 19 nt, Escherichia coli CFT073
uucgcaaaaaaccaucccu

SEQ ID NO: 652459 - RNA, 20 nt, Escherichia coli CFT073
uucgcaaaacacaguuuuga

SEQ ID NO: 652460 - RNA, 19 nt, Escherichia coli CFT073
uucgcccauuaacaaccga

SEQ ID NO: 652461 - RNA, 16 nt, Escherichia coli CFT073
uucgcccgccgagaaa

SEQ ID NO: 652462 - RNA, 13 nt, Escherichia coli CFT073
uucgcccgccgcu

SEQ ID NO: 652463 - RNA, 13 nt, Escherichia coli CFT073
uucgcgcuccggc

SEQ ID NO: 652464 - RNA, 16 nt, Escherichia coli CFT073
uucgcggaauuucaga

SEQ ID NO: 652465 - RNA, 16 nt, Escherichia coli CFT073
uucgcccguucuuccu

SEQ ID NO: 652466 - RNA, 22 nt, Escherichia coli CFT073
uucgcgacguucguuaacaaca

SEQ ID NO: 652467 - RNA, 22 nt, Escherichia coli CFT073
uucgcgaucaaacgccagauca

SEQ ID NO: 652468 - RNA, 18 nt, Escherichia coli CFT073
uuccugaaucagccagua

SEQ ID NO: 652469 - RNA, 21 nt, Escherichia coli CFT073
uuccugaaucacaauccgcuc

SEQ ID NO: 652470 - RNA, 19 nt, Escherichia coli CFT073
uuccugacgaucaagcgaa

SEQ ID NO: 652471 - RNA, 20 nt, Escherichia coli CFT073
uuccugauaaccuuccagcu

SEQ ID NO: 652472 - RNA, 21 nt, Escherichia coli CFT073
uuccugauaaccuuccagcuu

SEQ ID NO: 652473 - RNA, 13 nt, Escherichia coli CFT073
uuccugagaggau

SEQ ID NO: 652474 - RNA, 20 nt, Escherichia coli CFT073
uuccugagucagcagcgcca

SEQ ID NO: 652475 - RNA, 15 nt, Escherichia coli CFT073
uuccgucagcggcag

SEQ ID NO: 652476 - RNA, 22 nt, Escherichia coli CFT073
uuccguagcguuuuuucauuuc

SEQ ID NO: 652477 - RNA, 22 nt, Escherichia coli CFT073
uuccggugcuuuauacaaauga

SEQ ID NO: 652478 - RNA, 15 nt, Escherichia coli CFT073
uuccuucaagccauc

SEQ ID NO: 652479 - RNA, 17 nt, Escherichia coli CFT073
uuccuuaugcugcuuac

SEQ ID NO: 652480 - RNA, 18 nt, Escherichia coli CFT073
uuccuucgcgugacaaaa

SEQ ID NO: 652481 - RNA, 20 nt, Escherichia coli CFT073
uuccuucgcuuccuguauau

SEQ ID NO: 652482 - RNA, 13 nt, Escherichia coli CFT073
uucgaagaaaaac

SEQ ID NO: 652483 - RNA, 19 nt, Escherichia coli CFT073
uuccuugaaaaagagguug

SEQ ID NO: 652484 - RNA, 17 nt, Escherichia coli CFT073
uucgacaauaaucaacg

SEQ ID NO: 652485 - RNA, 23 nt, Escherichia coli CFT073
uucgacagcguuucgccgcccag

SEQ ID NO: 652486 - RNA, 15 nt, Escherichia coli CFT073
uucgaauccuucccc

SEQ ID NO: 652487 - RNA, 13 nt, Escherichia coli CFT073
uucgaccacaccu

SEQ ID NO: 652488 - RNA, 14 nt, Escherichia coli CFT073
uucgaccacaccuu

SEQ ID NO: 652489 - RNA, 18 nt, Escherichia coli CFT073
uucgaccagccaggccgc

SEQ ID NO: 652490 - RNA, 14 nt, Escherichia coli CFT073
uuccgcacguuuuu

SEQ ID NO: 652491 - RNA, 20 nt, Escherichia coli CFT073
uuccgcaccugccagcgccg

SEQ ID NO: 652492 - RNA, 15 nt, Escherichia coli CFT073
uuccgcaauuccgcc

SEQ ID NO: 652493 - RNA, 13 nt, Escherichia coli CFT073
uucccugcauaau

SEQ ID NO: 652494 - RNA, 16 nt, Escherichia coli CFT073
uucccugccugacaga

SEQ ID NO: 652495 - RNA, 16 nt, Escherichia coli CFT073
uucccuccucaaauca

SEQ ID NO: 652496 - RNA, 22 nt, Escherichia coli CFT073
uucccuggcguucgguauuaau

SEQ ID NO: 652497 - RNA, 15 nt, Escherichia coli CFT073
uuccgggcuguuuuc

SEQ ID NO: 652498 - RNA, 18 nt, Escherichia coli CFT073
uuccgggagcaauuugua

SEQ ID NO: 652499 - RNA, 19 nt, Escherichia coli CFT073
uuccggcucccgcagccac

SEQ ID NO: 652500 - RNA, 13 nt, Escherichia coli CFT073
uuccggcagcuuc

SEQ ID NO: 652501 - RNA, 20 nt, Escherichia coli CFT073
uuccggcgcuguuuggugca

SEQ ID NO: 652502 - RNA, 20 nt, Escherichia coli CFT073
uuccggcagcaaauucaccg

SEQ ID NO: 652503 - RNA, 20 nt, Escherichia coli CFT073
uuccgcaccaacgcaaaaaa

SEQ ID NO: 652504 - RNA, 20 nt, Escherichia coli CFT073
uuccgccgauggugcagcag

SEQ ID NO: 652505 - RNA, 14 nt, Escherichia coli CFT073
uucccggcuuugca

SEQ ID NO: 652506 - RNA, 18 nt, Escherichia coli CFT073
uuccccauucugcgcuga

SEQ ID NO: 652507 - RNA, 22 nt, Escherichia coli CFT073
uuccccauucugcgcugacucu

SEQ ID NO: 652508 - RNA, 15 nt, Escherichia coli CFT073
uuccccuaacucuuu

SEQ ID NO: 652509 - RNA, 19 nt, Escherichia coli CFT073
uuccccggcagcaucagua

SEQ ID NO: 652510 - RNA, 18 nt, Escherichia coli CFT073
uuccccggucagcagcac

SEQ ID NO: 652511 - RNA, 14 nt, Escherichia coli CFT073
uuccccgucaucau

SEQ ID NO: 652512 - RNA, 16 nt, Escherichia coli CFT073
uuccccugccaaccaa

SEQ ID NO: 652513 - RNA, 14 nt, Escherichia coli CFT073
uucccccugccaga

SEQ ID NO: 652514 - RNA, 19 nt, Escherichia coli CFT073
uuccccgcuucagcccgcg

SEQ ID NO: 652515 - RNA, 19 nt, Escherichia coli CFT073
uugucgaugggggagguca

SEQ ID NO: 652516 - RNA, 15 nt, Escherichia coli CFT073
uuguccgucugaaaa

SEQ ID NO: 652517 - RNA, 23 nt, Escherichia coli CFT073
uugucauuguuauaauguuggcu

SEQ ID NO: 652518 - RNA, 22 nt, Escherichia coli CFT073
uugucaucgaauaaauugagcu

SEQ ID NO: 652519 - RNA, 14 nt, Escherichia coli CFT073
uugucaucagucuu

SEQ ID NO: 652520 - RNA, 16 nt, Escherichia coli CFT073
uuguccagaucuuucg

SEQ ID NO: 652521 - RNA, 20 nt, Escherichia coli CFT073
uuguccaccguugugaaaau

SEQ ID NO: 652522 - RNA, 23 nt, Escherichia coli CFT073
uugucagacggugccagguaaug

SEQ ID NO: 652523 - RNA, 18 nt, Escherichia coli CFT073
uugucaggccggaauaac

SEQ ID NO: 652524 - RNA, 16 nt, Escherichia coli CFT073
uugucauaaccaaugu

SEQ ID NO: 652525 - RNA, 12 nt, Escherichia coli CFT073
uuguaucaccac

SEQ ID NO: 652526 - RNA, 15 nt, Escherichia coli CFT073
uuguaucccuuuuca

SEQ ID NO: 652527 - RNA, 15 nt, Escherichia coli CFT073
uuguauggccuggug

SEQ ID NO: 652528 - RNA, 14 nt, Escherichia coli CFT073
uuguaugguuuugu

SEQ ID NO: 652529 - RNA, 23 nt, Escherichia coli CFT073
uuguaugucggugcauuuucuau

SEQ ID NO: 652530 - RNA, 19 nt, Escherichia coli CFT073
uuguaccagcuucagaaua

SEQ ID NO: 652531 - RNA, 16 nt, Escherichia coli CFT073
uuguaccaguuaaagc

SEQ ID NO: 652532 - RNA, 19 nt, Escherichia coli CFT073
uuguacccaacgcgauacg

SEQ ID NO: 652533 - RNA, 13 nt, Escherichia coli CFT073
uuguagagcagca

SEQ ID NO: 652534 - RNA, 13 nt, Escherichia coli CFT073
uuguagaccugau

SEQ ID NO: 652535 - RNA, 15 nt, Escherichia coli CFT073
uuguacuuuaaaaua

SEQ ID NO: 652536 - RNA, 15 nt, Escherichia coli CFT073
uuguacuuuccagcc

SEQ ID NO: 652537 - RNA, 22 nt, Escherichia coli CFT073
uuguagugcgcgccaguaauca

SEQ ID NO: 652538 - RNA, 19 nt, Escherichia coli CFT073
uuguagcuaaacugaucuu

SEQ ID NO: 652539 - RNA, 11 nt, Escherichia coli CFT073
uuguaagcagg

SEQ ID NO: 652540 - RNA, 16 nt, Escherichia coli CFT073
uuguaagcagggccaa

SEQ ID NO: 652541 - RNA, 21 nt, Escherichia coli CFT073
uuguaacucaggaacuuagua

SEQ ID NO: 652542 - RNA, 16 nt, Escherichia coli CFT073
uuguaagucagaaagc

SEQ ID NO: 652543 - RNA, 20 nt, Escherichia coli CFT073
uugguugcagcacgcuggac

SEQ ID NO: 652544 - RNA, 16 nt, Escherichia coli CFT073
uugguuucgaugccuu

SEQ ID NO: 652545 - RNA, 14 nt, Escherichia coli CFT073
uuguaaagcgccaa

SEQ ID NO: 652546 - RNA, 16 nt, Escherichia coli CFT073
uuguaaauaauugaau

SEQ ID NO: 652547 - RNA, 12 nt, Escherichia coli CFT073
uuguaaaugaac

SEQ ID NO: 652548 - RNA, 23 nt, Escherichia coli CFT073
uuguaacaauccgauaaucccuu

SEQ ID NO: 652549 - RNA, 10 nt, Escherichia coli CFT073
uuguuuugcu

SEQ ID NO: 652550 - RNA, 15 nt, Escherichia coli CFT073
uuguucugcaaauuc

SEQ ID NO: 652551 - RNA, 16 nt, Escherichia coli CFT073
uuguucaugccggaug

SEQ ID NO: 652552 - RNA, 18 nt, Escherichia coli CFT073
uuguuaaauccagauccu

SEQ ID NO: 652553 - RNA, 16 nt, Escherichia coli CFT073
uuguguuuauuuaaug

SEQ ID NO: 652554 - RNA, 23 nt, Escherichia coli CFT073
uuguguaucaggucgaaaauaau

SEQ ID NO: 652555 - RNA, 17 nt, Escherichia coli CFT073
uugugugcuggccauca

SEQ ID NO: 652556 - RNA, 19 nt, Escherichia coli CFT073
uugugggccgaaaugagau

SEQ ID NO: 652557 - RNA, 12 nt, Escherichia coli CFT073
uugugggccuga

SEQ ID NO: 652558 - RNA, 15 nt, Escherichia coli CFT073
uugugggcaggaaaa

SEQ ID NO: 652559 - RNA, 14 nt, Escherichia coli CFT073
uuguggaucgauuu

SEQ ID NO: 652560 - RNA, 13 nt, Escherichia coli CFT073
uugugcuucaguu

SEQ ID NO: 652561 - RNA, 22 nt, Escherichia coli CFT073
uugugcuacugcuucaaaguuu

SEQ ID NO: 652562 - RNA, 19 nt, Escherichia coli CFT073
uugugccaucgccacacca

SEQ ID NO: 652563 - RNA, 17 nt, Escherichia coli CFT073
uugugauuuuagccaua

SEQ ID NO: 652564 - RNA, 20 nt, Escherichia coli CFT073
uugugccacauccagcggca

SEQ ID NO: 652565 - RNA, 12 nt, Escherichia coli CFT073
uugugccagacc

SEQ ID NO: 652566 - RNA, 21 nt, Escherichia coli CFT073
uugugccagaccgaacagcau

SEQ ID NO: 652567 - RNA, 19 nt, Escherichia coli CFT073
uugugcaaaaaaauuucau

SEQ ID NO: 652568 - RNA, 20 nt, Escherichia coli CFT073
uugugcacagaaaagcagag

SEQ ID NO: 652569 - RNA, 14 nt, Escherichia coli CFT073
uugugcaccaccaa

SEQ ID NO: 652570 - RNA, 13 nt, Escherichia coli CFT073
uugugaagugcaa

SEQ ID NO: 652571 - RNA, 20 nt, Escherichia coli CFT073
uugugacauuaaccaaccac

SEQ ID NO: 652572 - RNA, 21 nt, Escherichia coli CFT073
uugugaccacggacuuaugag

SEQ ID NO: 652573 - RNA, 21 nt, Escherichia coli CFT073
uugugaacuucgccaggauag

SEQ ID NO: 652574 - RNA, 17 nt, Escherichia coli CFT073
uugucgggcaggagcug

SEQ ID NO: 652575 - RNA, 14 nt, Escherichia coli CFT073
uugucgggcaggcu

SEQ ID NO: 652576 - RNA, 16 nt, Escherichia coli CFT073
uugucgguaauuucac

SEQ ID NO: 652577 - RNA, 14 nt, Escherichia coli CFT073
uugucuccagggcg

SEQ ID NO: 652578 - RNA, 18 nt, Escherichia coli CFT073
uuuauugaauuugcaaug

SEQ ID NO: 652579 - RNA, 20 nt, Escherichia coli CFT073
uuuauugaauuuguaggccu

SEQ ID NO: 652580 - RNA, 16 nt, Escherichia coli CFT073
uuuauugacauguuga

SEQ ID NO: 652581 - RNA, 14 nt, Escherichia coli CFT073
uuuauuaaauauua

SEQ ID NO: 652582 - RNA, 23 nt, Escherichia coli CFT073
uuuaugaaucaaaucaaccaggc

SEQ ID NO: 652583 - RNA, 12 nt, Escherichia coli CFT073
uuuaucuuccca

SEQ ID NO: 652584 - RNA, 13 nt, Escherichia coli CFT073
uuuaucuucccag

SEQ ID NO: 652585 - RNA, 14 nt, Escherichia coli CFT073
uuuauggagaaaac

SEQ ID NO: 652586 - RNA, 22 nt, Escherichia coli CFT073
uuuaucgcgcaaccacaacgca

SEQ ID NO: 652587 - RNA, 15 nt, Escherichia coli CFT073
uuuaucggcacccau

SEQ ID NO: 652588 - RNA, 12 nt, Escherichia coli CFT073
uuuauauucaug

SEQ ID NO: 652589 - RNA, 19 nt, Escherichia coli CFT073
uuuaucagcucauaggccu

SEQ ID NO: 652590 - RNA, 12 nt, Escherichia coli CFT073
uuuaucaggccu

SEQ ID NO: 652591 - RNA, 22 nt, Escherichia coli CFT073
uuuauccauauuuuuugaaaaa

SEQ ID NO: 652592 - RNA, 14 nt, Escherichia coli CFT073
uuuaucauaauagu

SEQ ID NO: 652593 - RNA, 19 nt, Escherichia coli CFT073
uuuaucccggcaaaaaaca

SEQ ID NO: 652594 - RNA, 15 nt, Escherichia coli CFT073
uuuaucccuucucca

SEQ ID NO: 652595 - RNA, 20 nt, Escherichia coli CFT073
uuuauccgaacacucgucca

SEQ ID NO: 652596 - RNA, 20 nt, Escherichia coli CFT073
uuuauccgaguagcucacca

SEQ ID NO: 652597 - RNA, 15 nt, Escherichia coli CFT073
uuuaucgacauaaau

SEQ ID NO: 652598 - RNA, 17 nt, Escherichia coli CFT073
uuuauaccaacaaaaaa

SEQ ID NO: 652599 - RNA, 20 nt, Escherichia coli CFT073
uuuauaacggugcugcacau

SEQ ID NO: 652600 - RNA, 16 nt, Escherichia coli CFT073
uuuauaacuauaugac

SEQ ID NO: 652601 - RNA, 22 nt, Escherichia coli CFT073
uuuauaacuauaugacucauaa

SEQ ID NO: 652602 - RNA, 12 nt, Escherichia coli CFT073
uuuagacuuugu

SEQ ID NO: 652603 - RNA, 17 nt, Escherichia coli CFT073
uuuagacacaucagcaa

SEQ ID NO: 652604 - RNA, 12 nt, Escherichia coli CFT073
uuuagacagcuu

SEQ ID NO: 652605 - RNA, 19 nt, Escherichia coli CFT073
uuuagcaguucaucaagcu

SEQ ID NO: 652606 - RNA, 15 nt, Escherichia coli CFT073
uuuacuaaaaaguga

SEQ ID NO: 652607 - RNA, 23 nt, Escherichia coli CFT073
uuuacuaaaaagugauaaaaguc

SEQ ID NO: 652608 - RNA, 16 nt, Escherichia coli CFT073
uuuacuaaaacuucau

SEQ ID NO: 652609 - RNA, 21 nt, Escherichia coli CFT073
uuuagaacugaucaauaaauu

SEQ ID NO: 652610 - RNA, 13 nt, Escherichia coli CFT073
uuuacuuucuugc

SEQ ID NO: 652611 - RNA, 15 nt, Escherichia coli CFT073
uuuacuuugcaauga

SEQ ID NO: 652612 - RNA, 15 nt, Escherichia coli CFT073
uuuagaaaagaguau

SEQ ID NO: 652613 - RNA, 17 nt, Escherichia coli CFT073
uuuacuuuugaaggaau

SEQ ID NO: 652614 - RNA, 13 nt, Escherichia coli CFT073
uuuacaucaucag

SEQ ID NO: 652615 - RNA, 21 nt, Escherichia coli CFT073
uuuaauggccucguggaaacc

SEQ ID NO: 652616 - RNA, 22 nt, Escherichia coli CFT073
uuuaccugaauugacuacaaaa

SEQ ID NO: 652617 - RNA, 14 nt, Escherichia coli CFT073
uuuaccgucuuucg

SEQ ID NO: 652618 - RNA, 15 nt, Escherichia coli CFT073
uuuaccguuccggua

SEQ ID NO: 652619 - RNA, 13 nt, Escherichia coli CFT073
uuuaccuucaucc

SEQ ID NO: 652620 - RNA, 22 nt, Escherichia coli CFT073
uuuacccguguuuugcaucaac

SEQ ID NO: 652621 - RNA, 16 nt, Escherichia coli CFT073
uuuacauuaauuuuca

SEQ ID NO: 652622 - RNA, 19 nt, Escherichia coli CFT073
uuuacauuaauuuucaauu

SEQ ID NO: 652623 - RNA, 18 nt, Escherichia coli CFT073
uuuaccgccacagcagcc

SEQ ID NO: 652624 - RNA, 15 nt, Escherichia coli CFT073
uuuaccggcaacucu

SEQ ID NO: 652625 - RNA, 17 nt, Escherichia coli CFT073
uuuaccggugccagcaa

SEQ ID NO: 652626 - RNA, 19 nt, Escherichia coli CFT073
uuuaauaaaaaggugauuu

SEQ ID NO: 652627 - RNA, 22 nt, Escherichia coli CFT073
uuuaacuucgcguucuguggca

SEQ ID NO: 652628 - RNA, 20 nt, Escherichia coli CFT073
uuuaauauccggugcauuca

SEQ ID NO: 652629 - RNA, 19 nt, Escherichia coli CFT073
uuuaauagauaauuuugaa

SEQ ID NO: 652630 - RNA, 23 nt, Escherichia coli CFT073
uuuaauaaucucgccuuaucaga

SEQ ID NO: 652631 - RNA, 13 nt, Escherichia coli CFT073
uuuaauaacagcu

SEQ ID NO: 652632 - RNA, 15 nt, Escherichia coli CFT073
uuuaauacaaucugg

SEQ ID NO: 652633 - RNA, 16 nt, Escherichia coli CFT073
uuuaaucuauauaugu

SEQ ID NO: 652634 - RNA, 21 nt, Escherichia coli CFT073
uuuaaucuauauauguuuuuu

SEQ ID NO: 652635 - RNA, 16 nt, Escherichia coli CFT073
uuuaaugccaaucuuc

SEQ ID NO: 652636 - RNA, 18 nt, Escherichia coli CFT073
uugguauggcugucgcac

SEQ ID NO: 652637 - RNA, 18 nt, Escherichia coli CFT073
uuggggaugacgaauaau

SEQ ID NO: 652638 - RNA, 17 nt, Escherichia coli CFT073
uugggcguuacagcugg

SEQ ID NO: 652639 - RNA, 18 nt, Escherichia coli CFT073
uugggcucacccaucgau

SEQ ID NO: 652640 - RNA, 19 nt, Escherichia coli CFT073
uuggucggaaucccaucgc

SEQ ID NO: 652641 - RNA, 16 nt, Escherichia coli CFT073
uuggugcauaacacaa

SEQ ID NO: 652642 - RNA, 23 nt, Escherichia coli CFT073
uuggugcccaggguaagaugaau

SEQ ID NO: 652643 - RNA, 20 nt, Escherichia coli CFT073
uugguuaacuccagcgaauc

SEQ ID NO: 652644 - RNA, 22 nt, Escherichia coli CFT073
uugguuaacugaauauuccagu

SEQ ID NO: 652645 - RNA, 17 nt, Escherichia coli CFT073
uugguggcgucaugcuc

SEQ ID NO: 652646 - RNA, 21 nt, Escherichia coli CFT073
uugguggcaaccggaauguuc

SEQ ID NO: 652647 - RNA, 21 nt, Escherichia coli CFT073
uuggccagucgcaaaucagcg

SEQ ID NO: 652648 - RNA, 12 nt, Escherichia coli CFT073
uuggccugaaua

SEQ ID NO: 652649 - RNA, 20 nt, Escherichia coli CFT073
uuggcgcgaaccaucaccuc

SEQ ID NO: 652650 - RNA, 23 nt, Escherichia coli CFT073
uuggcgcgaaccaucaccucuuc

SEQ ID NO: 652651 - RNA, 16 nt, Escherichia coli CFT073
uuggcgcauaacucac

SEQ ID NO: 652652 - RNA, 20 nt, Escherichia coli CFT073
uuggcgauaaaguugaagcu

SEQ ID NO: 652653 - RNA, 19 nt, Escherichia coli CFT073
uuggcgucgauaucaacca

SEQ ID NO: 652654 - RNA, 15 nt, Escherichia coli CFT073
uugggacagugcagg

SEQ ID NO: 652655 - RNA, 14 nt, Escherichia coli CFT073
uuggcuucacugau

SEQ ID NO: 652656 - RNA, 12 nt, Escherichia coli CFT073
uugcuucucuug

SEQ ID NO: 652657 - RNA, 14 nt, Escherichia coli CFT073
uugcuucuuacuau

SEQ ID NO: 652658 - RNA, 15 nt, Escherichia coli CFT073
uugcuuugcugugaa

SEQ ID NO: 652659 - RNA, 21 nt, Escherichia coli CFT073
uugcuuugaucaagcaccgcc

SEQ ID NO: 652660 - RNA, 18 nt, Escherichia coli CFT073
uugcuuccggcaagcaaa

SEQ ID NO: 652661 - RNA, 22 nt, Escherichia coli CFT073
uugcuuauuuaaacugaagacu

SEQ ID NO: 652662 - RNA, 18 nt, Escherichia coli CFT073
uugcuucaagaugccauu

SEQ ID NO: 652663 - RNA, 15 nt, Escherichia coli CFT073
uugcugugcuuuaca

SEQ ID NO: 652664 - RNA, 23 nt, Escherichia coli CFT073
uugcugucgauuuucacauaagc

SEQ ID NO: 652665 - RNA, 16 nt, Escherichia coli CFT073
uugcugucgcgcagca

SEQ ID NO: 652666 - RNA, 11 nt, Escherichia coli CFT073
uugcugugaag

SEQ ID NO: 652667 - RNA, 17 nt, Escherichia coli CFT073
uugcuguugauucugcg

SEQ ID NO: 652668 - RNA, 12 nt, Escherichia coli CFT073
uugcguaacuga

SEQ ID NO: 652669 - RNA, 15 nt, Escherichia coli CFT073
uugcguaaaaccugc

SEQ ID NO: 652670 - RNA, 22 nt, Escherichia coli CFT073
uugcgguggauuuaaugccaau

SEQ ID NO: 652671 - RNA, 21 nt, Escherichia coli CFT073
uugcgguguguggcugucaac

SEQ ID NO: 652672 - RNA, 13 nt, Escherichia coli CFT073
uugcgguuaaagc

SEQ ID NO: 652673 - RNA, 15 nt, Escherichia coli CFT073
uugcgguuucaacug

SEQ ID NO: 652674 - RNA, 13 nt, Escherichia coli CFT073
uugcuauaugcaa

SEQ ID NO: 652675 - RNA, 16 nt, Escherichia coli CFT073
uugcuauaugcaaggc

SEQ ID NO: 652676 - RNA, 23 nt, Escherichia coli CFT073
uugcuaccgucgccuuucacuuc

SEQ ID NO: 652677 - RNA, 18 nt, Escherichia coli CFT073
uugcuggccuagaugaau

SEQ ID NO: 652678 - RNA, 19 nt, Escherichia coli CFT073
uugcuaucgcgaaucccua

SEQ ID NO: 652679 - RNA, 15 nt, Escherichia coli CFT073
uugcugcugaagcaa

SEQ ID NO: 652680 - RNA, 13 nt, Escherichia coli CFT073
uugcuauuucccc

SEQ ID NO: 652681 - RNA, 14 nt, Escherichia coli CFT073
uugcugcucaaagg

SEQ ID NO: 652682 - RNA, 16 nt, Escherichia coli CFT073
uuggacuguugugaau

SEQ ID NO: 652683 - RNA, 19 nt, Escherichia coli CFT073
uuggacuguugugaauguu

SEQ ID NO: 652684 - RNA, 11 nt, Escherichia coli CFT073
uuggaaaucac

SEQ ID NO: 652685 - RNA, 14 nt, Escherichia coli CFT073
uuggcagcggcaag

SEQ ID NO: 652686 - RNA, 16 nt, Escherichia coli CFT073
uuggcaaucacaucac

SEQ ID NO: 652687 - RNA, 17 nt, Escherichia coli CFT073
uuggcacagguuuguac

SEQ ID NO: 652688 - RNA, 15 nt, Escherichia coli CFT073
uuggcaccaucccua

SEQ ID NO: 652689 - RNA, 12 nt, Escherichia coli CFT073
uuggcaccgccu

SEQ ID NO: 652690 - RNA, 18 nt, Escherichia coli CFT073
uuggaucuguugcuggcu

SEQ ID NO: 652691 - RNA, 14 nt, Escherichia coli CFT073
uuggcaaaaccaaa

SEQ ID NO: 652692 - RNA, 18 nt, Escherichia coli CFT073
uugccaggcaacagauaa

SEQ ID NO: 652693 - RNA, 20 nt, Escherichia coli CFT073
uugccaggucgcuugccgcc

SEQ ID NO: 652694 - RNA, 14 nt, Escherichia coli CFT073
uugccagugacaug

SEQ ID NO: 652695 - RNA, 22 nt, Escherichia coli CFT073
uugccagugguacaaaagcaau

SEQ ID NO: 652696 - RNA, 21 nt, Escherichia coli CFT073
uugccauaaaaacgauaaaua

SEQ ID NO: 652697 - RNA, 12 nt, Escherichia coli CFT073
uugccauaucca

SEQ ID NO: 652698 - RNA, 13 nt, Escherichia coli CFT073
uugccaugugccg

SEQ ID NO: 652699 - RNA, 16 nt, Escherichia coli CFT073
uugccauguuuuccuu

SEQ ID NO: 652700 - RNA, 17 nt, Escherichia coli CFT073
uugccauguuuuccuuu

SEQ ID NO: 652701 - RNA, 18 nt, Escherichia coli CFT073
uugccauguuuuccuuuu

SEQ ID NO: 652702 - RNA, 17 nt, Escherichia coli CFT073
uugccauuuucugacaa

SEQ ID NO: 652703 - RNA, 14 nt, Escherichia coli CFT073
uugccgucugccac

SEQ ID NO: 652704 - RNA, 15 nt, Escherichia coli CFT073
uugccguucuucccg

SEQ ID NO: 652705 - RNA, 19 nt, Escherichia coli CFT073
uugccguccggcaucgcaa

SEQ ID NO: 652706 - RNA, 20 nt, Escherichia coli CFT073
uugccgucgauaugcaaauc

SEQ ID NO: 652707 - RNA, 23 nt, Escherichia coli CFT073
uugccggggagauauuccccaga

SEQ ID NO: 652708 - RNA, 17 nt, Escherichia coli CFT073
uugccguacucuucaau

SEQ ID NO: 652709 - RNA, 21 nt, Escherichia coli CFT073
uugccguauaacgcgauuaca

SEQ ID NO: 652710 - RNA, 20 nt, Escherichia coli CFT073
uugcgggcgagauuuuacuu

SEQ ID NO: 652711 - RNA, 17 nt, Escherichia coli CFT073
uugcggcagagcaaaca

SEQ ID NO: 652712 - RNA, 13 nt, Escherichia coli CFT073
uugcggcacccau

SEQ ID NO: 652713 - RNA, 18 nt, Escherichia coli CFT073
uugcgacugaaccagcgc

SEQ ID NO: 652714 - RNA, 15 nt, Escherichia coli CFT073
uugcgacagccaucc

SEQ ID NO: 652715 - RNA, 23 nt, Escherichia coli CFT073
uugcgaguggcgcgccuguaagc

SEQ ID NO: 652716 - RNA, 18 nt, Escherichia coli CFT073
uugcgcgguguugauaca

SEQ ID NO: 652717 - RNA, 18 nt, Escherichia coli CFT073
uugcgcgacguugcuucu

SEQ ID NO: 652718 - RNA, 20 nt, Escherichia coli CFT073
uugcauccgauuguuccugc

SEQ ID NO: 652719 - RNA, 13 nt, Escherichia coli CFT073
uugcaucaucaag

SEQ ID NO: 652720 - RNA, 21 nt, Escherichia coli CFT073
uugcaucgccugcgcgauacu

SEQ ID NO: 652721 - RNA, 23 nt, Escherichia coli CFT073
uugcaguuggucagcaagaaacu

SEQ ID NO: 652722 - RNA, 21 nt, Escherichia coli CFT073
uugccaccgguacaaacauca

SEQ ID NO: 652723 - RNA, 13 nt, Escherichia coli CFT073
uugccagcagggc

SEQ ID NO: 652724 - RNA, 23 nt, Escherichia coli CFT073
uugccaccgguacaaacaucauc

SEQ ID NO: 652725 - RNA, 16 nt, Escherichia coli CFT073
uugcaugggaacugcu

SEQ ID NO: 652726 - RNA, 18 nt, Escherichia coli CFT073
uugcaggaacaaugccuc

SEQ ID NO: 652727 - RNA, 12 nt, Escherichia coli CFT073
uugcagcucccc

SEQ ID NO: 652728 - RNA, 22 nt, Escherichia coli CFT073
uugcagcuccccacaccaccau

SEQ ID NO: 652729 - RNA, 12 nt, Escherichia coli CFT073
uugcaggcuauu

SEQ ID NO: 652730 - RNA, 22 nt, Escherichia coli CFT073
uugcagggaggcaagacaugcu

SEQ ID NO: 652731 - RNA, 17 nt, Escherichia coli CFT073
uugcagggugcaagagu

SEQ ID NO: 652732 - RNA, 21 nt, Escherichia coli CFT073
uugcaggucguccugcaaagc

SEQ ID NO: 652733 - RNA, 14 nt, Escherichia coli CFT073
uugcagguucugcu

SEQ ID NO: 652734 - RNA, 18 nt, Escherichia coli CFT073
uugcaguccgcuaaaaau

SEQ ID NO: 652735 - RNA, 13 nt, Escherichia coli CFT073
uugcagaugcucu

SEQ ID NO: 652736 - RNA, 14 nt, Escherichia coli CFT073
uugcagaauuggcg

SEQ ID NO: 652737 - RNA, 20 nt, Escherichia coli CFT073
uugcagacgggcauuuucuu

SEQ ID NO: 652738 - RNA, 22 nt, Escherichia coli CFT073
uugcagacguucuucugcuuca

SEQ ID NO: 652739 - RNA, 22 nt, Escherichia coli CFT073
uugauuuuaaaggauuuacuaa

SEQ ID NO: 652740 - RNA, 18 nt, Escherichia coli CFT073
uugauuauccucuguaaa

SEQ ID NO: 652741 - RNA, 18 nt, Escherichia coli CFT073
uugauuaaugaugugcuu

SEQ ID NO: 652742 - RNA, 19 nt, Escherichia coli CFT073
uugauguuaccaacacuga

SEQ ID NO: 652743 - RNA, 22 nt, Escherichia coli CFT073
uugauguugccggauggaaaca

SEQ ID NO: 652744 - RNA, 13 nt, Escherichia coli CFT073
uugauguacucaa

SEQ ID NO: 652745 - RNA, 17 nt, Escherichia coli CFT073
uugauguccaguuccca

SEQ ID NO: 652746 - RNA, 20 nt, Escherichia coli CFT073
uugaugguaaaauaucacuc

SEQ ID NO: 652747 - RNA, 19 nt, Escherichia coli CFT073
uugauagauuucucuaaaa

SEQ ID NO: 652748 - RNA, 20 nt, Escherichia coli CFT073
uugauagauuucucuaaaaa

SEQ ID NO: 652749 - RNA, 12 nt, Escherichia coli CFT073
uugaugcugcca

SEQ ID NO: 652750 - RNA, 14 nt, Escherichia coli CFT073
uugauggauauaau

SEQ ID NO: 652751 - RNA, 22 nt, Escherichia coli CFT073
uugaucgcuggcagccauaauc

SEQ ID NO: 652752 - RNA, 15 nt, Escherichia coli CFT073
uugaguucacugccg

SEQ ID NO: 652753 - RNA, 22 nt, Escherichia coli CFT073
uugaguagccacgcgacauaaa

SEQ ID NO: 652754 - RNA, 16 nt, Escherichia coli CFT073
uugauaauaaagcuac

SEQ ID NO: 652755 - RNA, 13 nt, Escherichia coli CFT073
uugauaagcaagu

SEQ ID NO: 652756 - RNA, 17 nt, Escherichia coli CFT073
uugauaaguacauuaaa

SEQ ID NO: 652757 - RNA, 18 nt, Escherichia coli CFT073
uugauaaguacauuaaaa

SEQ ID NO: 652758 - RNA, 19 nt, Escherichia coli CFT073
uugauaaguacauuaaaau

SEQ ID NO: 652759 - RNA, 22 nt, Escherichia coli CFT073
uugagggaagcggguucaguga

SEQ ID NO: 652760 - RNA, 18 nt, Escherichia coli CFT073
uugaguacgcauccccag

SEQ ID NO: 652761 - RNA, 21 nt, Escherichia coli CFT073
uugagcuuuauccugcccgcu

SEQ ID NO: 652762 - RNA, 22 nt, Escherichia coli CFT073
uugaggaaguuauacagacuca

SEQ ID NO: 652763 - RNA, 20 nt, Escherichia coli CFT073
uucuuggcacccagcgcuuu

SEQ ID NO: 652764 - RNA, 21 nt, Escherichia coli CFT073
uucuuggcgucgaauauugga

SEQ ID NO: 652765 - RNA, 22 nt, Escherichia coli CFT073
uucuuguaacgaguacaaaaau

SEQ ID NO: 652766 - RNA, 15 nt, Escherichia coli CFT073
uugagcaucugcaaa

SEQ ID NO: 652767 - RNA, 11 nt, Escherichia coli CFT073
uugagcagcaa

SEQ ID NO: 652768 - RNA, 13 nt, Escherichia coli CFT073
uucuuguuuggca

SEQ ID NO: 652769 - RNA, 15 nt, Escherichia coli CFT073
uugagcgugcgcgcu

SEQ ID NO: 652770 - RNA, 19 nt, Escherichia coli CFT073
uugagcggaaacagcggcu

SEQ ID NO: 652771 - RNA, 19 nt, Escherichia coli CFT073
uugagccucgcugcucaca

SEQ ID NO: 652772 - RNA, 22 nt, Escherichia coli CFT073
aagcgccauucacaauuuaaau

SEQ ID NO: 652773 - RNA, 14 nt, Escherichia coli CFT073
aagcgccaucaaug

SEQ ID NO: 652774 - RNA, 19 nt, Escherichia coli CFT073
aagcgccaucaaugugcug

SEQ ID NO: 652775 - RNA, 22 nt, Escherichia coli CFT073
aagcgcaugaugucugcaagag

SEQ ID NO: 652776 - RNA, 16 nt, Escherichia coli CFT073
aagcgccacaaucgcu

SEQ ID NO: 652777 - RNA, 20 nt, Escherichia coli CFT073
aagcgcacuuugcuggucug

SEQ ID NO: 652778 - RNA, 18 nt, Escherichia coli CFT073
aagcgcggauuuuauuca

SEQ ID NO: 652779 - RNA, 21 nt, Escherichia coli CFT073
aagcggguuuuuuaucagaca

SEQ ID NO: 652780 - RNA, 13 nt, Escherichia coli CFT073
aagcgguaaugcg

SEQ ID NO: 652781 - RNA, 15 nt, Escherichia coli CFT073
aagcgggaauagcuc

SEQ ID NO: 652782 - RNA, 15 nt, Escherichia coli CFT073
aagcgcgucaccacc

SEQ ID NO: 652783 - RNA, 15 nt, Escherichia coli CFT073
aagcguuucaucuuc

SEQ ID NO: 652784 - RNA, 16 nt, Escherichia coli CFT073
aagcguuuucugccag

SEQ ID NO: 652785 - RNA, 18 nt, Escherichia coli CFT073
aagcguuuucugccagac

SEQ ID NO: 652786 - RNA, 13 nt, Escherichia coli CFT073
aagcucauuuccc

SEQ ID NO: 652787 - RNA, 13 nt, Escherichia coli CFT073
aagcucauaugca

SEQ ID NO: 652788 - RNA, 13 nt, Escherichia coli CFT073
aagcguugucagc

SEQ ID NO: 652789 - RNA, 21 nt, Escherichia coli CFT073
aagcuauuaauccauaaccau

SEQ ID NO: 652790 - RNA, 13 nt, Escherichia coli CFT073
aagcugacaggcg

SEQ ID NO: 652791 - RNA, 16 nt, Escherichia coli CFT073
aagcugaccagacagu

SEQ ID NO: 652792 - RNA, 15 nt, Escherichia coli CFT073
aagcugaacagucgc

SEQ ID NO: 652793 - RNA, 17 nt, Escherichia coli CFT073
aagcugaacagucgcug

SEQ ID NO: 652794 - RNA, 14 nt, Escherichia coli CFT073
aagcugaacauuuu

SEQ ID NO: 652795 - RNA, 22 nt, Escherichia coli CFT073
aagcugaauguucuucuucugc

SEQ ID NO: 652796 - RNA, 23 nt, Escherichia coli CFT073
aagcugguggcaaucgcgguggu

SEQ ID NO: 652797 - RNA, 24 nt, Escherichia coli CFT073
aaggaacgcugcauacucugcaac

SEQ ID NO: 652798 - RNA, 18 nt, Escherichia coli CFT073
aagccguuggucaucauc

SEQ ID NO: 652799 - RNA, 22 nt, Escherichia coli CFT073
aagccguuggucaucaucagga

SEQ ID NO: 652800 - RNA, 19 nt, Escherichia coli CFT073
aagccgugccagauggcau

SEQ ID NO: 652801 - RNA, 15 nt, Escherichia coli CFT073
aagccgggcagguga

SEQ ID NO: 652802 - RNA, 16 nt, Escherichia coli CFT073
aagccguauauucgcc

SEQ ID NO: 652803 - RNA, 12 nt, Escherichia coli CFT073
aagccgugaaaa

SEQ ID NO: 652804 - RNA, 15 nt, Escherichia coli CFT073
aagccugauaagcgu

SEQ ID NO: 652805 - RNA, 22 nt, Escherichia coli CFT073
aagccgggagcggcgucagcca

SEQ ID NO: 652806 - RNA, 18 nt, Escherichia coli CFT073
aagccgcuaacagcagca

SEQ ID NO: 652807 - RNA, 22 nt, Escherichia coli CFT073
aagccgcuuaauaagaagaaaa

SEQ ID NO: 652808 - RNA, 21 nt, Escherichia coli CFT073
aagccgcuuccgggcugccau

SEQ ID NO: 652809 - RNA, 18 nt, Escherichia coli CFT073
aagcgacgugcaguagca

SEQ ID NO: 652810 - RNA, 20 nt, Escherichia coli CFT073
aagcgacgugcaguagcagc

SEQ ID NO: 652811 - RNA, 21 nt, Escherichia coli CFT073
aagcgacgugcaguagcagca

SEQ ID NO: 652812 - RNA, 18 nt, Escherichia coli CFT073
aagcgacuuugccuggcg

SEQ ID NO: 652813 - RNA, 15 nt, Escherichia coli CFT073
aagcgcaaaggccag

SEQ ID NO: 652814 - RNA, 14 nt, Escherichia coli CFT073
aagcgauaacgcug

SEQ ID NO: 652815 - RNA, 18 nt, Escherichia coli CFT073
aagccuuccgcaaacagg

SEQ ID NO: 652816 - RNA, 22 nt, Escherichia coli CFT073
aagccuucgccuuucaguucaa

SEQ ID NO: 652817 - RNA, 14 nt, Escherichia coli CFT073
aagcccgccagacc

SEQ ID NO: 652818 - RNA, 17 nt, Escherichia coli CFT073
aagcccgccagaccagc

SEQ ID NO: 652819 - RNA, 15 nt, Escherichia coli CFT073
aagcccauaccacag

SEQ ID NO: 652820 - RNA, 22 nt, Escherichia coli CFT073
aagcccauaccacagcaaaacg

SEQ ID NO: 652821 - RNA, 14 nt, Escherichia coli CFT073
aagccgccagagau

SEQ ID NO: 652822 - RNA, 17 nt, Escherichia coli CFT073
aagccgaugucugcaau

SEQ ID NO: 652823 - RNA, 23 nt, Escherichia coli CFT073
aagccgaacagucgcugaucacc

SEQ ID NO: 652824 - RNA, 19 nt, Escherichia coli CFT073
aagccgaccagcaccgcca

SEQ ID NO: 652825 - RNA, 13 nt, Escherichia coli CFT073
aagcccugcaggg

SEQ ID NO: 652826 - RNA, 24 nt, Escherichia coli CFT073
aagccaugacgcacuuucgcuuua

SEQ ID NO: 652827 - RNA, 21 nt, Escherichia coli CFT073
aagccauucucgucuugcguu

SEQ ID NO: 652828 - RNA, 12 nt, Escherichia coli CFT073
aagcccacaccg

SEQ ID NO: 652829 - RNA, 20 nt, Escherichia coli CFT073
aagccauauuuaacuccuuc

SEQ ID NO: 652830 - RNA, 13 nt, Escherichia coli CFT073
aagccaguucuca

SEQ ID NO: 652831 - RNA, 14 nt, Escherichia coli CFT073
aagaaguuagagcc

SEQ ID NO: 652832 - RNA, 21 nt, Escherichia coli CFT073
aagccacuuccuuuagaagca

SEQ ID NO: 652833 - RNA, 20 nt, Escherichia coli CFT073
aagaaguaaaacagucgcuc

SEQ ID NO: 652834 - RNA, 14 nt, Escherichia coli CFT073
aaguaccgagaagc

SEQ ID NO: 652835 - RNA, 19 nt, Escherichia coli CFT073
aaguaccaucguccagcag

SEQ ID NO: 652836 - RNA, 21 nt, Escherichia coli CFT073
aaguacucuuugaacagccag

SEQ ID NO: 652837 - RNA, 16 nt, Escherichia coli CFT073
aaguacguuuucuucu

SEQ ID NO: 652838 - RNA, 16 nt, Escherichia coli CFT073
aaguacuccuguucac

SEQ ID NO: 652839 - RNA, 19 nt, Escherichia coli CFT073
aaguacucuuugaacagcc

SEQ ID NO: 652840 - RNA, 18 nt, Escherichia coli CFT073
aaguacgcuucacgcacc

SEQ ID NO: 652841 - RNA, 23 nt, Escherichia coli CFT073
aaggucaucacaucccagcagag

SEQ ID NO: 652842 - RNA, 16 nt, Escherichia coli CFT073
aaggucaccaguucac

SEQ ID NO: 652843 - RNA, 19 nt, Escherichia coli CFT073
aaguaaacccggcaucaug

SEQ ID NO: 652844 - RNA, 13 nt, Escherichia coli CFT073
aaguaaacaaaca

SEQ ID NO: 652845 - RNA, 14 nt, Escherichia coli CFT073
aaguaaucaaugcg

SEQ ID NO: 652846 - RNA, 15 nt, Escherichia coli CFT073
aaguaauggaaggcg

SEQ ID NO: 652847 - RNA, 13 nt, Escherichia coli CFT073
aaguaaucauaau

SEQ ID NO: 652848 - RNA, 14 nt, Escherichia coli CFT073
aaggcguucacgcc

SEQ ID NO: 652849 - RNA, 12 nt, Escherichia coli CFT073
aagggaacagag

SEQ ID NO: 652850 - RNA, 22 nt, Escherichia coli CFT073
aaggcuauccucuaaaccccaa

SEQ ID NO: 652851 - RNA, 15 nt, Escherichia coli CFT073
aaggauuagacgaau

SEQ ID NO: 652852 - RNA, 17 nt, Escherichia coli CFT073
aaggauugcagcacuga

SEQ ID NO: 652853 - RNA, 18 nt, Escherichia coli CFT073
aaggauugcagcacugau

SEQ ID NO: 652854 - RNA, 15 nt, Escherichia coli CFT073
aagggacggaacgaa

SEQ ID NO: 652855 - RNA, 23 nt, Escherichia coli CFT073
aagggacaucagguaguugccag

SEQ ID NO: 652856 - RNA, 16 nt, Escherichia coli CFT073
aagggagcagacugua

SEQ ID NO: 652857 - RNA, 18 nt, Escherichia coli CFT073
aaggguacgaaucacagc

SEQ ID NO: 652858 - RNA, 13 nt, Escherichia coli CFT073
aaggguaugcugu

SEQ ID NO: 652859 - RNA, 17 nt, Escherichia coli CFT073
aagggcggucggaagau

SEQ ID NO: 652860 - RNA, 13 nt, Escherichia coli CFT073
aaguaucaaacag

SEQ ID NO: 652861 - RNA, 16 nt, Escherichia coli CFT073
aaguaucaaacagaaa

SEQ ID NO: 652862 - RNA, 18 nt, Escherichia coli CFT073
aaguaucaaacagaaaaa

SEQ ID NO: 652863 - RNA, 22 nt, Escherichia coli CFT073
aaguaucaaacagaaaaacgaa

SEQ ID NO: 652864 - RNA, 19 nt, Escherichia coli CFT073
aaguauccacgcagacaau

SEQ ID NO: 652865 - RNA, 14 nt, Escherichia coli CFT073
aaguagcagguaau

SEQ ID NO: 652866 - RNA, 15 nt, Escherichia coli CFT073
aaguagcugaaaauc

SEQ ID NO: 652867 - RNA, 14 nt, Escherichia coli CFT073
aaguagccuucauc

SEQ ID NO: 652868 - RNA, 17 nt, Escherichia coli CFT073
aaguagccuucaucaga

SEQ ID NO: 652869 - RNA, 17 nt, Escherichia coli CFT073
aaguagcgcagcagaua

SEQ ID NO: 652870 - RNA, 15 nt, Escherichia coli CFT073
aaguagcgccagacu

SEQ ID NO: 652871 - RNA, 18 nt, Escherichia coli CFT073
aaguaguuccagcaugau

SEQ ID NO: 652872 - RNA, 21 nt, Escherichia coli CFT073
aagucgaacgguaacaggaaa

SEQ ID NO: 652873 - RNA, 23 nt, Escherichia coli CFT073
aagucgaacgguaacaggaagaa

SEQ ID NO: 652874 - RNA, 14 nt, Escherichia coli CFT073
aaguccugccagaa

SEQ ID NO: 652875 - RNA, 23 nt, Escherichia coli CFT073
aagucggcgugcaucucuucaaa

SEQ ID NO: 652876 - RNA, 13 nt, Escherichia coli CFT073
aagucaaacuggu

SEQ ID NO: 652877 - RNA, 17 nt, Escherichia coli CFT073
aagucaacaccaucuuc

SEQ ID NO: 652878 - RNA, 17 nt, Escherichia coli CFT073
aagucuggcaggaaaua

SEQ ID NO: 652879 - RNA, 16 nt, Escherichia coli CFT073
aagugcgccgaggaaa

SEQ ID NO: 652880 - RNA, 18 nt, Escherichia coli CFT073
aagugugaugguauucau

SEQ ID NO: 652881 - RNA, 21 nt, Escherichia coli CFT073
aaguguccaguugagcuccag

SEQ ID NO: 652882 - RNA, 20 nt, Escherichia coli CFT073
aaguggugucagaagaaaaa

SEQ ID NO: 652883 - RNA, 15 nt, Escherichia coli CFT073
aagugaucccacauc

SEQ ID NO: 652884 - RNA, 15 nt, Escherichia coli CFT073
aagugguauugaauc

SEQ ID NO: 652885 - RNA, 23 nt, Escherichia coli CFT073
aaguggugaugauacuugcaccu

SEQ ID NO: 652886 - RNA, 20 nt, Escherichia coli CFT073
aaguuaguaaaacuauugua

SEQ ID NO: 652887 - RNA, 23 nt, Escherichia coli CFT073
aaguuagucgcuuucauucagaa

SEQ ID NO: 652888 - RNA, 21 nt, Escherichia coli CFT073
aaguuauccugguacucgacu

SEQ ID NO: 652889 - RNA, 16 nt, Escherichia coli CFT073
aaguuauuaaugacaa

SEQ ID NO: 652890 - RNA, 18 nt, Escherichia coli CFT073
aauaguuacgaaaaggau

SEQ ID NO: 652891 - RNA, 21 nt, Escherichia coli CFT073
aauauacagccuuaacaagau

SEQ ID NO: 652892 - RNA, 19 nt, Escherichia coli CFT073
aauauacauacuguaaaua

SEQ ID NO: 652893 - RNA, 13 nt, Escherichia coli CFT073
aauauacuucugg

SEQ ID NO: 652894 - RNA, 11 nt, Escherichia coli CFT073
aauagccugau

SEQ ID NO: 652895 - RNA, 22 nt, Escherichia coli CFT073
aauagccgccauacggaaaauc

SEQ ID NO: 652896 - RNA, 20 nt, Escherichia coli CFT073
aauagcggaaaucuccagau

SEQ ID NO: 652897 - RNA, 19 nt, Escherichia coli CFT073
aauagucguccauuauuuu

SEQ ID NO: 652898 - RNA, 17 nt, Escherichia coli CFT073
aauagugccgcaccagc

SEQ ID NO: 652899 - RNA, 22 nt, Escherichia coli CFT073
aauagugguaccaggaucagca

SEQ ID NO: 652900 - RNA, 14 nt, Escherichia coli CFT073
aauauccugaccuu

SEQ ID NO: 652901 - RNA, 12 nt, Escherichia coli CFT073
aauauccugagu

SEQ ID NO: 652902 - RNA, 23 nt, Escherichia coli CFT073
aauaugcggugccauuaaaccaa

SEQ ID NO: 652903 - RNA, 19 nt, Escherichia coli CFT073
aauaugcgccacuccacug

SEQ ID NO: 652904 - RNA, 13 nt, Escherichia coli CFT073
aauauccagcagg

SEQ ID NO: 652905 - RNA, 17 nt, Escherichia coli CFT073
aauauccauguaccaga

SEQ ID NO: 652906 - RNA, 20 nt, Escherichia coli CFT073
aauauccauguaccagacug

SEQ ID NO: 652907 - RNA, 22 nt, Escherichia coli CFT073
aauauccauguaccagacugac

SEQ ID NO: 652908 - RNA, 18 nt, Escherichia coli CFT073
aauauccauuaaaacuga

SEQ ID NO: 652909 - RNA, 20 nt, Escherichia coli CFT073
aauaucccaacgcaaaacca

SEQ ID NO: 652910 - RNA, 23 nt, Escherichia coli CFT073
aauaucccaacgcaaaaccaagc

SEQ ID NO: 652911 - RNA, 18 nt, Escherichia coli CFT073
aauaucccauuucuccac

SEQ ID NO: 652912 - RNA, 11 nt, Escherichia coli CFT073
aauaucaucau

SEQ ID NO: 652913 - RNA, 12 nt, Escherichia coli CFT073
aauaucaucauc

SEQ ID NO: 652914 - RNA, 12 nt, Escherichia coli CFT073
aauaucaucacc

SEQ ID NO: 652915 - RNA, 13 nt, Escherichia coli CFT073
aauauauaaagau

SEQ ID NO: 652916 - RNA, 21 nt, Escherichia coli CFT073
aauauaucagccugaaugcuu

SEQ ID NO: 652917 - RNA, 21 nt, Escherichia coli CFT073
aauacucgucccguccuucau

SEQ ID NO: 652918 - RNA, 14 nt, Escherichia coli CFT073
aauacugacuggcg

SEQ ID NO: 652919 - RNA, 15 nt, Escherichia coli CFT073
aauacugaucaucau

SEQ ID NO: 652920 - RNA, 19 nt, Escherichia coli CFT073
aauacugccuauugcucua

SEQ ID NO: 652921 - RNA, 15 nt, Escherichia coli CFT073
aauagaguguuccuc

SEQ ID NO: 652922 - RNA, 19 nt, Escherichia coli CFT073
aauacuuugcagaucgcgg

SEQ ID NO: 652923 - RNA, 21 nt, Escherichia coli CFT073
aauagagugguuagagcacag

SEQ ID NO: 652924 - RNA, 17 nt, Escherichia coli CFT073
aauagauuaugaaauuc

SEQ ID NO: 652925 - RNA, 13 nt, Escherichia coli CFT073
aauagaaauuuag

SEQ ID NO: 652926 - RNA, 13 nt, Escherichia coli CFT073
aauagcaaaguag

SEQ ID NO: 652927 - RNA, 16 nt, Escherichia coli CFT073
aauagcaaaauauaaa

SEQ ID NO: 652928 - RNA, 14 nt, Escherichia coli CFT073
aauagauuuucaga

SEQ ID NO: 652929 - RNA, 17 nt, Escherichia coli CFT073
aauagauuuucagaaua

SEQ ID NO: 652930 - RNA, 18 nt, Escherichia coli CFT073
aauagcagacaaugccga

SEQ ID NO: 652931 - RNA, 19 nt, Escherichia coli CFT073
aauaccgccugcaaauaaa

SEQ ID NO: 652932 - RNA, 21 nt, Escherichia coli CFT073
aauaccgcgagauauccacau

SEQ ID NO: 652933 - RNA, 15 nt, Escherichia coli CFT073
aauaccgacaucacg

SEQ ID NO: 652934 - RNA, 14 nt, Escherichia coli CFT073
aauaccgauaagua

SEQ ID NO: 652935 - RNA, 15 nt, Escherichia coli CFT073
aauaccgauaucgcc

SEQ ID NO: 652936 - RNA, 15 nt, Escherichia coli CFT073
aauaccgccaacaug

SEQ ID NO: 652937 - RNA, 19 nt, Escherichia coli CFT073
aauaccguucucuuuauaa

SEQ ID NO: 652938 - RNA, 14 nt, Escherichia coli CFT073
aauaccguaaaacu

SEQ ID NO: 652939 - RNA, 13 nt, Escherichia coli CFT073
aauacgccccaga

SEQ ID NO: 652940 - RNA, 18 nt, Escherichia coli CFT073
aauacgcucgaacagcug

SEQ ID NO: 652941 - RNA, 23 nt, Escherichia coli CFT073
aauaccugagacaaacagucuca

SEQ ID NO: 652942 - RNA, 15 nt, Escherichia coli CFT073
aauaccugcaccaac

SEQ ID NO: 652943 - RNA, 18 nt, Escherichia coli CFT073
aauaauuucaacagauuu

SEQ ID NO: 652944 - RNA, 18 nt, Escherichia coli CFT073
aauaauuuccaucgacuc

SEQ ID NO: 652945 - RNA, 18 nt, Escherichia coli CFT073
aauacccgccagaaaagg

SEQ ID NO: 652946 - RNA, 17 nt, Escherichia coli CFT073
aauacccgcgccggccc

SEQ ID NO: 652947 - RNA, 15 nt, Escherichia coli CFT073
aauaccgaagaguaa

SEQ ID NO: 652948 - RNA, 20 nt, Escherichia coli CFT073
aauaccacccuugcccacca

SEQ ID NO: 652949 - RNA, 23 nt, Escherichia coli CFT073
aauaccacucagcuuaagaauua

SEQ ID NO: 652950 - RNA, 12 nt, Escherichia coli CFT073
aauaccaauaau

SEQ ID NO: 652951 - RNA, 21 nt, Escherichia coli CFT073
aauaccaagccaagccagagc

SEQ ID NO: 652952 - RNA, 14 nt, Escherichia coli CFT073
aauaaucucaccau

SEQ ID NO: 652953 - RNA, 22 nt, Escherichia coli CFT073
aauaaucguuccuuuaccaccu

SEQ ID NO: 652954 - RNA, 12 nt, Escherichia coli CFT073
aauaaucucaau

SEQ ID NO: 652955 - RNA, 16 nt, Escherichia coli CFT073
aauaaucucaauaucc

SEQ ID NO: 652956 - RNA, 15 nt, Escherichia coli CFT073
aauaaucugaaaacc

SEQ ID NO: 652957 - RNA, 21 nt, Escherichia coli CFT073
aauaaucggcgucauuuuguc

SEQ ID NO: 652958 - RNA, 17 nt, Escherichia coli CFT073
aauaaucgaucacguaa

SEQ ID NO: 652959 - RNA, 18 nt, Escherichia coli CFT073
aauaaugccaccagugcc

SEQ ID NO: 652960 - RNA, 21 nt, Escherichia coli CFT073
aauaaugcccaucgugauaaa

SEQ ID NO: 652961 - RNA, 18 nt, Escherichia coli CFT073
aauaaugccguugaucag

SEQ ID NO: 652962 - RNA, 15 nt, Escherichia coli CFT073
aauaauggccuuuuc

SEQ ID NO: 652963 - RNA, 14 nt, Escherichia coli CFT073
aauaauugccaagu

SEQ ID NO: 652964 - RNA, 20 nt, Escherichia coli CFT073
aauaauucggcuuaacagau

SEQ ID NO: 652965 - RNA, 14 nt, Escherichia coli CFT073
aauaauggugaauu

SEQ ID NO: 652966 - RNA, 23 nt, Escherichia coli CFT073
aauaaugucgacguuuuucaggc

SEQ ID NO: 652967 - RNA, 17 nt, Escherichia coli CFT073
aauaaugucggcauaaa

SEQ ID NO: 652968 - RNA, 22 nt, Escherichia coli CFT073
aauaaguuuuuugcgaaaaaua

SEQ ID NO: 652969 - RNA, 19 nt, Escherichia coli CFT073
aauaaguaagcauuauaua

SEQ ID NO: 652970 - RNA, 21 nt, Escherichia coli CFT073
aauaaguacgauacaaaagca

SEQ ID NO: 652971 - RNA, 22 nt, Escherichia coli CFT073
aauaaggcguacauccggcaau

SEQ ID NO: 652972 - RNA, 13 nt, Escherichia coli CFT073
aauaagcuuuuuc

SEQ ID NO: 652973 - RNA, 21 nt, Escherichia coli CFT073
aauaagcgcccagcucuuuac

SEQ ID NO: 652974 - RNA, 22 nt, Escherichia coli CFT073
aauaagcgcccagcucuuuacc

SEQ ID NO: 652975 - RNA, 22 nt, Escherichia coli CFT073
aauaagccccuuucgaaaucau

SEQ ID NO: 652976 - RNA, 23 nt, Escherichia coli CFT073
aauaagcaucgcuagauauauau

SEQ ID NO: 652977 - RNA, 15 nt, Escherichia coli CFT073
aauaagcacaaagca

SEQ ID NO: 652978 - RNA, 11 nt, Escherichia coli CFT073
aauaagcacuc

SEQ ID NO: 652979 - RNA, 11 nt, Escherichia coli CFT073
aauaaucagau

SEQ ID NO: 652980 - RNA, 23 nt, Escherichia coli CFT073
aauaaucagcacaauaaucagcc

SEQ ID NO: 652981 - RNA, 18 nt, Escherichia coli CFT073
aauaaucaugcagcgcag

SEQ ID NO: 652982 - RNA, 12 nt, Escherichia coli CFT073
aauaauaucuuu

SEQ ID NO: 652983 - RNA, 12 nt, Escherichia coli CFT073
aauaauauuucc

SEQ ID NO: 652984 - RNA, 13 nt, Escherichia coli CFT073
aauaauauuuccc

SEQ ID NO: 652985 - RNA, 15 nt, Escherichia coli CFT073
aauaagaguaauggu

SEQ ID NO: 652986 - RNA, 19 nt, Escherichia coli CFT073
aauaacggcucaaacugcu

SEQ ID NO: 652987 - RNA, 20 nt, Escherichia coli CFT073
aauaacguaguguaaaugca

SEQ ID NO: 652988 - RNA, 22 nt, Escherichia coli CFT073
aauaacguaguguaaaugcaaa

SEQ ID NO: 652989 - RNA, 16 nt, Escherichia coli CFT073
aauaacucccaggcua

SEQ ID NO: 652990 - RNA, 16 nt, Escherichia coli CFT073
aauaaccacuucuucu

SEQ ID NO: 652991 - RNA, 20 nt, Escherichia coli CFT073
aauaaccaacggcgagccag

SEQ ID NO: 652992 - RNA, 14 nt, Escherichia coli CFT073
aauaaccaucagcu

SEQ ID NO: 652993 - RNA, 17 nt, Escherichia coli CFT073
aauaacagugauugcuu

SEQ ID NO: 652994 - RNA, 16 nt, Escherichia coli CFT073
aauaaccggcacuuca

SEQ ID NO: 652995 - RNA, 22 nt, Escherichia coli CFT073
aauaacccguuguaaaugcugc

SEQ ID NO: 652996 - RNA, 18 nt, Escherichia coli CFT073
aauaacccggacaaauaa

SEQ ID NO: 652997 - RNA, 14 nt, Escherichia coli CFT073
aauaaccgccacca

SEQ ID NO: 652998 - RNA, 21 nt, Escherichia coli CFT073
aauaacgaucaucacgacaua

SEQ ID NO: 652999 - RNA, 20 nt, Escherichia coli CFT073
aauaaaucguguaaaucgcu

SEQ ID NO: 653000 - RNA, 21 nt, Escherichia coli CFT073
aauaaaugccggaagcagcaa

SEQ ID NO: 653001 - RNA, 22 nt, Escherichia coli CFT073
aauaaaucaaagucagaucaau

SEQ ID NO: 653002 - RNA, 18 nt, Escherichia coli CFT073
aaguugcgaaagcgagca

SEQ ID NO: 653003 - RNA, 18 nt, Escherichia coli CFT073
aaguugccggauguguug

SEQ ID NO: 653004 - RNA, 20 nt, Escherichia coli CFT073
aaguugaugguguagaaccg

SEQ ID NO: 653005 - RNA, 12 nt, Escherichia coli CFT073
aaguugcaaugg

SEQ ID NO: 653006 - RNA, 18 nt, Escherichia coli CFT073
aaguuccguuuccagcca

SEQ ID NO: 653007 - RNA, 17 nt, Escherichia coli CFT073
aaguuccuguaaagagu

SEQ ID NO: 653008 - RNA, 17 nt, Escherichia coli CFT073
aaguucauccauaccac

SEQ ID NO: 653009 - RNA, 14 nt, Escherichia coli CFT073
aauuaugcccucag

SEQ ID NO: 653010 - RNA, 13 nt, Escherichia coli CFT073
aauuauuaccauc

SEQ ID NO: 653011 - RNA, 19 nt, Escherichia coli CFT073
aauuauuacucaacagguu

SEQ ID NO: 653012 - RNA, 23 nt, Escherichia coli CFT073
aauuauuagcaacgauauccaua

SEQ ID NO: 653013 - RNA, 14 nt, Escherichia coli CFT073
aauuaucgcagccu

SEQ ID NO: 653014 - RNA, 23 nt, Escherichia coli CFT073
aauuaucuauacgacuggccaug

SEQ ID NO: 653015 - RNA, 23 nt, Escherichia coli CFT073
aauuaucaacguagaauaaaagc

SEQ ID NO: 653016 - RNA, 15 nt, Escherichia coli CFT073
aauuauuuuaccaua

SEQ ID NO: 653017 - RNA, 22 nt, Escherichia coli CFT073
aauuauuuuaccauauaaacau

SEQ ID NO: 653018 - RNA, 18 nt, Escherichia coli CFT073
aauuauugccuugaugaa

SEQ ID NO: 653019 - RNA, 22 nt, Escherichia coli CFT073
aauuauugccuugaugaaaaaa

SEQ ID NO: 653020 - RNA, 22 nt, Escherichia coli CFT073
aauuauuguaagcugucgaaaa

SEQ ID NO: 653021 - RNA, 11 nt, Escherichia coli CFT073
aauucaaaugg

SEQ ID NO: 653022 - RNA, 22 nt, Escherichia coli CFT073
aauucaaugacaguaucaccaa

SEQ ID NO: 653023 - RNA, 17 nt, Escherichia coli CFT073
aauuagcgucaccaucc

SEQ ID NO: 653024 - RNA, 19 nt, Escherichia coli CFT073
aauuacacacaacacaucg

SEQ ID NO: 653025 - RNA, 15 nt, Escherichia coli CFT073
aauuacaaaaugaca

SEQ ID NO: 653026 - RNA, 16 nt, Escherichia coli CFT073
aauuacgcuauacaac

SEQ ID NO: 653027 - RNA, 13 nt, Escherichia coli CFT073
aauuacugcugcg

SEQ ID NO: 653028 - RNA, 14 nt, Escherichia coli CFT073
aauguaauaugcag

SEQ ID NO: 653029 - RNA, 21 nt, Escherichia coli CFT073
aauuaauuuuuuaauaaaaag

SEQ ID NO: 653030 - RNA, 23 nt, Escherichia coli CFT073
aauuaauuuuuuaauaaaaaggu

SEQ ID NO: 653031 - RNA, 13 nt, Escherichia coli CFT073
aauuaauugcuau

SEQ ID NO: 653032 - RNA, 16 nt, Escherichia coli CFT073
aauuaaccagaaauag

SEQ ID NO: 653033 - RNA, 16 nt, Escherichia coli CFT073
aauuaacgaaaucuca

SEQ ID NO: 653034 - RNA, 21 nt, Escherichia coli CFT073
aauucucccugcgacguucuc

SEQ ID NO: 653035 - RNA, 22 nt, Escherichia coli CFT073
aauucucgccaguguucuuccg

SEQ ID NO: 653036 - RNA, 18 nt, Escherichia coli CFT073
aauucuauuuugccaggc

SEQ ID NO: 653037 - RNA, 23 nt, Escherichia coli CFT073
aauucgcggauguugcugcacca

SEQ ID NO: 653038 - RNA, 13 nt, Escherichia coli CFT073
aauucgcccuucg

SEQ ID NO: 653039 - RNA, 22 nt, Escherichia coli CFT073
aauucgacuuucucuggcuguu

SEQ ID NO: 653040 - RNA, 23 nt, Escherichia coli CFT073
aauucgggcgcugauucuuccca

SEQ ID NO: 653041 - RNA, 18 nt, Escherichia coli CFT073
aauuccgugccagcacca

SEQ ID NO: 653042 - RNA, 19 nt, Escherichia coli CFT073
aauuccgugccagcaccaa

SEQ ID NO: 653043 - RNA, 18 nt, Escherichia coli CFT073
aauuccggcuucuucugc

SEQ ID NO: 653044 - RNA, 19 nt, Escherichia coli CFT073
aauuccggcuucuucugcc

SEQ ID NO: 653045 - RNA, 23 nt, Escherichia coli CFT073
aauuccuuugcugcucuauugcc

SEQ ID NO: 653046 - RNA, 11 nt, Escherichia coli CFT073
aauucacuucu

SEQ ID NO: 653047 - RNA, 14 nt, Escherichia coli CFT073
aauucacgccuucu

SEQ ID NO: 653048 - RNA, 12 nt, Escherichia coli CFT073
aauucagugugc

SEQ ID NO: 653049 - RNA, 13 nt, Escherichia coli CFT073
aauuccacaccaa

SEQ ID NO: 653050 - RNA, 14 nt, Escherichia coli CFT073
aauuccagaauucu

SEQ ID NO: 653051 - RNA, 19 nt, Escherichia coli CFT073
aauuccacgcgccacgcac

SEQ ID NO: 653052 - RNA, 16 nt, Escherichia coli CFT073
aauucauugaauuuaa

SEQ ID NO: 653053 - RNA, 20 nt, Escherichia coli CFT073
aauucauguucgguaaacgg

SEQ ID NO: 653054 - RNA, 21 nt, Escherichia coli CFT073
aauuccgcccucgauaugcca

SEQ ID NO: 653055 - RNA, 23 nt, Escherichia coli CFT073
aauuccgcgcgaacagucagcac

SEQ ID NO: 653056 - RNA, 17 nt, Escherichia coli CFT073
aauuccggcagagaaag

SEQ ID NO: 653057 - RNA, 15 nt, Escherichia coli CFT073
aauuccaucuuuaac

SEQ ID NO: 653058 - RNA, 18 nt, Escherichia coli CFT073
aauucccaguuacugcca

SEQ ID NO: 653059 - RNA, 16 nt, Escherichia coli CFT073
aauuccccugccagaa

SEQ ID NO: 653060 - RNA, 19 nt, Escherichia coli CFT073
aauuccccugccagaagca

SEQ ID NO: 653061 - RNA, 20 nt, Escherichia coli CFT073
aauuguccagaucuuucgcc

SEQ ID NO: 653062 - RNA, 17 nt, Escherichia coli CFT073
aauugucaccgucacau

SEQ ID NO: 653063 - RNA, 19 nt, Escherichia coli CFT073
aauuguauuagcccguucu

SEQ ID NO: 653064 - RNA, 22 nt, Escherichia coli CFT073
aauuguuccgucagccgcccgc

SEQ ID NO: 653065 - RNA, 19 nt, Escherichia coli CFT073
aauugugguuuucucuugu

SEQ ID NO: 653066 - RNA, 19 nt, Escherichia coli CFT073
aauugugucgacauagcca

SEQ ID NO: 653067 - RNA, 22 nt, Escherichia coli CFT073
aauuguuugacuuauaagucuc

SEQ ID NO: 653068 - RNA, 17 nt, Escherichia coli CFT073
aauuuaaaugacaaugu

SEQ ID NO: 653069 - RNA, 23 nt, Escherichia coli CFT073
aauuuaccgaccucaacaaaaua

SEQ ID NO: 653070 - RNA, 12 nt, Escherichia coli CFT073
aauuucacacca

SEQ ID NO: 653071 - RNA, 16 nt, Escherichia coli CFT073
aauuucaccacugccu

SEQ ID NO: 653072 - RNA, 17 nt, Escherichia coli CFT073
aauuucacgcucaccca

SEQ ID NO: 653073 - RNA, 17 nt, Escherichia coli CFT073
aauuuauugaauuugua

SEQ ID NO: 653074 - RNA, 14 nt, Escherichia coli CFT073
aauuuaucagacaa

SEQ ID NO: 653075 - RNA, 16 nt, Escherichia coli CFT073
aauuuaucuucaccaa

SEQ ID NO: 653076 - RNA, 21 nt, Escherichia coli CFT073
aauucuguccuccaugaugac

SEQ ID NO: 653077 - RNA, 13 nt, Escherichia coli CFT073
aauucuucauucc

SEQ ID NO: 653078 - RNA, 14 nt, Escherichia coli CFT073
aauucuucauucca

SEQ ID NO: 653079 - RNA, 19 nt, Escherichia coli CFT073
aauucuuccuucacaucca

SEQ ID NO: 653080 - RNA, 13 nt, Escherichia coli CFT073
aauucuugcugac

SEQ ID NO: 653081 - RNA, 16 nt, Escherichia coli CFT073
aauugacuaucugacu

SEQ ID NO: 653082 - RNA, 23 nt, Escherichia coli CFT073
aauugagauaagcaacaaacuca

SEQ ID NO: 653083 - RNA, 17 nt, Escherichia coli CFT073
aauugaaauuugcauaa

SEQ ID NO: 653084 - RNA, 13 nt, Escherichia coli CFT073
aauugaagaguuu

SEQ ID NO: 653085 - RNA, 19 nt, Escherichia coli CFT073
aauugccgcaccaaccauc

SEQ ID NO: 653086 - RNA, 20 nt, Escherichia coli CFT073
aauugccgcacuuaaaaugc

SEQ ID NO: 653087 - RNA, 17 nt, Escherichia coli CFT073
aauugccucuucugaua

SEQ ID NO: 653088 - RNA, 18 nt, Escherichia coli CFT073
aauugccugauggccugc

SEQ ID NO: 653089 - RNA, 23 nt, Escherichia coli CFT073
aauugccugcggaucaagugaac

SEQ ID NO: 653090 - RNA, 17 nt, Escherichia coli CFT073
aauugccuguucaaccu

SEQ ID NO: 653091 - RNA, 21 nt, Escherichia coli CFT073
aauugcccgcagauguagcuc

SEQ ID NO: 653092 - RNA, 16 nt, Escherichia coli CFT073
aauugccccagacaca

SEQ ID NO: 653093 - RNA, 12 nt, Escherichia coli CFT073
aauugccagaca

SEQ ID NO: 653094 - RNA, 14 nt, Escherichia coli CFT073
aauugccagcuugc

SEQ ID NO: 653095 - RNA, 22 nt, Escherichia coli CFT073
aauugcacguccaguggcaucc

SEQ ID NO: 653096 - RNA, 20 nt, Escherichia coli CFT073
aauugcagaggcucaaccgc

SEQ ID NO: 653097 - RNA, 19 nt, Escherichia coli CFT073
aauugcaggaacuucguaa

SEQ ID NO: 653098 - RNA, 14 nt, Escherichia coli CFT073
aauugcaaacagag

SEQ ID NO: 653099 - RNA, 21 nt, Escherichia coli CFT073
aauugcaccucagcauaugcu

SEQ ID NO: 653100 - RNA, 16 nt, Escherichia coli CFT073
aauugaugcuuuuugc

SEQ ID NO: 653101 - RNA, 14 nt, Escherichia coli CFT073
aauuggggccgucc

SEQ ID NO: 653102 - RNA, 17 nt, Escherichia coli CFT073
aauuggcgcaaaggcgg

SEQ ID NO: 653103 - RNA, 19 nt, Escherichia coli CFT073
aauugcguaaagccugcug

SEQ ID NO: 653104 - RNA, 23 nt, Escherichia coli CFT073
aauugcgcagcggaggcgauaau

SEQ ID NO: 653105 - RNA, 16 nt, Escherichia coli CFT073
aauugcgaccuucuuc

SEQ ID NO: 653106 - RNA, 18 nt, Escherichia coli CFT073
aauugcgacugaaccagc

SEQ ID NO: 653107 - RNA, 18 nt, Escherichia coli CFT073
aauugcucauagagcgca

SEQ ID NO: 653108 - RNA, 15 nt, Escherichia coli CFT073
aauugcguucugucg

SEQ ID NO: 653109 - RNA, 16 nt, Escherichia coli CFT073
aaugcuuuccagagag

SEQ ID NO: 653110 - RNA, 14 nt, Escherichia coli CFT073
aauggaaacagcac

SEQ ID NO: 653111 - RNA, 16 nt, Escherichia coli CFT073
aauggaaacagcacca

SEQ ID NO: 653112 - RNA, 14 nt, Escherichia coli CFT073
aauggaaaaaguuu

SEQ ID NO: 653113 - RNA, 22 nt, Escherichia coli CFT073
aaugcgcgcuaugaugaaaaag

SEQ ID NO: 653114 - RNA, 17 nt, Escherichia coli CFT073
aaugcgcggucagaaaa

SEQ ID NO: 653115 - RNA, 18 nt, Escherichia coli CFT073
aaugcgcggucagaaaau

SEQ ID NO: 653116 - RNA, 19 nt, Escherichia coli CFT073
aaugcgucgugauaaguaa

SEQ ID NO: 653117 - RNA, 21 nt, Escherichia coli CFT073
aauguaaaaguugcaguccgc

SEQ ID NO: 653118 - RNA, 22 nt, Escherichia coli CFT073
aaugguuuguuuggcuggcaaa

SEQ ID NO: 653119 - RNA, 18 nt, Escherichia coli CFT073
aaugguuucauuccagua

SEQ ID NO: 653120 - RNA, 19 nt, Escherichia coli CFT073
aauggcgcauccagccaac

SEQ ID NO: 653121 - RNA, 15 nt, Escherichia coli CFT073
aauggcauugggugc

SEQ ID NO: 653122 - RNA, 15 nt, Escherichia coli CFT073
aauggccagcacauu

SEQ ID NO: 653123 - RNA, 20 nt, Escherichia coli CFT073
aauggagauuguuaauacga

SEQ ID NO: 653124 - RNA, 21 nt, Escherichia coli CFT073
aauggauaagaaagauacaaa

SEQ ID NO: 653125 - RNA, 20 nt, Escherichia coli CFT073
aaugccaccacaccagacca

SEQ ID NO: 653126 - RNA, 15 nt, Escherichia coli CFT073
aaugccaccagaaac

SEQ ID NO: 653127 - RNA, 13 nt, Escherichia coli CFT073
aaugccacccagc

SEQ ID NO: 653128 - RNA, 12 nt, Escherichia coli CFT073
aaugcaucagcu

SEQ ID NO: 653129 - RNA, 15 nt, Escherichia coli CFT073
aaugcaucagcuggc

SEQ ID NO: 653130 - RNA, 22 nt, Escherichia coli CFT073
aaugcgcaacaccguaagaaag

SEQ ID NO: 653131 - RNA, 20 nt, Escherichia coli CFT073
aaugcgauccugagccaguu

SEQ ID NO: 653132 - RNA, 17 nt, Escherichia coli CFT073
aaugcgaaugaaagaug

SEQ ID NO: 653133 - RNA, 18 nt, Escherichia coli CFT073
aaugccuugauauguauu

SEQ ID NO: 653134 - RNA, 15 nt, Escherichia coli CFT073
aaugccuuucuuugu

SEQ ID NO: 653135 - RNA, 18 nt, Escherichia coli CFT073
aaugccuuucuuuguucu

SEQ ID NO: 653136 - RNA, 15 nt, Escherichia coli CFT073
aaugccuuugaaauc

SEQ ID NO: 653137 - RNA, 11 nt, Escherichia coli CFT073
aaugcgaaaac

SEQ ID NO: 653138 - RNA, 16 nt, Escherichia coli CFT073
aaugcgacccacgccc

SEQ ID NO: 653139 - RNA, 21 nt, Escherichia coli CFT073
aaugccggaugcgacgcuagc

SEQ ID NO: 653140 - RNA, 17 nt, Escherichia coli CFT073
aaugccugauuguuugu

SEQ ID NO: 653141 - RNA, 21 nt, Escherichia coli CFT073
aaugccugcacuuugugucag

SEQ ID NO: 653142 - RNA, 23 nt, Escherichia coli CFT073
aaugccucucgcgaggagaggcc

SEQ ID NO: 653143 - RNA, 23 nt, Escherichia coli CFT073
aaugccugagacagacagccuca

SEQ ID NO: 653144 - RNA, 18 nt, Escherichia coli CFT073
aaugccucgcuaaucucu

SEQ ID NO: 653145 - RNA, 24 nt, Escherichia coli CFT073
aaugaucauuaacgcagaaucuuc

SEQ ID NO: 653146 - RNA, 14 nt, Escherichia coli CFT073
aaugaugauugacc

SEQ ID NO: 653147 - RNA, 14 nt, Escherichia coli CFT073
aaugaucugaucaa

SEQ ID NO: 653148 - RNA, 19 nt, Escherichia coli CFT073
aaugaucagcgguuuugcc

SEQ ID NO: 653149 - RNA, 21 nt, Escherichia coli CFT073
aaugaugcggcgcuuucagca

SEQ ID NO: 653150 - RNA, 17 nt, Escherichia coli CFT073
aaugcagcaaccagagc

SEQ ID NO: 653151 - RNA, 12 nt, Escherichia coli CFT073
aaugcagcagca

SEQ ID NO: 653152 - RNA, 12 nt, Escherichia coli CFT073
aaugauuuugau

SEQ ID NO: 653153 - RNA, 23 nt, Escherichia coli CFT073
aaugagaguacguucacuuuucu

SEQ ID NO: 653154 - RNA, 21 nt, Escherichia coli CFT073
aaugagauucaacaucucuau

SEQ ID NO: 653155 - RNA, 17 nt, Escherichia coli CFT073
aaugacguguaugcaua

SEQ ID NO: 653156 - RNA, 19 nt, Escherichia coli CFT073
aaugacggaucuuccagcg

SEQ ID NO: 653157 - RNA, 14 nt, Escherichia coli CFT073
aaugacgaugcacc

SEQ ID NO: 653158 - RNA, 15 nt, Escherichia coli CFT073
aaugaauaacuuccu

SEQ ID NO: 653159 - RNA, 14 nt, Escherichia coli CFT073
aaugaaucagcaga

SEQ ID NO: 653160 - RNA, 15 nt, Escherichia coli CFT073
aaugaaucagcagau

SEQ ID NO: 653161 - RNA, 17 nt, Escherichia coli CFT073
aaugaccgccugcgggg

SEQ ID NO: 653162 - RNA, 13 nt, Escherichia coli CFT073
aaugaaugcguuc

SEQ ID NO: 653163 - RNA, 16 nt, Escherichia coli CFT073
aaugaaauauuuuaaa

SEQ ID NO: 653164 - RNA, 12 nt, Escherichia coli CFT073
aaugaaauaaaa

SEQ ID NO: 653165 - RNA, 17 nt, Escherichia coli CFT073
aaugaaauaaaacaaau

SEQ ID NO: 653166 - RNA, 21 nt, Escherichia coli CFT073
aaugaaccaaucagccgagcu

SEQ ID NO: 653167 - RNA, 12 nt, Escherichia coli CFT073
aaugaaacucaa

SEQ ID NO: 653168 - RNA, 21 nt, Escherichia coli CFT073
aaugaaagaugaagaguggaa

SEQ ID NO: 653169 - RNA, 13 nt, Escherichia coli CFT073
aaugaaaaacagg

SEQ ID NO: 653170 - RNA, 10 nt, Escherichia coli CFT073
aaucuuuuca

SEQ ID NO: 653171 - RNA, 23 nt, Escherichia coli CFT073
aaucugugugggcacucgaagau

SEQ ID NO: 653172 - RNA, 22 nt, Escherichia coli CFT073
aaucuguugauuuaacagcaaa

SEQ ID NO: 653173 - RNA, 17 nt, Escherichia coli CFT073
aaucugugcuugcagau

SEQ ID NO: 653174 - RNA, 16 nt, Escherichia coli CFT073
aaucuguccuuccagu

SEQ ID NO: 653175 - RNA, 17 nt, Escherichia coli CFT073
aaucuggcuucaucugc

SEQ ID NO: 653176 - RNA, 12 nt, Escherichia coli CFT073
aaucuggucugg

SEQ ID NO: 653177 - RNA, 20 nt, Escherichia coli CFT073
aaucgccugcugaauauugc

SEQ ID NO: 653178 - RNA, 23 nt, Escherichia coli CFT073
aaucgccuuacccugaccgucuu

SEQ ID NO: 653179 - RNA, 15 nt, Escherichia coli CFT073
aaucgccagcggcag

SEQ ID NO: 653180 - RNA, 20 nt, Escherichia coli CFT073
aaucgccaacgccugcggcu

SEQ ID NO: 653181 - RNA, 13 nt, Escherichia coli CFT073
aauccuuccccca

SEQ ID NO: 653182 - RNA, 13 nt, Escherichia coli CFT073
aauccuuauauaa

SEQ ID NO: 653183 - RNA, 15 nt, Escherichia coli CFT073
aauccuuauuuuuau

SEQ ID NO: 653184 - RNA, 22 nt, Escherichia coli CFT073
aauccuuauuuuuauaacuaua

SEQ ID NO: 653185 - RNA, 22 nt, Escherichia coli CFT073
aaucgcuucaucgcccacauca

SEQ ID NO: 653186 - RNA, 14 nt, Escherichia coli CFT073
aaucgcuucauuua

SEQ ID NO: 653187 - RNA, 18 nt, Escherichia coli CFT073
aaucgggcgacagcugcg

SEQ ID NO: 653188 - RNA, 16 nt, Escherichia coli CFT073
aaucgcuguacucacc

SEQ ID NO: 653189 - RNA, 19 nt, Escherichia coli CFT073
aaucgcuguacucaccaac

SEQ ID NO: 653190 - RNA, 13 nt, Escherichia coli CFT073
aaucgcucccucu

SEQ ID NO: 653191 - RNA, 15 nt, Escherichia coli CFT073
aaucgguuucguuau

SEQ ID NO: 653192 - RNA, 12 nt, Escherichia coli CFT073
aaucguaaucgg

SEQ ID NO: 653193 - RNA, 14 nt, Escherichia coli CFT073
aaucgguaacgcuu

SEQ ID NO: 653194 - RNA, 20 nt, Escherichia coli CFT073
aaucgguggcggcaguugcc

SEQ ID NO: 653195 - RNA, 21 nt, Escherichia coli CFT073
aaucuacaaaggguaaagcac

SEQ ID NO: 653196 - RNA, 20 nt, Escherichia coli CFT073
aaucuacaaaagauuauugc

SEQ ID NO: 653197 - RNA, 13 nt, Escherichia coli CFT073
aaucgucaucagc

SEQ ID NO: 653198 - RNA, 22 nt, Escherichia coli CFT073
aaucguccuccgaauaaauuug

SEQ ID NO: 653199 - RNA, 16 nt, Escherichia coli CFT073
aaucuacggaagaguu

SEQ ID NO: 653200 - RNA, 12 nt, Escherichia coli CFT073
aaucuaggcucu

SEQ ID NO: 653201 - RNA, 22 nt, Escherichia coli CFT073
aauccguuccucaccguuuaau

SEQ ID NO: 653202 - RNA, 21 nt, Escherichia coli CFT073
aauccggguucggauaaauga

SEQ ID NO: 653203 - RNA, 21 nt, Escherichia coli CFT073
aauccguauuccugaaucagc

SEQ ID NO: 653204 - RNA, 19 nt, Escherichia coli CFT073
aauccgucccaauucuucc

SEQ ID NO: 653205 - RNA, 18 nt, Escherichia coli CFT073
aauccggcauacauuuau

SEQ ID NO: 653206 - RNA, 14 nt, Escherichia coli CFT073
aauccgcucugccc

SEQ ID NO: 653207 - RNA, 20 nt, Escherichia coli CFT073
aauccgcuggugcuuuaaau

SEQ ID NO: 653208 - RNA, 16 nt, Escherichia coli CFT073
aauccugccagugcaa

SEQ ID NO: 653209 - RNA, 19 nt, Escherichia coli CFT073
aauccugccagugcaaaaa

SEQ ID NO: 653210 - RNA, 19 nt, Escherichia coli CFT073
aauccuggcagcaucagac

SEQ ID NO: 653211 - RNA, 22 nt, Escherichia coli CFT073
aaucccaguacuguacaacaca

SEQ ID NO: 653212 - RNA, 13 nt, Escherichia coli CFT073
aauccccacugca

SEQ ID NO: 653213 - RNA, 15 nt, Escherichia coli CFT073
aauccccaguugugc

SEQ ID NO: 653214 - RNA, 23 nt, Escherichia coli CFT073
aauccccucaauaauaauccgcu

SEQ ID NO: 653215 - RNA, 20 nt, Escherichia coli CFT073
aaucccgccauaacggcugu

SEQ ID NO: 653216 - RNA, 13 nt, Escherichia coli CFT073
aaucccgccgcuu

SEQ ID NO: 653217 - RNA, 20 nt, Escherichia coli CFT073
aaucccggaaugagauucaa

SEQ ID NO: 653218 - RNA, 14 nt, Escherichia coli CFT073
aaucccggcaccaa

SEQ ID NO: 653219 - RNA, 24 nt, Escherichia coli CFT073
aaucccuuccgcuuuuaacaucuu

SEQ ID NO: 653220 - RNA, 12 nt, Escherichia coli CFT073
aaucccuucgac

SEQ ID NO: 653221 - RNA, 16 nt, Escherichia coli CFT073
aaucccuuuacaggcg

SEQ ID NO: 653222 - RNA, 19 nt, Escherichia coli CFT073
aaucccugcgaacugcgca

SEQ ID NO: 653223 - RNA, 14 nt, Escherichia coli CFT073
aaucagcuuaucca

SEQ ID NO: 653224 - RNA, 14 nt, Escherichia coli CFT073
aauauguuuuuaaa

SEQ ID NO: 653225 - RNA, 14 nt, Escherichia coli CFT073
aaucauacucccag

SEQ ID NO: 653226 - RNA, 19 nt, Escherichia coli CFT073
aaucauaauguugcugccu

SEQ ID NO: 653227 - RNA, 21 nt, Escherichia coli CFT073
aaucauaauuauaauaaauau

SEQ ID NO: 653228 - RNA, 23 nt, Escherichia coli CFT073
aaucaugcuccuguaauggcugg

SEQ ID NO: 653229 - RNA, 16 nt, Escherichia coli CFT073
aaucaucgccuucauc

SEQ ID NO: 653230 - RNA, 20 nt, Escherichia coli CFT073
aaucaucgccuuaugcugcu

SEQ ID NO: 653231 - RNA, 23 nt, Escherichia coli CFT073
aaucaucggcaucuucuucuggc

SEQ ID NO: 653232 - RNA, 15 nt, Escherichia coli CFT073
aaucauugauaauaa

SEQ ID NO: 653233 - RNA, 20 nt, Escherichia coli CFT073
aaucauucgcccgccgagaa

SEQ ID NO: 653234 - RNA, 15 nt, Escherichia coli CFT073
aauccaguacaugaa

SEQ ID NO: 653235 - RNA, 18 nt, Escherichia coli CFT073
aauccagucuuucgccau

SEQ ID NO: 653236 - RNA, 22 nt, Escherichia coli CFT073
aauccagggguuguuauuuccg

SEQ ID NO: 653237 - RNA, 15 nt, Escherichia coli CFT073
aauccauaaccauaa

SEQ ID NO: 653238 - RNA, 14 nt, Escherichia coli CFT073
aauccaguugcgua

SEQ ID NO: 653239 - RNA, 21 nt, Escherichia coli CFT073
aauccagauccugauccugca

SEQ ID NO: 653240 - RNA, 16 nt, Escherichia coli CFT073
aauccacguuccagau

SEQ ID NO: 653241 - RNA, 22 nt, Escherichia coli CFT073
aauccacguuccuggaaccagu

SEQ ID NO: 653242 - RNA, 20 nt, Escherichia coli CFT073
aauccacucaucgccuuuca

SEQ ID NO: 653243 - RNA, 22 nt, Escherichia coli CFT073
aauccacugguguaacuuugua

SEQ ID NO: 653244 - RNA, 16 nt, Escherichia coli CFT073
aauccacuucgccaga

SEQ ID NO: 653245 - RNA, 13 nt, Escherichia coli CFT073
aauccagcaagcu

SEQ ID NO: 653246 - RNA, 17 nt, Escherichia coli CFT073
aauccagcaagcugugc

SEQ ID NO: 653247 - RNA, 13 nt, Escherichia coli CFT073
aauccagcaccac

SEQ ID NO: 653248 - RNA, 14 nt, Escherichia coli CFT073
aauccagcaccaca

SEQ ID NO: 653249 - RNA, 15 nt, Escherichia coli CFT073
aauccagcagaauaa

SEQ ID NO: 653250 - RNA, 18 nt, Escherichia coli CFT073
aauccagcagaauaacau

SEQ ID NO: 653251 - RNA, 12 nt, Escherichia coli CFT073
aauccagcccca

SEQ ID NO: 653252 - RNA, 23 nt, Escherichia coli CFT073
aauccagccgcccagcgaaccgc

SEQ ID NO: 653253 - RNA, 21 nt, Escherichia coli CFT073
aauccagcuaaccauccacau

SEQ ID NO: 653254 - RNA, 22 nt, Escherichia coli CFT073
aauccagcuaaccauccacauu

SEQ ID NO: 653255 - RNA, 21 nt, Escherichia coli CFT073
aauccagcucggcgcuaauca

SEQ ID NO: 653256 - RNA, 13 nt, Escherichia coli CFT073
aauccaaaugccu

SEQ ID NO: 653257 - RNA, 23 nt, Escherichia coli CFT073
aaucauuuccagacacaacaaua

SEQ ID NO: 653258 - RNA, 14 nt, Escherichia coli CFT073
aauccacagcaaug

SEQ ID NO: 653259 - RNA, 15 nt, Escherichia coli CFT073
aauccaaacauggca

SEQ ID NO: 653260 - RNA, 22 nt, Escherichia coli CFT073
aauccaacauagcuaaaaauaa

SEQ ID NO: 653261 - RNA, 18 nt, Escherichia coli CFT073
aauccaaccucuucuuuu

SEQ ID NO: 653262 - RNA, 14 nt, Escherichia coli CFT073
aagaaaacauuuua

SEQ ID NO: 653263 - RNA, 16 nt, Escherichia coli CFT073
aagaaaacauuuuaaa

SEQ ID NO: 653264 - RNA, 23 nt, Escherichia coli CFT073
aagaaaauccucaacgccgcaca

SEQ ID NO: 653265 - RNA, 14 nt, Escherichia coli CFT073
aagaaaaugguuug

SEQ ID NO: 653266 - RNA, 13 nt, Escherichia coli CFT073
aagaaacacacuu

SEQ ID NO: 653267 - RNA, 14 nt, Escherichia coli CFT073
aagaaacaccagaa

SEQ ID NO: 653268 - RNA, 19 nt, Escherichia coli CFT073
aagaaacagauaaccacug

SEQ ID NO: 653269 - RNA, 15 nt, Escherichia coli CFT073
aagaaacgcuccacc

SEQ ID NO: 653270 - RNA, 13 nt, Escherichia coli CFT073
aagaaacucuauc

SEQ ID NO: 653271 - RNA, 19 nt, Escherichia coli CFT073
aagaaacucuauccacauu

SEQ ID NO: 653272 - RNA, 12 nt, Escherichia coli CFT073
aagaaagaagcc

SEQ ID NO: 653273 - RNA, 14 nt, Escherichia coli CFT073
aagaaaguacugau

SEQ ID NO: 653274 - RNA, 18 nt, Escherichia coli CFT073
aagaaaggcgggaauaau

SEQ ID NO: 653275 - RNA, 19 nt, Escherichia coli CFT073
aagaaaggcgggaauaauu

SEQ ID NO: 653276 - RNA, 17 nt, Escherichia coli CFT073
aagaaccagaauuucca

SEQ ID NO: 653277 - RNA, 11 nt, Escherichia coli CFT073
aagaaccaugc

SEQ ID NO: 653278 - RNA, 21 nt, Escherichia coli CFT073
aagaaccgcaccaggcaguuu

SEQ ID NO: 653279 - RNA, 14 nt, Escherichia coli CFT073
aagaacuccugaaa

SEQ ID NO: 653280 - RNA, 20 nt, Escherichia coli CFT073
aagaagaucagcaaauaauu

SEQ ID NO: 653281 - RNA, 13 nt, Escherichia coli CFT073
aagaagaucauca

SEQ ID NO: 653282 - RNA, 23 nt, Escherichia coli CFT073
aagaacuauugaagcccaaaaac

SEQ ID NO: 653283 - RNA, 23 nt, Escherichia coli CFT073
aagaacugacuuccacuuccugc

SEQ ID NO: 653284 - RNA, 19 nt, Escherichia coli CFT073
aagaagcuuuucgggaaca

SEQ ID NO: 653285 - RNA, 15 nt, Escherichia coli CFT073
aagaaggaaaauaca

SEQ ID NO: 653286 - RNA, 17 nt, Escherichia coli CFT073
aagaagcggcuauucug

SEQ ID NO: 653287 - RNA, 23 nt, Escherichia coli CFT073
aacuuaagcgccugauacagcca

SEQ ID NO: 653288 - RNA, 15 nt, Escherichia coli CFT073
aacuuaagucuccau

SEQ ID NO: 653289 - RNA, 17 nt, Escherichia coli CFT073
aacuuaaucgccaguuc

SEQ ID NO: 653290 - RNA, 20 nt, Escherichia coli CFT073
aacuuacugacaucaaaccc

SEQ ID NO: 653291 - RNA, 22 nt, Escherichia coli CFT073
aacuuaucaauugaugcuuuuu

SEQ ID NO: 653292 - RNA, 15 nt, Escherichia coli CFT073
aacuuacgcgucagg

SEQ ID NO: 653293 - RNA, 15 nt, Escherichia coli CFT073
aacuuaucaucaguc

SEQ ID NO: 653294 - RNA, 18 nt, Escherichia coli CFT073
aacuuaucuuauucccac

SEQ ID NO: 653295 - RNA, 18 nt, Escherichia coli CFT073
aacuuaucuguaauuaaa

SEQ ID NO: 653296 - RNA, 14 nt, Escherichia coli CFT073
aacuuaucuguaau

SEQ ID NO: 653297 - RNA, 20 nt, Escherichia coli CFT073
aacuucccaaagaucaacug

SEQ ID NO: 653298 - RNA, 17 nt, Escherichia coli CFT073
aacuuccagcuucagac

SEQ ID NO: 653299 - RNA, 20 nt, Escherichia coli CFT073
aacuuccccuuucacauuga

SEQ ID NO: 653300 - RNA, 19 nt, Escherichia coli CFT073
aacuucccgcugugguuca

SEQ ID NO: 653301 - RNA, 18 nt, Escherichia coli CFT073
aacuuccugaaucgccga

SEQ ID NO: 653302 - RNA, 10 nt, Escherichia coli CFT073
aacuuccugc

SEQ ID NO: 653303 - RNA, 18 nt, Escherichia coli CFT073
aacuucaguuuuauccua

SEQ ID NO: 653304 - RNA, 18 nt, Escherichia coli CFT073
aacuuccagaauauguuc

SEQ ID NO: 653305 - RNA, 15 nt, Escherichia coli CFT073
aacuucacucucuuu

SEQ ID NO: 653306 - RNA, 18 nt, Escherichia coli CFT073
aacuucucuucuuccgcu

SEQ ID NO: 653307 - RNA, 22 nt, Escherichia coli CFT073
aacuucuuuaguugagcuuuuu

SEQ ID NO: 653308 - RNA, 19 nt, Escherichia coli CFT073
aacuucucuucuuccgcuu

SEQ ID NO: 653309 - RNA, 20 nt, Escherichia coli CFT073
aacuucuauucaccagcaaa

SEQ ID NO: 653310 - RNA, 16 nt, Escherichia coli CFT073
aacuucgcguuguaua

SEQ ID NO: 653311 - RNA, 22 nt, Escherichia coli CFT073
aacuucggggagcgauaucagu

SEQ ID NO: 653312 - RNA, 14 nt, Escherichia coli CFT073
aacuucgccacagc

SEQ ID NO: 653313 - RNA, 23 nt, Escherichia coli CFT073
aacuucgccacagcggcaucaac

SEQ ID NO: 653314 - RNA, 18 nt, Escherichia coli CFT073
aacuuuuguauuuuaccu

SEQ ID NO: 653315 - RNA, 23 nt, Escherichia coli CFT073
aacuuuuuauccgguaaugccau

SEQ ID NO: 653316 - RNA, 17 nt, Escherichia coli CFT073
aacuuugccgugaacaa

SEQ ID NO: 653317 - RNA, 13 nt, Escherichia coli CFT073
aacuuuguugcga

SEQ ID NO: 653318 - RNA, 19 nt, Escherichia coli CFT073
aacuuuacuaaaaagugau

SEQ ID NO: 653319 - RNA, 20 nt, Escherichia coli CFT073
aacuuuacuggcucgccgca

SEQ ID NO: 653320 - RNA, 20 nt, Escherichia coli CFT073
aacuuucgggcgcaaaaaca

SEQ ID NO: 653321 - RNA, 16 nt, Escherichia coli CFT073
aacuuucucacaagcc

SEQ ID NO: 653322 - RNA, 14 nt, Escherichia coli CFT073
aacuugguuacgca

SEQ ID NO: 653323 - RNA, 19 nt, Escherichia coli CFT073
aacuuguagcuuucaacgc

SEQ ID NO: 653324 - RNA, 14 nt, Escherichia coli CFT073
aacuuguugcgccg

SEQ ID NO: 653325 - RNA, 15 nt, Escherichia coli CFT073
aacuuuaauuuugug

SEQ ID NO: 653326 - RNA, 21 nt, Escherichia coli CFT073
aacuucugcugugacuucagc

SEQ ID NO: 653327 - RNA, 22 nt, Escherichia coli CFT073
aacuguuuuaccaaauugguaa

SEQ ID NO: 653328 - RNA, 19 nt, Escherichia coli CFT073
aacuguuucgcggcaaacu

SEQ ID NO: 653329 - RNA, 22 nt, Escherichia coli CFT073
aacuguuuaacgguuucaacca

SEQ ID NO: 653330 - RNA, 16 nt, Escherichia coli CFT073
aacugugcaccgcccu

SEQ ID NO: 653331 - RNA, 17 nt, Escherichia coli CFT073
aacugugcaccgcccug

SEQ ID NO: 653332 - RNA, 14 nt, Escherichia coli CFT073
aacuguguaaugcg

SEQ ID NO: 653333 - RNA, 17 nt, Escherichia coli CFT073
aacugugccaaaucuac

SEQ ID NO: 653334 - RNA, 24 nt, Escherichia coli CFT073
aacugugaauccugcauaccauug

SEQ ID NO: 653335 - RNA, 22 nt, Escherichia coli CFT073
aacugucccauuccagccaugc

SEQ ID NO: 653336 - RNA, 19 nt, Escherichia coli CFT073
aacugucaacaccagggaa

SEQ ID NO: 653337 - RNA, 21 nt, Escherichia coli CFT073
aacuguaacgcagaagguuau

SEQ ID NO: 653338 - RNA, 18 nt, Escherichia coli CFT073
aacuggacccgaugauca

SEQ ID NO: 653339 - RNA, 15 nt, Escherichia coli CFT073
aacuggcaaaaacaa

SEQ ID NO: 653340 - RNA, 15 nt, Escherichia coli CFT073
aacuggcugaugcug

SEQ ID NO: 653341 - RNA, 21 nt, Escherichia coli CFT073
aacuggcugccguugaucugc

SEQ ID NO: 653342 - RNA, 19 nt, Escherichia coli CFT073
aacugguaacuguagguaa

SEQ ID NO: 653343 - RNA, 17 nt, Escherichia coli CFT073
aacuggucaucaaguua

SEQ ID NO: 653344 - RNA, 18 nt, Escherichia coli CFT073
aacuggugauccacgguu

SEQ ID NO: 653345 - RNA, 16 nt, Escherichia coli CFT073
aacugguguaagucgg

SEQ ID NO: 653346 - RNA, 22 nt, Escherichia coli CFT073
aacugguugaaauaaaccagua

SEQ ID NO: 653347 - RNA, 18 nt, Escherichia coli CFT073
aacugcugcauuucugga

SEQ ID NO: 653348 - RNA, 23 nt, Escherichia coli CFT073
aacugcugcauuucuggaaugcg

SEQ ID NO: 653349 - RNA, 17 nt, Escherichia coli CFT073
aacugccuccugcaaau

SEQ ID NO: 653350 - RNA, 19 nt, Escherichia coli CFT073
aacugccgucaauuuuaag

SEQ ID NO: 653351 - RNA, 20 nt, Escherichia coli CFT073
aacugccgcgccugaaucug

SEQ ID NO: 653352 - RNA, 17 nt, Escherichia coli CFT073
aacugccaguaaagcag

SEQ ID NO: 653353 - RNA, 21 nt, Escherichia coli CFT073
aacugcagcaggcgagcugcc

SEQ ID NO: 653354 - RNA, 13 nt, Escherichia coli CFT073
aacugcaaggaga

SEQ ID NO: 653355 - RNA, 23 nt, Escherichia coli CFT073
aacugauacccggcuaacagucu

SEQ ID NO: 653356 - RNA, 15 nt, Escherichia coli CFT073
aacugauccugacaa

SEQ ID NO: 653357 - RNA, 18 nt, Escherichia coli CFT073
aacugaucgacaguugcu

SEQ ID NO: 653358 - RNA, 20 nt, Escherichia coli CFT073
aacugaucgacaguugcugc

SEQ ID NO: 653359 - RNA, 14 nt, Escherichia coli CFT073
aacugaguucauau

SEQ ID NO: 653360 - RNA, 19 nt, Escherichia coli CFT073
aacugaaagaacaccagca

SEQ ID NO: 653361 - RNA, 19 nt, Escherichia coli CFT073
aacugaagauucgcccauu

SEQ ID NO: 653362 - RNA, 23 nt, Escherichia coli CFT073
aacugaagauugaacagcagaac

SEQ ID NO: 653363 - RNA, 21 nt, Escherichia coli CFT073
aacugacggucgguaaacccg

SEQ ID NO: 653364 - RNA, 17 nt, Escherichia coli CFT073
aacuaucaaccucuuuu

SEQ ID NO: 653365 - RNA, 16 nt, Escherichia coli CFT073
aacucaaucaggcuau

SEQ ID NO: 653366 - RNA, 22 nt, Escherichia coli CFT073
aacucaacgccugcuuuuacca

SEQ ID NO: 653367 - RNA, 21 nt, Escherichia coli CFT073
aacucaacgguccaaugguca

SEQ ID NO: 653368 - RNA, 16 nt, Escherichia coli CFT073
aacucaaaaauaauca

SEQ ID NO: 653369 - RNA, 12 nt, Escherichia coli CFT073
aacuauuguaua

SEQ ID NO: 653370 - RNA, 16 nt, Escherichia coli CFT073
aacucacucugcaccg

SEQ ID NO: 653371 - RNA, 20 nt, Escherichia coli CFT073
aacucauaaaccagcggcac

SEQ ID NO: 653372 - RNA, 14 nt, Escherichia coli CFT073
aacucaccgaugau

SEQ ID NO: 653373 - RNA, 20 nt, Escherichia coli CFT073
aacucaccuggcugauggaa

SEQ ID NO: 653374 - RNA, 13 nt, Escherichia coli CFT073
aacuccaccaaua

SEQ ID NO: 653375 - RNA, 20 nt, Escherichia coli CFT073
aacucaugacaaccugcugu

SEQ ID NO: 653376 - RNA, 14 nt, Escherichia coli CFT073
aacucauugccagc

SEQ ID NO: 653377 - RNA, 17 nt, Escherichia coli CFT073
aacucauccaccacaaa

SEQ ID NO: 653378 - RNA, 19 nt, Escherichia coli CFT073
aacuccauaccacguucuc

SEQ ID NO: 653379 - RNA, 22 nt, Escherichia coli CFT073
aacuccacuucaccgcgaauau

SEQ ID NO: 653380 - RNA, 15 nt, Escherichia coli CFT073
aacuccgugaagcuc

SEQ ID NO: 653381 - RNA, 15 nt, Escherichia coli CFT073
aacuccggcgaaaau

SEQ ID NO: 653382 - RNA, 23 nt, Escherichia coli CFT073
aacuccgccagcaacugauacac

SEQ ID NO: 653383 - RNA, 21 nt, Escherichia coli CFT073
aacuccccuuuaaauuauuug

SEQ ID NO: 653384 - RNA, 15 nt, Escherichia coli CFT073
aacucgaccaguagc

SEQ ID NO: 653385 - RNA, 21 nt, Escherichia coli CFT073
aacuccugaaagcgaaccaua

SEQ ID NO: 653386 - RNA, 22 nt, Escherichia coli CFT073
aacucgcuuaagccaucaucaa

SEQ ID NO: 653387 - RNA, 21 nt, Escherichia coli CFT073
aacucuauccacauuagucau

SEQ ID NO: 653388 - RNA, 16 nt, Escherichia coli CFT073
aacucucccaugcgcu

SEQ ID NO: 653389 - RNA, 20 nt, Escherichia coli CFT073
aacucugacgauucucccac

SEQ ID NO: 653390 - RNA, 17 nt, Escherichia coli CFT073
aacucuucuucugacac

SEQ ID NO: 653391 - RNA, 21 nt, Escherichia coli CFT073
aacucuuccgggaaaacaucg

SEQ ID NO: 653392 - RNA, 13 nt, Escherichia coli CFT073
aacucuucacacu

SEQ ID NO: 653393 - RNA, 13 nt, Escherichia coli CFT073
aacucuuucugac

SEQ ID NO: 653394 - RNA, 19 nt, Escherichia coli CFT073
aacucuuugggcagaaaau

SEQ ID NO: 653395 - RNA, 11 nt, Escherichia coli CFT073
aacucuugaau

SEQ ID NO: 653396 - RNA, 20 nt, Escherichia coli CFT073
aacguuugccagccacacca

SEQ ID NO: 653397 - RNA, 22 nt, Escherichia coli CFT073
aacguuucuuucaucagaucaa

SEQ ID NO: 653398 - RNA, 15 nt, Escherichia coli CFT073
aacguuuucaacaau

SEQ ID NO: 653399 - RNA, 12 nt, Escherichia coli CFT073
aacguuuucacc

SEQ ID NO: 653400 - RNA, 18 nt, Escherichia coli CFT073
aacguuuagcgguggcaa

SEQ ID NO: 653401 - RNA, 18 nt, Escherichia coli CFT073
aacguugcggguaaucau

SEQ ID NO: 653402 - RNA, 21 nt, Escherichia coli CFT073
aacguucagcacguuaaguuc

SEQ ID NO: 653403 - RNA, 12 nt, Escherichia coli CFT073
aacguuccagca

SEQ ID NO: 653404 - RNA, 13 nt, Escherichia coli CFT073
aacguuccagcaa

SEQ ID NO: 653405 - RNA, 17 nt, Escherichia coli CFT073
aacguugaauuucaggu

SEQ ID NO: 653406 - RNA, 15 nt, Escherichia coli CFT073
aacguuauuuugcua

SEQ ID NO: 653407 - RNA, 18 nt, Escherichia coli CFT073
aacguuaacgccccacuc

SEQ ID NO: 653408 - RNA, 19 nt, Escherichia coli CFT073
aacguuaccaagaaagaua

SEQ ID NO: 653409 - RNA, 13 nt, Escherichia coli CFT073
aacguuaccuuua

SEQ ID NO: 653410 - RNA, 15 nt, Escherichia coli CFT073
aacgugccacugaca

SEQ ID NO: 653411 - RNA, 23 nt, Escherichia coli CFT073
aacguggcagcaggaucuccagu

SEQ ID NO: 653412 - RNA, 21 nt, Escherichia coli CFT073
aacguggccuccaaaaaacaa

SEQ ID NO: 653413 - RNA, 15 nt, Escherichia coli CFT073
aacgugcggcaggca

SEQ ID NO: 653414 - RNA, 20 nt, Escherichia coli CFT073
aacgugcggggguuuucucu

SEQ ID NO: 653415 - RNA, 15 nt, Escherichia coli CFT073
aacgugggccaggcg

SEQ ID NO: 653416 - RNA, 21 nt, Escherichia coli CFT073
aacguguuuauauuugaacau

SEQ ID NO: 653417 - RNA, 16 nt, Escherichia coli CFT073
aacgugcaaaaucaaa

SEQ ID NO: 653418 - RNA, 20 nt, Escherichia coli CFT073
aacgucgguuucauuacaua

SEQ ID NO: 653419 - RNA, 12 nt, Escherichia coli CFT073
aacgucuucccg

SEQ ID NO: 653420 - RNA, 22 nt, Escherichia coli CFT073
aacgucgcaagacgaaaaauga

SEQ ID NO: 653421 - RNA, 15 nt, Escherichia coli CFT073
aacgucgcaucugac

SEQ ID NO: 653422 - RNA, 17 nt, Escherichia coli CFT073
aacgucgcguaauucca

SEQ ID NO: 653423 - RNA, 24 nt, Escherichia coli CFT073
aacgucgcguaauuccagaauucu

SEQ ID NO: 653424 - RNA, 13 nt, Escherichia coli CFT073
aacguccuuucau

SEQ ID NO: 653425 - RNA, 16 nt, Escherichia coli CFT073
aacguaggcacauucg

SEQ ID NO: 653426 - RNA, 13 nt, Escherichia coli CFT073
aacguagaauaaa

SEQ ID NO: 653427 - RNA, 15 nt, Escherichia coli CFT073
aacgucaccucagga

SEQ ID NO: 653428 - RNA, 22 nt, Escherichia coli CFT073
aacuaacugacuuucuuuuccc

SEQ ID NO: 653429 - RNA, 14 nt, Escherichia coli CFT073
aacuaguagcauga

SEQ ID NO: 653430 - RNA, 17 nt, Escherichia coli CFT073
aacuagcaacaaaaaaa

SEQ ID NO: 653431 - RNA, 15 nt, Escherichia coli CFT073
aacuagaagaggagg

SEQ ID NO: 653432 - RNA, 20 nt, Escherichia coli CFT073
aacuaccagcaguuugguaa

SEQ ID NO: 653433 - RNA, 17 nt, Escherichia coli CFT073
aacuacagcauuuugag

SEQ ID NO: 653434 - RNA, 21 nt, Escherichia coli CFT073
aacggucagcgcaccacacau

SEQ ID NO: 653435 - RNA, 19 nt, Escherichia coli CFT073
aacgguacuugcggucagg

SEQ ID NO: 653436 - RNA, 16 nt, Escherichia coli CFT073
aacgguaaaaccgugc

SEQ ID NO: 653437 - RNA, 20 nt, Escherichia coli CFT073
aacggugcaggcucaggcug

SEQ ID NO: 653438 - RNA, 15 nt, Escherichia coli CFT073
aacggugaaaacccu

SEQ ID NO: 653439 - RNA, 14 nt, Escherichia coli CFT073
aacgguuaacaguu

SEQ ID NO: 653440 - RNA, 16 nt, Escherichia coli CFT073
aacgguggccacagca

SEQ ID NO: 653441 - RNA, 17 nt, Escherichia coli CFT073
aacgguuaaucuguuga

SEQ ID NO: 653442 - RNA, 18 nt, Escherichia coli CFT073
aacggugcgaccaaacug

SEQ ID NO: 653443 - RNA, 17 nt, Escherichia coli CFT073
aacgguuucaaccagca

SEQ ID NO: 653444 - RNA, 23 nt, Escherichia coli CFT073
aacgguuuucaagacgccgucca

SEQ ID NO: 653445 - RNA, 21 nt, Escherichia coli CFT073
aacgguugcaaugcaucagcu

SEQ ID NO: 653446 - RNA, 15 nt, Escherichia coli CFT073
aacguaaaacaaagg

SEQ ID NO: 653447 - RNA, 19 nt, Escherichia coli CFT073
aacguaccgcgucgccggu

SEQ ID NO: 653448 - RNA, 14 nt, Escherichia coli CFT073
aacguaaucaacgc

SEQ ID NO: 653449 - RNA, 16 nt, Escherichia coli CFT073
aacggcauuuuccagc

SEQ ID NO: 653450 - RNA, 18 nt, Escherichia coli CFT073
aacggcgcaccagaauac

SEQ ID NO: 653451 - RNA, 23 nt, Escherichia coli CFT073
aacggcgcgacgggcacaccaac

SEQ ID NO: 653452 - RNA, 18 nt, Escherichia coli CFT073
aacggcguuaagcaagcu

SEQ ID NO: 653453 - RNA, 17 nt, Escherichia coli CFT073
aacggcgucagccacaa

SEQ ID NO: 653454 - RNA, 22 nt, Escherichia coli CFT073
aacggcgucgauugcucaacac

SEQ ID NO: 653455 - RNA, 18 nt, Escherichia coli CFT073
aacgggauuccugcgcuu

SEQ ID NO: 653456 - RNA, 20 nt, Escherichia coli CFT073
aacggcucacccccaucagc

SEQ ID NO: 653457 - RNA, 18 nt, Escherichia coli CFT073
aacggcugcuucggucag

SEQ ID NO: 653458 - RNA, 18 nt, Escherichia coli CFT073
aacggcugggaaaucacc

SEQ ID NO: 653459 - RNA, 20 nt, Escherichia coli CFT073
aacgggggcgauuuuccucc

SEQ ID NO: 653460 - RNA, 17 nt, Escherichia coli CFT073
aacgggcaccgccgcca

SEQ ID NO: 653461 - RNA, 16 nt, Escherichia coli CFT073
aacggcagaagcagca

SEQ ID NO: 653462 - RNA, 17 nt, Escherichia coli CFT073
aacggcacggaaagcag

SEQ ID NO: 653463 - RNA, 19 nt, Escherichia coli CFT073
aacggcacggaaagcagca

SEQ ID NO: 653464 - RNA, 21 nt, Escherichia coli CFT073
aacggcaagaucagcauccau

SEQ ID NO: 653465 - RNA, 14 nt, Escherichia coli CFT073
aacggcacaaaucc

SEQ ID NO: 653466 - RNA, 16 nt, Escherichia coli CFT073
aacggcacgaucaaga

SEQ ID NO: 653467 - RNA, 20 nt, Escherichia coli CFT073
aacggaccaauaaacgccag

SEQ ID NO: 653468 - RNA, 15 nt, Escherichia coli CFT073
aacgcuggugaaauc

SEQ ID NO: 653469 - RNA, 16 nt, Escherichia coli CFT073
aacgcuggugaaauca

SEQ ID NO: 653470 - RNA, 21 nt, Escherichia coli CFT073
aacgcugugcguaaucgccga

SEQ ID NO: 653471 - RNA, 12 nt, Escherichia coli CFT073
aacggaaagcag

SEQ ID NO: 653472 - RNA, 16 nt, Escherichia coli CFT073
aacggaaagcagauaa

SEQ ID NO: 653473 - RNA, 13 nt, Escherichia coli CFT073
aacggaccaauaa

SEQ ID NO: 653474 - RNA, 20 nt, Escherichia coli CFT073
aacgcuuguaaaugaacuca

SEQ ID NO: 653475 - RNA, 19 nt, Escherichia coli CFT073
aacgcuuucucaccaugac

SEQ ID NO: 653476 - RNA, 20 nt, Escherichia coli CFT073
aacggaaaagcaacaaccac

SEQ ID NO: 653477 - RNA, 18 nt, Escherichia coli CFT073
aacgcugccuugcucuuc

SEQ ID NO: 653478 - RNA, 13 nt, Escherichia coli CFT073
aacgcuaaccauu

SEQ ID NO: 653479 - RNA, 17 nt, Escherichia coli CFT073
aacgcgugugcgagugc

SEQ ID NO: 653480 - RNA, 22 nt, Escherichia coli CFT073
aacgcguuguaaaaacggaugc

SEQ ID NO: 653481 - RNA, 14 nt, Escherichia coli CFT073
aacgcuccaugcug

SEQ ID NO: 653482 - RNA, 13 nt, Escherichia coli CFT073
aacgcgcugccag

SEQ ID NO: 653483 - RNA, 21 nt, Escherichia coli CFT073
aacgcgcugccagaucaaaca

SEQ ID NO: 653484 - RNA, 14 nt, Escherichia coli CFT073
aacgcggcaauaaa

SEQ ID NO: 653485 - RNA, 21 nt, Escherichia coli CFT073
aacgcguagcgcaaaucaacu

SEQ ID NO: 653486 - RNA, 22 nt, Escherichia coli CFT073
aacgcgugcgccuuucagcgug

SEQ ID NO: 653487 - RNA, 19 nt, Escherichia coli CFT073
aacgcgcuaaccuguuuuc

SEQ ID NO: 653488 - RNA, 23 nt, Escherichia coli CFT073
aacgcgccaagauagaaccacgc

SEQ ID NO: 653489 - RNA, 18 nt, Escherichia coli CFT073
aacgcgccaauagccgca

SEQ ID NO: 653490 - RNA, 18 nt, Escherichia coli CFT073
aacgccucguuugcggca

SEQ ID NO: 653491 - RNA, 17 nt, Escherichia coli CFT073
aacgcgaaggccagcac

SEQ ID NO: 653492 - RNA, 23 nt, Escherichia coli CFT073
aacgccgucgccuucauaccaua

SEQ ID NO: 653493 - RNA, 16 nt, Escherichia coli CFT073
aacgccgcgugccacc

SEQ ID NO: 653494 - RNA, 14 nt, Escherichia coli CFT073
aacgccgcuauacg

SEQ ID NO: 653495 - RNA, 16 nt, Escherichia coli CFT073
aacgccgccagaccac

SEQ ID NO: 653496 - RNA, 14 nt, Escherichia coli CFT073
aacgccauccggca

SEQ ID NO: 653497 - RNA, 15 nt, Escherichia coli CFT073
aacgccaugccaaag

SEQ ID NO: 653498 - RNA, 14 nt, Escherichia coli CFT073
aacgcccugcaacu

SEQ ID NO: 653499 - RNA, 18 nt, Escherichia coli CFT073
aacgcccgagcuuccagc

SEQ ID NO: 653500 - RNA, 15 nt, Escherichia coli CFT073
aacgcccauacucau

SEQ ID NO: 653501 - RNA, 14 nt, Escherichia coli CFT073
aacgccccagcggc

SEQ ID NO: 653502 - RNA, 14 nt, Escherichia coli CFT073
aacgccaccaucac

SEQ ID NO: 653503 - RNA, 18 nt, Escherichia coli CFT073
aacgccaccccacaccag

SEQ ID NO: 653504 - RNA, 17 nt, Escherichia coli CFT073
aacgccacgccaccagc

SEQ ID NO: 653505 - RNA, 15 nt, Escherichia coli CFT073
aacgccacgcucacu

SEQ ID NO: 653506 - RNA, 17 nt, Escherichia coli CFT073
aacgaguacaaaaauaa

SEQ ID NO: 653507 - RNA, 21 nt, Escherichia coli CFT073
aacgagcaugauacucagcac

SEQ ID NO: 653508 - RNA, 17 nt, Escherichia coli CFT073
aacgauaacaaucacca

SEQ ID NO: 653509 - RNA, 18 nt, Escherichia coli CFT073
aacgauaacaaucaccaa

SEQ ID NO: 653510 - RNA, 20 nt, Escherichia coli CFT073
aacgaucgcccggcaccagc

SEQ ID NO: 653511 - RNA, 22 nt, Escherichia coli CFT073
aacgaucgcccggcaccagcac

SEQ ID NO: 653512 - RNA, 14 nt, Escherichia coli CFT073
aacgagaacgucgc

SEQ ID NO: 653513 - RNA, 21 nt, Escherichia coli CFT073
aacgagccauaaaaucacagg

SEQ ID NO: 653514 - RNA, 16 nt, Escherichia coli CFT073
aacgagcgauccaacu

SEQ ID NO: 653515 - RNA, 15 nt, Escherichia coli CFT073
aacgagcguacugac

SEQ ID NO: 653516 - RNA, 21 nt, Escherichia coli CFT073
aacgagauaauggcaaugguc

SEQ ID NO: 653517 - RNA, 21 nt, Escherichia coli CFT073
aacgacgaccgccgcucaccu

SEQ ID NO: 653518 - RNA, 14 nt, Escherichia coli CFT073
aacgacggcguggu

SEQ ID NO: 653519 - RNA, 15 nt, Escherichia coli CFT073
aacgacgguaaacca

SEQ ID NO: 653520 - RNA, 19 nt, Escherichia coli CFT073
aacgacgucgauuucugga

SEQ ID NO: 653521 - RNA, 16 nt, Escherichia coli CFT073
aacgacuacgccagaa

SEQ ID NO: 653522 - RNA, 21 nt, Escherichia coli CFT073
aacgauggcguaaccaaugcc

SEQ ID NO: 653523 - RNA, 16 nt, Escherichia coli CFT073
aacgcaauauccgcca

SEQ ID NO: 653524 - RNA, 16 nt, Escherichia coli CFT073
aacgcaaauacugacu

SEQ ID NO: 653525 - RNA, 17 nt, Escherichia coli CFT073
aacgcaguaaacgccag

SEQ ID NO: 653526 - RNA, 18 nt, Escherichia coli CFT073
aacgcauaccccaucagc

SEQ ID NO: 653527 - RNA, 16 nt, Escherichia coli CFT073
aacgcacgcugaccgc

SEQ ID NO: 653528 - RNA, 18 nt, Escherichia coli CFT073
aacgcacgucugauguaa

SEQ ID NO: 653529 - RNA, 21 nt, Escherichia coli CFT073
aacgcagacgccguuccagau

SEQ ID NO: 653530 - RNA, 20 nt, Escherichia coli CFT073
aacgcagcaacaccgcuuua

SEQ ID NO: 653531 - RNA, 15 nt, Escherichia coli CFT073
aacgcagcaacaugc

SEQ ID NO: 653532 - RNA, 13 nt, Escherichia coli CFT073
aacgcaccaggcg

SEQ ID NO: 653533 - RNA, 15 nt, Escherichia coli CFT073
aaccuccuccggcau

SEQ ID NO: 653534 - RNA, 13 nt, Escherichia coli CFT073
aaccucuguucag

SEQ ID NO: 653535 - RNA, 11 nt, Escherichia coli CFT073
aaccucucaga

SEQ ID NO: 653536 - RNA, 17 nt, Escherichia coli CFT073
aaccugaggcaauaaau

SEQ ID NO: 653537 - RNA, 21 nt, Escherichia coli CFT073
aaccugccgcgucgggcauca

SEQ ID NO: 653538 - RNA, 19 nt, Escherichia coli CFT073
aaccugcaggaaagcaaga

SEQ ID NO: 653539 - RNA, 14 nt, Escherichia coli CFT073
aaccguggcaaaau

SEQ ID NO: 653540 - RNA, 20 nt, Escherichia coli CFT073
aaccguuggcaucaagaaaa

SEQ ID NO: 653541 - RNA, 17 nt, Escherichia coli CFT073
aaccguguuuauuuuuc

SEQ ID NO: 653542 - RNA, 22 nt, Escherichia coli CFT073
aaccucacagaggucuuuucuc

SEQ ID NO: 653543 - RNA, 19 nt, Escherichia coli CFT073
aaccucaagcacagccgca

SEQ ID NO: 653544 - RNA, 15 nt, Escherichia coli CFT073
aacgaaaaugauuau

SEQ ID NO: 653545 - RNA, 20 nt, Escherichia coli CFT073
aacgaaauagccaggcagau

SEQ ID NO: 653546 - RNA, 14 nt, Escherichia coli CFT073
aacgaaagauuuaa

SEQ ID NO: 653547 - RNA, 20 nt, Escherichia coli CFT073
aacgaaaguuaauccacagc

SEQ ID NO: 653548 - RNA, 20 nt, Escherichia coli CFT073
aacgaagacagcgaaaacga

SEQ ID NO: 653549 - RNA, 17 nt, Escherichia coli CFT073
aacgaaggccggagcau

SEQ ID NO: 653550 - RNA, 16 nt, Escherichia coli CFT073
aacgaagcgccauuca

SEQ ID NO: 653551 - RNA, 18 nt, Escherichia coli CFT073
aacgaccgcgagcaaaau

SEQ ID NO: 653552 - RNA, 22 nt, Escherichia coli CFT073
aacgacacugcucgcagaaaua

SEQ ID NO: 653553 - RNA, 19 nt, Escherichia coli CFT073
aacgacaaaguuugucccu

SEQ ID NO: 653554 - RNA, 17 nt, Escherichia coli CFT073
aacgacaaaucauacag

SEQ ID NO: 653555 - RNA, 22 nt, Escherichia coli CFT073
aacgaaucuuuaaccaggcaag

SEQ ID NO: 653556 - RNA, 20 nt, Escherichia coli CFT073
aaccuugcaggccauaugac

SEQ ID NO: 653557 - RNA, 21 nt, Escherichia coli CFT073
aaccuugcaggccauaugaca

SEQ ID NO: 653558 - RNA, 22 nt, Escherichia coli CFT073
aaccuucguuagcuaauuuguu

SEQ ID NO: 653559 - RNA, 19 nt, Escherichia coli CFT073
aaccuucguucacaaacag

SEQ ID NO: 653560 - RNA, 22 nt, Escherichia coli CFT073
aaccuucuucauuaugaauagc

SEQ ID NO: 653561 - RNA, 21 nt, Escherichia coli CFT073
aaccuucauccaucggcgcuu

SEQ ID NO: 653562 - RNA, 14 nt, Escherichia coli CFT073
aaccuuacaaguaa

SEQ ID NO: 653563 - RNA, 17 nt, Escherichia coli CFT073
aaccugugacagcagcg

SEQ ID NO: 653564 - RNA, 21 nt, Escherichia coli CFT073
aaccuguuaaugcgaaugaaa

SEQ ID NO: 653565 - RNA, 19 nt, Escherichia coli CFT073
aaccgcaauaaccaucagc

SEQ ID NO: 653566 - RNA, 15 nt, Escherichia coli CFT073
aaccgcaccaaaucc

SEQ ID NO: 653567 - RNA, 16 nt, Escherichia coli CFT073
aaccgcaccaaaucca

SEQ ID NO: 653568 - RNA, 19 nt, Escherichia coli CFT073
aaccgcaccaaauccauuu

SEQ ID NO: 653569 - RNA, 17 nt, Escherichia coli CFT073
aaccgcacgcugcggca

SEQ ID NO: 653570 - RNA, 18 nt, Escherichia coli CFT073
aaccgcacucagccagcc

SEQ ID NO: 653571 - RNA, 15 nt, Escherichia coli CFT073
aaccgcagugauuuc

SEQ ID NO: 653572 - RNA, 18 nt, Escherichia coli CFT073
aaccgcaucauguaaauc

SEQ ID NO: 653573 - RNA, 15 nt, Escherichia coli CFT073
aaccgccaacagcag

SEQ ID NO: 653574 - RNA, 17 nt, Escherichia coli CFT073
aaccgccaguucccccu

SEQ ID NO: 653575 - RNA, 18 nt, Escherichia coli CFT073
aaccgccaguucccccug

SEQ ID NO: 653576 - RNA, 19 nt, Escherichia coli CFT073
aaccgcccaccgccaggca

SEQ ID NO: 653577 - RNA, 20 nt, Escherichia coli CFT073
aaccgcccagaccugcguuc

SEQ ID NO: 653578 - RNA, 22 nt, Escherichia coli CFT073
aaccgcccagugccagcaccac

SEQ ID NO: 653579 - RNA, 21 nt, Escherichia coli CFT073
aaccgcuggccaguuuucaga

SEQ ID NO: 653580 - RNA, 17 nt, Escherichia coli CFT073
aaccgcgccaugucugc

SEQ ID NO: 653581 - RNA, 20 nt, Escherichia coli CFT073
aaccgcgccaugucugcaua

SEQ ID NO: 653582 - RNA, 19 nt, Escherichia coli CFT073
aaccgcgacauacuuaaau

SEQ ID NO: 653583 - RNA, 22 nt, Escherichia coli CFT073
aaccgccgcugucugaaugaua

SEQ ID NO: 653584 - RNA, 17 nt, Escherichia coli CFT073
aaccggaucgauaaaca

SEQ ID NO: 653585 - RNA, 18 nt, Escherichia coli CFT073
aaccggauuuucaccauc

SEQ ID NO: 653586 - RNA, 16 nt, Escherichia coli CFT073
aaccggcacuucaacu

SEQ ID NO: 653587 - RNA, 20 nt, Escherichia coli CFT073
aaccggccuguaaggaauaa

SEQ ID NO: 653588 - RNA, 14 nt, Escherichia coli CFT073
aaccgguuuagaaa

SEQ ID NO: 653589 - RNA, 18 nt, Escherichia coli CFT073
aaccgguuuagaaaagag

SEQ ID NO: 653590 - RNA, 21 nt, Escherichia coli CFT073
aaccggugcgcgaucuuccuc

SEQ ID NO: 653591 - RNA, 13 nt, Escherichia coli CFT073
aaccggugcugcg

SEQ ID NO: 653592 - RNA, 22 nt, Escherichia coli CFT073
aaccguacuucaccucauguaa

SEQ ID NO: 653593 - RNA, 14 nt, Escherichia coli CFT073
aaccgguaccggac

SEQ ID NO: 653594 - RNA, 16 nt, Escherichia coli CFT073
aaccccgucugucuug

SEQ ID NO: 653595 - RNA, 19 nt, Escherichia coli CFT073
aacccgcaguccugcaggu

SEQ ID NO: 653596 - RNA, 17 nt, Escherichia coli CFT073
aacccgcuucuuccagc

SEQ ID NO: 653597 - RNA, 18 nt, Escherichia coli CFT073
aacccguaaaaaucggca

SEQ ID NO: 653598 - RNA, 17 nt, Escherichia coli CFT073
aaccgagauaaaugcca

SEQ ID NO: 653599 - RNA, 19 nt, Escherichia coli CFT073
aaccgagaugguaaagcac

SEQ ID NO: 653600 - RNA, 22 nt, Escherichia coli CFT073
aacccuuugcggugcagcagcu

SEQ ID NO: 653601 - RNA, 21 nt, Escherichia coli CFT073
aacccucccgguuaauaagag

SEQ ID NO: 653602 - RNA, 19 nt, Escherichia coli CFT073
aacccugaaaucagagaga

SEQ ID NO: 653603 - RNA, 15 nt, Escherichia coli CFT073
aacccuuucaccaac

SEQ ID NO: 653604 - RNA, 21 nt, Escherichia coli CFT073
aacccuucaagaauuaaaaua

SEQ ID NO: 653605 - RNA, 16 nt, Escherichia coli CFT073
aacccugcaucagaac

SEQ ID NO: 653606 - RNA, 22 nt, Escherichia coli CFT073
aacccaacguucguacugcccu

SEQ ID NO: 653607 - RNA, 15 nt, Escherichia coli CFT073
aacccaaauccgcca

SEQ ID NO: 653608 - RNA, 13 nt, Escherichia coli CFT073
aacccaccaugcc

SEQ ID NO: 653609 - RNA, 19 nt, Escherichia coli CFT073
aacccacagcgcaccaacg

SEQ ID NO: 653610 - RNA, 23 nt, Escherichia coli CFT073
aacccaccaccgcuaacugcugc

SEQ ID NO: 653611 - RNA, 15 nt, Escherichia coli CFT073
aacccagacaaauaa

SEQ ID NO: 653612 - RNA, 23 nt, Escherichia coli CFT073
aaccauuagucuggauugcagag

SEQ ID NO: 653613 - RNA, 15 nt, Escherichia coli CFT073
aaccaugcaaucacu

SEQ ID NO: 653614 - RNA, 13 nt, Escherichia coli CFT073
aaccaugcacuuu

SEQ ID NO: 653615 - RNA, 19 nt, Escherichia coli CFT073
aaccaugccgcccagcagc

SEQ ID NO: 653616 - RNA, 17 nt, Escherichia coli CFT073
aaccauguagacauagg

SEQ ID NO: 653617 - RNA, 12 nt, Escherichia coli CFT073
aaccauuaaaua

SEQ ID NO: 653618 - RNA, 20 nt, Escherichia coli CFT073
aaccaguugugcaccaccaa

SEQ ID NO: 653619 - RNA, 21 nt, Escherichia coli CFT073
aaccaguuuaugccuguccuc

SEQ ID NO: 653620 - RNA, 15 nt, Escherichia coli CFT073
aaccauaaugaugcc

SEQ ID NO: 653621 - RNA, 18 nt, Escherichia coli CFT073
aaccauagaauacgccac

SEQ ID NO: 653622 - RNA, 19 nt, Escherichia coli CFT073
aaccaguacugacuaucca

SEQ ID NO: 653623 - RNA, 23 nt, Escherichia coli CFT073
aaccaguagcaaaacucaccauc

SEQ ID NO: 653624 - RNA, 15 nt, Escherichia coli CFT073
aaccagucacgguua

SEQ ID NO: 653625 - RNA, 19 nt, Escherichia coli CFT073
aaccagugacggaacucuu

SEQ ID NO: 653626 - RNA, 19 nt, Escherichia coli CFT073
aaccagugaauacugcgcg

SEQ ID NO: 653627 - RNA, 21 nt, Escherichia coli CFT073
aaccaucaccaguuguugcgu

SEQ ID NO: 653628 - RNA, 13 nt, Escherichia coli CFT073
aaccauccacauu

SEQ ID NO: 653629 - RNA, 13 nt, Escherichia coli CFT073
aaccauccauauu

SEQ ID NO: 653630 - RNA, 16 nt, Escherichia coli CFT073
aaccauccgagcagca

SEQ ID NO: 653631 - RNA, 20 nt, Escherichia coli CFT073
aaccauccgagcagcaaugc

SEQ ID NO: 653632 - RNA, 22 nt, Escherichia coli CFT073
aaccacauggagcuuuaaacac

SEQ ID NO: 653633 - RNA, 21 nt, Escherichia coli CFT073
aaccacagugaggguuucuuc

SEQ ID NO: 653634 - RNA, 12 nt, Escherichia coli CFT073
aaccacaucagc

SEQ ID NO: 653635 - RNA, 15 nt, Escherichia coli CFT073
aaccacaaccacuuu

SEQ ID NO: 653636 - RNA, 14 nt, Escherichia coli CFT073
aaccaccaaacugc

SEQ ID NO: 653637 - RNA, 14 nt, Escherichia coli CFT073
aaccacccaccagc

SEQ ID NO: 653638 - RNA, 15 nt, Escherichia coli CFT073
aaccaccgaagauca

SEQ ID NO: 653639 - RNA, 21 nt, Escherichia coli CFT073
aaccaccgccacuaccaucag

SEQ ID NO: 653640 - RNA, 15 nt, Escherichia coli CFT073
aaccaccggcaccac

SEQ ID NO: 653641 - RNA, 16 nt, Escherichia coli CFT073
aaccacgcaaaggcgu

SEQ ID NO: 653642 - RNA, 10 nt, Escherichia coli CFT073
aaccacgcca

SEQ ID NO: 653643 - RNA, 17 nt, Escherichia coli CFT073
aaccacggaaaggcagu

SEQ ID NO: 653644 - RNA, 23 nt, Escherichia coli CFT073
aaccacggaguugaccagcucca

SEQ ID NO: 653645 - RNA, 12 nt, Escherichia coli CFT073
aaccacugugag

SEQ ID NO: 653646 - RNA, 15 nt, Escherichia coli CFT073
aaccacugcucugac

SEQ ID NO: 653647 - RNA, 18 nt, Escherichia coli CFT073
aaccacuaccguaguaaa

SEQ ID NO: 653648 - RNA, 14 nt, Escherichia coli CFT073
aaccagaaaccgug

SEQ ID NO: 653649 - RNA, 21 nt, Escherichia coli CFT073
aaccacuugcagcucauauuc

SEQ ID NO: 653650 - RNA, 23 nt, Escherichia coli CFT073
aaccagaaauagaccggagaaaa

SEQ ID NO: 653651 - RNA, 17 nt, Escherichia coli CFT073
aaccagagacagaccaa

SEQ ID NO: 653652 - RNA, 20 nt, Escherichia coli CFT073
aaccagaauuuccagaaagu

SEQ ID NO: 653653 - RNA, 15 nt, Escherichia coli CFT073
aaccagacgauuuuc

SEQ ID NO: 653654 - RNA, 17 nt, Escherichia coli CFT073
aaccagacgauuuuccc

SEQ ID NO: 653655 - RNA, 19 nt, Escherichia coli CFT073
aaccagacgauuuucccug

SEQ ID NO: 653656 - RNA, 17 nt, Escherichia coli CFT073
aaccagccguuauguug

SEQ ID NO: 653657 - RNA, 17 nt, Escherichia coli CFT073
aaccagcgcagacacca

SEQ ID NO: 653658 - RNA, 18 nt, Escherichia coli CFT073
aaccagcgcagacaccag

SEQ ID NO: 653659 - RNA, 18 nt, Escherichia coli CFT073
aaccagccaaauaaaauc

SEQ ID NO: 653660 - RNA, 17 nt, Escherichia coli CFT073
aaccagcaaugccagcg

SEQ ID NO: 653661 - RNA, 13 nt, Escherichia coli CFT073
aaccagcaccagc

SEQ ID NO: 653662 - RNA, 19 nt, Escherichia coli CFT073
aaccagcaccuuuuccagu

SEQ ID NO: 653663 - RNA, 12 nt, Escherichia coli CFT073
aaccaggaacag

SEQ ID NO: 653664 - RNA, 11 nt, Escherichia coli CFT073
aaccaggaaca

SEQ ID NO: 653665 - RNA, 19 nt, Escherichia coli CFT073
aaccaggcaaguucuuuug

SEQ ID NO: 653666 - RNA, 19 nt, Escherichia coli CFT073
aaccagggaaaaaagcccc

SEQ ID NO: 653667 - RNA, 18 nt, Escherichia coli CFT073
aaccagcgucgcaucagg

SEQ ID NO: 653668 - RNA, 21 nt, Escherichia coli CFT073
aaccagcguuuccagcaccag

SEQ ID NO: 653669 - RNA, 11 nt, Escherichia coli CFT073
aaccagcuaau

SEQ ID NO: 653670 - RNA, 21 nt, Escherichia coli CFT073
aaccagcugaccgguugcugg

SEQ ID NO: 653671 - RNA, 21 nt, Escherichia coli CFT073
aacauccgcuuuugguuuuuc

SEQ ID NO: 653672 - RNA, 19 nt, Escherichia coli CFT073
aacauccggcacuuucgga

SEQ ID NO: 653673 - RNA, 14 nt, Escherichia coli CFT073
aacauccggcucca

SEQ ID NO: 653674 - RNA, 15 nt, Escherichia coli CFT073
aacaucggcaguaau

SEQ ID NO: 653675 - RNA, 19 nt, Escherichia coli CFT073
aacauccuuuucaccuuca

SEQ ID NO: 653676 - RNA, 16 nt, Escherichia coli CFT073
aacaucgcaaaauaca

SEQ ID NO: 653677 - RNA, 21 nt, Escherichia coli CFT073
aacaucgccauuuucugccgc

SEQ ID NO: 653678 - RNA, 22 nt, Escherichia coli CFT073
aacaugacgcgcaucacgacaa

SEQ ID NO: 653679 - RNA, 19 nt, Escherichia coli CFT073
aacaugagaacaguucagc

SEQ ID NO: 653680 - RNA, 21 nt, Escherichia coli CFT073
aacauuaagaggcauuuuuug

SEQ ID NO: 653681 - RNA, 18 nt, Escherichia coli CFT073
aacaugguuaaaaucucc

SEQ ID NO: 653682 - RNA, 16 nt, Escherichia coli CFT073
aacauggcgcggcaca

SEQ ID NO: 653683 - RNA, 22 nt, Escherichia coli CFT073
aacauggcacugcgaucccggc

SEQ ID NO: 653684 - RNA, 16 nt, Escherichia coli CFT073
aacaugcgcagaagca

SEQ ID NO: 653685 - RNA, 18 nt, Escherichia coli CFT073
aacaugcgcagaagcaua

SEQ ID NO: 653686 - RNA, 19 nt, Escherichia coli CFT073
aacaugccacuggcuccac

SEQ ID NO: 653687 - RNA, 18 nt, Escherichia coli CFT073
aacauuaucugaugcgcu

SEQ ID NO: 653688 - RNA, 14 nt, Escherichia coli CFT073
aacauuaugucugu

SEQ ID NO: 653689 - RNA, 18 nt, Escherichia coli CFT073
aacauucggcaaugguuu

SEQ ID NO: 653690 - RNA, 21 nt, Escherichia coli CFT073
aacauucguugcaguaaaauu

SEQ ID NO: 653691 - RNA, 14 nt, Escherichia coli CFT073
aacauugauaagca

SEQ ID NO: 653692 - RNA, 12 nt, Escherichia coli CFT073
aacauugcugcu

SEQ ID NO: 653693 - RNA, 16 nt, Escherichia coli CFT073
aacauugcugcugaag

SEQ ID NO: 653694 - RNA, 16 nt, Escherichia coli CFT073
aacauuuuaaacauca

SEQ ID NO: 653695 - RNA, 13 nt, Escherichia coli CFT073
aacauuugggcug

SEQ ID NO: 653696 - RNA, 22 nt, Escherichia coli CFT073
aacauuggcucaucaaacaacg

SEQ ID NO: 653697 - RNA, 20 nt, Escherichia coli CFT073
aacauuuagcguuaaaauuu

SEQ ID NO: 653698 - RNA, 21 nt, Escherichia coli CFT073
aaccaaucaucgacauugacc

SEQ ID NO: 653699 - RNA, 13 nt, Escherichia coli CFT073
aaccaauauugcg

SEQ ID NO: 653700 - RNA, 20 nt, Escherichia coli CFT073
aaccaauaaagaacccggca

SEQ ID NO: 653701 - RNA, 18 nt, Escherichia coli CFT073
aaccaauaaguaagcauu

SEQ ID NO: 653702 - RNA, 16 nt, Escherichia coli CFT073
aaccaacgcuagcagc

SEQ ID NO: 653703 - RNA, 18 nt, Escherichia coli CFT073
aaccaacgcuagcagcag

SEQ ID NO: 653704 - RNA, 19 nt, Escherichia coli CFT073
aaccaaccagucacgguua

SEQ ID NO: 653705 - RNA, 15 nt, Escherichia coli CFT073
aaccaacaagcaccg

SEQ ID NO: 653706 - RNA, 12 nt, Escherichia coli CFT073
aaccaaaugccg

SEQ ID NO: 653707 - RNA, 14 nt, Escherichia coli CFT073
aaccaacaaaacau

SEQ ID NO: 653708 - RNA, 16 nt, Escherichia coli CFT073
aacaguagagccgcca

SEQ ID NO: 653709 - RNA, 22 nt, Escherichia coli CFT073
aacagucgcugaucaccguaga

SEQ ID NO: 653710 - RNA, 22 nt, Escherichia coli CFT073
aacagugaccaucuuccagcau

SEQ ID NO: 653711 - RNA, 21 nt, Escherichia coli CFT073
aacagucagucacaggggagg

SEQ ID NO: 653712 - RNA, 15 nt, Escherichia coli CFT073
aacagugccgaugcc

SEQ ID NO: 653713 - RNA, 15 nt, Escherichia coli CFT073
aacagugccgcgcau

SEQ ID NO: 653714 - RNA, 21 nt, Escherichia coli CFT073
aacagugccgcgcauagcacc

SEQ ID NO: 653715 - RNA, 23 nt, Escherichia coli CFT073
aacagugccgcgcauagcaccac

SEQ ID NO: 653716 - RNA, 14 nt, Escherichia coli CFT073
aacaguggcgacaa

SEQ ID NO: 653717 - RNA, 17 nt, Escherichia coli CFT073
aacaguggcgacaagca

SEQ ID NO: 653718 - RNA, 13 nt, Escherichia coli CFT073
aacauaagcaaau

SEQ ID NO: 653719 - RNA, 23 nt, Escherichia coli CFT073
aacaguucacccgguccgcgaau

SEQ ID NO: 653720 - RNA, 12 nt, Escherichia coli CFT073
aacaggaaacag

SEQ ID NO: 653721 - RNA, 17 nt, Escherichia coli CFT073
aacaggcgauuucaaau

SEQ ID NO: 653722 - RNA, 17 nt, Escherichia coli CFT073
aacaggcgaucuucccg

SEQ ID NO: 653723 - RNA, 22 nt, Escherichia coli CFT073
aacagguuacgcuggauuucaa

SEQ ID NO: 653724 - RNA, 11 nt, Escherichia coli CFT073
aacagguugau

SEQ ID NO: 653725 - RNA, 20 nt, Escherichia coli CFT073
aacagguugccguccagcgc

SEQ ID NO: 653726 - RNA, 19 nt, Escherichia coli CFT073
aacaguaauaaugcccauc

SEQ ID NO: 653727 - RNA, 22 nt, Escherichia coli CFT073
aacaguaaugccguggcaaagu

SEQ ID NO: 653728 - RNA, 22 nt, Escherichia coli CFT073
aacaguacaauauuaauuacuu

SEQ ID NO: 653729 - RNA, 22 nt, Escherichia coli CFT073
aacagggggaggcaucuucccg

SEQ ID NO: 653730 - RNA, 13 nt, Escherichia coli CFT073
aacaucaaauaca

SEQ ID NO: 653731 - RNA, 16 nt, Escherichia coli CFT073
aacaucaaaucacagc

SEQ ID NO: 653732 - RNA, 11 nt, Escherichia coli CFT073
aacauauugcu

SEQ ID NO: 653733 - RNA, 22 nt, Escherichia coli CFT073
aacauauugcuccauaauugcc

SEQ ID NO: 653734 - RNA, 21 nt, Escherichia coli CFT073
aacaucacugcaaauacccaa

SEQ ID NO: 653735 - RNA, 20 nt, Escherichia coli CFT073
aacaucaagcggcgcaugca

SEQ ID NO: 653736 - RNA, 20 nt, Escherichia coli CFT073
aacaucacaccauauccagc

SEQ ID NO: 653737 - RNA, 22 nt, Escherichia coli CFT073
aacaucacaccauauccagcgc

SEQ ID NO: 653738 - RNA, 18 nt, Escherichia coli CFT073
aacaucacaccugcucag

SEQ ID NO: 653739 - RNA, 12 nt, Escherichia coli CFT073
aacaucacaugc

SEQ ID NO: 653740 - RNA, 13 nt, Escherichia coli CFT073
aacauccaucagc

SEQ ID NO: 653741 - RNA, 21 nt, Escherichia coli CFT073
aacauccccagcgucagcagc

SEQ ID NO: 653742 - RNA, 15 nt, Escherichia coli CFT073
aacauccccauaucc

SEQ ID NO: 653743 - RNA, 20 nt, Escherichia coli CFT073
aacaucaugccggccagcgc

SEQ ID NO: 653744 - RNA, 15 nt, Escherichia coli CFT073
aacaucaucacgcag

SEQ ID NO: 653745 - RNA, 14 nt, Escherichia coli CFT073
aacaucauccccau

SEQ ID NO: 653746 - RNA, 18 nt, Escherichia coli CFT073
aacaucagcauucgucau

SEQ ID NO: 653747 - RNA, 16 nt, Escherichia coli CFT073
aacaucacgccuucaa

SEQ ID NO: 653748 - RNA, 17 nt, Escherichia coli CFT073
aacauacccaguuucau

SEQ ID NO: 653749 - RNA, 20 nt, Escherichia coli CFT073
aacauaccuaaaagcacgcc

SEQ ID NO: 653750 - RNA, 13 nt, Escherichia coli CFT073
aacauaauguaaa

SEQ ID NO: 653751 - RNA, 13 nt, Escherichia coli CFT073
aacauacaaauag

SEQ ID NO: 653752 - RNA, 13 nt, Escherichia coli CFT073
aacauaauccagc

SEQ ID NO: 653753 - RNA, 22 nt, Escherichia coli CFT073
aacauauuccgcaccugccagc

SEQ ID NO: 653754 - RNA, 22 nt, Escherichia coli CFT073
aacauauaaguggagcccucaa

SEQ ID NO: 653755 - RNA, 14 nt, Escherichia coli CFT073
aacauaucacuuuu

SEQ ID NO: 653756 - RNA, 15 nt, Escherichia coli CFT073
aacauaucagcgcaa

SEQ ID NO: 653757 - RNA, 18 nt, Escherichia coli CFT073
aacauaucagcgcaaaga

SEQ ID NO: 653758 - RNA, 16 nt, Escherichia coli CFT073
aacauaucccaccagc

SEQ ID NO: 653759 - RNA, 18 nt, Escherichia coli CFT073
aacauagcuuggcagagc

SEQ ID NO: 653760 - RNA, 17 nt, Escherichia coli CFT073
aacagcgcccaacacuu

SEQ ID NO: 653761 - RNA, 19 nt, Escherichia coli CFT073
aacagcgccugcaaaauaa

SEQ ID NO: 653762 - RNA, 14 nt, Escherichia coli CFT073
aacagcgacaccag

SEQ ID NO: 653763 - RNA, 20 nt, Escherichia coli CFT073
aacagcgacaccagccaucu

SEQ ID NO: 653764 - RNA, 22 nt, Escherichia coli CFT073
aacagcgaguucagacgcugca

SEQ ID NO: 653765 - RNA, 13 nt, Escherichia coli CFT073
aacagcgcaccag

SEQ ID NO: 653766 - RNA, 19 nt, Escherichia coli CFT073
aacagcgcaccagaaacaa

SEQ ID NO: 653767 - RNA, 20 nt, Escherichia coli CFT073
aacagcgcaccagaaacaau

SEQ ID NO: 653768 - RNA, 16 nt, Escherichia coli CFT073
aacagcguaaauaugc

SEQ ID NO: 653769 - RNA, 22 nt, Escherichia coli CFT073
aacagcgugccgcgaucccaga

SEQ ID NO: 653770 - RNA, 16 nt, Escherichia coli CFT073
aacagcaggcagaucc

SEQ ID NO: 653771 - RNA, 16 nt, Escherichia coli CFT073
aacagccagaagguga

SEQ ID NO: 653772 - RNA, 14 nt, Escherichia coli CFT073
aacagccagcagcg

SEQ ID NO: 653773 - RNA, 22 nt, Escherichia coli CFT073
aacagccaggcuuuaccuucag

SEQ ID NO: 653774 - RNA, 13 nt, Escherichia coli CFT073
aacagcagaucga

SEQ ID NO: 653775 - RNA, 20 nt, Escherichia coli CFT073
aacagcagaacgaccagcgc

SEQ ID NO: 653776 - RNA, 23 nt, Escherichia coli CFT073
aacagauuuugcaggccugauaa

SEQ ID NO: 653777 - RNA, 18 nt, Escherichia coli CFT073
aacagauaaccacuggca

SEQ ID NO: 653778 - RNA, 14 nt, Escherichia coli CFT073
aacagauaauaaaa

SEQ ID NO: 653779 - RNA, 17 nt, Escherichia coli CFT073
aacagaaacgccaucca

SEQ ID NO: 653780 - RNA, 20 nt, Escherichia coli CFT073
aacacuuugccgucugccac

SEQ ID NO: 653781 - RNA, 23 nt, Escherichia coli CFT073
aacacuuccgggucgcugucuuu

SEQ ID NO: 653782 - RNA, 20 nt, Escherichia coli CFT073
aacacuuggcgucaaacgac

SEQ ID NO: 653783 - RNA, 23 nt, Escherichia coli CFT073
aacagaacgcgccuuaaaaacca

SEQ ID NO: 653784 - RNA, 13 nt, Escherichia coli CFT073
aacagaagaucau

SEQ ID NO: 653785 - RNA, 14 nt, Escherichia coli CFT073
aacagaauacccag

SEQ ID NO: 653786 - RNA, 19 nt, Escherichia coli CFT073
aacagaauacccagcaaug

SEQ ID NO: 653787 - RNA, 14 nt, Escherichia coli CFT073
aacacgaucagcca

SEQ ID NO: 653788 - RNA, 21 nt, Escherichia coli CFT073
aacacgcaaucccguugccac

SEQ ID NO: 653789 - RNA, 19 nt, Escherichia coli CFT073
aacacgaucuucugccaau

SEQ ID NO: 653790 - RNA, 16 nt, Escherichia coli CFT073
aacacggcuuucugca

SEQ ID NO: 653791 - RNA, 21 nt, Escherichia coli CFT073
aacacugagguaacucucaug

SEQ ID NO: 653792 - RNA, 15 nt, Escherichia coli CFT073
aacacugccucaggc

SEQ ID NO: 653793 - RNA, 14 nt, Escherichia coli CFT073
aacacugcuuuuaa

SEQ ID NO: 653794 - RNA, 22 nt, Escherichia coli CFT073
aacacugcuuuuaaaugcccga

SEQ ID NO: 653795 - RNA, 20 nt, Escherichia coli CFT073
aacacuguuaccgcugcugg

SEQ ID NO: 653796 - RNA, 14 nt, Escherichia coli CFT073
aacacguugcaacu

SEQ ID NO: 653797 - RNA, 15 nt, Escherichia coli CFT073
aacaccuaccggcug

SEQ ID NO: 653798 - RNA, 17 nt, Escherichia coli CFT073
aacaccuggcaccagug

SEQ ID NO: 653799 - RNA, 22 nt, Escherichia coli CFT073
aacaccuuaaccucaggaaauu

SEQ ID NO: 653800 - RNA, 19 nt, Escherichia coli CFT073
aacacgaauaccaagcaga

SEQ ID NO: 653801 - RNA, 21 nt, Escherichia coli CFT073
aacacgaaucaggcggcucac

SEQ ID NO: 653802 - RNA, 23 nt, Escherichia coli CFT073
aacacgaaucaggcggcucaccu

SEQ ID NO: 653803 - RNA, 13 nt, Escherichia coli CFT073
aacaccugucuuc

SEQ ID NO: 653804 - RNA, 19 nt, Escherichia coli CFT073
aacaccuucguccagcauc

SEQ ID NO: 653805 - RNA, 21 nt, Escherichia coli CFT073
aacaccgcuguugccagcagc

SEQ ID NO: 653806 - RNA, 22 nt, Escherichia coli CFT073
aacaccgcuguugccagcagca

SEQ ID NO: 653807 - RNA, 19 nt, Escherichia coli CFT073
aacaccggugaccaucagc

SEQ ID NO: 653808 - RNA, 21 nt, Escherichia coli CFT073
aacaccguaagaaaggcggga

SEQ ID NO: 653809 - RNA, 15 nt, Escherichia coli CFT073
aacaccggcgcacug

SEQ ID NO: 653810 - RNA, 21 nt, Escherichia coli CFT073
aacacccugaugugcagauca

SEQ ID NO: 653811 - RNA, 17 nt, Escherichia coli CFT073
aacacaggauacgcaua

SEQ ID NO: 653812 - RNA, 14 nt, Escherichia coli CFT073
aacacagcaauaau

SEQ ID NO: 653813 - RNA, 13 nt, Escherichia coli CFT073
aacacacuuucca

SEQ ID NO: 653814 - RNA, 22 nt, Escherichia coli CFT073
aacacaguuguaauaagagguu

SEQ ID NO: 653815 - RNA, 13 nt, Escherichia coli CFT073
aacacaugcacau

SEQ ID NO: 653816 - RNA, 16 nt, Escherichia coli CFT073
aacacaugcacaucca

SEQ ID NO: 653817 - RNA, 18 nt, Escherichia coli CFT073
aacacauguguugaucac

SEQ ID NO: 653818 - RNA, 15 nt, Escherichia coli CFT073
aacaccaccagcgcc

SEQ ID NO: 653819 - RNA, 20 nt, Escherichia coli CFT073
aacaccaggcuaaauugcau

SEQ ID NO: 653820 - RNA, 18 nt, Escherichia coli CFT073
aacaccagaaccagcaac

SEQ ID NO: 653821 - RNA, 21 nt, Escherichia coli CFT073
aacaccagaaccagcaaccac

SEQ ID NO: 653822 - RNA, 15 nt, Escherichia coli CFT073
aacaccagcaauaau

SEQ ID NO: 653823 - RNA, 16 nt, Escherichia coli CFT073
aacaccagcagcagcg

SEQ ID NO: 653824 - RNA, 13 nt, Escherichia coli CFT073
aacaccagcagua

SEQ ID NO: 653825 - RNA, 14 nt, Escherichia coli CFT073
aacaaucaucaacc

SEQ ID NO: 653826 - RNA, 15 nt, Escherichia coli CFT073
aacaauccaaaugcc

SEQ ID NO: 653827 - RNA, 17 nt, Escherichia coli CFT073
aacaaucgcucacaaca

SEQ ID NO: 653828 - RNA, 18 nt, Escherichia coli CFT073
aacaauccucccuuaccc

SEQ ID NO: 653829 - RNA, 21 nt, Escherichia coli CFT073
aacaauaucgccagcuugcag

SEQ ID NO: 653830 - RNA, 16 nt, Escherichia coli CFT073
aacaauaucuaaaaug

SEQ ID NO: 653831 - RNA, 19 nt, Escherichia coli CFT073
aacaaucaccaaaccaaca

SEQ ID NO: 653832 - RNA, 22 nt, Escherichia coli CFT073
aacaaucaccaaaccaacaagc

SEQ ID NO: 653833 - RNA, 23 nt, Escherichia coli CFT073
aacaaucaccaaaccaacaagca

SEQ ID NO: 653834 - RNA, 13 nt, Escherichia coli CFT073
aacaauaaaguuu

SEQ ID NO: 653835 - RNA, 14 nt, Escherichia coli CFT073
aacaauacaaaaua

SEQ ID NO: 653836 - RNA, 15 nt, Escherichia coli CFT073
aacaauuaauacaau

SEQ ID NO: 653837 - RNA, 20 nt, Escherichia coli CFT073
aacaauucguugauuuuguu

SEQ ID NO: 653838 - RNA, 23 nt, Escherichia coli CFT073
aacaauugcgggccaaagaccag

SEQ ID NO: 653839 - RNA, 13 nt, Escherichia coli CFT073
aacacaccacagc

SEQ ID NO: 653840 - RNA, 20 nt, Escherichia coli CFT073
aacacacguaggccggauaa

SEQ ID NO: 653841 - RNA, 20 nt, Escherichia coli CFT073
aacacaacguacaccgcagc

SEQ ID NO: 653842 - RNA, 15 nt, Escherichia coli CFT073
aaauuucuucccuuu

SEQ ID NO: 653843 - RNA, 15 nt, Escherichia coli CFT073
aaauuucuaucauca

SEQ ID NO: 653844 - RNA, 16 nt, Escherichia coli CFT073
aaauuucuaucaucau

SEQ ID NO: 653845 - RNA, 18 nt, Escherichia coli CFT073
aaauuucgucguaaucau

SEQ ID NO: 653846 - RNA, 19 nt, Escherichia coli CFT073
aaauuuaucgcauauccuc

SEQ ID NO: 653847 - RNA, 13 nt, Escherichia coli CFT073
aaauuuauccagc

SEQ ID NO: 653848 - RNA, 12 nt, Escherichia coli CFT073
uuucaaaaacaa

SEQ ID NO: 653849 - RNA, 21 nt, Escherichia coli CFT073
aaauugcggguaggcaccuga

SEQ ID NO: 653850 - RNA, 16 nt, Escherichia coli CFT073
aaauugcgcaacuuuu

SEQ ID NO: 653851 - RNA, 20 nt, Escherichia coli CFT073
aaauugcgcaacuuuuucuu

SEQ ID NO: 653852 - RNA, 14 nt, Escherichia coli CFT073
aaauugcaggaacu

SEQ ID NO: 653853 - RNA, 23 nt, Escherichia coli CFT073
aaauugccccagacacaguucuu

SEQ ID NO: 653854 - RNA, 16 nt, Escherichia coli CFT073
aaauugcaauuuuuau

SEQ ID NO: 653855 - RNA, 16 nt, Escherichia coli CFT073
aaauugcugguuuugu

SEQ ID NO: 653856 - RNA, 16 nt, Escherichia coli CFT073
aaauuggcagaccaga

SEQ ID NO: 653857 - RNA, 16 nt, Escherichia coli CFT073
aaauuuaauaucuucu

SEQ ID NO: 653858 - RNA, 18 nt, Escherichia coli CFT073
aaauuuagcaaauuuuua

SEQ ID NO: 653859 - RNA, 10 nt, Escherichia coli CFT073
aacaaauaaa

SEQ ID NO: 653860 - RNA, 17 nt, Escherichia coli CFT073
aacaaauagauaaaaua

SEQ ID NO: 653861 - RNA, 18 nt, Escherichia coli CFT073
aacaaagaaugccauaaa

SEQ ID NO: 653862 - RNA, 22 nt, Escherichia coli CFT073
aacaaacuccccgcaaaccaga

SEQ ID NO: 653863 - RNA, 19 nt, Escherichia coli CFT073
aacaaacgauuuaucgauu

SEQ ID NO: 653864 - RNA, 12 nt, Escherichia coli CFT073
aacaaauuuuga

SEQ ID NO: 653865 - RNA, 13 nt, Escherichia coli CFT073
aacaaauuuugaa

SEQ ID NO: 653866 - RNA, 19 nt, Escherichia coli CFT073
aacaaaugaaagcagcagc

SEQ ID NO: 653867 - RNA, 13 nt, Escherichia coli CFT073
aacaaauucacgc

SEQ ID NO: 653868 - RNA, 12 nt, Escherichia coli CFT073
aaauuuuugcca

SEQ ID NO: 653869 - RNA, 22 nt, Escherichia coli CFT073
aaauuuuuucagauaaaagcuu

SEQ ID NO: 653870 - RNA, 22 nt, Escherichia coli CFT073
aacaaaaacuuuuguauuuuac

SEQ ID NO: 653871 - RNA, 12 nt, Escherichia coli CFT073
aacaaaaugccg

SEQ ID NO: 653872 - RNA, 18 nt, Escherichia coli CFT073
aacaaaaguggacauguu

SEQ ID NO: 653873 - RNA, 13 nt, Escherichia coli CFT073
aacaaaacauacu

SEQ ID NO: 653874 - RNA, 15 nt, Escherichia coli CFT073
aacaacggcacuuca

SEQ ID NO: 653875 - RNA, 13 nt, Escherichia coli CFT073
aacaagaaacaga

SEQ ID NO: 653876 - RNA, 21 nt, Escherichia coli CFT073
aacaacuuucgggcgcaaaaa

SEQ ID NO: 653877 - RNA, 19 nt, Escherichia coli CFT073
aacaacaguuuuaucucca

SEQ ID NO: 653878 - RNA, 24 nt, Escherichia coli CFT073
aacaaccggagucaggguugacuu

SEQ ID NO: 653879 - RNA, 17 nt, Escherichia coli CFT073
aacaacggacuaaacgu

SEQ ID NO: 653880 - RNA, 19 nt, Escherichia coli CFT073
aacaaggcgggagaaaugc

SEQ ID NO: 653881 - RNA, 13 nt, Escherichia coli CFT073
aacaauaaacugc

SEQ ID NO: 653882 - RNA, 13 nt, Escherichia coli CFT073
aacaauaaaaagc

SEQ ID NO: 653883 - RNA, 14 nt, Escherichia coli CFT073
aacaagcagcugcc

SEQ ID NO: 653884 - RNA, 19 nt, Escherichia coli CFT073
aacaagccacgcaccaucc

SEQ ID NO: 653885 - RNA, 19 nt, Escherichia coli CFT073
aacaagccaaauccagcac

SEQ ID NO: 653886 - RNA, 15 nt, Escherichia coli CFT073
aacaagacaucacuc

SEQ ID NO: 653887 - RNA, 14 nt, Escherichia coli CFT073
acaguaccagcagu

SEQ ID NO: 653888 - RNA, 16 nt, Escherichia coli CFT073
acaguaauuuccugcc

SEQ ID NO: 653889 - RNA, 14 nt, Escherichia coli CFT073
acaguaagcaauca

SEQ ID NO: 653890 - RNA, 22 nt, Escherichia coli CFT073
acaguaagccgguaaucaccag

SEQ ID NO: 653891 - RNA, 15 nt, Escherichia coli CFT073
acagguucaugcugc

SEQ ID NO: 653892 - RNA, 15 nt, Escherichia coli CFT073
acaguaacccagcac

SEQ ID NO: 653893 - RNA, 15 nt, Escherichia coli CFT073
acaggugccggauuu

SEQ ID NO: 653894 - RNA, 22 nt, Escherichia coli CFT073
acagguggucacagucugcucc

SEQ ID NO: 653895 - RNA, 13 nt, Escherichia coli CFT073
acagguaagcaca

SEQ ID NO: 653896 - RNA, 18 nt, Escherichia coli CFT073
acagguaucgacaauguc

SEQ ID NO: 653897 - RNA, 21 nt, Escherichia coli CFT073
acaggucaaaguaaccuuuga

SEQ ID NO: 653898 - RNA, 13 nt, Escherichia coli CFT073
acagguccuggcu

SEQ ID NO: 653899 - RNA, 15 nt, Escherichia coli CFT073
acaggucgcaaacgg

SEQ ID NO: 653900 - RNA, 23 nt, Escherichia coli CFT073
acaggucgcaaacggcgaaggau

SEQ ID NO: 653901 - RNA, 22 nt, Escherichia coli CFT073
acaggucgccagucccuuucag

SEQ ID NO: 653902 - RNA, 12 nt, Escherichia coli CFT073
acaggcugcugc

SEQ ID NO: 653903 - RNA, 13 nt, Escherichia coli CFT073
acaggcuacugcc

SEQ ID NO: 653904 - RNA, 20 nt, Escherichia coli CFT073
acaggcgcugaucgucagca

SEQ ID NO: 653905 - RNA, 15 nt, Escherichia coli CFT073
acaggcgggaagaac

SEQ ID NO: 653906 - RNA, 15 nt, Escherichia coli CFT073
acagugccgaugccg

SEQ ID NO: 653907 - RNA, 16 nt, Escherichia coli CFT073
acagugccccaaaugu

SEQ ID NO: 653908 - RNA, 20 nt, Escherichia coli CFT073
acagugccuggcgaaaggag

SEQ ID NO: 653909 - RNA, 19 nt, Escherichia coli CFT073
acaguggcgacaagcauaa

SEQ ID NO: 653910 - RNA, 23 nt, Escherichia coli CFT073
acaguggcgacaagcauaacaaa

SEQ ID NO: 653911 - RNA, 18 nt, Escherichia coli CFT073
acagugauugcuuuuguu

SEQ ID NO: 653912 - RNA, 20 nt, Escherichia coli CFT073
acagugaccaucuuccagca

SEQ ID NO: 653913 - RNA, 15 nt, Escherichia coli CFT073
acagugacccgcagc

SEQ ID NO: 653914 - RNA, 20 nt, Escherichia coli CFT073
acagucaguuaucgcauuau

SEQ ID NO: 653915 - RNA, 15 nt, Escherichia coli CFT073
acagucaaccgccug

SEQ ID NO: 653916 - RNA, 17 nt, Escherichia coli CFT073
acagucaaggaaugaaa

SEQ ID NO: 653917 - RNA, 21 nt, Escherichia coli CFT073
acagucaaggaaugaaauauu

SEQ ID NO: 653918 - RNA, 21 nt, Escherichia coli CFT073
acagucuggcguuuucuuuuu

SEQ ID NO: 653919 - RNA, 20 nt, Escherichia coli CFT073
acauaaauggguuuuuuguu

SEQ ID NO: 653920 - RNA, 15 nt, Escherichia coli CFT073
acauaacccagcgau

SEQ ID NO: 653921 - RNA, 14 nt, Escherichia coli CFT073
acaguugcugauaa

SEQ ID NO: 653922 - RNA, 13 nt, Escherichia coli CFT073
acaguuguaaagu

SEQ ID NO: 653923 - RNA, 23 nt, Escherichia coli CFT073
acaguguuuguugaaacuuucca

SEQ ID NO: 653924 - RNA, 17 nt, Escherichia coli CFT073
acaguuaaccaguuuua

SEQ ID NO: 653925 - RNA, 12 nt, Escherichia coli CFT073
acaguuaucaaa

SEQ ID NO: 653926 - RNA, 19 nt, Escherichia coli CFT073
acaucguugauuucaccau

SEQ ID NO: 653927 - RNA, 23 nt, Escherichia coli CFT073
acaucguugauuucaccaucuuc

SEQ ID NO: 653928 - RNA, 19 nt, Escherichia coli CFT073
acaucgccaggacgauucc

SEQ ID NO: 653929 - RNA, 13 nt, Escherichia coli CFT073
acaucucaaaucu

SEQ ID NO: 653930 - RNA, 18 nt, Escherichia coli CFT073
acaucuuaauagcugcca

SEQ ID NO: 653931 - RNA, 16 nt, Escherichia coli CFT073
acaugcuggauggcgu

SEQ ID NO: 653932 - RNA, 20 nt, Escherichia coli CFT073
acaugauccggcaucuuguu

SEQ ID NO: 653933 - RNA, 17 nt, Escherichia coli CFT073
acaugaugauggcuauc

SEQ ID NO: 653934 - RNA, 15 nt, Escherichia coli CFT073
acaugauaauaaaaa

SEQ ID NO: 653935 - RNA, 14 nt, Escherichia coli CFT073
acaugcagggcaaa

SEQ ID NO: 653936 - RNA, 19 nt, Escherichia coli CFT073
acaugagaacaguucagca

SEQ ID NO: 653937 - RNA, 15 nt, Escherichia coli CFT073
acaugagaacaguuc

SEQ ID NO: 653938 - RNA, 15 nt, Escherichia coli CFT073
acauacauaauaauc

SEQ ID NO: 653939 - RNA, 20 nt, Escherichia coli CFT073
acauacagcguuuugccauc

SEQ ID NO: 653940 - RNA, 21 nt, Escherichia coli CFT073
acauacaggggaucgacgccc

SEQ ID NO: 653941 - RNA, 17 nt, Escherichia coli CFT073
acauacauguauaaaaa

SEQ ID NO: 653942 - RNA, 19 nt, Escherichia coli CFT073
acauauuccgcaccugcca

SEQ ID NO: 653943 - RNA, 23 nt, Escherichia coli CFT073
acauauucgacacauucagaauu

SEQ ID NO: 653944 - RNA, 11 nt, Escherichia coli CFT073
acauauucauu

SEQ ID NO: 653945 - RNA, 22 nt, Escherichia coli CFT073
acauauuuuuguugaaauaaua

SEQ ID NO: 653946 - RNA, 18 nt, Escherichia coli CFT073
acaucaaaaggugccaug

SEQ ID NO: 653947 - RNA, 22 nt, Escherichia coli CFT073
acauauugcaccagaucuucca

SEQ ID NO: 653948 - RNA, 22 nt, Escherichia coli CFT073
acauauugcuccauaauugcca

SEQ ID NO: 653949 - RNA, 16 nt, Escherichia coli CFT073
acaucauugccgccug

SEQ ID NO: 653950 - RNA, 16 nt, Escherichia coli CFT073
acauccaccagcgccu

SEQ ID NO: 653951 - RNA, 15 nt, Escherichia coli CFT073
acaucgauguuugac

SEQ ID NO: 653952 - RNA, 18 nt, Escherichia coli CFT073
acaucgauguuugacaac

SEQ ID NO: 653953 - RNA, 14 nt, Escherichia coli CFT073
acaucgcaaaauac

SEQ ID NO: 653954 - RNA, 17 nt, Escherichia coli CFT073
acaucagaacagcccca

SEQ ID NO: 653955 - RNA, 17 nt, Escherichia coli CFT073
acaucagaguacagauu

SEQ ID NO: 653956 - RNA, 20 nt, Escherichia coli CFT073
acagcguauaaaccauauca

SEQ ID NO: 653957 - RNA, 19 nt, Escherichia coli CFT073
acagcgccugcaaaauaau

SEQ ID NO: 653958 - RNA, 23 nt, Escherichia coli CFT073
acagcgccugcacaaagcgccag

SEQ ID NO: 653959 - RNA, 18 nt, Escherichia coli CFT073
acagcgcgccagcuacca

SEQ ID NO: 653960 - RNA, 14 nt, Escherichia coli CFT073
acagcgcccaacac

SEQ ID NO: 653961 - RNA, 19 nt, Escherichia coli CFT073
acagcgcccagacaauuaa

SEQ ID NO: 653962 - RNA, 15 nt, Escherichia coli CFT073
acagcgauuccaguu

SEQ ID NO: 653963 - RNA, 17 nt, Escherichia coli CFT073
acagccuuguauuaaua

SEQ ID NO: 653964 - RNA, 15 nt, Escherichia coli CFT073
acagccugggaaggu

SEQ ID NO: 653965 - RNA, 23 nt, Escherichia coli CFT073
acagcgaauaguggaguaugagg

SEQ ID NO: 653966 - RNA, 14 nt, Escherichia coli CFT073
acagcgacagauuc

SEQ ID NO: 653967 - RNA, 18 nt, Escherichia coli CFT073
acagccucuuccagagag

SEQ ID NO: 653968 - RNA, 17 nt, Escherichia coli CFT073
acagccugauaacgaau

SEQ ID NO: 653969 - RNA, 15 nt, Escherichia coli CFT073
acagccucaagcacc

SEQ ID NO: 653970 - RNA, 13 nt, Escherichia coli CFT073
acagccuaccaga

SEQ ID NO: 653971 - RNA, 22 nt, Escherichia coli CFT073
acagccgcauuuuguuggacau

SEQ ID NO: 653972 - RNA, 13 nt, Escherichia coli CFT073
acagcccggcaug

SEQ ID NO: 653973 - RNA, 23 nt, Escherichia coli CFT073
acagccgaagccguuggucauca

SEQ ID NO: 653974 - RNA, 19 nt, Escherichia coli CFT073
acagccaugcgaaugccaa

SEQ ID NO: 653975 - RNA, 14 nt, Escherichia coli CFT073
acaggcagcaauca

SEQ ID NO: 653976 - RNA, 14 nt, Escherichia coli CFT073
acaggccaccaggc

SEQ ID NO: 653977 - RNA, 16 nt, Escherichia coli CFT073
acaggcgaucuucccg

SEQ ID NO: 653978 - RNA, 13 nt, Escherichia coli CFT073
acaggcgaugcca

SEQ ID NO: 653979 - RNA, 15 nt, Escherichia coli CFT073
acaggccgccaggca

SEQ ID NO: 653980 - RNA, 18 nt, Escherichia coli CFT073
acaggccgcuguuuuuca

SEQ ID NO: 653981 - RNA, 20 nt, Escherichia coli CFT073
acagcuuuuacagccaaugc

SEQ ID NO: 653982 - RNA, 17 nt, Escherichia coli CFT073
acaggaaccaaaugccg

SEQ ID NO: 653983 - RNA, 19 nt, Escherichia coli CFT073
acaggagcacggaucacuc

SEQ ID NO: 653984 - RNA, 20 nt, Escherichia coli CFT073
acaggcacuacguucucacu

SEQ ID NO: 653985 - RNA, 22 nt, Escherichia coli CFT073
acaggauggcauuugcaacacc

SEQ ID NO: 653986 - RNA, 19 nt, Escherichia coli CFT073
acagcuuaaucaccagcgc

SEQ ID NO: 653987 - RNA, 17 nt, Escherichia coli CFT073
acagcuuuuacagccaa

SEQ ID NO: 653988 - RNA, 21 nt, Escherichia coli CFT073
acagcuuuuacaaaaucuucg

SEQ ID NO: 653989 - RNA, 22 nt, Escherichia coli CFT073
acagcucgguauggccuuucug

SEQ ID NO: 653990 - RNA, 17 nt, Escherichia coli CFT073
acagcuauaccgccagg

SEQ ID NO: 653991 - RNA, 15 nt, Escherichia coli CFT073
acagcucacgcgcca

SEQ ID NO: 653992 - RNA, 12 nt, Escherichia coli CFT073
acagagcugcaa

SEQ ID NO: 653993 - RNA, 16 nt, Escherichia coli CFT073
acagaggucuuuucuc

SEQ ID NO: 653994 - RNA, 12 nt, Escherichia coli CFT073
acagaguagaaa

SEQ ID NO: 653995 - RNA, 16 nt, Escherichia coli CFT073
acagcaauggaaaaag

SEQ ID NO: 653996 - RNA, 17 nt, Escherichia coli CFT073
acagauugagaauaaug

SEQ ID NO: 653997 - RNA, 18 nt, Escherichia coli CFT073
acagaugcugcucuucac

SEQ ID NO: 653998 - RNA, 19 nt, Escherichia coli CFT073
acagauuagcuggccugcu

SEQ ID NO: 653999 - RNA, 20 nt, Escherichia coli CFT073
acagauucagcgcacuuuca

SEQ ID NO: 654000 - RNA, 17 nt, Escherichia coli CFT073
acagccagccagcacca

SEQ ID NO: 654001 - RNA, 22 nt, Escherichia coli CFT073
acagccagccagcaccaggcuu

SEQ ID NO: 654002 - RNA, 15 nt, Escherichia coli CFT073
acagccagccuccaa

SEQ ID NO: 654003 - RNA, 19 nt, Escherichia coli CFT073
acagccaggcgcugcugga

SEQ ID NO: 654004 - RNA, 22 nt, Escherichia coli CFT073
acagccaugccgccaccaccag

SEQ ID NO: 654005 - RNA, 23 nt, Escherichia coli CFT073
acagccaugccgccaccaccagc

SEQ ID NO: 654006 - RNA, 22 nt, Escherichia coli CFT073
acagccacacaccgcaaacugc

SEQ ID NO: 654007 - RNA, 15 nt, Escherichia coli CFT073
acagccaaucauaaa

SEQ ID NO: 654008 - RNA, 14 nt, Escherichia coli CFT073
acagcagauggcag

SEQ ID NO: 654009 - RNA, 16 nt, Escherichia coli CFT073
acagcagccacaccaa

SEQ ID NO: 654010 - RNA, 22 nt, Escherichia coli CFT073
acagccacaccuucuugcguca

SEQ ID NO: 654011 - RNA, 12 nt, Escherichia coli CFT073
acagccacaucc

SEQ ID NO: 654012 - RNA, 13 nt, Escherichia coli CFT073
acagcaccgugca

SEQ ID NO: 654013 - RNA, 20 nt, Escherichia coli CFT073
acagcaccguuaauccacgc

SEQ ID NO: 654014 - RNA, 18 nt, Escherichia coli CFT073
acagcacggcagcaacag

SEQ ID NO: 654015 - RNA, 21 nt, Escherichia coli CFT073
acagcacggcagcaacagcag

SEQ ID NO: 654016 - RNA, 14 nt, Escherichia coli CFT073
acagacaaacagcu

SEQ ID NO: 654017 - RNA, 17 nt, Escherichia coli CFT073
acagaccagcaaagugc

SEQ ID NO: 654018 - RNA, 14 nt, Escherichia coli CFT073
acagacaucggcca

SEQ ID NO: 654019 - RNA, 21 nt, Escherichia coli CFT073
acagaaugauauugauaauaa

SEQ ID NO: 654020 - RNA, 15 nt, Escherichia coli CFT073
acagaauggcaucug

SEQ ID NO: 654021 - RNA, 16 nt, Escherichia coli CFT073
acagaauuaucauuuu

SEQ ID NO: 654022 - RNA, 22 nt, Escherichia coli CFT073
acagaauuauccccgaugguga

SEQ ID NO: 654023 - RNA, 13 nt, Escherichia coli CFT073
acacuuuccugcu

SEQ ID NO: 654024 - RNA, 19 nt, Escherichia coli CFT073
acacuuucugcaaacaaga

SEQ ID NO: 654025 - RNA, 21 nt, Escherichia coli CFT073
acacuuuccaguuccggcauu

SEQ ID NO: 654026 - RNA, 21 nt, Escherichia coli CFT073
acacuucuucuguuucugucg

SEQ ID NO: 654027 - RNA, 18 nt, Escherichia coli CFT073
acacuguugagaggacaa

SEQ ID NO: 654028 - RNA, 19 nt, Escherichia coli CFT073
acacuucaauauuaaugcu

SEQ ID NO: 654029 - RNA, 18 nt, Escherichia coli CFT073
acacuucuucagccaguu

SEQ ID NO: 654030 - RNA, 15 nt, Escherichia coli CFT073
acacugcucgcagaa

SEQ ID NO: 654031 - RNA, 19 nt, Escherichia coli CFT073
acacugcuuuuaaaugccc

SEQ ID NO: 654032 - RNA, 21 nt, Escherichia coli CFT073
acacugguucccaacaacagc

SEQ ID NO: 654033 - RNA, 13 nt, Escherichia coli CFT073
acacuggcagugu

SEQ ID NO: 654034 - RNA, 17 nt, Escherichia coli CFT073
acacuguuaccgcugcu

SEQ ID NO: 654035 - RNA, 17 nt, Escherichia coli CFT073
acacugccagcccggca

SEQ ID NO: 654036 - RNA, 14 nt, Escherichia coli CFT073
acacugaugacagg

SEQ ID NO: 654037 - RNA, 20 nt, Escherichia coli CFT073
acacugauuuccccccggca

SEQ ID NO: 654038 - RNA, 18 nt, Escherichia coli CFT073
acacugagcgugagugcg

SEQ ID NO: 654039 - RNA, 13 nt, Escherichia coli CFT073
acacucugaccug

SEQ ID NO: 654040 - RNA, 17 nt, Escherichia coli CFT073
acacucggcgcggaugc

SEQ ID NO: 654041 - RNA, 20 nt, Escherichia coli CFT073
acacucguccagucgccugc

SEQ ID NO: 654042 - RNA, 16 nt, Escherichia coli CFT073
acacucguuucaaauu

SEQ ID NO: 654043 - RNA, 15 nt, Escherichia coli CFT073
aauuucaggcaacaa

SEQ ID NO: 654044 - RNA, 21 nt, Escherichia coli CFT073
aauuucaggcaacaaaaaacc

SEQ ID NO: 654045 - RNA, 23 nt, Escherichia coli CFT073
aauuucaggccccaucgaaucaa

SEQ ID NO: 654046 - RNA, 14 nt, Escherichia coli CFT073
aauuucagcaucgc

SEQ ID NO: 654047 - RNA, 17 nt, Escherichia coli CFT073
aauuucagcggcacugu

SEQ ID NO: 654048 - RNA, 16 nt, Escherichia coli CFT073
aauuucacuuucugac

SEQ ID NO: 654049 - RNA, 12 nt, Escherichia coli CFT073
aauuucagaaaa

SEQ ID NO: 654050 - RNA, 22 nt, Escherichia coli CFT073
acccaacacucgaacaaggcaa

SEQ ID NO: 654051 - RNA, 17 nt, Escherichia coli CFT073
acccaacgcaaagagag

SEQ ID NO: 654052 - RNA, 14 nt, Escherichia coli CFT073
acccaaucccccac

SEQ ID NO: 654053 - RNA, 18 nt, Escherichia coli CFT073
acccaagcgggaauagcu

SEQ ID NO: 654054 - RNA, 13 nt, Escherichia coli CFT073
acccacuuccccu

SEQ ID NO: 654055 - RNA, 21 nt, Escherichia coli CFT073
acccacaccgcagaacagauc

SEQ ID NO: 654056 - RNA, 22 nt, Escherichia coli CFT073
acccacauguugcgcuucacca

SEQ ID NO: 654057 - RNA, 17 nt, Escherichia coli CFT073
accaucagaccagacuu

SEQ ID NO: 654058 - RNA, 14 nt, Escherichia coli CFT073
accauccaggagau

SEQ ID NO: 654059 - RNA, 22 nt, Escherichia coli CFT073
accauuagucuggauugcagag

SEQ ID NO: 654060 - RNA, 20 nt, Escherichia coli CFT073
accauuaccaaucugcucug

SEQ ID NO: 654061 - RNA, 14 nt, Escherichia coli CFT073
accauuaucaaaca

SEQ ID NO: 654062 - RNA, 14 nt, Escherichia coli CFT073
accauuaucaccaa

SEQ ID NO: 654063 - RNA, 23 nt, Escherichia coli CFT073
accauugcgccguacaaguccug

SEQ ID NO: 654064 - RNA, 20 nt, Escherichia coli CFT073
accauuggcauugguaucgg

SEQ ID NO: 654065 - RNA, 16 nt, Escherichia coli CFT073
accauugaagcaaucc

SEQ ID NO: 654066 - RNA, 12 nt, Escherichia coli CFT073
accauucccaga

SEQ ID NO: 654067 - RNA, 20 nt, Escherichia coli CFT073
accccacaaacagaauggug

SEQ ID NO: 654068 - RNA, 15 nt, Escherichia coli CFT073
accccaccgccgagg

SEQ ID NO: 654069 - RNA, 17 nt, Escherichia coli CFT073
acccagcgguaaaaugg

SEQ ID NO: 654070 - RNA, 19 nt, Escherichia coli CFT073
acccagaaucucuuuuguu

SEQ ID NO: 654071 - RNA, 16 nt, Escherichia coli CFT073
acccagcaauccugca

SEQ ID NO: 654072 - RNA, 14 nt, Escherichia coli CFT073
acccagcaaugcca

SEQ ID NO: 654073 - RNA, 18 nt, Escherichia coli CFT073
acccagcaaugccaggcu

SEQ ID NO: 654074 - RNA, 21 nt, Escherichia coli CFT073
acccagcaaugccaggcucca

SEQ ID NO: 654075 - RNA, 14 nt, Escherichia coli CFT073
acccagcaccagua

SEQ ID NO: 654076 - RNA, 18 nt, Escherichia coli CFT073
acccagcaccaguaccau

SEQ ID NO: 654077 - RNA, 13 nt, Escherichia coli CFT073
acccagcagcagc

SEQ ID NO: 654078 - RNA, 14 nt, Escherichia coli CFT073
acccagcagcgcca

SEQ ID NO: 654079 - RNA, 15 nt, Escherichia coli CFT073
acccagcagcgccac

SEQ ID NO: 654080 - RNA, 16 nt, Escherichia coli CFT073
acccccauccacgcau

SEQ ID NO: 654081 - RNA, 13 nt, Escherichia coli CFT073
acccccgaacugg

SEQ ID NO: 654082 - RNA, 16 nt, Escherichia coli CFT073
accccauauucgaacc

SEQ ID NO: 654083 - RNA, 20 nt, Escherichia coli CFT073
accccauauuggcaacagcc

SEQ ID NO: 654084 - RNA, 14 nt, Escherichia coli CFT073
accccagauggauc

SEQ ID NO: 654085 - RNA, 15 nt, Escherichia coli CFT073
accccagcggcaacc

SEQ ID NO: 654086 - RNA, 21 nt, Escherichia coli CFT073
accccagcggcaaccagcagc

SEQ ID NO: 654087 - RNA, 15 nt, Escherichia coli CFT073
accagggauaaagcu

SEQ ID NO: 654088 - RNA, 22 nt, Escherichia coli CFT073
accaggcguggauacaggcggg

SEQ ID NO: 654089 - RNA, 19 nt, Escherichia coli CFT073
accagguuucggaugggcu

SEQ ID NO: 654090 - RNA, 16 nt, Escherichia coli CFT073
accagguuguaucacc

SEQ ID NO: 654091 - RNA, 12 nt, Escherichia coli CFT073
accagguuuuug

SEQ ID NO: 654092 - RNA, 23 nt, Escherichia coli CFT073
accaguaaaccaauuucugugca

SEQ ID NO: 654093 - RNA, 18 nt, Escherichia coli CFT073
accagcgccaccacgccg

SEQ ID NO: 654094 - RNA, 14 nt, Escherichia coli CFT073
accagcgcaggaac

SEQ ID NO: 654095 - RNA, 15 nt, Escherichia coli CFT073
accagccuucuucau

SEQ ID NO: 654096 - RNA, 15 nt, Escherichia coli CFT073
accagcgacagccag

SEQ ID NO: 654097 - RNA, 17 nt, Escherichia coli CFT073
accagcgacagccagcc

SEQ ID NO: 654098 - RNA, 19 nt, Escherichia coli CFT073
accagcgacagccagccca

SEQ ID NO: 654099 - RNA, 19 nt, Escherichia coli CFT073
accaggcgaccguuuucac

SEQ ID NO: 654100 - RNA, 15 nt, Escherichia coli CFT073
accaggccaucagca

SEQ ID NO: 654101 - RNA, 14 nt, Escherichia coli CFT073
accaggccagcgca

SEQ ID NO: 654102 - RNA, 15 nt, Escherichia coli CFT073
accauaauccggguu

SEQ ID NO: 654103 - RNA, 20 nt, Escherichia coli CFT073
accauaacccgcuuccagaa

SEQ ID NO: 654104 - RNA, 19 nt, Escherichia coli CFT073
accauacagaccgaauucu

SEQ ID NO: 654105 - RNA, 22 nt, Escherichia coli CFT073
accauaaugaugccgaagugaa

SEQ ID NO: 654106 - RNA, 23 nt, Escherichia coli CFT073
accauaaugauggugaaagcaaa

SEQ ID NO: 654107 - RNA, 14 nt, Escherichia coli CFT073
accauaaacaccgu

SEQ ID NO: 654108 - RNA, 20 nt, Escherichia coli CFT073
accaguuuuugcgcccauga

SEQ ID NO: 654109 - RNA, 23 nt, Escherichia coli CFT073
accauaguauuuauccauaauuu

SEQ ID NO: 654110 - RNA, 14 nt, Escherichia coli CFT073
accauauaaacaua

SEQ ID NO: 654111 - RNA, 22 nt, Escherichia coli CFT073
accauaguccggcaccagcgcu

SEQ ID NO: 654112 - RNA, 17 nt, Escherichia coli CFT073
accauauaucagcgcca

SEQ ID NO: 654113 - RNA, 15 nt, Escherichia coli CFT073
accaguugaugaugu

SEQ ID NO: 654114 - RNA, 15 nt, Escherichia coli CFT073
accaguucagugacc

SEQ ID NO: 654115 - RNA, 17 nt, Escherichia coli CFT073
accaguugugaugccac

SEQ ID NO: 654116 - RNA, 16 nt, Escherichia coli CFT073
accaguuuccagucac

SEQ ID NO: 654117 - RNA, 21 nt, Escherichia coli CFT073
accaguuuaugccuguccucu

SEQ ID NO: 654118 - RNA, 22 nt, Escherichia coli CFT073
accagugguuaccgaauccagc

SEQ ID NO: 654119 - RNA, 14 nt, Escherichia coli CFT073
accaguaauauccc

SEQ ID NO: 654120 - RNA, 16 nt, Escherichia coli CFT073
accaguacaccaauug

SEQ ID NO: 654121 - RNA, 20 nt, Escherichia coli CFT073
accaguagugaaaaaagcaa

SEQ ID NO: 654122 - RNA, 19 nt, Escherichia coli CFT073
accagucaaaacuuuucac

SEQ ID NO: 654123 - RNA, 21 nt, Escherichia coli CFT073
accagucaaaacuuuucacca

SEQ ID NO: 654124 - RNA, 18 nt, Escherichia coli CFT073
accagucacuaaauucag

SEQ ID NO: 654125 - RNA, 19 nt, Escherichia coli CFT073
accaguccacccacgugag

SEQ ID NO: 654126 - RNA, 16 nt, Escherichia coli CFT073
accaguccaucggcau

SEQ ID NO: 654127 - RNA, 18 nt, Escherichia coli CFT073
accagucccugaaugucu

SEQ ID NO: 654128 - RNA, 15 nt, Escherichia coli CFT073
accagugcagauacc

SEQ ID NO: 654129 - RNA, 18 nt, Escherichia coli CFT073
accagugcagaugcacaa

SEQ ID NO: 654130 - RNA, 15 nt, Escherichia coli CFT073
accagugccagaaca

SEQ ID NO: 654131 - RNA, 19 nt, Escherichia coli CFT073
accacgguguugguaaacg

SEQ ID NO: 654132 - RNA, 19 nt, Escherichia coli CFT073
accacucgauuaacucaua

SEQ ID NO: 654133 - RNA, 18 nt, Escherichia coli CFT073
accacugacacggaacaa

SEQ ID NO: 654134 - RNA, 18 nt, Escherichia coli CFT073
accacugaccgcccggcc

SEQ ID NO: 654135 - RNA, 16 nt, Escherichia coli CFT073
accacggccuuccucg

SEQ ID NO: 654136 - RNA, 19 nt, Escherichia coli CFT073
accacgguacgccagagug

SEQ ID NO: 654137 - RNA, 15 nt, Escherichia coli CFT073
accacgaacgagguu

SEQ ID NO: 654138 - RNA, 14 nt, Escherichia coli CFT073
accacgauauguuc

SEQ ID NO: 654139 - RNA, 18 nt, Escherichia coli CFT073
accacgauauguucagga

SEQ ID NO: 654140 - RNA, 14 nt, Escherichia coli CFT073
accacgaggaucga

SEQ ID NO: 654141 - RNA, 20 nt, Escherichia coli CFT073
accaccagacgcaacagaaa

SEQ ID NO: 654142 - RNA, 18 nt, Escherichia coli CFT073
accaccacugaccaccaa

SEQ ID NO: 654143 - RNA, 17 nt, Escherichia coli CFT073
accacccacuuuaaugu

SEQ ID NO: 654144 - RNA, 23 nt, Escherichia coli CFT073
accaccgaguaauaacaguaaug

SEQ ID NO: 654145 - RNA, 16 nt, Escherichia coli CFT073
accaccgauaaaauaa

SEQ ID NO: 654146 - RNA, 18 nt, Escherichia coli CFT073
accacccuugcccaccag

SEQ ID NO: 654147 - RNA, 14 nt, Escherichia coli CFT073
accaccgcaaagaa

SEQ ID NO: 654148 - RNA, 17 nt, Escherichia coli CFT073
accaccgcaaccgccaa

SEQ ID NO: 654149 - RNA, 20 nt, Escherichia coli CFT073
accaccgccacuaccaucag

SEQ ID NO: 654150 - RNA, 20 nt, Escherichia coli CFT073
accaccgccagauugcugcu

SEQ ID NO: 654151 - RNA, 13 nt, Escherichia coli CFT073
accaccggcacca

SEQ ID NO: 654152 - RNA, 16 nt, Escherichia coli CFT073
accagcauuagcauua

SEQ ID NO: 654153 - RNA, 19 nt, Escherichia coli CFT073
accagcauuccuaaaccau

SEQ ID NO: 654154 - RNA, 22 nt, Escherichia coli CFT073
accagcauuccuaaaccaucag

SEQ ID NO: 654155 - RNA, 15 nt, Escherichia coli CFT073
accagccuugugccu

SEQ ID NO: 654156 - RNA, 20 nt, Escherichia coli CFT073
accagccguugucagucauc

SEQ ID NO: 654157 - RNA, 22 nt, Escherichia coli CFT073
accagcaggucgauaauuuuca

SEQ ID NO: 654158 - RNA, 14 nt, Escherichia coli CFT073
accagcaguacagu

SEQ ID NO: 654159 - RNA, 23 nt, Escherichia coli CFT073
accagcaucaacaacaauuucac

SEQ ID NO: 654160 - RNA, 16 nt, Escherichia coli CFT073
accagcaucaggauga

SEQ ID NO: 654161 - RNA, 23 nt, Escherichia coli CFT073
accagagauguugaagaagucga

SEQ ID NO: 654162 - RNA, 13 nt, Escherichia coli CFT073
accagauccaaca

SEQ ID NO: 654163 - RNA, 17 nt, Escherichia coli CFT073
accagauccagcaaggg

SEQ ID NO: 654164 - RNA, 15 nt, Escherichia coli CFT073
accagauccugccau

SEQ ID NO: 654165 - RNA, 20 nt, Escherichia coli CFT073
accagaucgccuaauuucac

SEQ ID NO: 654166 - RNA, 13 nt, Escherichia coli CFT073
accagagugacca

SEQ ID NO: 654167 - RNA, 12 nt, Escherichia coli CFT073
accagauaagaa

SEQ ID NO: 654168 - RNA, 16 nt, Escherichia coli CFT073
accagauuaauuauug

SEQ ID NO: 654169 - RNA, 15 nt, Escherichia coli CFT073
accagauuaccgccu

SEQ ID NO: 654170 - RNA, 18 nt, Escherichia coli CFT073
accagauuaccgccuuca

SEQ ID NO: 654171 - RNA, 22 nt, Escherichia coli CFT073
accagaucuaucuggcgcgcua

SEQ ID NO: 654172 - RNA, 21 nt, Escherichia coli CFT073
accagaucugacgauuauuuu

SEQ ID NO: 654173 - RNA, 20 nt, Escherichia coli CFT073
accagaaagcgacccgguuc

SEQ ID NO: 654174 - RNA, 20 nt, Escherichia coli CFT073
accagaauagcggcuucauc

SEQ ID NO: 654175 - RNA, 15 nt, Escherichia coli CFT073
accacuggcacaaga

SEQ ID NO: 654176 - RNA, 18 nt, Escherichia coli CFT073
accacuggcacaagacug

SEQ ID NO: 654177 - RNA, 13 nt, Escherichia coli CFT073
accacugacaauc

SEQ ID NO: 654178 - RNA, 23 nt, Escherichia coli CFT073
accacugauaucuaacagugccu

SEQ ID NO: 654179 - RNA, 18 nt, Escherichia coli CFT073
accagaaucgccagcauc

SEQ ID NO: 654180 - RNA, 15 nt, Escherichia coli CFT073
accagaauugaccag

SEQ ID NO: 654181 - RNA, 16 nt, Escherichia coli CFT073
accagacaacagucaa

SEQ ID NO: 654182 - RNA, 13 nt, Escherichia coli CFT073
accagagauaaaa

SEQ ID NO: 654183 - RNA, 13 nt, Escherichia coli CFT073
accagagauagcg

SEQ ID NO: 654184 - RNA, 16 nt, Escherichia coli CFT073
accagacgauggcucc

SEQ ID NO: 654185 - RNA, 15 nt, Escherichia coli CFT073
accagacgauuuucc

SEQ ID NO: 654186 - RNA, 17 nt, Escherichia coli CFT073
accagacgcaacagaaa

SEQ ID NO: 654187 - RNA, 21 nt, Escherichia coli CFT073
accagaccggcaaucgcgcca

SEQ ID NO: 654188 - RNA, 18 nt, Escherichia coli CFT073
accagacgccccaguaaa

SEQ ID NO: 654189 - RNA, 21 nt, Escherichia coli CFT073
accagacgcgcguccccugcc

SEQ ID NO: 654190 - RNA, 14 nt, Escherichia coli CFT073
accagacgcgggca

SEQ ID NO: 654191 - RNA, 22 nt, Escherichia coli CFT073
accaaucacacaaccaugcagg

SEQ ID NO: 654192 - RNA, 12 nt, Escherichia coli CFT073
accaaucaccac

SEQ ID NO: 654193 - RNA, 15 nt, Escherichia coli CFT073
accaaguucuucacu

SEQ ID NO: 654194 - RNA, 17 nt, Escherichia coli CFT073
accaaucguccuccgaa

SEQ ID NO: 654195 - RNA, 17 nt, Escherichia coli CFT073
accaaucucccagccgg

SEQ ID NO: 654196 - RNA, 18 nt, Escherichia coli CFT073
accaaucugaaaccagcg

SEQ ID NO: 654197 - RNA, 19 nt, Escherichia coli CFT073
accaaucugaaaccagcgu

SEQ ID NO: 654198 - RNA, 18 nt, Escherichia coli CFT073
accaaucgcgggcaacgu

SEQ ID NO: 654199 - RNA, 14 nt, Escherichia coli CFT073
accaauccagccgg

SEQ ID NO: 654200 - RNA, 20 nt, Escherichia coli CFT073
accaaucagauugaucauca

SEQ ID NO: 654201 - RNA, 13 nt, Escherichia coli CFT073
accaauuuauuuu

SEQ ID NO: 654202 - RNA, 12 nt, Escherichia coli CFT073
accaauuuuaaa

SEQ ID NO: 654203 - RNA, 21 nt, Escherichia coli CFT073
accacauugccgaauggcugc

SEQ ID NO: 654204 - RNA, 15 nt, Escherichia coli CFT073
accacauucagcagc

SEQ ID NO: 654205 - RNA, 12 nt, Escherichia coli CFT073
accacaaaagcg

SEQ ID NO: 654206 - RNA, 14 nt, Escherichia coli CFT073
accacaaaccagcc

SEQ ID NO: 654207 - RNA, 15 nt, Escherichia coli CFT073
accacaaaccagccc

SEQ ID NO: 654208 - RNA, 19 nt, Escherichia coli CFT073
accacauggagcuuuaaac

SEQ ID NO: 654209 - RNA, 22 nt, Escherichia coli CFT073
accacauggagcuuuaaacacg

SEQ ID NO: 654210 - RNA, 16 nt, Escherichia coli CFT073
accaagucucaagagu

SEQ ID NO: 654211 - RNA, 19 nt, Escherichia coli CFT073
accaacugugccgcgacca

SEQ ID NO: 654212 - RNA, 16 nt, Escherichia coli CFT073
accaacuucauacauu

SEQ ID NO: 654213 - RNA, 16 nt, Escherichia coli CFT073
accaacgcuaaauacu

SEQ ID NO: 654214 - RNA, 13 nt, Escherichia coli CFT073
accaacgcagaaa

SEQ ID NO: 654215 - RNA, 14 nt, Escherichia coli CFT073
accaacgucccugg

SEQ ID NO: 654216 - RNA, 20 nt, Escherichia coli CFT073
accaacccaacuuauuguuu

SEQ ID NO: 654217 - RNA, 13 nt, Escherichia coli CFT073
accaaccacugcu

SEQ ID NO: 654218 - RNA, 15 nt, Escherichia coli CFT073
accaaagaaugacac

SEQ ID NO: 654219 - RNA, 21 nt, Escherichia coli CFT073
accaaagaaugacacuuucag

SEQ ID NO: 654220 - RNA, 19 nt, Escherichia coli CFT073
accaaaggugacuggcaga

SEQ ID NO: 654221 - RNA, 19 nt, Escherichia coli CFT073
accaaauaaacgaaucugc

SEQ ID NO: 654222 - RNA, 13 nt, Escherichia coli CFT073
accaaauacacgc

SEQ ID NO: 654223 - RNA, 17 nt, Escherichia coli CFT073
accaaaacagcgacacc

SEQ ID NO: 654224 - RNA, 15 nt, Escherichia coli CFT073
accaaaacgugcagc

SEQ ID NO: 654225 - RNA, 14 nt, Escherichia coli CFT073
accaaacugauuua

SEQ ID NO: 654226 - RNA, 17 nt, Escherichia coli CFT073
accaaacuuauccgcca

SEQ ID NO: 654227 - RNA, 14 nt, Escherichia coli CFT073
acauuucauucacg

SEQ ID NO: 654228 - RNA, 17 nt, Escherichia coli CFT073
acauuucagcuaacaaa

SEQ ID NO: 654229 - RNA, 21 nt, Escherichia coli CFT073
acauuuuuuacucucguucca

SEQ ID NO: 654230 - RNA, 18 nt, Escherichia coli CFT073
acauggcagaccaaacgg

SEQ ID NO: 654231 - RNA, 16 nt, Escherichia coli CFT073
acauggcuaugcguug

SEQ ID NO: 654232 - RNA, 15 nt, Escherichia coli CFT073
acaugguuaaaaucu

SEQ ID NO: 654233 - RNA, 13 nt, Escherichia coli CFT073
acauggucaucau

SEQ ID NO: 654234 - RNA, 19 nt, Escherichia coli CFT073
acauggugaaagcauggca

SEQ ID NO: 654235 - RNA, 20 nt, Escherichia coli CFT073
acauguggauuaaauugcgc

SEQ ID NO: 654236 - RNA, 23 nt, Escherichia coli CFT073
acauguguucccuguaggucgga

SEQ ID NO: 654237 - RNA, 13 nt, Escherichia coli CFT073
acauguccgagcu

SEQ ID NO: 654238 - RNA, 16 nt, Escherichia coli CFT073
acauguccgagcuuaa

SEQ ID NO: 654239 - RNA, 17 nt, Escherichia coli CFT073
acauguccgagcuuaau

SEQ ID NO: 654240 - RNA, 23 nt, Escherichia coli CFT073
acaugucauagcaauaaaugccu

SEQ ID NO: 654241 - RNA, 15 nt, Escherichia coli CFT073
acgauguuugcugcg

SEQ ID NO: 654242 - RNA, 21 nt, Escherichia coli CFT073
acgauuccaacgaaaaugauu

SEQ ID NO: 654243 - RNA, 21 nt, Escherichia coli CFT073
acgauuccggcaaauaacaga

SEQ ID NO: 654244 - RNA, 16 nt, Escherichia coli CFT073
acgauucggcaaucac

SEQ ID NO: 654245 - RNA, 18 nt, Escherichia coli CFT073
acgauucggcaaucacaa

SEQ ID NO: 654246 - RNA, 12 nt, Escherichia coli CFT073
acgauuuucccu

SEQ ID NO: 654247 - RNA, 10 nt, Escherichia coli CFT073
acgcaaagag

SEQ ID NO: 654248 - RNA, 19 nt, Escherichia coli CFT073
acgcaaagagagaagccag

SEQ ID NO: 654249 - RNA, 19 nt, Escherichia coli CFT073
acgauggaaccguauagca

SEQ ID NO: 654250 - RNA, 17 nt, Escherichia coli CFT073
acgauggcaauuuucac

SEQ ID NO: 654251 - RNA, 15 nt, Escherichia coli CFT073
acgaugucaaucagg

SEQ ID NO: 654252 - RNA, 17 nt, Escherichia coli CFT073
acgaugcaaauuuuuaa

SEQ ID NO: 654253 - RNA, 18 nt, Escherichia coli CFT073
acgaugcaaauuuuuaau

SEQ ID NO: 654254 - RNA, 19 nt, Escherichia coli CFT073
acgaucuucggcgucagaa

SEQ ID NO: 654255 - RNA, 16 nt, Escherichia coli CFT073
acgaugaacaugcagc

SEQ ID NO: 654256 - RNA, 16 nt, Escherichia coli CFT073
acgaucgcuuucaacg

SEQ ID NO: 654257 - RNA, 20 nt, Escherichia coli CFT073
acgaucgcgaauaugcuggg

SEQ ID NO: 654258 - RNA, 18 nt, Escherichia coli CFT073
acgauaggucauaucauc

SEQ ID NO: 654259 - RNA, 18 nt, Escherichia coli CFT073
acgauauccauaucuaac

SEQ ID NO: 654260 - RNA, 22 nt, Escherichia coli CFT073
acgauauguucaggauauuuau

SEQ ID NO: 654261 - RNA, 22 nt, Escherichia coli CFT073
acgauaaccgguuacggauuuc

SEQ ID NO: 654262 - RNA, 17 nt, Escherichia coli CFT073
acgauccuggucaggaa

SEQ ID NO: 654263 - RNA, 15 nt, Escherichia coli CFT073
acgagcaucaucuuc

SEQ ID NO: 654264 - RNA, 19 nt, Escherichia coli CFT073
acgagcuucgacuuccugc

SEQ ID NO: 654265 - RNA, 16 nt, Escherichia coli CFT073
acgaguauauucugua

SEQ ID NO: 654266 - RNA, 15 nt, Escherichia coli CFT073
acgaguccuuccugg

SEQ ID NO: 654267 - RNA, 22 nt, Escherichia coli CFT073
acgaacguuccccgcgauggcu

SEQ ID NO: 654268 - RNA, 15 nt, Escherichia coli CFT073
acgaacaauaucgcc

SEQ ID NO: 654269 - RNA, 17 nt, Escherichia coli CFT073
acgaaggccggagcaug

SEQ ID NO: 654270 - RNA, 17 nt, Escherichia coli CFT073
acgacagucaauauuca

SEQ ID NO: 654271 - RNA, 11 nt, Escherichia coli CFT073
acgacaaucuc

SEQ ID NO: 654272 - RNA, 14 nt, Escherichia coli CFT073
acgacacaaugcca

SEQ ID NO: 654273 - RNA, 18 nt, Escherichia coli CFT073
acgaauuuuuuguucagc

SEQ ID NO: 654274 - RNA, 14 nt, Escherichia coli CFT073
acgaauugcagaac

SEQ ID NO: 654275 - RNA, 17 nt, Escherichia coli CFT073
acgaauaccuucuuccu

SEQ ID NO: 654276 - RNA, 13 nt, Escherichia coli CFT073
acgagaaaagcca

SEQ ID NO: 654277 - RNA, 18 nt, Escherichia coli CFT073
acgagagcgggaaaacau

SEQ ID NO: 654278 - RNA, 21 nt, Escherichia coli CFT073
acgacgcugguuacaucaaca

SEQ ID NO: 654279 - RNA, 19 nt, Escherichia coli CFT073
acgacgggauucgaaccug

SEQ ID NO: 654280 - RNA, 21 nt, Escherichia coli CFT073
acgacgguucauuggguucau

SEQ ID NO: 654281 - RNA, 15 nt, Escherichia coli CFT073
acgacgguuuccacc

SEQ ID NO: 654282 - RNA, 21 nt, Escherichia coli CFT073
acgacucauucccauaccuuu

SEQ ID NO: 654283 - RNA, 14 nt, Escherichia coli CFT073
acgaccuuuuccau

SEQ ID NO: 654284 - RNA, 21 nt, Escherichia coli CFT073
acgaccuacacgcccgcgaag

SEQ ID NO: 654285 - RNA, 14 nt, Escherichia coli CFT073
acgaccuugccaag

SEQ ID NO: 654286 - RNA, 18 nt, Escherichia coli CFT073
acgaccggaugcgguuua

SEQ ID NO: 654287 - RNA, 13 nt, Escherichia coli CFT073
acgacccauuacg

SEQ ID NO: 654288 - RNA, 16 nt, Escherichia coli CFT073
acgaccgaucaccaca

SEQ ID NO: 654289 - RNA, 23 nt, Escherichia coli CFT073
acgacccucagcugccagggcac

SEQ ID NO: 654290 - RNA, 17 nt, Escherichia coli CFT073
acgaccgccgcucaccu

SEQ ID NO: 654291 - RNA, 14 nt, Escherichia coli CFT073
acgaccaccuucaa

SEQ ID NO: 654292 - RNA, 18 nt, Escherichia coli CFT073
acgaccagcggcaacauc

SEQ ID NO: 654293 - RNA, 17 nt, Escherichia coli CFT073
acgaccaguucacaccg

SEQ ID NO: 654294 - RNA, 14 nt, Escherichia coli CFT073
acgaccaucaaccu

SEQ ID NO: 654295 - RNA, 14 nt, Escherichia coli CFT073
acgacaugugccag

SEQ ID NO: 654296 - RNA, 12 nt, Escherichia coli CFT073
accuuugccuuc

SEQ ID NO: 654297 - RNA, 13 nt, Escherichia coli CFT073
accuuugaaaaua

SEQ ID NO: 654298 - RNA, 21 nt, Escherichia coli CFT073
accuuugaacagccagaauga

SEQ ID NO: 654299 - RNA, 16 nt, Escherichia coli CFT073
accuuucuccgcgacc

SEQ ID NO: 654300 - RNA, 13 nt, Escherichia coli CFT073
accuuucgguuca

SEQ ID NO: 654301 - RNA, 14 nt, Escherichia coli CFT073
accuuuccccggca

SEQ ID NO: 654302 - RNA, 22 nt, Escherichia coli CFT073
accuuuccccggcagcaucagu

SEQ ID NO: 654303 - RNA, 12 nt, Escherichia coli CFT073
accuuguuuaau

SEQ ID NO: 654304 - RNA, 23 nt, Escherichia coli CFT073
acgaaacaccggugaccaucagc

SEQ ID NO: 654305 - RNA, 14 nt, Escherichia coli CFT073
acgaaacagugccg

SEQ ID NO: 654306 - RNA, 15 nt, Escherichia coli CFT073
acgaaacgaaaccca

SEQ ID NO: 654307 - RNA, 13 nt, Escherichia coli CFT073
accuuuuuugcac

SEQ ID NO: 654308 - RNA, 13 nt, Escherichia coli CFT073
acgaaaucuucca

SEQ ID NO: 654309 - RNA, 17 nt, Escherichia coli CFT073
acgaaagcgcaguaagc

SEQ ID NO: 654310 - RNA, 19 nt, Escherichia coli CFT073
acgaaaguuaauccacagc

SEQ ID NO: 654311 - RNA, 11 nt, Escherichia coli CFT073
accuugccaag

SEQ ID NO: 654312 - RNA, 20 nt, Escherichia coli CFT073
accuugccaaggucgggguc

SEQ ID NO: 654313 - RNA, 20 nt, Escherichia coli CFT073
accuugcgggcaggcaaagu

SEQ ID NO: 654314 - RNA, 16 nt, Escherichia coli CFT073
accuuccagaaaaaga

SEQ ID NO: 654315 - RNA, 21 nt, Escherichia coli CFT073
accuucauagguaaacaucac

SEQ ID NO: 654316 - RNA, 22 nt, Escherichia coli CFT073
accuucauagguaaacaucaca

SEQ ID NO: 654317 - RNA, 16 nt, Escherichia coli CFT073
accuucgcggcacugg

SEQ ID NO: 654318 - RNA, 23 nt, Escherichia coli CFT073
accuucgccagaauauugccauu

SEQ ID NO: 654319 - RNA, 18 nt, Escherichia coli CFT073
accuucuguuauauauua

SEQ ID NO: 654320 - RNA, 20 nt, Escherichia coli CFT073
accuucuguuauauauuacc

SEQ ID NO: 654321 - RNA, 11 nt, Escherichia coli CFT073
accuucuuccu

SEQ ID NO: 654322 - RNA, 20 nt, Escherichia coli CFT073
accuucggugaauuucacuu

SEQ ID NO: 654323 - RNA, 19 nt, Escherichia coli CFT073
accuucugcgcccgcccgc

SEQ ID NO: 654324 - RNA, 22 nt, Escherichia coli CFT073
accuucuccggccuacaaaaca

SEQ ID NO: 654325 - RNA, 20 nt, Escherichia coli CFT073
accuucucucccgcauucca

SEQ ID NO: 654326 - RNA, 18 nt, Escherichia coli CFT073
accuuacauauauuacuc

SEQ ID NO: 654327 - RNA, 21 nt, Escherichia coli CFT073
accuguuuucgauuuuuucca

SEQ ID NO: 654328 - RNA, 17 nt, Escherichia coli CFT073
accuguuuugccaggcu

SEQ ID NO: 654329 - RNA, 15 nt, Escherichia coli CFT073
accuuauccagcaga

SEQ ID NO: 654330 - RNA, 22 nt, Escherichia coli CFT073
accuucaaaauuuaacauuacu

SEQ ID NO: 654331 - RNA, 15 nt, Escherichia coli CFT073
accuucaauacuggc

SEQ ID NO: 654332 - RNA, 17 nt, Escherichia coli CFT073
accuuacuggaguaaau

SEQ ID NO: 654333 - RNA, 22 nt, Escherichia coli CFT073
accuguuaaugcgaaugaaaga

SEQ ID NO: 654334 - RNA, 19 nt, Escherichia coli CFT073
accuguuaauucucccugc

SEQ ID NO: 654335 - RNA, 22 nt, Escherichia coli CFT073
accuguucgcgguuuucuucca

SEQ ID NO: 654336 - RNA, 14 nt, Escherichia coli CFT073
accuguucuucgcu

SEQ ID NO: 654337 - RNA, 20 nt, Escherichia coli CFT073
accugucgcgucaaucacuu

SEQ ID NO: 654338 - RNA, 22 nt, Escherichia coli CFT073
accuguaaguuacuaaaaguaa

SEQ ID NO: 654339 - RNA, 22 nt, Escherichia coli CFT073
accuggagcaguauugauagau

SEQ ID NO: 654340 - RNA, 17 nt, Escherichia coli CFT073
accugcucgucauccgc

SEQ ID NO: 654341 - RNA, 18 nt, Escherichia coli CFT073
accugcucaccagucacu

SEQ ID NO: 654342 - RNA, 23 nt, Escherichia coli CFT073
accugcguugcucaugcaacaca

SEQ ID NO: 654343 - RNA, 17 nt, Escherichia coli CFT073
accuggcgcaguggaua

SEQ ID NO: 654344 - RNA, 14 nt, Escherichia coli CFT073
accuggcgcuucac

SEQ ID NO: 654345 - RNA, 21 nt, Escherichia coli CFT073
accuggcaguggcaaccagcg

SEQ ID NO: 654346 - RNA, 17 nt, Escherichia coli CFT073
accuggccccuggcugg

SEQ ID NO: 654347 - RNA, 17 nt, Escherichia coli CFT073
accuggcgcaaaagaga

SEQ ID NO: 654348 - RNA, 22 nt, Escherichia coli CFT073
accugcacguuagcccuuugua

SEQ ID NO: 654349 - RNA, 19 nt, Escherichia coli CFT073
accugccagggugcaggcg

SEQ ID NO: 654350 - RNA, 22 nt, Escherichia coli CFT073
accugccagggagcgaaaaagc

SEQ ID NO: 654351 - RNA, 19 nt, Escherichia coli CFT073
accugccagcgccgacagu

SEQ ID NO: 654352 - RNA, 16 nt, Escherichia coli CFT073
accugccagaggaucu

SEQ ID NO: 654353 - RNA, 15 nt, Escherichia coli CFT073
accugcccuccggua

SEQ ID NO: 654354 - RNA, 15 nt, Escherichia coli CFT073
accugcgaaaaucag

SEQ ID NO: 654355 - RNA, 13 nt, Escherichia coli CFT073
accugcguucagc

SEQ ID NO: 654356 - RNA, 20 nt, Escherichia coli CFT073
accugcggggaugaauaugu

SEQ ID NO: 654357 - RNA, 19 nt, Escherichia coli CFT073
accugcgcggccagugcca

SEQ ID NO: 654358 - RNA, 20 nt, Escherichia coli CFT073
accugcgcggccagugccag

SEQ ID NO: 654359 - RNA, 16 nt, Escherichia coli CFT073
accugcgccucaguuu

SEQ ID NO: 654360 - RNA, 14 nt, Escherichia coli CFT073
accugcgcuggcag

SEQ ID NO: 654361 - RNA, 17 nt, Escherichia coli CFT073
accucgugcaccgccug

SEQ ID NO: 654362 - RNA, 21 nt, Escherichia coli CFT073
accucgguuaacagcgcacca

SEQ ID NO: 654363 - RNA, 23 nt, Escherichia coli CFT073
accucgguuaacagcgcaccaga

SEQ ID NO: 654364 - RNA, 16 nt, Escherichia coli CFT073
accucgucaccaccuc

SEQ ID NO: 654365 - RNA, 23 nt, Escherichia coli CFT073
accucuucggcagucacuuuuuu

SEQ ID NO: 654366 - RNA, 22 nt, Escherichia coli CFT073
accucuuccagcgauaaugaau

SEQ ID NO: 654367 - RNA, 20 nt, Escherichia coli CFT073
accucuuaaugcaggcagca

SEQ ID NO: 654368 - RNA, 15 nt, Escherichia coli CFT073
accucuucuuuaaaa

SEQ ID NO: 654369 - RNA, 18 nt, Escherichia coli CFT073
accucuucuuuaaaacgc

SEQ ID NO: 654370 - RNA, 15 nt, Escherichia coli CFT073
accucucagaauccc

SEQ ID NO: 654371 - RNA, 19 nt, Escherichia coli CFT073
accucugcaacgucuuccc

SEQ ID NO: 654372 - RNA, 20 nt, Escherichia coli CFT073
accucugcaacgucuucccg

SEQ ID NO: 654373 - RNA, 19 nt, Escherichia coli CFT073
accugauaagacgcgccag

SEQ ID NO: 654374 - RNA, 13 nt, Escherichia coli CFT073
accugacgcugcu

SEQ ID NO: 654375 - RNA, 17 nt, Escherichia coli CFT073
accugacgcugcucagg

SEQ ID NO: 654376 - RNA, 17 nt, Escherichia coli CFT073
accugacgaugcgguuc

SEQ ID NO: 654377 - RNA, 19 nt, Escherichia coli CFT073
accugaaccagaccgccuu

SEQ ID NO: 654378 - RNA, 15 nt, Escherichia coli CFT073
accugaauaugaccc

SEQ ID NO: 654379 - RNA, 16 nt, Escherichia coli CFT073
accugaaucuggcuuc

SEQ ID NO: 654380 - RNA, 13 nt, Escherichia coli CFT073
accuccaguccca

SEQ ID NO: 654381 - RNA, 23 nt, Escherichia coli CFT073
accucccgucgcccacaccagau

SEQ ID NO: 654382 - RNA, 22 nt, Escherichia coli CFT073
accuccgcuaaauccgccgcca

SEQ ID NO: 654383 - RNA, 21 nt, Escherichia coli CFT073
accucaucaccacagacaaac

SEQ ID NO: 654384 - RNA, 22 nt, Escherichia coli CFT073
accucaucaccacagacaaaca

SEQ ID NO: 654385 - RNA, 19 nt, Escherichia coli CFT073
accucaggaaaagcaaaau

SEQ ID NO: 654386 - RNA, 20 nt, Escherichia coli CFT073
accucagguucaaccgcagc

SEQ ID NO: 654387 - RNA, 23 nt, Escherichia coli CFT073
accucaguacccgcguucuggau

SEQ ID NO: 654388 - RNA, 14 nt, Escherichia coli CFT073
accucaggaaaagc

SEQ ID NO: 654389 - RNA, 15 nt, Escherichia coli CFT073
accucaggaaaagca

SEQ ID NO: 654390 - RNA, 14 nt, Escherichia coli CFT073
accucaaaaugagu

SEQ ID NO: 654391 - RNA, 16 nt, Escherichia coli CFT073
accucaaaaugaguca

SEQ ID NO: 654392 - RNA, 20 nt, Escherichia coli CFT073
accucaauggcagcaucacg

SEQ ID NO: 654393 - RNA, 15 nt, Escherichia coli CFT073
accucacccgccggu

SEQ ID NO: 654394 - RNA, 17 nt, Escherichia coli CFT073
accuauuucauucaggc

SEQ ID NO: 654395 - RNA, 14 nt, Escherichia coli CFT073
accucaaaaagaaa

SEQ ID NO: 654396 - RNA, 19 nt, Escherichia coli CFT073
accucaaaaccaacgggga

SEQ ID NO: 654397 - RNA, 19 nt, Escherichia coli CFT073
accuaucgcgucgccgguc

SEQ ID NO: 654398 - RNA, 16 nt, Escherichia coli CFT073
accuauuuaaauccua

SEQ ID NO: 654399 - RNA, 16 nt, Escherichia coli CFT073
accgucagccagcacu

SEQ ID NO: 654400 - RNA, 17 nt, Escherichia coli CFT073
accgucagccagcacug

SEQ ID NO: 654401 - RNA, 13 nt, Escherichia coli CFT073
accgucacuucuu

SEQ ID NO: 654402 - RNA, 23 nt, Escherichia coli CFT073
accgucacguugcgacaaaccag

SEQ ID NO: 654403 - RNA, 16 nt, Escherichia coli CFT073
accgucacaucaauua

SEQ ID NO: 654404 - RNA, 14 nt, Escherichia coli CFT073
accgucaccagucc

SEQ ID NO: 654405 - RNA, 19 nt, Escherichia coli CFT073
accguaugauguauauuuc

SEQ ID NO: 654406 - RNA, 15 nt, Escherichia coli CFT073
accgucaaauccaga

SEQ ID NO: 654407 - RNA, 14 nt, Escherichia coli CFT073
accgucaauaaaaa

SEQ ID NO: 654408 - RNA, 20 nt, Escherichia coli CFT073
accguagaaggcgacaaagc

SEQ ID NO: 654409 - RNA, 21 nt, Escherichia coli CFT073
accguagaggugauaugaaug

SEQ ID NO: 654410 - RNA, 18 nt, Escherichia coli CFT073
accguagcguaaaucauc

SEQ ID NO: 654411 - RNA, 17 nt, Escherichia coli CFT073
accgugcuucagccaaa

SEQ ID NO: 654412 - RNA, 23 nt, Escherichia coli CFT073
accgucuggcagauccugaaauu

SEQ ID NO: 654413 - RNA, 19 nt, Escherichia coli CFT073
accgucuucccgcagccac

SEQ ID NO: 654414 - RNA, 20 nt, Escherichia coli CFT073
accgucuuuauccagcacca

SEQ ID NO: 654415 - RNA, 14 nt, Escherichia coli CFT073
accgugaaagagau

SEQ ID NO: 654416 - RNA, 22 nt, Escherichia coli CFT073
accgucuuugcugauacuccau

SEQ ID NO: 654417 - RNA, 15 nt, Escherichia coli CFT073
accgugagcaaugca

SEQ ID NO: 654418 - RNA, 21 nt, Escherichia coli CFT073
accuacagccacaccuucuug

SEQ ID NO: 654419 - RNA, 14 nt, Escherichia coli CFT073
accuaccugcucaa

SEQ ID NO: 654420 - RNA, 14 nt, Escherichia coli CFT073
accuacgacuuugc

SEQ ID NO: 654421 - RNA, 21 nt, Escherichia coli CFT073
accuagcaaacuaucugugua

SEQ ID NO: 654422 - RNA, 19 nt, Escherichia coli CFT073
accguuucguggaaaacac

SEQ ID NO: 654423 - RNA, 18 nt, Escherichia coli CFT073
accguugcggcuccagac

SEQ ID NO: 654424 - RNA, 17 nt, Escherichia coli CFT073
accguucgccccauaca

SEQ ID NO: 654425 - RNA, 13 nt, Escherichia coli CFT073
accuaacagcauc

SEQ ID NO: 654426 - RNA, 14 nt, Escherichia coli CFT073
accuaacaguucac

SEQ ID NO: 654427 - RNA, 18 nt, Escherichia coli CFT073
accuaacaguucacccgg

SEQ ID NO: 654428 - RNA, 23 nt, Escherichia coli CFT073
accuaacuccugcgucggaacau

SEQ ID NO: 654429 - RNA, 15 nt, Escherichia coli CFT073
accuaagaaccagaa

SEQ ID NO: 654430 - RNA, 18 nt, Escherichia coli CFT073
accgguacggauacgaau

SEQ ID NO: 654431 - RNA, 12 nt, Escherichia coli CFT073
accgguaugacg

SEQ ID NO: 654432 - RNA, 19 nt, Escherichia coli CFT073
accggugaccaucagcaug

SEQ ID NO: 654433 - RNA, 23 nt, Escherichia coli CFT073
accgguuccgggcuguuuuccag

SEQ ID NO: 654434 - RNA, 22 nt, Escherichia coli CFT073
accgguucggacauguuuucca

SEQ ID NO: 654435 - RNA, 19 nt, Escherichia coli CFT073
accgguugucgugguuggu

SEQ ID NO: 654436 - RNA, 16 nt, Escherichia coli CFT073
accgguuucaauccag

SEQ ID NO: 654437 - RNA, 17 nt, Escherichia coli CFT073
accgguuucaauccagg

SEQ ID NO: 654438 - RNA, 15 nt, Escherichia coli CFT073
accguaaagcacugg

SEQ ID NO: 654439 - RNA, 12 nt, Escherichia coli CFT073
accguaaaaaua

SEQ ID NO: 654440 - RNA, 15 nt, Escherichia coli CFT073
accguaaacuuuagc

SEQ ID NO: 654441 - RNA, 18 nt, Escherichia coli CFT073
accguaaacccuaacauc

SEQ ID NO: 654442 - RNA, 14 nt, Escherichia coli CFT073
accguaacgaacac

SEQ ID NO: 654443 - RNA, 23 nt, Escherichia coli CFT073
accguaaguaagauaaaagcaau

SEQ ID NO: 654444 - RNA, 18 nt, Escherichia coli CFT073
accguacauugccgggcg

SEQ ID NO: 654445 - RNA, 18 nt, Escherichia coli CFT073
accggcuuucgcuucaac

SEQ ID NO: 654446 - RNA, 13 nt, Escherichia coli CFT073
accggguuuucaa

SEQ ID NO: 654447 - RNA, 17 nt, Escherichia coli CFT073
accggguuuucaaugau

SEQ ID NO: 654448 - RNA, 21 nt, Escherichia coli CFT073
accggguuuucaaugauaaag

SEQ ID NO: 654449 - RNA, 16 nt, Escherichia coli CFT073
accggggcauucauga

SEQ ID NO: 654450 - RNA, 18 nt, Escherichia coli CFT073
accggcauuuuuugcugc

SEQ ID NO: 654451 - RNA, 14 nt, Escherichia coli CFT073
accggcaagaauga

SEQ ID NO: 654452 - RNA, 16 nt, Escherichia coli CFT073
accggcaaucgcgcca

SEQ ID NO: 654453 - RNA, 16 nt, Escherichia coli CFT073
accggcaauaauuaac

SEQ ID NO: 654454 - RNA, 13 nt, Escherichia coli CFT073
accggcaaugguu

SEQ ID NO: 654455 - RNA, 15 nt, Escherichia coli CFT073
accggcaaugguuuc

SEQ ID NO: 654456 - RNA, 16 nt, Escherichia coli CFT073
accggcaaacuucguc

SEQ ID NO: 654457 - RNA, 18 nt, Escherichia coli CFT073
accggauuuucaccaucg

SEQ ID NO: 654458 - RNA, 16 nt, Escherichia coli CFT073
accggcaaccagcacc

SEQ ID NO: 654459 - RNA, 17 nt, Escherichia coli CFT073
accgcuguuaugcacac

SEQ ID NO: 654460 - RNA, 17 nt, Escherichia coli CFT073
accgcuguugccagcag

SEQ ID NO: 654461 - RNA, 23 nt, Escherichia coli CFT073
accgcuguugcuuccaccaucac

SEQ ID NO: 654462 - RNA, 16 nt, Escherichia coli CFT073
accgcuucaggaacug

SEQ ID NO: 654463 - RNA, 14 nt, Escherichia coli CFT073
accggcguuacgaa

SEQ ID NO: 654464 - RNA, 18 nt, Escherichia coli CFT073
accggcguaacggccacg

SEQ ID NO: 654465 - RNA, 16 nt, Escherichia coli CFT073
accgccuggcgcugcu

SEQ ID NO: 654466 - RNA, 16 nt, Escherichia coli CFT073
accgccugaagaacca

SEQ ID NO: 654467 - RNA, 20 nt, Escherichia coli CFT073
accgccugcauaaaggcaaa

SEQ ID NO: 654468 - RNA, 14 nt, Escherichia coli CFT073
accgccugcggaga

SEQ ID NO: 654469 - RNA, 18 nt, Escherichia coli CFT073
accgccggcuucaucuuu

SEQ ID NO: 654470 - RNA, 20 nt, Escherichia coli CFT073
accgccguacgucagcgccu

SEQ ID NO: 654471 - RNA, 20 nt, Escherichia coli CFT073
accgccgucguaacaggaaa

SEQ ID NO: 654472 - RNA, 16 nt, Escherichia coli CFT073
accgcccaccauaauc

SEQ ID NO: 654473 - RNA, 14 nt, Escherichia coli CFT073
accgcccacuacca

SEQ ID NO: 654474 - RNA, 19 nt, Escherichia coli CFT073
accgccauuaaacgcagua

SEQ ID NO: 654475 - RNA, 18 nt, Escherichia coli CFT073
accgcugucgaucagaga

SEQ ID NO: 654476 - RNA, 23 nt, Escherichia coli CFT073
accgcugcugccguuccuggcac

SEQ ID NO: 654477 - RNA, 13 nt, Escherichia coli CFT073
accgcugcuggcg

SEQ ID NO: 654478 - RNA, 21 nt, Escherichia coli CFT073
accgcucuucauacguggcag

SEQ ID NO: 654479 - RNA, 15 nt, Escherichia coli CFT073
accgcugauugcugg

SEQ ID NO: 654480 - RNA, 14 nt, Escherichia coli CFT073
accgcugccaggca

SEQ ID NO: 654481 - RNA, 16 nt, Escherichia coli CFT073
accgccaaagauaaaa

SEQ ID NO: 654482 - RNA, 20 nt, Escherichia coli CFT073
accgccaauuaauugugcuc

SEQ ID NO: 654483 - RNA, 22 nt, Escherichia coli CFT073
accgccaauuaauugugcuccu

SEQ ID NO: 654484 - RNA, 16 nt, Escherichia coli CFT073
accgccacagcagccu

SEQ ID NO: 654485 - RNA, 17 nt, Escherichia coli CFT073
accgccagucacugcca

SEQ ID NO: 654486 - RNA, 18 nt, Escherichia coli CFT073
accgcacaccgagauaau

SEQ ID NO: 654487 - RNA, 13 nt, Escherichia coli CFT073
accgcaccaccag

SEQ ID NO: 654488 - RNA, 17 nt, Escherichia coli CFT073
accgcacucagccagcc

SEQ ID NO: 654489 - RNA, 13 nt, Escherichia coli CFT073
accgcaucggcau

SEQ ID NO: 654490 - RNA, 16 nt, Escherichia coli CFT073
accgcacugguggcag

SEQ ID NO: 654491 - RNA, 16 nt, Escherichia coli CFT073
accccguugcuucgcc

SEQ ID NO: 654492 - RNA, 22 nt, Escherichia coli CFT073
accccgagcgaauaaaccacac

SEQ ID NO: 654493 - RNA, 16 nt, Escherichia coli CFT073
accccgccagcagaau

SEQ ID NO: 654494 - RNA, 17 nt, Escherichia coli CFT073
accccgccagcagaaug

SEQ ID NO: 654495 - RNA, 17 nt, Escherichia coli CFT073
accgaucgccagcaggg

SEQ ID NO: 654496 - RNA, 18 nt, Escherichia coli CFT073
accgaugcccucaauauc

SEQ ID NO: 654497 - RNA, 18 nt, Escherichia coli CFT073
accgaugccgugcggcug

SEQ ID NO: 654498 - RNA, 12 nt, Escherichia coli CFT073
accccugcggcc

SEQ ID NO: 654499 - RNA, 16 nt, Escherichia coli CFT073
accgaucgccagcagg

SEQ ID NO: 654500 - RNA, 14 nt, Escherichia coli CFT073
agaaagggaagaac

SEQ ID NO: 654501 - RNA, 16 nt, Escherichia coli CFT073
agaaaguaaucuauau

SEQ ID NO: 654502 - RNA, 18 nt, Escherichia coli CFT073
agaaaguaauuacgcccu

SEQ ID NO: 654503 - RNA, 22 nt, Escherichia coli CFT073
agaaaggcgggaauaauuuccc

SEQ ID NO: 654504 - RNA, 17 nt, Escherichia coli CFT073
agaaaggcguuguccuu

SEQ ID NO: 654505 - RNA, 16 nt, Escherichia coli CFT073
agaaagcgccagcaag

SEQ ID NO: 654506 - RNA, 17 nt, Escherichia coli CFT073
agaaacuccgguuauua

SEQ ID NO: 654507 - RNA, 23 nt, Escherichia coli CFT073
agaaacucuauccacauuaguca

SEQ ID NO: 654508 - RNA, 15 nt, Escherichia coli CFT073
agaaacgccagcagc

SEQ ID NO: 654509 - RNA, 24 nt, Escherichia coli CFT073
agaaacgccugaucgagcaguaau

SEQ ID NO: 654510 - RNA, 17 nt, Escherichia coli CFT073
agaaacgcucauaaauu

SEQ ID NO: 654511 - RNA, 16 nt, Escherichia coli CFT073
agaaaauguauuucau

SEQ ID NO: 654512 - RNA, 17 nt, Escherichia coli CFT073
agaaaauuauuuuaaau

SEQ ID NO: 654513 - RNA, 12 nt, Escherichia coli CFT073
agaaaaaucucc

SEQ ID NO: 654514 - RNA, 13 nt, Escherichia coli CFT073
agaaaaauucaac

SEQ ID NO: 654515 - RNA, 12 nt, Escherichia coli CFT073
agaaaauccagc

SEQ ID NO: 654516 - RNA, 14 nt, Escherichia coli CFT073
agaaaauccgccaa

SEQ ID NO: 654517 - RNA, 21 nt, Escherichia coli CFT073
acuuuuuauccgguaaugcca

SEQ ID NO: 654518 - RNA, 15 nt, Escherichia coli CFT073
acuuuuuaacuuuaa

SEQ ID NO: 654519 - RNA, 14 nt, Escherichia coli CFT073
acuuuuguauuuua

SEQ ID NO: 654520 - RNA, 22 nt, Escherichia coli CFT073
acuuuuuccaguccacguucaa

SEQ ID NO: 654521 - RNA, 18 nt, Escherichia coli CFT073
acuucgccacagcggcau

SEQ ID NO: 654522 - RNA, 22 nt, Escherichia coli CFT073
acuucgccagcgugacuauuaa

SEQ ID NO: 654523 - RNA, 23 nt, Escherichia coli CFT073
acuucgcauuuugcagcuguugc

SEQ ID NO: 654524 - RNA, 18 nt, Escherichia coli CFT073
acuucgauguccgcucca

SEQ ID NO: 654525 - RNA, 17 nt, Escherichia coli CFT073
acuucgaguacauccac

SEQ ID NO: 654526 - RNA, 20 nt, Escherichia coli CFT073
acuuccugcaaucuuuccug

SEQ ID NO: 654527 - RNA, 15 nt, Escherichia coli CFT073
acuuccugcggagca

SEQ ID NO: 654528 - RNA, 21 nt, Escherichia coli CFT073
acuuccugcggagcaaccugc

SEQ ID NO: 654529 - RNA, 13 nt, Escherichia coli CFT073
acuuccugcucgg

SEQ ID NO: 654530 - RNA, 15 nt, Escherichia coli CFT073
acuuccugucuuccc

SEQ ID NO: 654531 - RNA, 21 nt, Escherichia coli CFT073
acuucgccggaauuucuuuca

SEQ ID NO: 654532 - RNA, 17 nt, Escherichia coli CFT073
acuucgcucuuaucacc

SEQ ID NO: 654533 - RNA, 15 nt, Escherichia coli CFT073
acuuuugcccggcau

SEQ ID NO: 654534 - RNA, 12 nt, Escherichia coli CFT073
acuuuugauugu

SEQ ID NO: 654535 - RNA, 13 nt, Escherichia coli CFT073
agaacgcugcaau

SEQ ID NO: 654536 - RNA, 23 nt, Escherichia coli CFT073
agaacgcagcauuuccucaacau

SEQ ID NO: 654537 - RNA, 19 nt, Escherichia coli CFT073
agaacgacccucagcugcc

SEQ ID NO: 654538 - RNA, 13 nt, Escherichia coli CFT073
agaaccgccaccu

SEQ ID NO: 654539 - RNA, 15 nt, Escherichia coli CFT073
agaaccggagucagu

SEQ ID NO: 654540 - RNA, 20 nt, Escherichia coli CFT073
agaaccggagucagucccug

SEQ ID NO: 654541 - RNA, 22 nt, Escherichia coli CFT073
agaaccgccgcugucugaauga

SEQ ID NO: 654542 - RNA, 16 nt, Escherichia coli CFT073
agaaccguaaacagau

SEQ ID NO: 654543 - RNA, 16 nt, Escherichia coli CFT073
agaacccggcaauggu

SEQ ID NO: 654544 - RNA, 17 nt, Escherichia coli CFT073
agaacccggcaaugguc

SEQ ID NO: 654545 - RNA, 13 nt, Escherichia coli CFT073
agaaccccagcca

SEQ ID NO: 654546 - RNA, 16 nt, Escherichia coli CFT073
agaacccuuucaccaa

SEQ ID NO: 654547 - RNA, 15 nt, Escherichia coli CFT073
agaaccuaagaacca

SEQ ID NO: 654548 - RNA, 14 nt, Escherichia coli CFT073
agaacguccgcagg

SEQ ID NO: 654549 - RNA, 20 nt, Escherichia coli CFT073
agaacguacacagcccgaca

SEQ ID NO: 654550 - RNA, 16 nt, Escherichia coli CFT073
agaacggcuuucauau

SEQ ID NO: 654551 - RNA, 20 nt, Escherichia coli CFT073
agaacuaguagcaugaagua

SEQ ID NO: 654552 - RNA, 18 nt, Escherichia coli CFT073
agaacugcggcagguuga

SEQ ID NO: 654553 - RNA, 14 nt, Escherichia coli CFT073
agaacucggaagca

SEQ ID NO: 654554 - RNA, 13 nt, Escherichia coli CFT073
agaacuccuggcg

SEQ ID NO: 654555 - RNA, 18 nt, Escherichia coli CFT073
agaacuccugaaagcgaa

SEQ ID NO: 654556 - RNA, 12 nt, Escherichia coli CFT073
agaacucaucuu

SEQ ID NO: 654557 - RNA, 21 nt, Escherichia coli CFT073
agaaccagggaaaaaagcccc

SEQ ID NO: 654558 - RNA, 16 nt, Escherichia coli CFT073
agaacaucauccccac

SEQ ID NO: 654559 - RNA, 16 nt, Escherichia coli CFT073
agaacaugucauagca

SEQ ID NO: 654560 - RNA, 22 nt, Escherichia coli CFT073
agaaccaaaguuugcaaaccca

SEQ ID NO: 654561 - RNA, 11 nt, Escherichia coli CFT073
agaacaggcgc

SEQ ID NO: 654562 - RNA, 16 nt, Escherichia coli CFT073
agaacauaauguaaac

SEQ ID NO: 654563 - RNA, 22 nt, Escherichia coli CFT073
agaacaguucagcaacacuaca

SEQ ID NO: 654564 - RNA, 21 nt, Escherichia coli CFT073
agaacacgcucccagcaguga

SEQ ID NO: 654565 - RNA, 16 nt, Escherichia coli CFT073
agaacacgcucccagc

SEQ ID NO: 654566 - RNA, 19 nt, Escherichia coli CFT073
agaacaccugucuucggua

SEQ ID NO: 654567 - RNA, 17 nt, Escherichia coli CFT073
agaacacgaccugccag

SEQ ID NO: 654568 - RNA, 19 nt, Escherichia coli CFT073
agaacacuguuaccgcugc

SEQ ID NO: 654569 - RNA, 17 nt, Escherichia coli CFT073
agaacaaccaagacuau

SEQ ID NO: 654570 - RNA, 16 nt, Escherichia coli CFT073
agaaagucguaggccu

SEQ ID NO: 654571 - RNA, 23 nt, Escherichia coli CFT073
agaaagucgagugaacccccuga

SEQ ID NO: 654572 - RNA, 18 nt, Escherichia coli CFT073
agaaauuucggauauuuu

SEQ ID NO: 654573 - RNA, 21 nt, Escherichia coli CFT073
agacacgccgccagaccaaua

SEQ ID NO: 654574 - RNA, 21 nt, Escherichia coli CFT073
agacaguugauggaaaauugu

SEQ ID NO: 654575 - RNA, 21 nt, Escherichia coli CFT073
agacauacuggcuucgauacc

SEQ ID NO: 654576 - RNA, 15 nt, Escherichia coli CFT073
agacauagcacauaa

SEQ ID NO: 654577 - RNA, 21 nt, Escherichia coli CFT073
agacauagggaaacuccagcc

SEQ ID NO: 654578 - RNA, 15 nt, Escherichia coli CFT073
agacagaccuggcgc

SEQ ID NO: 654579 - RNA, 15 nt, Escherichia coli CFT073
agacagacagccuca

SEQ ID NO: 654580 - RNA, 13 nt, Escherichia coli CFT073
agacacuggaaac

SEQ ID NO: 654581 - RNA, 19 nt, Escherichia coli CFT073
agacacuggaaacagccaa

SEQ ID NO: 654582 - RNA, 20 nt, Escherichia coli CFT073
agacacuggaaacagccaau

SEQ ID NO: 654583 - RNA, 20 nt, Escherichia coli CFT073
agaccaggaugcuucaacga

SEQ ID NO: 654584 - RNA, 23 nt, Escherichia coli CFT073
agaccagacuuggucgguauuuc

SEQ ID NO: 654585 - RNA, 20 nt, Escherichia coli CFT073
agaccagcaaagugcgcuuu

SEQ ID NO: 654586 - RNA, 17 nt, Escherichia coli CFT073
agaccagcaauaaaaaa

SEQ ID NO: 654587 - RNA, 19 nt, Escherichia coli CFT073
agaccagcaauaaaaaacc

SEQ ID NO: 654588 - RNA, 21 nt, Escherichia coli CFT073
agaccacucauuuuuucgguu

SEQ ID NO: 654589 - RNA, 15 nt, Escherichia coli CFT073
agaccacucucuggc

SEQ ID NO: 654590 - RNA, 17 nt, Escherichia coli CFT073
agaccacucauuuuuuc

SEQ ID NO: 654591 - RNA, 20 nt, Escherichia coli CFT073
agaccacccaagcgggaaua

SEQ ID NO: 654592 - RNA, 11 nt, Escherichia coli CFT073
agacaaggcga

SEQ ID NO: 654593 - RNA, 13 nt, Escherichia coli CFT073
agacaauacuugc

SEQ ID NO: 654594 - RNA, 14 nt, Escherichia coli CFT073
agacaaucugugug

SEQ ID NO: 654595 - RNA, 17 nt, Escherichia coli CFT073
agaauucuauuuugcca

SEQ ID NO: 654596 - RNA, 15 nt, Escherichia coli CFT073
agaauugaccaguaa

SEQ ID NO: 654597 - RNA, 17 nt, Escherichia coli CFT073
agaccuggcgcuucacu

SEQ ID NO: 654598 - RNA, 20 nt, Escherichia coli CFT073
agaccuaacuuggcaaagcu

SEQ ID NO: 654599 - RNA, 18 nt, Escherichia coli CFT073
agaccguugcucagaauc

SEQ ID NO: 654600 - RNA, 22 nt, Escherichia coli CFT073
agaccugaauuugcuccagaaa

SEQ ID NO: 654601 - RNA, 13 nt, Escherichia coli CFT073
agaccucaucguu

SEQ ID NO: 654602 - RNA, 16 nt, Escherichia coli CFT073
agaccguugcucagaa

SEQ ID NO: 654603 - RNA, 17 nt, Escherichia coli CFT073
agacggugccagguaau

SEQ ID NO: 654604 - RNA, 14 nt, Escherichia coli CFT073
agacguagaaaauc

SEQ ID NO: 654605 - RNA, 18 nt, Escherichia coli CFT073
agacguccggcgcugcaa

SEQ ID NO: 654606 - RNA, 20 nt, Escherichia coli CFT073
agacgugcacgcagcaaacg

SEQ ID NO: 654607 - RNA, 15 nt, Escherichia coli CFT073
agacguucuuccugu

SEQ ID NO: 654608 - RNA, 22 nt, Escherichia coli CFT073
agacguuuguaacccaccaugc

SEQ ID NO: 654609 - RNA, 20 nt, Escherichia coli CFT073
agacggcugucauccagcag

SEQ ID NO: 654610 - RNA, 18 nt, Escherichia coli CFT073
agacggcgcuuacucaug

SEQ ID NO: 654611 - RNA, 17 nt, Escherichia coli CFT073
agacggcggaaagggcc

SEQ ID NO: 654612 - RNA, 14 nt, Escherichia coli CFT073
agacggcgcaacau

SEQ ID NO: 654613 - RNA, 16 nt, Escherichia coli CFT073
agacgcaucgcccagc

SEQ ID NO: 654614 - RNA, 23 nt, Escherichia coli CFT073
agacgaugaaugcaacugcccag

SEQ ID NO: 654615 - RNA, 20 nt, Escherichia coli CFT073
agacgauggcuccggaagcu

SEQ ID NO: 654616 - RNA, 17 nt, Escherichia coli CFT073
agacgcacccucaaaau

SEQ ID NO: 654617 - RNA, 18 nt, Escherichia coli CFT073
agaaucuaagaucccugc

SEQ ID NO: 654618 - RNA, 16 nt, Escherichia coli CFT073
agaaucgacaccaguu

SEQ ID NO: 654619 - RNA, 18 nt, Escherichia coli CFT073
agaauccccggcaggaag

SEQ ID NO: 654620 - RNA, 20 nt, Escherichia coli CFT073
agaauauguuuuuaaaccaa

SEQ ID NO: 654621 - RNA, 14 nt, Escherichia coli CFT073
agaauacgccccag

SEQ ID NO: 654622 - RNA, 17 nt, Escherichia coli CFT073
agaauacuucacaugau

SEQ ID NO: 654623 - RNA, 20 nt, Escherichia coli CFT073
agaauacuucacaugauaau

SEQ ID NO: 654624 - RNA, 14 nt, Escherichia coli CFT073
agaauauugccauu

SEQ ID NO: 654625 - RNA, 19 nt, Escherichia coli CFT073
agaauauugccgaagacca

SEQ ID NO: 654626 - RNA, 15 nt, Escherichia coli CFT073
agaauggcuguaggg

SEQ ID NO: 654627 - RNA, 11 nt, Escherichia coli CFT073
agaauguagau

SEQ ID NO: 654628 - RNA, 15 nt, Escherichia coli CFT073
agaaugguuucgcuu

SEQ ID NO: 654629 - RNA, 19 nt, Escherichia coli CFT073
agaaugaaauucgagagaa

SEQ ID NO: 654630 - RNA, 14 nt, Escherichia coli CFT073
agaaugaaguaaac

SEQ ID NO: 654631 - RNA, 20 nt, Escherichia coli CFT073
agaaugaaugauacagaaag

SEQ ID NO: 654632 - RNA, 21 nt, Escherichia coli CFT073
agaaugcgcgcgaaaacaucg

SEQ ID NO: 654633 - RNA, 20 nt, Escherichia coli CFT073
agaaugcuccccagaccaau

SEQ ID NO: 654634 - RNA, 17 nt, Escherichia coli CFT073
agaaugcucgcuggcag

SEQ ID NO: 654635 - RNA, 23 nt, Escherichia coli CFT073
agaagcugcugccgcuguugcgu

SEQ ID NO: 654636 - RNA, 18 nt, Escherichia coli CFT073
agaagcuugcuucuuugc

SEQ ID NO: 654637 - RNA, 18 nt, Escherichia coli CFT073
agaagguauacugcaaau

SEQ ID NO: 654638 - RNA, 16 nt, Escherichia coli CFT073
agaagcauccugcacu

SEQ ID NO: 654639 - RNA, 14 nt, Escherichia coli CFT073
agaagccaccgcac

SEQ ID NO: 654640 - RNA, 17 nt, Escherichia coli CFT073
agaagcauaaccgagca

SEQ ID NO: 654641 - RNA, 20 nt, Escherichia coli CFT073
agaagaaaaaaugcugcaau

SEQ ID NO: 654642 - RNA, 14 nt, Escherichia coli CFT073
agaacugugccaga

SEQ ID NO: 654643 - RNA, 22 nt, Escherichia coli CFT073
agaugucggcaaucgcaaucau

SEQ ID NO: 654644 - RNA, 14 nt, Escherichia coli CFT073
agaugucuuuaccc

SEQ ID NO: 654645 - RNA, 13 nt, Escherichia coli CFT073
agauguuuugccu

SEQ ID NO: 654646 - RNA, 18 nt, Escherichia coli CFT073
agauguugcugcucuuga

SEQ ID NO: 654647 - RNA, 16 nt, Escherichia coli CFT073
agauuaccagagaaaa

SEQ ID NO: 654648 - RNA, 17 nt, Escherichia coli CFT073
agauuaccagagaaaag

SEQ ID NO: 654649 - RNA, 22 nt, Escherichia coli CFT073
agauuaaguguagucagcaauu

SEQ ID NO: 654650 - RNA, 17 nt, Escherichia coli CFT073
agauggacgcagaccga

SEQ ID NO: 654651 - RNA, 19 nt, Escherichia coli CFT073
agauggcuuugcccuuucu

SEQ ID NO: 654652 - RNA, 23 nt, Escherichia coli CFT073
agaugcgcguaguacuuuaacuc

SEQ ID NO: 654653 - RNA, 16 nt, Escherichia coli CFT073
agaugcuguaccaggu

SEQ ID NO: 654654 - RNA, 18 nt, Escherichia coli CFT073
agaugcugugccuccugc

SEQ ID NO: 654655 - RNA, 19 nt, Escherichia coli CFT073
agaugcugugccuccugcg

SEQ ID NO: 654656 - RNA, 19 nt, Escherichia coli CFT073
agauugcguaacgugacau

SEQ ID NO: 654657 - RNA, 21 nt, Escherichia coli CFT073
agauuggcuucacugauuaac

SEQ ID NO: 654658 - RNA, 13 nt, Escherichia coli CFT073
agauugcugacaa

SEQ ID NO: 654659 - RNA, 15 nt, Escherichia coli CFT073
agauugcugcugaua

SEQ ID NO: 654660 - RNA, 19 nt, Escherichia coli CFT073
agauucguauuuaaaaccg

SEQ ID NO: 654661 - RNA, 15 nt, Escherichia coli CFT073
agauucuccaccugc

SEQ ID NO: 654662 - RNA, 17 nt, Escherichia coli CFT073
agauucggcgcaaugau

SEQ ID NO: 654663 - RNA, 14 nt, Escherichia coli CFT073
agauucgauaacau

SEQ ID NO: 654664 - RNA, 14 nt, Escherichia coli CFT073
agauucgauagaga

SEQ ID NO: 654665 - RNA, 23 nt, Escherichia coli CFT073
agauuagccgguaaaucaccauc

SEQ ID NO: 654666 - RNA, 23 nt, Escherichia coli CFT073
agauuaguaaugcguaacguuuc

SEQ ID NO: 654667 - RNA, 17 nt, Escherichia coli CFT073
agauuaugaaauucagu

SEQ ID NO: 654668 - RNA, 16 nt, Escherichia coli CFT073
agauuauucaaaaaca

SEQ ID NO: 654669 - RNA, 19 nt, Escherichia coli CFT073
agauuauucaaaaacagau

SEQ ID NO: 654670 - RNA, 16 nt, Escherichia coli CFT073
agauucagcgucgcca

SEQ ID NO: 654671 - RNA, 16 nt, Escherichia coli CFT073
agaugcaggaguagaa

SEQ ID NO: 654672 - RNA, 19 nt, Escherichia coli CFT073
agaugcgacggcaccacau

SEQ ID NO: 654673 - RNA, 22 nt, Escherichia coli CFT073
agaugcgacguuacaaccacau

SEQ ID NO: 654674 - RNA, 13 nt, Escherichia coli CFT073
agaugauaacccc

SEQ ID NO: 654675 - RNA, 23 nt, Escherichia coli CFT073
agaugacucgccgcaaaacccag

SEQ ID NO: 654676 - RNA, 17 nt, Escherichia coli CFT073
agaugacgaucagggcg

SEQ ID NO: 654677 - RNA, 15 nt, Escherichia coli CFT073
agaucuuccagcggc

SEQ ID NO: 654678 - RNA, 23 nt, Escherichia coli CFT073
agaugaaauaguugcauuccagu

SEQ ID NO: 654679 - RNA, 16 nt, Escherichia coli CFT073
agaucuuucacgccca

SEQ ID NO: 654680 - RNA, 16 nt, Escherichia coli CFT073
agaucgugcagcaccg

SEQ ID NO: 654681 - RNA, 18 nt, Escherichia coli CFT073
agaucguuaagcacagcg

SEQ ID NO: 654682 - RNA, 18 nt, Escherichia coli CFT073
agaucgcuucaauaccac

SEQ ID NO: 654683 - RNA, 19 nt, Escherichia coli CFT073
agaucgcccuuuuuugcuu

SEQ ID NO: 654684 - RNA, 20 nt, Escherichia coli CFT073
agaucgcgaugagucgccgc

SEQ ID NO: 654685 - RNA, 13 nt, Escherichia coli CFT073
agaucgcggccua

SEQ ID NO: 654686 - RNA, 22 nt, Escherichia coli CFT073
agaucgaaaucuuuuuacugcc

SEQ ID NO: 654687 - RNA, 17 nt, Escherichia coli CFT073
agauccaugaagcaaug

SEQ ID NO: 654688 - RNA, 20 nt, Escherichia coli CFT073
agauccagugcucauccuuc

SEQ ID NO: 654689 - RNA, 23 nt, Escherichia coli CFT073
agauccugauccugcaacaacac

SEQ ID NO: 654690 - RNA, 13 nt, Escherichia coli CFT073
agauccugaaauu

SEQ ID NO: 654691 - RNA, 17 nt, Escherichia coli CFT073
agauccugaaauuccug

SEQ ID NO: 654692 - RNA, 20 nt, Escherichia coli CFT073
agaucccacucaucaagcau

SEQ ID NO: 654693 - RNA, 16 nt, Escherichia coli CFT073
agaucccccgcacacu

SEQ ID NO: 654694 - RNA, 20 nt, Escherichia coli CFT073
agauccgcugaugaaucggg

SEQ ID NO: 654695 - RNA, 17 nt, Escherichia coli CFT073
agauccgcuucgccagu

SEQ ID NO: 654696 - RNA, 18 nt, Escherichia coli CFT073
agauccgggcauauuucc

SEQ ID NO: 654697 - RNA, 16 nt, Escherichia coli CFT073
agauccgccaguuugu

SEQ ID NO: 654698 - RNA, 12 nt, Escherichia coli CFT073
agaucagauaau

SEQ ID NO: 654699 - RNA, 14 nt, Escherichia coli CFT073
agaucagcaaauaa

SEQ ID NO: 654700 - RNA, 15 nt, Escherichia coli CFT073
agaucagcaaauaau

SEQ ID NO: 654701 - RNA, 23 nt, Escherichia coli CFT073
agaucaccuugcaguuguaauca

SEQ ID NO: 654702 - RNA, 23 nt, Escherichia coli CFT073
agaucaaacaaccguucacgcau

SEQ ID NO: 654703 - RNA, 24 nt, Escherichia coli CFT073
agaucaaauucaaugacaguauca

SEQ ID NO: 654704 - RNA, 16 nt, Escherichia coli CFT073
agauauuuaacaucau

SEQ ID NO: 654705 - RNA, 14 nt, Escherichia coli CFT073
agauauuuuguuca

SEQ ID NO: 654706 - RNA, 21 nt, Escherichia coli CFT073
agauauuuuguucaaaggcag

SEQ ID NO: 654707 - RNA, 22 nt, Escherichia coli CFT073
agauauuuuguucaaaggcaga

SEQ ID NO: 654708 - RNA, 13 nt, Escherichia coli CFT073
agauauagcccca

SEQ ID NO: 654709 - RNA, 17 nt, Escherichia coli CFT073
agauauagccuaacaca

SEQ ID NO: 654710 - RNA, 19 nt, Escherichia coli CFT073
agauagucgaaucaguaaa

SEQ ID NO: 654711 - RNA, 17 nt, Escherichia coli CFT073
agauagggcgagaaauu

SEQ ID NO: 654712 - RNA, 13 nt, Escherichia coli CFT073
agauauccacauu

SEQ ID NO: 654713 - RNA, 21 nt, Escherichia coli CFT073
agauaucccgccagcaccagc

SEQ ID NO: 654714 - RNA, 23 nt, Escherichia coli CFT073
agauaucccgccagcaccagcaa

SEQ ID NO: 654715 - RNA, 14 nt, Escherichia coli CFT073
agauauucaguacc

SEQ ID NO: 654716 - RNA, 15 nt, Escherichia coli CFT073
agauauucaucagca

SEQ ID NO: 654717 - RNA, 19 nt, Escherichia coli CFT073
agauauucccccaccgccg

SEQ ID NO: 654718 - RNA, 21 nt, Escherichia coli CFT073
agauauucuuccaguggcuuu

SEQ ID NO: 654719 - RNA, 20 nt, Escherichia coli CFT073
agauagcacgacguuucuuu

SEQ ID NO: 654720 - RNA, 21 nt, Escherichia coli CFT073
agauagccagguuuaccagca

SEQ ID NO: 654721 - RNA, 22 nt, Escherichia coli CFT073
agauagccagguuuaccagcag

SEQ ID NO: 654722 - RNA, 21 nt, Escherichia coli CFT073
agauacgcaucgcgcaccagc

SEQ ID NO: 654723 - RNA, 18 nt, Escherichia coli CFT073
agauagacuguugaaaua

SEQ ID NO: 654724 - RNA, 15 nt, Escherichia coli CFT073
agaguugauuuuguu

SEQ ID NO: 654725 - RNA, 15 nt, Escherichia coli CFT073
agaguugcaccagca

SEQ ID NO: 654726 - RNA, 18 nt, Escherichia coli CFT073
agaguugcaccagcaaua

SEQ ID NO: 654727 - RNA, 21 nt, Escherichia coli CFT073
agaguugaaaaucucacgcag

SEQ ID NO: 654728 - RNA, 23 nt, Escherichia coli CFT073
agaguugagcaguccccacauca

SEQ ID NO: 654729 - RNA, 15 nt, Escherichia coli CFT073
agaguuguaccaccc

SEQ ID NO: 654730 - RNA, 15 nt, Escherichia coli CFT073
agaguuuucaugaau

SEQ ID NO: 654731 - RNA, 14 nt, Escherichia coli CFT073
agauacacagccca

SEQ ID NO: 654732 - RNA, 18 nt, Escherichia coli CFT073
agauacacagcccaguuu

SEQ ID NO: 654733 - RNA, 15 nt, Escherichia coli CFT073
agauacaaccaaucg

SEQ ID NO: 654734 - RNA, 15 nt, Escherichia coli CFT073
agauacaaaacaugu

SEQ ID NO: 654735 - RNA, 18 nt, Escherichia coli CFT073
agauaauuuugaaauaaa

SEQ ID NO: 654736 - RNA, 13 nt, Escherichia coli CFT073
agauaccuucuug

SEQ ID NO: 654737 - RNA, 21 nt, Escherichia coli CFT073
agauacccggauacaacucgc

SEQ ID NO: 654738 - RNA, 15 nt, Escherichia coli CFT073
agauaccaacccugg

SEQ ID NO: 654739 - RNA, 17 nt, Escherichia coli CFT073
agauaccaccacagcac

SEQ ID NO: 654740 - RNA, 22 nt, Escherichia coli CFT073
agauaccaccacagcacaggcg

SEQ ID NO: 654741 - RNA, 18 nt, Escherichia coli CFT073
agauacccgacagauaaa

SEQ ID NO: 654742 - RNA, 22 nt, Escherichia coli CFT073
agauacccgacagauaaaucau

SEQ ID NO: 654743 - RNA, 15 nt, Escherichia coli CFT073
agagucgccagcugc

SEQ ID NO: 654744 - RNA, 17 nt, Escherichia coli CFT073
agagucagcaaugccag

SEQ ID NO: 654745 - RNA, 18 nt, Escherichia coli CFT073
agagucagcaaugccaga

SEQ ID NO: 654746 - RNA, 14 nt, Escherichia coli CFT073
agagguaauuuggc

SEQ ID NO: 654747 - RNA, 14 nt, Escherichia coli CFT073
agaggucuuuucuc

SEQ ID NO: 654748 - RNA, 13 nt, Escherichia coli CFT073
agaguauaaaaaa

SEQ ID NO: 654749 - RNA, 16 nt, Escherichia coli CFT073
agagcuggcagccccg

SEQ ID NO: 654750 - RNA, 16 nt, Escherichia coli CFT073
agagcuguagauauau

SEQ ID NO: 654751 - RNA, 14 nt, Escherichia coli CFT073
agagcugauuuccg

SEQ ID NO: 654752 - RNA, 17 nt, Escherichia coli CFT073
agagcugcaaaaguacc

SEQ ID NO: 654753 - RNA, 20 nt, Escherichia coli CFT073
agagcuggaaguuacucaaa

SEQ ID NO: 654754 - RNA, 23 nt, Escherichia coli CFT073
agagcuuuucagccugaagauca

SEQ ID NO: 654755 - RNA, 18 nt, Escherichia coli CFT073
agagccugaauaaacgcc

SEQ ID NO: 654756 - RNA, 20 nt, Escherichia coli CFT073
agagcgccucauaugcggca

SEQ ID NO: 654757 - RNA, 15 nt, Escherichia coli CFT073
agagcgcaccgcgcg

SEQ ID NO: 654758 - RNA, 19 nt, Escherichia coli CFT073
agacucaauggcauccgcc

SEQ ID NO: 654759 - RNA, 16 nt, Escherichia coli CFT073
agacuauauuaaagau

SEQ ID NO: 654760 - RNA, 20 nt, Escherichia coli CFT073
agagagccagccccacagca

SEQ ID NO: 654761 - RNA, 14 nt, Escherichia coli CFT073
agagagaagccagg

SEQ ID NO: 654762 - RNA, 13 nt, Escherichia coli CFT073
agagagccagccc

SEQ ID NO: 654763 - RNA, 15 nt, Escherichia coli CFT073
agagagcaacagcag

SEQ ID NO: 654764 - RNA, 15 nt, Escherichia coli CFT073
agagaggauaugcau

SEQ ID NO: 654765 - RNA, 20 nt, Escherichia coli CFT073
agagauaacuggcaaaaaca

SEQ ID NO: 654766 - RNA, 21 nt, Escherichia coli CFT073
agagauaacuggcaaaaacaa

SEQ ID NO: 654767 - RNA, 18 nt, Escherichia coli CFT073
agagauaaacgaccacuc

SEQ ID NO: 654768 - RNA, 14 nt, Escherichia coli CFT073
agagauaaucacac

SEQ ID NO: 654769 - RNA, 22 nt, Escherichia coli CFT073
agagauagcacgacguuucuuu

SEQ ID NO: 654770 - RNA, 15 nt, Escherichia coli CFT073
agagaucaccuugca

SEQ ID NO: 654771 - RNA, 16 nt, Escherichia coli CFT073
agagaucaccuugcag

SEQ ID NO: 654772 - RNA, 19 nt, Escherichia coli CFT073
agagauagcgaaccgcagg

SEQ ID NO: 654773 - RNA, 20 nt, Escherichia coli CFT073
agagauccacuacgcuguag

SEQ ID NO: 654774 - RNA, 22 nt, Escherichia coli CFT073
agagaucgauguuuucugccuc

SEQ ID NO: 654775 - RNA, 15 nt, Escherichia coli CFT073
agagauguaaaguga

SEQ ID NO: 654776 - RNA, 15 nt, Escherichia coli CFT073
agagcaaauaaaaca

SEQ ID NO: 654777 - RNA, 19 nt, Escherichia coli CFT073
agagcaaauaaaacaucac

SEQ ID NO: 654778 - RNA, 16 nt, Escherichia coli CFT073
agagcaacgagacuca

SEQ ID NO: 654779 - RNA, 12 nt, Escherichia coli CFT073
acuuauauguug

SEQ ID NO: 654780 - RNA, 23 nt, Escherichia coli CFT073
acuuaucaauugaugcuuuuugc

SEQ ID NO: 654781 - RNA, 19 nt, Escherichia coli CFT073
acuuaugaguucgcggcgc

SEQ ID NO: 654782 - RNA, 12 nt, Escherichia coli CFT073
acuucacaucau

SEQ ID NO: 654783 - RNA, 16 nt, Escherichia coli CFT073
acuucacaugauaaua

SEQ ID NO: 654784 - RNA, 12 nt, Escherichia coli CFT073
acuucacauacu

SEQ ID NO: 654785 - RNA, 13 nt, Escherichia coli CFT073
acuucaccauuca

SEQ ID NO: 654786 - RNA, 18 nt, Escherichia coli CFT073
acuucaguggaaucauca

SEQ ID NO: 654787 - RNA, 20 nt, Escherichia coli CFT073
acuucaccuuuuguugcuuu

SEQ ID NO: 654788 - RNA, 15 nt, Escherichia coli CFT073
acuucacgcugccag

SEQ ID NO: 654789 - RNA, 23 nt, Escherichia coli CFT073
acuucacggcugcuaauauuuuc

SEQ ID NO: 654790 - RNA, 17 nt, Escherichia coli CFT073
acuuccugaaucacaau

SEQ ID NO: 654791 - RNA, 20 nt, Escherichia coli CFT073
acuuccgggucgcugucuuu

SEQ ID NO: 654792 - RNA, 18 nt, Escherichia coli CFT073
acuuccgcgucaaucugc

SEQ ID NO: 654793 - RNA, 15 nt, Escherichia coli CFT073
acuuccgcaacgaca

SEQ ID NO: 654794 - RNA, 20 nt, Escherichia coli CFT073
acuucccccugagcgguggc

SEQ ID NO: 654795 - RNA, 13 nt, Escherichia coli CFT073
acuuccccugcca

SEQ ID NO: 654796 - RNA, 23 nt, Escherichia coli CFT073
acuuaagcgccugauacagccaa

SEQ ID NO: 654797 - RNA, 12 nt, Escherichia coli CFT073
acuuaauaagca

SEQ ID NO: 654798 - RNA, 21 nt, Escherichia coli CFT073
acuuaaccacaaacgauccug

SEQ ID NO: 654799 - RNA, 21 nt, Escherichia coli CFT073
acuuaguaggccugauaagcg

SEQ ID NO: 654800 - RNA, 20 nt, Escherichia coli CFT073
acuuagugcacuucuucaca

SEQ ID NO: 654801 - RNA, 23 nt, Escherichia coli CFT073
acuuagugcacuucuucacauca

SEQ ID NO: 654802 - RNA, 14 nt, Escherichia coli CFT073
acuguugagaggac

SEQ ID NO: 654803 - RNA, 15 nt, Escherichia coli CFT073
acuuaaauaaugcuu

SEQ ID NO: 654804 - RNA, 12 nt, Escherichia coli CFT073
acugugugcuga

SEQ ID NO: 654805 - RNA, 14 nt, Escherichia coli CFT073
acugucuucaccau

SEQ ID NO: 654806 - RNA, 14 nt, Escherichia coli CFT073
acugucgcuauuca

SEQ ID NO: 654807 - RNA, 14 nt, Escherichia coli CFT073
acugucuaaugauu

SEQ ID NO: 654808 - RNA, 14 nt, Escherichia coli CFT073
acugguucccagag

SEQ ID NO: 654809 - RNA, 18 nt, Escherichia coli CFT073
acugguugaaauaaacca

SEQ ID NO: 654810 - RNA, 20 nt, Escherichia coli CFT073
acugguucccaacaacagcg

SEQ ID NO: 654811 - RNA, 13 nt, Escherichia coli CFT073
acugguacucaac

SEQ ID NO: 654812 - RNA, 13 nt, Escherichia coli CFT073
acugguagggaua

SEQ ID NO: 654813 - RNA, 17 nt, Escherichia coli CFT073
acugguagggauaaugu

SEQ ID NO: 654814 - RNA, 14 nt, Escherichia coli CFT073
acuggucaaacuga

SEQ ID NO: 654815 - RNA, 21 nt, Escherichia coli CFT073
acuggucaucaaguuacgaua

SEQ ID NO: 654816 - RNA, 17 nt, Escherichia coli CFT073
acugguaacgauuucau

SEQ ID NO: 654817 - RNA, 22 nt, Escherichia coli CFT073
acugguaacguggcagcaggau

SEQ ID NO: 654818 - RNA, 23 nt, Escherichia coli CFT073
acugggugaagacggccauccca

SEQ ID NO: 654819 - RNA, 18 nt, Escherichia coli CFT073
acugguuauaugaauacg

SEQ ID NO: 654820 - RNA, 21 nt, Escherichia coli CFT073
acuggugcguuuaccugccug

SEQ ID NO: 654821 - RNA, 14 nt, Escherichia coli CFT073
acuggugggaccaa

SEQ ID NO: 654822 - RNA, 14 nt, Escherichia coli CFT073
acuggugagcggug

SEQ ID NO: 654823 - RNA, 18 nt, Escherichia coli CFT073
acuggcuuuccugaucaa

SEQ ID NO: 654824 - RNA, 15 nt, Escherichia coli CFT073
acuggcguuaggcac

SEQ ID NO: 654825 - RNA, 17 nt, Escherichia coli CFT073
acuggcuugccagcagg

SEQ ID NO: 654826 - RNA, 17 nt, Escherichia coli CFT073
acugggcgauuaauaaa

SEQ ID NO: 654827 - RNA, 12 nt, Escherichia coli CFT073
acuggggcugga

SEQ ID NO: 654828 - RNA, 15 nt, Escherichia coli CFT073
acuggccucuucucu

SEQ ID NO: 654829 - RNA, 19 nt, Escherichia coli CFT073
acuggccuuuauuuuccag

SEQ ID NO: 654830 - RNA, 18 nt, Escherichia coli CFT073
acuggcgacacgcaucac

SEQ ID NO: 654831 - RNA, 15 nt, Escherichia coli CFT073
acuggcggaugcggc

SEQ ID NO: 654832 - RNA, 15 nt, Escherichia coli CFT073
acuggcgggcggcuu

SEQ ID NO: 654833 - RNA, 19 nt, Escherichia coli CFT073
acuggcgcggcagguugag

SEQ ID NO: 654834 - RNA, 23 nt, Escherichia coli CFT073
acuggcgcuggcauggcgaaaau

SEQ ID NO: 654835 - RNA, 21 nt, Escherichia coli CFT073
acuggccauggauucaagcau

SEQ ID NO: 654836 - RNA, 18 nt, Escherichia coli CFT073
acuggauggccugauuca

SEQ ID NO: 654837 - RNA, 17 nt, Escherichia coli CFT073
acugcugaaugaggcuu

SEQ ID NO: 654838 - RNA, 21 nt, Escherichia coli CFT073
acugcugauguuguuucucuu

SEQ ID NO: 654839 - RNA, 15 nt, Escherichia coli CFT073
acugcugcgguugaa

SEQ ID NO: 654840 - RNA, 22 nt, Escherichia coli CFT073
acugcucguaaagcaucagacu

SEQ ID NO: 654841 - RNA, 14 nt, Escherichia coli CFT073
acugcucguucagc

SEQ ID NO: 654842 - RNA, 22 nt, Escherichia coli CFT073
acugcuccugcagaaaauccag

SEQ ID NO: 654843 - RNA, 12 nt, Escherichia coli CFT073
acugcuccaggg

SEQ ID NO: 654844 - RNA, 13 nt, Escherichia coli CFT073
acugcucgcagaa

SEQ ID NO: 654845 - RNA, 21 nt, Escherichia coli CFT073
acugcucauuaauauacuucu

SEQ ID NO: 654846 - RNA, 17 nt, Escherichia coli CFT073
acugcgguguaaaccag

SEQ ID NO: 654847 - RNA, 22 nt, Escherichia coli CFT073
acugcguggcgaaccgucugaa

SEQ ID NO: 654848 - RNA, 15 nt, Escherichia coli CFT073
acugcggauaaacau

SEQ ID NO: 654849 - RNA, 14 nt, Escherichia coli CFT073
acugcuugccaccg

SEQ ID NO: 654850 - RNA, 14 nt, Escherichia coli CFT073
acugcuugccauuc

SEQ ID NO: 654851 - RNA, 15 nt, Escherichia coli CFT073
acugcuggaauacug

SEQ ID NO: 654852 - RNA, 18 nt, Escherichia coli CFT073
acugcuggcuuaaaaaac

SEQ ID NO: 654853 - RNA, 16 nt, Escherichia coli CFT073
acugcuguugcugccg

SEQ ID NO: 654854 - RNA, 19 nt, Escherichia coli CFT073
acuggacccgaugaucaaa

SEQ ID NO: 654855 - RNA, 20 nt, Escherichia coli CFT073
acugcuuuuucaauuuccag

SEQ ID NO: 654856 - RNA, 15 nt, Escherichia coli CFT073
acuggaaacagccaa

SEQ ID NO: 654857 - RNA, 15 nt, Escherichia coli CFT073
acuggaaaucaaaua

SEQ ID NO: 654858 - RNA, 16 nt, Escherichia coli CFT073
acuggaaaucaaauac

SEQ ID NO: 654859 - RNA, 21 nt, Escherichia coli CFT073
acuggaacaguugcagucuca

SEQ ID NO: 654860 - RNA, 22 nt, Escherichia coli CFT073
acugccccgccagugcuuucag

SEQ ID NO: 654861 - RNA, 15 nt, Escherichia coli CFT073
acugccgaccagaau

SEQ ID NO: 654862 - RNA, 21 nt, Escherichia coli CFT073
acugccagaauagccgcagcu

SEQ ID NO: 654863 - RNA, 14 nt, Escherichia coli CFT073
acugccagcaaaaa

SEQ ID NO: 654864 - RNA, 16 nt, Escherichia coli CFT073
acugccacuuuuuccc

SEQ ID NO: 654865 - RNA, 13 nt, Escherichia coli CFT073
acugccagaauag

SEQ ID NO: 654866 - RNA, 14 nt, Escherichia coli CFT073
acugccaucuuccg

SEQ ID NO: 654867 - RNA, 17 nt, Escherichia coli CFT073
acugccagccacacugc

SEQ ID NO: 654868 - RNA, 16 nt, Escherichia coli CFT073
acugcacaccgcggaa

SEQ ID NO: 654869 - RNA, 21 nt, Escherichia coli CFT073
acugcacgaugccucaucaca

SEQ ID NO: 654870 - RNA, 23 nt, Escherichia coli CFT073
acugcagcaggcgagcugccagu

SEQ ID NO: 654871 - RNA, 21 nt, Escherichia coli CFT073
acugcagccagcguuacccag

SEQ ID NO: 654872 - RNA, 14 nt, Escherichia coli CFT073
acugcauaaucgcu

SEQ ID NO: 654873 - RNA, 23 nt, Escherichia coli CFT073
acugcauggccagacauuacaaa

SEQ ID NO: 654874 - RNA, 15 nt, Escherichia coli CFT073
acugcgaccagggau

SEQ ID NO: 654875 - RNA, 15 nt, Escherichia coli CFT073
acugcgaccagugaa

SEQ ID NO: 654876 - RNA, 18 nt, Escherichia coli CFT073
acugcgaccagugaaaau

SEQ ID NO: 654877 - RNA, 21 nt, Escherichia coli CFT073
acugcgcauuaaauaccaagc

SEQ ID NO: 654878 - RNA, 22 nt, Escherichia coli CFT073
acugcgcgccgaagcugaccag

SEQ ID NO: 654879 - RNA, 19 nt, Escherichia coli CFT073
acugcgccucaacauacaa

SEQ ID NO: 654880 - RNA, 16 nt, Escherichia coli CFT073
acugcgcccgccagca

SEQ ID NO: 654881 - RNA, 20 nt, Escherichia coli CFT073
acugcgaauuuccugccaga

SEQ ID NO: 654882 - RNA, 23 nt, Escherichia coli CFT073
acugcgaauuuccugccagaccu

SEQ ID NO: 654883 - RNA, 17 nt, Escherichia coli CFT073
acugccuuaaacuccau

SEQ ID NO: 654884 - RNA, 20 nt, Escherichia coli CFT073
acugccuugcgauaucccau

SEQ ID NO: 654885 - RNA, 14 nt, Escherichia coli CFT073
acugccuuuaucaa

SEQ ID NO: 654886 - RNA, 16 nt, Escherichia coli CFT073
acugccuuucccuuuc

SEQ ID NO: 654887 - RNA, 16 nt, Escherichia coli CFT073
acugccggacguucgc

SEQ ID NO: 654888 - RNA, 13 nt, Escherichia coli CFT073
acugccgggugga

SEQ ID NO: 654889 - RNA, 20 nt, Escherichia coli CFT073
acugccgucagggccugcgu

SEQ ID NO: 654890 - RNA, 19 nt, Escherichia coli CFT073
acugccgagaaugacgaca

SEQ ID NO: 654891 - RNA, 22 nt, Escherichia coli CFT073
acugccgccgucaucugggcag

SEQ ID NO: 654892 - RNA, 15 nt, Escherichia coli CFT073
acugauuacccuucg

SEQ ID NO: 654893 - RNA, 19 nt, Escherichia coli CFT073
acugaugugucccuuuacu

SEQ ID NO: 654894 - RNA, 15 nt, Escherichia coli CFT073
acugaugacaaaguc

SEQ ID NO: 654895 - RNA, 20 nt, Escherichia coli CFT073
acugaugauaaguucaaguu

SEQ ID NO: 654896 - RNA, 17 nt, Escherichia coli CFT073
acugaucgucaucaaac

SEQ ID NO: 654897 - RNA, 16 nt, Escherichia coli CFT073
acugaucuuuaucaag

SEQ ID NO: 654898 - RNA, 18 nt, Escherichia coli CFT073
acugaucuuuaucaagca

SEQ ID NO: 654899 - RNA, 13 nt, Escherichia coli CFT073
acugaucaucauu

SEQ ID NO: 654900 - RNA, 14 nt, Escherichia coli CFT073
acugauccugacaa

SEQ ID NO: 654901 - RNA, 23 nt, Escherichia coli CFT073
acugaucgacaguugcugcguga

SEQ ID NO: 654902 - RNA, 15 nt, Escherichia coli CFT073
acugcaacucaccuu

SEQ ID NO: 654903 - RNA, 13 nt, Escherichia coli CFT073
acugcaacugugc

SEQ ID NO: 654904 - RNA, 14 nt, Escherichia coli CFT073
acugcaaggagagc

SEQ ID NO: 654905 - RNA, 19 nt, Escherichia coli CFT073
acugcaaauacccaaaaaa

SEQ ID NO: 654906 - RNA, 15 nt, Escherichia coli CFT073
acugcaaaucaccac

SEQ ID NO: 654907 - RNA, 16 nt, Escherichia coli CFT073
acugcaaaucaccaca

SEQ ID NO: 654908 - RNA, 22 nt, Escherichia coli CFT073
acugauuuguaugguuuuguag

SEQ ID NO: 654909 - RNA, 17 nt, Escherichia coli CFT073
acugauugauugcgaca

SEQ ID NO: 654910 - RNA, 22 nt, Escherichia coli CFT073
acugauuuccccccggcagcug

SEQ ID NO: 654911 - RNA, 21 nt, Escherichia coli CFT073
acucuuugggcagaaaaucca

SEQ ID NO: 654912 - RNA, 16 nt, Escherichia coli CFT073
acugaaacaugaacau

SEQ ID NO: 654913 - RNA, 18 nt, Escherichia coli CFT073
acugacugacagacugcu

SEQ ID NO: 654914 - RNA, 14 nt, Escherichia coli CFT073
acugauaacuuuuu

SEQ ID NO: 654915 - RNA, 18 nt, Escherichia coli CFT073
acugauaagcugagcaca

SEQ ID NO: 654916 - RNA, 15 nt, Escherichia coli CFT073
acugauacaccuuca

SEQ ID NO: 654917 - RNA, 19 nt, Escherichia coli CFT073
acugauagcggcggauuuc

SEQ ID NO: 654918 - RNA, 13 nt, Escherichia coli CFT073
acugauauugugc

SEQ ID NO: 654919 - RNA, 17 nt, Escherichia coli CFT073
acugaguuuuauucuuu

SEQ ID NO: 654920 - RNA, 23 nt, Escherichia coli CFT073
acugaguuuuauucuuuuuugau

SEQ ID NO: 654921 - RNA, 19 nt, Escherichia coli CFT073
acugaguuacguccaugua

SEQ ID NO: 654922 - RNA, 22 nt, Escherichia coli CFT073
acugaguuacguccauguagcu

SEQ ID NO: 654923 - RNA, 21 nt, Escherichia coli CFT073
acugaggcgauagcauccagu

SEQ ID NO: 654924 - RNA, 22 nt, Escherichia coli CFT073
acugagguaacucucaugcuuc

SEQ ID NO: 654925 - RNA, 21 nt, Escherichia coli CFT073
acucugugcgucugcuuuuau

SEQ ID NO: 654926 - RNA, 14 nt, Escherichia coli CFT073
acucuuaaagcuac

SEQ ID NO: 654927 - RNA, 21 nt, Escherichia coli CFT073
acucuuaagguucacuuaauc

SEQ ID NO: 654928 - RNA, 17 nt, Escherichia coli CFT073
acucugacccagaagac

SEQ ID NO: 654929 - RNA, 16 nt, Escherichia coli CFT073
acucugaccgggaaua

SEQ ID NO: 654930 - RNA, 23 nt, Escherichia coli CFT073
acucugaccugucgcagauauug

SEQ ID NO: 654931 - RNA, 21 nt, Escherichia coli CFT073
acucucgggaaggcccuuucc

SEQ ID NO: 654932 - RNA, 22 nt, Escherichia coli CFT073
acucugcuugaauucauuuaca

SEQ ID NO: 654933 - RNA, 19 nt, Escherichia coli CFT073
acucugcgacgguuucugg

SEQ ID NO: 654934 - RNA, 15 nt, Escherichia coli CFT073
acucugcaccgccuc

SEQ ID NO: 654935 - RNA, 17 nt, Escherichia coli CFT073
acucugcacguuuugcu

SEQ ID NO: 654936 - RNA, 12 nt, Escherichia coli CFT073
acucugaugacu

SEQ ID NO: 654937 - RNA, 22 nt, Escherichia coli CFT073
acucugccauccguaauuauua

SEQ ID NO: 654938 - RNA, 14 nt, Escherichia coli CFT073
acucuacucccugc

SEQ ID NO: 654939 - RNA, 19 nt, Escherichia coli CFT073
acucuacauguguucugca

SEQ ID NO: 654940 - RNA, 23 nt, Escherichia coli CFT073
acucggaaaaugcauucuuaucc

SEQ ID NO: 654941 - RNA, 17 nt, Escherichia coli CFT073
acucgcuuaagccauca

SEQ ID NO: 654942 - RNA, 16 nt, Escherichia coli CFT073
acucgcuggcggcugg

SEQ ID NO: 654943 - RNA, 18 nt, Escherichia coli CFT073
acucgaaggaauaagcug

SEQ ID NO: 654944 - RNA, 15 nt, Escherichia coli CFT073
acucgaccugcaacu

SEQ ID NO: 654945 - RNA, 17 nt, Escherichia coli CFT073
acuccuucguguauuuu

SEQ ID NO: 654946 - RNA, 15 nt, Escherichia coli CFT073
acuccugaaagcgaa

SEQ ID NO: 654947 - RNA, 20 nt, Escherichia coli CFT073
acuccucgccuuaacgcaaa

SEQ ID NO: 654948 - RNA, 21 nt, Escherichia coli CFT073
acuccgcuuaccauccacacc

SEQ ID NO: 654949 - RNA, 16 nt, Escherichia coli CFT073
acucaaucgccaaaaa

SEQ ID NO: 654950 - RNA, 13 nt, Escherichia coli CFT073
acucaaugacuuc

SEQ ID NO: 654951 - RNA, 17 nt, Escherichia coli CFT073
acucaagccguuaauuc

SEQ ID NO: 654952 - RNA, 23 nt, Escherichia coli CFT073
acucaagccguuaauucuuaaca

SEQ ID NO: 654953 - RNA, 17 nt, Escherichia coli CFT073
acucaacuuauugauca

SEQ ID NO: 654954 - RNA, 20 nt, Escherichia coli CFT073
acucaacuuauugaucaucc

SEQ ID NO: 654955 - RNA, 17 nt, Escherichia coli CFT073
acucaacagccagaagg

SEQ ID NO: 654956 - RNA, 13 nt, Escherichia coli CFT073
acucaaccgccac

SEQ ID NO: 654957 - RNA, 17 nt, Escherichia coli CFT073
acuaaacccgaccacuu

SEQ ID NO: 654958 - RNA, 22 nt, Escherichia coli CFT073
acuaaacguagcggaaaucaca

SEQ ID NO: 654959 - RNA, 19 nt, Escherichia coli CFT073
acuaccacguaacgacuga

SEQ ID NO: 654960 - RNA, 22 nt, Escherichia coli CFT073
acuaccacguaacgacugacuu

SEQ ID NO: 654961 - RNA, 15 nt, Escherichia coli CFT073
acuaccagugccaga

SEQ ID NO: 654962 - RNA, 16 nt, Escherichia coli CFT073
acuaccagugccagaa

SEQ ID NO: 654963 - RNA, 18 nt, Escherichia coli CFT073
acuaccagugccagaaca

SEQ ID NO: 654964 - RNA, 20 nt, Escherichia coli CFT073
acuaccagugccagaacaga

SEQ ID NO: 654965 - RNA, 21 nt, Escherichia coli CFT073
acuaccagugccagaacagaa

SEQ ID NO: 654966 - RNA, 13 nt, Escherichia coli CFT073
acuaccauaaaaa

SEQ ID NO: 654967 - RNA, 23 nt, Escherichia coli CFT073
acuacagcggaacuuuuuucauc

SEQ ID NO: 654968 - RNA, 14 nt, Escherichia coli CFT073
acuaauuaagacug

SEQ ID NO: 654969 - RNA, 18 nt, Escherichia coli CFT073
acuacggcucagcaauau

SEQ ID NO: 654970 - RNA, 15 nt, Escherichia coli CFT073
acuacgcgccgccag

SEQ ID NO: 654971 - RNA, 23 nt, Escherichia coli CFT073
acuacgcagacggcuuucuucag

SEQ ID NO: 654972 - RNA, 23 nt, Escherichia coli CFT073
acuacccgcauuuucuucauucg

SEQ ID NO: 654973 - RNA, 22 nt, Escherichia coli CFT073
acuacccgcgccaauaacagaa

SEQ ID NO: 654974 - RNA, 22 nt, Escherichia coli CFT073
acuauugaagcccaaaaacuac

SEQ ID NO: 654975 - RNA, 16 nt, Escherichia coli CFT073
acuauuuacuugccug

SEQ ID NO: 654976 - RNA, 19 nt, Escherichia coli CFT073
acuauuucaaacacgaugc

SEQ ID NO: 654977 - RNA, 14 nt, Escherichia coli CFT073
acuauuguauacca

SEQ ID NO: 654978 - RNA, 18 nt, Escherichia coli CFT073
acucaaaaauaaucaucu

SEQ ID NO: 654979 - RNA, 13 nt, Escherichia coli CFT073
acucaaaucacgc

SEQ ID NO: 654980 - RNA, 18 nt, Escherichia coli CFT073
acuaucaggucuuucuga

SEQ ID NO: 654981 - RNA, 20 nt, Escherichia coli CFT073
acuaucaaccucuuuuucug

SEQ ID NO: 654982 - RNA, 15 nt, Escherichia coli CFT073
acuauuacugaccuc

SEQ ID NO: 654983 - RNA, 14 nt, Escherichia coli CFT073
acuauuaauauaua

SEQ ID NO: 654984 - RNA, 16 nt, Escherichia coli CFT073
acuauuaauauauauu

SEQ ID NO: 654985 - RNA, 17 nt, Escherichia coli CFT073
acuauuaauauauauua

SEQ ID NO: 654986 - RNA, 14 nt, Escherichia coli CFT073
acuauccacuggaa

SEQ ID NO: 654987 - RNA, 15 nt, Escherichia coli CFT073
acuauccacuggaau

SEQ ID NO: 654988 - RNA, 19 nt, Escherichia coli CFT073
acuauggauauaauuuuuu

SEQ ID NO: 654989 - RNA, 16 nt, Escherichia coli CFT073
acguuaugcuuacuga

SEQ ID NO: 654990 - RNA, 19 nt, Escherichia coli CFT073
acguuauucgcuuccucca

SEQ ID NO: 654991 - RNA, 12 nt, Escherichia coli CFT073
acguuggaucgc

SEQ ID NO: 654992 - RNA, 17 nt, Escherichia coli CFT073
acguuggcagugccauc

SEQ ID NO: 654993 - RNA, 21 nt, Escherichia coli CFT073
acguuggcagugccaucaaua

SEQ ID NO: 654994 - RNA, 13 nt, Escherichia coli CFT073
acguuauuuugcu

SEQ ID NO: 654995 - RNA, 17 nt, Escherichia coli CFT073
acguuucuuccacacca

SEQ ID NO: 654996 - RNA, 17 nt, Escherichia coli CFT073
acguuucaaacaggcug

SEQ ID NO: 654997 - RNA, 21 nt, Escherichia coli CFT073
acguuucacggucggccagua

SEQ ID NO: 654998 - RNA, 17 nt, Escherichia coli CFT073
acguuuaacacgcucug

SEQ ID NO: 654999 - RNA, 21 nt, Escherichia coli CFT073
acguugucuggcgucuccucc

SEQ ID NO: 655000 - RNA, 15 nt, Escherichia coli CFT073
acguugugcccuucc

SEQ ID NO: 655001 - RNA, 15 nt, Escherichia coli CFT073
acguuuucucaaguc

SEQ ID NO: 655002 - RNA, 12 nt, Escherichia coli CFT073
acguuuugcugg

SEQ ID NO: 655003 - RNA, 15 nt, Escherichia coli CFT073
acguuugauuuuuaa

SEQ ID NO: 655004 - RNA, 17 nt, Escherichia coli CFT073
acguuuggucagaucag

SEQ ID NO: 655005 - RNA, 20 nt, Escherichia coli CFT073
acguuuguaacccaccaugc

SEQ ID NO: 655006 - RNA, 22 nt, Escherichia coli CFT073
acguuuuaaugauuuccaggau

SEQ ID NO: 655007 - RNA, 20 nt, Escherichia coli CFT073
acuaaacccgaccacuucca

SEQ ID NO: 655008 - RNA, 16 nt, Escherichia coli CFT073
acguuaccggguguuc

SEQ ID NO: 655009 - RNA, 16 nt, Escherichia coli CFT073
acgucugccacggcag

SEQ ID NO: 655010 - RNA, 20 nt, Escherichia coli CFT073
acgucguuccccaucaccug

SEQ ID NO: 655011 - RNA, 15 nt, Escherichia coli CFT073
acgucgucaggcaau

SEQ ID NO: 655012 - RNA, 17 nt, Escherichia coli CFT073
acgucucaaucaccacc

SEQ ID NO: 655013 - RNA, 16 nt, Escherichia coli CFT073
acgucggcauauuuaa

SEQ ID NO: 655014 - RNA, 14 nt, Escherichia coli CFT073
acgucgcgcaugcg

SEQ ID NO: 655015 - RNA, 19 nt, Escherichia coli CFT073
acguaccgggcuuccggca

SEQ ID NO: 655016 - RNA, 19 nt, Escherichia coli CFT073
acguccggcaauauagaua

SEQ ID NO: 655017 - RNA, 19 nt, Escherichia coli CFT073
acguccggcagcagaaagc

SEQ ID NO: 655018 - RNA, 20 nt, Escherichia coli CFT073
acgucgcaacuccaccagca

SEQ ID NO: 655019 - RNA, 16 nt, Escherichia coli CFT073
acgucgcaagacgaaa

SEQ ID NO: 655020 - RNA, 20 nt, Escherichia coli CFT073
acgucgcaagacgaaaaaug

SEQ ID NO: 655021 - RNA, 14 nt, Escherichia coli CFT073
acgucgccagaaau

SEQ ID NO: 655022 - RNA, 13 nt, Escherichia coli CFT073
acgucgcccaccg

SEQ ID NO: 655023 - RNA, 17 nt, Escherichia coli CFT073
acggugauaaucauccc

SEQ ID NO: 655024 - RNA, 18 nt, Escherichia coli CFT073
acggugcuuuaauuucau

SEQ ID NO: 655025 - RNA, 14 nt, Escherichia coli CFT073
acgguggccacagc

SEQ ID NO: 655026 - RNA, 14 nt, Escherichia coli CFT073
acggucacggcugu

SEQ ID NO: 655027 - RNA, 20 nt, Escherichia coli CFT073
acggucacggcuguagccag

SEQ ID NO: 655028 - RNA, 13 nt, Escherichia coli CFT073
acggucagcgcac

SEQ ID NO: 655029 - RNA, 13 nt, Escherichia coli CFT073
acgguccggcauc

SEQ ID NO: 655030 - RNA, 23 nt, Escherichia coli CFT073
acggugaaaaaccaaucucccag

SEQ ID NO: 655031 - RNA, 14 nt, Escherichia coli CFT073
acggucuaccaguu

SEQ ID NO: 655032 - RNA, 23 nt, Escherichia coli CFT073
acguaaggacggaauuugcugcu

SEQ ID NO: 655033 - RNA, 16 nt, Escherichia coli CFT073
acguaaaaacccgcuu

SEQ ID NO: 655034 - RNA, 22 nt, Escherichia coli CFT073
acgguuucucccgccugcugcg

SEQ ID NO: 655035 - RNA, 16 nt, Escherichia coli CFT073
acgguuaugaauaacu

SEQ ID NO: 655036 - RNA, 16 nt, Escherichia coli CFT073
acgguugcggaaccca

SEQ ID NO: 655037 - RNA, 20 nt, Escherichia coli CFT073
acgguugcuuuacagccagg

SEQ ID NO: 655038 - RNA, 15 nt, Escherichia coli CFT073
acgguuaaaaacagc

SEQ ID NO: 655039 - RNA, 17 nt, Escherichia coli CFT073
acgguuaaaaacagcca

SEQ ID NO: 655040 - RNA, 18 nt, Escherichia coli CFT073
acgguuaacgccagccac

SEQ ID NO: 655041 - RNA, 16 nt, Escherichia coli CFT073
acggcggaaagggccg

SEQ ID NO: 655042 - RNA, 20 nt, Escherichia coli CFT073
acgggcgauggaaccacaug

SEQ ID NO: 655043 - RNA, 14 nt, Escherichia coli CFT073
acgggccugcaggu

SEQ ID NO: 655044 - RNA, 17 nt, Escherichia coli CFT073
acgggcggaggggagga

SEQ ID NO: 655045 - RNA, 13 nt, Escherichia coli CFT073
acggcgguaaaag

SEQ ID NO: 655046 - RNA, 18 nt, Escherichia coli CFT073
acggggacuccacaccgg

SEQ ID NO: 655047 - RNA, 19 nt, Escherichia coli CFT073
acgggcggugcggugccag

SEQ ID NO: 655048 - RNA, 19 nt, Escherichia coli CFT073
acgggguguguagcgggug

SEQ ID NO: 655049 - RNA, 18 nt, Escherichia coli CFT073
acgguaauauuuuguggu

SEQ ID NO: 655050 - RNA, 14 nt, Escherichia coli CFT073
acgguaagccgcaa

SEQ ID NO: 655051 - RNA, 18 nt, Escherichia coli CFT073
acgguaaguucacgcagg

SEQ ID NO: 655052 - RNA, 16 nt, Escherichia coli CFT073
acgguacucaucacgu

SEQ ID NO: 655053 - RNA, 21 nt, Escherichia coli CFT073
acgguacuugcggucaggugc

SEQ ID NO: 655054 - RNA, 15 nt, Escherichia coli CFT073
acgguauaacccagu

SEQ ID NO: 655055 - RNA, 22 nt, Escherichia coli CFT073
acggguggcgaauuaacaccac

SEQ ID NO: 655056 - RNA, 15 nt, Escherichia coli CFT073
acgguaaaauacagg

SEQ ID NO: 655057 - RNA, 22 nt, Escherichia coli CFT073
acggauugcuuguucgaugccu

SEQ ID NO: 655058 - RNA, 23 nt, Escherichia coli CFT073
acggaugauuaccggagcugcag

SEQ ID NO: 655059 - RNA, 15 nt, Escherichia coli CFT073
acggaugcgcccacu

SEQ ID NO: 655060 - RNA, 13 nt, Escherichia coli CFT073
acggcccagcaug

SEQ ID NO: 655061 - RNA, 18 nt, Escherichia coli CFT073
acggcccauaacccacac

SEQ ID NO: 655062 - RNA, 18 nt, Escherichia coli CFT073
acggccccaaauaccugg

SEQ ID NO: 655063 - RNA, 16 nt, Escherichia coli CFT073
acggccgugaacuggc

SEQ ID NO: 655064 - RNA, 18 nt, Escherichia coli CFT073
acggcccguacugaaccc

SEQ ID NO: 655065 - RNA, 15 nt, Escherichia coli CFT073
acggcgacaagaaua

SEQ ID NO: 655066 - RNA, 22 nt, Escherichia coli CFT073
acggcggaacgccuaacucuug

SEQ ID NO: 655067 - RNA, 14 nt, Escherichia coli CFT073
acggaaagcagcau

SEQ ID NO: 655068 - RNA, 20 nt, Escherichia coli CFT073
acggaaugaggcacgacaca

SEQ ID NO: 655069 - RNA, 13 nt, Escherichia coli CFT073
acggaccaauaaa

SEQ ID NO: 655070 - RNA, 14 nt, Escherichia coli CFT073
acggaacgggccau

SEQ ID NO: 655071 - RNA, 19 nt, Escherichia coli CFT073
acggaagacguucaguuca

SEQ ID NO: 655072 - RNA, 13 nt, Escherichia coli CFT073
acggaauaaaccg

SEQ ID NO: 655073 - RNA, 22 nt, Escherichia coli CFT073
acggaagcuuaucacagaggaa

SEQ ID NO: 655074 - RNA, 23 nt, Escherichia coli CFT073
acgcugcugccggaacaggcauc

SEQ ID NO: 655075 - RNA, 15 nt, Escherichia coli CFT073
acgcuggcgcgucuu

SEQ ID NO: 655076 - RNA, 18 nt, Escherichia coli CFT073
acgcuggcgcgucuuauc

SEQ ID NO: 655077 - RNA, 20 nt, Escherichia coli CFT073
acgcuggccgcgucuuaucc

SEQ ID NO: 655078 - RNA, 18 nt, Escherichia coli CFT073
acgcuggcagcagaacca

SEQ ID NO: 655079 - RNA, 22 nt, Escherichia coli CFT073
acgcuggcagcagaaccaggga

SEQ ID NO: 655080 - RNA, 21 nt, Escherichia coli CFT073
acgcuguaagccgccgccauc

SEQ ID NO: 655081 - RNA, 13 nt, Escherichia coli CFT073
acgcugucggcac

SEQ ID NO: 655082 - RNA, 19 nt, Escherichia coli CFT073
acgcuggggaaugccauga

SEQ ID NO: 655083 - RNA, 23 nt, Escherichia coli CFT073
acgcugguaguuguacaacugcu

SEQ ID NO: 655084 - RNA, 21 nt, Escherichia coli CFT073
acgcaaugugcagcagugcca

SEQ ID NO: 655085 - RNA, 14 nt, Escherichia coli CFT073
acgcugcucaggcg

SEQ ID NO: 655086 - RNA, 20 nt, Escherichia coli CFT073
acgcaaggcacaaagucgcg

SEQ ID NO: 655087 - RNA, 22 nt, Escherichia coli CFT073
acgcaacugccaguaaagcagc

SEQ ID NO: 655088 - RNA, 19 nt, Escherichia coli CFT073
aggaauccagcacgaagag

SEQ ID NO: 655089 - RNA, 21 nt, Escherichia coli CFT073
aggaauggcgauuuugugcaa

SEQ ID NO: 655090 - RNA, 22 nt, Escherichia coli CFT073
aggaauaucuucccgccgcuga

SEQ ID NO: 655091 - RNA, 21 nt, Escherichia coli CFT073
aggaagcuuucgcaguagauc

SEQ ID NO: 655092 - RNA, 17 nt, Escherichia coli CFT073
aggaagcgcaacagcgc

SEQ ID NO: 655093 - RNA, 19 nt, Escherichia coli CFT073
aggaagagguaagcuucag

SEQ ID NO: 655094 - RNA, 20 nt, Escherichia coli CFT073
aggaagaagcuugcuucuuu

SEQ ID NO: 655095 - RNA, 21 nt, Escherichia coli CFT073
aggaacgggauugccagcaua

SEQ ID NO: 655096 - RNA, 23 nt, Escherichia coli CFT073
aggaacgcgccaagauagaacca

SEQ ID NO: 655097 - RNA, 19 nt, Escherichia coli CFT073
aggaacucaaaccauuucu

SEQ ID NO: 655098 - RNA, 17 nt, Escherichia coli CFT073
aggaacugcaaggagag

SEQ ID NO: 655099 - RNA, 12 nt, Escherichia coli CFT073
aggaacauaaag

SEQ ID NO: 655100 - RNA, 21 nt, Escherichia coli CFT073
aggaaauauacacgaaaugaa

SEQ ID NO: 655101 - RNA, 14 nt, Escherichia coli CFT073
aggaaauaaauaau

SEQ ID NO: 655102 - RNA, 15 nt, Escherichia coli CFT073
aggaaauaaauaauc

SEQ ID NO: 655103 - RNA, 15 nt, Escherichia coli CFT073
aggaaaauacagcaa

SEQ ID NO: 655104 - RNA, 14 nt, Escherichia coli CFT073
aggaaaaacggaau

SEQ ID NO: 655105 - RNA, 19 nt, Escherichia coli CFT073
aggaaaagucggggagaaa

SEQ ID NO: 655106 - RNA, 16 nt, Escherichia coli CFT073
aggaaaaugagauggu

SEQ ID NO: 655107 - RNA, 19 nt, Escherichia coli CFT073
aggaaaaugaucaauaauu

SEQ ID NO: 655108 - RNA, 14 nt, Escherichia coli CFT073
aggauaaccuucca

SEQ ID NO: 655109 - RNA, 14 nt, Escherichia coli CFT073
aggauauauuucau

SEQ ID NO: 655110 - RNA, 16 nt, Escherichia coli CFT073
aggauauaaaaauaac

SEQ ID NO: 655111 - RNA, 17 nt, Escherichia coli CFT073
aggauauaaaaauaaca

SEQ ID NO: 655112 - RNA, 15 nt, Escherichia coli CFT073
aggauauucugcggc

SEQ ID NO: 655113 - RNA, 16 nt, Escherichia coli CFT073
aggaucaccaauacca

SEQ ID NO: 655114 - RNA, 20 nt, Escherichia coli CFT073
aggaucaccaauaccagcau

SEQ ID NO: 655115 - RNA, 13 nt, Escherichia coli CFT073
aggaucagcaaaa

SEQ ID NO: 655116 - RNA, 18 nt, Escherichia coli CFT073
aggaucagccauuuugca

SEQ ID NO: 655117 - RNA, 16 nt, Escherichia coli CFT073
aggaucgauggugaag

SEQ ID NO: 655118 - RNA, 19 nt, Escherichia coli CFT073
aggaucgauggugaagugg

SEQ ID NO: 655119 - RNA, 21 nt, Escherichia coli CFT073
aggaggcguucugcgggagaa

SEQ ID NO: 655120 - RNA, 15 nt, Escherichia coli CFT073
aggaggagagcaggc

SEQ ID NO: 655121 - RNA, 23 nt, Escherichia coli CFT073
aggagcugagugcgaaaaucaau

SEQ ID NO: 655122 - RNA, 20 nt, Escherichia coli CFT073
aggaguuugaacauaucagc

SEQ ID NO: 655123 - RNA, 16 nt, Escherichia coli CFT073
aggauaaacuccugca

SEQ ID NO: 655124 - RNA, 19 nt, Escherichia coli CFT073
aggauaaacuccugcacgc

SEQ ID NO: 655125 - RNA, 15 nt, Escherichia coli CFT073
aggauaaauaaaaua

SEQ ID NO: 655126 - RNA, 20 nt, Escherichia coli CFT073
aggauaaauaaaauaaccac

SEQ ID NO: 655127 - RNA, 19 nt, Escherichia coli CFT073
aggaguauggcccagccuu

SEQ ID NO: 655128 - RNA, 19 nt, Escherichia coli CFT073
aggagaagcauccugcacu

SEQ ID NO: 655129 - RNA, 19 nt, Escherichia coli CFT073
aggacuggcgauaucaaua

SEQ ID NO: 655130 - RNA, 21 nt, Escherichia coli CFT073
aggacuauuuacagauuuccc

SEQ ID NO: 655131 - RNA, 22 nt, Escherichia coli CFT073
aggacuauuuacagauuuccca

SEQ ID NO: 655132 - RNA, 20 nt, Escherichia coli CFT073
aggagccaacacuuucacua

SEQ ID NO: 655133 - RNA, 15 nt, Escherichia coli CFT073
aggagaccaaaccau

SEQ ID NO: 655134 - RNA, 14 nt, Escherichia coli CFT073
aggagagcaggcca

SEQ ID NO: 655135 - RNA, 14 nt, Escherichia coli CFT073
aggagagccaguac

SEQ ID NO: 655136 - RNA, 19 nt, Escherichia coli CFT073
aggagauauuuaacaucau

SEQ ID NO: 655137 - RNA, 14 nt, Escherichia coli CFT073
aggacgaauacaag

SEQ ID NO: 655138 - RNA, 13 nt, Escherichia coli CFT073
aggacggaauuug

SEQ ID NO: 655139 - RNA, 22 nt, Escherichia coli CFT073
aggacggaauuugcugcuggca

SEQ ID NO: 655140 - RNA, 20 nt, Escherichia coli CFT073
aggacgauuccggcaaauaa

SEQ ID NO: 655141 - RNA, 14 nt, Escherichia coli CFT073
aggccaacauccau

SEQ ID NO: 655142 - RNA, 14 nt, Escherichia coli CFT073
aggccaaccgccca

SEQ ID NO: 655143 - RNA, 21 nt, Escherichia coli CFT073
aggccaaaagcuaacagcgcc

SEQ ID NO: 655144 - RNA, 12 nt, Escherichia coli CFT073
aggccaaagccg

SEQ ID NO: 655145 - RNA, 16 nt, Escherichia coli CFT073
aggcaucuucuucauu

SEQ ID NO: 655146 - RNA, 18 nt, Escherichia coli CFT073
aggcauuccuuuacuuag

SEQ ID NO: 655147 - RNA, 22 nt, Escherichia coli CFT073
aggcauaaagcugccuugccag

SEQ ID NO: 655148 - RNA, 17 nt, Escherichia coli CFT073
aggcaucggcuuuuuac

SEQ ID NO: 655149 - RNA, 15 nt, Escherichia coli CFT073
aggcaucgugcacca

SEQ ID NO: 655150 - RNA, 13 nt, Escherichia coli CFT073
aggcaucagcaau

SEQ ID NO: 655151 - RNA, 20 nt, Escherichia coli CFT073
aggcaucagcaauuguaaau

SEQ ID NO: 655152 - RNA, 20 nt, Escherichia coli CFT073
aggcagcuuagaaaggaaca

SEQ ID NO: 655153 - RNA, 18 nt, Escherichia coli CFT073
aggccauaaucaaauaaa

SEQ ID NO: 655154 - RNA, 14 nt, Escherichia coli CFT073
aggccaguauuuca

SEQ ID NO: 655155 - RNA, 16 nt, Escherichia coli CFT073
aggccaguauuucaua

SEQ ID NO: 655156 - RNA, 15 nt, Escherichia coli CFT073
aggccaggguaaaaa

SEQ ID NO: 655157 - RNA, 19 nt, Escherichia coli CFT073
aggccauuugcucuaccag

SEQ ID NO: 655158 - RNA, 21 nt, Escherichia coli CFT073
aggccauuugcucuaccagcc

SEQ ID NO: 655159 - RNA, 15 nt, Escherichia coli CFT073
aggccauaugacacc

SEQ ID NO: 655160 - RNA, 15 nt, Escherichia coli CFT073
aggccauauuucaca

SEQ ID NO: 655161 - RNA, 19 nt, Escherichia coli CFT073
aggccaccucgcaacaaug

SEQ ID NO: 655162 - RNA, 20 nt, Escherichia coli CFT073
aggccaccucgcaacaaugu

SEQ ID NO: 655163 - RNA, 21 nt, Escherichia coli CFT073
aggccaccucgcaacaauguc

SEQ ID NO: 655164 - RNA, 15 nt, Escherichia coli CFT073
aggccacggugguuc

SEQ ID NO: 655165 - RNA, 15 nt, Escherichia coli CFT073
aggccagauaaaaca

SEQ ID NO: 655166 - RNA, 19 nt, Escherichia coli CFT073
aggccagauaaaacacauc

SEQ ID NO: 655167 - RNA, 17 nt, Escherichia coli CFT073
aggccagccugauccac

SEQ ID NO: 655168 - RNA, 12 nt, Escherichia coli CFT073
aggccagccaga

SEQ ID NO: 655169 - RNA, 18 nt, Escherichia coli CFT073
aggccagccagaagaaaa

SEQ ID NO: 655170 - RNA, 22 nt, Escherichia coli CFT073
aggccagauacugccgaccaga

SEQ ID NO: 655171 - RNA, 12 nt, Escherichia coli CFT073
aggccccagccu

SEQ ID NO: 655172 - RNA, 14 nt, Escherichia coli CFT073
aggccccagccuca

SEQ ID NO: 655173 - RNA, 18 nt, Escherichia coli CFT073
aggcagauaauagucagc

SEQ ID NO: 655174 - RNA, 19 nt, Escherichia coli CFT073
aggcagcaaucacugccag

SEQ ID NO: 655175 - RNA, 16 nt, Escherichia coli CFT073
aggcagauccaguuac

SEQ ID NO: 655176 - RNA, 23 nt, Escherichia coli CFT073
aggcagaacaccggcagcgggau

SEQ ID NO: 655177 - RNA, 19 nt, Escherichia coli CFT073
aggcagagucaucucugcc

SEQ ID NO: 655178 - RNA, 15 nt, Escherichia coli CFT073
aggcagaaacaucau

SEQ ID NO: 655179 - RNA, 18 nt, Escherichia coli CFT073
aggcacuggccuuuucac

SEQ ID NO: 655180 - RNA, 17 nt, Escherichia coli CFT073
aggcacuucuuccgcca

SEQ ID NO: 655181 - RNA, 16 nt, Escherichia coli CFT073
aggcacucauuuucuc

SEQ ID NO: 655182 - RNA, 20 nt, Escherichia coli CFT073
aggcaccguguuccugaacg

SEQ ID NO: 655183 - RNA, 15 nt, Escherichia coli CFT073
aggcacaccagcaau

SEQ ID NO: 655184 - RNA, 14 nt, Escherichia coli CFT073
aggcacacugccag

SEQ ID NO: 655185 - RNA, 16 nt, Escherichia coli CFT073
aggcacacugccagug

SEQ ID NO: 655186 - RNA, 14 nt, Escherichia coli CFT073
aggcaccagccccu

SEQ ID NO: 655187 - RNA, 23 nt, Escherichia coli CFT073
aggcaccagccccuggaaaaaau

SEQ ID NO: 655188 - RNA, 15 nt, Escherichia coli CFT073
aggcaaccagcacgc

SEQ ID NO: 655189 - RNA, 21 nt, Escherichia coli CFT073
aggcaaccguucgggaaaaua

SEQ ID NO: 655190 - RNA, 14 nt, Escherichia coli CFT073
aggcaauucuuucc

SEQ ID NO: 655191 - RNA, 22 nt, Escherichia coli CFT073
aggcaauucuuuccguuuucac

SEQ ID NO: 655192 - RNA, 23 nt, Escherichia coli CFT073
aggcaauucuuuccguuuucacc

SEQ ID NO: 655193 - RNA, 20 nt, Escherichia coli CFT073
aggcaagccgcuaacagcag

SEQ ID NO: 655194 - RNA, 22 nt, Escherichia coli CFT073
aggcaagccgcuaacagcagca

SEQ ID NO: 655195 - RNA, 17 nt, Escherichia coli CFT073
aggcaaaauccuuccag

SEQ ID NO: 655196 - RNA, 15 nt, Escherichia coli CFT073
aggcaaaaaggccua

SEQ ID NO: 655197 - RNA, 12 nt, Escherichia coli CFT073
aggcaaaccagu

SEQ ID NO: 655198 - RNA, 14 nt, Escherichia coli CFT073
aggauuuacuaaaa

SEQ ID NO: 655199 - RNA, 21 nt, Escherichia coli CFT073
aggauuuacuaaaacuucauu

SEQ ID NO: 655200 - RNA, 15 nt, Escherichia coli CFT073
aggauuauuuauuca

SEQ ID NO: 655201 - RNA, 15 nt, Escherichia coli CFT073
aggauuagacgaaua

SEQ ID NO: 655202 - RNA, 14 nt, Escherichia coli CFT073
aggauuaccggugu

SEQ ID NO: 655203 - RNA, 20 nt, Escherichia coli CFT073
aggaugcgagucaggccagg

SEQ ID NO: 655204 - RNA, 13 nt, Escherichia coli CFT073
aggaugagaaaag

SEQ ID NO: 655205 - RNA, 23 nt, Escherichia coli CFT073
aggaugcugcaauaaaauaucuu

SEQ ID NO: 655206 - RNA, 22 nt, Escherichia coli CFT073
aggauggcauuugcaacaccgu

SEQ ID NO: 655207 - RNA, 22 nt, Escherichia coli CFT073
aggaugauggcgugaaagaaaa

SEQ ID NO: 655208 - RNA, 20 nt, Escherichia coli CFT073
aggaucguugagcagcagau

SEQ ID NO: 655209 - RNA, 19 nt, Escherichia coli CFT073
aggaucgggcagugcucgu

SEQ ID NO: 655210 - RNA, 12 nt, Escherichia coli CFT073
agcuugcagaau

SEQ ID NO: 655211 - RNA, 14 nt, Escherichia coli CFT073
agcuugcgauccug

SEQ ID NO: 655212 - RNA, 16 nt, Escherichia coli CFT073
agcuugcgauccugca

SEQ ID NO: 655213 - RNA, 18 nt, Escherichia coli CFT073
agcuugcgauccugcaga

SEQ ID NO: 655214 - RNA, 12 nt, Escherichia coli CFT073
agcuugcuucuu

SEQ ID NO: 655215 - RNA, 15 nt, Escherichia coli CFT073
agcuugcuucuuugc

SEQ ID NO: 655216 - RNA, 18 nt, Escherichia coli CFT073
agcuugcuuuccagcuuc

SEQ ID NO: 655217 - RNA, 16 nt, Escherichia coli CFT073
agcuuucgaccagcca

SEQ ID NO: 655218 - RNA, 22 nt, Escherichia coli CFT073
agcuuuaacauccgcaauuucg

SEQ ID NO: 655219 - RNA, 19 nt, Escherichia coli CFT073
agcuuugcguuucuuccug

SEQ ID NO: 655220 - RNA, 17 nt, Escherichia coli CFT073
agcuuugugcuucaguu

SEQ ID NO: 655221 - RNA, 16 nt, Escherichia coli CFT073
agcuuucgcaucagcu

SEQ ID NO: 655222 - RNA, 16 nt, Escherichia coli CFT073
agcuuccagaauccgu

SEQ ID NO: 655223 - RNA, 21 nt, Escherichia coli CFT073
agcuuccagccgguaauuuau

SEQ ID NO: 655224 - RNA, 18 nt, Escherichia coli CFT073
agcuuccaggcaaucagu

SEQ ID NO: 655225 - RNA, 18 nt, Escherichia coli CFT073
agcuucaucaucgcagau

SEQ ID NO: 655226 - RNA, 18 nt, Escherichia coli CFT073
agcuucacuuuccaguuc

SEQ ID NO: 655227 - RNA, 19 nt, Escherichia coli CFT073
agcuucacuuuccaguuca

SEQ ID NO: 655228 - RNA, 12 nt, Escherichia coli CFT073
agcuucagauug

SEQ ID NO: 655229 - RNA, 12 nt, Escherichia coli CFT073
agcuucacccgc

SEQ ID NO: 655230 - RNA, 12 nt, Escherichia coli CFT073
agcuucacgcgc

SEQ ID NO: 655231 - RNA, 20 nt, Escherichia coli CFT073
agcuuaucgggccuacaauu

SEQ ID NO: 655232 - RNA, 14 nt, Escherichia coli CFT073
agcuuaucuuuuuc

SEQ ID NO: 655233 - RNA, 18 nt, Escherichia coli CFT073
agcuuauuaacagucagu

SEQ ID NO: 655234 - RNA, 20 nt, Escherichia coli CFT073
agcuuauuaacagucaguca

SEQ ID NO: 655235 - RNA, 18 nt, Escherichia coli CFT073
agcuuauauacucuaaau

SEQ ID NO: 655236 - RNA, 18 nt, Escherichia coli CFT073
agcuuaucaaucucugca

SEQ ID NO: 655237 - RNA, 22 nt, Escherichia coli CFT073
agcuuaucacagaggaagaggu

SEQ ID NO: 655238 - RNA, 14 nt, Escherichia coli CFT073
agcuuauccagcaa

SEQ ID NO: 655239 - RNA, 21 nt, Escherichia coli CFT073
agcuuaucgcaggcuuccugg

SEQ ID NO: 655240 - RNA, 18 nt, Escherichia coli CFT073
agcuuaaucaccagcgca

SEQ ID NO: 655241 - RNA, 19 nt, Escherichia coli CFT073
agcuucgacuuccugcaau

SEQ ID NO: 655242 - RNA, 15 nt, Escherichia coli CFT073
agcuucgcuucccaa

SEQ ID NO: 655243 - RNA, 11 nt, Escherichia coli CFT073
agcuucuuccu

SEQ ID NO: 655244 - RNA, 16 nt, Escherichia coli CFT073
agcuucuucuccagcu

SEQ ID NO: 655245 - RNA, 18 nt, Escherichia coli CFT073
agcuucuucuccagcugc

SEQ ID NO: 655246 - RNA, 19 nt, Escherichia coli CFT073
agcuucuucuccagcugcg

SEQ ID NO: 655247 - RNA, 18 nt, Escherichia coli CFT073
agcuguugcgccagcaca

SEQ ID NO: 655248 - RNA, 14 nt, Escherichia coli CFT073
agcuguuuggccug

SEQ ID NO: 655249 - RNA, 14 nt, Escherichia coli CFT073
agcuguuuugguaa

SEQ ID NO: 655250 - RNA, 15 nt, Escherichia coli CFT073
agcuguuucaucuca

SEQ ID NO: 655251 - RNA, 17 nt, Escherichia coli CFT073
agcuguuucaucucagu

SEQ ID NO: 655252 - RNA, 20 nt, Escherichia coli CFT073
agcuguuucaucucagucag

SEQ ID NO: 655253 - RNA, 23 nt, Escherichia coli CFT073
agcuguuaucgauauacaaacau

SEQ ID NO: 655254 - RNA, 20 nt, Escherichia coli CFT073
agcuguucagauacaccauc

SEQ ID NO: 655255 - RNA, 17 nt, Escherichia coli CFT073
agcuguaccagcaacug

SEQ ID NO: 655256 - RNA, 15 nt, Escherichia coli CFT073
agcugucgaaaagau

SEQ ID NO: 655257 - RNA, 13 nt, Escherichia coli CFT073
agcuguccgauuu

SEQ ID NO: 655258 - RNA, 18 nt, Escherichia coli CFT073
agcugcgaccaguggcgg

SEQ ID NO: 655259 - RNA, 22 nt, Escherichia coli CFT073
agcuggucagcaucgucaacgc

SEQ ID NO: 655260 - RNA, 20 nt, Escherichia coli CFT073
agcugggcgauuuucuacuu

SEQ ID NO: 655261 - RNA, 12 nt, Escherichia coli CFT073
agcucacgcagc

SEQ ID NO: 655262 - RNA, 21 nt, Escherichia coli CFT073
agcucaccucaccuuucgguu

SEQ ID NO: 655263 - RNA, 18 nt, Escherichia coli CFT073
agcucacggccagucauu

SEQ ID NO: 655264 - RNA, 20 nt, Escherichia coli CFT073
agcucacuuugucugcaauc

SEQ ID NO: 655265 - RNA, 14 nt, Escherichia coli CFT073
agcucuaucugcac

SEQ ID NO: 655266 - RNA, 14 nt, Escherichia coli CFT073
agcucucagcauau

SEQ ID NO: 655267 - RNA, 17 nt, Escherichia coli CFT073
agcucucuuccaguucg

SEQ ID NO: 655268 - RNA, 11 nt, Escherichia coli CFT073
agcucaucaac

SEQ ID NO: 655269 - RNA, 15 nt, Escherichia coli CFT073
agcucaucaaugaua

SEQ ID NO: 655270 - RNA, 23 nt, Escherichia coli CFT073
agcucaguugguuagagcacauc

SEQ ID NO: 655271 - RNA, 17 nt, Escherichia coli CFT073
agcugcagccaguugcu

SEQ ID NO: 655272 - RNA, 18 nt, Escherichia coli CFT073
agcugaagcucguuguuu

SEQ ID NO: 655273 - RNA, 14 nt, Escherichia coli CFT073
agcugaacagucgc

SEQ ID NO: 655274 - RNA, 18 nt, Escherichia coli CFT073
agcugaacgcuucaccac

SEQ ID NO: 655275 - RNA, 20 nt, Escherichia coli CFT073
agcucuuuugacgcccccag

SEQ ID NO: 655276 - RNA, 16 nt, Escherichia coli CFT073
agcucugaauaaacgg

SEQ ID NO: 655277 - RNA, 23 nt, Escherichia coli CFT073
agcguaccaugauccugcaauac

SEQ ID NO: 655278 - RNA, 19 nt, Escherichia coli CFT073
agcguacugaccgucgccu

SEQ ID NO: 655279 - RNA, 15 nt, Escherichia coli CFT073
agcguacugucugcu

SEQ ID NO: 655280 - RNA, 15 nt, Escherichia coli CFT073
agcggugucugccag

SEQ ID NO: 655281 - RNA, 16 nt, Escherichia coli CFT073
agcguacaaucgccac

SEQ ID NO: 655282 - RNA, 19 nt, Escherichia coli CFT073
agcguacaaucgccacauu

SEQ ID NO: 655283 - RNA, 13 nt, Escherichia coli CFT073
agcgggccaguaa

SEQ ID NO: 655284 - RNA, 22 nt, Escherichia coli CFT073
agcgguaagguugucgaugcca

SEQ ID NO: 655285 - RNA, 18 nt, Escherichia coli CFT073
agcgucgggccacgcugc

SEQ ID NO: 655286 - RNA, 13 nt, Escherichia coli CFT073
agcgucgggaagc

SEQ ID NO: 655287 - RNA, 16 nt, Escherichia coli CFT073
agcguauccagcauac

SEQ ID NO: 655288 - RNA, 19 nt, Escherichia coli CFT073
agcgugcggcggcugacau

SEQ ID NO: 655289 - RNA, 16 nt, Escherichia coli CFT073
agcgucugagcaggcg

SEQ ID NO: 655290 - RNA, 14 nt, Escherichia coli CFT073
agcguggucauggc

SEQ ID NO: 655291 - RNA, 17 nt, Escherichia coli CFT073
agcguggcgaaucgcuu

SEQ ID NO: 655292 - RNA, 14 nt, Escherichia coli CFT073
agcgugcucucaaa

SEQ ID NO: 655293 - RNA, 11 nt, Escherichia coli CFT073
agcgugcuggu

SEQ ID NO: 655294 - RNA, 13 nt, Escherichia coli CFT073
agcuaaugccaac

SEQ ID NO: 655295 - RNA, 22 nt, Escherichia coli CFT073
agcuaauggcugcggacgacca

SEQ ID NO: 655296 - RNA, 19 nt, Escherichia coli CFT073
agcuaauuuguuaacaaua

SEQ ID NO: 655297 - RNA, 20 nt, Escherichia coli CFT073
agcucaagugccagaucaga

SEQ ID NO: 655298 - RNA, 15 nt, Escherichia coli CFT073
agcucaacaguaagg

SEQ ID NO: 655299 - RNA, 21 nt, Escherichia coli CFT073
agcucaacgccgcuaucagau

SEQ ID NO: 655300 - RNA, 14 nt, Escherichia coli CFT073
agcucaccagcagg

SEQ ID NO: 655301 - RNA, 19 nt, Escherichia coli CFT073
agcuaaccauccacauuuu

SEQ ID NO: 655302 - RNA, 16 nt, Escherichia coli CFT073
agcuaauauucuuuuu

SEQ ID NO: 655303 - RNA, 18 nt, Escherichia coli CFT073
agcguucaucugaccacg

SEQ ID NO: 655304 - RNA, 19 nt, Escherichia coli CFT073
agcguuccacgucacaggc

SEQ ID NO: 655305 - RNA, 13 nt, Escherichia coli CFT073
agcguuccagcag

SEQ ID NO: 655306 - RNA, 15 nt, Escherichia coli CFT073
agcgugguuugcuca

SEQ ID NO: 655307 - RNA, 21 nt, Escherichia coli CFT073
agcguguacggcauugucuga

SEQ ID NO: 655308 - RNA, 17 nt, Escherichia coli CFT073
agcguuaauuuccucuu

SEQ ID NO: 655309 - RNA, 13 nt, Escherichia coli CFT073
agcgcgccagccg

SEQ ID NO: 655310 - RNA, 13 nt, Escherichia coli CFT073
agcgcgcagguag

SEQ ID NO: 655311 - RNA, 11 nt, Escherichia coli CFT073
agcgcgccugg

SEQ ID NO: 655312 - RNA, 20 nt, Escherichia coli CFT073
agcgcgcgaauauggcggcg

SEQ ID NO: 655313 - RNA, 13 nt, Escherichia coli CFT073
agcgcgcugacau

SEQ ID NO: 655314 - RNA, 22 nt, Escherichia coli CFT073
agcgcgcuuuaccaucgcgcac

SEQ ID NO: 655315 - RNA, 13 nt, Escherichia coli CFT073
agcgcgcggcugg

SEQ ID NO: 655316 - RNA, 19 nt, Escherichia coli CFT073
agcgcggauuuuauucagc

SEQ ID NO: 655317 - RNA, 15 nt, Escherichia coli CFT073
agcgcggcagcggga

SEQ ID NO: 655318 - RNA, 16 nt, Escherichia coli CFT073
agcgcggcggcaauca

SEQ ID NO: 655319 - RNA, 18 nt, Escherichia coli CFT073
agcgcggcgacaauaauc

SEQ ID NO: 655320 - RNA, 21 nt, Escherichia coli CFT073
agcgcuggagagcgccgggca

SEQ ID NO: 655321 - RNA, 19 nt, Escherichia coli CFT073
agcgcugcggccugcugca

SEQ ID NO: 655322 - RNA, 17 nt, Escherichia coli CFT073
agcgcugcgcaggcaau

SEQ ID NO: 655323 - RNA, 22 nt, Escherichia coli CFT073
agcggaaacaauaauauugcua

SEQ ID NO: 655324 - RNA, 13 nt, Escherichia coli CFT073
agcggaccgcuuu

SEQ ID NO: 655325 - RNA, 11 nt, Escherichia coli CFT073
agcggagcgca

SEQ ID NO: 655326 - RNA, 19 nt, Escherichia coli CFT073
agcggagaucgccagcccu

SEQ ID NO: 655327 - RNA, 20 nt, Escherichia coli CFT073
agcggcgcauccgccagcag

SEQ ID NO: 655328 - RNA, 22 nt, Escherichia coli CFT073
agcggccccauuuauuucucac

SEQ ID NO: 655329 - RNA, 20 nt, Escherichia coli CFT073
agcggccagacgcgccgcca

SEQ ID NO: 655330 - RNA, 16 nt, Escherichia coli CFT073
agcgggaucagguaag

SEQ ID NO: 655331 - RNA, 22 nt, Escherichia coli CFT073
agcgggaucggcguacuggcaa

SEQ ID NO: 655332 - RNA, 20 nt, Escherichia coli CFT073
agcgggauucuccugagaau

SEQ ID NO: 655333 - RNA, 15 nt, Escherichia coli CFT073
agcgggaauagcuca

SEQ ID NO: 655334 - RNA, 22 nt, Escherichia coli CFT073
agcggcuggcacucuuccagac

SEQ ID NO: 655335 - RNA, 19 nt, Escherichia coli CFT073
agcggcggcacagcggggu

SEQ ID NO: 655336 - RNA, 18 nt, Escherichia coli CFT073
agcggcgcggucgaucac

SEQ ID NO: 655337 - RNA, 19 nt, Escherichia coli CFT073
agcggcguacccuccggga

SEQ ID NO: 655338 - RNA, 16 nt, Escherichia coli CFT073
agcggcguaucuucca

SEQ ID NO: 655339 - RNA, 23 nt, Escherichia coli CFT073
agcggcguuuuguagagcagcac

SEQ ID NO: 655340 - RNA, 23 nt, Escherichia coli CFT073
agggaguaugcggucaaaagcug

SEQ ID NO: 655341 - RNA, 14 nt, Escherichia coli CFT073
agggauauuucacc

SEQ ID NO: 655342 - RNA, 21 nt, Escherichia coli CFT073
agggauaagccagaccacagg

SEQ ID NO: 655343 - RNA, 14 nt, Escherichia coli CFT073
agggcaaacagcac

SEQ ID NO: 655344 - RNA, 20 nt, Escherichia coli CFT073
agggauucgacgcaaacaac

SEQ ID NO: 655345 - RNA, 19 nt, Escherichia coli CFT073
agggaaauaaucgggaaua

SEQ ID NO: 655346 - RNA, 20 nt, Escherichia coli CFT073
agggaacagagagcgccuca

SEQ ID NO: 655347 - RNA, 15 nt, Escherichia coli CFT073
agggaaacuccagcc

SEQ ID NO: 655348 - RNA, 15 nt, Escherichia coli CFT073
aggcuuuugguguuu

SEQ ID NO: 655349 - RNA, 18 nt, Escherichia coli CFT073
agggagcagacuguaaau

SEQ ID NO: 655350 - RNA, 20 nt, Escherichia coli CFT073
agggaaucgauaacugcucu

SEQ ID NO: 655351 - RNA, 22 nt, Escherichia coli CFT073
agggaauauaccaccgauugac

SEQ ID NO: 655352 - RNA, 16 nt, Escherichia coli CFT073
aggcuguucccacgca

SEQ ID NO: 655353 - RNA, 16 nt, Escherichia coli CFT073
aggcuuauccggcauu

SEQ ID NO: 655354 - RNA, 15 nt, Escherichia coli CFT073
aggcuuacacuuccu

SEQ ID NO: 655355 - RNA, 15 nt, Escherichia coli CFT073
aggcuucaaucaaua

SEQ ID NO: 655356 - RNA, 20 nt, Escherichia coli CFT073
aggcuuuggcaccuucgcca

SEQ ID NO: 655357 - RNA, 12 nt, Escherichia coli CFT073
aggcuuuccaga

SEQ ID NO: 655358 - RNA, 14 nt, Escherichia coli CFT073
aggcuuuaaacccg

SEQ ID NO: 655359 - RNA, 19 nt, Escherichia coli CFT073
aggcuguaacgaucaauuu

SEQ ID NO: 655360 - RNA, 14 nt, Escherichia coli CFT073
aggcuggcugaccc

SEQ ID NO: 655361 - RNA, 20 nt, Escherichia coli CFT073
aggcugcuugagccagugag

SEQ ID NO: 655362 - RNA, 16 nt, Escherichia coli CFT073
aggcugcauuauccac

SEQ ID NO: 655363 - RNA, 18 nt, Escherichia coli CFT073
aggggaacacggcuuucu

SEQ ID NO: 655364 - RNA, 14 nt, Escherichia coli CFT073
aggggaacagacca

SEQ ID NO: 655365 - RNA, 16 nt, Escherichia coli CFT073
aggggaacugcaggca

SEQ ID NO: 655366 - RNA, 13 nt, Escherichia coli CFT073
aggggacauuuag

SEQ ID NO: 655367 - RNA, 15 nt, Escherichia coli CFT073
aggggcaaucagcac

SEQ ID NO: 655368 - RNA, 13 nt, Escherichia coli CFT073
aggggcagaaaca

SEQ ID NO: 655369 - RNA, 16 nt, Escherichia coli CFT073
aggggauggaugcccc

SEQ ID NO: 655370 - RNA, 17 nt, Escherichia coli CFT073
agggcuaacgugcaggu

SEQ ID NO: 655371 - RNA, 18 nt, Escherichia coli CFT073
agggguuauaucuucuuu

SEQ ID NO: 655372 - RNA, 14 nt, Escherichia coli CFT073
aggguaagaugaau

SEQ ID NO: 655373 - RNA, 18 nt, Escherichia coli CFT073
aggguaaaaaccagggug

SEQ ID NO: 655374 - RNA, 20 nt, Escherichia coli CFT073
aggggcuuauauaggugaua

SEQ ID NO: 655375 - RNA, 21 nt, Escherichia coli CFT073
aggggcuuccagcaaauccau

SEQ ID NO: 655376 - RNA, 13 nt, Escherichia coli CFT073
aggggcuaaaagc

SEQ ID NO: 655377 - RNA, 17 nt, Escherichia coli CFT073
agggcggcuaucccaaa

SEQ ID NO: 655378 - RNA, 12 nt, Escherichia coli CFT073
agggcggacuga

SEQ ID NO: 655379 - RNA, 18 nt, Escherichia coli CFT073
agggccaucauuuugcua

SEQ ID NO: 655380 - RNA, 13 nt, Escherichia coli CFT073
agggcaacuucag

SEQ ID NO: 655381 - RNA, 20 nt, Escherichia coli CFT073
aggccgcaugugcccccugc

SEQ ID NO: 655382 - RNA, 13 nt, Escherichia coli CFT073
aggccgccaggca

SEQ ID NO: 655383 - RNA, 23 nt, Escherichia coli CFT073
aggccgccaguguuggcgucaga

SEQ ID NO: 655384 - RNA, 18 nt, Escherichia coli CFT073
aggccgcggcucaggcgc

SEQ ID NO: 655385 - RNA, 22 nt, Escherichia coli CFT073
aggccggaaccggcaacggcgu

SEQ ID NO: 655386 - RNA, 23 nt, Escherichia coli CFT073
aggccggauaagaugcgccagca

SEQ ID NO: 655387 - RNA, 15 nt, Escherichia coli CFT073
aggccugauaagaca

SEQ ID NO: 655388 - RNA, 15 nt, Escherichia coli CFT073
aggccugauaagacg

SEQ ID NO: 655389 - RNA, 17 nt, Escherichia coli CFT073
aggccuaaugucguggu

SEQ ID NO: 655390 - RNA, 16 nt, Escherichia coli CFT073
aggccuacaaaggcac

SEQ ID NO: 655391 - RNA, 16 nt, Escherichia coli CFT073
aggccuacaaucccgu

SEQ ID NO: 655392 - RNA, 22 nt, Escherichia coli CFT073
aggccuacaggugcaccgcauc

SEQ ID NO: 655393 - RNA, 17 nt, Escherichia coli CFT073
aggccguacagcccagg

SEQ ID NO: 655394 - RNA, 22 nt, Escherichia coli CFT073
aggccuugaacucugaaucgcu

SEQ ID NO: 655395 - RNA, 12 nt, Escherichia coli CFT073
aggccugcugaa

SEQ ID NO: 655396 - RNA, 19 nt, Escherichia coli CFT073
aggccugcaaaaucuguug

SEQ ID NO: 655397 - RNA, 12 nt, Escherichia coli CFT073
aggcgagcugcc

SEQ ID NO: 655398 - RNA, 21 nt, Escherichia coli CFT073
aggcgacgguuuccaggcagc

SEQ ID NO: 655399 - RNA, 20 nt, Escherichia coli CFT073
aggcgacucgguugcacaga

SEQ ID NO: 655400 - RNA, 18 nt, Escherichia coli CFT073
aggcgaauguacgucagg

SEQ ID NO: 655401 - RNA, 21 nt, Escherichia coli CFT073
aggcgacacuucguuaaccac

SEQ ID NO: 655402 - RNA, 21 nt, Escherichia coli CFT073
aggcgacauaucauuuugcug

SEQ ID NO: 655403 - RNA, 17 nt, Escherichia coli CFT073
aggcgaccguuuucacc

SEQ ID NO: 655404 - RNA, 18 nt, Escherichia coli CFT073
aggcgcauugcuggcugc

SEQ ID NO: 655405 - RNA, 22 nt, Escherichia coli CFT073
aggcgcauugcuggcugcggga

SEQ ID NO: 655406 - RNA, 16 nt, Escherichia coli CFT073
aggcgaugaaauucac

SEQ ID NO: 655407 - RNA, 13 nt, Escherichia coli CFT073
aggcgcagaacuu

SEQ ID NO: 655408 - RNA, 15 nt, Escherichia coli CFT073
aggcgcaaccuucac

SEQ ID NO: 655409 - RNA, 14 nt, Escherichia coli CFT073
aggcgcuaaaagca

SEQ ID NO: 655410 - RNA, 23 nt, Escherichia coli CFT073
aggcgcuaaaagcauagccccag

SEQ ID NO: 655411 - RNA, 19 nt, Escherichia coli CFT073
aggcgcggacauacgcauc

SEQ ID NO: 655412 - RNA, 16 nt, Escherichia coli CFT073
aggcgcugcuggagca

SEQ ID NO: 655413 - RNA, 21 nt, Escherichia coli CFT073
aggcgcugguaaucaccaccc

SEQ ID NO: 655414 - RNA, 21 nt, Escherichia coli CFT073
aggcgcuuaucgucccaggca

SEQ ID NO: 655415 - RNA, 15 nt, Escherichia coli CFT073
aggcggcucaccugc

SEQ ID NO: 655416 - RNA, 17 nt, Escherichia coli CFT073
aggcggcucaccugcac

SEQ ID NO: 655417 - RNA, 17 nt, Escherichia coli CFT073
aggcggcucaucacccc

SEQ ID NO: 655418 - RNA, 15 nt, Escherichia coli CFT073
aggcguaauauaaaa

SEQ ID NO: 655419 - RNA, 23 nt, Escherichia coli CFT073
aggcgguuacgccgcauccgaca

SEQ ID NO: 655420 - RNA, 16 nt, Escherichia coli CFT073
aggcgguggaacaagu

SEQ ID NO: 655421 - RNA, 18 nt, Escherichia coli CFT073
aggcugauguugauaaag

SEQ ID NO: 655422 - RNA, 14 nt, Escherichia coli CFT073
aggcugaggcguuu

SEQ ID NO: 655423 - RNA, 19 nt, Escherichia coli CFT073
aggcugaggcguuucaacu

SEQ ID NO: 655424 - RNA, 19 nt, Escherichia coli CFT073
aggcugacggcguuugguu

SEQ ID NO: 655425 - RNA, 16 nt, Escherichia coli CFT073
aggcucucauuuuuca

SEQ ID NO: 655426 - RNA, 20 nt, Escherichia coli CFT073
aggcucugauugccuuccac

SEQ ID NO: 655427 - RNA, 19 nt, Escherichia coli CFT073
aggcugaaaaucuucucuc

SEQ ID NO: 655428 - RNA, 15 nt, Escherichia coli CFT073
aggcuccagauaaca

SEQ ID NO: 655429 - RNA, 22 nt, Escherichia coli CFT073
aggcuaauaccgucgaugccaa

SEQ ID NO: 655430 - RNA, 23 nt, Escherichia coli CFT073
aggcuaauaccgucgaugccaau

SEQ ID NO: 655431 - RNA, 15 nt, Escherichia coli CFT073
aggcguuuuccagau

SEQ ID NO: 655432 - RNA, 16 nt, Escherichia coli CFT073
aggcuacgcagcaugg

SEQ ID NO: 655433 - RNA, 16 nt, Escherichia coli CFT073
aggcuaucggccaggu

SEQ ID NO: 655434 - RNA, 20 nt, Escherichia coli CFT073
aggcuauagcagguaaaacg

SEQ ID NO: 655435 - RNA, 13 nt, Escherichia coli CFT073
aggcuacucccag

SEQ ID NO: 655436 - RNA, 12 nt, Escherichia coli CFT073
aggcguuuaugc

SEQ ID NO: 655437 - RNA, 17 nt, Escherichia coli CFT073
aggcguuaacagcgcau

SEQ ID NO: 655438 - RNA, 15 nt, Escherichia coli CFT073
aggcgugcagcgugc

SEQ ID NO: 655439 - RNA, 17 nt, Escherichia coli CFT073
aggcgugaagccccaac

SEQ ID NO: 655440 - RNA, 10 nt, Escherichia coli CFT073
aguaaauggu

SEQ ID NO: 655441 - RNA, 17 nt, Escherichia coli CFT073
aguaaauggugauauca

SEQ ID NO: 655442 - RNA, 16 nt, Escherichia coli CFT073
aguaaauauugucgau

SEQ ID NO: 655443 - RNA, 13 nt, Escherichia coli CFT073
aguaaauccauaa

SEQ ID NO: 655444 - RNA, 20 nt, Escherichia coli CFT073
aguaaaucgucuguuugcgu

SEQ ID NO: 655445 - RNA, 17 nt, Escherichia coli CFT073
aguaacagucaguuauc

SEQ ID NO: 655446 - RNA, 21 nt, Escherichia coli CFT073
aguaaauuucgcgcuccggca

SEQ ID NO: 655447 - RNA, 17 nt, Escherichia coli CFT073
aguaacaaaugugccau

SEQ ID NO: 655448 - RNA, 15 nt, Escherichia coli CFT073
aguaaccuuugaaca

SEQ ID NO: 655449 - RNA, 22 nt, Escherichia coli CFT073
aguaaccuucgcggcacuggua

SEQ ID NO: 655450 - RNA, 15 nt, Escherichia coli CFT073
aguaacccagcacca

SEQ ID NO: 655451 - RNA, 17 nt, Escherichia coli CFT073
aguaacguuugauuaac

SEQ ID NO: 655452 - RNA, 14 nt, Escherichia coli CFT073
aguaacgcggcaau

SEQ ID NO: 655453 - RNA, 15 nt, Escherichia coli CFT073
aguaacucauugcca

SEQ ID NO: 655454 - RNA, 21 nt, Escherichia coli CFT073
aguaagcaaucacuuuuuacc

SEQ ID NO: 655455 - RNA, 17 nt, Escherichia coli CFT073
aguaagcguuuucucaa

SEQ ID NO: 655456 - RNA, 21 nt, Escherichia coli CFT073
aguaagcguuuucucaaaaaa

SEQ ID NO: 655457 - RNA, 20 nt, Escherichia coli CFT073
aguaagaggaggacagccag

SEQ ID NO: 655458 - RNA, 20 nt, Escherichia coli CFT073
aguaacuuccccuuucacau

SEQ ID NO: 655459 - RNA, 13 nt, Escherichia coli CFT073
aguaacugcugua

SEQ ID NO: 655460 - RNA, 17 nt, Escherichia coli CFT073
aguaacugugaucauau

SEQ ID NO: 655461 - RNA, 16 nt, Escherichia coli CFT073
aguaagaauaaaacgc

SEQ ID NO: 655462 - RNA, 21 nt, Escherichia coli CFT073
aguaagucuuccggugcauca

SEQ ID NO: 655463 - RNA, 20 nt, Escherichia coli CFT073
aguaaguucacacucugcuu

SEQ ID NO: 655464 - RNA, 22 nt, Escherichia coli CFT073
aguaauaaagacgguggcacau

SEQ ID NO: 655465 - RNA, 14 nt, Escherichia coli CFT073
aguaauagccugau

SEQ ID NO: 655466 - RNA, 17 nt, Escherichia coli CFT073
aguaauagccugaugua

SEQ ID NO: 655467 - RNA, 18 nt, Escherichia coli CFT073
aguaauauccccagccua

SEQ ID NO: 655468 - RNA, 14 nt, Escherichia coli CFT073
aguaauuccacacc

SEQ ID NO: 655469 - RNA, 16 nt, Escherichia coli CFT073
aguaauuuugcucacc

SEQ ID NO: 655470 - RNA, 21 nt, Escherichia coli CFT073
aguaaugccggaggcaaguuu

SEQ ID NO: 655471 - RNA, 15 nt, Escherichia coli CFT073
aguaaugcgcccaug

SEQ ID NO: 655472 - RNA, 22 nt, Escherichia coli CFT073
aguaaugguuuuauugcccugu

SEQ ID NO: 655473 - RNA, 20 nt, Escherichia coli CFT073
aguaauguuuucuuuaccac

SEQ ID NO: 655474 - RNA, 14 nt, Escherichia coli CFT073
aguaauuaaacuga

SEQ ID NO: 655475 - RNA, 20 nt, Escherichia coli CFT073
aguaaugacgaccgggagau

SEQ ID NO: 655476 - RNA, 19 nt, Escherichia coli CFT073
aguaaugaucacuggaaga

SEQ ID NO: 655477 - RNA, 10 nt, Escherichia coli CFT073
aguaaugaaa

SEQ ID NO: 655478 - RNA, 13 nt, Escherichia coli CFT073
aguaaucacgaau

SEQ ID NO: 655479 - RNA, 19 nt, Escherichia coli CFT073
aguaaucaggcuaucuucg

SEQ ID NO: 655480 - RNA, 13 nt, Escherichia coli CFT073
aguaauccagcaa

SEQ ID NO: 655481 - RNA, 18 nt, Escherichia coli CFT073
aguaaucaaucaccucuu

SEQ ID NO: 655482 - RNA, 12 nt, Escherichia coli CFT073
aguaauuuuucu

SEQ ID NO: 655483 - RNA, 19 nt, Escherichia coli CFT073
aguacaacgccgauuaaua

SEQ ID NO: 655484 - RNA, 22 nt, Escherichia coli CFT073
aguacacugguucccaacaaca

SEQ ID NO: 655485 - RNA, 21 nt, Escherichia coli CFT073
aguacaccgccguugauuuca

SEQ ID NO: 655486 - RNA, 17 nt, Escherichia coli CFT073
aguacagccgccagaca

SEQ ID NO: 655487 - RNA, 16 nt, Escherichia coli CFT073
aguacauuguuuucca

SEQ ID NO: 655488 - RNA, 23 nt, Escherichia coli CFT073
aguaccaucguccagcagcaaug

SEQ ID NO: 655489 - RNA, 18 nt, Escherichia coli CFT073
aguaccaucguccagcag

SEQ ID NO: 655490 - RNA, 18 nt, Escherichia coli CFT073
aguaccauugaagcaauc

SEQ ID NO: 655491 - RNA, 18 nt, Escherichia coli CFT073
aguaccaggcaauaaaca

SEQ ID NO: 655492 - RNA, 13 nt, Escherichia coli CFT073
aguaccagcagcg

SEQ ID NO: 655493 - RNA, 18 nt, Escherichia coli CFT073
aguaccagcccgccgaga

SEQ ID NO: 655494 - RNA, 17 nt, Escherichia coli CFT073
aguaccaaagccucaau

SEQ ID NO: 655495 - RNA, 20 nt, Escherichia coli CFT073
aggugucaauaauauuugua

SEQ ID NO: 655496 - RNA, 17 nt, Escherichia coli CFT073
agguguauugcccgccg

SEQ ID NO: 655497 - RNA, 21 nt, Escherichia coli CFT073
aggugugaaaccuuuaugcag

SEQ ID NO: 655498 - RNA, 20 nt, Escherichia coli CFT073
aggugucgcgcacucuacuc

SEQ ID NO: 655499 - RNA, 17 nt, Escherichia coli CFT073
agguuaaaguacucuuu

SEQ ID NO: 655500 - RNA, 13 nt, Escherichia coli CFT073
agguuaauauuuu

SEQ ID NO: 655501 - RNA, 17 nt, Escherichia coli CFT073
agguuaauauuuucgcc

SEQ ID NO: 655502 - RNA, 18 nt, Escherichia coli CFT073
agguuacggucgccguaa

SEQ ID NO: 655503 - RNA, 14 nt, Escherichia coli CFT073
agguuaacccacag

SEQ ID NO: 655504 - RNA, 19 nt, Escherichia coli CFT073
agguuaacccacagcgcac

SEQ ID NO: 655505 - RNA, 17 nt, Escherichia coli CFT073
agguuaacgaaggugaa

SEQ ID NO: 655506 - RNA, 17 nt, Escherichia coli CFT073
agguuauaaacccccug

SEQ ID NO: 655507 - RNA, 22 nt, Escherichia coli CFT073
agguuccggcaaucaacagaua

SEQ ID NO: 655508 - RNA, 21 nt, Escherichia coli CFT073
agguucaguccguugcaguuu

SEQ ID NO: 655509 - RNA, 18 nt, Escherichia coli CFT073
agguugccggucuuucuu

SEQ ID NO: 655510 - RNA, 19 nt, Escherichia coli CFT073
agguugccggucuuucuuu

SEQ ID NO: 655511 - RNA, 13 nt, Escherichia coli CFT073
aguaaauacugcg

SEQ ID NO: 655512 - RNA, 13 nt, Escherichia coli CFT073
aguaaauaaaaaa

SEQ ID NO: 655513 - RNA, 12 nt, Escherichia coli CFT073
aguaaauaaccu

SEQ ID NO: 655514 - RNA, 12 nt, Escherichia coli CFT073
aguaaacgguga

SEQ ID NO: 655515 - RNA, 16 nt, Escherichia coli CFT073
aguaaaaaaacaucau

SEQ ID NO: 655516 - RNA, 17 nt, Escherichia coli CFT073
aguaaaaaaacaucaua

SEQ ID NO: 655517 - RNA, 15 nt, Escherichia coli CFT073
aguaaacaucuucuu

SEQ ID NO: 655518 - RNA, 20 nt, Escherichia coli CFT073
agguugucgaguagaaagag

SEQ ID NO: 655519 - RNA, 14 nt, Escherichia coli CFT073
agguugugaaugag

SEQ ID NO: 655520 - RNA, 17 nt, Escherichia coli CFT073
agguuuaaccaucaggc

SEQ ID NO: 655521 - RNA, 17 nt, Escherichia coli CFT073
agguuucgaccacaccu

SEQ ID NO: 655522 - RNA, 11 nt, Escherichia coli CFT073
agguuucugcc

SEQ ID NO: 655523 - RNA, 16 nt, Escherichia coli CFT073
agguuucccgccguaa

SEQ ID NO: 655524 - RNA, 13 nt, Escherichia coli CFT073
agguuuccggguc

SEQ ID NO: 655525 - RNA, 19 nt, Escherichia coli CFT073
agguuuaccagcagcccug

SEQ ID NO: 655526 - RNA, 15 nt, Escherichia coli CFT073
agguuuaccagcagc

SEQ ID NO: 655527 - RNA, 20 nt, Escherichia coli CFT073
agguuucacguaccagaugc

SEQ ID NO: 655528 - RNA, 16 nt, Escherichia coli CFT073
agguuuguacaacgua

SEQ ID NO: 655529 - RNA, 16 nt, Escherichia coli CFT073
agguuuuaguuucgcc

SEQ ID NO: 655530 - RNA, 20 nt, Escherichia coli CFT073
agguuuuuacccaacucuuu

SEQ ID NO: 655531 - RNA, 16 nt, Escherichia coli CFT073
agguuuuucagcugcc

SEQ ID NO: 655532 - RNA, 20 nt, Escherichia coli CFT073
agguuuuguagcuaaacuga

SEQ ID NO: 655533 - RNA, 20 nt, Escherichia coli CFT073
agguuuucuuucaccucuuc

SEQ ID NO: 655534 - RNA, 13 nt, Escherichia coli CFT073
agguuuuccuucg

SEQ ID NO: 655535 - RNA, 18 nt, Escherichia coli CFT073
aggugacgcuggcagcag

SEQ ID NO: 655536 - RNA, 19 nt, Escherichia coli CFT073
aggugacauuaaagcuuua

SEQ ID NO: 655537 - RNA, 14 nt, Escherichia coli CFT073
aggugauacaucaa

SEQ ID NO: 655538 - RNA, 12 nt, Escherichia coli CFT073
aggugcccgcgu

SEQ ID NO: 655539 - RNA, 14 nt, Escherichia coli CFT073
aggugccacagcag

SEQ ID NO: 655540 - RNA, 23 nt, Escherichia coli CFT073
aggugguauagaaugcagcagca

SEQ ID NO: 655541 - RNA, 18 nt, Escherichia coli CFT073
aggugguuaccgccagca

SEQ ID NO: 655542 - RNA, 17 nt, Escherichia coli CFT073
agguggccgagaggcug

SEQ ID NO: 655543 - RNA, 18 nt, Escherichia coli CFT073
aggucagguuugacauaa

SEQ ID NO: 655544 - RNA, 15 nt, Escherichia coli CFT073
aggucauaucaucaa

SEQ ID NO: 655545 - RNA, 15 nt, Escherichia coli CFT073
aggucgaaaauaauc

SEQ ID NO: 655546 - RNA, 21 nt, Escherichia coli CFT073
aggugaacgccaccaacgcac

SEQ ID NO: 655547 - RNA, 13 nt, Escherichia coli CFT073
aggucgugccaga

SEQ ID NO: 655548 - RNA, 20 nt, Escherichia coli CFT073
agggucuuuuaaauccugca

SEQ ID NO: 655549 - RNA, 19 nt, Escherichia coli CFT073
agggugacagcaggaaaau

SEQ ID NO: 655550 - RNA, 17 nt, Escherichia coli CFT073
agggucgcguuccaggc

SEQ ID NO: 655551 - RNA, 14 nt, Escherichia coli CFT073
aggguauccaggcc

SEQ ID NO: 655552 - RNA, 16 nt, Escherichia coli CFT073
aggguggggaaaaaac

SEQ ID NO: 655553 - RNA, 18 nt, Escherichia coli CFT073
agggugcagaaucaaucu

SEQ ID NO: 655554 - RNA, 12 nt, Escherichia coli CFT073
agguaacaggga

SEQ ID NO: 655555 - RNA, 17 nt, Escherichia coli CFT073
agguaacucucaugcuu

SEQ ID NO: 655556 - RNA, 18 nt, Escherichia coli CFT073
agguaacgucgguuucau

SEQ ID NO: 655557 - RNA, 19 nt, Escherichia coli CFT073
agguaagaguuucaacauc

SEQ ID NO: 655558 - RNA, 13 nt, Escherichia coli CFT073
agguaagcaacag

SEQ ID NO: 655559 - RNA, 23 nt, Escherichia coli CFT073
aggguuucuucaaacugcagcag

SEQ ID NO: 655560 - RNA, 12 nt, Escherichia coli CFT073
agguaaaacaag

SEQ ID NO: 655561 - RNA, 12 nt, Escherichia coli CFT073
agguacaaagcc

SEQ ID NO: 655562 - RNA, 16 nt, Escherichia coli CFT073
agguaauugcuuucuu

SEQ ID NO: 655563 - RNA, 18 nt, Escherichia coli CFT073
agguaauggcguuaucac

SEQ ID NO: 655564 - RNA, 19 nt, Escherichia coli CFT073
agguaaugguuaguacacc

SEQ ID NO: 655565 - RNA, 14 nt, Escherichia coli CFT073
agguagcagcagcg

SEQ ID NO: 655566 - RNA, 19 nt, Escherichia coli CFT073
agguagcgauagaaaucag

SEQ ID NO: 655567 - RNA, 22 nt, Escherichia coli CFT073
agguagcguuucaccucuuuca

SEQ ID NO: 655568 - RNA, 17 nt, Escherichia coli CFT073
agguaguuaaucaguac

SEQ ID NO: 655569 - RNA, 17 nt, Escherichia coli CFT073
agguaucguuacgccag

SEQ ID NO: 655570 - RNA, 18 nt, Escherichia coli CFT073
aggucaccagagauaaaa

SEQ ID NO: 655571 - RNA, 20 nt, Escherichia coli CFT073
aggucagagagccagcccca

SEQ ID NO: 655572 - RNA, 13 nt, Escherichia coli CFT073
aggucagagagcc

SEQ ID NO: 655573 - RNA, 17 nt, Escherichia coli CFT073
aggucagagagccagcc

SEQ ID NO: 655574 - RNA, 13 nt, Escherichia coli CFT073
aggucaaugcaac

SEQ ID NO: 655575 - RNA, 21 nt, Escherichia coli CFT073
agguauugcuaagcucucagc

SEQ ID NO: 655576 - RNA, 22 nt, Escherichia coli CFT073
agguauugcuaagcucucagca

SEQ ID NO: 655577 - RNA, 17 nt, Escherichia coli CFT073
agguauuucgucuaagc

SEQ ID NO: 655578 - RNA, 22 nt, Escherichia coli CFT073
aucagcggugccgcgauaccac

SEQ ID NO: 655579 - RNA, 23 nt, Escherichia coli CFT073
aucagcggcggcgcaaccaucag

SEQ ID NO: 655580 - RNA, 16 nt, Escherichia coli CFT073
aucagcggacgcugcu

SEQ ID NO: 655581 - RNA, 15 nt, Escherichia coli CFT073
aucagcgccagcgcg

SEQ ID NO: 655582 - RNA, 17 nt, Escherichia coli CFT073
aucagcgccaucgccag

SEQ ID NO: 655583 - RNA, 19 nt, Escherichia coli CFT073
aucagcgcagcacccagaa

SEQ ID NO: 655584 - RNA, 14 nt, Escherichia coli CFT073
aucagcgccagcgc

SEQ ID NO: 655585 - RNA, 19 nt, Escherichia coli CFT073
aucagccuuaaucuucacu

SEQ ID NO: 655586 - RNA, 16 nt, Escherichia coli CFT073
aucagcccugcccaga

SEQ ID NO: 655587 - RNA, 19 nt, Escherichia coli CFT073
aucagcccaaaaauugccc

SEQ ID NO: 655588 - RNA, 18 nt, Escherichia coli CFT073
aucagccauaauaaccuc

SEQ ID NO: 655589 - RNA, 17 nt, Escherichia coli CFT073
aucagcaucucauccau

SEQ ID NO: 655590 - RNA, 17 nt, Escherichia coli CFT073
aucagcauacuccagcc

SEQ ID NO: 655591 - RNA, 19 nt, Escherichia coli CFT073
aucagcaucccaccugaaa

SEQ ID NO: 655592 - RNA, 20 nt, Escherichia coli CFT073
aucagcauauuuggcgcugg

SEQ ID NO: 655593 - RNA, 18 nt, Escherichia coli CFT073
aucagcaucaacccgcuc

SEQ ID NO: 655594 - RNA, 12 nt, Escherichia coli CFT073
aucagcaguauc

SEQ ID NO: 655595 - RNA, 18 nt, Escherichia coli CFT073
aucagcagcguucccagc

SEQ ID NO: 655596 - RNA, 21 nt, Escherichia coli CFT073
aucagcagcguucccagccag

SEQ ID NO: 655597 - RNA, 22 nt, Escherichia coli CFT073
aucagccacuucaaccagcggc

SEQ ID NO: 655598 - RNA, 19 nt, Escherichia coli CFT073
aucagcaucucauccauca

SEQ ID NO: 655599 - RNA, 16 nt, Escherichia coli CFT073
aucagcaugacaaaaa

SEQ ID NO: 655600 - RNA, 17 nt, Escherichia coli CFT073
aucagcaugacaaaaaa

SEQ ID NO: 655601 - RNA, 22 nt, Escherichia coli CFT073
aucagcaugacaaaaaagccaa

SEQ ID NO: 655602 - RNA, 14 nt, Escherichia coli CFT073
aucagcaaaauggc

SEQ ID NO: 655603 - RNA, 23 nt, Escherichia coli CFT073
aucagcaaacugguugaaauaaa

SEQ ID NO: 655604 - RNA, 18 nt, Escherichia coli CFT073
aucagcagauaucccgcc

SEQ ID NO: 655605 - RNA, 15 nt, Escherichia coli CFT073
aucagcagcacaaac

SEQ ID NO: 655606 - RNA, 18 nt, Escherichia coli CFT073
aucagaaacaaauacaug

SEQ ID NO: 655607 - RNA, 17 nt, Escherichia coli CFT073
aucagaauccggugccu

SEQ ID NO: 655608 - RNA, 14 nt, Escherichia coli CFT073
aucagaaaugccag

SEQ ID NO: 655609 - RNA, 19 nt, Escherichia coli CFT073
aucagaaaugccaguaacu

SEQ ID NO: 655610 - RNA, 15 nt, Escherichia coli CFT073
aucagaagauuaaga

SEQ ID NO: 655611 - RNA, 20 nt, Escherichia coli CFT073
aucagaacgcagcauuuccu

SEQ ID NO: 655612 - RNA, 22 nt, Escherichia coli CFT073
aucacuuaggccuacuaccagu

SEQ ID NO: 655613 - RNA, 15 nt, Escherichia coli CFT073
aucacuuccagcagu

SEQ ID NO: 655614 - RNA, 14 nt, Escherichia coli CFT073
aucacuggccucuu

SEQ ID NO: 655615 - RNA, 18 nt, Escherichia coli CFT073
aucacuggccucuucucu

SEQ ID NO: 655616 - RNA, 17 nt, Escherichia coli CFT073
aucacuuugcagaaaau

SEQ ID NO: 655617 - RNA, 16 nt, Escherichia coli CFT073
aucacuuucaccggug

SEQ ID NO: 655618 - RNA, 23 nt, Escherichia coli CFT073
aucacuuguaguuacauuuuuau

SEQ ID NO: 655619 - RNA, 19 nt, Escherichia coli CFT073
aucagaaugcgcucuuccg

SEQ ID NO: 655620 - RNA, 23 nt, Escherichia coli CFT073
aucagacaccggcgcacaaccgc

SEQ ID NO: 655621 - RNA, 21 nt, Escherichia coli CFT073
aucagacccacccaacauggu

SEQ ID NO: 655622 - RNA, 19 nt, Escherichia coli CFT073
aucagacugcuuuucccuu

SEQ ID NO: 655623 - RNA, 20 nt, Escherichia coli CFT073
aucagaccgccaaucagcau

SEQ ID NO: 655624 - RNA, 20 nt, Escherichia coli CFT073
aucagaccuacggauucaau

SEQ ID NO: 655625 - RNA, 18 nt, Escherichia coli CFT073
aucagaguacagauucaa

SEQ ID NO: 655626 - RNA, 16 nt, Escherichia coli CFT073
aucagauggcggcugg

SEQ ID NO: 655627 - RNA, 19 nt, Escherichia coli CFT073
aucagauggcggcuggcgc

SEQ ID NO: 655628 - RNA, 13 nt, Escherichia coli CFT073
aucagauccgcac

SEQ ID NO: 655629 - RNA, 20 nt, Escherichia coli CFT073
aucagauucgauagagaacg

SEQ ID NO: 655630 - RNA, 22 nt, Escherichia coli CFT073
aucagauugaugcgaguaauca

SEQ ID NO: 655631 - RNA, 19 nt, Escherichia coli CFT073
aucacgcacucgacgcagc

SEQ ID NO: 655632 - RNA, 17 nt, Escherichia coli CFT073
aucacgcacugcaauau

SEQ ID NO: 655633 - RNA, 17 nt, Escherichia coli CFT073
aucacgcagcaagccgu

SEQ ID NO: 655634 - RNA, 12 nt, Escherichia coli CFT073
aucacgcagcug

SEQ ID NO: 655635 - RNA, 18 nt, Escherichia coli CFT073
aucacgcucaacuuccug

SEQ ID NO: 655636 - RNA, 13 nt, Escherichia coli CFT073
aucacgcugccaa

SEQ ID NO: 655637 - RNA, 15 nt, Escherichia coli CFT073
aucacgcgccugcca

SEQ ID NO: 655638 - RNA, 14 nt, Escherichia coli CFT073
aucacgcccgccag

SEQ ID NO: 655639 - RNA, 13 nt, Escherichia coli CFT073
aucacgcaucacc

SEQ ID NO: 655640 - RNA, 21 nt, Escherichia coli CFT073
aucacucacgacacauaaaua

SEQ ID NO: 655641 - RNA, 18 nt, Escherichia coli CFT073
aucacucccuuucugcca

SEQ ID NO: 655642 - RNA, 19 nt, Escherichia coli CFT073
aucacucggggcuuuucuc

SEQ ID NO: 655643 - RNA, 16 nt, Escherichia coli CFT073
aucacucgugauaacc

SEQ ID NO: 655644 - RNA, 22 nt, Escherichia coli CFT073
aucacucuuuucgccgagcagg

SEQ ID NO: 655645 - RNA, 13 nt, Escherichia coli CFT073
aucacugaaauug

SEQ ID NO: 655646 - RNA, 15 nt, Escherichia coli CFT073
aucacugccaccagg

SEQ ID NO: 655647 - RNA, 12 nt, Escherichia coli CFT073
aucacguagcca

SEQ ID NO: 655648 - RNA, 14 nt, Escherichia coli CFT073
aucacguagccacg

SEQ ID NO: 655649 - RNA, 15 nt, Escherichia coli CFT073
aucaccacagacaaa

SEQ ID NO: 655650 - RNA, 15 nt, Escherichia coli CFT073
aucaccacauacugc

SEQ ID NO: 655651 - RNA, 13 nt, Escherichia coli CFT073
aucaccaaacugc

SEQ ID NO: 655652 - RNA, 18 nt, Escherichia coli CFT073
aucaccaacgauuuuuuc

SEQ ID NO: 655653 - RNA, 15 nt, Escherichia coli CFT073
aucaccaauaccagc

SEQ ID NO: 655654 - RNA, 18 nt, Escherichia coli CFT073
aucacauuaaauuuaugu

SEQ ID NO: 655655 - RNA, 21 nt, Escherichia coli CFT073
aucacaugcuggaaccacagc

SEQ ID NO: 655656 - RNA, 15 nt, Escherichia coli CFT073
aucacauccugauag

SEQ ID NO: 655657 - RNA, 22 nt, Escherichia coli CFT073
aucacaugcggcgugccuucac

SEQ ID NO: 655658 - RNA, 13 nt, Escherichia coli CFT073
aucacaggcgcga

SEQ ID NO: 655659 - RNA, 21 nt, Escherichia coli CFT073
aucacagagccugacauuucc

SEQ ID NO: 655660 - RNA, 22 nt, Escherichia coli CFT073
aucacagagccugacauuuccg

SEQ ID NO: 655661 - RNA, 14 nt, Escherichia coli CFT073
aucacagcaccuua

SEQ ID NO: 655662 - RNA, 15 nt, Escherichia coli CFT073
aucacaucaggcuga

SEQ ID NO: 655663 - RNA, 18 nt, Escherichia coli CFT073
aucacauccggcaauauc

SEQ ID NO: 655664 - RNA, 20 nt, Escherichia coli CFT073
aucacauccggcaauaucca

SEQ ID NO: 655665 - RNA, 11 nt, Escherichia coli CFT073
aucaccucuuc

SEQ ID NO: 655666 - RNA, 14 nt, Escherichia coli CFT073
aucaccucuucacc

SEQ ID NO: 655667 - RNA, 16 nt, Escherichia coli CFT073
aucaccguagaaggcg

SEQ ID NO: 655668 - RNA, 16 nt, Escherichia coli CFT073
aucaccggcaaaacca

SEQ ID NO: 655669 - RNA, 21 nt, Escherichia coli CFT073
aucaccggcacaaaacuguau

SEQ ID NO: 655670 - RNA, 20 nt, Escherichia coli CFT073
aucaccggcauuuuuugcug

SEQ ID NO: 655671 - RNA, 19 nt, Escherichia coli CFT073
aucaccgaugacagaauca

SEQ ID NO: 655672 - RNA, 20 nt, Escherichia coli CFT073
aucaccgaugacagaaucag

SEQ ID NO: 655673 - RNA, 17 nt, Escherichia coli CFT073
aucaccgcacggcgagu

SEQ ID NO: 655674 - RNA, 13 nt, Escherichia coli CFT073
aucaccccgagcg

SEQ ID NO: 655675 - RNA, 20 nt, Escherichia coli CFT073
aucaccccgcgcucacacca

SEQ ID NO: 655676 - RNA, 15 nt, Escherichia coli CFT073
aucacccgagagaac

SEQ ID NO: 655677 - RNA, 16 nt, Escherichia coli CFT073
aucaccaucagcagca

SEQ ID NO: 655678 - RNA, 20 nt, Escherichia coli CFT073
aucaccaguaccgccgccau

SEQ ID NO: 655679 - RNA, 14 nt, Escherichia coli CFT073
aucaaguugauuuu

SEQ ID NO: 655680 - RNA, 18 nt, Escherichia coli CFT073
aucaauagugaacugacu

SEQ ID NO: 655681 - RNA, 14 nt, Escherichia coli CFT073
aucaauuaauccag

SEQ ID NO: 655682 - RNA, 14 nt, Escherichia coli CFT073
aucaauuaucuguu

SEQ ID NO: 655683 - RNA, 14 nt, Escherichia coli CFT073
aucaauucaucgcu

SEQ ID NO: 655684 - RNA, 17 nt, Escherichia coli CFT073
aucaauggauucaugau

SEQ ID NO: 655685 - RNA, 22 nt, Escherichia coli CFT073
aucaauucucgccaguguucuu

SEQ ID NO: 655686 - RNA, 18 nt, Escherichia coli CFT073
aucaauucuuuuucugaa

SEQ ID NO: 655687 - RNA, 21 nt, Escherichia coli CFT073
aucaauugaugcuuuuugccc

SEQ ID NO: 655688 - RNA, 22 nt, Escherichia coli CFT073
aucaauugaugcuuuuugcccu

SEQ ID NO: 655689 - RNA, 20 nt, Escherichia coli CFT073
aucaauugcguuaaaaucag

SEQ ID NO: 655690 - RNA, 21 nt, Escherichia coli CFT073
aucaauuuaucguauuggccg

SEQ ID NO: 655691 - RNA, 17 nt, Escherichia coli CFT073
aucaauuucuucaggau

SEQ ID NO: 655692 - RNA, 20 nt, Escherichia coli CFT073
aucaauuugcuucuggcugg

SEQ ID NO: 655693 - RNA, 12 nt, Escherichia coli CFT073
aucacaaaauag

SEQ ID NO: 655694 - RNA, 15 nt, Escherichia coli CFT073
aucacaauaaucgcc

SEQ ID NO: 655695 - RNA, 19 nt, Escherichia coli CFT073
aucacaaugccgccaauaa

SEQ ID NO: 655696 - RNA, 21 nt, Escherichia coli CFT073
aucacaaugccgccaauaaug

SEQ ID NO: 655697 - RNA, 16 nt, Escherichia coli CFT073
aucacaccauccagca

SEQ ID NO: 655698 - RNA, 17 nt, Escherichia coli CFT073
aucacaccauccagcaa

SEQ ID NO: 655699 - RNA, 20 nt, Escherichia coli CFT073
aucacaccauccagcaacaa

SEQ ID NO: 655700 - RNA, 23 nt, Escherichia coli CFT073
aucacacagcgguuuaccgaugc

SEQ ID NO: 655701 - RNA, 18 nt, Escherichia coli CFT073
aucacaccucguauucca

SEQ ID NO: 655702 - RNA, 18 nt, Escherichia coli CFT073
aucaacgcuacguuauuu

SEQ ID NO: 655703 - RNA, 16 nt, Escherichia coli CFT073
aucaacgcacuggcgc

SEQ ID NO: 655704 - RNA, 16 nt, Escherichia coli CFT073
aucaacgccagauaaa

SEQ ID NO: 655705 - RNA, 16 nt, Escherichia coli CFT073
aucaagcgaaaaugcu

SEQ ID NO: 655706 - RNA, 18 nt, Escherichia coli CFT073
aucaagcgaaaucaacac

SEQ ID NO: 655707 - RNA, 12 nt, Escherichia coli CFT073
aucaagcaccaa

SEQ ID NO: 655708 - RNA, 18 nt, Escherichia coli CFT073
aucaagcauuuucucacu

SEQ ID NO: 655709 - RNA, 17 nt, Escherichia coli CFT073
aucaagugaacuuucuc

SEQ ID NO: 655710 - RNA, 20 nt, Escherichia coli CFT073
aucaagugaacuuucucugu

SEQ ID NO: 655711 - RNA, 18 nt, Escherichia coli CFT073
aucaagguugcacaacca

SEQ ID NO: 655712 - RNA, 19 nt, Escherichia coli CFT073
aucaaggcaguugcccuug

SEQ ID NO: 655713 - RNA, 19 nt, Escherichia coli CFT073
aucaaggcauauaccacac

SEQ ID NO: 655714 - RNA, 17 nt, Escherichia coli CFT073
aucaagcuguuccuccc

SEQ ID NO: 655715 - RNA, 14 nt, Escherichia coli CFT073
aucaagcugugccu

SEQ ID NO: 655716 - RNA, 17 nt, Escherichia coli CFT073
aucaagcugaguauuaa

SEQ ID NO: 655717 - RNA, 13 nt, Escherichia coli CFT073
aucaagcuggcgc

SEQ ID NO: 655718 - RNA, 17 nt, Escherichia coli CFT073
aucaagcggcgcaugca

SEQ ID NO: 655719 - RNA, 20 nt, Escherichia coli CFT073
aucaagcggcgcaugcaggc

SEQ ID NO: 655720 - RNA, 23 nt, Escherichia coli CFT073
aucaaccagaucgcucaucugcu

SEQ ID NO: 655721 - RNA, 12 nt, Escherichia coli CFT073
aucaaccaggcc

SEQ ID NO: 655722 - RNA, 14 nt, Escherichia coli CFT073
aucaacauucagau

SEQ ID NO: 655723 - RNA, 18 nt, Escherichia coli CFT073
aucaacccgcccagugcu

SEQ ID NO: 655724 - RNA, 17 nt, Escherichia coli CFT073
aucaaccucuuuuucug

SEQ ID NO: 655725 - RNA, 22 nt, Escherichia coli CFT073
aucaaccucuuuuucugccuga

SEQ ID NO: 655726 - RNA, 21 nt, Escherichia coli CFT073
aucaaacaaccguucacgcau

SEQ ID NO: 655727 - RNA, 22 nt, Escherichia coli CFT073
aucaaacgccugaccguugauu

SEQ ID NO: 655728 - RNA, 19 nt, Escherichia coli CFT073
aucaaacgugacauucuga

SEQ ID NO: 655729 - RNA, 21 nt, Escherichia coli CFT073
aucaaacuuuuaaauugaaga

SEQ ID NO: 655730 - RNA, 16 nt, Escherichia coli CFT073
auauucaccgucacaa

SEQ ID NO: 655731 - RNA, 20 nt, Escherichia coli CFT073
auauucaauuuguuaucgcu

SEQ ID NO: 655732 - RNA, 13 nt, Escherichia coli CFT073
auauugaugcaca

SEQ ID NO: 655733 - RNA, 23 nt, Escherichia coli CFT073
auauucuugcggcguauauuggu

SEQ ID NO: 655734 - RNA, 22 nt, Escherichia coli CFT073
auauugauaauaaaaagaauga

SEQ ID NO: 655735 - RNA, 16 nt, Escherichia coli CFT073
auauucucgcccgucu

SEQ ID NO: 655736 - RNA, 22 nt, Escherichia coli CFT073
auauucuguaacucgaauuauu

SEQ ID NO: 655737 - RNA, 18 nt, Escherichia coli CFT073
auauucuguaccaaaauu

SEQ ID NO: 655738 - RNA, 11 nt, Escherichia coli CFT073
auauucguuau

SEQ ID NO: 655739 - RNA, 22 nt, Escherichia coli CFT073
auauuccugcauugcuuuugug

SEQ ID NO: 655740 - RNA, 11 nt, Escherichia coli CFT073
auauuccugca

SEQ ID NO: 655741 - RNA, 13 nt, Escherichia coli CFT073
auauucagcgcca

SEQ ID NO: 655742 - RNA, 15 nt, Escherichia coli CFT073
auauucagcgcccug

SEQ ID NO: 655743 - RNA, 13 nt, Escherichia coli CFT073
auauuuucagggg

SEQ ID NO: 655744 - RNA, 23 nt, Escherichia coli CFT073
auauuuugaaucgguggcggcag

SEQ ID NO: 655745 - RNA, 20 nt, Escherichia coli CFT073
auauuuugcuuuaaguucag

SEQ ID NO: 655746 - RNA, 13 nt, Escherichia coli CFT073
auauuuugugauu

SEQ ID NO: 655747 - RNA, 22 nt, Escherichia coli CFT073
auauuuuucaguaacggcgcuu

SEQ ID NO: 655748 - RNA, 21 nt, Escherichia coli CFT073
aucaaaaaaaucuucacugaa

SEQ ID NO: 655749 - RNA, 20 nt, Escherichia coli CFT073
auauuuuuuuccuaaacccu

SEQ ID NO: 655750 - RNA, 15 nt, Escherichia coli CFT073
auauuuuuugaaaaa

SEQ ID NO: 655751 - RNA, 19 nt, Escherichia coli CFT073
auauugccgaagaccagau

SEQ ID NO: 655752 - RNA, 18 nt, Escherichia coli CFT073
auauugcgagcucaauau

SEQ ID NO: 655753 - RNA, 17 nt, Escherichia coli CFT073
auauuuuauugauuguu

SEQ ID NO: 655754 - RNA, 15 nt, Escherichia coli CFT073
auauuuuccagcaac

SEQ ID NO: 655755 - RNA, 13 nt, Escherichia coli CFT073
auauuuaaaaacg

SEQ ID NO: 655756 - RNA, 13 nt, Escherichia coli CFT073
auaucuuucuugc

SEQ ID NO: 655757 - RNA, 18 nt, Escherichia coli CFT073
auaucuucuguugcaggg

SEQ ID NO: 655758 - RNA, 22 nt, Escherichia coli CFT073
auaucuucuugcguuuuuugau

SEQ ID NO: 655759 - RNA, 19 nt, Escherichia coli CFT073
auaucugccggaagacaca

SEQ ID NO: 655760 - RNA, 15 nt, Escherichia coli CFT073
auaucugguuaaaaa

SEQ ID NO: 655761 - RNA, 21 nt, Escherichia coli CFT073
auaucuucacgauuauuaagc

SEQ ID NO: 655762 - RNA, 22 nt, Escherichia coli CFT073
auaucauuuugcugccauguca

SEQ ID NO: 655763 - RNA, 14 nt, Escherichia coli CFT073
auaucauugaaguu

SEQ ID NO: 655764 - RNA, 12 nt, Escherichia coli CFT073
auauccagccaa

SEQ ID NO: 655765 - RNA, 16 nt, Escherichia coli CFT073
auauccagauccaaua

SEQ ID NO: 655766 - RNA, 22 nt, Escherichia coli CFT073
auauccagcgcggcgaaggugc

SEQ ID NO: 655767 - RNA, 19 nt, Escherichia coli CFT073
auauccagguuacgcaugg

SEQ ID NO: 655768 - RNA, 14 nt, Escherichia coli CFT073
auaucgacauucaa

SEQ ID NO: 655769 - RNA, 15 nt, Escherichia coli CFT073
auaucuaaaauguca

SEQ ID NO: 655770 - RNA, 15 nt, Escherichia coli CFT073
auaucuaaugccauu

SEQ ID NO: 655771 - RNA, 17 nt, Escherichia coli CFT073
auaucgccauuaaacaa

SEQ ID NO: 655772 - RNA, 19 nt, Escherichia coli CFT073
auaucgccauuaaacaacc

SEQ ID NO: 655773 - RNA, 15 nt, Escherichia coli CFT073
auaucgauaaacagc

SEQ ID NO: 655774 - RNA, 23 nt, Escherichia coli CFT073
auauauugagcucgcaauauuuu

SEQ ID NO: 655775 - RNA, 15 nt, Escherichia coli CFT073
auauacaaauagauc

SEQ ID NO: 655776 - RNA, 17 nt, Escherichia coli CFT073
auauaugucaccagcau

SEQ ID NO: 655777 - RNA, 14 nt, Escherichia coli CFT073
auaucaagcaugau

SEQ ID NO: 655778 - RNA, 19 nt, Escherichia coli CFT073
auaucaacgcccauacuca

SEQ ID NO: 655779 - RNA, 14 nt, Escherichia coli CFT073
auaucaauaacaua

SEQ ID NO: 655780 - RNA, 17 nt, Escherichia coli CFT073
auaucagcgccacauca

SEQ ID NO: 655781 - RNA, 19 nt, Escherichia coli CFT073
auaucagcgccacaucagc

SEQ ID NO: 655782 - RNA, 22 nt, Escherichia coli CFT073
auaucagccugaaugcuuucau

SEQ ID NO: 655783 - RNA, 13 nt, Escherichia coli CFT073
auaucaccugcuu

SEQ ID NO: 655784 - RNA, 23 nt, Escherichia coli CFT073
auaucaccugcuucgauagaauc

SEQ ID NO: 655785 - RNA, 22 nt, Escherichia coli CFT073
auaucaccaguaacuuccccuu

SEQ ID NO: 655786 - RNA, 20 nt, Escherichia coli CFT073
auaucacuggugaaagagcc

SEQ ID NO: 655787 - RNA, 16 nt, Escherichia coli CFT073
auauaauguaucugaa

SEQ ID NO: 655788 - RNA, 13 nt, Escherichia coli CFT073
auauaaaaucaua

SEQ ID NO: 655789 - RNA, 12 nt, Escherichia coli CFT073
auauaaccaugg

SEQ ID NO: 655790 - RNA, 22 nt, Escherichia coli CFT073
auaguuucacggcaccagccau

SEQ ID NO: 655791 - RNA, 19 nt, Escherichia coli CFT073
auagugguaccaggaucag

SEQ ID NO: 655792 - RNA, 15 nt, Escherichia coli CFT073
auagugcuucaaaua

SEQ ID NO: 655793 - RNA, 19 nt, Escherichia coli CFT073
auaguacuggaagaaaaca

SEQ ID NO: 655794 - RNA, 21 nt, Escherichia coli CFT073
auaguacuggaagaaaacauu

SEQ ID NO: 655795 - RNA, 20 nt, Escherichia coli CFT073
auaguaagccggauaauucc

SEQ ID NO: 655796 - RNA, 21 nt, Escherichia coli CFT073
auaguaagaagcaagguagug

SEQ ID NO: 655797 - RNA, 20 nt, Escherichia coli CFT073
auagguguaaauaucaggau

SEQ ID NO: 655798 - RNA, 16 nt, Escherichia coli CFT073
auagguugaaauaaac

SEQ ID NO: 655799 - RNA, 18 nt, Escherichia coli CFT073
auagguugaaauaaaccg

SEQ ID NO: 655800 - RNA, 21 nt, Escherichia coli CFT073
auagguggcaaagaaaucaac

SEQ ID NO: 655801 - RNA, 14 nt, Escherichia coli CFT073
auagguggcaaaga

SEQ ID NO: 655802 - RNA, 17 nt, Escherichia coli CFT073
auaggugguauagaaug

SEQ ID NO: 655803 - RNA, 18 nt, Escherichia coli CFT073
auagggggguaacacucu

SEQ ID NO: 655804 - RNA, 15 nt, Escherichia coli CFT073
auagguaaacaucac

SEQ ID NO: 655805 - RNA, 19 nt, Escherichia coli CFT073
auagguaaacaucacauau

SEQ ID NO: 655806 - RNA, 18 nt, Escherichia coli CFT073
auaggccgccgauaacca

SEQ ID NO: 655807 - RNA, 19 nt, Escherichia coli CFT073
auaggcuucaaccguuucu

SEQ ID NO: 655808 - RNA, 17 nt, Escherichia coli CFT073
auagcugccagccccuc

SEQ ID NO: 655809 - RNA, 16 nt, Escherichia coli CFT073
auagcucaacaguaag

SEQ ID NO: 655810 - RNA, 14 nt, Escherichia coli CFT073
auagcuaaucaucu

SEQ ID NO: 655811 - RNA, 19 nt, Escherichia coli CFT073
auagcuaaucaucuguugu

SEQ ID NO: 655812 - RNA, 12 nt, Escherichia coli CFT073
auagcuaauccc

SEQ ID NO: 655813 - RNA, 22 nt, Escherichia coli CFT073
auagcuuuggcggcaucugcca

SEQ ID NO: 655814 - RNA, 13 nt, Escherichia coli CFT073
auagcguaacuua

SEQ ID NO: 655815 - RNA, 11 nt, Escherichia coli CFT073
auagcccgguu

SEQ ID NO: 655816 - RNA, 21 nt, Escherichia coli CFT073
auagcggcgauuaagaaugcg

SEQ ID NO: 655817 - RNA, 19 nt, Escherichia coli CFT073
auagccaccuggcugcguu

SEQ ID NO: 655818 - RNA, 19 nt, Escherichia coli CFT073
auagccagcagagcaaaaa

SEQ ID NO: 655819 - RNA, 18 nt, Escherichia coli CFT073
auagccagccucauccau

SEQ ID NO: 655820 - RNA, 14 nt, Escherichia coli CFT073
auagauuaugaaau

SEQ ID NO: 655821 - RNA, 17 nt, Escherichia coli CFT073
auagcacgacguuucuu

SEQ ID NO: 655822 - RNA, 19 nt, Escherichia coli CFT073
auagcaaugccaucaccaa

SEQ ID NO: 655823 - RNA, 21 nt, Escherichia coli CFT073
auagcaaucuguaacaaggug

SEQ ID NO: 655824 - RNA, 13 nt, Escherichia coli CFT073
auagagugugugu

SEQ ID NO: 655825 - RNA, 18 nt, Escherichia coli CFT073
auagaguguuccucugcc

SEQ ID NO: 655826 - RNA, 19 nt, Escherichia coli CFT073
auagagcuugugcaccagc

SEQ ID NO: 655827 - RNA, 13 nt, Escherichia coli CFT073
auagaguauccug

SEQ ID NO: 655828 - RNA, 16 nt, Escherichia coli CFT073
auagacuguugaaaua

SEQ ID NO: 655829 - RNA, 21 nt, Escherichia coli CFT073
auagagaacgcgugguugguu

SEQ ID NO: 655830 - RNA, 21 nt, Escherichia coli CFT073
auagagccuggcugcgugagg

SEQ ID NO: 655831 - RNA, 17 nt, Escherichia coli CFT073
auacucuuugguauuca

SEQ ID NO: 655832 - RNA, 23 nt, Escherichia coli CFT073
auacugcgcauggaagcgcaggu

SEQ ID NO: 655833 - RNA, 20 nt, Escherichia coli CFT073
auacugccguagugaugcau

SEQ ID NO: 655834 - RNA, 20 nt, Escherichia coli CFT073
auacugccgaccagagccaa

SEQ ID NO: 655835 - RNA, 14 nt, Escherichia coli CFT073
auacugaucaucau

SEQ ID NO: 655836 - RNA, 16 nt, Escherichia coli CFT073
auacugaucaucauua

SEQ ID NO: 655837 - RNA, 18 nt, Escherichia coli CFT073
auacugaucgucaucaaa

SEQ ID NO: 655838 - RNA, 14 nt, Escherichia coli CFT073
auacugcaaauauu

SEQ ID NO: 655839 - RNA, 16 nt, Escherichia coli CFT073
auacugcaauuucauu

SEQ ID NO: 655840 - RNA, 22 nt, Escherichia coli CFT073
auacugcagcggucacauguuc

SEQ ID NO: 655841 - RNA, 18 nt, Escherichia coli CFT073
auacuggcguuacccagc

SEQ ID NO: 655842 - RNA, 20 nt, Escherichia coli CFT073
auacuguaaauaguauuauu

SEQ ID NO: 655843 - RNA, 21 nt, Escherichia coli CFT073
auacuucuggguuccuuccag

SEQ ID NO: 655844 - RNA, 15 nt, Escherichia coli CFT073
auacucaucuuccau

SEQ ID NO: 655845 - RNA, 17 nt, Escherichia coli CFT073
auacucaucuuccgggc

SEQ ID NO: 655846 - RNA, 13 nt, Escherichia coli CFT073
auacucuccucca

SEQ ID NO: 655847 - RNA, 18 nt, Escherichia coli CFT073
auacucgccgaaccaaac

SEQ ID NO: 655848 - RNA, 18 nt, Escherichia coli CFT073
auacgugaucgcaauucu

SEQ ID NO: 655849 - RNA, 22 nt, Escherichia coli CFT073
auacguugcauaaaugccgcaa

SEQ ID NO: 655850 - RNA, 16 nt, Escherichia coli CFT073
auacucaagcaaccag

SEQ ID NO: 655851 - RNA, 24 nt, Escherichia coli CFT073
auacggcgguucuuucaugguacu

SEQ ID NO: 655852 - RNA, 20 nt, Escherichia coli CFT073
auacgguuaaaucaggaaaa

SEQ ID NO: 655853 - RNA, 20 nt, Escherichia coli CFT073
auacgggcuuuuuaauuccu

SEQ ID NO: 655854 - RNA, 15 nt, Escherichia coli CFT073
auacggcauuuuccc

SEQ ID NO: 655855 - RNA, 12 nt, Escherichia coli CFT073
auacgacgacgg

SEQ ID NO: 655856 - RNA, 13 nt, Escherichia coli CFT073
auacgcaguggcg

SEQ ID NO: 655857 - RNA, 13 nt, Escherichia coli CFT073
auaccgcgguucc

SEQ ID NO: 655858 - RNA, 11 nt, Escherichia coli CFT073
auaccggcauc

SEQ ID NO: 655859 - RNA, 16 nt, Escherichia coli CFT073
auaauuacuuacaucu

SEQ ID NO: 655860 - RNA, 16 nt, Escherichia coli CFT073
auaccugacgcaacug

SEQ ID NO: 655861 - RNA, 18 nt, Escherichia coli CFT073
auaccuggucugaaccaa

SEQ ID NO: 655862 - RNA, 19 nt, Escherichia coli CFT073
auaccuggucugaaccaau

SEQ ID NO: 655863 - RNA, 20 nt, Escherichia coli CFT073
auaccuguuaauucucccug

SEQ ID NO: 655864 - RNA, 15 nt, Escherichia coli CFT073
auaccgguacggaag

SEQ ID NO: 655865 - RNA, 15 nt, Escherichia coli CFT073
auaccgggaucaggu

SEQ ID NO: 655866 - RNA, 20 nt, Escherichia coli CFT073
auaccgucaggauaaacucc

SEQ ID NO: 655867 - RNA, 16 nt, Escherichia coli CFT073
auaccguccaccagag

SEQ ID NO: 655868 - RNA, 12 nt, Escherichia coli CFT073
aguuuucuuugc

SEQ ID NO: 655869 - RNA, 14 nt, Escherichia coli CFT073
aguuuguuuagcca

SEQ ID NO: 655870 - RNA, 17 nt, Escherichia coli CFT073
aguuuuuugcgaaaaau

SEQ ID NO: 655871 - RNA, 16 nt, Escherichia coli CFT073
aguuuuggggagaugu

SEQ ID NO: 655872 - RNA, 12 nt, Escherichia coli CFT073
aguuuuuucuuc

SEQ ID NO: 655873 - RNA, 17 nt, Escherichia coli CFT073
aguuuuuucuucccaag

SEQ ID NO: 655874 - RNA, 15 nt, Escherichia coli CFT073
aguuugaucaguucu

SEQ ID NO: 655875 - RNA, 16 nt, Escherichia coli CFT073
aguuucuuuuaacaaa

SEQ ID NO: 655876 - RNA, 17 nt, Escherichia coli CFT073
aguuugaaagaugcugg

SEQ ID NO: 655877 - RNA, 14 nt, Escherichia coli CFT073
aguuuccaucagac

SEQ ID NO: 655878 - RNA, 16 nt, Escherichia coli CFT073
aguuucccaaugacgu

SEQ ID NO: 655879 - RNA, 16 nt, Escherichia coli CFT073
aguuuccuguuucuca

SEQ ID NO: 655880 - RNA, 16 nt, Escherichia coli CFT073
aguuucgacaucacau

SEQ ID NO: 655881 - RNA, 19 nt, Escherichia coli CFT073
aguuucggacgcggcacgc

SEQ ID NO: 655882 - RNA, 16 nt, Escherichia coli CFT073
aguuguucaacaguaa

SEQ ID NO: 655883 - RNA, 19 nt, Escherichia coli CFT073
aguuggcagagauucuuca

SEQ ID NO: 655884 - RNA, 16 nt, Escherichia coli CFT073
aguugugugccaguaa

SEQ ID NO: 655885 - RNA, 15 nt, Escherichia coli CFT073
aguuggaguaaaacg

SEQ ID NO: 655886 - RNA, 14 nt, Escherichia coli CFT073
aguuuaaacagaau

SEQ ID NO: 655887 - RNA, 15 nt, Escherichia coli CFT073
aguuuaauucuuuga

SEQ ID NO: 655888 - RNA, 15 nt, Escherichia coli CFT073
aguuguuuuuuuaac

SEQ ID NO: 655889 - RNA, 20 nt, Escherichia coli CFT073
aguugaagccgaacagucgc

SEQ ID NO: 655890 - RNA, 17 nt, Escherichia coli CFT073
aguucuuccgccagaca

SEQ ID NO: 655891 - RNA, 16 nt, Escherichia coli CFT073
aguugcaccagcaaua

SEQ ID NO: 655892 - RNA, 21 nt, Escherichia coli CFT073
aguugauuggcgcgaaccauc

SEQ ID NO: 655893 - RNA, 16 nt, Escherichia coli CFT073
aguugcucggcaaggc

SEQ ID NO: 655894 - RNA, 16 nt, Escherichia coli CFT073
aguugcaguuauuaua

SEQ ID NO: 655895 - RNA, 23 nt, Escherichia coli CFT073
aguugcucacgaauagcuuuaac

SEQ ID NO: 655896 - RNA, 13 nt, Escherichia coli CFT073
aguugauuuuaac

SEQ ID NO: 655897 - RNA, 13 nt, Escherichia coli CFT073
aguucgagaaaaa

SEQ ID NO: 655898 - RNA, 14 nt, Escherichia coli CFT073
aguucgagaaaaau

SEQ ID NO: 655899 - RNA, 14 nt, Escherichia coli CFT073
aguucuucaaaaau

SEQ ID NO: 655900 - RNA, 20 nt, Escherichia coli CFT073
aguucuuaaggcauauauga

SEQ ID NO: 655901 - RNA, 20 nt, Escherichia coli CFT073
aguucugcgguugugcaaaa

SEQ ID NO: 655902 - RNA, 22 nt, Escherichia coli CFT073
aguucugcgguugugcaaaaaa

SEQ ID NO: 655903 - RNA, 16 nt, Escherichia coli CFT073
aguucguugaucaacu

SEQ ID NO: 655904 - RNA, 14 nt, Escherichia coli CFT073
aguucguugaucag

SEQ ID NO: 655905 - RNA, 19 nt, Escherichia coli CFT073
aguucguccccaccaguga

SEQ ID NO: 655906 - RNA, 17 nt, Escherichia coli CFT073
aguucguacacccgcca

SEQ ID NO: 655907 - RNA, 23 nt, Escherichia coli CFT073
aguucaauugaccugauaagaca

SEQ ID NO: 655908 - RNA, 18 nt, Escherichia coli CFT073
aguucaaccucaagcaca

SEQ ID NO: 655909 - RNA, 18 nt, Escherichia coli CFT073
aguuccacuuugcuuuca

SEQ ID NO: 655910 - RNA, 19 nt, Escherichia coli CFT073
aguuccacuuugcuuucag

SEQ ID NO: 655911 - RNA, 13 nt, Escherichia coli CFT073
aguuccagcaaau

SEQ ID NO: 655912 - RNA, 20 nt, Escherichia coli CFT073
aguuccacauaaaguagcca

SEQ ID NO: 655913 - RNA, 18 nt, Escherichia coli CFT073
aguucauuuuucucaacg

SEQ ID NO: 655914 - RNA, 21 nt, Escherichia coli CFT073
aguuacgauaaucaggaaugu

SEQ ID NO: 655915 - RNA, 19 nt, Escherichia coli CFT073
aguuaaaaaaugcagcaaa

SEQ ID NO: 655916 - RNA, 21 nt, Escherichia coli CFT073
aguuaaaaaaugcagcaaaga

SEQ ID NO: 655917 - RNA, 17 nt, Escherichia coli CFT073
aguuagucgcuuucauu

SEQ ID NO: 655918 - RNA, 22 nt, Escherichia coli CFT073
aguuacucugcaagucuugcug

SEQ ID NO: 655919 - RNA, 21 nt, Escherichia coli CFT073
aguuacuggcgaguauugcuu

SEQ ID NO: 655920 - RNA, 22 nt, Escherichia coli CFT073
aguuacuggggcgcuuguugau

SEQ ID NO: 655921 - RNA, 19 nt, Escherichia coli CFT073
aguguguuauugccuggca

SEQ ID NO: 655922 - RNA, 12 nt, Escherichia coli CFT073
aguguucuuccg

SEQ ID NO: 655923 - RNA, 11 nt, Escherichia coli CFT073
aguguugcguu

SEQ ID NO: 655924 - RNA, 20 nt, Escherichia coli CFT073
aguguugcguuuuuaucuuc

SEQ ID NO: 655925 - RNA, 17 nt, Escherichia coli CFT073
aguguuggauggcggcu

SEQ ID NO: 655926 - RNA, 19 nt, Escherichia coli CFT073
aguguuggcggcagaugau

SEQ ID NO: 655927 - RNA, 21 nt, Escherichia coli CFT073
aguguuggcgucagaccggca

SEQ ID NO: 655928 - RNA, 22 nt, Escherichia coli CFT073
agugugcgaucgagauucaucc

SEQ ID NO: 655929 - RNA, 14 nt, Escherichia coli CFT073
agugugcgaugcuc

SEQ ID NO: 655930 - RNA, 16 nt, Escherichia coli CFT073
agugugggaaaaauug

SEQ ID NO: 655931 - RNA, 19 nt, Escherichia coli CFT073
agugugggaaaaauuguuu

SEQ ID NO: 655932 - RNA, 21 nt, Escherichia coli CFT073
aguguggggaaugauauuuuc

SEQ ID NO: 655933 - RNA, 15 nt, Escherichia coli CFT073
aguggguaaugucac

SEQ ID NO: 655934 - RNA, 21 nt, Escherichia coli CFT073
agugggauuaaggcuuccagc

SEQ ID NO: 655935 - RNA, 19 nt, Escherichia coli CFT073
agugggcaacaagccgcuu

SEQ ID NO: 655936 - RNA, 15 nt, Escherichia coli CFT073
agugggcgacaaagu

SEQ ID NO: 655937 - RNA, 19 nt, Escherichia coli CFT073
agugggcgacaaaguugaa

SEQ ID NO: 655938 - RNA, 14 nt, Escherichia coli CFT073
aguggcaauauauu

SEQ ID NO: 655939 - RNA, 17 nt, Escherichia coli CFT073
aguggcucaggcucuca

SEQ ID NO: 655940 - RNA, 19 nt, Escherichia coli CFT073
aguggcugcguuucaugua

SEQ ID NO: 655941 - RNA, 14 nt, Escherichia coli CFT073
aguggugcggcuga

SEQ ID NO: 655942 - RNA, 15 nt, Escherichia coli CFT073
agugucauucagauc

SEQ ID NO: 655943 - RNA, 16 nt, Escherichia coli CFT073
aguguccagaugcugu

SEQ ID NO: 655944 - RNA, 17 nt, Escherichia coli CFT073
agugugaauauucagaa

SEQ ID NO: 655945 - RNA, 21 nt, Escherichia coli CFT073
aguguaauccugccagugcaa

SEQ ID NO: 655946 - RNA, 18 nt, Escherichia coli CFT073
aguggucgacaaccagca

SEQ ID NO: 655947 - RNA, 13 nt, Escherichia coli CFT073
agugucagcacca

SEQ ID NO: 655948 - RNA, 14 nt, Escherichia coli CFT073
agugcuaaacgcuu

SEQ ID NO: 655949 - RNA, 23 nt, Escherichia coli CFT073
agugcgcaguugccggaugcggc

SEQ ID NO: 655950 - RNA, 15 nt, Escherichia coli CFT073
agugccuguugcaua

SEQ ID NO: 655951 - RNA, 14 nt, Escherichia coli CFT073
aguggauuaucuuc

SEQ ID NO: 655952 - RNA, 16 nt, Escherichia coli CFT073
aguggauuaucuucac

SEQ ID NO: 655953 - RNA, 23 nt, Escherichia coli CFT073
aguggauuuuuguuucacacuga

SEQ ID NO: 655954 - RNA, 15 nt, Escherichia coli CFT073
aguggcaaccagcag

SEQ ID NO: 655955 - RNA, 17 nt, Escherichia coli CFT073
aguggagccaucaccau

SEQ ID NO: 655956 - RNA, 14 nt, Escherichia coli CFT073
aguggaaucaucac

SEQ ID NO: 655957 - RNA, 19 nt, Escherichia coli CFT073
agugcucguagaagccaga

SEQ ID NO: 655958 - RNA, 21 nt, Escherichia coli CFT073
agugacucggguucuacaacg

SEQ ID NO: 655959 - RNA, 17 nt, Escherichia coli CFT073
agugagcgauucaaauu

SEQ ID NO: 655960 - RNA, 14 nt, Escherichia coli CFT073
agugcagacucacc

SEQ ID NO: 655961 - RNA, 15 nt, Escherichia coli CFT073
agugcagaugcacaa

SEQ ID NO: 655962 - RNA, 16 nt, Escherichia coli CFT073
agugcagcgcaugauu

SEQ ID NO: 655963 - RNA, 24 nt, Escherichia coli CFT073
agugcagcgcaugauuuucaucuu

SEQ ID NO: 655964 - RNA, 14 nt, Escherichia coli CFT073
agugccugcacaac

SEQ ID NO: 655965 - RNA, 16 nt, Escherichia coli CFT073
agugcgaaaaucaaua

SEQ ID NO: 655966 - RNA, 19 nt, Escherichia coli CFT073
agugcgaaacuucuuaaaa

SEQ ID NO: 655967 - RNA, 20 nt, Escherichia coli CFT073
agugcgaaacuucuuaaaau

SEQ ID NO: 655968 - RNA, 20 nt, Escherichia coli CFT073
agugcauaaauaccggcaug

SEQ ID NO: 655969 - RNA, 19 nt, Escherichia coli CFT073
agucucuucuuugcaggga

SEQ ID NO: 655970 - RNA, 18 nt, Escherichia coli CFT073
agucucuuuauguaauaa

SEQ ID NO: 655971 - RNA, 22 nt, Escherichia coli CFT073
agucguuucgcccguucuuccu

SEQ ID NO: 655972 - RNA, 17 nt, Escherichia coli CFT073
agucguuuuaguaacaa

SEQ ID NO: 655973 - RNA, 21 nt, Escherichia coli CFT073
agucgcgcucaucagcggcga

SEQ ID NO: 655974 - RNA, 23 nt, Escherichia coli CFT073
agucgcgcuucguuuuccgccac

SEQ ID NO: 655975 - RNA, 21 nt, Escherichia coli CFT073
agucgcggaauauccaguaac

SEQ ID NO: 655976 - RNA, 20 nt, Escherichia coli CFT073
agucgcccaaacgcccagau

SEQ ID NO: 655977 - RNA, 14 nt, Escherichia coli CFT073
agucgccaguaauc

SEQ ID NO: 655978 - RNA, 17 nt, Escherichia coli CFT073
agucgccggcggauuca

SEQ ID NO: 655979 - RNA, 14 nt, Escherichia coli CFT073
agucgccagcucug

SEQ ID NO: 655980 - RNA, 17 nt, Escherichia coli CFT073
aguccgcuuccgcugaa

SEQ ID NO: 655981 - RNA, 17 nt, Escherichia coli CFT073
aguccggcaccagcgcu

SEQ ID NO: 655982 - RNA, 22 nt, Escherichia coli CFT073
aguacccagacgcaguacgcca

SEQ ID NO: 655983 - RNA, 18 nt, Escherichia coli CFT073
aguaccgaacagccaggc

SEQ ID NO: 655984 - RNA, 19 nt, Escherichia coli CFT073
aguaccgccaccaccagac

SEQ ID NO: 655985 - RNA, 16 nt, Escherichia coli CFT073
aguaccgccagugcag

SEQ ID NO: 655986 - RNA, 14 nt, Escherichia coli CFT073
aguaccgccgcagu

SEQ ID NO: 655987 - RNA, 23 nt, Escherichia coli CFT073
aguaccgccgccauaaacagcag

SEQ ID NO: 655988 - RNA, 17 nt, Escherichia coli CFT073
aguccgucguucaacaa

SEQ ID NO: 655989 - RNA, 22 nt, Escherichia coli CFT073
aguccguggcacgguaaacucc

SEQ ID NO: 655990 - RNA, 16 nt, Escherichia coli CFT073
aguccuuccuggcugg

SEQ ID NO: 655991 - RNA, 14 nt, Escherichia coli CFT073
agucuggugcugcg

SEQ ID NO: 655992 - RNA, 20 nt, Escherichia coli CFT073
agucuguggugcgguuuuug

SEQ ID NO: 655993 - RNA, 11 nt, Escherichia coli CFT073
agucuuccugc

SEQ ID NO: 655994 - RNA, 15 nt, Escherichia coli CFT073
agucuuccugcggca

SEQ ID NO: 655995 - RNA, 20 nt, Escherichia coli CFT073
agucugaccacuaucgccuu

SEQ ID NO: 655996 - RNA, 13 nt, Escherichia coli CFT073
agucugcaccuuu

SEQ ID NO: 655997 - RNA, 17 nt, Escherichia coli CFT073
agucugccguugccacg

SEQ ID NO: 655998 - RNA, 21 nt, Escherichia coli CFT073
agucugcuccaucgcaugcca

SEQ ID NO: 655999 - RNA, 17 nt, Escherichia coli CFT073
agucuggaagaauaguc

SEQ ID NO: 656000 - RNA, 17 nt, Escherichia coli CFT073
agucuggaagaccagcg

SEQ ID NO: 656001 - RNA, 12 nt, Escherichia coli CFT073
agucugcugacg

SEQ ID NO: 656002 - RNA, 23 nt, Escherichia coli CFT073
agucugcuuuagggggggcucuu

SEQ ID NO: 656003 - RNA, 20 nt, Escherichia coli CFT073
agucuuucugugcaaucaca

SEQ ID NO: 656004 - RNA, 15 nt, Escherichia coli CFT073
agucuuucagacuga

SEQ ID NO: 656005 - RNA, 12 nt, Escherichia coli CFT073
agugacagcccc

SEQ ID NO: 656006 - RNA, 21 nt, Escherichia coli CFT073
agugacaguguuauucccaac

SEQ ID NO: 656007 - RNA, 13 nt, Escherichia coli CFT073
agugaaaaaagca

SEQ ID NO: 656008 - RNA, 14 nt, Escherichia coli CFT073
agugaaaaaagcaa

SEQ ID NO: 656009 - RNA, 16 nt, Escherichia coli CFT073
agugacauucaccuca

SEQ ID NO: 656010 - RNA, 18 nt, Escherichia coli CFT073
agugacccgcagccagca

SEQ ID NO: 656011 - RNA, 18 nt, Escherichia coli CFT073
auaagaaagauacaaaac

SEQ ID NO: 656012 - RNA, 15 nt, Escherichia coli CFT073
auaagaaaaugccuc

SEQ ID NO: 656013 - RNA, 15 nt, Escherichia coli CFT073
auaagaaacacacuu

SEQ ID NO: 656014 - RNA, 13 nt, Escherichia coli CFT073
auaacuuuuagua

SEQ ID NO: 656015 - RNA, 14 nt, Escherichia coli CFT073
auaacuugccaggc

SEQ ID NO: 656016 - RNA, 17 nt, Escherichia coli CFT073
auaacuuccuguaacca

SEQ ID NO: 656017 - RNA, 15 nt, Escherichia coli CFT073
auaacuucuaccuga

SEQ ID NO: 656018 - RNA, 23 nt, Escherichia coli CFT073
auaacuucuaccugaugcuuuuu

SEQ ID NO: 656019 - RNA, 17 nt, Escherichia coli CFT073
auaacucccuauaaugc

SEQ ID NO: 656020 - RNA, 16 nt, Escherichia coli CFT073
auaacugaauaauaca

SEQ ID NO: 656021 - RNA, 16 nt, Escherichia coli CFT073
auaacuggucaucaag

SEQ ID NO: 656022 - RNA, 19 nt, Escherichia coli CFT073
auaacguugaugcaggcag

SEQ ID NO: 656023 - RNA, 21 nt, Escherichia coli CFT073
auaacucaaguuguaauuccu

SEQ ID NO: 656024 - RNA, 18 nt, Escherichia coli CFT073
auaacucaccaucaagua

SEQ ID NO: 656025 - RNA, 14 nt, Escherichia coli CFT073
auaacucaccauca

SEQ ID NO: 656026 - RNA, 19 nt, Escherichia coli CFT073
auaaccgucagcgcaugau

SEQ ID NO: 656027 - RNA, 23 nt, Escherichia coli CFT073
auaaccuaacucuuccugcgcac

SEQ ID NO: 656028 - RNA, 18 nt, Escherichia coli CFT073
auaaccgcugccaggcac

SEQ ID NO: 656029 - RNA, 22 nt, Escherichia coli CFT073
auaaccgugcgcaucgccagac

SEQ ID NO: 656030 - RNA, 18 nt, Escherichia coli CFT073
auaaccucaugguuuuua

SEQ ID NO: 656031 - RNA, 21 nt, Escherichia coli CFT073
auaaccucaugguuuuuaugg

SEQ ID NO: 656032 - RNA, 22 nt, Escherichia coli CFT073
auaacacuuggcgucaaacgac

SEQ ID NO: 656033 - RNA, 23 nt, Escherichia coli CFT073
auaacagaaugcgcgcgaaaaca

SEQ ID NO: 656034 - RNA, 14 nt, Escherichia coli CFT073
auaaccaaaugacu

SEQ ID NO: 656035 - RNA, 23 nt, Escherichia coli CFT073
auaaccaacggcgagccagcgca

SEQ ID NO: 656036 - RNA, 13 nt, Escherichia coli CFT073
auaacccacacca

SEQ ID NO: 656037 - RNA, 15 nt, Escherichia coli CFT073
auaacccagggguca

SEQ ID NO: 656038 - RNA, 19 nt, Escherichia coli CFT073
auaacccggacaaauaacc

SEQ ID NO: 656039 - RNA, 23 nt, Escherichia coli CFT073
auaacccgucagcagauccauug

SEQ ID NO: 656040 - RNA, 20 nt, Escherichia coli CFT073
auaacccguuguaaaugcug

SEQ ID NO: 656041 - RNA, 17 nt, Escherichia coli CFT073
auaacccuaaagcaccc

SEQ ID NO: 656042 - RNA, 13 nt, Escherichia coli CFT073
auaacccugaccc

SEQ ID NO: 656043 - RNA, 16 nt, Escherichia coli CFT073
auaaccgcaaaaccaa

SEQ ID NO: 656044 - RNA, 16 nt, Escherichia coli CFT073
auaaccgccagcacag

SEQ ID NO: 656045 - RNA, 13 nt, Escherichia coli CFT073
auaaaaagaauga

SEQ ID NO: 656046 - RNA, 16 nt, Escherichia coli CFT073
auaaaaagaagaucau

SEQ ID NO: 656047 - RNA, 18 nt, Escherichia coli CFT073
auaaaaagaagaucauca

SEQ ID NO: 656048 - RNA, 16 nt, Escherichia coli CFT073
auaaacuccugcacgc

SEQ ID NO: 656049 - RNA, 19 nt, Escherichia coli CFT073
auaaacuacagaugaaaua

SEQ ID NO: 656050 - RNA, 21 nt, Escherichia coli CFT073
auaaacccuucacuguaggca

SEQ ID NO: 656051 - RNA, 19 nt, Escherichia coli CFT073
auaaaccgcaucauguaaa

SEQ ID NO: 656052 - RNA, 19 nt, Escherichia coli CFT073
auaaaccguccccaaaaaa

SEQ ID NO: 656053 - RNA, 23 nt, Escherichia coli CFT073
auaaaccguccccaaaaaagcca

SEQ ID NO: 656054 - RNA, 15 nt, Escherichia coli CFT073
auaaaccuccagcau

SEQ ID NO: 656055 - RNA, 14 nt, Escherichia coli CFT073
auaaagaugaaaac

SEQ ID NO: 656056 - RNA, 17 nt, Escherichia coli CFT073
auaaagaugaaaacgcc

SEQ ID NO: 656057 - RNA, 19 nt, Escherichia coli CFT073
auaaaucggggucugauuu

SEQ ID NO: 656058 - RNA, 14 nt, Escherichia coli CFT073
auaaaugaagaaaa

SEQ ID NO: 656059 - RNA, 16 nt, Escherichia coli CFT073
auaaaugaagaaaaac

SEQ ID NO: 656060 - RNA, 14 nt, Escherichia coli CFT073
auaaauauccuccg

SEQ ID NO: 656061 - RNA, 15 nt, Escherichia coli CFT073
auaaaggucaucaca

SEQ ID NO: 656062 - RNA, 14 nt, Escherichia coli CFT073
auaaaggaguaaca

SEQ ID NO: 656063 - RNA, 23 nt, Escherichia coli CFT073
auaaaggccgucgccacaaucag

SEQ ID NO: 656064 - RNA, 23 nt, Escherichia coli CFT073
auaaagggaugcccccagauugu

SEQ ID NO: 656065 - RNA, 22 nt, Escherichia coli CFT073
auaaagcguuuaucaauuaacu

SEQ ID NO: 656066 - RNA, 19 nt, Escherichia coli CFT073
auaaagcuauuaauccaua

SEQ ID NO: 656067 - RNA, 13 nt, Escherichia coli CFT073
auaaagcucagau

SEQ ID NO: 656068 - RNA, 13 nt, Escherichia coli CFT073
auaaagcgauaaa

SEQ ID NO: 656069 - RNA, 18 nt, Escherichia coli CFT073
auaaagccgguauucaca

SEQ ID NO: 656070 - RNA, 21 nt, Escherichia coli CFT073
auaaagccguagcguuugcug

SEQ ID NO: 656071 - RNA, 21 nt, Escherichia coli CFT073
auaaagcacccuguuugucua

SEQ ID NO: 656072 - RNA, 21 nt, Escherichia coli CFT073
auaaagcccaucguugaaaaa

SEQ ID NO: 656073 - RNA, 12 nt, Escherichia coli CFT073
auaaguuuuuug

SEQ ID NO: 656074 - RNA, 15 nt, Escherichia coli CFT073
auaauaaaaaagaaa

SEQ ID NO: 656075 - RNA, 22 nt, Escherichia coli CFT073
auaauaaaaaagaaaagaacua

SEQ ID NO: 656076 - RNA, 17 nt, Escherichia coli CFT073
auaauaaaaaaggcacc

SEQ ID NO: 656077 - RNA, 21 nt, Escherichia coli CFT073
auaauaaaaaguuguuaauaa

SEQ ID NO: 656078 - RNA, 13 nt, Escherichia coli CFT073
auaauaaagcuac

SEQ ID NO: 656079 - RNA, 12 nt, Escherichia coli CFT073
auaagucucaga

SEQ ID NO: 656080 - RNA, 15 nt, Escherichia coli CFT073
auaaguggagcccuc

SEQ ID NO: 656081 - RNA, 23 nt, Escherichia coli CFT073
auaaguggugucagaagaaaaaa

SEQ ID NO: 656082 - RNA, 15 nt, Escherichia coli CFT073
auaaguacuaaauaa

SEQ ID NO: 656083 - RNA, 17 nt, Escherichia coli CFT073
auaaguacuaaauaauu

SEQ ID NO: 656084 - RNA, 21 nt, Escherichia coli CFT073
auaaguacuaaauaauuugaa

SEQ ID NO: 656085 - RNA, 19 nt, Escherichia coli CFT073
auaaguaucugcuaauauu

SEQ ID NO: 656086 - RNA, 18 nt, Escherichia coli CFT073
auaagucccgaccacaca

SEQ ID NO: 656087 - RNA, 21 nt, Escherichia coli CFT073
auaagucccgaccacacaaag

SEQ ID NO: 656088 - RNA, 14 nt, Escherichia coli CFT073
auaaggcauuuacg

SEQ ID NO: 656089 - RNA, 13 nt, Escherichia coli CFT073
auaaggguacgaa

SEQ ID NO: 656090 - RNA, 22 nt, Escherichia coli CFT073
auaagguacggcccguacugaa

SEQ ID NO: 656091 - RNA, 17 nt, Escherichia coli CFT073
auaagcguagcgcagca

SEQ ID NO: 656092 - RNA, 23 nt, Escherichia coli CFT073
auaagcugccgcuccuucaccuu

SEQ ID NO: 656093 - RNA, 16 nt, Escherichia coli CFT073
auaagcuuagucuuau

SEQ ID NO: 656094 - RNA, 18 nt, Escherichia coli CFT073
auaagcaccgaacaagaa

SEQ ID NO: 656095 - RNA, 20 nt, Escherichia coli CFT073
auaagcaggccauuugcucu

SEQ ID NO: 656096 - RNA, 17 nt, Escherichia coli CFT073
auaagccauauuuaacu

SEQ ID NO: 656097 - RNA, 17 nt, Escherichia coli CFT073
auaagcgaggccagcca

SEQ ID NO: 656098 - RNA, 18 nt, Escherichia coli CFT073
auaagaccgugagcaaug

SEQ ID NO: 656099 - RNA, 18 nt, Escherichia coli CFT073
auaagacgcggcaggcgu

SEQ ID NO: 656100 - RNA, 22 nt, Escherichia coli CFT073
auaagagaugaauuuauaauca

SEQ ID NO: 656101 - RNA, 13 nt, Escherichia coli CFT073
auaagcaaggcaa

SEQ ID NO: 656102 - RNA, 21 nt, Escherichia coli CFT073
auaagcacaaagcaauauuau

SEQ ID NO: 656103 - RNA, 17 nt, Escherichia coli CFT073
auaagcaaauccuuccg

SEQ ID NO: 656104 - RNA, 16 nt, Escherichia coli CFT073
auaagaugcgccagca

SEQ ID NO: 656105 - RNA, 17 nt, Escherichia coli CFT073
auaauaacucgcagcuu

SEQ ID NO: 656106 - RNA, 16 nt, Escherichia coli CFT073
auaauaaguaaacaaa

SEQ ID NO: 656107 - RNA, 22 nt, Escherichia coli CFT073
auaauaaguaaggcagagccaa

SEQ ID NO: 656108 - RNA, 23 nt, Escherichia coli CFT073
auaauagaccggacgaaaucccc

SEQ ID NO: 656109 - RNA, 21 nt, Escherichia coli CFT073
auaauacaugcgaacuuuacu

SEQ ID NO: 656110 - RNA, 19 nt, Escherichia coli CFT073
auaauacguagcaccaaca

SEQ ID NO: 656111 - RNA, 22 nt, Escherichia coli CFT073
auaaucaagguugcacaaccaa

SEQ ID NO: 656112 - RNA, 15 nt, Escherichia coli CFT073
auaaucaaccauuaa

SEQ ID NO: 656113 - RNA, 22 nt, Escherichia coli CFT073
auaauaucccaacgcaaaacca

SEQ ID NO: 656114 - RNA, 14 nt, Escherichia coli CFT073
auaauauaaauuaa

SEQ ID NO: 656115 - RNA, 16 nt, Escherichia coli CFT073
auaaucuucaaauaaa

SEQ ID NO: 656116 - RNA, 19 nt, Escherichia coli CFT073
auaaugaacgccaccccac

SEQ ID NO: 656117 - RNA, 15 nt, Escherichia coli CFT073
auaaucuuuacacca

SEQ ID NO: 656118 - RNA, 17 nt, Escherichia coli CFT073
auaaucgcguuuuacaa

SEQ ID NO: 656119 - RNA, 14 nt, Escherichia coli CFT073
auaaucgggaauac

SEQ ID NO: 656120 - RNA, 14 nt, Escherichia coli CFT073
auaaucguaaucag

SEQ ID NO: 656121 - RNA, 21 nt, Escherichia coli CFT073
auaaucguaaucagcaucuca

SEQ ID NO: 656122 - RNA, 17 nt, Escherichia coli CFT073
auaaucguaaucagcau

SEQ ID NO: 656123 - RNA, 17 nt, Escherichia coli CFT073
auaaucauacucccagc

SEQ ID NO: 656124 - RNA, 14 nt, Escherichia coli CFT073
auaaucacaauggu

SEQ ID NO: 656125 - RNA, 15 nt, Escherichia coli CFT073
auaaucacaaugguc

SEQ ID NO: 656126 - RNA, 14 nt, Escherichia coli CFT073
auaaucaccacaca

SEQ ID NO: 656127 - RNA, 14 nt, Escherichia coli CFT073
auaaucaccaucag

SEQ ID NO: 656128 - RNA, 19 nt, Escherichia coli CFT073
auaaucacucuuccccgcu

SEQ ID NO: 656129 - RNA, 20 nt, Escherichia coli CFT073
auaauggcuaucgaaaucaa

SEQ ID NO: 656130 - RNA, 15 nt, Escherichia coli CFT073
auaauguguucaacu

SEQ ID NO: 656131 - RNA, 20 nt, Escherichia coli CFT073
aucgcauccggcaauaacuc

SEQ ID NO: 656132 - RNA, 19 nt, Escherichia coli CFT073
aucgcauacgguuucucca

SEQ ID NO: 656133 - RNA, 22 nt, Escherichia coli CFT073
aucgcaucuuuuuuuaccugaa

SEQ ID NO: 656134 - RNA, 21 nt, Escherichia coli CFT073
aucgcauggcugcgaaucgcu

SEQ ID NO: 656135 - RNA, 14 nt, Escherichia coli CFT073
aucgcacguugcca

SEQ ID NO: 656136 - RNA, 17 nt, Escherichia coli CFT073
aucgcaggcgagaacau

SEQ ID NO: 656137 - RNA, 18 nt, Escherichia coli CFT073
aucgcaggcgagaacaug

SEQ ID NO: 656138 - RNA, 17 nt, Escherichia coli CFT073
aucgcagguaagauaau

SEQ ID NO: 656139 - RNA, 20 nt, Escherichia coli CFT073
aucgcccacgcaccaccagc

SEQ ID NO: 656140 - RNA, 14 nt, Escherichia coli CFT073
aucgcccccaucac

SEQ ID NO: 656141 - RNA, 14 nt, Escherichia coli CFT073
aucgcccugccagc

SEQ ID NO: 656142 - RNA, 16 nt, Escherichia coli CFT073
aucgcccggcaccagc

SEQ ID NO: 656143 - RNA, 17 nt, Escherichia coli CFT073
aucgcccggcaccagca

SEQ ID NO: 656144 - RNA, 14 nt, Escherichia coli CFT073
aucgcggcacacag

SEQ ID NO: 656145 - RNA, 14 nt, Escherichia coli CFT073
aucgcggcacagaa

SEQ ID NO: 656146 - RNA, 22 nt, Escherichia coli CFT073
aucgcgcguuaauuucuuuuca

SEQ ID NO: 656147 - RNA, 21 nt, Escherichia coli CFT073
aucgcgcucaauguugcugcu

SEQ ID NO: 656148 - RNA, 21 nt, Escherichia coli CFT073
aucgcgcgggcauugaugaac

SEQ ID NO: 656149 - RNA, 21 nt, Escherichia coli CFT073
aucgcggcgauauccagcgcg

SEQ ID NO: 656150 - RNA, 24 nt, Escherichia coli CFT073
aucgcggcgauauccagcgcggcg

SEQ ID NO: 656151 - RNA, 21 nt, Escherichia coli CFT073
aucgcgcuuaucgccagcgcg

SEQ ID NO: 656152 - RNA, 16 nt, Escherichia coli CFT073
aucgcgccggaaagca

SEQ ID NO: 656153 - RNA, 14 nt, Escherichia coli CFT073
aucgcgccagccag

SEQ ID NO: 656154 - RNA, 21 nt, Escherichia coli CFT073
aucgccguuaaccauaauccg

SEQ ID NO: 656155 - RNA, 14 nt, Escherichia coli CFT073
aucgcgacggcaga

SEQ ID NO: 656156 - RNA, 20 nt, Escherichia coli CFT073
aucagcuuccuugcugauuu

SEQ ID NO: 656157 - RNA, 18 nt, Escherichia coli CFT073
aucaggaaaaacggaaug

SEQ ID NO: 656158 - RNA, 21 nt, Escherichia coli CFT073
aucagcguuucuuccagccac

SEQ ID NO: 656159 - RNA, 15 nt, Escherichia coli CFT073
aucagcguccagccc

SEQ ID NO: 656160 - RNA, 15 nt, Escherichia coli CFT073
aucagcuccggcagc

SEQ ID NO: 656161 - RNA, 17 nt, Escherichia coli CFT073
aucgaaaccuucagcau

SEQ ID NO: 656162 - RNA, 22 nt, Escherichia coli CFT073
aucgaaaaagaaucgauuaucu

SEQ ID NO: 656163 - RNA, 15 nt, Escherichia coli CFT073
aucgaaaucaaagua

SEQ ID NO: 656164 - RNA, 13 nt, Escherichia coli CFT073
aucgauaaacagc

SEQ ID NO: 656165 - RNA, 14 nt, Escherichia coli CFT073
aucgagcaguaauc

SEQ ID NO: 656166 - RNA, 12 nt, Escherichia coli CFT073
aucgagcagcuc

SEQ ID NO: 656167 - RNA, 15 nt, Escherichia coli CFT073
aucgcaaccagccac

SEQ ID NO: 656168 - RNA, 14 nt, Escherichia coli CFT073
aucgcaaacagcac

SEQ ID NO: 656169 - RNA, 15 nt, Escherichia coli CFT073
aucgauaacugcucu

SEQ ID NO: 656170 - RNA, 22 nt, Escherichia coli CFT073
aucgauaacugcucucccauuu

SEQ ID NO: 656171 - RNA, 17 nt, Escherichia coli CFT073
aucgauaaucaguaaug

SEQ ID NO: 656172 - RNA, 13 nt, Escherichia coli CFT073
aucgauaugggca

SEQ ID NO: 656173 - RNA, 19 nt, Escherichia coli CFT073
aucgauaugggcagcucua

SEQ ID NO: 656174 - RNA, 22 nt, Escherichia coli CFT073
aucggccaucucaacuuucuug

SEQ ID NO: 656175 - RNA, 14 nt, Escherichia coli CFT073
aucgggaauacaga

SEQ ID NO: 656176 - RNA, 20 nt, Escherichia coli CFT073
aucgggaugguguucacuca

SEQ ID NO: 656177 - RNA, 15 nt, Escherichia coli CFT073
aucgggucaccugcc

SEQ ID NO: 656178 - RNA, 17 nt, Escherichia coli CFT073
aucgggcgacagcugcg

SEQ ID NO: 656179 - RNA, 22 nt, Escherichia coli CFT073
aucgguauagccguagcuggca

SEQ ID NO: 656180 - RNA, 17 nt, Escherichia coli CFT073
aucggugauauccaggu

SEQ ID NO: 656181 - RNA, 15 nt, Escherichia coli CFT073
aucggagccaaaauc

SEQ ID NO: 656182 - RNA, 15 nt, Escherichia coli CFT073
aucggaggcuuguuc

SEQ ID NO: 656183 - RNA, 23 nt, Escherichia coli CFT073
aucggauuacccggcaucauuau

SEQ ID NO: 656184 - RNA, 16 nt, Escherichia coli CFT073
aucggcaaaaugggua

SEQ ID NO: 656185 - RNA, 22 nt, Escherichia coli CFT073
aucgcguaaggcuucaaucaau

SEQ ID NO: 656186 - RNA, 18 nt, Escherichia coli CFT073
aucgcguacucaccgcuc

SEQ ID NO: 656187 - RNA, 19 nt, Escherichia coli CFT073
aucgcgguaacagaugaau

SEQ ID NO: 656188 - RNA, 15 nt, Escherichia coli CFT073
aucuaccacugccug

SEQ ID NO: 656189 - RNA, 14 nt, Escherichia coli CFT073
aucguucgcugccu

SEQ ID NO: 656190 - RNA, 22 nt, Escherichia coli CFT073
aucguucugugccgucugcccc

SEQ ID NO: 656191 - RNA, 14 nt, Escherichia coli CFT073
aucguugaccugga

SEQ ID NO: 656192 - RNA, 22 nt, Escherichia coli CFT073
aucguguuuaucuuccagcauu

SEQ ID NO: 656193 - RNA, 21 nt, Escherichia coli CFT073
aucguguggauaauccauccc

SEQ ID NO: 656194 - RNA, 16 nt, Escherichia coli CFT073
aucgugcagcaccgcc

SEQ ID NO: 656195 - RNA, 20 nt, Escherichia coli CFT073
aucgugccaggaccauucac

SEQ ID NO: 656196 - RNA, 18 nt, Escherichia coli CFT073
aucgugcgggaccagcac

SEQ ID NO: 656197 - RNA, 23 nt, Escherichia coli CFT073
aucgugcuggauuugugucagaa

SEQ ID NO: 656198 - RNA, 17 nt, Escherichia coli CFT073
aucgucgccgucauacg

SEQ ID NO: 656199 - RNA, 23 nt, Escherichia coli CFT073
aucgucgcuaagcggcuccgguc

SEQ ID NO: 656200 - RNA, 15 nt, Escherichia coli CFT073
aucgucgccagacca

SEQ ID NO: 656201 - RNA, 21 nt, Escherichia coli CFT073
aucgucccaggcaaaucccau

SEQ ID NO: 656202 - RNA, 11 nt, Escherichia coli CFT073
aucugaauauu

SEQ ID NO: 656203 - RNA, 22 nt, Escherichia coli CFT073
aucugaugauauuuuucccuga

SEQ ID NO: 656204 - RNA, 15 nt, Escherichia coli CFT073
aucugauucuuccca

SEQ ID NO: 656205 - RNA, 19 nt, Escherichia coli CFT073
aucugauuuaaaaaugcca

SEQ ID NO: 656206 - RNA, 11 nt, Escherichia coli CFT073
aucugauuuuc

SEQ ID NO: 656207 - RNA, 19 nt, Escherichia coli CFT073
aucugauuuucuuccagua

SEQ ID NO: 656208 - RNA, 22 nt, Escherichia coli CFT073
aucugcaaaauaccaauaauca

SEQ ID NO: 656209 - RNA, 15 nt, Escherichia coli CFT073
aucugcaaauucaau

SEQ ID NO: 656210 - RNA, 18 nt, Escherichia coli CFT073
aucugcaaauucaauaaa

SEQ ID NO: 656211 - RNA, 14 nt, Escherichia coli CFT073
aucugcgggaacau

SEQ ID NO: 656212 - RNA, 21 nt, Escherichia coli CFT073
aucugcgccacgaaaacccuc

SEQ ID NO: 656213 - RNA, 22 nt, Escherichia coli CFT073
aucugcgccuacggcauucugc

SEQ ID NO: 656214 - RNA, 22 nt, Escherichia coli CFT073
aucugccguagcggcgauaaac

SEQ ID NO: 656215 - RNA, 15 nt, Escherichia coli CFT073
aucugcgacauagca

SEQ ID NO: 656216 - RNA, 19 nt, Escherichia coli CFT073
aucugccauuaacuccacc

SEQ ID NO: 656217 - RNA, 23 nt, Escherichia coli CFT073
aucugccccauugcugaugcacc

SEQ ID NO: 656218 - RNA, 21 nt, Escherichia coli CFT073
aucugcccggcauuaauauug

SEQ ID NO: 656219 - RNA, 19 nt, Escherichia coli CFT073
aucugcccuuuaguaugcu

SEQ ID NO: 656220 - RNA, 14 nt, Escherichia coli CFT073
aucucguugaucac

SEQ ID NO: 656221 - RNA, 17 nt, Escherichia coli CFT073
aucucguggucaauauc

SEQ ID NO: 656222 - RNA, 15 nt, Escherichia coli CFT073
aucucgguggaaaau

SEQ ID NO: 656223 - RNA, 14 nt, Escherichia coli CFT073
aucucgguuuucag

SEQ ID NO: 656224 - RNA, 16 nt, Escherichia coli CFT073
aucucgguuuucaggu

SEQ ID NO: 656225 - RNA, 15 nt, Escherichia coli CFT073
aucucgccuuugagc

SEQ ID NO: 656226 - RNA, 13 nt, Escherichia coli CFT073
aucucuucaagcu

SEQ ID NO: 656227 - RNA, 14 nt, Escherichia coli CFT073
aucucuucaagcug

SEQ ID NO: 656228 - RNA, 21 nt, Escherichia coli CFT073
aucucugccuugaguuuuuca

SEQ ID NO: 656229 - RNA, 19 nt, Escherichia coli CFT073
aucucugcaacgucuuccc

SEQ ID NO: 656230 - RNA, 20 nt, Escherichia coli CFT073
aucucugcaacgucuucccg

SEQ ID NO: 656231 - RNA, 11 nt, Escherichia coli CFT073
aucucugcaag

SEQ ID NO: 656232 - RNA, 23 nt, Escherichia coli CFT073
aucucugacgcgcauacucuccu

SEQ ID NO: 656233 - RNA, 13 nt, Escherichia coli CFT073
aucucuucuuccg

SEQ ID NO: 656234 - RNA, 22 nt, Escherichia coli CFT073
aucucuuucuuugaaugacgau

SEQ ID NO: 656235 - RNA, 13 nt, Escherichia coli CFT073
aucucuuccagcg

SEQ ID NO: 656236 - RNA, 14 nt, Escherichia coli CFT073
aucucuuccagcgu

SEQ ID NO: 656237 - RNA, 20 nt, Escherichia coli CFT073
aucucuuccagcgucuccag

SEQ ID NO: 656238 - RNA, 13 nt, Escherichia coli CFT073
aucucuucaccau

SEQ ID NO: 656239 - RNA, 23 nt, Escherichia coli CFT073
aucucuucaccugccugcagcug

SEQ ID NO: 656240 - RNA, 21 nt, Escherichia coli CFT073
aucucuuaucauccaggugaa

SEQ ID NO: 656241 - RNA, 21 nt, Escherichia coli CFT073
aucucuucuucaagccaggcu

SEQ ID NO: 656242 - RNA, 18 nt, Escherichia coli CFT073
aucucuucgagaauaucu

SEQ ID NO: 656243 - RNA, 12 nt, Escherichia coli CFT073
aucucuuccgca

SEQ ID NO: 656244 - RNA, 21 nt, Escherichia coli CFT073
aucucgccagagagcggagca

SEQ ID NO: 656245 - RNA, 15 nt, Escherichia coli CFT073
aucuccauugccggc

SEQ ID NO: 656246 - RNA, 16 nt, Escherichia coli CFT073
aucuccagugagagau

SEQ ID NO: 656247 - RNA, 13 nt, Escherichia coli CFT073
aucuccaucaucu

SEQ ID NO: 656248 - RNA, 23 nt, Escherichia coli CFT073
aucuccgccucgcucaggugacg

SEQ ID NO: 656249 - RNA, 13 nt, Escherichia coli CFT073
aucucccgcuggc

SEQ ID NO: 656250 - RNA, 18 nt, Escherichia coli CFT073
aucuccgaaguuaaccuu

SEQ ID NO: 656251 - RNA, 18 nt, Escherichia coli CFT073
aucuccggcgguaaaugc

SEQ ID NO: 656252 - RNA, 14 nt, Escherichia coli CFT073
aucucacguccacc

SEQ ID NO: 656253 - RNA, 16 nt, Escherichia coli CFT073
aucucacuacaacaac

SEQ ID NO: 656254 - RNA, 16 nt, Escherichia coli CFT073
aucucagauaaaugca

SEQ ID NO: 656255 - RNA, 22 nt, Escherichia coli CFT073
aucucagauaaaugcaaacgca

SEQ ID NO: 656256 - RNA, 21 nt, Escherichia coli CFT073
aucucaauuuucacuuucggc

SEQ ID NO: 656257 - RNA, 17 nt, Escherichia coli CFT073
aucucaauccgcuuacc

SEQ ID NO: 656258 - RNA, 17 nt, Escherichia coli CFT073
aucucaaucgcacccgc

SEQ ID NO: 656259 - RNA, 14 nt, Escherichia coli CFT073
aucucaaucaaaag

SEQ ID NO: 656260 - RNA, 21 nt, Escherichia coli CFT073
aucucacgcaguuuauccauc

SEQ ID NO: 656261 - RNA, 16 nt, Escherichia coli CFT073
aucucacccgguacau

SEQ ID NO: 656262 - RNA, 15 nt, Escherichia coli CFT073
aucucaaauugcucu

SEQ ID NO: 656263 - RNA, 17 nt, Escherichia coli CFT073
aucucaacaaacgcaua

SEQ ID NO: 656264 - RNA, 20 nt, Escherichia coli CFT073
aucucaaccgcuucuuucuc

SEQ ID NO: 656265 - RNA, 20 nt, Escherichia coli CFT073
aucucaagaaugaccgccug

SEQ ID NO: 656266 - RNA, 17 nt, Escherichia coli CFT073
aucuaucacuauaaaua

SEQ ID NO: 656267 - RNA, 20 nt, Escherichia coli CFT073
aucuaucuggcgcgcuauua

SEQ ID NO: 656268 - RNA, 11 nt, Escherichia coli CFT073
aucuacugccu

SEQ ID NO: 656269 - RNA, 20 nt, Escherichia coli CFT073
aucuaccagcggacggcuga

SEQ ID NO: 656270 - RNA, 20 nt, Escherichia coli CFT073
aucuacggaagaguuuuuca

SEQ ID NO: 656271 - RNA, 19 nt, Escherichia coli CFT073
aucuacgcucucuucaaac

SEQ ID NO: 656272 - RNA, 15 nt, Escherichia coli CFT073
aucuauagcacccgc

SEQ ID NO: 656273 - RNA, 14 nt, Escherichia coli CFT073
augccggaaucaga

SEQ ID NO: 656274 - RNA, 20 nt, Escherichia coli CFT073
augccggccagcgccaccac

SEQ ID NO: 656275 - RNA, 20 nt, Escherichia coli CFT073
augccggaugcgcuugcauc

SEQ ID NO: 656276 - RNA, 17 nt, Escherichia coli CFT073
augccgcuacaaaaugc

SEQ ID NO: 656277 - RNA, 16 nt, Escherichia coli CFT073
augccggguaaagauu

SEQ ID NO: 656278 - RNA, 22 nt, Escherichia coli CFT073
augccggguuugccaugugccg

SEQ ID NO: 656279 - RNA, 11 nt, Escherichia coli CFT073
augccggugau

SEQ ID NO: 656280 - RNA, 16 nt, Escherichia coli CFT073
augccgguuaauacgc

SEQ ID NO: 656281 - RNA, 17 nt, Escherichia coli CFT073
augccguaaccagcgca

SEQ ID NO: 656282 - RNA, 23 nt, Escherichia coli CFT073
augccugaugguguugcaccauc

SEQ ID NO: 656283 - RNA, 16 nt, Escherichia coli CFT073
augccguuugcugcau

SEQ ID NO: 656284 - RNA, 18 nt, Escherichia coli CFT073
augccuuucuuuguucuu

SEQ ID NO: 656285 - RNA, 18 nt, Escherichia coli CFT073
augccuugauauguauua

SEQ ID NO: 656286 - RNA, 20 nt, Escherichia coli CFT073
augccuugauauguauuaua

SEQ ID NO: 656287 - RNA, 21 nt, Escherichia coli CFT073
augccuugugggccugaaagc

SEQ ID NO: 656288 - RNA, 12 nt, Escherichia coli CFT073
augccuggauga

SEQ ID NO: 656289 - RNA, 20 nt, Escherichia coli CFT073
augccccacagagugguggg

SEQ ID NO: 656290 - RNA, 18 nt, Escherichia coli CFT073
augccccauaauauugcc

SEQ ID NO: 656291 - RNA, 15 nt, Escherichia coli CFT073
augccauuuugcacc

SEQ ID NO: 656292 - RNA, 23 nt, Escherichia coli CFT073
augcccaaaaaaacggcaacggc

SEQ ID NO: 656293 - RNA, 18 nt, Escherichia coli CFT073
augcccaugccaauuaaa

SEQ ID NO: 656294 - RNA, 20 nt, Escherichia coli CFT073
augccauuaacaucccuuca

SEQ ID NO: 656295 - RNA, 18 nt, Escherichia coli CFT073
augccaucugccagcaag

SEQ ID NO: 656296 - RNA, 15 nt, Escherichia coli CFT073
augccaucaccaacg

SEQ ID NO: 656297 - RNA, 23 nt, Escherichia coli CFT073
augccaucauggcgaugagaauc

SEQ ID NO: 656298 - RNA, 23 nt, Escherichia coli CFT073
augccauccggcucgcaucaauu

SEQ ID NO: 656299 - RNA, 16 nt, Escherichia coli CFT073
augccaguaacucauu

SEQ ID NO: 656300 - RNA, 12 nt, Escherichia coli CFT073
augccaguaauc

SEQ ID NO: 656301 - RNA, 15 nt, Escherichia coli CFT073
augccagucaaugaa

SEQ ID NO: 656302 - RNA, 14 nt, Escherichia coli CFT073
augccagucaguua

SEQ ID NO: 656303 - RNA, 16 nt, Escherichia coli CFT073
augccgcccagcagca

SEQ ID NO: 656304 - RNA, 20 nt, Escherichia coli CFT073
augccgacggcgcacaggca

SEQ ID NO: 656305 - RNA, 19 nt, Escherichia coli CFT073
augccgaagugaaucggau

SEQ ID NO: 656306 - RNA, 16 nt, Escherichia coli CFT073
augccgaaugccgggu

SEQ ID NO: 656307 - RNA, 14 nt, Escherichia coli CFT073
augccgacaaacag

SEQ ID NO: 656308 - RNA, 15 nt, Escherichia coli CFT073
augcccgcuauccuc

SEQ ID NO: 656309 - RNA, 14 nt, Escherichia coli CFT073
augcccucaauauc

SEQ ID NO: 656310 - RNA, 20 nt, Escherichia coli CFT073
augcccucaauaucuuuccc

SEQ ID NO: 656311 - RNA, 20 nt, Escherichia coli CFT073
augcaguuuuggugcgaauc

SEQ ID NO: 656312 - RNA, 22 nt, Escherichia coli CFT073
augccaaauguauccaucacca

SEQ ID NO: 656313 - RNA, 20 nt, Escherichia coli CFT073
augccaaccgcgacaauauc

SEQ ID NO: 656314 - RNA, 22 nt, Escherichia coli CFT073
augccaacggggccagcacaua

SEQ ID NO: 656315 - RNA, 22 nt, Escherichia coli CFT073
augccaaucggcggcacucgcu

SEQ ID NO: 656316 - RNA, 13 nt, Escherichia coli CFT073
augccacaguaaa

SEQ ID NO: 656317 - RNA, 15 nt, Escherichia coli CFT073
augccacccauuaca

SEQ ID NO: 656318 - RNA, 17 nt, Escherichia coli CFT073
augccagaauccccacu

SEQ ID NO: 656319 - RNA, 14 nt, Escherichia coli CFT073
augccacuggaugu

SEQ ID NO: 656320 - RNA, 18 nt, Escherichia coli CFT073
augccacugucaacugcu

SEQ ID NO: 656321 - RNA, 19 nt, Escherichia coli CFT073
augccagaaacaucggcag

SEQ ID NO: 656322 - RNA, 21 nt, Escherichia coli CFT073
augccagaauccccacugcau

SEQ ID NO: 656323 - RNA, 24 nt, Escherichia coli CFT073
augccagaauccccacugcauggc

SEQ ID NO: 656324 - RNA, 17 nt, Escherichia coli CFT073
augccagacuuuguuga

SEQ ID NO: 656325 - RNA, 13 nt, Escherichia coli CFT073
augcaguaccaga

SEQ ID NO: 656326 - RNA, 14 nt, Escherichia coli CFT073
augcaguaccagau

SEQ ID NO: 656327 - RNA, 15 nt, Escherichia coli CFT073
augcaguaccagaua

SEQ ID NO: 656328 - RNA, 14 nt, Escherichia coli CFT073
augcaguacgucga

SEQ ID NO: 656329 - RNA, 23 nt, Escherichia coli CFT073
augcaggcugggcacucuuggca

SEQ ID NO: 656330 - RNA, 17 nt, Escherichia coli CFT073
augcacacaaaauugcc

SEQ ID NO: 656331 - RNA, 16 nt, Escherichia coli CFT073
augcacacgcagcuga

SEQ ID NO: 656332 - RNA, 18 nt, Escherichia coli CFT073
augcacaggagacaccag

SEQ ID NO: 656333 - RNA, 14 nt, Escherichia coli CFT073
augcagcauccagc

SEQ ID NO: 656334 - RNA, 17 nt, Escherichia coli CFT073
augcagccacugcugcg

SEQ ID NO: 656335 - RNA, 23 nt, Escherichia coli CFT073
augcagccccauaugcagcacuu

SEQ ID NO: 656336 - RNA, 19 nt, Escherichia coli CFT073
augauggugaaagcaaaaa

SEQ ID NO: 656337 - RNA, 17 nt, Escherichia coli CFT073
augauuguaaguuuuca

SEQ ID NO: 656338 - RNA, 23 nt, Escherichia coli CFT073
augcaaauucaauauauugcaug

SEQ ID NO: 656339 - RNA, 22 nt, Escherichia coli CFT073
augcaacauuaucugaugcgcu

SEQ ID NO: 656340 - RNA, 18 nt, Escherichia coli CFT073
augcaagaggguuauuug

SEQ ID NO: 656341 - RNA, 20 nt, Escherichia coli CFT073
augcaagaggguuauuuguu

SEQ ID NO: 656342 - RNA, 19 nt, Escherichia coli CFT073
augaguuauacagaguguu

SEQ ID NO: 656343 - RNA, 19 nt, Escherichia coli CFT073
augaugaacgguugcaaua

SEQ ID NO: 656344 - RNA, 17 nt, Escherichia coli CFT073
augauggcgauacugcc

SEQ ID NO: 656345 - RNA, 23 nt, Escherichia coli CFT073
augacaucgcccucuuucaccag

SEQ ID NO: 656346 - RNA, 16 nt, Escherichia coli CFT073
augaauuaccccuggu

SEQ ID NO: 656347 - RNA, 11 nt, Escherichia coli CFT073
augaauugagg

SEQ ID NO: 656348 - RNA, 15 nt, Escherichia coli CFT073
augaauggaguuguc

SEQ ID NO: 656349 - RNA, 18 nt, Escherichia coli CFT073
augaaugauaugcccagg

SEQ ID NO: 656350 - RNA, 23 nt, Escherichia coli CFT073
augaaugcaacugcccaggcaaa

SEQ ID NO: 656351 - RNA, 16 nt, Escherichia coli CFT073
augaauaacuuccugu

SEQ ID NO: 656352 - RNA, 17 nt, Escherichia coli CFT073
augaauaacuuccugua

SEQ ID NO: 656353 - RNA, 12 nt, Escherichia coli CFT073
augaauaacccc

SEQ ID NO: 656354 - RNA, 14 nt, Escherichia coli CFT073
augaaguugaaauc

SEQ ID NO: 656355 - RNA, 16 nt, Escherichia coli CFT073
augaaguugaaaucac

SEQ ID NO: 656356 - RNA, 16 nt, Escherichia coli CFT073
augaaguaacagaaga

SEQ ID NO: 656357 - RNA, 16 nt, Escherichia coli CFT073
augaauauucuguuca

SEQ ID NO: 656358 - RNA, 15 nt, Escherichia coli CFT073
augaauauugcugaa

SEQ ID NO: 656359 - RNA, 18 nt, Escherichia coli CFT073
augaauaucauaggucag

SEQ ID NO: 656360 - RNA, 18 nt, Escherichia coli CFT073
augaauccaggccagaua

SEQ ID NO: 656361 - RNA, 17 nt, Escherichia coli CFT073
augaaucaaaucaacca

SEQ ID NO: 656362 - RNA, 14 nt, Escherichia coli CFT073
augaaucagcagau

SEQ ID NO: 656363 - RNA, 13 nt, Escherichia coli CFT073
augacgcccugug

SEQ ID NO: 656364 - RNA, 16 nt, Escherichia coli CFT073
augacgaauaauugcc

SEQ ID NO: 656365 - RNA, 18 nt, Escherichia coli CFT073
augacgaauagcagacaa

SEQ ID NO: 656366 - RNA, 15 nt, Escherichia coli CFT073
augagaacaucaucc

SEQ ID NO: 656367 - RNA, 23 nt, Escherichia coli CFT073
augagaacaucauccccacaccu

SEQ ID NO: 656368 - RNA, 15 nt, Escherichia coli CFT073
augacuuaaaucucu

SEQ ID NO: 656369 - RNA, 16 nt, Escherichia coli CFT073
augacuuccgccacca

SEQ ID NO: 656370 - RNA, 16 nt, Escherichia coli CFT073
augacuuucaaagaga

SEQ ID NO: 656371 - RNA, 14 nt, Escherichia coli CFT073
augaguaacaguca

SEQ ID NO: 656372 - RNA, 21 nt, Escherichia coli CFT073
augaguaaacuucaacgcugc

SEQ ID NO: 656373 - RNA, 12 nt, Escherichia coli CFT073
augaguacagcg

SEQ ID NO: 656374 - RNA, 18 nt, Escherichia coli CFT073
augagguucagccgagca

SEQ ID NO: 656375 - RNA, 15 nt, Escherichia coli CFT073
augagguuucccgcc

SEQ ID NO: 656376 - RNA, 14 nt, Escherichia coli CFT073
augagauucaacau

SEQ ID NO: 656377 - RNA, 16 nt, Escherichia coli CFT073
augagauccagcgagc

SEQ ID NO: 656378 - RNA, 23 nt, Escherichia coli CFT073
augagacgguuaaaaacagccag

SEQ ID NO: 656379 - RNA, 12 nt, Escherichia coli CFT073
aucuuucgagua

SEQ ID NO: 656380 - RNA, 18 nt, Escherichia coli CFT073
aucuuuccggcagaagca

SEQ ID NO: 656381 - RNA, 14 nt, Escherichia coli CFT073
aucuuuccucacuc

SEQ ID NO: 656382 - RNA, 21 nt, Escherichia coli CFT073
aucuuucugcgcaucuucccc

SEQ ID NO: 656383 - RNA, 16 nt, Escherichia coli CFT073
aucuuuuauccgaaca

SEQ ID NO: 656384 - RNA, 15 nt, Escherichia coli CFT073
augaaaaugccgggg

SEQ ID NO: 656385 - RNA, 16 nt, Escherichia coli CFT073
augaaacgcaaauacu

SEQ ID NO: 656386 - RNA, 16 nt, Escherichia coli CFT073
augaaagcagcagcug

SEQ ID NO: 656387 - RNA, 19 nt, Escherichia coli CFT073
augaaagcaugucaggcag

SEQ ID NO: 656388 - RNA, 14 nt, Escherichia coli CFT073
augaagaaaaaccg

SEQ ID NO: 656389 - RNA, 20 nt, Escherichia coli CFT073
augaaauaguugcauuccag

SEQ ID NO: 656390 - RNA, 14 nt, Escherichia coli CFT073
augaaauauuaucu

SEQ ID NO: 656391 - RNA, 11 nt, Escherichia coli CFT073
augaaaucaug

SEQ ID NO: 656392 - RNA, 16 nt, Escherichia coli CFT073
augaaauacuaaauau

SEQ ID NO: 656393 - RNA, 18 nt, Escherichia coli CFT073
augaaauacuaaauauga

SEQ ID NO: 656394 - RNA, 19 nt, Escherichia coli CFT073
aucuucuuucucggccacc

SEQ ID NO: 656395 - RNA, 22 nt, Escherichia coli CFT073
aucuuuccgcaauagucauuaa

SEQ ID NO: 656396 - RNA, 19 nt, Escherichia coli CFT073
aucuuucaucuguuuucaa

SEQ ID NO: 656397 - RNA, 17 nt, Escherichia coli CFT073
aucuuucacuuuugcca

SEQ ID NO: 656398 - RNA, 19 nt, Escherichia coli CFT073
aucuggcaagccugaaaac

SEQ ID NO: 656399 - RNA, 19 nt, Escherichia coli CFT073
aucuggcgagaacaccgag

SEQ ID NO: 656400 - RNA, 20 nt, Escherichia coli CFT073
aucuggcggaucugaucagc

SEQ ID NO: 656401 - RNA, 24 nt, Escherichia coli CFT073
aucuggcguuaaaaccaauucaca

SEQ ID NO: 656402 - RNA, 20 nt, Escherichia coli CFT073
aucuucucuacccgcucgaa

SEQ ID NO: 656403 - RNA, 16 nt, Escherichia coli CFT073
aucuucuccugucaug

SEQ ID NO: 656404 - RNA, 17 nt, Escherichia coli CFT073
aucuucucgaaacgcuu

SEQ ID NO: 656405 - RNA, 19 nt, Escherichia coli CFT073
aucuucugaagcaaacuug

SEQ ID NO: 656406 - RNA, 24 nt, Escherichia coli CFT073
aucuucugaaggugccuuuauugc

SEQ ID NO: 656407 - RNA, 22 nt, Escherichia coli CFT073
aucuucugaaucagaucaaguu

SEQ ID NO: 656408 - RNA, 23 nt, Escherichia coli CFT073
aucuucugaaucagaucaaguuc

SEQ ID NO: 656409 - RNA, 19 nt, Escherichia coli CFT073
aucuucugccaauuuuucg

SEQ ID NO: 656410 - RNA, 20 nt, Escherichia coli CFT073
aucuucugccaauuuuucgc

SEQ ID NO: 656411 - RNA, 14 nt, Escherichia coli CFT073
aucuucucucaucc

SEQ ID NO: 656412 - RNA, 16 nt, Escherichia coli CFT073
aucuucuuuauaucua

SEQ ID NO: 656413 - RNA, 14 nt, Escherichia coli CFT073
augugacgcugucu

SEQ ID NO: 656414 - RNA, 15 nt, Escherichia coli CFT073
augugauaaauacga

SEQ ID NO: 656415 - RNA, 20 nt, Escherichia coli CFT073
augugaaggugauucccagc

SEQ ID NO: 656416 - RNA, 15 nt, Escherichia coli CFT073
augucuuuuauggua

SEQ ID NO: 656417 - RNA, 16 nt, Escherichia coli CFT073
auguccugcggacagu

SEQ ID NO: 656418 - RNA, 19 nt, Escherichia coli CFT073
augucgacauaaucaaggu

SEQ ID NO: 656419 - RNA, 14 nt, Escherichia coli CFT073
augugcuuuuccuc

SEQ ID NO: 656420 - RNA, 15 nt, Escherichia coli CFT073
auguggcugggguac

SEQ ID NO: 656421 - RNA, 18 nt, Escherichia coli CFT073
auguccauauauaaaauc

SEQ ID NO: 656422 - RNA, 18 nt, Escherichia coli CFT073
auguauuauaaguacuuu

SEQ ID NO: 656423 - RNA, 21 nt, Escherichia coli CFT073
auguauuauaaguacuuucca

SEQ ID NO: 656424 - RNA, 20 nt, Escherichia coli CFT073
augucauuacgaucaagaau

SEQ ID NO: 656425 - RNA, 12 nt, Escherichia coli CFT073
auguaucgauau

SEQ ID NO: 656426 - RNA, 19 nt, Escherichia coli CFT073
auguaucgcccuuaccauu

SEQ ID NO: 656427 - RNA, 23 nt, Escherichia coli CFT073
auguaucgcccuuaccauuccca

SEQ ID NO: 656428 - RNA, 14 nt, Escherichia coli CFT073
auguauccggcaug

SEQ ID NO: 656429 - RNA, 16 nt, Escherichia coli CFT073
auguauacaaaaucug

SEQ ID NO: 656430 - RNA, 21 nt, Escherichia coli CFT073
auguauauuauccaucaaagg

SEQ ID NO: 656431 - RNA, 23 nt, Escherichia coli CFT073
auguaguguuuuauaccaacaaa

SEQ ID NO: 656432 - RNA, 12 nt, Escherichia coli CFT073
auguagucaucu

SEQ ID NO: 656433 - RNA, 16 nt, Escherichia coli CFT073
auguagucaucugcac

SEQ ID NO: 656434 - RNA, 21 nt, Escherichia coli CFT073
auguaauuaagcgcaaaggcc

SEQ ID NO: 656435 - RNA, 20 nt, Escherichia coli CFT073
auguaagcgcauaaucaauc

SEQ ID NO: 656436 - RNA, 16 nt, Escherichia coli CFT073
auguaaguaauuauua

SEQ ID NO: 656437 - RNA, 17 nt, Escherichia coli CFT073
auguaagucugaaucag

SEQ ID NO: 656438 - RNA, 16 nt, Escherichia coli CFT073
auguaauaaaccugcu

SEQ ID NO: 656439 - RNA, 16 nt, Escherichia coli CFT073
auguaagaugaaauag

SEQ ID NO: 656440 - RNA, 20 nt, Escherichia coli CFT073
augguuagccuguaauguca

SEQ ID NO: 656441 - RNA, 16 nt, Escherichia coli CFT073
augguuuuaauacugc

SEQ ID NO: 656442 - RNA, 11 nt, Escherichia coli CFT073
augguuuucaa

SEQ ID NO: 656443 - RNA, 18 nt, Escherichia coli CFT073
augguuuggucuccugca

SEQ ID NO: 656444 - RNA, 13 nt, Escherichia coli CFT073
auggcauccaagc

SEQ ID NO: 656445 - RNA, 21 nt, Escherichia coli CFT073
auggcauccgccacuuuaugc

SEQ ID NO: 656446 - RNA, 23 nt, Escherichia coli CFT073
auggcauccuguuuucuggaugc

SEQ ID NO: 656447 - RNA, 20 nt, Escherichia coli CFT073
auggcauaccauccggcaua

SEQ ID NO: 656448 - RNA, 20 nt, Escherichia coli CFT073
augcgcaucaaggccaggca

SEQ ID NO: 656449 - RNA, 23 nt, Escherichia coli CFT073
augcgcaucaaggccaggcagaa

SEQ ID NO: 656450 - RNA, 21 nt, Escherichia coli CFT073
augcgcacggaguaacaaaug

SEQ ID NO: 656451 - RNA, 15 nt, Escherichia coli CFT073
augcgcagaagcaua

SEQ ID NO: 656452 - RNA, 18 nt, Escherichia coli CFT073
augccuuuugacuccuga

SEQ ID NO: 656453 - RNA, 18 nt, Escherichia coli CFT073
augcgauuuauaucgcau

SEQ ID NO: 656454 - RNA, 12 nt, Escherichia coli CFT073
augcgaugcugg

SEQ ID NO: 656455 - RNA, 13 nt, Escherichia coli CFT073
augcgaugaaacg

SEQ ID NO: 656456 - RNA, 17 nt, Escherichia coli CFT073
augcgauguucccccag

SEQ ID NO: 656457 - RNA, 11 nt, Escherichia coli CFT073
auggcccauga

SEQ ID NO: 656458 - RNA, 15 nt, Escherichia coli CFT073
auggccccagguauc

SEQ ID NO: 656459 - RNA, 20 nt, Escherichia coli CFT073
auggcgcgccaccucuuuca

SEQ ID NO: 656460 - RNA, 16 nt, Escherichia coli CFT073
auggcuacguagcuca

SEQ ID NO: 656461 - RNA, 21 nt, Escherichia coli CFT073
auggcuaucgaaaucaaagua

SEQ ID NO: 656462 - RNA, 23 nt, Escherichia coli CFT073
auggcggcuuggcugcaaauauu

SEQ ID NO: 656463 - RNA, 22 nt, Escherichia coli CFT073
auggcuccgggugugacaacaa

SEQ ID NO: 656464 - RNA, 13 nt, Escherichia coli CFT073
auggcuccgggug

SEQ ID NO: 656465 - RNA, 16 nt, Escherichia coli CFT073
auggcucagauugaac

SEQ ID NO: 656466 - RNA, 19 nt, Escherichia coli CFT073
augggcaaacaaaaaaccu

SEQ ID NO: 656467 - RNA, 14 nt, Escherichia coli CFT073
augggaggaaaagu

SEQ ID NO: 656468 - RNA, 21 nt, Escherichia coli CFT073
augggaggaaaaguaaucaau

SEQ ID NO: 656469 - RNA, 15 nt, Escherichia coli CFT073
augggcauccacagu

SEQ ID NO: 656470 - RNA, 19 nt, Escherichia coli CFT073
auggcugaaagcgccggga

SEQ ID NO: 656471 - RNA, 19 nt, Escherichia coli CFT073
auggggacaucaaagaaaa

SEQ ID NO: 656472 - RNA, 16 nt, Escherichia coli CFT073
augguaacaccagagu

SEQ ID NO: 656473 - RNA, 13 nt, Escherichia coli CFT073
auggguuguugag

SEQ ID NO: 656474 - RNA, 17 nt, Escherichia coli CFT073
augggcgccauuuuuca

SEQ ID NO: 656475 - RNA, 19 nt, Escherichia coli CFT073
augguacuggcgacugcca

SEQ ID NO: 656476 - RNA, 20 nt, Escherichia coli CFT073
augguagaaacgcugaaugc

SEQ ID NO: 656477 - RNA, 14 nt, Escherichia coli CFT073
augguaucggcauc

SEQ ID NO: 656478 - RNA, 20 nt, Escherichia coli CFT073
auggucucgccgauagucag

SEQ ID NO: 656479 - RNA, 21 nt, Escherichia coli CFT073
augguauaucguuuuucauua

SEQ ID NO: 656480 - RNA, 23 nt, Escherichia coli CFT073
auggucugcgccgcauucagggc

SEQ ID NO: 656481 - RNA, 18 nt, Escherichia coli CFT073
augguguuggcaaucagc

SEQ ID NO: 656482 - RNA, 14 nt, Escherichia coli CFT073
augguguacucauc

SEQ ID NO: 656483 - RNA, 17 nt, Escherichia coli CFT073
augguuaaauugaaauu

SEQ ID NO: 656484 - RNA, 21 nt, Escherichia coli CFT073
auuaaugacauucaggccgcc

SEQ ID NO: 656485 - RNA, 13 nt, Escherichia coli CFT073
auuaaucccuuaa

SEQ ID NO: 656486 - RNA, 23 nt, Escherichia coli CFT073
auuaaucgccaguuucugcccaa

SEQ ID NO: 656487 - RNA, 21 nt, Escherichia coli CFT073
auuaaugccgcaacuuucgcc

SEQ ID NO: 656488 - RNA, 13 nt, Escherichia coli CFT073
auuaaugcuuuca

SEQ ID NO: 656489 - RNA, 14 nt, Escherichia coli CFT073
auuaaugcuuucag

SEQ ID NO: 656490 - RNA, 19 nt, Escherichia coli CFT073
auuaauccauaaccauaau

SEQ ID NO: 656491 - RNA, 13 nt, Escherichia coli CFT073
auuaaucaccagu

SEQ ID NO: 656492 - RNA, 14 nt, Escherichia coli CFT073
auuaaucagcagau

SEQ ID NO: 656493 - RNA, 16 nt, Escherichia coli CFT073
auuaauauuaaaccac

SEQ ID NO: 656494 - RNA, 21 nt, Escherichia coli CFT073
auuaauaaggaugcaacacau

SEQ ID NO: 656495 - RNA, 17 nt, Escherichia coli CFT073
auuaauaaaauuaucca

SEQ ID NO: 656496 - RNA, 13 nt, Escherichia coli CFT073
auuaauaaccauu

SEQ ID NO: 656497 - RNA, 18 nt, Escherichia coli CFT073
auuaaguaacaauaucua

SEQ ID NO: 656498 - RNA, 19 nt, Escherichia coli CFT073
auuaaguuaccgguagugc

SEQ ID NO: 656499 - RNA, 15 nt, Escherichia coli CFT073
auuaaguugauuuug

SEQ ID NO: 656500 - RNA, 22 nt, Escherichia coli CFT073
auuaaauucgaacggugaauuc

SEQ ID NO: 656501 - RNA, 11 nt, Escherichia coli CFT073
auuaaccauga

SEQ ID NO: 656502 - RNA, 12 nt, Escherichia coli CFT073
auuaacccauuu

SEQ ID NO: 656503 - RNA, 21 nt, Escherichia coli CFT073
auuaacaggcggcuaugcugg

SEQ ID NO: 656504 - RNA, 12 nt, Escherichia coli CFT073
auuaacagucag

SEQ ID NO: 656505 - RNA, 18 nt, Escherichia coli CFT073
auuaacuaaaugaaauau

SEQ ID NO: 656506 - RNA, 14 nt, Escherichia coli CFT073
auuaacguuuccau

SEQ ID NO: 656507 - RNA, 23 nt, Escherichia coli CFT073
auuaacuccggccugcacugcag

SEQ ID NO: 656508 - RNA, 20 nt, Escherichia coli CFT073
auuaacugcuggaauacugg

SEQ ID NO: 656509 - RNA, 19 nt, Escherichia coli CFT073
auuaacccgcaacagcaau

SEQ ID NO: 656510 - RNA, 15 nt, Escherichia coli CFT073
auuaacgaaaucuca

SEQ ID NO: 656511 - RNA, 20 nt, Escherichia coli CFT073
auuaacgacacucucuucaa

SEQ ID NO: 656512 - RNA, 22 nt, Escherichia coli CFT073
auuaacgccagacucgccaggc

SEQ ID NO: 656513 - RNA, 19 nt, Escherichia coli CFT073
auuaacgcuuguaaaugaa

SEQ ID NO: 656514 - RNA, 23 nt, Escherichia coli CFT073
auuaacggcguuuccuucguuau

SEQ ID NO: 656515 - RNA, 16 nt, Escherichia coli CFT073
auuaaaaugaauaacu

SEQ ID NO: 656516 - RNA, 13 nt, Escherichia coli CFT073
auguuuuuauuaa

SEQ ID NO: 656517 - RNA, 20 nt, Escherichia coli CFT073
auguuuuuauuaaaguagua

SEQ ID NO: 656518 - RNA, 23 nt, Escherichia coli CFT073
auguuuuucaccuugagggauuc

SEQ ID NO: 656519 - RNA, 13 nt, Escherichia coli CFT073
auuaaacaaauaa

SEQ ID NO: 656520 - RNA, 14 nt, Escherichia coli CFT073
auuaaacaaauaaa

SEQ ID NO: 656521 - RNA, 16 nt, Escherichia coli CFT073
auuaaaccaggaacag

SEQ ID NO: 656522 - RNA, 11 nt, Escherichia coli CFT073
auuaaagcagc

SEQ ID NO: 656523 - RNA, 11 nt, Escherichia coli CFT073
auuaaagaugu

SEQ ID NO: 656524 - RNA, 18 nt, Escherichia coli CFT073
auuaaauauuauaugugu

SEQ ID NO: 656525 - RNA, 21 nt, Escherichia coli CFT073
auuaaauccgccaaauggaua

SEQ ID NO: 656526 - RNA, 15 nt, Escherichia coli CFT073
auuaaauaguuuuuu

SEQ ID NO: 656527 - RNA, 18 nt, Escherichia coli CFT073
auuaaagccgcgaaacug

SEQ ID NO: 656528 - RNA, 15 nt, Escherichia coli CFT073
auuaaaggcaccaau

SEQ ID NO: 656529 - RNA, 17 nt, Escherichia coli CFT073
auuaaaggcaccaauau

SEQ ID NO: 656530 - RNA, 17 nt, Escherichia coli CFT073
auguugcuuuaaaucgu

SEQ ID NO: 656531 - RNA, 18 nt, Escherichia coli CFT073
auguuguugucacacccg

SEQ ID NO: 656532 - RNA, 23 nt, Escherichia coli CFT073
auguugcgcagaguuuccaggcu

SEQ ID NO: 656533 - RNA, 17 nt, Escherichia coli CFT073
auguugcgccucaagaa

SEQ ID NO: 656534 - RNA, 15 nt, Escherichia coli CFT073
auguucaucaagcug

SEQ ID NO: 656535 - RNA, 20 nt, Escherichia coli CFT073
auguucaucaagcugugccu

SEQ ID NO: 656536 - RNA, 17 nt, Escherichia coli CFT073
auguucaggauauuuau

SEQ ID NO: 656537 - RNA, 20 nt, Escherichia coli CFT073
auguuccagggccuccugca

SEQ ID NO: 656538 - RNA, 16 nt, Escherichia coli CFT073
auguuccaguucacga

SEQ ID NO: 656539 - RNA, 21 nt, Escherichia coli CFT073
auguucagaaagcgccagcaa

SEQ ID NO: 656540 - RNA, 22 nt, Escherichia coli CFT073
auguucagaaagcgccagcaag

SEQ ID NO: 656541 - RNA, 16 nt, Escherichia coli CFT073
auguuuacgccugguu

SEQ ID NO: 656542 - RNA, 18 nt, Escherichia coli CFT073
auguuucaacggaccaau

SEQ ID NO: 656543 - RNA, 13 nt, Escherichia coli CFT073
auguuuccagcau

SEQ ID NO: 656544 - RNA, 19 nt, Escherichia coli CFT073
auguuucaacggaccaaua

SEQ ID NO: 656545 - RNA, 21 nt, Escherichia coli CFT073
auguuuuaacacacaauuacc

SEQ ID NO: 656546 - RNA, 21 nt, Escherichia coli CFT073
auuaugcacaccccgcgccgc

SEQ ID NO: 656547 - RNA, 12 nt, Escherichia coli CFT073
auuaucuucacc

SEQ ID NO: 656548 - RNA, 16 nt, Escherichia coli CFT073
auuaucuggcaagccu

SEQ ID NO: 656549 - RNA, 18 nt, Escherichia coli CFT073
auuaucuggucaguuaac

SEQ ID NO: 656550 - RNA, 21 nt, Escherichia coli CFT073
auuaucuccccgccaaaaucu

SEQ ID NO: 656551 - RNA, 13 nt, Escherichia coli CFT073
auuauccagccag

SEQ ID NO: 656552 - RNA, 14 nt, Escherichia coli CFT073
auuauccagcgccc

SEQ ID NO: 656553 - RNA, 15 nt, Escherichia coli CFT073
auuaucccccagcac

SEQ ID NO: 656554 - RNA, 21 nt, Escherichia coli CFT073
auuaucggagaaauucugcau

SEQ ID NO: 656555 - RNA, 16 nt, Escherichia coli CFT073
auuaucgcuucgcuaa

SEQ ID NO: 656556 - RNA, 12 nt, Escherichia coli CFT073
auuaucacauca

SEQ ID NO: 656557 - RNA, 17 nt, Escherichia coli CFT073
auuaucaacguagaaua

SEQ ID NO: 656558 - RNA, 14 nt, Escherichia coli CFT073
auuaucaaaucacc

SEQ ID NO: 656559 - RNA, 16 nt, Escherichia coli CFT073
auuaucaaaucaccau

SEQ ID NO: 656560 - RNA, 22 nt, Escherichia coli CFT073
auuaucaauugcuucaauaauc

SEQ ID NO: 656561 - RNA, 16 nt, Escherichia coli CFT073
auuauuacguccacca

SEQ ID NO: 656562 - RNA, 14 nt, Escherichia coli CFT073
auuauuaacaagau

SEQ ID NO: 656563 - RNA, 19 nt, Escherichia coli CFT073
auuaugcguagccaggcuu

SEQ ID NO: 656564 - RNA, 18 nt, Escherichia coli CFT073
auuaugucauugaauguu

SEQ ID NO: 656565 - RNA, 16 nt, Escherichia coli CFT073
auuauggaucaccauc

SEQ ID NO: 656566 - RNA, 14 nt, Escherichia coli CFT073
auuauggugacaaa

SEQ ID NO: 656567 - RNA, 20 nt, Escherichia coli CFT073
auuauugagcgcaaauugcu

SEQ ID NO: 656568 - RNA, 15 nt, Escherichia coli CFT073
auuauucaaaaacag

SEQ ID NO: 656569 - RNA, 23 nt, Escherichia coli CFT073
auuauugccuugaugaaaaaacc

SEQ ID NO: 656570 - RNA, 23 nt, Escherichia coli CFT073
auuauuggcaucguauuucagac

SEQ ID NO: 656571 - RNA, 13 nt, Escherichia coli CFT073
auucaaaaacaga

SEQ ID NO: 656572 - RNA, 22 nt, Escherichia coli CFT073
auuauuuuugcuauaugcaagg

SEQ ID NO: 656573 - RNA, 22 nt, Escherichia coli CFT073
auucaaagcgauuauagcuaac

SEQ ID NO: 656574 - RNA, 21 nt, Escherichia coli CFT073
auucaaaggugacguccagaa

SEQ ID NO: 656575 - RNA, 16 nt, Escherichia coli CFT073
auucaaccucuguuca

SEQ ID NO: 656576 - RNA, 17 nt, Escherichia coli CFT073
auucaacguccuggcgc

SEQ ID NO: 656577 - RNA, 14 nt, Escherichia coli CFT073
auucaacuaacuga

SEQ ID NO: 656578 - RNA, 19 nt, Escherichia coli CFT073
auucaagauuggccugaau

SEQ ID NO: 656579 - RNA, 22 nt, Escherichia coli CFT073
auucaagauuggccugaauauc

SEQ ID NO: 656580 - RNA, 22 nt, Escherichia coli CFT073
auucaagcauuauuuuugcuau

SEQ ID NO: 656581 - RNA, 14 nt, Escherichia coli CFT073
auucaagcauugau

SEQ ID NO: 656582 - RNA, 17 nt, Escherichia coli CFT073
auucaccuguaauugcu

SEQ ID NO: 656583 - RNA, 16 nt, Escherichia coli CFT073
auucacguaucagcau

SEQ ID NO: 656584 - RNA, 16 nt, Escherichia coli CFT073
auucacguugauggua

SEQ ID NO: 656585 - RNA, 11 nt, Escherichia coli CFT073
auucacuuccg

SEQ ID NO: 656586 - RNA, 19 nt, Escherichia coli CFT073
auucacuucuguuuuauca

SEQ ID NO: 656587 - RNA, 16 nt, Escherichia coli CFT073
auucacuuucugaagg

SEQ ID NO: 656588 - RNA, 12 nt, Escherichia coli CFT073
auucagcaacau

SEQ ID NO: 656589 - RNA, 16 nt, Escherichia coli CFT073
auucagcaacaucacc

SEQ ID NO: 656590 - RNA, 13 nt, Escherichia coli CFT073
auucagaugccau

SEQ ID NO: 656591 - RNA, 15 nt, Escherichia coli CFT073
auucagauucaaauc

SEQ ID NO: 656592 - RNA, 23 nt, Escherichia coli CFT073
auucagaacacaaaaccgauuaa

SEQ ID NO: 656593 - RNA, 21 nt, Escherichia coli CFT073
auucagacacgccgccagacc

SEQ ID NO: 656594 - RNA, 16 nt, Escherichia coli CFT073
auucagaguauauauu

SEQ ID NO: 656595 - RNA, 17 nt, Escherichia coli CFT073
auucagaguauauauuc

SEQ ID NO: 656596 - RNA, 13 nt, Escherichia coli CFT073
auucacaaaaaca

SEQ ID NO: 656597 - RNA, 15 nt, Escherichia coli CFT073
auucacaaaaacagu

SEQ ID NO: 656598 - RNA, 16 nt, Escherichia coli CFT073
auucaaucucuucaca

SEQ ID NO: 656599 - RNA, 15 nt, Escherichia coli CFT073
auucaauguguugau

SEQ ID NO: 656600 - RNA, 17 nt, Escherichia coli CFT073
auucacauuuuuaagcc

SEQ ID NO: 656601 - RNA, 17 nt, Escherichia coli CFT073
auucaccaccaucaaau

SEQ ID NO: 656602 - RNA, 21 nt, Escherichia coli CFT073
auucacacucugccagcgaca

SEQ ID NO: 656603 - RNA, 13 nt, Escherichia coli CFT073
auucaccaccgug

SEQ ID NO: 656604 - RNA, 19 nt, Escherichia coli CFT073
auucaccagcaaauccagc

SEQ ID NO: 656605 - RNA, 18 nt, Escherichia coli CFT073
auucacccgcgccuaaau

SEQ ID NO: 656606 - RNA, 16 nt, Escherichia coli CFT073
auucaccguucaauuc

SEQ ID NO: 656607 - RNA, 15 nt, Escherichia coli CFT073
auucaccucagaaau

SEQ ID NO: 656608 - RNA, 16 nt, Escherichia coli CFT073
auucaccucugcggca

SEQ ID NO: 656609 - RNA, 16 nt, Escherichia coli CFT073
auuagcgguaaaccaa

SEQ ID NO: 656610 - RNA, 17 nt, Escherichia coli CFT073
auuagcgguaaaccaac

SEQ ID NO: 656611 - RNA, 19 nt, Escherichia coli CFT073
auuagcaaauuauccccca

SEQ ID NO: 656612 - RNA, 22 nt, Escherichia coli CFT073
auuacuucgccggaauuucuuu

SEQ ID NO: 656613 - RNA, 18 nt, Escherichia coli CFT073
auuacuguugucgagcaa

SEQ ID NO: 656614 - RNA, 20 nt, Escherichia coli CFT073
auuacugaccuccaguccca

SEQ ID NO: 656615 - RNA, 16 nt, Escherichia coli CFT073
auuacucuaccuuccu

SEQ ID NO: 656616 - RNA, 17 nt, Escherichia coli CFT073
auuacucucuuucgcuu

SEQ ID NO: 656617 - RNA, 20 nt, Escherichia coli CFT073
auuacuggccuuuauuuucc

SEQ ID NO: 656618 - RNA, 15 nt, Escherichia coli CFT073
auuacuggcgauugu

SEQ ID NO: 656619 - RNA, 13 nt, Escherichia coli CFT073
auuacuguaggcc

SEQ ID NO: 656620 - RNA, 18 nt, Escherichia coli CFT073
auuacuuuccaucuuucc

SEQ ID NO: 656621 - RNA, 20 nt, Escherichia coli CFT073
auuauaucuuaguuauuacu

SEQ ID NO: 656622 - RNA, 13 nt, Escherichia coli CFT073
auuauaauaaaua

SEQ ID NO: 656623 - RNA, 14 nt, Escherichia coli CFT073
auuauaauaaauau

SEQ ID NO: 656624 - RNA, 13 nt, Escherichia coli CFT073
auuagcuuaucaa

SEQ ID NO: 656625 - RNA, 23 nt, Escherichia coli CFT073
auuauaaaucccugccgccauca

SEQ ID NO: 656626 - RNA, 16 nt, Escherichia coli CFT073
auuagucuuuaucugc

SEQ ID NO: 656627 - RNA, 20 nt, Escherichia coli CFT073
auuaauuauugauuccagca

SEQ ID NO: 656628 - RNA, 16 nt, Escherichia coli CFT073
auuaauguuuucaguu

SEQ ID NO: 656629 - RNA, 19 nt, Escherichia coli CFT073
auuaauuucccaccacuau

SEQ ID NO: 656630 - RNA, 13 nt, Escherichia coli CFT073
auuaauuugccag

SEQ ID NO: 656631 - RNA, 15 nt, Escherichia coli CFT073
auuaauuuguauggu

SEQ ID NO: 656632 - RNA, 18 nt, Escherichia coli CFT073
auuacauaccagcagcau

SEQ ID NO: 656633 - RNA, 20 nt, Escherichia coli CFT073
auuacauaccagcagcauca

SEQ ID NO: 656634 - RNA, 22 nt, Escherichia coli CFT073
auuacauaccagcagcaucacg

SEQ ID NO: 656635 - RNA, 21 nt, Escherichia coli CFT073
auuacagccgggagugaauuc

SEQ ID NO: 656636 - RNA, 23 nt, Escherichia coli CFT073
auuacagcgcaauacgaaucaca

SEQ ID NO: 656637 - RNA, 17 nt, Escherichia coli CFT073
auuacacaaguccagca

SEQ ID NO: 656638 - RNA, 16 nt, Escherichia coli CFT073
auuacacacaacacau

SEQ ID NO: 656639 - RNA, 18 nt, Escherichia coli CFT073
auuacaagaaucaugcca

SEQ ID NO: 656640 - RNA, 20 nt, Escherichia coli CFT073
auuacaagaaucaugccaaa

SEQ ID NO: 656641 - RNA, 19 nt, Escherichia coli CFT073
auuaccugagccugugcau

SEQ ID NO: 656642 - RNA, 17 nt, Escherichia coli CFT073
auuaccggucagggcca

SEQ ID NO: 656643 - RNA, 20 nt, Escherichia coli CFT073
auuacgacggugaucaucaa

SEQ ID NO: 656644 - RNA, 18 nt, Escherichia coli CFT073
auuacgaaagcaaaauua

SEQ ID NO: 656645 - RNA, 15 nt, Escherichia coli CFT073
auuacccuauuuaaa

SEQ ID NO: 656646 - RNA, 16 nt, Escherichia coli CFT073
auuacccuauuuaaag

SEQ ID NO: 656647 - RNA, 21 nt, Escherichia coli CFT073
auuaccccuggugggguuccc

SEQ ID NO: 656648 - RNA, 12 nt, Escherichia coli CFT073
auuacccggcau

SEQ ID NO: 656649 - RNA, 21 nt, Escherichia coli CFT073
auuaccgauaucaauaacaua

SEQ ID NO: 656650 - RNA, 12 nt, Escherichia coli CFT073
auuaccauuuca

SEQ ID NO: 656651 - RNA, 13 nt, Escherichia coli CFT073
auuaccaaucugc

SEQ ID NO: 656652 - RNA, 18 nt, Escherichia coli CFT073
auuaccacaacaaaucgu

SEQ ID NO: 656653 - RNA, 16 nt, Escherichia coli CFT073
auuaccaccagcgaca

SEQ ID NO: 656654 - RNA, 23 nt, Escherichia coli CFT073
auuaccacugaggcgauagcauc

SEQ ID NO: 656655 - RNA, 15 nt, Escherichia coli CFT073
auuaccagcaucacc

SEQ ID NO: 656656 - RNA, 15 nt, Escherichia coli CFT073
auuacgcggcuucaa

SEQ ID NO: 656657 - RNA, 18 nt, Escherichia coli CFT073
auuacgcggcuucaacuu

SEQ ID NO: 656658 - RNA, 20 nt, Escherichia coli CFT073
auuacgcucgcugcaaaaca

SEQ ID NO: 656659 - RNA, 23 nt, Escherichia coli CFT073
auuacgcuucggcaauuucagug

SEQ ID NO: 656660 - RNA, 17 nt, Escherichia coli CFT073
auuacggcucaacccca

SEQ ID NO: 656661 - RNA, 20 nt, Escherichia coli CFT073
auuacgggucacaaacauca

SEQ ID NO: 656662 - RNA, 19 nt, Escherichia coli CFT073
auuacguccaucacaauca

SEQ ID NO: 656663 - RNA, 15 nt, Escherichia coli CFT073
auuacuccacuuccu

SEQ ID NO: 656664 - RNA, 22 nt, Escherichia coli CFT073
auuacuauggauauaauuuuuu

SEQ ID NO: 656665 - RNA, 15 nt, Escherichia coli CFT073
auuacuacaaacaau

SEQ ID NO: 656666 - RNA, 17 nt, Escherichia coli CFT073
auuacuacaaacaaugc

SEQ ID NO: 656667 - RNA, 21 nt, Escherichia coli CFT073
auuacguucgacugcgccuuc

SEQ ID NO: 656668 - RNA, 22 nt, Escherichia coli CFT073
auuuaucuacuacccagcaauc

SEQ ID NO: 656669 - RNA, 14 nt, Escherichia coli CFT073
auuuauucagaauu

SEQ ID NO: 656670 - RNA, 16 nt, Escherichia coli CFT073
auuuauucagaauuuu

SEQ ID NO: 656671 - RNA, 18 nt, Escherichia coli CFT073
auuuauugaauuuucaau

SEQ ID NO: 656672 - RNA, 17 nt, Escherichia coli CFT073
auuuauuugacauuuuu

SEQ ID NO: 656673 - RNA, 20 nt, Escherichia coli CFT073
auuuauuugacauuuuuuca

SEQ ID NO: 656674 - RNA, 21 nt, Escherichia coli CFT073
auuuauuuccuucgcuuuaau

SEQ ID NO: 656675 - RNA, 23 nt, Escherichia coli CFT073
auuuauuuuuacucuucuuuaau

SEQ ID NO: 656676 - RNA, 14 nt, Escherichia coli CFT073
auuucaaauugcuc

SEQ ID NO: 656677 - RNA, 13 nt, Escherichia coli CFT073
auuucaacagauu

SEQ ID NO: 656678 - RNA, 19 nt, Escherichia coli CFT073
auuucagcaucgccaucaa

SEQ ID NO: 656679 - RNA, 14 nt, Escherichia coli CFT073
auuucagccccagc

SEQ ID NO: 656680 - RNA, 18 nt, Escherichia coli CFT073
auuucagcggcacuguuu

SEQ ID NO: 656681 - RNA, 17 nt, Escherichia coli CFT073
auuucaggcaacaaaaa

SEQ ID NO: 656682 - RNA, 16 nt, Escherichia coli CFT073
auuucaggccccaucg

SEQ ID NO: 656683 - RNA, 20 nt, Escherichia coli CFT073
auuucaggccccaucgaauc

SEQ ID NO: 656684 - RNA, 21 nt, Escherichia coli CFT073
auuucaucgccagcgaauucc

SEQ ID NO: 656685 - RNA, 14 nt, Escherichia coli CFT073
auuuauaaaaucca

SEQ ID NO: 656686 - RNA, 14 nt, Escherichia coli CFT073
auuuauagauucua

SEQ ID NO: 656687 - RNA, 18 nt, Escherichia coli CFT073
auuuaucgauuuucaaaa

SEQ ID NO: 656688 - RNA, 21 nt, Escherichia coli CFT073
auuuaaugacgaaucagcaaa

SEQ ID NO: 656689 - RNA, 22 nt, Escherichia coli CFT073
auuuaacucaccgaugaucgcc

SEQ ID NO: 656690 - RNA, 17 nt, Escherichia coli CFT073
auuuagauaaacggaac

SEQ ID NO: 656691 - RNA, 14 nt, Escherichia coli CFT073
auuuaguauuuuau

SEQ ID NO: 656692 - RNA, 12 nt, Escherichia coli CFT073
auuguaauacaa

SEQ ID NO: 656693 - RNA, 17 nt, Escherichia coli CFT073
auugggugacuggaaca

SEQ ID NO: 656694 - RNA, 17 nt, Escherichia coli CFT073
auuguacuuuccagcca

SEQ ID NO: 656695 - RNA, 22 nt, Escherichia coli CFT073
auuguaugucggugcauuuucu

SEQ ID NO: 656696 - RNA, 17 nt, Escherichia coli CFT073
auugucaauauccagca

SEQ ID NO: 656697 - RNA, 15 nt, Escherichia coli CFT073
auugugcgccauuuu

SEQ ID NO: 656698 - RNA, 20 nt, Escherichia coli CFT073
auugucuucaucgaugcugc

SEQ ID NO: 656699 - RNA, 23 nt, Escherichia coli CFT073
auugucugugucugauauuuuau

SEQ ID NO: 656700 - RNA, 23 nt, Escherichia coli CFT073
auugucuuaaaccggacaauaaa

SEQ ID NO: 656701 - RNA, 16 nt, Escherichia coli CFT073
auugucgauacgccuc

SEQ ID NO: 656702 - RNA, 18 nt, Escherichia coli CFT073
auugucgcccuguaauuc

SEQ ID NO: 656703 - RNA, 18 nt, Escherichia coli CFT073
auugucgcggcuaacucc

SEQ ID NO: 656704 - RNA, 17 nt, Escherichia coli CFT073
auugucaggaucaccaa

SEQ ID NO: 656705 - RNA, 18 nt, Escherichia coli CFT073
auugucaggaucaccaau

SEQ ID NO: 656706 - RNA, 14 nt, Escherichia coli CFT073
auugugugacacuu

SEQ ID NO: 656707 - RNA, 17 nt, Escherichia coli CFT073
auugugugacacuucuu

SEQ ID NO: 656708 - RNA, 17 nt, Escherichia coli CFT073
auuguucaacgaaaaua

SEQ ID NO: 656709 - RNA, 13 nt, Escherichia coli CFT073
auuguuauaaugu

SEQ ID NO: 656710 - RNA, 17 nt, Escherichia coli CFT073
auuguuauaccagucca

SEQ ID NO: 656711 - RNA, 17 nt, Escherichia coli CFT073
auuguuaucagcaauaa

SEQ ID NO: 656712 - RNA, 12 nt, Escherichia coli CFT073
auuguucugcaa

SEQ ID NO: 656713 - RNA, 16 nt, Escherichia coli CFT073
auuguuuaaaaauaca

SEQ ID NO: 656714 - RNA, 15 nt, Escherichia coli CFT073
auuguugccggagaa

SEQ ID NO: 656715 - RNA, 12 nt, Escherichia coli CFT073
auuguuuuaaau

SEQ ID NO: 656716 - RNA, 23 nt, Escherichia coli CFT073
auuguuuuaaauauuguuuuuau

SEQ ID NO: 656717 - RNA, 18 nt, Escherichia coli CFT073
auuuaaacccuuucugcu

SEQ ID NO: 656718 - RNA, 13 nt, Escherichia coli CFT073
auuuaaacugaag

SEQ ID NO: 656719 - RNA, 16 nt, Escherichia coli CFT073
auuuaaacugaagacu

SEQ ID NO: 656720 - RNA, 13 nt, Escherichia coli CFT073
auuuaacagcaaa

SEQ ID NO: 656721 - RNA, 18 nt, Escherichia coli CFT073
auuuaacccuucaagaau

SEQ ID NO: 656722 - RNA, 14 nt, Escherichia coli CFT073
auuuaacggcagca

SEQ ID NO: 656723 - RNA, 22 nt, Escherichia coli CFT073
auugcucccugcggcgaugacc

SEQ ID NO: 656724 - RNA, 14 nt, Escherichia coli CFT073
auugcuagcggguu

SEQ ID NO: 656725 - RNA, 17 nt, Escherichia coli CFT073
auugcuaagcucucagc

SEQ ID NO: 656726 - RNA, 13 nt, Escherichia coli CFT073
auugcuaucaaca

SEQ ID NO: 656727 - RNA, 15 nt, Escherichia coli CFT073
auugcuauuuaacaa

SEQ ID NO: 656728 - RNA, 22 nt, Escherichia coli CFT073
auugccuuccaccagauggcuu

SEQ ID NO: 656729 - RNA, 21 nt, Escherichia coli CFT073
auugccuggugcccaucacua

SEQ ID NO: 656730 - RNA, 18 nt, Escherichia coli CFT073
auugcgaauauggacuuu

SEQ ID NO: 656731 - RNA, 13 nt, Escherichia coli CFT073
auugcgagcucaa

SEQ ID NO: 656732 - RNA, 17 nt, Escherichia coli CFT073
auugcgagcucaauaua

SEQ ID NO: 656733 - RNA, 18 nt, Escherichia coli CFT073
auugcgcaacuuuuucuu

SEQ ID NO: 656734 - RNA, 19 nt, Escherichia coli CFT073
auugcgcaaccgcccggcc

SEQ ID NO: 656735 - RNA, 14 nt, Escherichia coli CFT073
auuggagaauaugu

SEQ ID NO: 656736 - RNA, 20 nt, Escherichia coli CFT073
auuggagaguugcaccagca

SEQ ID NO: 656737 - RNA, 21 nt, Escherichia coli CFT073
auuggagaguugcaccagcaa

SEQ ID NO: 656738 - RNA, 14 nt, Escherichia coli CFT073
auuggagccugccc

SEQ ID NO: 656739 - RNA, 13 nt, Escherichia coli CFT073
auugcuucaagau

SEQ ID NO: 656740 - RNA, 14 nt, Escherichia coli CFT073
auugcuugcgccuu

SEQ ID NO: 656741 - RNA, 21 nt, Escherichia coli CFT073
auuggggaugacgaauaauug

SEQ ID NO: 656742 - RNA, 21 nt, Escherichia coli CFT073
auuggcaaucacaucaccaua

SEQ ID NO: 656743 - RNA, 21 nt, Escherichia coli CFT073
auuggcaauugccauaaaaac

SEQ ID NO: 656744 - RNA, 18 nt, Escherichia coli CFT073
auuggcagguggcauguu

SEQ ID NO: 656745 - RNA, 13 nt, Escherichia coli CFT073
auugcaauuuuua

SEQ ID NO: 656746 - RNA, 18 nt, Escherichia coli CFT073
auugcacaugcuaaaaau

SEQ ID NO: 656747 - RNA, 19 nt, Escherichia coli CFT073
auugcaccagaucuuccag

SEQ ID NO: 656748 - RNA, 23 nt, Escherichia coli CFT073
auugaguagccacgcgacauaaa

SEQ ID NO: 656749 - RNA, 18 nt, Escherichia coli CFT073
auugauuucuuauucaua

SEQ ID NO: 656750 - RNA, 12 nt, Escherichia coli CFT073
auugagcugccc

SEQ ID NO: 656751 - RNA, 17 nt, Escherichia coli CFT073
auugaggcgcugaaugu

SEQ ID NO: 656752 - RNA, 13 nt, Escherichia coli CFT073
auugcacuggcac

SEQ ID NO: 656753 - RNA, 19 nt, Escherichia coli CFT073
auugccauuacuacaaaca

SEQ ID NO: 656754 - RNA, 17 nt, Escherichia coli CFT073
auugcccaagaugccag

SEQ ID NO: 656755 - RNA, 22 nt, Escherichia coli CFT073
auugcccuguuugucgaucauc

SEQ ID NO: 656756 - RNA, 16 nt, Escherichia coli CFT073
auugcccgcagaugua

SEQ ID NO: 656757 - RNA, 12 nt, Escherichia coli CFT073
auugccucaugc

SEQ ID NO: 656758 - RNA, 22 nt, Escherichia coli CFT073
auugccugaucgcgcaaacagu

SEQ ID NO: 656759 - RNA, 21 nt, Escherichia coli CFT073
auugccugaugcgacgcugcg

SEQ ID NO: 656760 - RNA, 16 nt, Escherichia coli CFT073
auugccgaagaccaga

SEQ ID NO: 656761 - RNA, 17 nt, Escherichia coli CFT073
auugccgcagucuggug

SEQ ID NO: 656762 - RNA, 15 nt, Escherichia coli CFT073
auugccgccucugcc

SEQ ID NO: 656763 - RNA, 18 nt, Escherichia coli CFT073
auugccgcgauagcaagc

SEQ ID NO: 656764 - RNA, 17 nt, Escherichia coli CFT073
auugaaagcaaaaaaag

SEQ ID NO: 656765 - RNA, 20 nt, Escherichia coli CFT073
auugaaagcaaaaaaagaau

SEQ ID NO: 656766 - RNA, 16 nt, Escherichia coli CFT073
auugaaaauuacucag

SEQ ID NO: 656767 - RNA, 21 nt, Escherichia coli CFT073
auugaagcagaucuucaggag

SEQ ID NO: 656768 - RNA, 18 nt, Escherichia coli CFT073
auugaagcccaaaaacua

SEQ ID NO: 656769 - RNA, 19 nt, Escherichia coli CFT073
auugaagcaauccauacca

SEQ ID NO: 656770 - RNA, 18 nt, Escherichia coli CFT073
auugagaauaaugccuuu

SEQ ID NO: 656771 - RNA, 23 nt, Escherichia coli CFT073
auugagcaaagacgcguucaucu

SEQ ID NO: 656772 - RNA, 16 nt, Escherichia coli CFT073
auugagauccugccag

SEQ ID NO: 656773 - RNA, 20 nt, Escherichia coli CFT073
auugagaucgcuuaacagaa

SEQ ID NO: 656774 - RNA, 17 nt, Escherichia coli CFT073
auugagaaacagaaaaa

SEQ ID NO: 656775 - RNA, 11 nt, Escherichia coli CFT073
auugagauaag

SEQ ID NO: 656776 - RNA, 16 nt, Escherichia coli CFT073
auugagauaagcaaca

SEQ ID NO: 656777 - RNA, 17 nt, Escherichia coli CFT073
auugaccgccagcgcca

SEQ ID NO: 656778 - RNA, 17 nt, Escherichia coli CFT073
auugaaggcaauugcau

SEQ ID NO: 656779 - RNA, 13 nt, Escherichia coli CFT073
auugacuaucuga

SEQ ID NO: 656780 - RNA, 14 nt, Escherichia coli CFT073
auucucccgccugc

SEQ ID NO: 656781 - RNA, 14 nt, Escherichia coli CFT073
auucucccacagca

SEQ ID NO: 656782 - RNA, 17 nt, Escherichia coli CFT073
auucaggggaagccaga

SEQ ID NO: 656783 - RNA, 20 nt, Escherichia coli CFT073
auucaggggaagccagacaa

SEQ ID NO: 656784 - RNA, 15 nt, Escherichia coli CFT073
auucagcgucucacu

SEQ ID NO: 656785 - RNA, 19 nt, Escherichia coli CFT073
auucaggaugugagcuggc

SEQ ID NO: 656786 - RNA, 17 nt, Escherichia coli CFT073
auucagcagagcaauau

SEQ ID NO: 656787 - RNA, 19 nt, Escherichia coli CFT073
auucagcauggaauagaau

SEQ ID NO: 656788 - RNA, 20 nt, Escherichia coli CFT073
auucagcccgagguuauuuu

SEQ ID NO: 656789 - RNA, 14 nt, Escherichia coli CFT073
auucagcccggcaa

SEQ ID NO: 656790 - RNA, 17 nt, Escherichia coli CFT073
auucagcccggcaacgu

SEQ ID NO: 656791 - RNA, 19 nt, Escherichia coli CFT073
auucagcccggguuugccg

SEQ ID NO: 656792 - RNA, 17 nt, Escherichia coli CFT073
auucagcguaucaauua

SEQ ID NO: 656793 - RNA, 21 nt, Escherichia coli CFT073
auucuggaguaaugcaugacu

SEQ ID NO: 656794 - RNA, 17 nt, Escherichia coli CFT073
auucuccggcaggaaau

SEQ ID NO: 656795 - RNA, 16 nt, Escherichia coli CFT073
auucuccggcaggaaa

SEQ ID NO: 656796 - RNA, 21 nt, Escherichia coli CFT073
auucucgcuacccaugaagaa

SEQ ID NO: 656797 - RNA, 22 nt, Escherichia coli CFT073
auucuggcuaaccaaacuucag

SEQ ID NO: 656798 - RNA, 16 nt, Escherichia coli CFT073
auucuggugagagcaa

SEQ ID NO: 656799 - RNA, 22 nt, Escherichia coli CFT073
auucuguucaguacgaaauaac

SEQ ID NO: 656800 - RNA, 13 nt, Escherichia coli CFT073
auucuguuucauu

SEQ ID NO: 656801 - RNA, 18 nt, Escherichia coli CFT073
auuuuaaauuuccucuug

SEQ ID NO: 656802 - RNA, 15 nt, Escherichia coli CFT073
auuuuaaaggauuua

SEQ ID NO: 656803 - RNA, 23 nt, Escherichia coli CFT073
auuuuaaaggauuuacuaaaacu

SEQ ID NO: 656804 - RNA, 15 nt, Escherichia coli CFT073
auuuuaauaaaucac

SEQ ID NO: 656805 - RNA, 15 nt, Escherichia coli CFT073
auuuuacgcccgcga

SEQ ID NO: 656806 - RNA, 22 nt, Escherichia coli CFT073
auuuuacugguugauuuuaaag

SEQ ID NO: 656807 - RNA, 14 nt, Escherichia coli CFT073
auuuuacuucccag

SEQ ID NO: 656808 - RNA, 18 nt, Escherichia coli CFT073
auuuucaauugauaauaa

SEQ ID NO: 656809 - RNA, 14 nt, Escherichia coli CFT073
auuuucaccacauu

SEQ ID NO: 656810 - RNA, 22 nt, Escherichia coli CFT073
auuuucagcgugcccacguuca

SEQ ID NO: 656811 - RNA, 20 nt, Escherichia coli CFT073
auuuugcacauuccagaugc

SEQ ID NO: 656812 - RNA, 21 nt, Escherichia coli CFT073
auuuugaugauaucagccugc

SEQ ID NO: 656813 - RNA, 14 nt, Escherichia coli CFT073
auuuucuucauucg

SEQ ID NO: 656814 - RNA, 22 nt, Escherichia coli CFT073
auuuucuuccaguagcacaauc

SEQ ID NO: 656815 - RNA, 15 nt, Escherichia coli CFT073
auuuuguaggccuga

SEQ ID NO: 656816 - RNA, 18 nt, Escherichia coli CFT073
auuuuguaggccugauaa

SEQ ID NO: 656817 - RNA, 16 nt, Escherichia coli CFT073
auuuugucagcccuuu

SEQ ID NO: 656818 - RNA, 16 nt, Escherichia coli CFT073
auuuuguucaauaaga

SEQ ID NO: 656819 - RNA, 15 nt, Escherichia coli CFT073
auuuuccggguucuc

SEQ ID NO: 656820 - RNA, 12 nt, Escherichia coli CFT073
auuuuccugcgc

SEQ ID NO: 656821 - RNA, 16 nt, Escherichia coli CFT073
auuuuccuugaaaaag

SEQ ID NO: 656822 - RNA, 18 nt, Escherichia coli CFT073
auuuuccuugaaaaagag

SEQ ID NO: 656823 - RNA, 19 nt, Escherichia coli CFT073
auuuucuucagcaguucag

SEQ ID NO: 656824 - RNA, 14 nt, Escherichia coli CFT073
auuuucgccacuuc

SEQ ID NO: 656825 - RNA, 18 nt, Escherichia coli CFT073
auuugugcgucauuuuca

SEQ ID NO: 656826 - RNA, 19 nt, Escherichia coli CFT073
auuugucucaaaacugaaa

SEQ ID NO: 656827 - RNA, 13 nt, Escherichia coli CFT073
auuuguucaugcc

SEQ ID NO: 656828 - RNA, 19 nt, Escherichia coli CFT073
auuuguuaacaauauuaac

SEQ ID NO: 656829 - RNA, 14 nt, Escherichia coli CFT073
auuugaucaaauac

SEQ ID NO: 656830 - RNA, 15 nt, Escherichia coli CFT073
auuugaugaauuuua

SEQ ID NO: 656831 - RNA, 20 nt, Escherichia coli CFT073
auuugccgauaagcaggagu

SEQ ID NO: 656832 - RNA, 21 nt, Escherichia coli CFT073
auuugcgcucaauaaucaauc

SEQ ID NO: 656833 - RNA, 17 nt, Escherichia coli CFT073
auuugcggugaagccac

SEQ ID NO: 656834 - RNA, 15 nt, Escherichia coli CFT073
auuugcucuaccagc

SEQ ID NO: 656835 - RNA, 13 nt, Escherichia coli CFT073
auuugcuccagaa

SEQ ID NO: 656836 - RNA, 19 nt, Escherichia coli CFT073
auuuggauugcuauuuaac

SEQ ID NO: 656837 - RNA, 12 nt, Escherichia coli CFT073
auuuggauuuuu

SEQ ID NO: 656838 - RNA, 12 nt, Escherichia coli CFT073
auuugaacaucg

SEQ ID NO: 656839 - RNA, 17 nt, Escherichia coli CFT073
auuugaguucacugccg

SEQ ID NO: 656840 - RNA, 20 nt, Escherichia coli CFT073
auuucucgccguucuccuca

SEQ ID NO: 656841 - RNA, 13 nt, Escherichia coli CFT073
auuucuuauucau

SEQ ID NO: 656842 - RNA, 15 nt, Escherichia coli CFT073
auuucuccacuggga

SEQ ID NO: 656843 - RNA, 20 nt, Escherichia coli CFT073
auuucguuagcaaacgacac

SEQ ID NO: 656844 - RNA, 17 nt, Escherichia coli CFT073
auuucaugaagcugaca

SEQ ID NO: 656845 - RNA, 16 nt, Escherichia coli CFT073
auuucaugccgaacag

SEQ ID NO: 656846 - RNA, 16 nt, Escherichia coli CFT073
auuucaucgcccaggc

SEQ ID NO: 656847 - RNA, 20 nt, Escherichia coli CFT073
auuucaucgcuacaccaauc

SEQ ID NO: 656848 - RNA, 13 nt, Escherichia coli CFT073
auuucucaucaau

SEQ ID NO: 656849 - RNA, 17 nt, Escherichia coli CFT073
caaaaacaguaagcaau

SEQ ID NO: 656850 - RNA, 13 nt, Escherichia coli CFT073
caaaaacccugcc

SEQ ID NO: 656851 - RNA, 18 nt, Escherichia coli CFT073
caaaaaccggcacgccgu

SEQ ID NO: 656852 - RNA, 19 nt, Escherichia coli CFT073
caaaaacguugccguaagc

SEQ ID NO: 656853 - RNA, 13 nt, Escherichia coli CFT073
caaaaaauagcaa

SEQ ID NO: 656854 - RNA, 19 nt, Escherichia coli CFT073
caaaaaaucaacgacaaaa

SEQ ID NO: 656855 - RNA, 13 nt, Escherichia coli CFT073
caaaaacaaagaa

SEQ ID NO: 656856 - RNA, 15 nt, Escherichia coli CFT073
caaaaacaaauuuug

SEQ ID NO: 656857 - RNA, 13 nt, Escherichia coli CFT073
caaaaauaaaugc

SEQ ID NO: 656858 - RNA, 17 nt, Escherichia coli CFT073
caaaaauaaaugcuuga

SEQ ID NO: 656859 - RNA, 14 nt, Escherichia coli CFT073
caaaaauaaucauc

SEQ ID NO: 656860 - RNA, 14 nt, Escherichia coli CFT073
caaaaauuacucuc

SEQ ID NO: 656861 - RNA, 17 nt, Escherichia coli CFT073
caaaaaucgacagcagg

SEQ ID NO: 656862 - RNA, 20 nt, Escherichia coli CFT073
caaaacggacauguugcuua

SEQ ID NO: 656863 - RNA, 21 nt, Escherichia coli CFT073
caaaacguggccuccaaaaaa

SEQ ID NO: 656864 - RNA, 20 nt, Escherichia coli CFT073
caaaacguugaaguacccgc

SEQ ID NO: 656865 - RNA, 17 nt, Escherichia coli CFT073
caaaacucgcuggcggc

SEQ ID NO: 656866 - RNA, 20 nt, Escherichia coli CFT073
caaaacugacgccauucuca

SEQ ID NO: 656867 - RNA, 19 nt, Escherichia coli CFT073
caaaacucaccauccugau

SEQ ID NO: 656868 - RNA, 19 nt, Escherichia coli CFT073
caaaacuggugguaagaau

SEQ ID NO: 656869 - RNA, 19 nt, Escherichia coli CFT073
caaaacaucgcuugcucgc

SEQ ID NO: 656870 - RNA, 14 nt, Escherichia coli CFT073
caaaacauacccag

SEQ ID NO: 656871 - RNA, 14 nt, Escherichia coli CFT073
caaaacgaccaccu

SEQ ID NO: 656872 - RNA, 18 nt, Escherichia coli CFT073
caaaacgcgcucacugca

SEQ ID NO: 656873 - RNA, 18 nt, Escherichia coli CFT073
caaaacgcgugacaccau

SEQ ID NO: 656874 - RNA, 18 nt, Escherichia coli CFT073
caaaaccacauggagcuu

SEQ ID NO: 656875 - RNA, 15 nt, Escherichia coli CFT073
caaaacccaggcuua

SEQ ID NO: 656876 - RNA, 15 nt, Escherichia coli CFT073
caaaacccugcgcca

SEQ ID NO: 656877 - RNA, 23 nt, Escherichia coli CFT073
auuuuuuugagaacauucaucau

SEQ ID NO: 656878 - RNA, 13 nt, Escherichia coli CFT073
caaaaaaaauuuu

SEQ ID NO: 656879 - RNA, 15 nt, Escherichia coli CFT073
caaaaaaagccacgg

SEQ ID NO: 656880 - RNA, 13 nt, Escherichia coli CFT073
caaaaaaagcuau

SEQ ID NO: 656881 - RNA, 19 nt, Escherichia coli CFT073
caaaaaacacucuucaaca

SEQ ID NO: 656882 - RNA, 21 nt, Escherichia coli CFT073
caaaaaagaaggaaaauacag

SEQ ID NO: 656883 - RNA, 11 nt, Escherichia coli CFT073
caaaaaaccua

SEQ ID NO: 656884 - RNA, 12 nt, Escherichia coli CFT073
caaaaaagaggg

SEQ ID NO: 656885 - RNA, 19 nt, Escherichia coli CFT073
caaaaaaggccgcaggcug

SEQ ID NO: 656886 - RNA, 15 nt, Escherichia coli CFT073
auuuuuuuacccagc

SEQ ID NO: 656887 - RNA, 13 nt, Escherichia coli CFT073
auuuuuuccaaca

SEQ ID NO: 656888 - RNA, 13 nt, Escherichia coli CFT073
auuuuuuccccuu

SEQ ID NO: 656889 - RNA, 20 nt, Escherichia coli CFT073
auuuuuuccgcaaaaacgac

SEQ ID NO: 656890 - RNA, 21 nt, Escherichia coli CFT073
auuuuuuauuguccgguuuaa

SEQ ID NO: 656891 - RNA, 22 nt, Escherichia coli CFT073
auuuuuucugaccaauagauau

SEQ ID NO: 656892 - RNA, 16 nt, Escherichia coli CFT073
auuuuuccagcauuuc

SEQ ID NO: 656893 - RNA, 17 nt, Escherichia coli CFT073
auuuuuccagcauuucu

SEQ ID NO: 656894 - RNA, 19 nt, Escherichia coli CFT073
auuuuucaggaucaagcug

SEQ ID NO: 656895 - RNA, 15 nt, Escherichia coli CFT073
auuuuuccacuggau

SEQ ID NO: 656896 - RNA, 15 nt, Escherichia coli CFT073
auuuuucgcuuuuca

SEQ ID NO: 656897 - RNA, 21 nt, Escherichia coli CFT073
auuuuucgcgcgggcagaugc

SEQ ID NO: 656898 - RNA, 22 nt, Escherichia coli CFT073
auuuuucgcgcgggcagaugcc

SEQ ID NO: 656899 - RNA, 22 nt, Escherichia coli CFT073
auuuuucgagggugcgaauaag

SEQ ID NO: 656900 - RNA, 19 nt, Escherichia coli CFT073
auuuuugccaucaaucacu

SEQ ID NO: 656901 - RNA, 22 nt, Escherichia coli CFT073
auuuuugcugggaaccuucgga

SEQ ID NO: 656902 - RNA, 19 nt, Escherichia coli CFT073
auuuuugcgccaucaugau

SEQ ID NO: 656903 - RNA, 15 nt, Escherichia coli CFT073
auuuuuuaauaaaaa

SEQ ID NO: 656904 - RNA, 22 nt, Escherichia coli CFT073
caagccgaauaacggcucaaac

SEQ ID NO: 656905 - RNA, 23 nt, Escherichia coli CFT073
caagccgaauaacggcucaaacu

SEQ ID NO: 656906 - RNA, 20 nt, Escherichia coli CFT073
caagcccugguaacugccag

SEQ ID NO: 656907 - RNA, 20 nt, Escherichia coli CFT073
caagccgcuaacagcagcag

SEQ ID NO: 656908 - RNA, 14 nt, Escherichia coli CFT073
caagcauaacaaaa

SEQ ID NO: 656909 - RNA, 21 nt, Escherichia coli CFT073
caagcaucauuuuguggguuu

SEQ ID NO: 656910 - RNA, 18 nt, Escherichia coli CFT073
caagcaucggcauaccca

SEQ ID NO: 656911 - RNA, 20 nt, Escherichia coli CFT073
caagcauuacgaaaucggca

SEQ ID NO: 656912 - RNA, 15 nt, Escherichia coli CFT073
caagcauuauuuuug

SEQ ID NO: 656913 - RNA, 16 nt, Escherichia coli CFT073
caagcauuauuuuugc

SEQ ID NO: 656914 - RNA, 15 nt, Escherichia coli CFT073
caagccaagccagag

SEQ ID NO: 656915 - RNA, 19 nt, Escherichia coli CFT073
caagccaaucugcuggaaa

SEQ ID NO: 656916 - RNA, 22 nt, Escherichia coli CFT073
caagccacuuccuuuagaagca

SEQ ID NO: 656917 - RNA, 14 nt, Escherichia coli CFT073
caagccagguaaau

SEQ ID NO: 656918 - RNA, 15 nt, Escherichia coli CFT073
caagccagguaaauc

SEQ ID NO: 656919 - RNA, 20 nt, Escherichia coli CFT073
caagccagguaaaucagacc

SEQ ID NO: 656920 - RNA, 23 nt, Escherichia coli CFT073
caacuucgaguacauccacugca

SEQ ID NO: 656921 - RNA, 13 nt, Escherichia coli CFT073
caagcagagagac

SEQ ID NO: 656922 - RNA, 14 nt, Escherichia coli CFT073
caagcacagggcaa

SEQ ID NO: 656923 - RNA, 17 nt, Escherichia coli CFT073
caagcacccguggcuau

SEQ ID NO: 656924 - RNA, 20 nt, Escherichia coli CFT073
caagcaccggcaccgaggug

SEQ ID NO: 656925 - RNA, 22 nt, Escherichia coli CFT073
caagcacggcgcgacucagcgg

SEQ ID NO: 656926 - RNA, 14 nt, Escherichia coli CFT073
caagcguugcuuca

SEQ ID NO: 656927 - RNA, 13 nt, Escherichia coli CFT073
caagcuaaaccaa

SEQ ID NO: 656928 - RNA, 20 nt, Escherichia coli CFT073
caagcggggggaucagacug

SEQ ID NO: 656929 - RNA, 19 nt, Escherichia coli CFT073
caagcggcgcaugcaggca

SEQ ID NO: 656930 - RNA, 14 nt, Escherichia coli CFT073
caagccguuaauuc

SEQ ID NO: 656931 - RNA, 23 nt, Escherichia coli CFT073
caaggaugcguuuuucggucaga

SEQ ID NO: 656932 - RNA, 19 nt, Escherichia coli CFT073
caaggaagcuuucgcagua

SEQ ID NO: 656933 - RNA, 21 nt, Escherichia coli CFT073
caaggcgauuuggguagaaac

SEQ ID NO: 656934 - RNA, 23 nt, Escherichia coli CFT073
caaggcgcgacaucucuucuucg

SEQ ID NO: 656935 - RNA, 20 nt, Escherichia coli CFT073
caaggcgcggguuucgacau

SEQ ID NO: 656936 - RNA, 17 nt, Escherichia coli CFT073
caaggucuuuaccuuuu

SEQ ID NO: 656937 - RNA, 16 nt, Escherichia coli CFT073
caaggugcgaaaaaaa

SEQ ID NO: 656938 - RNA, 18 nt, Escherichia coli CFT073
caagguagugcuucuaaa

SEQ ID NO: 656939 - RNA, 12 nt, Escherichia coli CFT073
caagguguuuca

SEQ ID NO: 656940 - RNA, 17 nt, Escherichia coli CFT073
caagguugcacaaccaa

SEQ ID NO: 656941 - RNA, 14 nt, Escherichia coli CFT073
caaguacuuuugca

SEQ ID NO: 656942 - RNA, 19 nt, Escherichia coli CFT073
caaguauucacucugcugu

SEQ ID NO: 656943 - RNA, 19 nt, Escherichia coli CFT073
caauaaaauaucuucuacu

SEQ ID NO: 656944 - RNA, 20 nt, Escherichia coli CFT073
caauaaagccgguauucaca

SEQ ID NO: 656945 - RNA, 18 nt, Escherichia coli CFT073
caauaaacugcgaccagg

SEQ ID NO: 656946 - RNA, 17 nt, Escherichia coli CFT073
caauaacaauuaucugg

SEQ ID NO: 656947 - RNA, 12 nt, Escherichia coli CFT073
caauaaauacaa

SEQ ID NO: 656948 - RNA, 22 nt, Escherichia coli CFT073
caauaaauugcgauauguugug

SEQ ID NO: 656949 - RNA, 13 nt, Escherichia coli CFT073
caauaaccaucag

SEQ ID NO: 656950 - RNA, 14 nt, Escherichia coli CFT073
caauaagcuuaguc

SEQ ID NO: 656951 - RNA, 19 nt, Escherichia coli CFT073
caauaaguaagcauuauau

SEQ ID NO: 656952 - RNA, 19 nt, Escherichia coli CFT073
caauaauaucccaacgcaa

SEQ ID NO: 656953 - RNA, 18 nt, Escherichia coli CFT073
caauagcgccugcugcug

SEQ ID NO: 656954 - RNA, 18 nt, Escherichia coli CFT073
caauacuugcgaaucauu

SEQ ID NO: 656955 - RNA, 14 nt, Escherichia coli CFT073
caauacuucaacau

SEQ ID NO: 656956 - RNA, 21 nt, Escherichia coli CFT073
caauacuggcaaaaucaaaaa

SEQ ID NO: 656957 - RNA, 15 nt, Escherichia coli CFT073
caauacguuucauau

SEQ ID NO: 656958 - RNA, 14 nt, Escherichia coli CFT073
caauaauaucuuuc

SEQ ID NO: 656959 - RNA, 13 nt, Escherichia coli CFT073
caauaauuucuca

SEQ ID NO: 656960 - RNA, 13 nt, Escherichia coli CFT073
caauacaaaauag

SEQ ID NO: 656961 - RNA, 17 nt, Escherichia coli CFT073
caauaucgacgccaguu

SEQ ID NO: 656962 - RNA, 15 nt, Escherichia coli CFT073
caauaucgcugugug

SEQ ID NO: 656963 - RNA, 15 nt, Escherichia coli CFT073
caauaucguuaucgc

SEQ ID NO: 656964 - RNA, 16 nt, Escherichia coli CFT073
caauaucuuuaucugc

SEQ ID NO: 656965 - RNA, 22 nt, Escherichia coli CFT073
caauaucaucauccgcaauaac

SEQ ID NO: 656966 - RNA, 19 nt, Escherichia coli CFT073
caauauccgguucacuuca

SEQ ID NO: 656967 - RNA, 19 nt, Escherichia coli CFT073
caauauccagcagguuuug

SEQ ID NO: 656968 - RNA, 20 nt, Escherichia coli CFT073
caauagugaacugacugauu

SEQ ID NO: 656969 - RNA, 21 nt, Escherichia coli CFT073
caauaguuacgaaaaggauaa

SEQ ID NO: 656970 - RNA, 12 nt, Escherichia coli CFT073
caauauaaacag

SEQ ID NO: 656971 - RNA, 21 nt, Escherichia coli CFT073
caaugccaggcuccagauaac

SEQ ID NO: 656972 - RNA, 16 nt, Escherichia coli CFT073
caaugccaucaccaac

SEQ ID NO: 656973 - RNA, 15 nt, Escherichia coli CFT073
caaugcccaaaaugg

SEQ ID NO: 656974 - RNA, 22 nt, Escherichia coli CFT073
caaugccgagauauagccccau

SEQ ID NO: 656975 - RNA, 23 nt, Escherichia coli CFT073
caaugccgcauacauaacagaau

SEQ ID NO: 656976 - RNA, 18 nt, Escherichia coli CFT073
caaugccgccaauaauga

SEQ ID NO: 656977 - RNA, 16 nt, Escherichia coli CFT073
caaugccauucacaaa

SEQ ID NO: 656978 - RNA, 22 nt, Escherichia coli CFT073
caaugcgaucccgacaaucauc

SEQ ID NO: 656979 - RNA, 16 nt, Escherichia coli CFT073
caaugccgucaccagc

SEQ ID NO: 656980 - RNA, 19 nt, Escherichia coli CFT073
caaugcuuuuugcauuucc

SEQ ID NO: 656981 - RNA, 21 nt, Escherichia coli CFT073
caauggaauagcgaagaauac

SEQ ID NO: 656982 - RNA, 16 nt, Escherichia coli CFT073
caaugcguagcugggc

SEQ ID NO: 656983 - RNA, 22 nt, Escherichia coli CFT073
caaugcguuguagcuuuuuccu

SEQ ID NO: 656984 - RNA, 13 nt, Escherichia coli CFT073
caauggugaacug

SEQ ID NO: 656985 - RNA, 13 nt, Escherichia coli CFT073
caauggugccgac

SEQ ID NO: 656986 - RNA, 15 nt, Escherichia coli CFT073
caauggucagccaca

SEQ ID NO: 656987 - RNA, 13 nt, Escherichia coli CFT073
caaugucaaguga

SEQ ID NO: 656988 - RNA, 16 nt, Escherichia coli CFT073
caauguaggccugaua

SEQ ID NO: 656989 - RNA, 19 nt, Escherichia coli CFT073
caauguaucuuucaucauu

SEQ ID NO: 656990 - RNA, 22 nt, Escherichia coli CFT073
caauguauugaauuugcgauac

SEQ ID NO: 656991 - RNA, 11 nt, Escherichia coli CFT073
caauggcaucc

SEQ ID NO: 656992 - RNA, 18 nt, Escherichia coli CFT073
caauggcccauucagcau

SEQ ID NO: 656993 - RNA, 20 nt, Escherichia coli CFT073
caauggccucuggugcaauu

SEQ ID NO: 656994 - RNA, 20 nt, Escherichia coli CFT073
caauggcgaccacugaccgc

SEQ ID NO: 656995 - RNA, 20 nt, Escherichia coli CFT073
caauggcaggaucugguguu

SEQ ID NO: 656996 - RNA, 19 nt, Escherichia coli CFT073
caaugacagccccaccagc

SEQ ID NO: 656997 - RNA, 18 nt, Escherichia coli CFT073
caaugacaguaucaccaa

SEQ ID NO: 656998 - RNA, 20 nt, Escherichia coli CFT073
caaugacuauuugcgccgca

SEQ ID NO: 656999 - RNA, 17 nt, Escherichia coli CFT073
caaugaccaccaaauaa

SEQ ID NO: 657000 - RNA, 22 nt, Escherichia coli CFT073
caaugacgucuuccaccggcug

SEQ ID NO: 657001 - RNA, 13 nt, Escherichia coli CFT073
caaugaaacucaa

SEQ ID NO: 657002 - RNA, 15 nt, Escherichia coli CFT073
caaucuuuccugcac

SEQ ID NO: 657003 - RNA, 18 nt, Escherichia coli CFT073
caaucuuuacacacaagc

SEQ ID NO: 657004 - RNA, 17 nt, Escherichia coli CFT073
caaucuggcugaugaag

SEQ ID NO: 657005 - RNA, 19 nt, Escherichia coli CFT073
caaucuuaggggacauuua

SEQ ID NO: 657006 - RNA, 13 nt, Escherichia coli CFT073
caaucuucaacac

SEQ ID NO: 657007 - RNA, 17 nt, Escherichia coli CFT073
caaucuucaacacuuca

SEQ ID NO: 657008 - RNA, 21 nt, Escherichia coli CFT073
caaugcagaauuugcaccacu

SEQ ID NO: 657009 - RNA, 20 nt, Escherichia coli CFT073
caaugccagaaacaucggca

SEQ ID NO: 657010 - RNA, 14 nt, Escherichia coli CFT073
caaugagcacaaca

SEQ ID NO: 657011 - RNA, 15 nt, Escherichia coli CFT073
caaugauaacgucgg

SEQ ID NO: 657012 - RNA, 18 nt, Escherichia coli CFT073
caaugauaacgucggcau

SEQ ID NO: 657013 - RNA, 13 nt, Escherichia coli CFT073
caaugauaagacu

SEQ ID NO: 657014 - RNA, 17 nt, Escherichia coli CFT073
caaugaguucgcgcgcu

SEQ ID NO: 657015 - RNA, 21 nt, Escherichia coli CFT073
caaugaguucgcgcgcugcca

SEQ ID NO: 657016 - RNA, 21 nt, Escherichia coli CFT073
caauauugucuucaucgaugc

SEQ ID NO: 657017 - RNA, 13 nt, Escherichia coli CFT073
caaucaaacuucc

SEQ ID NO: 657018 - RNA, 12 nt, Escherichia coli CFT073
caaucaaaugac

SEQ ID NO: 657019 - RNA, 16 nt, Escherichia coli CFT073
caaucauuuuuucccc

SEQ ID NO: 657020 - RNA, 18 nt, Escherichia coli CFT073
caaucauuuuuuccccuu

SEQ ID NO: 657021 - RNA, 19 nt, Escherichia coli CFT073
caaucauuuuuuccccuua

SEQ ID NO: 657022 - RNA, 21 nt, Escherichia coli CFT073
caauccagggguuguuauuuc

SEQ ID NO: 657023 - RNA, 18 nt, Escherichia coli CFT073
caauccauaccagcacau

SEQ ID NO: 657024 - RNA, 16 nt, Escherichia coli CFT073
caaucauuucugcaau

SEQ ID NO: 657025 - RNA, 15 nt, Escherichia coli CFT073
caaucauuugcacca

SEQ ID NO: 657026 - RNA, 16 nt, Escherichia coli CFT073
caaucauuugcaccag

SEQ ID NO: 657027 - RNA, 18 nt, Escherichia coli CFT073
caaucauuugcaccaggc

SEQ ID NO: 657028 - RNA, 15 nt, Escherichia coli CFT073
caaucaucucuaccu

SEQ ID NO: 657029 - RNA, 14 nt, Escherichia coli CFT073
caauccccgccagc

SEQ ID NO: 657030 - RNA, 18 nt, Escherichia coli CFT073
caaucccuuaguaacgcc

SEQ ID NO: 657031 - RNA, 13 nt, Escherichia coli CFT073
caaucccuuccac

SEQ ID NO: 657032 - RNA, 12 nt, Escherichia coli CFT073
caaucgggaaga

SEQ ID NO: 657033 - RNA, 15 nt, Escherichia coli CFT073
caaucgggcaguaug

SEQ ID NO: 657034 - RNA, 17 nt, Escherichia coli CFT073
caaucguaugaucaucc

SEQ ID NO: 657035 - RNA, 22 nt, Escherichia coli CFT073
caaucgcggcgauauccagcgc

SEQ ID NO: 657036 - RNA, 21 nt, Escherichia coli CFT073
caaucgcgccagaacacgcuc

SEQ ID NO: 657037 - RNA, 22 nt, Escherichia coli CFT073
caaucgcugcgguaauaauucc

SEQ ID NO: 657038 - RNA, 15 nt, Escherichia coli CFT073
caaucgcuucaucgc

SEQ ID NO: 657039 - RNA, 14 nt, Escherichia coli CFT073
caaucgaccaggcc

SEQ ID NO: 657040 - RNA, 19 nt, Escherichia coli CFT073
caaucgaccaggccaucag

SEQ ID NO: 657041 - RNA, 18 nt, Escherichia coli CFT073
caaucgaacgcagcaaca

SEQ ID NO: 657042 - RNA, 21 nt, Escherichia coli CFT073
caaucgaaaaagaaucgauua

SEQ ID NO: 657043 - RNA, 18 nt, Escherichia coli CFT073
caaucgaaauacgacuga

SEQ ID NO: 657044 - RNA, 14 nt, Escherichia coli CFT073
caaucgccccacuu

SEQ ID NO: 657045 - RNA, 16 nt, Escherichia coli CFT073
caaucgccagauccgc

SEQ ID NO: 657046 - RNA, 18 nt, Escherichia coli CFT073
caaucgccuccagcgcug

SEQ ID NO: 657047 - RNA, 18 nt, Escherichia coli CFT073
caaucuacaaaagauuau

SEQ ID NO: 657048 - RNA, 16 nt, Escherichia coli CFT073
caaucgucugguuuuc

SEQ ID NO: 657049 - RNA, 19 nt, Escherichia coli CFT073
caaucgucugguuuuccuu

SEQ ID NO: 657050 - RNA, 14 nt, Escherichia coli CFT073
caaucugcuccauu

SEQ ID NO: 657051 - RNA, 20 nt, Escherichia coli CFT073
caaucugcuucuuaccaccu

SEQ ID NO: 657052 - RNA, 14 nt, Escherichia coli CFT073
caaucugcaaaaua

SEQ ID NO: 657053 - RNA, 17 nt, Escherichia coli CFT073
caaucugcgcuucucgc

SEQ ID NO: 657054 - RNA, 17 nt, Escherichia coli CFT073
caaucucugacauaaaa

SEQ ID NO: 657055 - RNA, 23 nt, Escherichia coli CFT073
caaucucgcugaucuuauugguu

SEQ ID NO: 657056 - RNA, 19 nt, Escherichia coli CFT073
caaucucuucaccugccug

SEQ ID NO: 657057 - RNA, 23 nt, Escherichia coli CFT073
caaucucuuccagcgucuccaga

SEQ ID NO: 657058 - RNA, 22 nt, Escherichia coli CFT073
caaccgucgccucgccgagcag

SEQ ID NO: 657059 - RNA, 17 nt, Escherichia coli CFT073
caaccguuugauugaaa

SEQ ID NO: 657060 - RNA, 14 nt, Escherichia coli CFT073
caaccucuucuuuu

SEQ ID NO: 657061 - RNA, 15 nt, Escherichia coli CFT073
caaccugaguaaauc

SEQ ID NO: 657062 - RNA, 21 nt, Escherichia coli CFT073
caaccuccuccggcaucuuua

SEQ ID NO: 657063 - RNA, 22 nt, Escherichia coli CFT073
caacgcauuuauuugacauuuu

SEQ ID NO: 657064 - RNA, 22 nt, Escherichia coli CFT073
caacgcccauacucaucuucca

SEQ ID NO: 657065 - RNA, 17 nt, Escherichia coli CFT073
caacgccccuucugccg

SEQ ID NO: 657066 - RNA, 14 nt, Escherichia coli CFT073
caacgcccugcaac

SEQ ID NO: 657067 - RNA, 18 nt, Escherichia coli CFT073
caacgccgccaacgugac

SEQ ID NO: 657068 - RNA, 15 nt, Escherichia coli CFT073
caacggcaaacacgc

SEQ ID NO: 657069 - RNA, 21 nt, Escherichia coli CFT073
caacggcaacaauuuccgcag

SEQ ID NO: 657070 - RNA, 22 nt, Escherichia coli CFT073
caacggaccaauaaacgccagg

SEQ ID NO: 657071 - RNA, 13 nt, Escherichia coli CFT073
caacgcugccaug

SEQ ID NO: 657072 - RNA, 21 nt, Escherichia coli CFT073
caacgcuucaaaccuucaucc

SEQ ID NO: 657073 - RNA, 16 nt, Escherichia coli CFT073
caacgcuucaaccagu

SEQ ID NO: 657074 - RNA, 20 nt, Escherichia coli CFT073
caacggcgucagccacaaca

SEQ ID NO: 657075 - RNA, 14 nt, Escherichia coli CFT073
caacguagaauaaa

SEQ ID NO: 657076 - RNA, 13 nt, Escherichia coli CFT073
caacguagccugc

SEQ ID NO: 657077 - RNA, 19 nt, Escherichia coli CFT073
caacguacggcuucagaca

SEQ ID NO: 657078 - RNA, 13 nt, Escherichia coli CFT073
caacgucugccug

SEQ ID NO: 657079 - RNA, 18 nt, Escherichia coli CFT073
caacucuuuuaccaccgc

SEQ ID NO: 657080 - RNA, 17 nt, Escherichia coli CFT073
caacucuucaagauuaa

SEQ ID NO: 657081 - RNA, 14 nt, Escherichia coli CFT073
caacugaaagaaca

SEQ ID NO: 657082 - RNA, 18 nt, Escherichia coli CFT073
caacugaaagaacaccag

SEQ ID NO: 657083 - RNA, 20 nt, Escherichia coli CFT073
caacugauuuucaucuucuu

SEQ ID NO: 657084 - RNA, 12 nt, Escherichia coli CFT073
caacugacugac

SEQ ID NO: 657085 - RNA, 17 nt, Escherichia coli CFT073
caacugauacaccuuca

SEQ ID NO: 657086 - RNA, 17 nt, Escherichia coli CFT073
caacugaucugccagca

SEQ ID NO: 657087 - RNA, 20 nt, Escherichia coli CFT073
caacuggcaaucgacucuga

SEQ ID NO: 657088 - RNA, 22 nt, Escherichia coli CFT073
caacugcuggacgauuucaccc

SEQ ID NO: 657089 - RNA, 23 nt, Escherichia coli CFT073
caacugcugcgguugaacgccaa

SEQ ID NO: 657090 - RNA, 18 nt, Escherichia coli CFT073
caacugcuuuuugcucuc

SEQ ID NO: 657091 - RNA, 19 nt, Escherichia coli CFT073
caacuggguuaacgucaua

SEQ ID NO: 657092 - RNA, 20 nt, Escherichia coli CFT073
caacugguauaggccaugcu

SEQ ID NO: 657093 - RNA, 23 nt, Escherichia coli CFT073
caacuguggaauaugcgccacuc

SEQ ID NO: 657094 - RNA, 13 nt, Escherichia coli CFT073
caacccgcgcgcu

SEQ ID NO: 657095 - RNA, 12 nt, Escherichia coli CFT073
caacccugcccu

SEQ ID NO: 657096 - RNA, 15 nt, Escherichia coli CFT073
caacccugcccuuca

SEQ ID NO: 657097 - RNA, 15 nt, Escherichia coli CFT073
caacccgagcgccag

SEQ ID NO: 657098 - RNA, 16 nt, Escherichia coli CFT073
caaccccaauguaacc

SEQ ID NO: 657099 - RNA, 13 nt, Escherichia coli CFT073
caaccauccccaa

SEQ ID NO: 657100 - RNA, 20 nt, Escherichia coli CFT073
caaccauggaacucuuucug

SEQ ID NO: 657101 - RNA, 15 nt, Escherichia coli CFT073
caaccaugguuucaa

SEQ ID NO: 657102 - RNA, 20 nt, Escherichia coli CFT073
caaccaugccgcccagcagc

SEQ ID NO: 657103 - RNA, 22 nt, Escherichia coli CFT073
caacccaaacgguaucuuucca

SEQ ID NO: 657104 - RNA, 12 nt, Escherichia coli CFT073
caacccacaaaa

SEQ ID NO: 657105 - RNA, 15 nt, Escherichia coli CFT073
caacccacaaaaaca

SEQ ID NO: 657106 - RNA, 14 nt, Escherichia coli CFT073
caacccagaagaaa

SEQ ID NO: 657107 - RNA, 14 nt, Escherichia coli CFT073
caacccagacaaau

SEQ ID NO: 657108 - RNA, 19 nt, Escherichia coli CFT073
caaccguaaacgaucaucg

SEQ ID NO: 657109 - RNA, 22 nt, Escherichia coli CFT073
caaccguaggucggauaagacg

SEQ ID NO: 657110 - RNA, 15 nt, Escherichia coli CFT073
caaccgucagccacu

SEQ ID NO: 657111 - RNA, 22 nt, Escherichia coli CFT073
caaccggugcgcgaucuuccuc

SEQ ID NO: 657112 - RNA, 14 nt, Escherichia coli CFT073
caaccggugcugcg

SEQ ID NO: 657113 - RNA, 15 nt, Escherichia coli CFT073
caaccggugcugcgc

SEQ ID NO: 657114 - RNA, 23 nt, Escherichia coli CFT073
caaccgguggcaguagcgccucu

SEQ ID NO: 657115 - RNA, 22 nt, Escherichia coli CFT073
caaccgggcuauuugaauuccu

SEQ ID NO: 657116 - RNA, 18 nt, Escherichia coli CFT073
caaccggaaguccgagga

SEQ ID NO: 657117 - RNA, 23 nt, Escherichia coli CFT073
caaccgggaucaccgaaccaggg

SEQ ID NO: 657118 - RNA, 20 nt, Escherichia coli CFT073
caaccgagcgccccagaccu

SEQ ID NO: 657119 - RNA, 15 nt, Escherichia coli CFT073
caaccgccgcugcuu

SEQ ID NO: 657120 - RNA, 16 nt, Escherichia coli CFT073
caaccgccaacagcag

SEQ ID NO: 657121 - RNA, 12 nt, Escherichia coli CFT073
caaccagaaagu

SEQ ID NO: 657122 - RNA, 14 nt, Escherichia coli CFT073
caaccagcaaugcc

SEQ ID NO: 657123 - RNA, 19 nt, Escherichia coli CFT073
caaccagcagcaucaccac

SEQ ID NO: 657124 - RNA, 12 nt, Escherichia coli CFT073
caaccagcaggg

SEQ ID NO: 657125 - RNA, 15 nt, Escherichia coli CFT073
caaccacucaccgcu

SEQ ID NO: 657126 - RNA, 14 nt, Escherichia coli CFT073
caaccaccugaaga

SEQ ID NO: 657127 - RNA, 17 nt, Escherichia coli CFT073
caaccaccugaagaaaa

SEQ ID NO: 657128 - RNA, 20 nt, Escherichia coli CFT073
caaccacuacgugaucgucu

SEQ ID NO: 657129 - RNA, 12 nt, Escherichia coli CFT073
caaccacauuca

SEQ ID NO: 657130 - RNA, 16 nt, Escherichia coli CFT073
caaccaaucgcggcga

SEQ ID NO: 657131 - RNA, 15 nt, Escherichia coli CFT073
caaccaagacuauua

SEQ ID NO: 657132 - RNA, 15 nt, Escherichia coli CFT073
caacaugagaacagu

SEQ ID NO: 657133 - RNA, 16 nt, Escherichia coli CFT073
caacaugagaacaguu

SEQ ID NO: 657134 - RNA, 15 nt, Escherichia coli CFT073
caacauggucaucau

SEQ ID NO: 657135 - RNA, 21 nt, Escherichia coli CFT073
caacaugcggugauuuugccu

SEQ ID NO: 657136 - RNA, 22 nt, Escherichia coli CFT073
caacaugcuauuacgccagccu

SEQ ID NO: 657137 - RNA, 14 nt, Escherichia coli CFT073
caacaucucuauua

SEQ ID NO: 657138 - RNA, 15 nt, Escherichia coli CFT073
caacauuuccagcgc

SEQ ID NO: 657139 - RNA, 14 nt, Escherichia coli CFT073
caacauuaccgaau

SEQ ID NO: 657140 - RNA, 21 nt, Escherichia coli CFT073
caacauuaccgaauccuggua

SEQ ID NO: 657141 - RNA, 20 nt, Escherichia coli CFT073
caacauuaucugaugcgcuu

SEQ ID NO: 657142 - RNA, 23 nt, Escherichia coli CFT073
caacaauugcgggccaaagacca

SEQ ID NO: 657143 - RNA, 21 nt, Escherichia coli CFT073
caacaauuuccgcagcuccag

SEQ ID NO: 657144 - RNA, 16 nt, Escherichia coli CFT073
caacacaauuuguggc

SEQ ID NO: 657145 - RNA, 19 nt, Escherichia coli CFT073
caaauuucuucagccacau

SEQ ID NO: 657146 - RNA, 16 nt, Escherichia coli CFT073
caacacuacaccccag

SEQ ID NO: 657147 - RNA, 22 nt, Escherichia coli CFT073
caacacuucauuaucuucuuuc

SEQ ID NO: 657148 - RNA, 21 nt, Escherichia coli CFT073
caacacuuuaucugccauuaa

SEQ ID NO: 657149 - RNA, 22 nt, Escherichia coli CFT073
caacaggaacauguauuuguuu

SEQ ID NO: 657150 - RNA, 16 nt, Escherichia coli CFT073
caacagagccaaagaa

SEQ ID NO: 657151 - RNA, 19 nt, Escherichia coli CFT073
caacagcguuucuucgaca

SEQ ID NO: 657152 - RNA, 22 nt, Escherichia coli CFT073
caacaccacuugcugguugugg

SEQ ID NO: 657153 - RNA, 20 nt, Escherichia coli CFT073
caacacaugcacauccacgc

SEQ ID NO: 657154 - RNA, 17 nt, Escherichia coli CFT073
caaaucgcccgucaguu

SEQ ID NO: 657155 - RNA, 14 nt, Escherichia coli CFT073
caaaucaucaguac

SEQ ID NO: 657156 - RNA, 18 nt, Escherichia coli CFT073
caaaucgucgguguccac

SEQ ID NO: 657157 - RNA, 16 nt, Escherichia coli CFT073
caaaucgugacagcau

SEQ ID NO: 657158 - RNA, 19 nt, Escherichia coli CFT073
caaaucgugacagcauacc

SEQ ID NO: 657159 - RNA, 15 nt, Escherichia coli CFT073
caaaucgcucccucu

SEQ ID NO: 657160 - RNA, 17 nt, Escherichia coli CFT073
caaaucgcucccucucc

SEQ ID NO: 657161 - RNA, 19 nt, Escherichia coli CFT073
caaaucucgugguucaaca

SEQ ID NO: 657162 - RNA, 17 nt, Escherichia coli CFT073
caaaucaaugguguuau

SEQ ID NO: 657163 - RNA, 14 nt, Escherichia coli CFT073
caaaucauaaaaau

SEQ ID NO: 657164 - RNA, 23 nt, Escherichia coli CFT073
caaaucagcggcagauccaccag

SEQ ID NO: 657165 - RNA, 17 nt, Escherichia coli CFT073
caaaucaccaaacugcu

SEQ ID NO: 657166 - RNA, 19 nt, Escherichia coli CFT073
caaaucacuauuaaagaaa

SEQ ID NO: 657167 - RNA, 14 nt, Escherichia coli CFT073
caaauuauccccca

SEQ ID NO: 657168 - RNA, 18 nt, Escherichia coli CFT073
caaauuauuaccaucggu

SEQ ID NO: 657169 - RNA, 19 nt, Escherichia coli CFT073
caaauucuuuaucgauaaa

SEQ ID NO: 657170 - RNA, 16 nt, Escherichia coli CFT073
caaaugcaacauuauc

SEQ ID NO: 657171 - RNA, 14 nt, Escherichia coli CFT073
caaaugcagcaacc

SEQ ID NO: 657172 - RNA, 16 nt, Escherichia coli CFT073
caaaugcagcaaccag

SEQ ID NO: 657173 - RNA, 16 nt, Escherichia coli CFT073
caaauagccagcagag

SEQ ID NO: 657174 - RNA, 15 nt, Escherichia coli CFT073
caaauagccugccag

SEQ ID NO: 657175 - RNA, 17 nt, Escherichia coli CFT073
caaauagccugccagug

SEQ ID NO: 657176 - RNA, 18 nt, Escherichia coli CFT073
caaauagcggaccaauac

SEQ ID NO: 657177 - RNA, 13 nt, Escherichia coli CFT073
caaauaaagaagu

SEQ ID NO: 657178 - RNA, 19 nt, Escherichia coli CFT073
caaauaaagaaguggugau

SEQ ID NO: 657179 - RNA, 16 nt, Escherichia coli CFT073
caaauaaugacucaaa

SEQ ID NO: 657180 - RNA, 13 nt, Escherichia coli CFT073
caaauaaaauccc

SEQ ID NO: 657181 - RNA, 23 nt, Escherichia coli CFT073
caaauaaaacaucaccaaugaca

SEQ ID NO: 657182 - RNA, 22 nt, Escherichia coli CFT073
caaaguuugcccgucugcugcu

SEQ ID NO: 657183 - RNA, 13 nt, Escherichia coli CFT073
caaaguuuugugc

SEQ ID NO: 657184 - RNA, 22 nt, Escherichia coli CFT073
caaaggucugauguugaaugug

SEQ ID NO: 657185 - RNA, 23 nt, Escherichia coli CFT073
caaagccuuuuuaggucgcccug

SEQ ID NO: 657186 - RNA, 21 nt, Escherichia coli CFT073
caaaguaccaucguccagcag

SEQ ID NO: 657187 - RNA, 21 nt, Escherichia coli CFT073
caaaguaguaaugaucacugg

SEQ ID NO: 657188 - RNA, 15 nt, Escherichia coli CFT073
caaagcccgccgcca

SEQ ID NO: 657189 - RNA, 14 nt, Escherichia coli CFT073
caaagcagcaagaa

SEQ ID NO: 657190 - RNA, 20 nt, Escherichia coli CFT073
caaagcaucauaaccucugc

SEQ ID NO: 657191 - RNA, 21 nt, Escherichia coli CFT073
caaagcauucguaaugaaugu

SEQ ID NO: 657192 - RNA, 13 nt, Escherichia coli CFT073
caaagccaacagc

SEQ ID NO: 657193 - RNA, 15 nt, Escherichia coli CFT073
caaagcaaauaaugu

SEQ ID NO: 657194 - RNA, 16 nt, Escherichia coli CFT073
caaagauuuuaccaau

SEQ ID NO: 657195 - RNA, 13 nt, Escherichia coli CFT073
caaagaauuggcu

SEQ ID NO: 657196 - RNA, 16 nt, Escherichia coli CFT073
caaagaacucacgcgc

SEQ ID NO: 657197 - RNA, 20 nt, Escherichia coli CFT073
caaagaaacggaagccccag

SEQ ID NO: 657198 - RNA, 18 nt, Escherichia coli CFT073
caaagaaaucaacaaauu

SEQ ID NO: 657199 - RNA, 13 nt, Escherichia coli CFT073
caaaagccccuga

SEQ ID NO: 657200 - RNA, 22 nt, Escherichia coli CFT073
caaaagccccugaauucucaaa

SEQ ID NO: 657201 - RNA, 13 nt, Escherichia coli CFT073
cagcaauaaaaaa

SEQ ID NO: 657202 - RNA, 21 nt, Escherichia coli CFT073
cagcaagcugugcgauagcaa

SEQ ID NO: 657203 - RNA, 17 nt, Escherichia coli CFT073
cagcaagagcaaauaaa

SEQ ID NO: 657204 - RNA, 18 nt, Escherichia coli CFT073
cagcaagagcaaauaaaa

SEQ ID NO: 657205 - RNA, 14 nt, Escherichia coli CFT073
cagcaagaaacuga

SEQ ID NO: 657206 - RNA, 17 nt, Escherichia coli CFT073
cagcaacugauggccca

SEQ ID NO: 657207 - RNA, 21 nt, Escherichia coli CFT073
cagcaacuggcuugccagcag

SEQ ID NO: 657208 - RNA, 21 nt, Escherichia coli CFT073
cagcaacgggcugaagaagua

SEQ ID NO: 657209 - RNA, 19 nt, Escherichia coli CFT073
cagcaacgcuucaaccagu

SEQ ID NO: 657210 - RNA, 22 nt, Escherichia coli CFT073
cagcaacggaaaagcaacaacc

SEQ ID NO: 657211 - RNA, 14 nt, Escherichia coli CFT073
cagcaacggccaaa

SEQ ID NO: 657212 - RNA, 14 nt, Escherichia coli CFT073
cagcaaccgcuucc

SEQ ID NO: 657213 - RNA, 22 nt, Escherichia coli CFT073
cagcaaccuccgucuggccagu

SEQ ID NO: 657214 - RNA, 18 nt, Escherichia coli CFT073
cagcaacauggcgcggca

SEQ ID NO: 657215 - RNA, 23 nt, Escherichia coli CFT073
cagcaacauggcgcggcacacca

SEQ ID NO: 657216 - RNA, 17 nt, Escherichia coli CFT073
cagcaacagguaaccca

SEQ ID NO: 657217 - RNA, 19 nt, Escherichia coli CFT073
cagcaacagguaacccagu

SEQ ID NO: 657218 - RNA, 22 nt, Escherichia coli CFT073
cagcaaccaguagcaaaacuca

SEQ ID NO: 657219 - RNA, 14 nt, Escherichia coli CFT073
cagcaaccaaugcc

SEQ ID NO: 657220 - RNA, 21 nt, Escherichia coli CFT073
cagcaaccacuugcagcucau

SEQ ID NO: 657221 - RNA, 10 nt, Escherichia coli CFT073
cagcaaccag

SEQ ID NO: 657222 - RNA, 13 nt, Escherichia coli CFT073
cagcaaccagagc

SEQ ID NO: 657223 - RNA, 15 nt, Escherichia coli CFT073
cagcaaccagagccg

SEQ ID NO: 657224 - RNA, 23 nt, Escherichia coli CFT073
cagcaaauucaccgccugcugau

SEQ ID NO: 657225 - RNA, 14 nt, Escherichia coli CFT073
cagcaacaccgcuu

SEQ ID NO: 657226 - RNA, 16 nt, Escherichia coli CFT073
cagcaacagcgcguca

SEQ ID NO: 657227 - RNA, 15 nt, Escherichia coli CFT073
cagcaaagagagcag

SEQ ID NO: 657228 - RNA, 17 nt, Escherichia coli CFT073
cagcaaagagagcagcg

SEQ ID NO: 657229 - RNA, 22 nt, Escherichia coli CFT073
cagcaaacugguugaaauaaac

SEQ ID NO: 657230 - RNA, 13 nt, Escherichia coli CFT073
cagcaaauaaaac

SEQ ID NO: 657231 - RNA, 14 nt, Escherichia coli CFT073
cagcaaauaaaacu

SEQ ID NO: 657232 - RNA, 19 nt, Escherichia coli CFT073
cagcaaauaauucaucuuu

SEQ ID NO: 657233 - RNA, 16 nt, Escherichia coli CFT073
cagcaaaucagccauu

SEQ ID NO: 657234 - RNA, 13 nt, Escherichia coli CFT073
cagcaauggaaaa

SEQ ID NO: 657235 - RNA, 15 nt, Escherichia coli CFT073
cagcaauggaaaaag

SEQ ID NO: 657236 - RNA, 17 nt, Escherichia coli CFT073
cagcaauuuacguuuuu

SEQ ID NO: 657237 - RNA, 13 nt, Escherichia coli CFT073
cagcaauuucucc

SEQ ID NO: 657238 - RNA, 15 nt, Escherichia coli CFT073
cagcacacauaacag

SEQ ID NO: 657239 - RNA, 17 nt, Escherichia coli CFT073
cagcaauuuuaauaucc

SEQ ID NO: 657240 - RNA, 12 nt, Escherichia coli CFT073
cagcaauuuuac

SEQ ID NO: 657241 - RNA, 13 nt, Escherichia coli CFT073
cagcaaucacugc

SEQ ID NO: 657242 - RNA, 18 nt, Escherichia coli CFT073
cagcaauacguuucauau

SEQ ID NO: 657243 - RNA, 22 nt, Escherichia coli CFT073
cagcaauaagccaguccagaaa

SEQ ID NO: 657244 - RNA, 16 nt, Escherichia coli CFT073
cagcaauaaucagaug

SEQ ID NO: 657245 - RNA, 15 nt, Escherichia coli CFT073
cagcaauccccagac

SEQ ID NO: 657246 - RNA, 19 nt, Escherichia coli CFT073
cagcaauccccagacaaaa

SEQ ID NO: 657247 - RNA, 15 nt, Escherichia coli CFT073
cagcaauccugcaug

SEQ ID NO: 657248 - RNA, 17 nt, Escherichia coli CFT073
cagcaauccugcaugua

SEQ ID NO: 657249 - RNA, 21 nt, Escherichia coli CFT073
cagcaaugacauacagcaccg

SEQ ID NO: 657250 - RNA, 12 nt, Escherichia coli CFT073
cagcaaugccag

SEQ ID NO: 657251 - RNA, 21 nt, Escherichia coli CFT073
cagcacaggcgggugaugaac

SEQ ID NO: 657252 - RNA, 16 nt, Escherichia coli CFT073
cagcacagagauaaaa

SEQ ID NO: 657253 - RNA, 23 nt, Escherichia coli CFT073
cagcacagccagaaucaagguaa

SEQ ID NO: 657254 - RNA, 19 nt, Escherichia coli CFT073
cagcacagccagccuccaa

SEQ ID NO: 657255 - RNA, 23 nt, Escherichia coli CFT073
cagcacaccgucagccagcacug

SEQ ID NO: 657256 - RNA, 12 nt, Escherichia coli CFT073
cagcacauuaca

SEQ ID NO: 657257 - RNA, 16 nt, Escherichia coli CFT073
cagcacauccaguucc

SEQ ID NO: 657258 - RNA, 21 nt, Escherichia coli CFT073
cagcacaucaucaaagccaau

SEQ ID NO: 657259 - RNA, 15 nt, Escherichia coli CFT073
cagcacaucucaaau

SEQ ID NO: 657260 - RNA, 15 nt, Escherichia coli CFT073
cagcacaucaucaaa

SEQ ID NO: 657261 - RNA, 13 nt, Escherichia coli CFT073
cagcaccagcaac

SEQ ID NO: 657262 - RNA, 19 nt, Escherichia coli CFT073
cagcaccacuuccggcaac

SEQ ID NO: 657263 - RNA, 18 nt, Escherichia coli CFT073
cagcaccagacgcaaccu

SEQ ID NO: 657264 - RNA, 14 nt, Escherichia coli CFT073
cagcaccagagaac

SEQ ID NO: 657265 - RNA, 17 nt, Escherichia coli CFT073
cagcaccaaacuggaau

SEQ ID NO: 657266 - RNA, 21 nt, Escherichia coli CFT073
cagcaccaaacuggaauagcg

SEQ ID NO: 657267 - RNA, 15 nt, Escherichia coli CFT073
cagcaccacgcagaa

SEQ ID NO: 657268 - RNA, 14 nt, Escherichia coli CFT073
cagaugcugugcaa

SEQ ID NO: 657269 - RNA, 22 nt, Escherichia coli CFT073
cagauggcagccaucauuuuua

SEQ ID NO: 657270 - RNA, 17 nt, Escherichia coli CFT073
cagauggcauccagcgg

SEQ ID NO: 657271 - RNA, 16 nt, Escherichia coli CFT073
cagaugcggugcgcca

SEQ ID NO: 657272 - RNA, 17 nt, Escherichia coli CFT073
cagaugcgccaguugca

SEQ ID NO: 657273 - RNA, 22 nt, Escherichia coli CFT073
cagaugcggcaugaacgccuga

SEQ ID NO: 657274 - RNA, 23 nt, Escherichia coli CFT073
cagaugcgacggcaccacauucu

SEQ ID NO: 657275 - RNA, 19 nt, Escherichia coli CFT073
cagaugaaugaaaacgaau

SEQ ID NO: 657276 - RNA, 14 nt, Escherichia coli CFT073
cagaucuucaucac

SEQ ID NO: 657277 - RNA, 20 nt, Escherichia coli CFT073
cagaugaacgugucaacgcu

SEQ ID NO: 657278 - RNA, 16 nt, Escherichia coli CFT073
cagaucuuccagcggc

SEQ ID NO: 657279 - RNA, 23 nt, Escherichia coli CFT073
cagaucugaauauucggcuccag

SEQ ID NO: 657280 - RNA, 16 nt, Escherichia coli CFT073
cagaucugacgauuau

SEQ ID NO: 657281 - RNA, 19 nt, Escherichia coli CFT073
cagaucugacgauuauuuu

SEQ ID NO: 657282 - RNA, 20 nt, Escherichia coli CFT073
cagaucugacgauuauuuuc

SEQ ID NO: 657283 - RNA, 16 nt, Escherichia coli CFT073
cagaucguugaccugg

SEQ ID NO: 657284 - RNA, 24 nt, Escherichia coli CFT073
cagaucguugaccuggaugccugc

SEQ ID NO: 657285 - RNA, 22 nt, Escherichia coli CFT073
cagaucuaacguuggcgugaca

SEQ ID NO: 657286 - RNA, 15 nt, Escherichia coli CFT073
cagauccugaaauuc

SEQ ID NO: 657287 - RNA, 24 nt, Escherichia coli CFT073
cagauccugaaauuccugagagga

SEQ ID NO: 657288 - RNA, 23 nt, Escherichia coli CFT073
cagauccugauccugcaacaaca

SEQ ID NO: 657289 - RNA, 16 nt, Escherichia coli CFT073
cagaucgcucaucugc

SEQ ID NO: 657290 - RNA, 16 nt, Escherichia coli CFT073
cagaucgaaaucuuuu

SEQ ID NO: 657291 - RNA, 20 nt, Escherichia coli CFT073
cagaucgccccggucaucaa

SEQ ID NO: 657292 - RNA, 15 nt, Escherichia coli CFT073
cagauugcugcugau

SEQ ID NO: 657293 - RNA, 20 nt, Escherichia coli CFT073
cagauuuaacggcagcaagg

SEQ ID NO: 657294 - RNA, 23 nt, Escherichia coli CFT073
cagcaaaagcaggcaccgcgccc

SEQ ID NO: 657295 - RNA, 15 nt, Escherichia coli CFT073
cagcaaaaucaccau

SEQ ID NO: 657296 - RNA, 14 nt, Escherichia coli CFT073
cagauuagcuggcc

SEQ ID NO: 657297 - RNA, 19 nt, Escherichia coli CFT073
cagauuaguaucguguccg

SEQ ID NO: 657298 - RNA, 19 nt, Escherichia coli CFT073
cagauuauucaaaaacaga

SEQ ID NO: 657299 - RNA, 13 nt, Escherichia coli CFT073
cagaugggcuggc

SEQ ID NO: 657300 - RNA, 16 nt, Escherichia coli CFT073
cagauaaugagacaca

SEQ ID NO: 657301 - RNA, 17 nt, Escherichia coli CFT073
cagauaauaaaaaagaa

SEQ ID NO: 657302 - RNA, 18 nt, Escherichia coli CFT073
cagauaauaaaaaaggca

SEQ ID NO: 657303 - RNA, 22 nt, Escherichia coli CFT073
cagauaauauuuaucuucccag

SEQ ID NO: 657304 - RNA, 20 nt, Escherichia coli CFT073
cagauaaucaacccccaccu

SEQ ID NO: 657305 - RNA, 19 nt, Escherichia coli CFT073
cagauaaccgucugcgccu

SEQ ID NO: 657306 - RNA, 16 nt, Escherichia coli CFT073
cagauaaauggcacag

SEQ ID NO: 657307 - RNA, 22 nt, Escherichia coli CFT073
cagauaaauggcacagugguca

SEQ ID NO: 657308 - RNA, 21 nt, Escherichia coli CFT073
cagauaaccacuggcacaaga

SEQ ID NO: 657309 - RNA, 13 nt, Escherichia coli CFT073
cagauaacccagc

SEQ ID NO: 657310 - RNA, 15 nt, Escherichia coli CFT073
cagauaacccagcag

SEQ ID NO: 657311 - RNA, 21 nt, Escherichia coli CFT073
cagauagccgccagagaaagc

SEQ ID NO: 657312 - RNA, 22 nt, Escherichia coli CFT073
cagauacugaugaacgcgcaga

SEQ ID NO: 657313 - RNA, 15 nt, Escherichia coli CFT073
cagauacuggaaaau

SEQ ID NO: 657314 - RNA, 21 nt, Escherichia coli CFT073
cagauacggcgcaucaguuuc

SEQ ID NO: 657315 - RNA, 23 nt, Escherichia coli CFT073
cagauacacggugcgaugcaaaa

SEQ ID NO: 657316 - RNA, 22 nt, Escherichia coli CFT073
cagauaccaguugaucaaauaa

SEQ ID NO: 657317 - RNA, 23 nt, Escherichia coli CFT073
cagauacccgacagauaaaucau

SEQ ID NO: 657318 - RNA, 16 nt, Escherichia coli CFT073
cagaucagacccagaa

SEQ ID NO: 657319 - RNA, 13 nt, Escherichia coli CFT073
cagaucagccacu

SEQ ID NO: 657320 - RNA, 17 nt, Escherichia coli CFT073
cagaucaccaauaucaa

SEQ ID NO: 657321 - RNA, 21 nt, Escherichia coli CFT073
cagauccaaaccgacugccug

SEQ ID NO: 657322 - RNA, 21 nt, Escherichia coli CFT073
cagauccaauaccgcacuaag

SEQ ID NO: 657323 - RNA, 23 nt, Escherichia coli CFT073
cagauccagugcucauccuucag

SEQ ID NO: 657324 - RNA, 13 nt, Escherichia coli CFT073
cagauccgccaug

SEQ ID NO: 657325 - RNA, 14 nt, Escherichia coli CFT073
cagauccagugcuc

SEQ ID NO: 657326 - RNA, 17 nt, Escherichia coli CFT073
cagauaucgcggauaug

SEQ ID NO: 657327 - RNA, 19 nt, Escherichia coli CFT073
cagauaugcgcugucauuc

SEQ ID NO: 657328 - RNA, 23 nt, Escherichia coli CFT073
cagaucaaaaugguagccgcccu

SEQ ID NO: 657329 - RNA, 17 nt, Escherichia coli CFT073
cagaguaaaccgccugu

SEQ ID NO: 657330 - RNA, 17 nt, Escherichia coli CFT073
cagaguacgcaguugcu

SEQ ID NO: 657331 - RNA, 13 nt, Escherichia coli CFT073
cagaguauauauu

SEQ ID NO: 657332 - RNA, 14 nt, Escherichia coli CFT073
cagaguauauauuc

SEQ ID NO: 657333 - RNA, 21 nt, Escherichia coli CFT073
cagaguauuacccggcacagc

SEQ ID NO: 657334 - RNA, 15 nt, Escherichia coli CFT073
cagagucaucucugc

SEQ ID NO: 657335 - RNA, 13 nt, Escherichia coli CFT073
cagagguacauca

SEQ ID NO: 657336 - RNA, 16 nt, Escherichia coli CFT073
cagaggugcgaccagc

SEQ ID NO: 657337 - RNA, 16 nt, Escherichia coli CFT073
cagagucuuugcuugc

SEQ ID NO: 657338 - RNA, 17 nt, Escherichia coli CFT073
cagagugaccggauacu

SEQ ID NO: 657339 - RNA, 22 nt, Escherichia coli CFT073
cagagugcccacguugcaucac

SEQ ID NO: 657340 - RNA, 13 nt, Escherichia coli CFT073
cagaguuccugca

SEQ ID NO: 657341 - RNA, 19 nt, Escherichia coli CFT073
cagagugugaaacaguaag

SEQ ID NO: 657342 - RNA, 18 nt, Escherichia coli CFT073
cagaguggauuaucuuca

SEQ ID NO: 657343 - RNA, 17 nt, Escherichia coli CFT073
cagauaaaacacaucag

SEQ ID NO: 657344 - RNA, 20 nt, Escherichia coli CFT073
cagauaaaaugcgaaaaaaa

SEQ ID NO: 657345 - RNA, 17 nt, Escherichia coli CFT073
cagaggaucuccacccg

SEQ ID NO: 657346 - RNA, 18 nt, Escherichia coli CFT073
cagaggaucuggacgcca

SEQ ID NO: 657347 - RNA, 14 nt, Escherichia coli CFT073
cagaggaggagagc

SEQ ID NO: 657348 - RNA, 18 nt, Escherichia coli CFT073
cagaggcauaaagcugcc

SEQ ID NO: 657349 - RNA, 19 nt, Escherichia coli CFT073
cagaggcauaaagcugccu

SEQ ID NO: 657350 - RNA, 21 nt, Escherichia coli CFT073
cagaggcauaaagcugccuug

SEQ ID NO: 657351 - RNA, 15 nt, Escherichia coli CFT073
cagaggcggcaaaau

SEQ ID NO: 657352 - RNA, 20 nt, Escherichia coli CFT073
cagagcugaauaucacgggc

SEQ ID NO: 657353 - RNA, 20 nt, Escherichia coli CFT073
cagagcugcaaaaguaccau

SEQ ID NO: 657354 - RNA, 22 nt, Escherichia coli CFT073
cagagcgauauccagcgccaga

SEQ ID NO: 657355 - RNA, 15 nt, Escherichia coli CFT073
cagagcucaaccaga

SEQ ID NO: 657356 - RNA, 16 nt, Escherichia coli CFT073
cagagcggccuucuuc

SEQ ID NO: 657357 - RNA, 20 nt, Escherichia coli CFT073
cagagcggccuucuucuuuc

SEQ ID NO: 657358 - RNA, 14 nt, Escherichia coli CFT073
cagacucaaaccaa

SEQ ID NO: 657359 - RNA, 23 nt, Escherichia coli CFT073
cagacucaccagcaucgcuucca

SEQ ID NO: 657360 - RNA, 14 nt, Escherichia coli CFT073
cagacuccagcagu

SEQ ID NO: 657361 - RNA, 15 nt, Escherichia coli CFT073
cagacuccagcagug

SEQ ID NO: 657362 - RNA, 20 nt, Escherichia coli CFT073
cagacuaagcugcgggaaau

SEQ ID NO: 657363 - RNA, 17 nt, Escherichia coli CFT073
cagacuaaaccgcacug

SEQ ID NO: 657364 - RNA, 15 nt, Escherichia coli CFT073
cagacuacugacgaa

SEQ ID NO: 657365 - RNA, 15 nt, Escherichia coli CFT073
cagacguucuuccug

SEQ ID NO: 657366 - RNA, 15 nt, Escherichia coli CFT073
cagacguucuucugc

SEQ ID NO: 657367 - RNA, 15 nt, Escherichia coli CFT073
cagacguugauaacc

SEQ ID NO: 657368 - RNA, 23 nt, Escherichia coli CFT073
cagacguugauaaccacggcgca

SEQ ID NO: 657369 - RNA, 18 nt, Escherichia coli CFT073
cagacguugccguacuga

SEQ ID NO: 657370 - RNA, 21 nt, Escherichia coli CFT073
cagacguuuguaacccaccau

SEQ ID NO: 657371 - RNA, 15 nt, Escherichia coli CFT073
cagacguuuuuucug

SEQ ID NO: 657372 - RNA, 16 nt, Escherichia coli CFT073
cagacguuuuuucugc

SEQ ID NO: 657373 - RNA, 12 nt, Escherichia coli CFT073
cagacguucuuc

SEQ ID NO: 657374 - RNA, 17 nt, Escherichia coli CFT073
cagacggcuuucuucag

SEQ ID NO: 657375 - RNA, 22 nt, Escherichia coli CFT073
cagacgugggcgacggcuugcc

SEQ ID NO: 657376 - RNA, 20 nt, Escherichia coli CFT073
cagacggugccagguaauga

SEQ ID NO: 657377 - RNA, 20 nt, Escherichia coli CFT073
cagacggcugucauccagca

SEQ ID NO: 657378 - RNA, 16 nt, Escherichia coli CFT073
cagacggagcugccag

SEQ ID NO: 657379 - RNA, 23 nt, Escherichia coli CFT073
cagacgcucuuucaccaguggga

SEQ ID NO: 657380 - RNA, 15 nt, Escherichia coli CFT073
cagacgcccgcgccc

SEQ ID NO: 657381 - RNA, 16 nt, Escherichia coli CFT073
cagacgccgguuaauc

SEQ ID NO: 657382 - RNA, 19 nt, Escherichia coli CFT073
cagacgccguuccagauuc

SEQ ID NO: 657383 - RNA, 17 nt, Escherichia coli CFT073
cagacgcgccgccaccg

SEQ ID NO: 657384 - RNA, 22 nt, Escherichia coli CFT073
cagacgcgcugagucacaaaug

SEQ ID NO: 657385 - RNA, 22 nt, Escherichia coli CFT073
cagacgccacuuuuuucaccca

SEQ ID NO: 657386 - RNA, 21 nt, Escherichia coli CFT073
cagacgcaucgcccagccauc

SEQ ID NO: 657387 - RNA, 18 nt, Escherichia coli CFT073
cagaccuuaucccgccgg

SEQ ID NO: 657388 - RNA, 17 nt, Escherichia coli CFT073
cagaccugaauuugcuc

SEQ ID NO: 657389 - RNA, 20 nt, Escherichia coli CFT073
cagaccugaauuugcuccag

SEQ ID NO: 657390 - RNA, 23 nt, Escherichia coli CFT073
cagacgacugucuuccugcggug

SEQ ID NO: 657391 - RNA, 17 nt, Escherichia coli CFT073
cagagaacacccagaau

SEQ ID NO: 657392 - RNA, 20 nt, Escherichia coli CFT073
cagagaacaucaauccaaac

SEQ ID NO: 657393 - RNA, 13 nt, Escherichia coli CFT073
cagagaacguggu

SEQ ID NO: 657394 - RNA, 21 nt, Escherichia coli CFT073
cagagaacgugguauggaguu

SEQ ID NO: 657395 - RNA, 20 nt, Escherichia coli CFT073
cagagaaucaugucagagcu

SEQ ID NO: 657396 - RNA, 14 nt, Escherichia coli CFT073
cagagaaaccacau

SEQ ID NO: 657397 - RNA, 16 nt, Escherichia coli CFT073
cagagaaaccacauca

SEQ ID NO: 657398 - RNA, 20 nt, Escherichia coli CFT073
cagagaaacgccagcagcag

SEQ ID NO: 657399 - RNA, 18 nt, Escherichia coli CFT073
cagagaaagcaaaaauaa

SEQ ID NO: 657400 - RNA, 14 nt, Escherichia coli CFT073
cagagaaaagauaa

SEQ ID NO: 657401 - RNA, 18 nt, Escherichia coli CFT073
cagacuuuuugcggcagc

SEQ ID NO: 657402 - RNA, 21 nt, Escherichia coli CFT073
cagacuuggucgguauuuccg

SEQ ID NO: 657403 - RNA, 15 nt, Escherichia coli CFT073
cagacuuuuugcggc

SEQ ID NO: 657404 - RNA, 23 nt, Escherichia coli CFT073
cagacugcuuuucccuuucagau

SEQ ID NO: 657405 - RNA, 20 nt, Escherichia coli CFT073
cagacugaucaauaucagca

SEQ ID NO: 657406 - RNA, 17 nt, Escherichia coli CFT073
cagacugaucaucgccc

SEQ ID NO: 657407 - RNA, 15 nt, Escherichia coli CFT073
cagacugaugugcuc

SEQ ID NO: 657408 - RNA, 16 nt, Escherichia coli CFT073
cagacugcgcauuaaa

SEQ ID NO: 657409 - RNA, 18 nt, Escherichia coli CFT073
cagacugaagcuccgcug

SEQ ID NO: 657410 - RNA, 17 nt, Escherichia coli CFT073
cagacuggauacgcuga

SEQ ID NO: 657411 - RNA, 23 nt, Escherichia coli CFT073
cagacuggcgauuauccaugcca

SEQ ID NO: 657412 - RNA, 12 nt, Escherichia coli CFT073
cagagcaaacag

SEQ ID NO: 657413 - RNA, 13 nt, Escherichia coli CFT073
cagagcaaacagg

SEQ ID NO: 657414 - RNA, 16 nt, Escherichia coli CFT073
cagagcaaacaggcug

SEQ ID NO: 657415 - RNA, 23 nt, Escherichia coli CFT073
cagagaucgccccggcaagaaau

SEQ ID NO: 657416 - RNA, 20 nt, Escherichia coli CFT073
cagagauagaacugcauugu

SEQ ID NO: 657417 - RNA, 23 nt, Escherichia coli CFT073
cagagagacauuggcaaaaccaa

SEQ ID NO: 657418 - RNA, 12 nt, Escherichia coli CFT073
cagagagccagc

SEQ ID NO: 657419 - RNA, 14 nt, Escherichia coli CFT073
cagagagcgaauau

SEQ ID NO: 657420 - RNA, 18 nt, Escherichia coli CFT073
cagagagcgaauaucauu

SEQ ID NO: 657421 - RNA, 17 nt, Escherichia coli CFT073
cagagagguuuucaacu

SEQ ID NO: 657422 - RNA, 15 nt, Escherichia coli CFT073
cagagagucacgcag

SEQ ID NO: 657423 - RNA, 14 nt, Escherichia coli CFT073
cagagauacaggcc

SEQ ID NO: 657424 - RNA, 22 nt, Escherichia coli CFT073
cagacacuggaaacagccaauc

SEQ ID NO: 657425 - RNA, 12 nt, Escherichia coli CFT073
cagacagccuca

SEQ ID NO: 657426 - RNA, 19 nt, Escherichia coli CFT073
cagacaccgauugccccug

SEQ ID NO: 657427 - RNA, 23 nt, Escherichia coli CFT073
cagacaccggcgcacaaccgcca

SEQ ID NO: 657428 - RNA, 18 nt, Escherichia coli CFT073
cagacauuacaaaauaca

SEQ ID NO: 657429 - RNA, 17 nt, Escherichia coli CFT073
cagaccaaagucaaacu

SEQ ID NO: 657430 - RNA, 11 nt, Escherichia coli CFT073
cagaccaauag

SEQ ID NO: 657431 - RNA, 15 nt, Escherichia coli CFT073
cagaccaaucaccac

SEQ ID NO: 657432 - RNA, 17 nt, Escherichia coli CFT073
cagaccaaucaccacuu

SEQ ID NO: 657433 - RNA, 18 nt, Escherichia coli CFT073
cagaccaaucccgccaua

SEQ ID NO: 657434 - RNA, 20 nt, Escherichia coli CFT073
cagaccaaucccgccauaac

SEQ ID NO: 657435 - RNA, 14 nt, Escherichia coli CFT073
cagaccuaaaaauu

SEQ ID NO: 657436 - RNA, 22 nt, Escherichia coli CFT073
cagaccuacggauucaaugcaa

SEQ ID NO: 657437 - RNA, 22 nt, Escherichia coli CFT073
cagaccgggaaucgaaaugcca

SEQ ID NO: 657438 - RNA, 23 nt, Escherichia coli CFT073
cagaccgggaaucgaaaugccaa

SEQ ID NO: 657439 - RNA, 17 nt, Escherichia coli CFT073
cagaccagcuaccacgc

SEQ ID NO: 657440 - RNA, 20 nt, Escherichia coli CFT073
cagaccagcaaagugcgcuu

SEQ ID NO: 657441 - RNA, 19 nt, Escherichia coli CFT073
cagaccagcaauaaaaaac

SEQ ID NO: 657442 - RNA, 14 nt, Escherichia coli CFT073
cagacccagaacca

SEQ ID NO: 657443 - RNA, 20 nt, Escherichia coli CFT073
cagacccaguuuugcgcguu

SEQ ID NO: 657444 - RNA, 15 nt, Escherichia coli CFT073
cagaccaauggcgag

SEQ ID NO: 657445 - RNA, 13 nt, Escherichia coli CFT073
cagaccaauguua

SEQ ID NO: 657446 - RNA, 13 nt, Escherichia coli CFT073
cagaccacugcgc

SEQ ID NO: 657447 - RNA, 16 nt, Escherichia coli CFT073
cagaccagaaacgcca

SEQ ID NO: 657448 - RNA, 20 nt, Escherichia coli CFT073
cagaccagaaacgccaccau

SEQ ID NO: 657449 - RNA, 14 nt, Escherichia coli CFT073
cagaccagauugaa

SEQ ID NO: 657450 - RNA, 23 nt, Escherichia coli CFT073
cagaccagauugaacucgacaua

SEQ ID NO: 657451 - RNA, 18 nt, Escherichia coli CFT073
cagacaauccagcgaaau

SEQ ID NO: 657452 - RNA, 12 nt, Escherichia coli CFT073
cagacaacauga

SEQ ID NO: 657453 - RNA, 13 nt, Escherichia coli CFT073
cagaauuuucccu

SEQ ID NO: 657454 - RNA, 20 nt, Escherichia coli CFT073
cagacaaaaagaauacgcaa

SEQ ID NO: 657455 - RNA, 16 nt, Escherichia coli CFT073
cagacaaaacugacgc

SEQ ID NO: 657456 - RNA, 19 nt, Escherichia coli CFT073
cagacaaaugucagaaaga

SEQ ID NO: 657457 - RNA, 16 nt, Escherichia coli CFT073
cagaauggcauuauuu

SEQ ID NO: 657458 - RNA, 21 nt, Escherichia coli CFT073
cagaaugauauugauaauaaa

SEQ ID NO: 657459 - RNA, 14 nt, Escherichia coli CFT073
cagaaugccccauu

SEQ ID NO: 657460 - RNA, 14 nt, Escherichia coli CFT073
cagaauugccgccu

SEQ ID NO: 657461 - RNA, 14 nt, Escherichia coli CFT073
cagaauuaauugcu

SEQ ID NO: 657462 - RNA, 15 nt, Escherichia coli CFT073
cagaauuuccagaaa

SEQ ID NO: 657463 - RNA, 19 nt, Escherichia coli CFT073
cagaauuucgacuuuuuuc

SEQ ID NO: 657464 - RNA, 14 nt, Escherichia coli CFT073
cagaauuugaggaa

SEQ ID NO: 657465 - RNA, 15 nt, Escherichia coli CFT073
cagaauuugaggaag

SEQ ID NO: 657466 - RNA, 20 nt, Escherichia coli CFT073
cagaauuugaggaagcugcc

SEQ ID NO: 657467 - RNA, 21 nt, Escherichia coli CFT073
cagaauaccuugcugcuccag

SEQ ID NO: 657468 - RNA, 14 nt, Escherichia coli CFT073
cagaauacccagca

SEQ ID NO: 657469 - RNA, 23 nt, Escherichia coli CFT073
cagaauaccuugcugcuccagcg

SEQ ID NO: 657470 - RNA, 17 nt, Escherichia coli CFT073
cagaauagcgccgccaa

SEQ ID NO: 657471 - RNA, 19 nt, Escherichia coli CFT073
cagaauagcggcuucaucu

SEQ ID NO: 657472 - RNA, 21 nt, Escherichia coli CFT073
cagaauaacgcggcaggagag

SEQ ID NO: 657473 - RNA, 21 nt, Escherichia coli CFT073
cagaauaacgugaucgaacau

SEQ ID NO: 657474 - RNA, 13 nt, Escherichia coli CFT073
cagaauaagggca

SEQ ID NO: 657475 - RNA, 15 nt, Escherichia coli CFT073
cagaauauugccauu

SEQ ID NO: 657476 - RNA, 21 nt, Escherichia coli CFT073
cagaauauugccgaagaccag

SEQ ID NO: 657477 - RNA, 22 nt, Escherichia coli CFT073
cagaauauauaaagauacacag

SEQ ID NO: 657478 - RNA, 13 nt, Escherichia coli CFT073
cagaaucagcagc

SEQ ID NO: 657479 - RNA, 21 nt, Escherichia coli CFT073
cagaauccguacgcuuuucca

SEQ ID NO: 657480 - RNA, 15 nt, Escherichia coli CFT073
cagaauccccacaaa

SEQ ID NO: 657481 - RNA, 18 nt, Escherichia coli CFT073
cagaauccccacugcaug

SEQ ID NO: 657482 - RNA, 17 nt, Escherichia coli CFT073
cagaaucaucauaucgu

SEQ ID NO: 657483 - RNA, 23 nt, Escherichia coli CFT073
cagaaucuaagaucccugccauu

SEQ ID NO: 657484 - RNA, 19 nt, Escherichia coli CFT073
cagaaucgguccgccacau

SEQ ID NO: 657485 - RNA, 21 nt, Escherichia coli CFT073
cagaaugaaugauacagaaag

SEQ ID NO: 657486 - RNA, 17 nt, Escherichia coli CFT073
cagaaugacaucaucgc

SEQ ID NO: 657487 - RNA, 16 nt, Escherichia coli CFT073
cagaagauuaagagaa

SEQ ID NO: 657488 - RNA, 21 nt, Escherichia coli CFT073
cagaagagaagaaagaagccg

SEQ ID NO: 657489 - RNA, 22 nt, Escherichia coli CFT073
cagaagaggagaguacgugagu

SEQ ID NO: 657490 - RNA, 22 nt, Escherichia coli CFT073
cagaagcagaaugaaugauaca

SEQ ID NO: 657491 - RNA, 17 nt, Escherichia coli CFT073
cagaaguugcacccagu

SEQ ID NO: 657492 - RNA, 17 nt, Escherichia coli CFT073
cagaaguugugaaacga

SEQ ID NO: 657493 - RNA, 17 nt, Escherichia coli CFT073
cagaagggccuuuggca

SEQ ID NO: 657494 - RNA, 23 nt, Escherichia coli CFT073
cagaacuucugguaacagcggac

SEQ ID NO: 657495 - RNA, 20 nt, Escherichia coli CFT073
cagaacugguagcgcauuuc

SEQ ID NO: 657496 - RNA, 22 nt, Escherichia coli CFT073
cagaacuucgcuaacaaucuca

SEQ ID NO: 657497 - RNA, 23 nt, Escherichia coli CFT073
cagaacuucgcguuguauaacau

SEQ ID NO: 657498 - RNA, 13 nt, Escherichia coli CFT073
cagaacuucgcua

SEQ ID NO: 657499 - RNA, 16 nt, Escherichia coli CFT073
cagaacucccuguucc

SEQ ID NO: 657500 - RNA, 19 nt, Escherichia coli CFT073
cagaacggugcgaccaaac

SEQ ID NO: 657501 - RNA, 23 nt, Escherichia coli CFT073
cagaacggugcgaccaaacugcu

SEQ ID NO: 657502 - RNA, 17 nt, Escherichia coli CFT073
cagaacgaccaguucac

SEQ ID NO: 657503 - RNA, 15 nt, Escherichia coli CFT073
cagaacgaugaaguc

SEQ ID NO: 657504 - RNA, 17 nt, Escherichia coli CFT073
cagaacgcgugcgccuu

SEQ ID NO: 657505 - RNA, 17 nt, Escherichia coli CFT073
cagaacgcuuucgcaca

SEQ ID NO: 657506 - RNA, 21 nt, Escherichia coli CFT073
cagaacgcgccuuaaaaacca

SEQ ID NO: 657507 - RNA, 13 nt, Escherichia coli CFT073
cagaaccagcaac

SEQ ID NO: 657508 - RNA, 20 nt, Escherichia coli CFT073
cagaaccgcguaacuuuugc

SEQ ID NO: 657509 - RNA, 15 nt, Escherichia coli CFT073
cagaaccgcuucuuc

SEQ ID NO: 657510 - RNA, 23 nt, Escherichia coli CFT073
cagaaccugaggcaauaaauaca

SEQ ID NO: 657511 - RNA, 17 nt, Escherichia coli CFT073
cagaaaauacucagcac

SEQ ID NO: 657512 - RNA, 19 nt, Escherichia coli CFT073
cagaaaauacucagcaccc

SEQ ID NO: 657513 - RNA, 20 nt, Escherichia coli CFT073
cagaaaaucacggcaaacug

SEQ ID NO: 657514 - RNA, 20 nt, Escherichia coli CFT073
cagaaaauccagcagaauaa

SEQ ID NO: 657515 - RNA, 21 nt, Escherichia coli CFT073
cagaaaauccagcagaauaac

SEQ ID NO: 657516 - RNA, 19 nt, Escherichia coli CFT073
cagaaaaggugccacagca

SEQ ID NO: 657517 - RNA, 20 nt, Escherichia coli CFT073
cagaaaaggugccacagcag

SEQ ID NO: 657518 - RNA, 20 nt, Escherichia coli CFT073
cagaaacaaaugaaauauug

SEQ ID NO: 657519 - RNA, 23 nt, Escherichia coli CFT073
cagaaacgcuggugaaaucagcc

SEQ ID NO: 657520 - RNA, 18 nt, Escherichia coli CFT073
cagaaacgccauccagcc

SEQ ID NO: 657521 - RNA, 15 nt, Escherichia coli CFT073
cagaaacauccccag

SEQ ID NO: 657522 - RNA, 23 nt, Escherichia coli CFT073
cagaaaccaggucaaugcaaccc

SEQ ID NO: 657523 - RNA, 23 nt, Escherichia coli CFT073
cagaaagacgguuaacgccagcc

SEQ ID NO: 657524 - RNA, 14 nt, Escherichia coli CFT073
cagaaagaaauuuc

SEQ ID NO: 657525 - RNA, 22 nt, Escherichia coli CFT073
cagaaagcgacccgguucaauu

SEQ ID NO: 657526 - RNA, 21 nt, Escherichia coli CFT073
cagaaagcgacuuugccuggc

SEQ ID NO: 657527 - RNA, 15 nt, Escherichia coli CFT073
cagaaagcgccagca

SEQ ID NO: 657528 - RNA, 18 nt, Escherichia coli CFT073
cagaaagcgccagcaaga

SEQ ID NO: 657529 - RNA, 19 nt, Escherichia coli CFT073
cagaaagugaguuuugcau

SEQ ID NO: 657530 - RNA, 16 nt, Escherichia coli CFT073
cagaaaguggcacaca

SEQ ID NO: 657531 - RNA, 20 nt, Escherichia coli CFT073
cagaaaguucgcgaaaguua

SEQ ID NO: 657532 - RNA, 20 nt, Escherichia coli CFT073
cagaaagguauuuagcgaau

SEQ ID NO: 657533 - RNA, 23 nt, Escherichia coli CFT073
cagaaagguucggcuaaccgacu

SEQ ID NO: 657534 - RNA, 16 nt, Escherichia coli CFT073
cagaaauagagaaaga

SEQ ID NO: 657535 - RNA, 22 nt, Escherichia coli CFT073
cagaaauaaucaccugaugccc

SEQ ID NO: 657536 - RNA, 18 nt, Escherichia coli CFT073
cagaaauagaaagugacu

SEQ ID NO: 657537 - RNA, 16 nt, Escherichia coli CFT073
cagaaauuaaacuguc

SEQ ID NO: 657538 - RNA, 21 nt, Escherichia coli CFT073
cagaaauggcuggcagcagac

SEQ ID NO: 657539 - RNA, 20 nt, Escherichia coli CFT073
cagaaaugccaguaacucau

SEQ ID NO: 657540 - RNA, 14 nt, Escherichia coli CFT073
cagaaaugaugggg

SEQ ID NO: 657541 - RNA, 19 nt, Escherichia coli CFT073
cagaacaccggcagcggga

SEQ ID NO: 657542 - RNA, 21 nt, Escherichia coli CFT073
cagaacacugcgcucuucugg

SEQ ID NO: 657543 - RNA, 22 nt, Escherichia coli CFT073
cagaacacuguuaccgcugcug

SEQ ID NO: 657544 - RNA, 11 nt, Escherichia coli CFT073
cagaacaccau

SEQ ID NO: 657545 - RNA, 23 nt, Escherichia coli CFT073
cagaacagaucccacauauguuu

SEQ ID NO: 657546 - RNA, 18 nt, Escherichia coli CFT073
cagaacagguuacggucg

SEQ ID NO: 657547 - RNA, 15 nt, Escherichia coli CFT073
cagaacaauuccugu

SEQ ID NO: 657548 - RNA, 18 nt, Escherichia coli CFT073
cagaacaauuccugugcc

SEQ ID NO: 657549 - RNA, 13 nt, Escherichia coli CFT073
cacuugcaggaac

SEQ ID NO: 657550 - RNA, 22 nt, Escherichia coli CFT073
cacuugcagucggcuuucucau

SEQ ID NO: 657551 - RNA, 12 nt, Escherichia coli CFT073
cacuucuuugau

SEQ ID NO: 657552 - RNA, 15 nt, Escherichia coli CFT073
cacuugccugcugug

SEQ ID NO: 657553 - RNA, 16 nt, Escherichia coli CFT073
cacuugcgcauaauaa

SEQ ID NO: 657554 - RNA, 22 nt, Escherichia coli CFT073
cacuugcggcacccauuuaucc

SEQ ID NO: 657555 - RNA, 13 nt, Escherichia coli CFT073
cacuuuccugcuc

SEQ ID NO: 657556 - RNA, 19 nt, Escherichia coli CFT073
cacuuucgacuucaagcga

SEQ ID NO: 657557 - RNA, 17 nt, Escherichia coli CFT073
cacuuucgccaguucuu

SEQ ID NO: 657558 - RNA, 18 nt, Escherichia coli CFT073
cacuuucgccaguucuuc

SEQ ID NO: 657559 - RNA, 17 nt, Escherichia coli CFT073
cacuuucacccugacug

SEQ ID NO: 657560 - RNA, 19 nt, Escherichia coli CFT073
cacuuuuuccggugccauc

SEQ ID NO: 657561 - RNA, 20 nt, Escherichia coli CFT073
cacuuuuuccggugccaucu

SEQ ID NO: 657562 - RNA, 14 nt, Escherichia coli CFT073
cagaaaaacuacac

SEQ ID NO: 657563 - RNA, 18 nt, Escherichia coli CFT073
cagaaaacgguugauaua

SEQ ID NO: 657564 - RNA, 17 nt, Escherichia coli CFT073
cacuuucucgacaucca

SEQ ID NO: 657565 - RNA, 20 nt, Escherichia coli CFT073
cacuuugcgcuccuguuccc

SEQ ID NO: 657566 - RNA, 21 nt, Escherichia coli CFT073
cacuuuguaggccugauaaga

SEQ ID NO: 657567 - RNA, 15 nt, Escherichia coli CFT073
cacuuuguauccacu

SEQ ID NO: 657568 - RNA, 14 nt, Escherichia coli CFT073
cacuuugucagcaa

SEQ ID NO: 657569 - RNA, 15 nt, Escherichia coli CFT073
cacuuugucagcaaa

SEQ ID NO: 657570 - RNA, 15 nt, Escherichia coli CFT073
cacuuugucguaagc

SEQ ID NO: 657571 - RNA, 18 nt, Escherichia coli CFT073
cacuuuuaacgccucguu

SEQ ID NO: 657572 - RNA, 13 nt, Escherichia coli CFT073
cacuuuucaguua

SEQ ID NO: 657573 - RNA, 16 nt, Escherichia coli CFT073
cacuuuucaguuacca

SEQ ID NO: 657574 - RNA, 21 nt, Escherichia coli CFT073
cacuugagccgccaccagaac

SEQ ID NO: 657575 - RNA, 16 nt, Escherichia coli CFT073
cacuucuucuguuucu

SEQ ID NO: 657576 - RNA, 16 nt, Escherichia coli CFT073
cacuucuucagccagu

SEQ ID NO: 657577 - RNA, 16 nt, Escherichia coli CFT073
cacuucuucacaucaa

SEQ ID NO: 657578 - RNA, 23 nt, Escherichia coli CFT073
cacuucugaugcagguacucacc

SEQ ID NO: 657579 - RNA, 13 nt, Escherichia coli CFT073
cacuucugcggug

SEQ ID NO: 657580 - RNA, 22 nt, Escherichia coli CFT073
cacuucugaguucggcaugggg

SEQ ID NO: 657581 - RNA, 23 nt, Escherichia coli CFT073
cacuucugaguucggcauggggu

SEQ ID NO: 657582 - RNA, 19 nt, Escherichia coli CFT073
cacuucguuaaccacgauc

SEQ ID NO: 657583 - RNA, 15 nt, Escherichia coli CFT073
cacuuccucaagcgu

SEQ ID NO: 657584 - RNA, 12 nt, Escherichia coli CFT073
cacuucccagcc

SEQ ID NO: 657585 - RNA, 22 nt, Escherichia coli CFT073
cacuuccggugccgguuucacg

SEQ ID NO: 657586 - RNA, 19 nt, Escherichia coli CFT073
cacuuccuuuagaagcacu

SEQ ID NO: 657587 - RNA, 14 nt, Escherichia coli CFT073
cacuucgauccagu

SEQ ID NO: 657588 - RNA, 15 nt, Escherichia coli CFT073
cacuucaauauuaau

SEQ ID NO: 657589 - RNA, 20 nt, Escherichia coli CFT073
cacuuauuuguuauuacugc

SEQ ID NO: 657590 - RNA, 17 nt, Escherichia coli CFT073
cacuucaaccacauuca

SEQ ID NO: 657591 - RNA, 14 nt, Escherichia coli CFT073
cacuucaguaaaua

SEQ ID NO: 657592 - RNA, 20 nt, Escherichia coli CFT073
cacuucauagugcgcggugu

SEQ ID NO: 657593 - RNA, 20 nt, Escherichia coli CFT073
cacuucauauggcacuuuca

SEQ ID NO: 657594 - RNA, 12 nt, Escherichia coli CFT073
cacuucaucaag

SEQ ID NO: 657595 - RNA, 15 nt, Escherichia coli CFT073
cacuucaucaagcaa

SEQ ID NO: 657596 - RNA, 19 nt, Escherichia coli CFT073
cacuucauccggauacagc

SEQ ID NO: 657597 - RNA, 15 nt, Escherichia coli CFT073
cacuuccagcggcca

SEQ ID NO: 657598 - RNA, 18 nt, Escherichia coli CFT073
cacuucauuggcuugcac

SEQ ID NO: 657599 - RNA, 18 nt, Escherichia coli CFT073
cacugucgagaucgcggc

SEQ ID NO: 657600 - RNA, 22 nt, Escherichia coli CFT073
cacugucaucgacaaaaacccu

SEQ ID NO: 657601 - RNA, 15 nt, Escherichia coli CFT073
cacuguagaccaguc

SEQ ID NO: 657602 - RNA, 19 nt, Escherichia coli CFT073
cacugguucccaacaacag

SEQ ID NO: 657603 - RNA, 21 nt, Escherichia coli CFT073
cacuguggucaacccaacugg

SEQ ID NO: 657604 - RNA, 19 nt, Escherichia coli CFT073
cacuguuugaucugcugcc

SEQ ID NO: 657605 - RNA, 13 nt, Escherichia coli CFT073
cacuuaaccacaa

SEQ ID NO: 657606 - RNA, 20 nt, Escherichia coli CFT073
cacuuaacguuaccuuuaau

SEQ ID NO: 657607 - RNA, 15 nt, Escherichia coli CFT073
cacuuaaagcaacac

SEQ ID NO: 657608 - RNA, 19 nt, Escherichia coli CFT073
cacuggguauaccggcguu

SEQ ID NO: 657609 - RNA, 19 nt, Escherichia coli CFT073
cacugggguaaauccacgu

SEQ ID NO: 657610 - RNA, 13 nt, Escherichia coli CFT073
cacuggcgcgccu

SEQ ID NO: 657611 - RNA, 15 nt, Escherichia coli CFT073
cacuggccucuucuc

SEQ ID NO: 657612 - RNA, 16 nt, Escherichia coli CFT073
cacuggccucuucucu

SEQ ID NO: 657613 - RNA, 17 nt, Escherichia coli CFT073
cacuggcacaagacuga

SEQ ID NO: 657614 - RNA, 14 nt, Escherichia coli CFT073
cacugcucaccgca

SEQ ID NO: 657615 - RNA, 17 nt, Escherichia coli CFT073
cacugcucgcagaaaua

SEQ ID NO: 657616 - RNA, 23 nt, Escherichia coli CFT073
caauguuuuucuccuacacccca

SEQ ID NO: 657617 - RNA, 24 nt, Escherichia coli CFT073
caauguuuuucuccuacaccccag

SEQ ID NO: 657618 - RNA, 18 nt, Escherichia coli CFT073
cacugaugauccuggauu

SEQ ID NO: 657619 - RNA, 22 nt, Escherichia coli CFT073
cacugcaaaucaccacaugccc

SEQ ID NO: 657620 - RNA, 19 nt, Escherichia coli CFT073
caauguuauccggcuauau

SEQ ID NO: 657621 - RNA, 23 nt, Escherichia coli CFT073
caauguuaccgaucgccagcagg

SEQ ID NO: 657622 - RNA, 19 nt, Escherichia coli CFT073
caaugucauggcagucuua

SEQ ID NO: 657623 - RNA, 15 nt, Escherichia coli CFT073
caauguggaaagccc

SEQ ID NO: 657624 - RNA, 20 nt, Escherichia coli CFT073
cacugcgaccagugaaaaug

SEQ ID NO: 657625 - RNA, 21 nt, Escherichia coli CFT073
cacugccuugcgauaucccau

SEQ ID NO: 657626 - RNA, 16 nt, Escherichia coli CFT073
cacugccgccaugcgg

SEQ ID NO: 657627 - RNA, 18 nt, Escherichia coli CFT073
cacugccggggaaguaaa

SEQ ID NO: 657628 - RNA, 21 nt, Escherichia coli CFT073
cacugccggggaaguaaaccc

SEQ ID NO: 657629 - RNA, 17 nt, Escherichia coli CFT073
cacugccguacaggcag

SEQ ID NO: 657630 - RNA, 13 nt, Escherichia coli CFT073
cacugcgcccgcc

SEQ ID NO: 657631 - RNA, 14 nt, Escherichia coli CFT073
cacugcgcccgcca

SEQ ID NO: 657632 - RNA, 18 nt, Escherichia coli CFT073
cacugcgcccgccagcau

SEQ ID NO: 657633 - RNA, 22 nt, Escherichia coli CFT073
cacugcgcgauaaucccaacgc

SEQ ID NO: 657634 - RNA, 15 nt, Escherichia coli CFT073
cacugcggcauuucc

SEQ ID NO: 657635 - RNA, 19 nt, Escherichia coli CFT073
cacugccagugucggaugc

SEQ ID NO: 657636 - RNA, 14 nt, Escherichia coli CFT073
cacugccagcccgg

SEQ ID NO: 657637 - RNA, 18 nt, Escherichia coli CFT073
cacugcaucaguaaagua

SEQ ID NO: 657638 - RNA, 13 nt, Escherichia coli CFT073
cacugccaccagg

SEQ ID NO: 657639 - RNA, 14 nt, Escherichia coli CFT073
cacugccaccaucc

SEQ ID NO: 657640 - RNA, 18 nt, Escherichia coli CFT073
cacugccaccauccccac

SEQ ID NO: 657641 - RNA, 14 nt, Escherichia coli CFT073
cacugccagaauag

SEQ ID NO: 657642 - RNA, 20 nt, Escherichia coli CFT073
cacugccagaauagccgcag

SEQ ID NO: 657643 - RNA, 17 nt, Escherichia coli CFT073
cacugccagcaaaaaau

SEQ ID NO: 657644 - RNA, 21 nt, Escherichia coli CFT073
cagcgcuuuuggcgcguuccc

SEQ ID NO: 657645 - RNA, 23 nt, Escherichia coli CFT073
cagcggaaauuaccgcaccacca

SEQ ID NO: 657646 - RNA, 14 nt, Escherichia coli CFT073
cagcggacgcugcu

SEQ ID NO: 657647 - RNA, 12 nt, Escherichia coli CFT073
cagcgcuuuauc

SEQ ID NO: 657648 - RNA, 18 nt, Escherichia coli CFT073
cagcgcugcccaccacuc

SEQ ID NO: 657649 - RNA, 19 nt, Escherichia coli CFT073
cagcgcugcggccugcugc

SEQ ID NO: 657650 - RNA, 12 nt, Escherichia coli CFT073
cagcgcuggaga

SEQ ID NO: 657651 - RNA, 21 nt, Escherichia coli CFT073
cagcgcuggagagcgccgggc

SEQ ID NO: 657652 - RNA, 17 nt, Escherichia coli CFT073
cagcgcguuugucagca

SEQ ID NO: 657653 - RNA, 17 nt, Escherichia coli CFT073
cagcgcgugcgccaccg

SEQ ID NO: 657654 - RNA, 14 nt, Escherichia coli CFT073
cagcggcaccuucg

SEQ ID NO: 657655 - RNA, 16 nt, Escherichia coli CFT073
cagcggcaaccagcag

SEQ ID NO: 657656 - RNA, 21 nt, Escherichia coli CFT073
cagcggcaaccagcagcauca

SEQ ID NO: 657657 - RNA, 15 nt, Escherichia coli CFT073
cagcggaugacccag

SEQ ID NO: 657658 - RNA, 16 nt, Escherichia coli CFT073
cagcggcaguaaauau

SEQ ID NO: 657659 - RNA, 16 nt, Escherichia coli CFT073
cagcggcaucaaccgc

SEQ ID NO: 657660 - RNA, 20 nt, Escherichia coli CFT073
cagcggccagacgcgccgcc

SEQ ID NO: 657661 - RNA, 20 nt, Escherichia coli CFT073
cagcgcggaaggaaugaaau

SEQ ID NO: 657662 - RNA, 22 nt, Escherichia coli CFT073
cagcgcggaaggaaugaaauag

SEQ ID NO: 657663 - RNA, 13 nt, Escherichia coli CFT073
cagcgcgcgcagc

SEQ ID NO: 657664 - RNA, 19 nt, Escherichia coli CFT073
cagcgcgccugaaugccac

SEQ ID NO: 657665 - RNA, 16 nt, Escherichia coli CFT073
cagcgcgccagcuacc

SEQ ID NO: 657666 - RNA, 14 nt, Escherichia coli CFT073
cagcgcgauuagcg

SEQ ID NO: 657667 - RNA, 16 nt, Escherichia coli CFT073
cagcgcgaucgcgcca

SEQ ID NO: 657668 - RNA, 23 nt, Escherichia coli CFT073
cagcgcgaccgccaugaugaucc

SEQ ID NO: 657669 - RNA, 14 nt, Escherichia coli CFT073
cagcgccugaugga

SEQ ID NO: 657670 - RNA, 21 nt, Escherichia coli CFT073
cagcgccugggaaucaaacca

SEQ ID NO: 657671 - RNA, 15 nt, Escherichia coli CFT073
cagcgccuguugauu

SEQ ID NO: 657672 - RNA, 17 nt, Escherichia coli CFT073
cagcgccugcagcugca

SEQ ID NO: 657673 - RNA, 14 nt, Escherichia coli CFT073
cagcgccugcugca

SEQ ID NO: 657674 - RNA, 20 nt, Escherichia coli CFT073
cagcgccugcugcacaccau

SEQ ID NO: 657675 - RNA, 16 nt, Escherichia coli CFT073
cagcgccugcgcggca

SEQ ID NO: 657676 - RNA, 17 nt, Escherichia coli CFT073
cagcgccuggcagcaug

SEQ ID NO: 657677 - RNA, 13 nt, Escherichia coli CFT073
cagcgccugcagc

SEQ ID NO: 657678 - RNA, 16 nt, Escherichia coli CFT073
cagcgccauuaacagu

SEQ ID NO: 657679 - RNA, 13 nt, Escherichia coli CFT073
cagcgccaucccc

SEQ ID NO: 657680 - RNA, 20 nt, Escherichia coli CFT073
cagcgccaucgccaggaaca

SEQ ID NO: 657681 - RNA, 22 nt, Escherichia coli CFT073
cagcgccaucgccaggaacaac

SEQ ID NO: 657682 - RNA, 17 nt, Escherichia coli CFT073
cagcgccaccgguuuau

SEQ ID NO: 657683 - RNA, 14 nt, Escherichia coli CFT073
cagcgccagacacu

SEQ ID NO: 657684 - RNA, 15 nt, Escherichia coli CFT073
cagcgccagacacug

SEQ ID NO: 657685 - RNA, 15 nt, Escherichia coli CFT073
cagcgccagauagcc

SEQ ID NO: 657686 - RNA, 14 nt, Escherichia coli CFT073
cagcgccaggcaca

SEQ ID NO: 657687 - RNA, 14 nt, Escherichia coli CFT073
cagcgcccgcuuca

SEQ ID NO: 657688 - RNA, 17 nt, Escherichia coli CFT073
cagcgcccguaaaccaa

SEQ ID NO: 657689 - RNA, 20 nt, Escherichia coli CFT073
cagcgcccguaaaccaagcu

SEQ ID NO: 657690 - RNA, 21 nt, Escherichia coli CFT073
cagcgcccguaaaccaagcug

SEQ ID NO: 657691 - RNA, 15 nt, Escherichia coli CFT073
cagcgcccugccgau

SEQ ID NO: 657692 - RNA, 13 nt, Escherichia coli CFT073
cagcgccgcgagc

SEQ ID NO: 657693 - RNA, 13 nt, Escherichia coli CFT073
cagcgaucgcuuu

SEQ ID NO: 657694 - RNA, 15 nt, Escherichia coli CFT073
cagcgaugcugacga

SEQ ID NO: 657695 - RNA, 17 nt, Escherichia coli CFT073
cagcgauuaacugcgcg

SEQ ID NO: 657696 - RNA, 21 nt, Escherichia coli CFT073
cagcgauaaugaaugaugcgg

SEQ ID NO: 657697 - RNA, 23 nt, Escherichia coli CFT073
cagcgcaaagcccgccgccacaa

SEQ ID NO: 657698 - RNA, 17 nt, Escherichia coli CFT073
cagcgcaccagaaacaa

SEQ ID NO: 657699 - RNA, 15 nt, Escherichia coli CFT073
cagcgcaauagccug

SEQ ID NO: 657700 - RNA, 18 nt, Escherichia coli CFT073
cagcgcaauagccugaug

SEQ ID NO: 657701 - RNA, 22 nt, Escherichia coli CFT073
cagcgcaaucugcuucuuacca

SEQ ID NO: 657702 - RNA, 12 nt, Escherichia coli CFT073
cagcgccaaccc

SEQ ID NO: 657703 - RNA, 17 nt, Escherichia coli CFT073
cagcgcauggcggcagc

SEQ ID NO: 657704 - RNA, 18 nt, Escherichia coli CFT073
cagcgccaccaccaguac

SEQ ID NO: 657705 - RNA, 20 nt, Escherichia coli CFT073
cagcgccaccacgccgaugg

SEQ ID NO: 657706 - RNA, 12 nt, Escherichia coli CFT073
cagcgccaccac

SEQ ID NO: 657707 - RNA, 15 nt, Escherichia coli CFT073
cagcgccaccacaaa

SEQ ID NO: 657708 - RNA, 16 nt, Escherichia coli CFT073
cagcgccaccacaaaa

SEQ ID NO: 657709 - RNA, 19 nt, Escherichia coli CFT073
cagcgcauagcuaaucccc

SEQ ID NO: 657710 - RNA, 13 nt, Escherichia coli CFT073
cagcgcaucauga

SEQ ID NO: 657711 - RNA, 12 nt, Escherichia coli CFT073
cagcgcaggaaa

SEQ ID NO: 657712 - RNA, 13 nt, Escherichia coli CFT073
cagcgcaggaaag

SEQ ID NO: 657713 - RNA, 13 nt, Escherichia coli CFT073
cagcgcacuuuca

SEQ ID NO: 657714 - RNA, 13 nt, Escherichia coli CFT073
cagcgcagcaccc

SEQ ID NO: 657715 - RNA, 15 nt, Escherichia coli CFT073
cagcgcagcacccag

SEQ ID NO: 657716 - RNA, 22 nt, Escherichia coli CFT073
cagcccuuugauuugucugcca

SEQ ID NO: 657717 - RNA, 17 nt, Escherichia coli CFT073
cagccgauaucuuuccg

SEQ ID NO: 657718 - RNA, 15 nt, Escherichia coli CFT073
cagcccugcccagag

SEQ ID NO: 657719 - RNA, 14 nt, Escherichia coli CFT073
cagcccuucuuuca

SEQ ID NO: 657720 - RNA, 19 nt, Escherichia coli CFT073
cagcccuaaaaacaguacc

SEQ ID NO: 657721 - RNA, 22 nt, Escherichia coli CFT073
cagcccuaucaucgcggcacac

SEQ ID NO: 657722 - RNA, 22 nt, Escherichia coli CFT073
cagcccggcaagugucgccugc

SEQ ID NO: 657723 - RNA, 18 nt, Escherichia coli CFT073
cagcccggcauguuucaa

SEQ ID NO: 657724 - RNA, 17 nt, Escherichia coli CFT073
cagccgcaaacgacacu

SEQ ID NO: 657725 - RNA, 21 nt, Escherichia coli CFT073
cagccgauguuauugcagaca

SEQ ID NO: 657726 - RNA, 21 nt, Escherichia coli CFT073
cagccgcgauuuuugcucccg

SEQ ID NO: 657727 - RNA, 18 nt, Escherichia coli CFT073
cagccgccgcuccucauc

SEQ ID NO: 657728 - RNA, 13 nt, Escherichia coli CFT073
cagccgcgucuga

SEQ ID NO: 657729 - RNA, 23 nt, Escherichia coli CFT073
cagccgcgucugaauaucaucac

SEQ ID NO: 657730 - RNA, 22 nt, Escherichia coli CFT073
cagcgaagccagcucccacagu

SEQ ID NO: 657731 - RNA, 17 nt, Escherichia coli CFT073
cagcgaaccguucauuu

SEQ ID NO: 657732 - RNA, 18 nt, Escherichia coli CFT073
cagcgaaacgcaaaaccc

SEQ ID NO: 657733 - RNA, 22 nt, Escherichia coli CFT073
cagcgaaauacaaguccccgcu

SEQ ID NO: 657734 - RNA, 22 nt, Escherichia coli CFT073
cagcgaaaaagucccuucccag

SEQ ID NO: 657735 - RNA, 13 nt, Escherichia coli CFT073
cagcgaaaccuga

SEQ ID NO: 657736 - RNA, 15 nt, Escherichia coli CFT073
cagcgaauuccaguu

SEQ ID NO: 657737 - RNA, 23 nt, Escherichia coli CFT073
cagcgaaucagcccagcccugaa

SEQ ID NO: 657738 - RNA, 16 nt, Escherichia coli CFT073
cagcgaaucagcccag

SEQ ID NO: 657739 - RNA, 23 nt, Escherichia coli CFT073
cagcgaagguaacaccaguuucc

SEQ ID NO: 657740 - RNA, 19 nt, Escherichia coli CFT073
cagcgacaagcucucuuca

SEQ ID NO: 657741 - RNA, 23 nt, Escherichia coli CFT073
cagcgacauacucagcgccugcu

SEQ ID NO: 657742 - RNA, 14 nt, Escherichia coli CFT073
cagcgaccgcgcca

SEQ ID NO: 657743 - RNA, 17 nt, Escherichia coli CFT073
cagcgagcuggcgcuga

SEQ ID NO: 657744 - RNA, 22 nt, Escherichia coli CFT073
cagcgagcuggcgcugauaaau

SEQ ID NO: 657745 - RNA, 20 nt, Escherichia coli CFT073
cagcgagaagucggcuuuua

SEQ ID NO: 657746 - RNA, 20 nt, Escherichia coli CFT073
cagcgacgaccguuuuacgc

SEQ ID NO: 657747 - RNA, 12 nt, Escherichia coli CFT073
cagcgagaaguc

SEQ ID NO: 657748 - RNA, 17 nt, Escherichia coli CFT073
cagccuucgccaccgug

SEQ ID NO: 657749 - RNA, 21 nt, Escherichia coli CFT073
cagccuucuguaaccuuuucc

SEQ ID NO: 657750 - RNA, 12 nt, Escherichia coli CFT073
cagccuucuuca

SEQ ID NO: 657751 - RNA, 19 nt, Escherichia coli CFT073
cagccuucuucauccagcg

SEQ ID NO: 657752 - RNA, 17 nt, Escherichia coli CFT073
cagccuuaacaagauau

SEQ ID NO: 657753 - RNA, 15 nt, Escherichia coli CFT073
cagccuuaccggaga

SEQ ID NO: 657754 - RNA, 14 nt, Escherichia coli CFT073
cagccuuuccagca

SEQ ID NO: 657755 - RNA, 22 nt, Escherichia coli CFT073
cagccuugugccucaacccauu

SEQ ID NO: 657756 - RNA, 16 nt, Escherichia coli CFT073
cagccuuuucauccuc

SEQ ID NO: 657757 - RNA, 17 nt, Escherichia coli CFT073
cagccugcguucaguug

SEQ ID NO: 657758 - RNA, 14 nt, Escherichia coli CFT073
cagccucugucuuc

SEQ ID NO: 657759 - RNA, 14 nt, Escherichia coli CFT073
cagccucucucuga

SEQ ID NO: 657760 - RNA, 16 nt, Escherichia coli CFT073
cagccucucucugagg

SEQ ID NO: 657761 - RNA, 19 nt, Escherichia coli CFT073
cagccugaaugccgcgccc

SEQ ID NO: 657762 - RNA, 20 nt, Escherichia coli CFT073
cagccugaaugccgcgcccc

SEQ ID NO: 657763 - RNA, 19 nt, Escherichia coli CFT073
cagccuccaacccacaaaa

SEQ ID NO: 657764 - RNA, 20 nt, Escherichia coli CFT073
cagccuacagaacgcugcaa

SEQ ID NO: 657765 - RNA, 15 nt, Escherichia coli CFT073
cagccguuucaccac

SEQ ID NO: 657766 - RNA, 20 nt, Escherichia coli CFT073
cagccucaagcacccgccgc

SEQ ID NO: 657767 - RNA, 21 nt, Escherichia coli CFT073
cagccucaagcacccgccgcu

SEQ ID NO: 657768 - RNA, 15 nt, Escherichia coli CFT073
cagccguuuguucug

SEQ ID NO: 657769 - RNA, 19 nt, Escherichia coli CFT073
cagccguuuguucugcauc

SEQ ID NO: 657770 - RNA, 17 nt, Escherichia coli CFT073
cagccgucgccaguacc

SEQ ID NO: 657771 - RNA, 13 nt, Escherichia coli CFT073
cagccccacagca

SEQ ID NO: 657772 - RNA, 13 nt, Escherichia coli CFT073
cagccccaccagc

SEQ ID NO: 657773 - RNA, 15 nt, Escherichia coli CFT073
cagccccgcgcggcg

SEQ ID NO: 657774 - RNA, 14 nt, Escherichia coli CFT073
cagccccugugcca

SEQ ID NO: 657775 - RNA, 15 nt, Escherichia coli CFT073
cagccccucagcggu

SEQ ID NO: 657776 - RNA, 14 nt, Escherichia coli CFT073
cagccccgguuuuu

SEQ ID NO: 657777 - RNA, 18 nt, Escherichia coli CFT073
cagcccagcccugaacca

SEQ ID NO: 657778 - RNA, 14 nt, Escherichia coli CFT073
cagcccaggaagcc

SEQ ID NO: 657779 - RNA, 16 nt, Escherichia coli CFT073
cagccaugucgccacc

SEQ ID NO: 657780 - RNA, 14 nt, Escherichia coli CFT073
cagccaugcauuuu

SEQ ID NO: 657781 - RNA, 12 nt, Escherichia coli CFT073
cagccaugccac

SEQ ID NO: 657782 - RNA, 18 nt, Escherichia coli CFT073
cagccaugccgccaccac

SEQ ID NO: 657783 - RNA, 23 nt, Escherichia coli CFT073
cagccaugccgccaccaccagcg

SEQ ID NO: 657784 - RNA, 22 nt, Escherichia coli CFT073
cagccaucaccacgccgagaga

SEQ ID NO: 657785 - RNA, 20 nt, Escherichia coli CFT073
cagccaucgccaccgcuucg

SEQ ID NO: 657786 - RNA, 16 nt, Escherichia coli CFT073
cagccaucgccacugc

SEQ ID NO: 657787 - RNA, 19 nt, Escherichia coli CFT073
cagccaucgccacugcaaa

SEQ ID NO: 657788 - RNA, 19 nt, Escherichia coli CFT073
cagccaucgccugcuggau

SEQ ID NO: 657789 - RNA, 16 nt, Escherichia coli CFT073
cagccagcccaucgcu

SEQ ID NO: 657790 - RNA, 16 nt, Escherichia coli CFT073
cagccagccagcacca

SEQ ID NO: 657791 - RNA, 17 nt, Escherichia coli CFT073
cagccagauaucgagaa

SEQ ID NO: 657792 - RNA, 20 nt, Escherichia coli CFT073
cagccacuucaaccagcggc

SEQ ID NO: 657793 - RNA, 22 nt, Escherichia coli CFT073
cagccacuuccugcucgguaaa

SEQ ID NO: 657794 - RNA, 16 nt, Escherichia coli CFT073
cagccagaaaucacca

SEQ ID NO: 657795 - RNA, 20 nt, Escherichia coli CFT073
cagccagaacagcggagcaa

SEQ ID NO: 657796 - RNA, 14 nt, Escherichia coli CFT073
cagccacugcugcg

SEQ ID NO: 657797 - RNA, 17 nt, Escherichia coli CFT073
cagccacucggacaccu

SEQ ID NO: 657798 - RNA, 14 nt, Escherichia coli CFT073
cagccaguuuuuca

SEQ ID NO: 657799 - RNA, 17 nt, Escherichia coli CFT073
cagccauaaagaaauca

SEQ ID NO: 657800 - RNA, 20 nt, Escherichia coli CFT073
cagccauaaagaaaucaccu

SEQ ID NO: 657801 - RNA, 14 nt, Escherichia coli CFT073
cagccaguugaucu

SEQ ID NO: 657802 - RNA, 12 nt, Escherichia coli CFT073
cagccaguugcu

SEQ ID NO: 657803 - RNA, 14 nt, Escherichia coli CFT073
cagccaguugcucu

SEQ ID NO: 657804 - RNA, 21 nt, Escherichia coli CFT073
cagccagugauuccggugccg

SEQ ID NO: 657805 - RNA, 22 nt, Escherichia coli CFT073
cagccagggauaagccagacca

SEQ ID NO: 657806 - RNA, 15 nt, Escherichia coli CFT073
cagccagguggcaga

SEQ ID NO: 657807 - RNA, 17 nt, Escherichia coli CFT073
cagccagguggcgaucc

SEQ ID NO: 657808 - RNA, 15 nt, Escherichia coli CFT073
cagccaggcgcugcu

SEQ ID NO: 657809 - RNA, 15 nt, Escherichia coli CFT073
cagccaggaaacgca

SEQ ID NO: 657810 - RNA, 18 nt, Escherichia coli CFT073
cagccagcgccgcgcggg

SEQ ID NO: 657811 - RNA, 14 nt, Escherichia coli CFT073
cagccagcgcaccu

SEQ ID NO: 657812 - RNA, 19 nt, Escherichia coli CFT073
cagccagccgcuaacuucc

SEQ ID NO: 657813 - RNA, 20 nt, Escherichia coli CFT073
cagccacaacaaacgaccgc

SEQ ID NO: 657814 - RNA, 19 nt, Escherichia coli CFT073
cagccaaucacaucaggcu

SEQ ID NO: 657815 - RNA, 21 nt, Escherichia coli CFT073
cagccaaucauaaacgccuga

SEQ ID NO: 657816 - RNA, 17 nt, Escherichia coli CFT073
cagccaaugcaggcauc

SEQ ID NO: 657817 - RNA, 21 nt, Escherichia coli CFT073
cagccaauugauuuaacgcag

SEQ ID NO: 657818 - RNA, 20 nt, Escherichia coli CFT073
cagccacaccacgcgccugc

SEQ ID NO: 657819 - RNA, 20 nt, Escherichia coli CFT073
cagccaaagcgacacaauca

SEQ ID NO: 657820 - RNA, 15 nt, Escherichia coli CFT073
cagccaaauccagcg

SEQ ID NO: 657821 - RNA, 15 nt, Escherichia coli CFT073
cagccaaccacauga

SEQ ID NO: 657822 - RNA, 12 nt, Escherichia coli CFT073
cagcauuagcau

SEQ ID NO: 657823 - RNA, 18 nt, Escherichia coli CFT073
cagcauucccgccaccau

SEQ ID NO: 657824 - RNA, 16 nt, Escherichia coli CFT073
cagcauugcgccagcg

SEQ ID NO: 657825 - RNA, 23 nt, Escherichia coli CFT073
cagcauuguauauugcagcaacg

SEQ ID NO: 657826 - RNA, 12 nt, Escherichia coli CFT073
cagcauuucuuc

SEQ ID NO: 657827 - RNA, 14 nt, Escherichia coli CFT073
cagcauuucuucca

SEQ ID NO: 657828 - RNA, 20 nt, Escherichia coli CFT073
cagcaugucuugccucccug

SEQ ID NO: 657829 - RNA, 18 nt, Escherichia coli CFT073
cagcauggucgcagcggc

SEQ ID NO: 657830 - RNA, 20 nt, Escherichia coli CFT073
cagcaugugguuaccaucaa

SEQ ID NO: 657831 - RNA, 17 nt, Escherichia coli CFT073
cagcaucaggaugauac

SEQ ID NO: 657832 - RNA, 18 nt, Escherichia coli CFT073
cagcaucauaaaugggcu

SEQ ID NO: 657833 - RNA, 15 nt, Escherichia coli CFT073
cagcaucacgcccgc

SEQ ID NO: 657834 - RNA, 12 nt, Escherichia coli CFT073
cagcaucaccac

SEQ ID NO: 657835 - RNA, 22 nt, Escherichia coli CFT073
cagcaguuuuuccccugccaga

SEQ ID NO: 657836 - RNA, 21 nt, Escherichia coli CFT073
cagcauaauugccguuuccug

SEQ ID NO: 657837 - RNA, 17 nt, Escherichia coli CFT073
cagcauaaucaccauca

SEQ ID NO: 657838 - RNA, 19 nt, Escherichia coli CFT073
cagcauaaucaccaucagc

SEQ ID NO: 657839 - RNA, 18 nt, Escherichia coli CFT073
cagcauaaucaccaguac

SEQ ID NO: 657840 - RNA, 16 nt, Escherichia coli CFT073
cagcauaaucaccauc

SEQ ID NO: 657841 - RNA, 18 nt, Escherichia coli CFT073
cagcauaccuuccagcgc

SEQ ID NO: 657842 - RNA, 14 nt, Escherichia coli CFT073
cagcauacgccaca

SEQ ID NO: 657843 - RNA, 15 nt, Escherichia coli CFT073
cagcauaccuucaca

SEQ ID NO: 657844 - RNA, 13 nt, Escherichia coli CFT073
cagcauacuccag

SEQ ID NO: 657845 - RNA, 17 nt, Escherichia coli CFT073
cagcauaguacgggcaa

SEQ ID NO: 657846 - RNA, 14 nt, Escherichia coli CFT073
cagcaugccgccaa

SEQ ID NO: 657847 - RNA, 24 nt, Escherichia coli CFT073
cagcaugccgccaagcauuacgaa

SEQ ID NO: 657848 - RNA, 19 nt, Escherichia coli CFT073
cagcaucgucaucagcucc

SEQ ID NO: 657849 - RNA, 17 nt, Escherichia coli CFT073
cagcaucgucaucauuc

SEQ ID NO: 657850 - RNA, 22 nt, Escherichia coli CFT073
cagcaucucgcgcucuucuuca

SEQ ID NO: 657851 - RNA, 23 nt, Escherichia coli CFT073
cagcaucucgcgcucuucuucac

SEQ ID NO: 657852 - RNA, 14 nt, Escherichia coli CFT073
cagcaucgaccagg

SEQ ID NO: 657853 - RNA, 17 nt, Escherichia coli CFT073
cagcaucgcuuugugcu

SEQ ID NO: 657854 - RNA, 21 nt, Escherichia coli CFT073
cagcaucgcuuugugcucuuc

SEQ ID NO: 657855 - RNA, 22 nt, Escherichia coli CFT073
cagcaucgcuuugugcucuucc

SEQ ID NO: 657856 - RNA, 18 nt, Escherichia coli CFT073
cagcaucggcaacgccag

SEQ ID NO: 657857 - RNA, 21 nt, Escherichia coli CFT073
cagcaggaaucccaucagacg

SEQ ID NO: 657858 - RNA, 23 nt, Escherichia coli CFT073
cagcaggaccuuauccccggucu

SEQ ID NO: 657859 - RNA, 16 nt, Escherichia coli CFT073
cagcaggaccauacug

SEQ ID NO: 657860 - RNA, 16 nt, Escherichia coli CFT073
cagcagcgucagcacu

SEQ ID NO: 657861 - RNA, 16 nt, Escherichia coli CFT073
cagcagcggagaaaug

SEQ ID NO: 657862 - RNA, 12 nt, Escherichia coli CFT073
cagcagccagag

SEQ ID NO: 657863 - RNA, 23 nt, Escherichia coli CFT073
cagcagcagacagccuaccagac

SEQ ID NO: 657864 - RNA, 21 nt, Escherichia coli CFT073
cagcagcgccaggcacaccag

SEQ ID NO: 657865 - RNA, 22 nt, Escherichia coli CFT073
cagcagcccugccggaacgugc

SEQ ID NO: 657866 - RNA, 16 nt, Escherichia coli CFT073
cagcagcgaauaauuc

SEQ ID NO: 657867 - RNA, 16 nt, Escherichia coli CFT073
cagcaguaaaccaccc

SEQ ID NO: 657868 - RNA, 18 nt, Escherichia coli CFT073
cagcaguaaaccacccac

SEQ ID NO: 657869 - RNA, 14 nt, Escherichia coli CFT073
cagcaguacgccau

SEQ ID NO: 657870 - RNA, 14 nt, Escherichia coli CFT073
cagcaguucugcca

SEQ ID NO: 657871 - RNA, 16 nt, Escherichia coli CFT073
cagcaggcgagcugcc

SEQ ID NO: 657872 - RNA, 19 nt, Escherichia coli CFT073
cagcagggcaaacagcacg

SEQ ID NO: 657873 - RNA, 22 nt, Escherichia coli CFT073
cagcagauaaaagaccacaauc

SEQ ID NO: 657874 - RNA, 16 nt, Escherichia coli CFT073
cagcagauaccaaccc

SEQ ID NO: 657875 - RNA, 19 nt, Escherichia coli CFT073
cagcagagauacaggccac

SEQ ID NO: 657876 - RNA, 18 nt, Escherichia coli CFT073
cagcagauccauugcgaa

SEQ ID NO: 657877 - RNA, 14 nt, Escherichia coli CFT073
cagcagauggcagc

SEQ ID NO: 657878 - RNA, 17 nt, Escherichia coli CFT073
cagcagauuaaccgcuu

SEQ ID NO: 657879 - RNA, 18 nt, Escherichia coli CFT073
cagcagauugcgaauaug

SEQ ID NO: 657880 - RNA, 14 nt, Escherichia coli CFT073
cagcagcaaccauu

SEQ ID NO: 657881 - RNA, 12 nt, Escherichia coli CFT073
cagcagcaauau

SEQ ID NO: 657882 - RNA, 21 nt, Escherichia coli CFT073
cagcagaaucauccaggcuuu

SEQ ID NO: 657883 - RNA, 19 nt, Escherichia coli CFT073
cagcagaaugacaucaucg

SEQ ID NO: 657884 - RNA, 19 nt, Escherichia coli CFT073
cagcagaagggccuuuggc

SEQ ID NO: 657885 - RNA, 20 nt, Escherichia coli CFT073
cagcagacagccuaccagac

SEQ ID NO: 657886 - RNA, 23 nt, Escherichia coli CFT073
cagcacugauuuuuuccaacagg

SEQ ID NO: 657887 - RNA, 15 nt, Escherichia coli CFT073
cagcacugcuuaaau

SEQ ID NO: 657888 - RNA, 19 nt, Escherichia coli CFT073
cagcacuuaaccacaaacg

SEQ ID NO: 657889 - RNA, 15 nt, Escherichia coli CFT073
cagcacuucauagug

SEQ ID NO: 657890 - RNA, 21 nt, Escherichia coli CFT073
cagcacuucauagugcgcggu

SEQ ID NO: 657891 - RNA, 20 nt, Escherichia coli CFT073
cagcacuucacccaucgcca

SEQ ID NO: 657892 - RNA, 17 nt, Escherichia coli CFT073
cagcacuucgcugacau

SEQ ID NO: 657893 - RNA, 15 nt, Escherichia coli CFT073
cagcacguugaacug

SEQ ID NO: 657894 - RNA, 21 nt, Escherichia coli CFT073
cagcacuacugccagauucuc

SEQ ID NO: 657895 - RNA, 16 nt, Escherichia coli CFT073
cagcacucacgccagg

SEQ ID NO: 657896 - RNA, 13 nt, Escherichia coli CFT073
cagcacggagaga

SEQ ID NO: 657897 - RNA, 17 nt, Escherichia coli CFT073
cagcacgcaggcaucuu

SEQ ID NO: 657898 - RNA, 15 nt, Escherichia coli CFT073
cagcaccgggccaaa

SEQ ID NO: 657899 - RNA, 17 nt, Escherichia coli CFT073
cagcaccgggccaaaaa

SEQ ID NO: 657900 - RNA, 18 nt, Escherichia coli CFT073
cagcaccgucuggcagau

SEQ ID NO: 657901 - RNA, 18 nt, Escherichia coli CFT073
cagcaccgugcauuuuuc

SEQ ID NO: 657902 - RNA, 17 nt, Escherichia coli CFT073
cagcaccccgacagcau

SEQ ID NO: 657903 - RNA, 19 nt, Escherichia coli CFT073
cagcacccgaugcggcagu

SEQ ID NO: 657904 - RNA, 14 nt, Escherichia coli CFT073
cagcaccgcuggcu

SEQ ID NO: 657905 - RNA, 19 nt, Escherichia coli CFT073
cagcaccgcuuuaaaauua

SEQ ID NO: 657906 - RNA, 13 nt, Escherichia coli CFT073
cagcaccgcccgu

SEQ ID NO: 657907 - RNA, 17 nt, Escherichia coli CFT073
cagcaccgcgacaauca

SEQ ID NO: 657908 - RNA, 13 nt, Escherichia coli CFT073
cauugacaguaaa

SEQ ID NO: 657909 - RNA, 17 nt, Escherichia coli CFT073
cauugacaguaaagaua

SEQ ID NO: 657910 - RNA, 19 nt, Escherichia coli CFT073
cauugaauuaaaaugugua

SEQ ID NO: 657911 - RNA, 23 nt, Escherichia coli CFT073
cauugacagaccguugcucagaa

SEQ ID NO: 657912 - RNA, 23 nt, Escherichia coli CFT073
cauugaagcgccguccaguaaug

SEQ ID NO: 657913 - RNA, 18 nt, Escherichia coli CFT073
cauugaaggcaauugcau

SEQ ID NO: 657914 - RNA, 20 nt, Escherichia coli CFT073
cauugaacuuguagcuuuca

SEQ ID NO: 657915 - RNA, 16 nt, Escherichia coli CFT073
cauucugucucauggc

SEQ ID NO: 657916 - RNA, 19 nt, Escherichia coli CFT073
cauugacgguuuccacuuc

SEQ ID NO: 657917 - RNA, 18 nt, Escherichia coli CFT073
cauugaguagccucugcg

SEQ ID NO: 657918 - RNA, 21 nt, Escherichia coli CFT073
cauugaguuguggggcaugau

SEQ ID NO: 657919 - RNA, 18 nt, Escherichia coli CFT073
cauucucgcuacccauga

SEQ ID NO: 657920 - RNA, 19 nt, Escherichia coli CFT073
cauuaucuucuuucucggc

SEQ ID NO: 657921 - RNA, 18 nt, Escherichia coli CFT073
cauuaugagugaugugcu

SEQ ID NO: 657922 - RNA, 21 nt, Escherichia coli CFT073
cauuauccucaaugaaucgca

SEQ ID NO: 657923 - RNA, 15 nt, Escherichia coli CFT073
cauuauccuuuaucu

SEQ ID NO: 657924 - RNA, 19 nt, Escherichia coli CFT073
cauuauccuuuaucugccc

SEQ ID NO: 657925 - RNA, 13 nt, Escherichia coli CFT073
cauuaucgauccu

SEQ ID NO: 657926 - RNA, 22 nt, Escherichia coli CFT073
cauugucugaacguucugcugu

SEQ ID NO: 657927 - RNA, 15 nt, Escherichia coli CFT073
cauuguggaaaggcc

SEQ ID NO: 657928 - RNA, 13 nt, Escherichia coli CFT073
cauuguuccacuc

SEQ ID NO: 657929 - RNA, 15 nt, Escherichia coli CFT073
cauuguucugcaaau

SEQ ID NO: 657930 - RNA, 14 nt, Escherichia coli CFT073
cauugcaacguggu

SEQ ID NO: 657931 - RNA, 15 nt, Escherichia coli CFT073
cauugccgccucugc

SEQ ID NO: 657932 - RNA, 12 nt, Escherichia coli CFT073
cauugaugaacg

SEQ ID NO: 657933 - RNA, 18 nt, Escherichia coli CFT073
cauugaugagaacaucau

SEQ ID NO: 657934 - RNA, 23 nt, Escherichia coli CFT073
cauugaucgauaagccagcaacc

SEQ ID NO: 657935 - RNA, 23 nt, Escherichia coli CFT073
cauugccugaucgcgcaaacagu

SEQ ID NO: 657936 - RNA, 23 nt, Escherichia coli CFT073
cauugccugaugcgacgcugcgc

SEQ ID NO: 657937 - RNA, 17 nt, Escherichia coli CFT073
cauugcgcauucuacuu

SEQ ID NO: 657938 - RNA, 21 nt, Escherichia coli CFT073
cauugccugaucgcgcaaaca

SEQ ID NO: 657939 - RNA, 17 nt, Escherichia coli CFT073
cauugccggaagcgcca

SEQ ID NO: 657940 - RNA, 21 nt, Escherichia coli CFT073
cauugccgggcgcaucagauc

SEQ ID NO: 657941 - RNA, 20 nt, Escherichia coli CFT073
cauugcuggugauugcaaag

SEQ ID NO: 657942 - RNA, 15 nt, Escherichia coli CFT073
cauugcuuuaagaua

SEQ ID NO: 657943 - RNA, 15 nt, Escherichia coli CFT073
cauuuuuaauaacuu

SEQ ID NO: 657944 - RNA, 22 nt, Escherichia coli CFT073
cauuuugggcgggaucuccaca

SEQ ID NO: 657945 - RNA, 23 nt, Escherichia coli CFT073
cauuuugggcgggaucuccacaa

SEQ ID NO: 657946 - RNA, 19 nt, Escherichia coli CFT073
cauuuuguaggccugauaa

SEQ ID NO: 657947 - RNA, 21 nt, Escherichia coli CFT073
cauuuuguaggccugauaaga

SEQ ID NO: 657948 - RNA, 14 nt, Escherichia coli CFT073
cauuuugauuaaua

SEQ ID NO: 657949 - RNA, 18 nt, Escherichia coli CFT073
cauuuugcugcuuccauu

SEQ ID NO: 657950 - RNA, 22 nt, Escherichia coli CFT073
cauuuuuuaucacuucuucuug

SEQ ID NO: 657951 - RNA, 23 nt, Escherichia coli CFT073
cauuuuugccaucaaucacuuug

SEQ ID NO: 657952 - RNA, 16 nt, Escherichia coli CFT073
cauuuuucagacguuc

SEQ ID NO: 657953 - RNA, 15 nt, Escherichia coli CFT073
cauuuuuaguuuugu

SEQ ID NO: 657954 - RNA, 16 nt, Escherichia coli CFT073
cauuuuuaguuuugug

SEQ ID NO: 657955 - RNA, 15 nt, Escherichia coli CFT073
cauuuuuauuaaaua

SEQ ID NO: 657956 - RNA, 22 nt, Escherichia coli CFT073
cauuuucagccagggauaagcc

SEQ ID NO: 657957 - RNA, 19 nt, Escherichia coli CFT073
cauuuucagcuuucgcauc

SEQ ID NO: 657958 - RNA, 12 nt, Escherichia coli CFT073
cauuuucuuccg

SEQ ID NO: 657959 - RNA, 15 nt, Escherichia coli CFT073
cauuuucuucagcag

SEQ ID NO: 657960 - RNA, 15 nt, Escherichia coli CFT073
cauuuuauccucuuc

SEQ ID NO: 657961 - RNA, 22 nt, Escherichia coli CFT073
cauuuggauggaaaauuuuuuc

SEQ ID NO: 657962 - RNA, 20 nt, Escherichia coli CFT073
cauuuggauugcuauuuaac

SEQ ID NO: 657963 - RNA, 19 nt, Escherichia coli CFT073
cauuuggcggggauuuuuu

SEQ ID NO: 657964 - RNA, 22 nt, Escherichia coli CFT073
cauuuggucggagauuugaaug

SEQ ID NO: 657965 - RNA, 21 nt, Escherichia coli CFT073
cauuugcaccaggccgcgcag

SEQ ID NO: 657966 - RNA, 17 nt, Escherichia coli CFT073
cauuuguugguacaccu

SEQ ID NO: 657967 - RNA, 16 nt, Escherichia coli CFT073
cauuugugacauuaac

SEQ ID NO: 657968 - RNA, 14 nt, Escherichia coli CFT073
cauuugucggaugc

SEQ ID NO: 657969 - RNA, 15 nt, Escherichia coli CFT073
cauuuaaugacaaaa

SEQ ID NO: 657970 - RNA, 13 nt, Escherichia coli CFT073
cauuuaagccacu

SEQ ID NO: 657971 - RNA, 23 nt, Escherichia coli CFT073
cauuaaaaugaauaacuuccugu

SEQ ID NO: 657972 - RNA, 19 nt, Escherichia coli CFT073
cauuaaacucaccuugugu

SEQ ID NO: 657973 - RNA, 14 nt, Escherichia coli CFT073
cauuaaaccagugc

SEQ ID NO: 657974 - RNA, 20 nt, Escherichia coli CFT073
cauguugcagggcauuccau

SEQ ID NO: 657975 - RNA, 21 nt, Escherichia coli CFT073
cauguuuuuuaaguucagcau

SEQ ID NO: 657976 - RNA, 12 nt, Escherichia coli CFT073
cauguuuuccuu

SEQ ID NO: 657977 - RNA, 21 nt, Escherichia coli CFT073
cauggucgcagcggcuucccc

SEQ ID NO: 657978 - RNA, 14 nt, Escherichia coli CFT073
caugguauaaggag

SEQ ID NO: 657979 - RNA, 23 nt, Escherichia coli CFT073
caugguggaaaucgaacuucccg

SEQ ID NO: 657980 - RNA, 17 nt, Escherichia coli CFT073
caugugcccccugcaau

SEQ ID NO: 657981 - RNA, 17 nt, Escherichia coli CFT073
caugugcgacgggccaa

SEQ ID NO: 657982 - RNA, 15 nt, Escherichia coli CFT073
cauguuccucaucgu

SEQ ID NO: 657983 - RNA, 18 nt, Escherichia coli CFT073
cauguuccugccagucuu

SEQ ID NO: 657984 - RNA, 17 nt, Escherichia coli CFT073
cauuaaggucauaucuu

SEQ ID NO: 657985 - RNA, 24 nt, Escherichia coli CFT073
cauuaaguaacaauaucuaaaaug

SEQ ID NO: 657986 - RNA, 17 nt, Escherichia coli CFT073
cauuaauacaucaacuu

SEQ ID NO: 657987 - RNA, 23 nt, Escherichia coli CFT073
cauuaaugccguuauacaucgcu

SEQ ID NO: 657988 - RNA, 20 nt, Escherichia coli CFT073
cauuaacccgagaucuuuaa

SEQ ID NO: 657989 - RNA, 12 nt, Escherichia coli CFT073
cauuaacaguag

SEQ ID NO: 657990 - RNA, 16 nt, Escherichia coli CFT073
cauuaaauuuaugugc

SEQ ID NO: 657991 - RNA, 13 nt, Escherichia coli CFT073
cauuaacaaccga

SEQ ID NO: 657992 - RNA, 15 nt, Escherichia coli CFT073
cauuaacaaccgaau

SEQ ID NO: 657993 - RNA, 20 nt, Escherichia coli CFT073
cauuaaauccgccaaaugga

SEQ ID NO: 657994 - RNA, 19 nt, Escherichia coli CFT073
cauuaaaugcguagguuaa

SEQ ID NO: 657995 - RNA, 13 nt, Escherichia coli CFT073
cauuaagaaucac

SEQ ID NO: 657996 - RNA, 23 nt, Escherichia coli CFT073
cauuaacgaaacccgaaccacgc

SEQ ID NO: 657997 - RNA, 16 nt, Escherichia coli CFT073
cauuaacucacuggcg

SEQ ID NO: 657998 - RNA, 18 nt, Escherichia coli CFT073
cauuaacgcgaaauaauc

SEQ ID NO: 657999 - RNA, 20 nt, Escherichia coli CFT073
cauuaacgcgaaauaaucaa

SEQ ID NO: 658000 - RNA, 14 nt, Escherichia coli CFT073
cauuaagcgccgga

SEQ ID NO: 658001 - RNA, 20 nt, Escherichia coli CFT073
cauuaccgaagggaucuucc

SEQ ID NO: 658002 - RNA, 20 nt, Escherichia coli CFT073
cauuaccgcauuaucaaggc

SEQ ID NO: 658003 - RNA, 12 nt, Escherichia coli CFT073
cauuagccaggc

SEQ ID NO: 658004 - RNA, 20 nt, Escherichia coli CFT073
cauuagcaaauuauccccca

SEQ ID NO: 658005 - RNA, 17 nt, Escherichia coli CFT073
cauuacaagaaucaugc

SEQ ID NO: 658006 - RNA, 13 nt, Escherichia coli CFT073
cauuacaaaauac

SEQ ID NO: 658007 - RNA, 15 nt, Escherichia coli CFT073
cauuacaaaauacaa

SEQ ID NO: 658008 - RNA, 18 nt, Escherichia coli CFT073
cauuaauuuucaauugau

SEQ ID NO: 658009 - RNA, 21 nt, Escherichia coli CFT073
caugcgcaccuuuaccacucc

SEQ ID NO: 658010 - RNA, 19 nt, Escherichia coli CFT073
caugcgauuacguucgacu

SEQ ID NO: 658011 - RNA, 16 nt, Escherichia coli CFT073
caugccgucaauccag

SEQ ID NO: 658012 - RNA, 19 nt, Escherichia coli CFT073
caucuuuugcgauauauuu

SEQ ID NO: 658013 - RNA, 12 nt, Escherichia coli CFT073
caucuuuuucaa

SEQ ID NO: 658014 - RNA, 21 nt, Escherichia coli CFT073
caugcacgcccgcagcggaau

SEQ ID NO: 658015 - RNA, 16 nt, Escherichia coli CFT073
cauggaauagaaucac

SEQ ID NO: 658016 - RNA, 20 nt, Escherichia coli CFT073
caugcggugauuuugccugu

SEQ ID NO: 658017 - RNA, 21 nt, Escherichia coli CFT073
caugcguuaucgccauccaga

SEQ ID NO: 658018 - RNA, 15 nt, Escherichia coli CFT073
caugcgguaacagaa

SEQ ID NO: 658019 - RNA, 22 nt, Escherichia coli CFT073
caugcgcugcgcuuaucaggcc

SEQ ID NO: 658020 - RNA, 13 nt, Escherichia coli CFT073
cauggcagccagg

SEQ ID NO: 658021 - RNA, 20 nt, Escherichia coli CFT073
cauggcuugcgccauggcau

SEQ ID NO: 658022 - RNA, 20 nt, Escherichia coli CFT073
caugggagaacgaugcugcu

SEQ ID NO: 658023 - RNA, 16 nt, Escherichia coli CFT073
caugggcauccacagu

SEQ ID NO: 658024 - RNA, 15 nt, Escherichia coli CFT073
caugguaaaaccgac

SEQ ID NO: 658025 - RNA, 20 nt, Escherichia coli CFT073
caugguaaaaccgacuuaaa

SEQ ID NO: 658026 - RNA, 23 nt, Escherichia coli CFT073
caucuucuugcagcuuaaucaua

SEQ ID NO: 658027 - RNA, 16 nt, Escherichia coli CFT073
caucuucuccacgcca

SEQ ID NO: 658028 - RNA, 22 nt, Escherichia coli CFT073
caucuucugaaucagaucaagu

SEQ ID NO: 658029 - RNA, 17 nt, Escherichia coli CFT073
caucuucggcaauacuu

SEQ ID NO: 658030 - RNA, 13 nt, Escherichia coli CFT073
caucuucgucaaa

SEQ ID NO: 658031 - RNA, 15 nt, Escherichia coli CFT073
caucuucgucaaaga

SEQ ID NO: 658032 - RNA, 13 nt, Escherichia coli CFT073
caucuuccgggca

SEQ ID NO: 658033 - RNA, 13 nt, Escherichia coli CFT073
caucuuccagcug

SEQ ID NO: 658034 - RNA, 19 nt, Escherichia coli CFT073
caucuuguucauagugccu

SEQ ID NO: 658035 - RNA, 13 nt, Escherichia coli CFT073
caucuguuuucaa

SEQ ID NO: 658036 - RNA, 18 nt, Escherichia coli CFT073
caucuucacuguccgcca

SEQ ID NO: 658037 - RNA, 16 nt, Escherichia coli CFT073
caucuucauuaaaugc

SEQ ID NO: 658038 - RNA, 23 nt, Escherichia coli CFT073
caucuuaauagcugccagccccu

SEQ ID NO: 658039 - RNA, 19 nt, Escherichia coli CFT073
caucuggcgauacggugca

SEQ ID NO: 658040 - RNA, 13 nt, Escherichia coli CFT073
caucugcuuuuug

SEQ ID NO: 658041 - RNA, 23 nt, Escherichia coli CFT073
caucuggcaccgguacacaaccg

SEQ ID NO: 658042 - RNA, 15 nt, Escherichia coli CFT073
caucuggcauaaaca

SEQ ID NO: 658043 - RNA, 12 nt, Escherichia coli CFT073
caucuguuaucu

SEQ ID NO: 658044 - RNA, 19 nt, Escherichia coli CFT073
caucuggugccagcgccag

SEQ ID NO: 658045 - RNA, 20 nt, Escherichia coli CFT073
caucugccgguuccagcuuc

SEQ ID NO: 658046 - RNA, 16 nt, Escherichia coli CFT073
caucugccugauccug

SEQ ID NO: 658047 - RNA, 15 nt, Escherichia coli CFT073
caucugcgacagcca

SEQ ID NO: 658048 - RNA, 22 nt, Escherichia coli CFT073
caucugccaccguguauuucug

SEQ ID NO: 658049 - RNA, 16 nt, Escherichia coli CFT073
caucugcaaugcgaau

SEQ ID NO: 658050 - RNA, 16 nt, Escherichia coli CFT073
caucugauucuuccca

SEQ ID NO: 658051 - RNA, 21 nt, Escherichia coli CFT073
caucucgcgcucuucuucacg

SEQ ID NO: 658052 - RNA, 13 nt, Escherichia coli CFT073
caucucuucuucc

SEQ ID NO: 658053 - RNA, 14 nt, Escherichia coli CFT073
caucucuucuuccg

SEQ ID NO: 658054 - RNA, 22 nt, Escherichia coli CFT073
caucucuucuuccggcaccauu

SEQ ID NO: 658055 - RNA, 17 nt, Escherichia coli CFT073
caucuacgcucucuuca

SEQ ID NO: 658056 - RNA, 19 nt, Escherichia coli CFT073
caucggugaggaucaccag

SEQ ID NO: 658057 - RNA, 16 nt, Escherichia coli CFT073
caucuauagcacccgc

SEQ ID NO: 658058 - RNA, 15 nt, Escherichia coli CFT073
caucgguauaaccaa

SEQ ID NO: 658059 - RNA, 22 nt, Escherichia coli CFT073
caucgguaucaucccagccaau

SEQ ID NO: 658060 - RNA, 22 nt, Escherichia coli CFT073
caucggggcugaugaaguugaa

SEQ ID NO: 658061 - RNA, 23 nt, Escherichia coli CFT073
caucggcuuuggcaaauggcgcu

SEQ ID NO: 658062 - RNA, 18 nt, Escherichia coli CFT073
caucgggauagucaaaua

SEQ ID NO: 658063 - RNA, 20 nt, Escherichia coli CFT073
cauccgccccggcuucaaaa

SEQ ID NO: 658064 - RNA, 14 nt, Escherichia coli CFT073
cauccgccagcagc

SEQ ID NO: 658065 - RNA, 15 nt, Escherichia coli CFT073
cauccgccagcagcu

SEQ ID NO: 658066 - RNA, 17 nt, Escherichia coli CFT073
cauccggcgucaucuua

SEQ ID NO: 658067 - RNA, 17 nt, Escherichia coli CFT073
cauccggcucgcaucaa

SEQ ID NO: 658068 - RNA, 23 nt, Escherichia coli CFT073
cauccggcuuuuuuacaucauca

SEQ ID NO: 658069 - RNA, 17 nt, Escherichia coli CFT073
cauccgggcaugaagaa

SEQ ID NO: 658070 - RNA, 22 nt, Escherichia coli CFT073
cauccgguuaucgccugcgcca

SEQ ID NO: 658071 - RNA, 16 nt, Escherichia coli CFT073
cauccgguuucaucag

SEQ ID NO: 658072 - RNA, 23 nt, Escherichia coli CFT073
cauccgugaauaaugcaaaaagg

SEQ ID NO: 658073 - RNA, 16 nt, Escherichia coli CFT073
cauccuaaaggcaaaa

SEQ ID NO: 658074 - RNA, 15 nt, Escherichia coli CFT073
cauccugaucgccau

SEQ ID NO: 658075 - RNA, 19 nt, Escherichia coli CFT073
cauccugaauauccuguuc

SEQ ID NO: 658076 - RNA, 22 nt, Escherichia coli CFT073
cauccuuaugcagcggaauaau

SEQ ID NO: 658077 - RNA, 23 nt, Escherichia coli CFT073
caucgaauguugcguucaucagu

SEQ ID NO: 658078 - RNA, 12 nt, Escherichia coli CFT073
caucgacauaau

SEQ ID NO: 658079 - RNA, 21 nt, Escherichia coli CFT073
caucgaaaaugccacugcgcc

SEQ ID NO: 658080 - RNA, 16 nt, Escherichia coli CFT073
caucgccagcucaagg

SEQ ID NO: 658081 - RNA, 15 nt, Escherichia coli CFT073
caucgccagcagcca

SEQ ID NO: 658082 - RNA, 18 nt, Escherichia coli CFT073
caucgcccgcaacaaacu

SEQ ID NO: 658083 - RNA, 21 nt, Escherichia coli CFT073
caucgccauauuggggaugac

SEQ ID NO: 658084 - RNA, 16 nt, Escherichia coli CFT073
caucgccaugaugagc

SEQ ID NO: 658085 - RNA, 12 nt, Escherichia coli CFT073
caucgagcagca

SEQ ID NO: 658086 - RNA, 16 nt, Escherichia coli CFT073
caucgacgucagcaga

SEQ ID NO: 658087 - RNA, 15 nt, Escherichia coli CFT073
caucgacucaagcgu

SEQ ID NO: 658088 - RNA, 20 nt, Escherichia coli CFT073
caucgacauugaccagugca

SEQ ID NO: 658089 - RNA, 17 nt, Escherichia coli CFT073
caucgccuucaucugca

SEQ ID NO: 658090 - RNA, 19 nt, Escherichia coli CFT073
caucgccugaucgcgcagu

SEQ ID NO: 658091 - RNA, 14 nt, Escherichia coli CFT073
caucgccuucuuga

SEQ ID NO: 658092 - RNA, 17 nt, Escherichia coli CFT073
caucgcgcccgccgcca

SEQ ID NO: 658093 - RNA, 18 nt, Escherichia coli CFT073
caucgcgcccgccgccau

SEQ ID NO: 658094 - RNA, 14 nt, Escherichia coli CFT073
caucggcgcuggcg

SEQ ID NO: 658095 - RNA, 15 nt, Escherichia coli CFT073
caucgcuacaccaau

SEQ ID NO: 658096 - RNA, 18 nt, Escherichia coli CFT073
caucgcuagauauauauu

SEQ ID NO: 658097 - RNA, 18 nt, Escherichia coli CFT073
caucgcgucaucgucaca

SEQ ID NO: 658098 - RNA, 14 nt, Escherichia coli CFT073
caucgcuacaccaa

SEQ ID NO: 658099 - RNA, 16 nt, Escherichia coli CFT073
caucgcggucagcugc

SEQ ID NO: 658100 - RNA, 21 nt, Escherichia coli CFT073
caucagcgauucauugaguaa

SEQ ID NO: 658101 - RNA, 19 nt, Escherichia coli CFT073
caucacgcucgcaggcggc

SEQ ID NO: 658102 - RNA, 19 nt, Escherichia coli CFT073
caucagccacuucaaccag

SEQ ID NO: 658103 - RNA, 12 nt, Escherichia coli CFT073
caucagccaggg

SEQ ID NO: 658104 - RNA, 13 nt, Escherichia coli CFT073
caucaccucuuca

SEQ ID NO: 658105 - RNA, 14 nt, Escherichia coli CFT073
caucaccucuucac

SEQ ID NO: 658106 - RNA, 14 nt, Escherichia coli CFT073
caucaccugacagc

SEQ ID NO: 658107 - RNA, 17 nt, Escherichia coli CFT073
caucaccugacagcaga

SEQ ID NO: 658108 - RNA, 17 nt, Escherichia coli CFT073
caucaccgccaggccua

SEQ ID NO: 658109 - RNA, 21 nt, Escherichia coli CFT073
caucacgaaaaucaucugccg

SEQ ID NO: 658110 - RNA, 13 nt, Escherichia coli CFT073
caucacgaaaucc

SEQ ID NO: 658111 - RNA, 17 nt, Escherichia coli CFT073
caucacgacagcaccac

SEQ ID NO: 658112 - RNA, 18 nt, Escherichia coli CFT073
caucacgacagcaccacu

SEQ ID NO: 658113 - RNA, 20 nt, Escherichia coli CFT073
caucacgaccgcuucaggaa

SEQ ID NO: 658114 - RNA, 15 nt, Escherichia coli CFT073
caucacgcacugcaa

SEQ ID NO: 658115 - RNA, 20 nt, Escherichia coli CFT073
caucacgcacugcaauauua

SEQ ID NO: 658116 - RNA, 20 nt, Escherichia coli CFT073
caucacgcagcgugaagcua

SEQ ID NO: 658117 - RNA, 15 nt, Escherichia coli CFT073
caucacgcccgcuuu

SEQ ID NO: 658118 - RNA, 13 nt, Escherichia coli CFT073
caucacgccgcug

SEQ ID NO: 658119 - RNA, 15 nt, Escherichia coli CFT073
caucaguuucauuuc

SEQ ID NO: 658120 - RNA, 20 nt, Escherichia coli CFT073
caucaguguccagaugcugu

SEQ ID NO: 658121 - RNA, 14 nt, Escherichia coli CFT073
caucagguauuuau

SEQ ID NO: 658122 - RNA, 15 nt, Escherichia coli CFT073
caucaguagcauccc

SEQ ID NO: 658123 - RNA, 17 nt, Escherichia coli CFT073
caucaguagcauccccg

SEQ ID NO: 658124 - RNA, 20 nt, Escherichia coli CFT073
caucagugaucagccacagu

SEQ ID NO: 658125 - RNA, 19 nt, Escherichia coli CFT073
caucaggcagaacaccggc

SEQ ID NO: 658126 - RNA, 21 nt, Escherichia coli CFT073
caucaggcaucgugcaccaau

SEQ ID NO: 658127 - RNA, 22 nt, Escherichia coli CFT073
caucaggcaucgugcaccaauu

SEQ ID NO: 658128 - RNA, 21 nt, Escherichia coli CFT073
caucaggcguugauugccgga

SEQ ID NO: 658129 - RNA, 16 nt, Escherichia coli CFT073
caucaucgccccgcuc

SEQ ID NO: 658130 - RNA, 13 nt, Escherichia coli CFT073
caucaucgcuuuc

SEQ ID NO: 658131 - RNA, 15 nt, Escherichia coli CFT073
caucaucgcagauuu

SEQ ID NO: 658132 - RNA, 16 nt, Escherichia coli CFT073
caucaucgugaccaaa

SEQ ID NO: 658133 - RNA, 16 nt, Escherichia coli CFT073
caucauccucuucagc

SEQ ID NO: 658134 - RNA, 19 nt, Escherichia coli CFT073
caucauccccguaucuuca

SEQ ID NO: 658135 - RNA, 14 nt, Escherichia coli CFT073
caucauccgcgcaa

SEQ ID NO: 658136 - RNA, 16 nt, Escherichia coli CFT073
caucaucacuuuuucc

SEQ ID NO: 658137 - RNA, 12 nt, Escherichia coli CFT073
caucaucagaaa

SEQ ID NO: 658138 - RNA, 18 nt, Escherichia coli CFT073
caucauauggaagaaacg

SEQ ID NO: 658139 - RNA, 14 nt, Escherichia coli CFT073
caucauaauaauug

SEQ ID NO: 658140 - RNA, 16 nt, Escherichia coli CFT073
caucauacuggcucug

SEQ ID NO: 658141 - RNA, 12 nt, Escherichia coli CFT073
caucauuuugcu

SEQ ID NO: 658142 - RNA, 13 nt, Escherichia coli CFT073
caucauuuugcua

SEQ ID NO: 658143 - RNA, 16 nt, Escherichia coli CFT073
caucauugcgccgaac

SEQ ID NO: 658144 - RNA, 23 nt, Escherichia coli CFT073
caucauugcgccgaacaacagug

SEQ ID NO: 658145 - RNA, 18 nt, Escherichia coli CFT073
caucauuucccacgcggc

SEQ ID NO: 658146 - RNA, 14 nt, Escherichia coli CFT073
cauccacgaccaga

SEQ ID NO: 658147 - RNA, 12 nt, Escherichia coli CFT073
cauccacauucg

SEQ ID NO: 658148 - RNA, 16 nt, Escherichia coli CFT073
cauccacauucgcaac

SEQ ID NO: 658149 - RNA, 15 nt, Escherichia coli CFT073
cauccaccagcgccu

SEQ ID NO: 658150 - RNA, 23 nt, Escherichia coli CFT073
caucaugaucugugugguuuugu

SEQ ID NO: 658151 - RNA, 22 nt, Escherichia coli CFT073
caucauucccuacgcgauaaaa

SEQ ID NO: 658152 - RNA, 14 nt, Escherichia coli CFT073
cauauuuuuugaaa

SEQ ID NO: 658153 - RNA, 13 nt, Escherichia coli CFT073
cauauucagcagc

SEQ ID NO: 658154 - RNA, 14 nt, Escherichia coli CFT073
cauauucagcagca

SEQ ID NO: 658155 - RNA, 13 nt, Escherichia coli CFT073
cauauucagcgcc

SEQ ID NO: 658156 - RNA, 15 nt, Escherichia coli CFT073
cauauuugguaucaa

SEQ ID NO: 658157 - RNA, 12 nt, Escherichia coli CFT073
caucaaccagca

SEQ ID NO: 658158 - RNA, 14 nt, Escherichia coli CFT073
caucaaacaacggc

SEQ ID NO: 658159 - RNA, 15 nt, Escherichia coli CFT073
caucaaacagccccu

SEQ ID NO: 658160 - RNA, 16 nt, Escherichia coli CFT073
caucaaacagccccug

SEQ ID NO: 658161 - RNA, 15 nt, Escherichia coli CFT073
caucaaacccauuuu

SEQ ID NO: 658162 - RNA, 14 nt, Escherichia coli CFT073
caucaaaauuaccu

SEQ ID NO: 658163 - RNA, 17 nt, Escherichia coli CFT073
caucaaaauuaccuuua

SEQ ID NO: 658164 - RNA, 15 nt, Escherichia coli CFT073
caucaaaaaucaaug

SEQ ID NO: 658165 - RNA, 14 nt, Escherichia coli CFT073
caucaauaacaaag

SEQ ID NO: 658166 - RNA, 21 nt, Escherichia coli CFT073
caucaaguugauuuuucguuu

SEQ ID NO: 658167 - RNA, 19 nt, Escherichia coli CFT073
caucaauaaagccgcccau

SEQ ID NO: 658168 - RNA, 15 nt, Escherichia coli CFT073
caucaaguaaccuuu

SEQ ID NO: 658169 - RNA, 12 nt, Escherichia coli CFT073
caucaauaccau

SEQ ID NO: 658170 - RNA, 14 nt, Escherichia coli CFT073
caucaccccgcgcu

SEQ ID NO: 658171 - RNA, 13 nt, Escherichia coli CFT073
caucacccgcugc

SEQ ID NO: 658172 - RNA, 14 nt, Escherichia coli CFT073
caucacccucccau

SEQ ID NO: 658173 - RNA, 12 nt, Escherichia coli CFT073
caucacccugcg

SEQ ID NO: 658174 - RNA, 21 nt, Escherichia coli CFT073
caucacccugcgauugugaca

SEQ ID NO: 658175 - RNA, 23 nt, Escherichia coli CFT073
caucaacgugaaucccaguacug

SEQ ID NO: 658176 - RNA, 20 nt, Escherichia coli CFT073
caucaacccgcccagugcug

SEQ ID NO: 658177 - RNA, 17 nt, Escherichia coli CFT073
caucaaccagcacaaag

SEQ ID NO: 658178 - RNA, 15 nt, Escherichia coli CFT073
caucaaccagcaccu

SEQ ID NO: 658179 - RNA, 13 nt, Escherichia coli CFT073
caucaacccagaa

SEQ ID NO: 658180 - RNA, 17 nt, Escherichia coli CFT073
caucaacgcagacgccg

SEQ ID NO: 658181 - RNA, 18 nt, Escherichia coli CFT073
caucaagcugugccugaa

SEQ ID NO: 658182 - RNA, 23 nt, Escherichia coli CFT073
caucaagcggcgcaugcaggcau

SEQ ID NO: 658183 - RNA, 15 nt, Escherichia coli CFT073
caucaagcuguuccu

SEQ ID NO: 658184 - RNA, 13 nt, Escherichia coli CFT073
caucaacugacua

SEQ ID NO: 658185 - RNA, 12 nt, Escherichia coli CFT073
caucaagaaaaa

SEQ ID NO: 658186 - RNA, 18 nt, Escherichia coli CFT073
cauaucuucuccugucau

SEQ ID NO: 658187 - RNA, 13 nt, Escherichia coli CFT073
cauaucuucugaa

SEQ ID NO: 658188 - RNA, 16 nt, Escherichia coli CFT073
cauaugcacaugauga

SEQ ID NO: 658189 - RNA, 19 nt, Escherichia coli CFT073
cauaugcagcauccagcug

SEQ ID NO: 658190 - RNA, 16 nt, Escherichia coli CFT073
cauaucgguaaaugcu

SEQ ID NO: 658191 - RNA, 15 nt, Escherichia coli CFT073
cauaucuauuacagc

SEQ ID NO: 658192 - RNA, 20 nt, Escherichia coli CFT073
cauaucuucaggccaauuca

SEQ ID NO: 658193 - RNA, 17 nt, Escherichia coli CFT073
cauaucucccaguaagc

SEQ ID NO: 658194 - RNA, 23 nt, Escherichia coli CFT073
cauauguucccuuaauuaucugg

SEQ ID NO: 658195 - RNA, 17 nt, Escherichia coli CFT073
cauaugcuuuuuuaaaa

SEQ ID NO: 658196 - RNA, 17 nt, Escherichia coli CFT073
cauauggaagaaacgcu

SEQ ID NO: 658197 - RNA, 24 nt, Escherichia coli CFT073
cauauggauaugaucugcacagca

SEQ ID NO: 658198 - RNA, 16 nt, Escherichia coli CFT073
cauaugcgccagacga

SEQ ID NO: 658199 - RNA, 18 nt, Escherichia coli CFT073
cauaugcgccagcugcau

SEQ ID NO: 658200 - RNA, 13 nt, Escherichia coli CFT073
cauaucgcuggcu

SEQ ID NO: 658201 - RNA, 14 nt, Escherichia coli CFT073
cauaucgcuggcug

SEQ ID NO: 658202 - RNA, 19 nt, Escherichia coli CFT073
cauaucgcuggcugcagug

SEQ ID NO: 658203 - RNA, 19 nt, Escherichia coli CFT073
cauaucacuuuuauauaau

SEQ ID NO: 658204 - RNA, 20 nt, Escherichia coli CFT073
cauauauaaaaucauauucu

SEQ ID NO: 658205 - RNA, 12 nt, Escherichia coli CFT073
cauacuuucuca

SEQ ID NO: 658206 - RNA, 22 nt, Escherichia coli CFT073
cauagaaaaagaauugcagaua

SEQ ID NO: 658207 - RNA, 13 nt, Escherichia coli CFT073
cauauaacgucca

SEQ ID NO: 658208 - RNA, 18 nt, Escherichia coli CFT073
cauauaacguccaguuga

SEQ ID NO: 658209 - RNA, 19 nt, Escherichia coli CFT073
cauauaaccggcaacagaa

SEQ ID NO: 658210 - RNA, 20 nt, Escherichia coli CFT073
cauauaaccggcaacagaac

SEQ ID NO: 658211 - RNA, 15 nt, Escherichia coli CFT073
cauauaagugcauua

SEQ ID NO: 658212 - RNA, 21 nt, Escherichia coli CFT073
cauacggcauuuucccugcgu

SEQ ID NO: 658213 - RNA, 18 nt, Escherichia coli CFT073
cauacggcgguucuuuca

SEQ ID NO: 658214 - RNA, 21 nt, Escherichia coli CFT073
cauacgggauuuuacuuccca

SEQ ID NO: 658215 - RNA, 20 nt, Escherichia coli CFT073
cauacggaaaaucucauuug

SEQ ID NO: 658216 - RNA, 19 nt, Escherichia coli CFT073
cauacgcgguauuaaaucc

SEQ ID NO: 658217 - RNA, 23 nt, Escherichia coli CFT073
cauacgcgguauuaaauccgcua

SEQ ID NO: 658218 - RNA, 16 nt, Escherichia coli CFT073
cauacgagucgccugu

SEQ ID NO: 658219 - RNA, 21 nt, Escherichia coli CFT073
cauacgacuuugcgcaggcaa

SEQ ID NO: 658220 - RNA, 20 nt, Escherichia coli CFT073
cauaccuucacaaaaugcca

SEQ ID NO: 658221 - RNA, 14 nt, Escherichia coli CFT073
cauaccuaaaagca

SEQ ID NO: 658222 - RNA, 16 nt, Escherichia coli CFT073
cauaccuaccugcagu

SEQ ID NO: 658223 - RNA, 17 nt, Escherichia coli CFT073
cauaccuaccugcaguu

SEQ ID NO: 658224 - RNA, 16 nt, Escherichia coli CFT073
cauaccuauuuaaauc

SEQ ID NO: 658225 - RNA, 14 nt, Escherichia coli CFT073
cauacuauugccau

SEQ ID NO: 658226 - RNA, 20 nt, Escherichia coli CFT073
cauacguggcagaaugguuu

SEQ ID NO: 658227 - RNA, 15 nt, Escherichia coli CFT073
cauacguugcauaaa

SEQ ID NO: 658228 - RNA, 23 nt, Escherichia coli CFT073
cauacucguugacgaccaguccg

SEQ ID NO: 658229 - RNA, 15 nt, Escherichia coli CFT073
cauacucuccuccag

SEQ ID NO: 658230 - RNA, 18 nt, Escherichia coli CFT073
cauacugacaaacugcgc

SEQ ID NO: 658231 - RNA, 17 nt, Escherichia coli CFT073
cauacugauuacccagu

SEQ ID NO: 658232 - RNA, 15 nt, Escherichia coli CFT073
cauacuuaaugccag

SEQ ID NO: 658233 - RNA, 17 nt, Escherichia coli CFT073
cauacuuaaauaaugcu

SEQ ID NO: 658234 - RNA, 16 nt, Escherichia coli CFT073
cauacugcuugccauu

SEQ ID NO: 658235 - RNA, 18 nt, Escherichia coli CFT073
cauacuggacacugaaua

SEQ ID NO: 658236 - RNA, 17 nt, Escherichia coli CFT073
cauacuggcucugaaua

SEQ ID NO: 658237 - RNA, 22 nt, Escherichia coli CFT073
cauacuguccugcggcguacca

SEQ ID NO: 658238 - RNA, 23 nt, Escherichia coli CFT073
cauacuuauugaaagcaaaaaaa

SEQ ID NO: 658239 - RNA, 20 nt, Escherichia coli CFT073
cauacagcuuuuacagccaa

SEQ ID NO: 658240 - RNA, 14 nt, Escherichia coli CFT073
cauacagcaccgcc

SEQ ID NO: 658241 - RNA, 16 nt, Escherichia coli CFT073
cauacagccagcaaua

SEQ ID NO: 658242 - RNA, 14 nt, Escherichia coli CFT073
cauacccaguuuca

SEQ ID NO: 658243 - RNA, 13 nt, Escherichia coli CFT073
cauaccagcagga

SEQ ID NO: 658244 - RNA, 14 nt, Escherichia coli CFT073
cauaccauauuguu

SEQ ID NO: 658245 - RNA, 17 nt, Escherichia coli CFT073
cauaccauauuguuuca

SEQ ID NO: 658246 - RNA, 15 nt, Escherichia coli CFT073
cauaacguaaaccaa

SEQ ID NO: 658247 - RNA, 21 nt, Escherichia coli CFT073
cauaacgccaauucauuccuu

SEQ ID NO: 658248 - RNA, 19 nt, Escherichia coli CFT073
cauaacgcugauauuucgg

SEQ ID NO: 658249 - RNA, 22 nt, Escherichia coli CFT073
cauaacgcuggggaaugccaug

SEQ ID NO: 658250 - RNA, 19 nt, Escherichia coli CFT073
cauaaugaugccgaaguga

SEQ ID NO: 658251 - RNA, 22 nt, Escherichia coli CFT073
cauaaugauggggucacagguu

SEQ ID NO: 658252 - RNA, 16 nt, Escherichia coli CFT073
cauaauccuguagaua

SEQ ID NO: 658253 - RNA, 13 nt, Escherichia coli CFT073
cauaauccggguu

SEQ ID NO: 658254 - RNA, 21 nt, Escherichia coli CFT073
cauaaucgggaugcguaacag

SEQ ID NO: 658255 - RNA, 16 nt, Escherichia coli CFT073
cauaaucggcgcggcg

SEQ ID NO: 658256 - RNA, 13 nt, Escherichia coli CFT073
caguuuaaacaga

SEQ ID NO: 658257 - RNA, 17 nt, Escherichia coli CFT073
caguuuaaccgggagau

SEQ ID NO: 658258 - RNA, 22 nt, Escherichia coli CFT073
caguuuaccgaaaaucacgcug

SEQ ID NO: 658259 - RNA, 23 nt, Escherichia coli CFT073
cauaaaaauauauuccuauauau

SEQ ID NO: 658260 - RNA, 15 nt, Escherichia coli CFT073
cauaaagauguaauc

SEQ ID NO: 658261 - RNA, 13 nt, Escherichia coli CFT073
cauaaacuucauu

SEQ ID NO: 658262 - RNA, 21 nt, Escherichia coli CFT073
cauaaacgccuuauccggccu

SEQ ID NO: 658263 - RNA, 19 nt, Escherichia coli CFT073
cauaaacaucgucaggaag

SEQ ID NO: 658264 - RNA, 12 nt, Escherichia coli CFT073
cauaaacaucuu

SEQ ID NO: 658265 - RNA, 22 nt, Escherichia coli CFT073
cauaaacaucuuccacaugccc

SEQ ID NO: 658266 - RNA, 17 nt, Escherichia coli CFT073
cauaaacaccagcagca

SEQ ID NO: 658267 - RNA, 14 nt, Escherichia coli CFT073
cauaaacacucaca

SEQ ID NO: 658268 - RNA, 17 nt, Escherichia coli CFT073
cauaaaccgagccaaac

SEQ ID NO: 658269 - RNA, 15 nt, Escherichia coli CFT073
cauaaauggguuuuu

SEQ ID NO: 658270 - RNA, 19 nt, Escherichia coli CFT073
cauaacaaauaucuuucua

SEQ ID NO: 658271 - RNA, 13 nt, Escherichia coli CFT073
cauaaauuucagg

SEQ ID NO: 658272 - RNA, 11 nt, Escherichia coli CFT073
cauaacagaau

SEQ ID NO: 658273 - RNA, 19 nt, Escherichia coli CFT073
cauaaccagguaaagacca

SEQ ID NO: 658274 - RNA, 22 nt, Escherichia coli CFT073
cauaaccagugacggaacucuu

SEQ ID NO: 658275 - RNA, 21 nt, Escherichia coli CFT073
cauaaccgccagcacagccag

SEQ ID NO: 658276 - RNA, 21 nt, Escherichia coli CFT073
cagugugccugaugcgacgcu

SEQ ID NO: 658277 - RNA, 14 nt, Escherichia coli CFT073
cagugugcgaugcu

SEQ ID NO: 658278 - RNA, 18 nt, Escherichia coli CFT073
cagugucgcaucaggcau

SEQ ID NO: 658279 - RNA, 23 nt, Escherichia coli CFT073
cagugucuuaucuggcauuugca

SEQ ID NO: 658280 - RNA, 13 nt, Escherichia coli CFT073
caguguuguauuc

SEQ ID NO: 658281 - RNA, 16 nt, Escherichia coli CFT073
caguuaaccaguuuua

SEQ ID NO: 658282 - RNA, 22 nt, Escherichia coli CFT073
caguuaaccugcgccucaguuu

SEQ ID NO: 658283 - RNA, 16 nt, Escherichia coli CFT073
caguguuuaguggcuu

SEQ ID NO: 658284 - RNA, 12 nt, Escherichia coli CFT073
caguguuuauca

SEQ ID NO: 658285 - RNA, 17 nt, Escherichia coli CFT073
caguucuuccgccagac

SEQ ID NO: 658286 - RNA, 17 nt, Escherichia coli CFT073
caguugaccugcgaccg

SEQ ID NO: 658287 - RNA, 21 nt, Escherichia coli CFT073
caguugacuuugacaccgcug

SEQ ID NO: 658288 - RNA, 13 nt, Escherichia coli CFT073
caguucugcagcg

SEQ ID NO: 658289 - RNA, 15 nt, Escherichia coli CFT073
caguucucuggcauu

SEQ ID NO: 658290 - RNA, 20 nt, Escherichia coli CFT073
caguucucuggcauuuuugu

SEQ ID NO: 658291 - RNA, 12 nt, Escherichia coli CFT073
caguugcgugcc

SEQ ID NO: 658292 - RNA, 19 nt, Escherichia coli CFT073
caguugaugaccagugcag

SEQ ID NO: 658293 - RNA, 23 nt, Escherichia coli CFT073
caguugcaguuauuauaaguuca

SEQ ID NO: 658294 - RNA, 20 nt, Escherichia coli CFT073
caguugguagguccagccgc

SEQ ID NO: 658295 - RNA, 20 nt, Escherichia coli CFT073
caguugguuagagcacauca

SEQ ID NO: 658296 - RNA, 15 nt, Escherichia coli CFT073
caguuguugcgugaa

SEQ ID NO: 658297 - RNA, 21 nt, Escherichia coli CFT073
caguuggcagaauuugaggaa

SEQ ID NO: 658298 - RNA, 15 nt, Escherichia coli CFT073
caguuggcagcaagc

SEQ ID NO: 658299 - RNA, 16 nt, Escherichia coli CFT073
cagucgcgacgcugac

SEQ ID NO: 658300 - RNA, 17 nt, Escherichia coli CFT073
cagucgcgcaauugcca

SEQ ID NO: 658301 - RNA, 13 nt, Escherichia coli CFT073
cagucgcugauca

SEQ ID NO: 658302 - RNA, 17 nt, Escherichia coli CFT073
cagucgcuuuaccgcug

SEQ ID NO: 658303 - RNA, 18 nt, Escherichia coli CFT073
cagucgcuuuaccgcugc

SEQ ID NO: 658304 - RNA, 19 nt, Escherichia coli CFT073
cagucgcuuuaccgcugcg

SEQ ID NO: 658305 - RNA, 23 nt, Escherichia coli CFT073
cagucggggggaggcugcauuau

SEQ ID NO: 658306 - RNA, 21 nt, Escherichia coli CFT073
cagucgggugcugccgguggg

SEQ ID NO: 658307 - RNA, 13 nt, Escherichia coli CFT073
cagucgugcccaa

SEQ ID NO: 658308 - RNA, 16 nt, Escherichia coli CFT073
cagucgucaucccagu

SEQ ID NO: 658309 - RNA, 13 nt, Escherichia coli CFT073
cagucggcuuucu

SEQ ID NO: 658310 - RNA, 13 nt, Escherichia coli CFT073
cagucggccaugu

SEQ ID NO: 658311 - RNA, 21 nt, Escherichia coli CFT073
cagucuggagaugggugugcu

SEQ ID NO: 658312 - RNA, 16 nt, Escherichia coli CFT073
cagucuccuugcucca

SEQ ID NO: 658313 - RNA, 22 nt, Escherichia coli CFT073
caguccuggcgcuuugaaacgc

SEQ ID NO: 658314 - RNA, 23 nt, Escherichia coli CFT073
caguccuguucaaacuucgccac

SEQ ID NO: 658315 - RNA, 23 nt, Escherichia coli CFT073
cagucgaccaaacuuauccgcca

SEQ ID NO: 658316 - RNA, 15 nt, Escherichia coli CFT073
cagucgcacgccugg

SEQ ID NO: 658317 - RNA, 17 nt, Escherichia coli CFT073
cagucgagcaccagauc

SEQ ID NO: 658318 - RNA, 22 nt, Escherichia coli CFT073
cagucgauauggccuucuucau

SEQ ID NO: 658319 - RNA, 14 nt, Escherichia coli CFT073
cagucacccugccc

SEQ ID NO: 658320 - RNA, 15 nt, Escherichia coli CFT073
cagucaccugcccuc

SEQ ID NO: 658321 - RNA, 20 nt, Escherichia coli CFT073
cagucaccugcggugcagcc

SEQ ID NO: 658322 - RNA, 16 nt, Escherichia coli CFT073
cagucacugccaccau

SEQ ID NO: 658323 - RNA, 16 nt, Escherichia coli CFT073
cagucacuuccugauc

SEQ ID NO: 658324 - RNA, 17 nt, Escherichia coli CFT073
cagucacuuuuuuuccg

SEQ ID NO: 658325 - RNA, 17 nt, Escherichia coli CFT073
cagucagcgaacaccag

SEQ ID NO: 658326 - RNA, 20 nt, Escherichia coli CFT073
cagucagcgguuuugaucac

SEQ ID NO: 658327 - RNA, 18 nt, Escherichia coli CFT073
cagucagggucuggugcu

SEQ ID NO: 658328 - RNA, 21 nt, Escherichia coli CFT073
cagucagggucuggugcugau

SEQ ID NO: 658329 - RNA, 18 nt, Escherichia coli CFT073
cagucauaacguucagca

SEQ ID NO: 658330 - RNA, 19 nt, Escherichia coli CFT073
cagucauaacguucagcac

SEQ ID NO: 658331 - RNA, 21 nt, Escherichia coli CFT073
cagugaaaacgcauaccaguc

SEQ ID NO: 658332 - RNA, 22 nt, Escherichia coli CFT073
cagucuuugccguuggcggcgu

SEQ ID NO: 658333 - RNA, 17 nt, Escherichia coli CFT073
cagugaaucucaggcaa

SEQ ID NO: 658334 - RNA, 19 nt, Escherichia coli CFT073
cagugaaucucaggcaaau

SEQ ID NO: 658335 - RNA, 17 nt, Escherichia coli CFT073
cagugaggguuucuuca

SEQ ID NO: 658336 - RNA, 18 nt, Escherichia coli CFT073
cagugaggguuucuucaa

SEQ ID NO: 658337 - RNA, 14 nt, Escherichia coli CFT073
cagugauaacucaa

SEQ ID NO: 658338 - RNA, 17 nt, Escherichia coli CFT073
cagugauaucgcucugg

SEQ ID NO: 658339 - RNA, 21 nt, Escherichia coli CFT073
cagugacaguguuauucccaa

SEQ ID NO: 658340 - RNA, 17 nt, Escherichia coli CFT073
cagugacgaccuuuucc

SEQ ID NO: 658341 - RNA, 19 nt, Escherichia coli CFT073
caguguaaaccaaagccac

SEQ ID NO: 658342 - RNA, 15 nt, Escherichia coli CFT073
caguguccagaugcu

SEQ ID NO: 658343 - RNA, 14 nt, Escherichia coli CFT073
caguguccaaccga

SEQ ID NO: 658344 - RNA, 17 nt, Escherichia coli CFT073
cagugucacguuaaaua

SEQ ID NO: 658345 - RNA, 21 nt, Escherichia coli CFT073
cagugucacguuaaauaaaaa

SEQ ID NO: 658346 - RNA, 22 nt, Escherichia coli CFT073
cagugucagaaucguaaagauc

SEQ ID NO: 658347 - RNA, 16 nt, Escherichia coli CFT073
cagugucagguacuga

SEQ ID NO: 658348 - RNA, 22 nt, Escherichia coli CFT073
caguggaaucaaugugcuuuca

SEQ ID NO: 658349 - RNA, 13 nt, Escherichia coli CFT073
caguggagccauc

SEQ ID NO: 658350 - RNA, 21 nt, Escherichia coli CFT073
caguggaugcgccauaccaug

SEQ ID NO: 658351 - RNA, 22 nt, Escherichia coli CFT073
caguggcacuaauuaagacuga

SEQ ID NO: 658352 - RNA, 17 nt, Escherichia coli CFT073
caguggcgcaucagcag

SEQ ID NO: 658353 - RNA, 19 nt, Escherichia coli CFT073
cagugcuucuaacaucaug

SEQ ID NO: 658354 - RNA, 14 nt, Escherichia coli CFT073
cagugcuuuaauca

SEQ ID NO: 658355 - RNA, 16 nt, Escherichia coli CFT073
cagugccagcaccacu

SEQ ID NO: 658356 - RNA, 14 nt, Escherichia coli CFT073
cagugccagaacag

SEQ ID NO: 658357 - RNA, 15 nt, Escherichia coli CFT073
cagugccagaacaga

SEQ ID NO: 658358 - RNA, 18 nt, Escherichia coli CFT073
cagugcagauaccaccag

SEQ ID NO: 658359 - RNA, 12 nt, Escherichia coli CFT073
cagugcagaugc

SEQ ID NO: 658360 - RNA, 13 nt, Escherichia coli CFT073
cagugcauaaguc

SEQ ID NO: 658361 - RNA, 19 nt, Escherichia coli CFT073
cagugcaucgcgaccaauc

SEQ ID NO: 658362 - RNA, 14 nt, Escherichia coli CFT073
cagugcaugggcaa

SEQ ID NO: 658363 - RNA, 12 nt, Escherichia coli CFT073
cagguuggcgcu

SEQ ID NO: 658364 - RNA, 16 nt, Escherichia coli CFT073
caguaaaccaauuucu

SEQ ID NO: 658365 - RNA, 19 nt, Escherichia coli CFT073
caguaaaccacccaccagc

SEQ ID NO: 658366 - RNA, 18 nt, Escherichia coli CFT073
caggugguugugcugagu

SEQ ID NO: 658367 - RNA, 14 nt, Escherichia coli CFT073
cagguguaauaaag

SEQ ID NO: 658368 - RNA, 12 nt, Escherichia coli CFT073
caggugcuuuug

SEQ ID NO: 658369 - RNA, 19 nt, Escherichia coli CFT073
cagguggcaaacgccaccu

SEQ ID NO: 658370 - RNA, 13 nt, Escherichia coli CFT073
cagguaaagacca

SEQ ID NO: 658371 - RNA, 15 nt, Escherichia coli CFT073
cagguaacagggaac

SEQ ID NO: 658372 - RNA, 16 nt, Escherichia coli CFT073
caggguuucgacggca

SEQ ID NO: 658373 - RNA, 16 nt, Escherichia coli CFT073
caggguguuaucaaua

SEQ ID NO: 658374 - RNA, 24 nt, Escherichia coli CFT073
caggguguuaucaauaccgauggc

SEQ ID NO: 658375 - RNA, 20 nt, Escherichia coli CFT073
caggguugacuuggcuuucu

SEQ ID NO: 658376 - RNA, 17 nt, Escherichia coli CFT073
caguaacugcuguaguc

SEQ ID NO: 658377 - RNA, 18 nt, Escherichia coli CFT073
caguaacuuacuuagugc

SEQ ID NO: 658378 - RNA, 14 nt, Escherichia coli CFT073
caguaaacgccagg

SEQ ID NO: 658379 - RNA, 14 nt, Escherichia coli CFT073
caguaacucauugc

SEQ ID NO: 658380 - RNA, 18 nt, Escherichia coli CFT073
caguaaggccugguucau

SEQ ID NO: 658381 - RNA, 19 nt, Escherichia coli CFT073
caguaagcaguccagcgcc

SEQ ID NO: 658382 - RNA, 21 nt, Escherichia coli CFT073
caguaagcccaccacaaacca

SEQ ID NO: 658383 - RNA, 15 nt, Escherichia coli CFT073
caguacacgcugaag

SEQ ID NO: 658384 - RNA, 17 nt, Escherichia coli CFT073
caguacacgcugaagau

SEQ ID NO: 658385 - RNA, 13 nt, Escherichia coli CFT073
caguaauaaagac

SEQ ID NO: 658386 - RNA, 15 nt, Escherichia coli CFT073
caguaauaaagacgg

SEQ ID NO: 658387 - RNA, 18 nt, Escherichia coli CFT073
caguaauaccgaacgcag

SEQ ID NO: 658388 - RNA, 18 nt, Escherichia coli CFT073
caguaccguagaggugau

SEQ ID NO: 658389 - RNA, 23 nt, Escherichia coli CFT073
caguaccgccgccauaaacagca

SEQ ID NO: 658390 - RNA, 18 nt, Escherichia coli CFT073
caguacguuaucaccgau

SEQ ID NO: 658391 - RNA, 18 nt, Escherichia coli CFT073
caguacuguacaacacag

SEQ ID NO: 658392 - RNA, 19 nt, Escherichia coli CFT073
caguacugacuauccacug

SEQ ID NO: 658393 - RNA, 20 nt, Escherichia coli CFT073
caguacugacuauccacugg

SEQ ID NO: 658394 - RNA, 15 nt, Escherichia coli CFT073
caguacagccgccag

SEQ ID NO: 658395 - RNA, 13 nt, Escherichia coli CFT073
caguaccagcaac

SEQ ID NO: 658396 - RNA, 13 nt, Escherichia coli CFT073
caguaccagcagc

SEQ ID NO: 658397 - RNA, 14 nt, Escherichia coli CFT073
caguaccagcagcg

SEQ ID NO: 658398 - RNA, 17 nt, Escherichia coli CFT073
caguaccaggcaauaaa

SEQ ID NO: 658399 - RNA, 20 nt, Escherichia coli CFT073
caguaccaggcaauaaacau

SEQ ID NO: 658400 - RNA, 22 nt, Escherichia coli CFT073
caguaccgauugcccauacagg

SEQ ID NO: 658401 - RNA, 19 nt, Escherichia coli CFT073
caguaccgccaccaccaga

SEQ ID NO: 658402 - RNA, 22 nt, Escherichia coli CFT073
caguaccgccgccauaaacagc

SEQ ID NO: 658403 - RNA, 16 nt, Escherichia coli CFT073
caguauauugcagaaa

SEQ ID NO: 658404 - RNA, 21 nt, Escherichia coli CFT073
caguauuugucugccacaccu

SEQ ID NO: 658405 - RNA, 19 nt, Escherichia coli CFT073
cagucacaggggaggaaca

SEQ ID NO: 658406 - RNA, 15 nt, Escherichia coli CFT073
cagucaaccgccuga

SEQ ID NO: 658407 - RNA, 12 nt, Escherichia coli CFT073
caguagcagcag

SEQ ID NO: 658408 - RNA, 19 nt, Escherichia coli CFT073
caguagcagcaggaauaau

SEQ ID NO: 658409 - RNA, 18 nt, Escherichia coli CFT073
caguagaacaauuaauac

SEQ ID NO: 658410 - RNA, 17 nt, Escherichia coli CFT073
caguagagaucuucaua

SEQ ID NO: 658411 - RNA, 14 nt, Escherichia coli CFT073
caguagcaguaauu

SEQ ID NO: 658412 - RNA, 15 nt, Escherichia coli CFT073
caguagcaugaacau

SEQ ID NO: 658413 - RNA, 20 nt, Escherichia coli CFT073
caguaguuuuugcagaugga

SEQ ID NO: 658414 - RNA, 14 nt, Escherichia coli CFT073
caggcaguggaaua

SEQ ID NO: 658415 - RNA, 19 nt, Escherichia coli CFT073
caggcaguggaauauccca

SEQ ID NO: 658416 - RNA, 22 nt, Escherichia coli CFT073
caggcagcaaucacugccagaa

SEQ ID NO: 658417 - RNA, 16 nt, Escherichia coli CFT073
caggcagcacugcuua

SEQ ID NO: 658418 - RNA, 18 nt, Escherichia coli CFT073
caggcagauccaguuacc

SEQ ID NO: 658419 - RNA, 18 nt, Escherichia coli CFT073
caggcaguuuauccagcc

SEQ ID NO: 658420 - RNA, 17 nt, Escherichia coli CFT073
caggccgcaucauacug

SEQ ID NO: 658421 - RNA, 22 nt, Escherichia coli CFT073
caggccggaugagacgcggcac

SEQ ID NO: 658422 - RNA, 17 nt, Escherichia coli CFT073
caggccggaguuaaucu

SEQ ID NO: 658423 - RNA, 13 nt, Escherichia coli CFT073
caggccgcgcagu

SEQ ID NO: 658424 - RNA, 21 nt, Escherichia coli CFT073
caggcgcgaagccugcggaua

SEQ ID NO: 658425 - RNA, 13 nt, Escherichia coli CFT073
caggcgcgccugg

SEQ ID NO: 658426 - RNA, 16 nt, Escherichia coli CFT073
caggccuaacacaugc

SEQ ID NO: 658427 - RNA, 15 nt, Escherichia coli CFT073
caggccuacaauccc

SEQ ID NO: 658428 - RNA, 16 nt, Escherichia coli CFT073
caggccuacacuccgg

SEQ ID NO: 658429 - RNA, 16 nt, Escherichia coli CFT073
caggccgucgcguagc

SEQ ID NO: 658430 - RNA, 22 nt, Escherichia coli CFT073
caggccgucgcguagcaccacg

SEQ ID NO: 658431 - RNA, 14 nt, Escherichia coli CFT073
caggcuaauccagu

SEQ ID NO: 658432 - RNA, 22 nt, Escherichia coli CFT073
caggcuaccgcagugaaauuuc

SEQ ID NO: 658433 - RNA, 23 nt, Escherichia coli CFT073
caggcuacggcuguaguucagaa

SEQ ID NO: 658434 - RNA, 13 nt, Escherichia coli CFT073
caggcuacuccca

SEQ ID NO: 658435 - RNA, 14 nt, Escherichia coli CFT073
caggcuacucccag

SEQ ID NO: 658436 - RNA, 17 nt, Escherichia coli CFT073
caggcuacucccaguag

SEQ ID NO: 658437 - RNA, 17 nt, Escherichia coli CFT073
caggcuagaugugccaa

SEQ ID NO: 658438 - RNA, 20 nt, Escherichia coli CFT073
caggcguggauacaggcggg

SEQ ID NO: 658439 - RNA, 16 nt, Escherichia coli CFT073
caggcggcuucgcauc

SEQ ID NO: 658440 - RNA, 11 nt, Escherichia coli CFT073
caggguaaaaa

SEQ ID NO: 658441 - RNA, 19 nt, Escherichia coli CFT073
cagggucacgguauuaaua

SEQ ID NO: 658442 - RNA, 19 nt, Escherichia coli CFT073
caggguguaggcaaaggga

SEQ ID NO: 658443 - RNA, 17 nt, Escherichia coli CFT073
caggguggugacaccau

SEQ ID NO: 658444 - RNA, 18 nt, Escherichia coli CFT073
cagggugaauaaaagaaa

SEQ ID NO: 658445 - RNA, 22 nt, Escherichia coli CFT073
cagggugagggcaauaaucuuu

SEQ ID NO: 658446 - RNA, 21 nt, Escherichia coli CFT073
cagggcggacugauaacuuuu

SEQ ID NO: 658447 - RNA, 22 nt, Escherichia coli CFT073
cagggcgucaauuugcuccgcc

SEQ ID NO: 658448 - RNA, 23 nt, Escherichia coli CFT073
cagggcuuuuuuauuucaucuuu

SEQ ID NO: 658449 - RNA, 20 nt, Escherichia coli CFT073
caggggauggaugcccccag

SEQ ID NO: 658450 - RNA, 17 nt, Escherichia coli CFT073
caggggcaaucagcacu

SEQ ID NO: 658451 - RNA, 22 nt, Escherichia coli CFT073
caggggcaaucagcacuacugc

SEQ ID NO: 658452 - RNA, 23 nt, Escherichia coli CFT073
caggggcaaucagcacuacugcc

SEQ ID NO: 658453 - RNA, 14 nt, Escherichia coli CFT073
caggggcuggugcc

SEQ ID NO: 658454 - RNA, 12 nt, Escherichia coli CFT073
cagggcauugcu

SEQ ID NO: 658455 - RNA, 14 nt, Escherichia coli CFT073
cagggcagguaaca

SEQ ID NO: 658456 - RNA, 16 nt, Escherichia coli CFT073
cagggacgcgcaaaau

SEQ ID NO: 658457 - RNA, 14 nt, Escherichia coli CFT073
cagggcaacggcca

SEQ ID NO: 658458 - RNA, 21 nt, Escherichia coli CFT073
cagggcaaucgcgccaaccag

SEQ ID NO: 658459 - RNA, 23 nt, Escherichia coli CFT073
cagggaagauguuggcagcggca

SEQ ID NO: 658460 - RNA, 15 nt, Escherichia coli CFT073
caggcucauaccuuc

SEQ ID NO: 658461 - RNA, 21 nt, Escherichia coli CFT073
cagggaaaggauggcgaugcu

SEQ ID NO: 658462 - RNA, 14 nt, Escherichia coli CFT073
caggauugguaaua

SEQ ID NO: 658463 - RNA, 21 nt, Escherichia coli CFT073
caggcacuucuuccgccagca

SEQ ID NO: 658464 - RNA, 21 nt, Escherichia coli CFT073
caggcacuugguuugcuggua

SEQ ID NO: 658465 - RNA, 17 nt, Escherichia coli CFT073
caggcagaaacaucauc

SEQ ID NO: 658466 - RNA, 19 nt, Escherichia coli CFT073
caggaugugagcuggcgga

SEQ ID NO: 658467 - RNA, 19 nt, Escherichia coli CFT073
caggaucguugagcagcag

SEQ ID NO: 658468 - RNA, 22 nt, Escherichia coli CFT073
caggagcgauuaugaaacaaga

SEQ ID NO: 658469 - RNA, 17 nt, Escherichia coli CFT073
caggagccgcaguaacc

SEQ ID NO: 658470 - RNA, 13 nt, Escherichia coli CFT073
caggagcgcggca

SEQ ID NO: 658471 - RNA, 19 nt, Escherichia coli CFT073
caggagcgguguaggccug

SEQ ID NO: 658472 - RNA, 14 nt, Escherichia coli CFT073
caggagcugagugc

SEQ ID NO: 658473 - RNA, 22 nt, Escherichia coli CFT073
caggaggagauauuuaacauca

SEQ ID NO: 658474 - RNA, 14 nt, Escherichia coli CFT073
caggaguuauagag

SEQ ID NO: 658475 - RNA, 17 nt, Escherichia coli CFT073
caggauaaacuccugca

SEQ ID NO: 658476 - RNA, 14 nt, Escherichia coli CFT073
caggagucacgcag

SEQ ID NO: 658477 - RNA, 18 nt, Escherichia coli CFT073
caggacgcucccucaaua

SEQ ID NO: 658478 - RNA, 14 nt, Escherichia coli CFT073
caggacgauaaacc

SEQ ID NO: 658479 - RNA, 18 nt, Escherichia coli CFT073
caggacgauuccggcaaa

SEQ ID NO: 658480 - RNA, 15 nt, Escherichia coli CFT073
caggacccucaagga

SEQ ID NO: 658481 - RNA, 13 nt, Escherichia coli CFT073
caggacaucagcg

SEQ ID NO: 658482 - RNA, 21 nt, Escherichia coli CFT073
caggaagcucuggccccaccu

SEQ ID NO: 658483 - RNA, 17 nt, Escherichia coli CFT073
caggaagaagcccauca

SEQ ID NO: 658484 - RNA, 20 nt, Escherichia coli CFT073
caggaacuuaguaggccuga

SEQ ID NO: 658485 - RNA, 18 nt, Escherichia coli CFT073
caggaagccuuccgcaaa

SEQ ID NO: 658486 - RNA, 16 nt, Escherichia coli CFT073
caggaagcccgcccag

SEQ ID NO: 658487 - RNA, 19 nt, Escherichia coli CFT073
caggaacugcaaggagagc

SEQ ID NO: 658488 - RNA, 18 nt, Escherichia coli CFT073
caggaacgggauugccag

SEQ ID NO: 658489 - RNA, 16 nt, Escherichia coli CFT073
cagcuauccugccggu

SEQ ID NO: 658490 - RNA, 22 nt, Escherichia coli CFT073
cagcuaucguuagccauauggc

SEQ ID NO: 658491 - RNA, 16 nt, Escherichia coli CFT073
cagcggcuacugaugu

SEQ ID NO: 658492 - RNA, 15 nt, Escherichia coli CFT073
cagcggccagcgcac

SEQ ID NO: 658493 - RNA, 15 nt, Escherichia coli CFT073
cagcggcggcacagc

SEQ ID NO: 658494 - RNA, 15 nt, Escherichia coli CFT073
cagcucauccagcgu

SEQ ID NO: 658495 - RNA, 20 nt, Escherichia coli CFT073
cagcucaaucaacuccauua

SEQ ID NO: 658496 - RNA, 15 nt, Escherichia coli CFT073
cagcucaucaacacg

SEQ ID NO: 658497 - RNA, 20 nt, Escherichia coli CFT073
cagcucgcgauacgcuucaa

SEQ ID NO: 658498 - RNA, 17 nt, Escherichia coli CFT073
cagcuccguccagccac

SEQ ID NO: 658499 - RNA, 22 nt, Escherichia coli CFT073
cagcuccgccagcuccgggcug

SEQ ID NO: 658500 - RNA, 20 nt, Escherichia coli CFT073
cagcucggcgaucuguuccg

SEQ ID NO: 658501 - RNA, 19 nt, Escherichia coli CFT073
cagcugguugaugcgcccu

SEQ ID NO: 658502 - RNA, 15 nt, Escherichia coli CFT073
cagcuucaucaucgc

SEQ ID NO: 658503 - RNA, 23 nt, Escherichia coli CFT073
cagcuucagacggauguauucuu

SEQ ID NO: 658504 - RNA, 13 nt, Escherichia coli CFT073
cagcuucagauug

SEQ ID NO: 658505 - RNA, 10 nt, Escherichia coli CFT073
cagcuucaga

SEQ ID NO: 658506 - RNA, 16 nt, Escherichia coli CFT073
cagcuucacgcgcugg

SEQ ID NO: 658507 - RNA, 13 nt, Escherichia coli CFT073
cagcuucacgcgc

SEQ ID NO: 658508 - RNA, 17 nt, Escherichia coli CFT073
cagcugucguacccagu

SEQ ID NO: 658509 - RNA, 14 nt, Escherichia coli CFT073
cagcuguuccucaa

SEQ ID NO: 658510 - RNA, 14 nt, Escherichia coli CFT073
cagcuguuucaucu

SEQ ID NO: 658511 - RNA, 18 nt, Escherichia coli CFT073
cagcuuaagcgaccaguu

SEQ ID NO: 658512 - RNA, 18 nt, Escherichia coli CFT073
cagcuguuuugguaaacu

SEQ ID NO: 658513 - RNA, 24 nt, Escherichia coli CFT073
cagcuuacgcgccagagcuggcac

SEQ ID NO: 658514 - RNA, 20 nt, Escherichia coli CFT073
cagcuuagacaacgccgcuu

SEQ ID NO: 658515 - RNA, 19 nt, Escherichia coli CFT073
cagcuuaguaagcccaggg

SEQ ID NO: 658516 - RNA, 13 nt, Escherichia coli CFT073
ccuuauauaaaac

SEQ ID NO: 658517 - RNA, 13 nt, Escherichia coli CFT073
ccuuauaaccaga

SEQ ID NO: 658518 - RNA, 20 nt, Escherichia coli CFT073
ccuuauccggccuaccgcau

SEQ ID NO: 658519 - RNA, 13 nt, Escherichia coli CFT073
ccuuauccgccug

SEQ ID NO: 658520 - RNA, 16 nt, Escherichia coli CFT073
ccuuaucguuagcaug

SEQ ID NO: 658521 - RNA, 18 nt, Escherichia coli CFT073
ccuuaugcugcuuacaua

SEQ ID NO: 658522 - RNA, 19 nt, Escherichia coli CFT073
ccuuaugcagcggaauaau

SEQ ID NO: 658523 - RNA, 11 nt, Escherichia coli CFT073
ccuuaguaucg

SEQ ID NO: 658524 - RNA, 23 nt, Escherichia coli CFT073
ccuuaguaacgccagcggucaua

SEQ ID NO: 658525 - RNA, 15 nt, Escherichia coli CFT073
ccuucaagaauuaaa

SEQ ID NO: 658526 - RNA, 13 nt, Escherichia coli CFT073
ccuucaauuaugc

SEQ ID NO: 658527 - RNA, 17 nt, Escherichia coli CFT073
ccuucacaggccgccag

SEQ ID NO: 658528 - RNA, 20 nt, Escherichia coli CFT073
ccuucaauaucauuacgcca

SEQ ID NO: 658529 - RNA, 20 nt, Escherichia coli CFT073
ccuucaauacuggcaaaauc

SEQ ID NO: 658530 - RNA, 15 nt, Escherichia coli CFT073
ccuucaggacccuca

SEQ ID NO: 658531 - RNA, 20 nt, Escherichia coli CFT073
ccuucacgggcaaccacagu

SEQ ID NO: 658532 - RNA, 14 nt, Escherichia coli CFT073
ccuuaacaaaaacu

SEQ ID NO: 658533 - RNA, 16 nt, Escherichia coli CFT073
ccuuaacgauuacagc

SEQ ID NO: 658534 - RNA, 16 nt, Escherichia coli CFT073
ccuuaacgcaaaaucu

SEQ ID NO: 658535 - RNA, 19 nt, Escherichia coli CFT073
ccuguuuuuuaauucagga

SEQ ID NO: 658536 - RNA, 19 nt, Escherichia coli CFT073
ccuuaauaccggcauccag

SEQ ID NO: 658537 - RNA, 13 nt, Escherichia coli CFT073
ccuguuuucgauu

SEQ ID NO: 658538 - RNA, 16 nt, Escherichia coli CFT073
ccuguuuaauaugcaa

SEQ ID NO: 658539 - RNA, 15 nt, Escherichia coli CFT073
ccuguugauugcguu

SEQ ID NO: 658540 - RNA, 17 nt, Escherichia coli CFT073
ccugucuaaccgccugc

SEQ ID NO: 658541 - RNA, 16 nt, Escherichia coli CFT073
ccugucuucccugcug

SEQ ID NO: 658542 - RNA, 22 nt, Escherichia coli CFT073
ccuguaaaaaagaaaugccugc

SEQ ID NO: 658543 - RNA, 20 nt, Escherichia coli CFT073
ccuguaaaaaaggcagccau

SEQ ID NO: 658544 - RNA, 19 nt, Escherichia coli CFT073
ccugugcaaccuuuuccau

SEQ ID NO: 658545 - RNA, 20 nt, Escherichia coli CFT073
ccuguucauaugcuuguuug

SEQ ID NO: 658546 - RNA, 16 nt, Escherichia coli CFT073
ccuguucauuuuuagg

SEQ ID NO: 658547 - RNA, 19 nt, Escherichia coli CFT073
ccugccaguggagccauca

SEQ ID NO: 658548 - RNA, 21 nt, Escherichia coli CFT073
ccugccaguuauagcgcagac

SEQ ID NO: 658549 - RNA, 19 nt, Escherichia coli CFT073
ccugccagggucaguuuca

SEQ ID NO: 658550 - RNA, 20 nt, Escherichia coli CFT073
ccugccaguaagcaguccag

SEQ ID NO: 658551 - RNA, 21 nt, Escherichia coli CFT073
ccugccaguaagcaguccagc

SEQ ID NO: 658552 - RNA, 19 nt, Escherichia coli CFT073
ccugccagcgucagcagga

SEQ ID NO: 658553 - RNA, 12 nt, Escherichia coli CFT073
ccugccagcuug

SEQ ID NO: 658554 - RNA, 18 nt, Escherichia coli CFT073
ccugccagauccagugcg

SEQ ID NO: 658555 - RNA, 17 nt, Escherichia coli CFT073
ccugccagaugcagcgg

SEQ ID NO: 658556 - RNA, 14 nt, Escherichia coli CFT073
ccugccagaagcag

SEQ ID NO: 658557 - RNA, 18 nt, Escherichia coli CFT073
ccugccagaagcagaaug

SEQ ID NO: 658558 - RNA, 20 nt, Escherichia coli CFT073
ccugccagagcugaauauca

SEQ ID NO: 658559 - RNA, 20 nt, Escherichia coli CFT073
ccugccccagagacaacccg

SEQ ID NO: 658560 - RNA, 21 nt, Escherichia coli CFT073
ccugcucagcacgccacucac

SEQ ID NO: 658561 - RNA, 17 nt, Escherichia coli CFT073
ccugcucaggcagaaga

SEQ ID NO: 658562 - RNA, 18 nt, Escherichia coli CFT073
ccugcuccagcagcucaa

SEQ ID NO: 658563 - RNA, 14 nt, Escherichia coli CFT073
ccugcuccaucauc

SEQ ID NO: 658564 - RNA, 21 nt, Escherichia coli CFT073
ccugcuuaucgcccugcucca

SEQ ID NO: 658565 - RNA, 18 nt, Escherichia coli CFT073
ccugcuuugacacuucau

SEQ ID NO: 658566 - RNA, 16 nt, Escherichia coli CFT073
ccugcuugaacgcacc

SEQ ID NO: 658567 - RNA, 14 nt, Escherichia coli CFT073
ccugcuggcagcgu

SEQ ID NO: 658568 - RNA, 16 nt, Escherichia coli CFT073
ccugcuggcagcgugu

SEQ ID NO: 658569 - RNA, 19 nt, Escherichia coli CFT073
ccugcugugccagcuccac

SEQ ID NO: 658570 - RNA, 12 nt, Escherichia coli CFT073
ccugcugguugc

SEQ ID NO: 658571 - RNA, 13 nt, Escherichia coli CFT073
ccugcuggguaaa

SEQ ID NO: 658572 - RNA, 19 nt, Escherichia coli CFT073
ccugcuggcuagccucccu

SEQ ID NO: 658573 - RNA, 13 nt, Escherichia coli CFT073
ccuggcugcccau

SEQ ID NO: 658574 - RNA, 14 nt, Escherichia coli CFT073
ccuggcuggucagc

SEQ ID NO: 658575 - RNA, 16 nt, Escherichia coli CFT073
ccuggcuggucagcaa

SEQ ID NO: 658576 - RNA, 14 nt, Escherichia coli CFT073
ccugggccaccucu

SEQ ID NO: 658577 - RNA, 18 nt, Escherichia coli CFT073
ccugguuauuucacuuca

SEQ ID NO: 658578 - RNA, 19 nt, Escherichia coli CFT073
ccugguuauuucacuucaa

SEQ ID NO: 658579 - RNA, 22 nt, Escherichia coli CFT073
ccuggugguaucaaggcugaug

SEQ ID NO: 658580 - RNA, 23 nt, Escherichia coli CFT073
ccugguggucgaaaaucugcccg

SEQ ID NO: 658581 - RNA, 21 nt, Escherichia coli CFT073
ccuggaauuucuucggcgggc

SEQ ID NO: 658582 - RNA, 15 nt, Escherichia coli CFT073
ccuggccccuggcug

SEQ ID NO: 658583 - RNA, 17 nt, Escherichia coli CFT073
ccuggcgcugugguggg

SEQ ID NO: 658584 - RNA, 16 nt, Escherichia coli CFT073
ccuggcgcaaaagaga

SEQ ID NO: 658585 - RNA, 23 nt, Escherichia coli CFT073
ccuggcgaauuuguuccccaugc

SEQ ID NO: 658586 - RNA, 14 nt, Escherichia coli CFT073
ccugaucaaucauc

SEQ ID NO: 658587 - RNA, 13 nt, Escherichia coli CFT073
ccugauccauacu

SEQ ID NO: 658588 - RNA, 12 nt, Escherichia coli CFT073
ccugaugaaaaa

SEQ ID NO: 658589 - RNA, 23 nt, Escherichia coli CFT073
ccugaugaauauucucggcugcc

SEQ ID NO: 658590 - RNA, 20 nt, Escherichia coli CFT073
ccugaugacgcagaucccac

SEQ ID NO: 658591 - RNA, 15 nt, Escherichia coli CFT073
ccugaucgacgcgcu

SEQ ID NO: 658592 - RNA, 18 nt, Escherichia coli CFT073
ccugauuaagaucgugca

SEQ ID NO: 658593 - RNA, 19 nt, Escherichia coli CFT073
ccugauuaccuaccaacgc

SEQ ID NO: 658594 - RNA, 21 nt, Escherichia coli CFT073
ccugauuaguggcacacugau

SEQ ID NO: 658595 - RNA, 23 nt, Escherichia coli CFT073
ccugauguagcgugauuuuguag

SEQ ID NO: 658596 - RNA, 20 nt, Escherichia coli CFT073
ccugaugugaaagauaaaac

SEQ ID NO: 658597 - RNA, 16 nt, Escherichia coli CFT073
ccugaugugacgcuug

SEQ ID NO: 658598 - RNA, 14 nt, Escherichia coli CFT073
ccugauggcgcgcc

SEQ ID NO: 658599 - RNA, 19 nt, Escherichia coli CFT073
ccugaugcgguuucaacau

SEQ ID NO: 658600 - RNA, 16 nt, Escherichia coli CFT073
ccugaugcgugcgcca

SEQ ID NO: 658601 - RNA, 19 nt, Escherichia coli CFT073
ccugaugcgacgcuugacg

SEQ ID NO: 658602 - RNA, 22 nt, Escherichia coli CFT073
ccugaugcgacgcuugccgcgu

SEQ ID NO: 658603 - RNA, 18 nt, Escherichia coli CFT073
ccugaugcgaugcuggcg

SEQ ID NO: 658604 - RNA, 22 nt, Escherichia coli CFT073
ccugaugcgacgcgggccgcgu

SEQ ID NO: 658605 - RNA, 18 nt, Escherichia coli CFT073
ccugaugaucuaaaagca

SEQ ID NO: 658606 - RNA, 14 nt, Escherichia coli CFT073
ccugcaaauaaaua

SEQ ID NO: 658607 - RNA, 15 nt, Escherichia coli CFT073
ccugcaaauaaauac

SEQ ID NO: 658608 - RNA, 24 nt, Escherichia coli CFT073
ccugcaacaucaauaaagccgccc

SEQ ID NO: 658609 - RNA, 13 nt, Escherichia coli CFT073
ccugcaacaucac

SEQ ID NO: 658610 - RNA, 17 nt, Escherichia coli CFT073
ccugcaaaaucuguuga

SEQ ID NO: 658611 - RNA, 11 nt, Escherichia coli CFT073
ccugcaaaaua

SEQ ID NO: 658612 - RNA, 22 nt, Escherichia coli CFT073
ccugauuguuuguagccgccaa

SEQ ID NO: 658613 - RNA, 21 nt, Escherichia coli CFT073
ccugcaggaaagcaagaccaa

SEQ ID NO: 658614 - RNA, 23 nt, Escherichia coli CFT073
ccugcagcugcagauaacuggcc

SEQ ID NO: 658615 - RNA, 19 nt, Escherichia coli CFT073
ccugacugucgcuauucaa

SEQ ID NO: 658616 - RNA, 12 nt, Escherichia coli CFT073
ccugacgcugcu

SEQ ID NO: 658617 - RNA, 22 nt, Escherichia coli CFT073
ccugacgcuguuuuuaacacag

SEQ ID NO: 658618 - RNA, 16 nt, Escherichia coli CFT073
ccugacgcaauaacac

SEQ ID NO: 658619 - RNA, 22 nt, Escherichia coli CFT073
ccugacgagcuuucuuauucgc

SEQ ID NO: 658620 - RNA, 15 nt, Escherichia coli CFT073
ccugacgaucaagcg

SEQ ID NO: 658621 - RNA, 17 nt, Escherichia coli CFT073
ccugaccuuaauaaacu

SEQ ID NO: 658622 - RNA, 16 nt, Escherichia coli CFT073
ccugaccggaaagaau

SEQ ID NO: 658623 - RNA, 16 nt, Escherichia coli CFT073
ccugaccuuuuuucag

SEQ ID NO: 658624 - RNA, 12 nt, Escherichia coli CFT073
ccugacauuucc

SEQ ID NO: 658625 - RNA, 22 nt, Escherichia coli CFT073
ccugacaggcgggaagaacggc

SEQ ID NO: 658626 - RNA, 19 nt, Escherichia coli CFT073
ccugaccauuaucaaacag

SEQ ID NO: 658627 - RNA, 21 nt, Escherichia coli CFT073
ccugacccagaccgauacaca

SEQ ID NO: 658628 - RNA, 16 nt, Escherichia coli CFT073
ccucuuccauuucauc

SEQ ID NO: 658629 - RNA, 20 nt, Escherichia coli CFT073
ccucuuccauuucaucgcca

SEQ ID NO: 658630 - RNA, 19 nt, Escherichia coli CFT073
ccucuuccggaaccaccag

SEQ ID NO: 658631 - RNA, 16 nt, Escherichia coli CFT073
ccugaauuugcuccag

SEQ ID NO: 658632 - RNA, 15 nt, Escherichia coli CFT073
ccugauaaccuucca

SEQ ID NO: 658633 - RNA, 21 nt, Escherichia coli CFT073
ccugauaaccuuccagcuucg

SEQ ID NO: 658634 - RNA, 12 nt, Escherichia coli CFT073
ccugauaagacg

SEQ ID NO: 658635 - RNA, 22 nt, Escherichia coli CFT073
ccugauaagacgcgccagcauc

SEQ ID NO: 658636 - RNA, 15 nt, Escherichia coli CFT073
ccugaguaucgaaaa

SEQ ID NO: 658637 - RNA, 22 nt, Escherichia coli CFT073
ccugaguaucgaaaacaucaaa

SEQ ID NO: 658638 - RNA, 19 nt, Escherichia coli CFT073
ccugauacgagcaaaagcc

SEQ ID NO: 658639 - RNA, 15 nt, Escherichia coli CFT073
ccugagccggaguug

SEQ ID NO: 658640 - RNA, 19 nt, Escherichia coli CFT073
ccugagacagacagccuca

SEQ ID NO: 658641 - RNA, 22 nt, Escherichia coli CFT073
ccugagaauuccggcagagaaa

SEQ ID NO: 658642 - RNA, 20 nt, Escherichia coli CFT073
ccugacuuuguaccagcggg

SEQ ID NO: 658643 - RNA, 15 nt, Escherichia coli CFT073
ccugacuguuuuucc

SEQ ID NO: 658644 - RNA, 17 nt, Escherichia coli CFT073
ccugagcagcaaccacu

SEQ ID NO: 658645 - RNA, 11 nt, Escherichia coli CFT073
ccucuaacucu

SEQ ID NO: 658646 - RNA, 18 nt, Escherichia coli CFT073
ccucuaacagaucaucca

SEQ ID NO: 658647 - RNA, 19 nt, Escherichia coli CFT073
ccucuaaaccccaaccacu

SEQ ID NO: 658648 - RNA, 22 nt, Escherichia coli CFT073
ccucugccccgccaacagugcc

SEQ ID NO: 658649 - RNA, 13 nt, Escherichia coli CFT073
ccucugcguuauu

SEQ ID NO: 658650 - RNA, 15 nt, Escherichia coli CFT073
ccucugcgcccagca

SEQ ID NO: 658651 - RNA, 17 nt, Escherichia coli CFT073
ccucuguucagguggcc

SEQ ID NO: 658652 - RNA, 18 nt, Escherichia coli CFT073
ccucuuaaugcaggcagc

SEQ ID NO: 658653 - RNA, 22 nt, Escherichia coli CFT073
ccucuucaggaggagauauuua

SEQ ID NO: 658654 - RNA, 20 nt, Escherichia coli CFT073
ccucuuccagagagguuuuc

SEQ ID NO: 658655 - RNA, 23 nt, Escherichia coli CFT073
ccucuuccagagagguuuucaac

SEQ ID NO: 658656 - RNA, 20 nt, Escherichia coli CFT073
ccucgucaccaccucacccg

SEQ ID NO: 658657 - RNA, 18 nt, Escherichia coli CFT073
ccucgucccaaaagcucg

SEQ ID NO: 658658 - RNA, 12 nt, Escherichia coli CFT073
ccucggcacgcg

SEQ ID NO: 658659 - RNA, 14 nt, Escherichia coli CFT073
ccucagccuucugu

SEQ ID NO: 658660 - RNA, 21 nt, Escherichia coli CFT073
ccucagccgaaacacacaaag

SEQ ID NO: 658661 - RNA, 16 nt, Escherichia coli CFT073
ccucagguugauagaa

SEQ ID NO: 658662 - RNA, 17 nt, Escherichia coli CFT073
ccucagguugauagaaa

SEQ ID NO: 658663 - RNA, 11 nt, Escherichia coli CFT073
ccucagguuca

SEQ ID NO: 658664 - RNA, 17 nt, Escherichia coli CFT073
ccucgccgagcagcugu

SEQ ID NO: 658665 - RNA, 22 nt, Escherichia coli CFT073
ccggucagccaucgccaccgcu

SEQ ID NO: 658666 - RNA, 13 nt, Escherichia coli CFT073
ccggucagcagca

SEQ ID NO: 658667 - RNA, 13 nt, Escherichia coli CFT073
ccggucauuggcc

SEQ ID NO: 658668 - RNA, 16 nt, Escherichia coli CFT073
ccgggugaacugccac

SEQ ID NO: 658669 - RNA, 13 nt, Escherichia coli CFT073
ccgguacgccgcg

SEQ ID NO: 658670 - RNA, 16 nt, Escherichia coli CFT073
ccgguaccuuugaacu

SEQ ID NO: 658671 - RNA, 21 nt, Escherichia coli CFT073
ccgguacaaacaucauccagu

SEQ ID NO: 658672 - RNA, 21 nt, Escherichia coli CFT073
ccgggugcgaugcauccggca

SEQ ID NO: 658673 - RNA, 17 nt, Escherichia coli CFT073
ccgggccgcagagauag

SEQ ID NO: 658674 - RNA, 12 nt, Escherichia coli CFT073
ccgggcaaaugc

SEQ ID NO: 658675 - RNA, 20 nt, Escherichia coli CFT073
ccgggcaaaugcuccccugc

SEQ ID NO: 658676 - RNA, 13 nt, Escherichia coli CFT073
ccgggauugagau

SEQ ID NO: 658677 - RNA, 18 nt, Escherichia coli CFT073
ccgggaucagacgaccca

SEQ ID NO: 658678 - RNA, 18 nt, Escherichia coli CFT073
ccgggccucgcagcggca

SEQ ID NO: 658679 - RNA, 20 nt, Escherichia coli CFT073
ccgggccucgcagcggcagc

SEQ ID NO: 658680 - RNA, 17 nt, Escherichia coli CFT073
ccgggcgaugcagcgca

SEQ ID NO: 658681 - RNA, 18 nt, Escherichia coli CFT073
ccgggggguugccgccac

SEQ ID NO: 658682 - RNA, 13 nt, Escherichia coli CFT073
ccgggguaauucc

SEQ ID NO: 658683 - RNA, 16 nt, Escherichia coli CFT073
ccguaauaucuuccug

SEQ ID NO: 658684 - RNA, 18 nt, Escherichia coli CFT073
ccguaauguugcgccagu

SEQ ID NO: 658685 - RNA, 18 nt, Escherichia coli CFT073
ccguaauuaacaccuuaa

SEQ ID NO: 658686 - RNA, 23 nt, Escherichia coli CFT073
ccguaauuauuacuccacuuccu

SEQ ID NO: 658687 - RNA, 18 nt, Escherichia coli CFT073
ccgguugucgugguuggu

SEQ ID NO: 658688 - RNA, 15 nt, Escherichia coli CFT073
ccgguuucaaaacug

SEQ ID NO: 658689 - RNA, 19 nt, Escherichia coli CFT073
ccgguuucgaacugaugug

SEQ ID NO: 658690 - RNA, 19 nt, Escherichia coli CFT073
ccgguugcagcucugccau

SEQ ID NO: 658691 - RNA, 21 nt, Escherichia coli CFT073
ccgguuggcgacugaugaagu

SEQ ID NO: 658692 - RNA, 20 nt, Escherichia coli CFT073
ccgguuaucacccugugucg

SEQ ID NO: 658693 - RNA, 17 nt, Escherichia coli CFT073
ccgguucacuucacgca

SEQ ID NO: 658694 - RNA, 17 nt, Escherichia coli CFT073
ccgguuacggauuuccc

SEQ ID NO: 658695 - RNA, 22 nt, Escherichia coli CFT073
ccgguguucccguccgcacgcu

SEQ ID NO: 658696 - RNA, 18 nt, Escherichia coli CFT073
ccgguucgucauacucca

SEQ ID NO: 658697 - RNA, 13 nt, Escherichia coli CFT073
ccgguucgcuuuu

SEQ ID NO: 658698 - RNA, 22 nt, Escherichia coli CFT073
ccgucaaagcgccagcgcgccu

SEQ ID NO: 658699 - RNA, 23 nt, Escherichia coli CFT073
ccgucaauccagccgcccagcga

SEQ ID NO: 658700 - RNA, 11 nt, Escherichia coli CFT073
ccgucaacagg

SEQ ID NO: 658701 - RNA, 19 nt, Escherichia coli CFT073
ccgucacaggcacaccgcc

SEQ ID NO: 658702 - RNA, 21 nt, Escherichia coli CFT073
ccgucacaggcacaccgccgc

SEQ ID NO: 658703 - RNA, 14 nt, Escherichia coli CFT073
ccgucaccaguccc

SEQ ID NO: 658704 - RNA, 15 nt, Escherichia coli CFT073
ccguaugauguauau

SEQ ID NO: 658705 - RNA, 12 nt, Escherichia coli CFT073
ccguaugacaaa

SEQ ID NO: 658706 - RNA, 22 nt, Escherichia coli CFT073
ccguaccaucauaagcgccagg

SEQ ID NO: 658707 - RNA, 13 nt, Escherichia coli CFT073
ccguacccagcaa

SEQ ID NO: 658708 - RNA, 14 nt, Escherichia coli CFT073
ccguaccgggcgcg

SEQ ID NO: 658709 - RNA, 17 nt, Escherichia coli CFT073
ccgucaucacgcaggcu

SEQ ID NO: 658710 - RNA, 23 nt, Escherichia coli CFT073
ccgucaucaucggcugcgcuucu

SEQ ID NO: 658711 - RNA, 21 nt, Escherichia coli CFT073
ccgucaguuuuucacccgcaa

SEQ ID NO: 658712 - RNA, 14 nt, Escherichia coli CFT073
ccgucaguugugcc

SEQ ID NO: 658713 - RNA, 17 nt, Escherichia coli CFT073
ccgucaguugugccagu

SEQ ID NO: 658714 - RNA, 19 nt, Escherichia coli CFT073
ccgucagggccugcgugug

SEQ ID NO: 658715 - RNA, 17 nt, Escherichia coli CFT073
ccgucaugucucucaga

SEQ ID NO: 658716 - RNA, 16 nt, Escherichia coli CFT073
ccgucccuacugguaa

SEQ ID NO: 658717 - RNA, 18 nt, Escherichia coli CFT073
ccuacucucgcaugggga

SEQ ID NO: 658718 - RNA, 13 nt, Escherichia coli CFT073
ccuacugcuccua

SEQ ID NO: 658719 - RNA, 19 nt, Escherichia coli CFT073
ccuacacguugaaacuuau

SEQ ID NO: 658720 - RNA, 20 nt, Escherichia coli CFT073
ccuacguuaaaacacacuac

SEQ ID NO: 658721 - RNA, 19 nt, Escherichia coli CFT073
ccuacagagcugauuuccg

SEQ ID NO: 658722 - RNA, 17 nt, Escherichia coli CFT073
ccuacaauuucagugau

SEQ ID NO: 658723 - RNA, 19 nt, Escherichia coli CFT073
ccuacaaguccguugaaau

SEQ ID NO: 658724 - RNA, 18 nt, Escherichia coli CFT073
ccuacacauuaucucaac

SEQ ID NO: 658725 - RNA, 22 nt, Escherichia coli CFT073
ccuaucaucgcggcacacagca

SEQ ID NO: 658726 - RNA, 21 nt, Escherichia coli CFT073
ccucacgaagcguugucagcc

SEQ ID NO: 658727 - RNA, 15 nt, Escherichia coli CFT073
ccucacccuaacccu

SEQ ID NO: 658728 - RNA, 15 nt, Escherichia coli CFT073
ccucacuuugauuua

SEQ ID NO: 658729 - RNA, 19 nt, Escherichia coli CFT073
ccucagaaaucagauaaaa

SEQ ID NO: 658730 - RNA, 18 nt, Escherichia coli CFT073
ccucacuuaaagcaacac

SEQ ID NO: 658731 - RNA, 21 nt, Escherichia coli CFT073
ccucacagagcgcuuauacac

SEQ ID NO: 658732 - RNA, 12 nt, Escherichia coli CFT073
ccucacagaggu

SEQ ID NO: 658733 - RNA, 20 nt, Escherichia coli CFT073
ccucacagcuaaucaucauc

SEQ ID NO: 658734 - RNA, 20 nt, Escherichia coli CFT073
ccucaaucagcggcucaugu

SEQ ID NO: 658735 - RNA, 22 nt, Escherichia coli CFT073
ccucaaugaaucgcagucucuu

SEQ ID NO: 658736 - RNA, 12 nt, Escherichia coli CFT073
ccucaauaauca

SEQ ID NO: 658737 - RNA, 21 nt, Escherichia coli CFT073
ccucaauggcagcaucacgca

SEQ ID NO: 658738 - RNA, 23 nt, Escherichia coli CFT073
ccucaagcguuugcggcuguucc

SEQ ID NO: 658739 - RNA, 16 nt, Escherichia coli CFT073
ccuauuuaaauccuac

SEQ ID NO: 658740 - RNA, 19 nt, Escherichia coli CFT073
ccucaacgaugcgaccgcc

SEQ ID NO: 658741 - RNA, 20 nt, Escherichia coli CFT073
ccgugcagguucuuuuaaac

SEQ ID NO: 658742 - RNA, 19 nt, Escherichia coli CFT073
ccgugaugauuucgauccg

SEQ ID NO: 658743 - RNA, 13 nt, Escherichia coli CFT073
ccgucgcgccagg

SEQ ID NO: 658744 - RNA, 15 nt, Escherichia coli CFT073
ccgucgcgccaggcg

SEQ ID NO: 658745 - RNA, 21 nt, Escherichia coli CFT073
ccgucgcaauacccugaccca

SEQ ID NO: 658746 - RNA, 12 nt, Escherichia coli CFT073
ccgucgcauggg

SEQ ID NO: 658747 - RNA, 21 nt, Escherichia coli CFT073
ccguguuuuugugccagagca

SEQ ID NO: 658748 - RNA, 14 nt, Escherichia coli CFT073
ccguuaaccaugca

SEQ ID NO: 658749 - RNA, 16 nt, Escherichia coli CFT073
ccguuaacuaacggua

SEQ ID NO: 658750 - RNA, 13 nt, Escherichia coli CFT073
ccguuaagcugga

SEQ ID NO: 658751 - RNA, 15 nt, Escherichia coli CFT073
ccguuaccggacggc

SEQ ID NO: 658752 - RNA, 21 nt, Escherichia coli CFT073
ccguuacggaccacgcacagc

SEQ ID NO: 658753 - RNA, 20 nt, Escherichia coli CFT073
ccguugugcgauccacgcca

SEQ ID NO: 658754 - RNA, 14 nt, Escherichia coli CFT073
ccuaaaccaucagc

SEQ ID NO: 658755 - RNA, 18 nt, Escherichia coli CFT073
ccuaaaagcacgccagac

SEQ ID NO: 658756 - RNA, 18 nt, Escherichia coli CFT073
ccguugugcugaugucag

SEQ ID NO: 658757 - RNA, 19 nt, Escherichia coli CFT073
ccguucuuaagauauaaag

SEQ ID NO: 658758 - RNA, 12 nt, Escherichia coli CFT073
ccguucuucccg

SEQ ID NO: 658759 - RNA, 14 nt, Escherichia coli CFT073
ccuacaaaaucaug

SEQ ID NO: 658760 - RNA, 21 nt, Escherichia coli CFT073
ccuaagaaccagaauuuccag

SEQ ID NO: 658761 - RNA, 17 nt, Escherichia coli CFT073
ccuaaauggaaaauugg

SEQ ID NO: 658762 - RNA, 20 nt, Escherichia coli CFT073
ccuaaacgcgccgcuuuuuc

SEQ ID NO: 658763 - RNA, 14 nt, Escherichia coli CFT073
ccuaaacccugagu

SEQ ID NO: 658764 - RNA, 11 nt, Escherichia coli CFT073
ccuaaauaacc

SEQ ID NO: 658765 - RNA, 16 nt, Escherichia coli CFT073
ccuaaagcuaucccuu

SEQ ID NO: 658766 - RNA, 13 nt, Escherichia coli CFT073
ccuaaaggcaaaa

SEQ ID NO: 658767 - RNA, 19 nt, Escherichia coli CFT073
ccgcugauugcuggcgggc

SEQ ID NO: 658768 - RNA, 14 nt, Escherichia coli CFT073
ccgcuccuucaccu

SEQ ID NO: 658769 - RNA, 13 nt, Escherichia coli CFT073
ccgcuccgccauc

SEQ ID NO: 658770 - RNA, 23 nt, Escherichia coli CFT073
ccgcuccgccaucuucuugcagc

SEQ ID NO: 658771 - RNA, 18 nt, Escherichia coli CFT073
ccgcucgaaguuuuccuc

SEQ ID NO: 658772 - RNA, 13 nt, Escherichia coli CFT073
ccgcucgccgcag

SEQ ID NO: 658773 - RNA, 21 nt, Escherichia coli CFT073
ccgcugcgauuucagcgccgc

SEQ ID NO: 658774 - RNA, 17 nt, Escherichia coli CFT073
ccgcuguaauugccgcu

SEQ ID NO: 658775 - RNA, 21 nt, Escherichia coli CFT073
ccgcuucgcguaaaauugcag

SEQ ID NO: 658776 - RNA, 11 nt, Escherichia coli CFT073
ccgcuucgccu

SEQ ID NO: 658777 - RNA, 16 nt, Escherichia coli CFT073
ccgcuucgccugcccc

SEQ ID NO: 658778 - RNA, 13 nt, Escherichia coli CFT073
ccgcuucgcccgc

SEQ ID NO: 658779 - RNA, 15 nt, Escherichia coli CFT073
ccgcgguucccagcg

SEQ ID NO: 658780 - RNA, 14 nt, Escherichia coli CFT073
ccgcgugacgcugg

SEQ ID NO: 658781 - RNA, 18 nt, Escherichia coli CFT073
ccgcgugaugcggcaucu

SEQ ID NO: 658782 - RNA, 18 nt, Escherichia coli CFT073
ccgcgugcgcuggacgcc

SEQ ID NO: 658783 - RNA, 22 nt, Escherichia coli CFT073
ccgcuaguucucgggcggcagg

SEQ ID NO: 658784 - RNA, 15 nt, Escherichia coli CFT073
ccgcuacucugaccc

SEQ ID NO: 658785 - RNA, 23 nt, Escherichia coli CFT073
ccgcgcggguggugcgcaccagg

SEQ ID NO: 658786 - RNA, 18 nt, Escherichia coli CFT073
ccgcgcuaccacuuccca

SEQ ID NO: 658787 - RNA, 16 nt, Escherichia coli CFT073
ccgcgcuuucuucuuc

SEQ ID NO: 658788 - RNA, 19 nt, Escherichia coli CFT073
ccgcgcuuucuggcgcaga

SEQ ID NO: 658789 - RNA, 22 nt, Escherichia coli CFT073
ccgcgcugcuguagcaguucca

SEQ ID NO: 658790 - RNA, 21 nt, Escherichia coli CFT073
ccgcgcaguaccacuucaucc

SEQ ID NO: 658791 - RNA, 20 nt, Escherichia coli CFT073
ccgcgcgcaccguccagcgu

SEQ ID NO: 658792 - RNA, 17 nt, Escherichia coli CFT073
ccgcgcggcgcaggcgc

SEQ ID NO: 658793 - RNA, 16 nt, Escherichia coli CFT073
ccgccuuucacgccgg

SEQ ID NO: 658794 - RNA, 17 nt, Escherichia coli CFT073
ccgccuggugcaggcgu

SEQ ID NO: 658795 - RNA, 15 nt, Escherichia coli CFT073
ccgccuguugcccuu

SEQ ID NO: 658796 - RNA, 21 nt, Escherichia coli CFT073
ccgccuggagguuuagccaaa

SEQ ID NO: 658797 - RNA, 17 nt, Escherichia coli CFT073
ccgccugcgugcaguuc

SEQ ID NO: 658798 - RNA, 18 nt, Escherichia coli CFT073
ccgccgauggugcagcag

SEQ ID NO: 658799 - RNA, 17 nt, Escherichia coli CFT073
ccgcgaaguuuuuccag

SEQ ID NO: 658800 - RNA, 18 nt, Escherichia coli CFT073
ccgcgaauuaugcagccu

SEQ ID NO: 658801 - RNA, 20 nt, Escherichia coli CFT073
ccgcgaagcagcuccagaau

SEQ ID NO: 658802 - RNA, 16 nt, Escherichia coli CFT073
ccgcgauuuguuucaa

SEQ ID NO: 658803 - RNA, 16 nt, Escherichia coli CFT073
ccgcgacgacgacagg

SEQ ID NO: 658804 - RNA, 22 nt, Escherichia coli CFT073
ccgcgauaccacccgcagugau

SEQ ID NO: 658805 - RNA, 15 nt, Escherichia coli CFT073
ccgcgaccugaucca

SEQ ID NO: 658806 - RNA, 17 nt, Escherichia coli CFT073
ccggagguuuuucaaau

SEQ ID NO: 658807 - RNA, 18 nt, Escherichia coli CFT073
ccggagcccuacaaacca

SEQ ID NO: 658808 - RNA, 14 nt, Escherichia coli CFT073
ccgcuucugcagcu

SEQ ID NO: 658809 - RNA, 19 nt, Escherichia coli CFT073
ccggaccggucggggccag

SEQ ID NO: 658810 - RNA, 16 nt, Escherichia coli CFT073
ccggaugguaugccau

SEQ ID NO: 658811 - RNA, 14 nt, Escherichia coli CFT073
ccggauucaagcau

SEQ ID NO: 658812 - RNA, 22 nt, Escherichia coli CFT073
ccggaugcggcgugaacgccuu

SEQ ID NO: 658813 - RNA, 13 nt, Escherichia coli CFT073
ccggauggcagag

SEQ ID NO: 658814 - RNA, 17 nt, Escherichia coli CFT073
ccggaugcgcuucuuua

SEQ ID NO: 658815 - RNA, 20 nt, Escherichia coli CFT073
ccggaugcgaacauccggca

SEQ ID NO: 658816 - RNA, 15 nt, Escherichia coli CFT073
ccggauaucggcagc

SEQ ID NO: 658817 - RNA, 16 nt, Escherichia coli CFT073
ccggaugcaccaucuc

SEQ ID NO: 658818 - RNA, 15 nt, Escherichia coli CFT073
ccggaucgaugccaa

SEQ ID NO: 658819 - RNA, 20 nt, Escherichia coli CFT073
ccggcaaucugcuggcaaac

SEQ ID NO: 658820 - RNA, 20 nt, Escherichia coli CFT073
ccggcaauuagcuggaauaa

SEQ ID NO: 658821 - RNA, 14 nt, Escherichia coli CFT073
ccggcacaaaacug

SEQ ID NO: 658822 - RNA, 23 nt, Escherichia coli CFT073
ccggcauaaacaaagcgcacuau

SEQ ID NO: 658823 - RNA, 15 nt, Escherichia coli CFT073
ccggcauaauaagcc

SEQ ID NO: 658824 - RNA, 18 nt, Escherichia coli CFT073
ccggcaguauuaccagac

SEQ ID NO: 658825 - RNA, 15 nt, Escherichia coli CFT073
ccggcaccagcgcug

SEQ ID NO: 658826 - RNA, 16 nt, Escherichia coli CFT073
ccggcaucuuuaacgu

SEQ ID NO: 658827 - RNA, 15 nt, Escherichia coli CFT073
ccggcaugaacaaaa

SEQ ID NO: 658828 - RNA, 17 nt, Escherichia coli CFT073
ccggccccuggucgcgc

SEQ ID NO: 658829 - RNA, 18 nt, Escherichia coli CFT073
ccggccagcaugccugug

SEQ ID NO: 658830 - RNA, 19 nt, Escherichia coli CFT073
ccggcgacacaucuaaugc

SEQ ID NO: 658831 - RNA, 18 nt, Escherichia coli CFT073
ccggccuacgggaacagu

SEQ ID NO: 658832 - RNA, 16 nt, Escherichia coli CFT073
ccggcgcacuggcgcu

SEQ ID NO: 658833 - RNA, 18 nt, Escherichia coli CFT073
ccggcgauaucccaggca

SEQ ID NO: 658834 - RNA, 16 nt, Escherichia coli CFT073
ccgcccuuuuucuuau

SEQ ID NO: 658835 - RNA, 19 nt, Escherichia coli CFT073
ccgccaguuugcaggccaa

SEQ ID NO: 658836 - RNA, 22 nt, Escherichia coli CFT073
ccgccaguguagcgauuucacg

SEQ ID NO: 658837 - RNA, 12 nt, Escherichia coli CFT073
ccgccauccagg

SEQ ID NO: 658838 - RNA, 20 nt, Escherichia coli CFT073
ccgcccagaccgugcgcagc

SEQ ID NO: 658839 - RNA, 16 nt, Escherichia coli CFT073
ccgccauuuccagcgu

SEQ ID NO: 658840 - RNA, 14 nt, Escherichia coli CFT073
ccgccagcagcagc

SEQ ID NO: 658841 - RNA, 16 nt, Escherichia coli CFT073
ccgccagcaggaacga

SEQ ID NO: 658842 - RNA, 19 nt, Escherichia coli CFT073
ccgccagcaugccgccaag

SEQ ID NO: 658843 - RNA, 18 nt, Escherichia coli CFT073
ccgccagcgccaaagcca

SEQ ID NO: 658844 - RNA, 22 nt, Escherichia coli CFT073
ccgccagcgccaucgguagcac

SEQ ID NO: 658845 - RNA, 19 nt, Escherichia coli CFT073
ccgccagcuucgcuuccca

SEQ ID NO: 658846 - RNA, 15 nt, Escherichia coli CFT073
ccgccagcacagcca

SEQ ID NO: 658847 - RNA, 24 nt, Escherichia coli CFT073
ccgccagaauacccgaagcgccaa

SEQ ID NO: 658848 - RNA, 17 nt, Escherichia coli CFT073
ccgccagaauccccggc

SEQ ID NO: 658849 - RNA, 21 nt, Escherichia coli CFT073
ccgccagacguccggcgcugc

SEQ ID NO: 658850 - RNA, 22 nt, Escherichia coli CFT073
ccgccacgguaucaagcccgcc

SEQ ID NO: 658851 - RNA, 23 nt, Escherichia coli CFT073
ccgccacuugagccgccaccaga

SEQ ID NO: 658852 - RNA, 14 nt, Escherichia coli CFT073
ccgccaccgccaga

SEQ ID NO: 658853 - RNA, 15 nt, Escherichia coli CFT073
ccgccaccgccagaa

SEQ ID NO: 658854 - RNA, 20 nt, Escherichia coli CFT073
ccgcaaucagcguuucgcca

SEQ ID NO: 658855 - RNA, 20 nt, Escherichia coli CFT073
ccgauggcgggauuuuuagc

SEQ ID NO: 658856 - RNA, 16 nt, Escherichia coli CFT073
ccgcaauuccgcccgu

SEQ ID NO: 658857 - RNA, 16 nt, Escherichia coli CFT073
ccgcaaucgcggcagc

SEQ ID NO: 658858 - RNA, 20 nt, Escherichia coli CFT073
ccgcaccgacgguguggaaa

SEQ ID NO: 658859 - RNA, 15 nt, Escherichia coli CFT073
ccgcacaauacauag

SEQ ID NO: 658860 - RNA, 19 nt, Escherichia coli CFT073
ccgcacauacuggacacug

SEQ ID NO: 658861 - RNA, 13 nt, Escherichia coli CFT073
ccgcaccaaccau

SEQ ID NO: 658862 - RNA, 17 nt, Escherichia coli CFT073
ccgcagcaacuacagca

SEQ ID NO: 658863 - RNA, 16 nt, Escherichia coli CFT073
ccgcagaccuucugcc

SEQ ID NO: 658864 - RNA, 19 nt, Escherichia coli CFT073
ccgcagccggaaaaccauc

SEQ ID NO: 658865 - RNA, 18 nt, Escherichia coli CFT073
ccgcauauuccaccacuu

SEQ ID NO: 658866 - RNA, 15 nt, Escherichia coli CFT073
ccgcagcguccagcg

SEQ ID NO: 658867 - RNA, 16 nt, Escherichia coli CFT073
ccgcagcguccagcgc

SEQ ID NO: 658868 - RNA, 15 nt, Escherichia coli CFT073
ccgcaucaauuaccu

SEQ ID NO: 658869 - RNA, 20 nt, Escherichia coli CFT073
ccgcaucauguaaaucaauu

SEQ ID NO: 658870 - RNA, 17 nt, Escherichia coli CFT073
ccgcauccggcgacagg

SEQ ID NO: 658871 - RNA, 21 nt, Escherichia coli CFT073
ccgcauccggcguaaacaacg

SEQ ID NO: 658872 - RNA, 17 nt, Escherichia coli CFT073
ccgcauccggcuuaaau

SEQ ID NO: 658873 - RNA, 14 nt, Escherichia coli CFT073
ccgccaaacgcggu

SEQ ID NO: 658874 - RNA, 24 nt, Escherichia coli CFT073
ccgccaaacugugcaccgcccugc

SEQ ID NO: 658875 - RNA, 16 nt, Escherichia coli CFT073
ccgccaaucgccacgc

SEQ ID NO: 658876 - RNA, 11 nt, Escherichia coli CFT073
ccgccaccacg

SEQ ID NO: 658877 - RNA, 12 nt, Escherichia coli CFT073
ccgccaccagaa

SEQ ID NO: 658878 - RNA, 19 nt, Escherichia coli CFT073
ccgccaccagaaccgccgc

SEQ ID NO: 658879 - RNA, 16 nt, Escherichia coli CFT073
ccgaggcauucagcca

SEQ ID NO: 658880 - RNA, 17 nt, Escherichia coli CFT073
ccgaggcauucagccag

SEQ ID NO: 658881 - RNA, 15 nt, Escherichia coli CFT073
ccgaggccaaaacca

SEQ ID NO: 658882 - RNA, 22 nt, Escherichia coli CFT073
ccgagcggcaccacgagcggcg

SEQ ID NO: 658883 - RNA, 17 nt, Escherichia coli CFT073
ccgagcggccaaaggga

SEQ ID NO: 658884 - RNA, 23 nt, Escherichia coli CFT073
ccgagucgccuuuuuccaucguc

SEQ ID NO: 658885 - RNA, 14 nt, Escherichia coli CFT073
ccgauccggcacca

SEQ ID NO: 658886 - RNA, 17 nt, Escherichia coli CFT073
ccgauaauuccucccgu

SEQ ID NO: 658887 - RNA, 17 nt, Escherichia coli CFT073
ccgacuucagccagugc

SEQ ID NO: 658888 - RNA, 18 nt, Escherichia coli CFT073
ccgacuucaguggaauca

SEQ ID NO: 658889 - RNA, 13 nt, Escherichia coli CFT073
ccgacuuauucuu

SEQ ID NO: 658890 - RNA, 19 nt, Escherichia coli CFT073
ccgacuggcaucuguuauc

SEQ ID NO: 658891 - RNA, 12 nt, Escherichia coli CFT073
ccgacugccugc

SEQ ID NO: 658892 - RNA, 17 nt, Escherichia coli CFT073
ccgacugcgccaauacc

SEQ ID NO: 658893 - RNA, 20 nt, Escherichia coli CFT073
ccgacugacgcucugcuuua

SEQ ID NO: 658894 - RNA, 16 nt, Escherichia coli CFT073
ccgacgguauuaacuc

SEQ ID NO: 658895 - RNA, 22 nt, Escherichia coli CFT073
ccgagccaaacucauccaccac

SEQ ID NO: 658896 - RNA, 11 nt, Escherichia coli CFT073
ccgagcagcca

SEQ ID NO: 658897 - RNA, 13 nt, Escherichia coli CFT073
ccgagcagccacu

SEQ ID NO: 658898 - RNA, 14 nt, Escherichia coli CFT073
ccgagcagccacug

SEQ ID NO: 658899 - RNA, 13 nt, Escherichia coli CFT073
ccgagcaggaugc

SEQ ID NO: 658900 - RNA, 20 nt, Escherichia coli CFT073
ccgaccaucggcacgaccag

SEQ ID NO: 658901 - RNA, 15 nt, Escherichia coli CFT073
ccgaccgcaaggaag

SEQ ID NO: 658902 - RNA, 12 nt, Escherichia coli CFT073
ccgaccucaaca

SEQ ID NO: 658903 - RNA, 13 nt, Escherichia coli CFT073
cccuuucugcauc

SEQ ID NO: 658904 - RNA, 15 nt, Escherichia coli CFT073
cccuuucugcaugaa

SEQ ID NO: 658905 - RNA, 12 nt, Escherichia coli CFT073
cccuuucugcug

SEQ ID NO: 658906 - RNA, 18 nt, Escherichia coli CFT073
cccuuguugugccagacc

SEQ ID NO: 658907 - RNA, 15 nt, Escherichia coli CFT073
cccuugucgcagcau

SEQ ID NO: 658908 - RNA, 17 nt, Escherichia coli CFT073
cccuuucuuauuuuucu

SEQ ID NO: 658909 - RNA, 12 nt, Escherichia coli CFT073
cccuuuuagcac

SEQ ID NO: 658910 - RNA, 18 nt, Escherichia coli CFT073
ccgaauuaaacaacgcca

SEQ ID NO: 658911 - RNA, 16 nt, Escherichia coli CFT073
ccgacaaacagcgaga

SEQ ID NO: 658912 - RNA, 22 nt, Escherichia coli CFT073
ccgacaaauguguucagcgaca

SEQ ID NO: 658913 - RNA, 16 nt, Escherichia coli CFT073
ccgacaccggcagaga

SEQ ID NO: 658914 - RNA, 22 nt, Escherichia coli CFT073
ccgaagguagccuuuuuuauuu

SEQ ID NO: 658915 - RNA, 20 nt, Escherichia coli CFT073
ccgaagccguuggucaucau

SEQ ID NO: 658916 - RNA, 17 nt, Escherichia coli CFT073
ccgacauuaucaccgac

SEQ ID NO: 658917 - RNA, 17 nt, Escherichia coli CFT073
ccgacauuucugcugcc

SEQ ID NO: 658918 - RNA, 10 nt, Escherichia coli CFT073
ccgaccacuu

SEQ ID NO: 658919 - RNA, 13 nt, Escherichia coli CFT073
ccgaccacuucca

SEQ ID NO: 658920 - RNA, 16 nt, Escherichia coli CFT073
ccgaccaucgccagcu

SEQ ID NO: 658921 - RNA, 19 nt, Escherichia coli CFT073
ccgaccaucgccagcucaa

SEQ ID NO: 658922 - RNA, 23 nt, Escherichia coli CFT073
ccgacauaggccagccgccgcuc

SEQ ID NO: 658923 - RNA, 13 nt, Escherichia coli CFT073
ccgacacuggcag

SEQ ID NO: 658924 - RNA, 18 nt, Escherichia coli CFT073
cccgcgauaaaaauccug

SEQ ID NO: 658925 - RNA, 13 nt, Escherichia coli CFT073
cccgccugcugcg

SEQ ID NO: 658926 - RNA, 15 nt, Escherichia coli CFT073
cccgccuucacuucc

SEQ ID NO: 658927 - RNA, 19 nt, Escherichia coli CFT073
cccgccuucacuuccggca

SEQ ID NO: 658928 - RNA, 21 nt, Escherichia coli CFT073
cccgcgccaaccaugccgccc

SEQ ID NO: 658929 - RNA, 18 nt, Escherichia coli CFT073
cccgcgauggcuggaauc

SEQ ID NO: 658930 - RNA, 20 nt, Escherichia coli CFT073
cccgccggugagcacaucag

SEQ ID NO: 658931 - RNA, 15 nt, Escherichia coli CFT073
cccgccugauagacc

SEQ ID NO: 658932 - RNA, 12 nt, Escherichia coli CFT073
cccgcagccacg

SEQ ID NO: 658933 - RNA, 18 nt, Escherichia coli CFT073
cccgcagccagcacugcc

SEQ ID NO: 658934 - RNA, 17 nt, Escherichia coli CFT073
cccgcagccgauuuuau

SEQ ID NO: 658935 - RNA, 16 nt, Escherichia coli CFT073
cccgcauuuacucuca

SEQ ID NO: 658936 - RNA, 13 nt, Escherichia coli CFT073
cccgccagaccag

SEQ ID NO: 658937 - RNA, 14 nt, Escherichia coli CFT073
cccgccaccggcuu

SEQ ID NO: 658938 - RNA, 15 nt, Escherichia coli CFT073
cccgccccugacagg

SEQ ID NO: 658939 - RNA, 23 nt, Escherichia coli CFT073
cccgccagugcuuucagugccug

SEQ ID NO: 658940 - RNA, 14 nt, Escherichia coli CFT073
cccgccagcgucuc

SEQ ID NO: 658941 - RNA, 19 nt, Escherichia coli CFT073
cccgccagcacgaccgcca

SEQ ID NO: 658942 - RNA, 19 nt, Escherichia coli CFT073
cccgccagcaugccgccaa

SEQ ID NO: 658943 - RNA, 23 nt, Escherichia coli CFT073
cccggaagccaccacgccaagaa

SEQ ID NO: 658944 - RNA, 20 nt, Escherichia coli CFT073
cccgcuuuuuugucaccuuu

SEQ ID NO: 658945 - RNA, 17 nt, Escherichia coli CFT073
cccggaagcaucaaacg

SEQ ID NO: 658946 - RNA, 12 nt, Escherichia coli CFT073
cccggaagccac

SEQ ID NO: 658947 - RNA, 13 nt, Escherichia coli CFT073
cccggaagccacc

SEQ ID NO: 658948 - RNA, 12 nt, Escherichia coli CFT073
cccgcuucgccc

SEQ ID NO: 658949 - RNA, 15 nt, Escherichia coli CFT073
cccgcuucgcccgcc

SEQ ID NO: 658950 - RNA, 16 nt, Escherichia coli CFT073
cccgcuucgcccgcca

SEQ ID NO: 658951 - RNA, 17 nt, Escherichia coli CFT073
cccggcaaaaaacacuc

SEQ ID NO: 658952 - RNA, 22 nt, Escherichia coli CFT073
cccggcaaaaaacacucuucaa

SEQ ID NO: 658953 - RNA, 23 nt, Escherichia coli CFT073
cccggcaaaauagaguguuccuc

SEQ ID NO: 658954 - RNA, 14 nt, Escherichia coli CFT073
cccggauggcaaca

SEQ ID NO: 658955 - RNA, 15 nt, Escherichia coli CFT073
cccggcaaucgccag

SEQ ID NO: 658956 - RNA, 22 nt, Escherichia coli CFT073
cccggcaaucgccagauccgcu

SEQ ID NO: 658957 - RNA, 23 nt, Escherichia coli CFT073
cccggcaagaaauaccgaagagu

SEQ ID NO: 658958 - RNA, 20 nt, Escherichia coli CFT073
cccggcacauggccgggguu

SEQ ID NO: 658959 - RNA, 16 nt, Escherichia coli CFT073
cccggcaccaaucacc

SEQ ID NO: 658960 - RNA, 21 nt, Escherichia coli CFT073
cccggcaccaaucaccgccaa

SEQ ID NO: 658961 - RNA, 12 nt, Escherichia coli CFT073
cccggcagagaa

SEQ ID NO: 658962 - RNA, 15 nt, Escherichia coli CFT073
cccggcagagaaaau

SEQ ID NO: 658963 - RNA, 16 nt, Escherichia coli CFT073
cccggcauugacgaug

SEQ ID NO: 658964 - RNA, 22 nt, Escherichia coli CFT073
cccggcauugacgaugccgucg

SEQ ID NO: 658965 - RNA, 17 nt, Escherichia coli CFT073
cccggccacagcgccag

SEQ ID NO: 658966 - RNA, 24 nt, Escherichia coli CFT073
cccggccaguacgcgggcaacgcc

SEQ ID NO: 658967 - RNA, 18 nt, Escherichia coli CFT073
cccggccauacccgccag

SEQ ID NO: 658968 - RNA, 17 nt, Escherichia coli CFT073
cccgcggcgcagcucca

SEQ ID NO: 658969 - RNA, 19 nt, Escherichia coli CFT073
cccgcguuucgcugcgucu

SEQ ID NO: 658970 - RNA, 14 nt, Escherichia coli CFT073
cccgcuaacugaua

SEQ ID NO: 658971 - RNA, 12 nt, Escherichia coli CFT073
cccgcuucaucg

SEQ ID NO: 658972 - RNA, 11 nt, Escherichia coli CFT073
cccgcuuccag

SEQ ID NO: 658973 - RNA, 20 nt, Escherichia coli CFT073
cccgcucgaaguuuuccuca

SEQ ID NO: 658974 - RNA, 12 nt, Escherichia coli CFT073
cccgcuccagcu

SEQ ID NO: 658975 - RNA, 13 nt, Escherichia coli CFT073
cccgcucauaaua

SEQ ID NO: 658976 - RNA, 22 nt, Escherichia coli CFT073
cccgcuaccugccgccaccaug

SEQ ID NO: 658977 - RNA, 22 nt, Escherichia coli CFT073
cccgcuaaugcgacccacgccc

SEQ ID NO: 658978 - RNA, 23 nt, Escherichia coli CFT073
cccgcuaaugcgacccacgcccc

SEQ ID NO: 658979 - RNA, 20 nt, Escherichia coli CFT073
cccguaccgguugucguggu

SEQ ID NO: 658980 - RNA, 12 nt, Escherichia coli CFT073
cccguagcccau

SEQ ID NO: 658981 - RNA, 21 nt, Escherichia coli CFT073
cccgguuuaccaucacuuugc

SEQ ID NO: 658982 - RNA, 17 nt, Escherichia coli CFT073
cccgguuucucuucugc

SEQ ID NO: 658983 - RNA, 13 nt, Escherichia coli CFT073
cccguaaaccaag

SEQ ID NO: 658984 - RNA, 20 nt, Escherichia coli CFT073
cccgucaacggugcuuuaau

SEQ ID NO: 658985 - RNA, 12 nt, Escherichia coli CFT073
cccguccccuga

SEQ ID NO: 658986 - RNA, 13 nt, Escherichia coli CFT073
cccgugucccagg

SEQ ID NO: 658987 - RNA, 23 nt, Escherichia coli CFT073
cccguguuuuugugccagagcac

SEQ ID NO: 658988 - RNA, 15 nt, Escherichia coli CFT073
cccguuucaccguga

SEQ ID NO: 658989 - RNA, 20 nt, Escherichia coli CFT073
cccguugcuucuagugccug

SEQ ID NO: 658990 - RNA, 20 nt, Escherichia coli CFT073
cccguuguaaaugcugcucc

SEQ ID NO: 658991 - RNA, 12 nt, Escherichia coli CFT073
cccgugcugcuu

SEQ ID NO: 658992 - RNA, 14 nt, Escherichia coli CFT073
cccuaacaucaucc

SEQ ID NO: 658993 - RNA, 22 nt, Escherichia coli CFT073
cccguuuuuagauuguuuucaa

SEQ ID NO: 658994 - RNA, 22 nt, Escherichia coli CFT073
cccuaauaccguuccaacgcca

SEQ ID NO: 658995 - RNA, 18 nt, Escherichia coli CFT073
cccuaaauaaacaccagc

SEQ ID NO: 658996 - RNA, 14 nt, Escherichia coli CFT073
cccuaacucuuuca

SEQ ID NO: 658997 - RNA, 17 nt, Escherichia coli CFT073
cccuacucucugugcug

SEQ ID NO: 658998 - RNA, 20 nt, Escherichia coli CFT073
cccuacgcgauaaaaaaccc

SEQ ID NO: 658999 - RNA, 17 nt, Escherichia coli CFT073
cccuacuccaccuuuga

SEQ ID NO: 659000 - RNA, 15 nt, Escherichia coli CFT073
cccuauuuaaagcac

SEQ ID NO: 659001 - RNA, 21 nt, Escherichia coli CFT073
cccuauuuaaagcacaaaaac

SEQ ID NO: 659002 - RNA, 19 nt, Escherichia coli CFT073
cccucaaacgccagcaugu

SEQ ID NO: 659003 - RNA, 16 nt, Escherichia coli CFT073
cccucaagccacuucc

SEQ ID NO: 659004 - RNA, 19 nt, Escherichia coli CFT073
cccucaauaaucauucgcc

SEQ ID NO: 659005 - RNA, 22 nt, Escherichia coli CFT073
cccucaauaaucauucgcccgc

SEQ ID NO: 659006 - RNA, 20 nt, Escherichia coli CFT073
cccucaacuugcucaagcca

SEQ ID NO: 659007 - RNA, 15 nt, Escherichia coli CFT073
cccggcgcagcgcgc

SEQ ID NO: 659008 - RNA, 22 nt, Escherichia coli CFT073
cccggccccuggucgcgcggca

SEQ ID NO: 659009 - RNA, 20 nt, Escherichia coli CFT073
cccggcguggugcagccgcc

SEQ ID NO: 659010 - RNA, 15 nt, Escherichia coli CFT073
cccggcuuugcaagc

SEQ ID NO: 659011 - RNA, 19 nt, Escherichia coli CFT073
cccggcuuuuuuacgccug

SEQ ID NO: 659012 - RNA, 14 nt, Escherichia coli CFT073
cccggcuuccugca

SEQ ID NO: 659013 - RNA, 16 nt, Escherichia coli CFT073
cccggcuuccugcagc

SEQ ID NO: 659014 - RNA, 19 nt, Escherichia coli CFT073
cccggcuuccugcagcgug

SEQ ID NO: 659015 - RNA, 13 nt, Escherichia coli CFT073
cccgggcuuuauc

SEQ ID NO: 659016 - RNA, 23 nt, Escherichia coli CFT073
cccggucagcagcaccaccgccc

SEQ ID NO: 659017 - RNA, 22 nt, Escherichia coli CFT073
cccgguauccaucagacuuugc

SEQ ID NO: 659018 - RNA, 13 nt, Escherichia coli CFT073
cccggugccgccg

SEQ ID NO: 659019 - RNA, 19 nt, Escherichia coli CFT073
cccggugaccgucgagcag

SEQ ID NO: 659020 - RNA, 17 nt, Escherichia coli CFT073
cccggucguugucuggc

SEQ ID NO: 659021 - RNA, 17 nt, Escherichia coli CFT073
ccccgcuucgcccgcca

SEQ ID NO: 659022 - RNA, 22 nt, Escherichia coli CFT073
ccccgcgacagaagaggagagu

SEQ ID NO: 659023 - RNA, 13 nt, Escherichia coli CFT073
ccccuucugccgc

SEQ ID NO: 659024 - RNA, 11 nt, Escherichia coli CFT073
ccccugcccca

SEQ ID NO: 659025 - RNA, 14 nt, Escherichia coli CFT073
ccccugccccagag

SEQ ID NO: 659026 - RNA, 20 nt, Escherichia coli CFT073
ccccugccccaucugcccca

SEQ ID NO: 659027 - RNA, 17 nt, Escherichia coli CFT073
ccccuuucgaaaucauu

SEQ ID NO: 659028 - RNA, 15 nt, Escherichia coli CFT073
ccccugccagaagca

SEQ ID NO: 659029 - RNA, 18 nt, Escherichia coli CFT073
ccccugccagaagcagaa

SEQ ID NO: 659030 - RNA, 21 nt, Escherichia coli CFT073
cccgaacucgaccugcaacug

SEQ ID NO: 659031 - RNA, 21 nt, Escherichia coli CFT073
cccgacgacgucgcuguucau

SEQ ID NO: 659032 - RNA, 17 nt, Escherichia coli CFT073
cccgacacggcucgccu

SEQ ID NO: 659033 - RNA, 11 nt, Escherichia coli CFT073
cccgaugcugu

SEQ ID NO: 659034 - RNA, 14 nt, Escherichia coli CFT073
cccgauucacauaa

SEQ ID NO: 659035 - RNA, 15 nt, Escherichia coli CFT073
cccgcaccaccgagu

SEQ ID NO: 659036 - RNA, 19 nt, Escherichia coli CFT073
cccgcacaaauagccagca

SEQ ID NO: 659037 - RNA, 22 nt, Escherichia coli CFT073
cccgcacaaggcuauccucuaa

SEQ ID NO: 659038 - RNA, 17 nt, Escherichia coli CFT073
cccgcacaccucacacc

SEQ ID NO: 659039 - RNA, 20 nt, Escherichia coli CFT073
cccgcaacgcccugcaacug

SEQ ID NO: 659040 - RNA, 15 nt, Escherichia coli CFT073
cccgcaaugcaauca

SEQ ID NO: 659041 - RNA, 18 nt, Escherichia coli CFT073
cccgagcggccaaaggga

SEQ ID NO: 659042 - RNA, 21 nt, Escherichia coli CFT073
cccgagcggccaaagggagca

SEQ ID NO: 659043 - RNA, 16 nt, Escherichia coli CFT073
cccgagagaacugcug

SEQ ID NO: 659044 - RNA, 15 nt, Escherichia coli CFT073
cccgauaagggagca

SEQ ID NO: 659045 - RNA, 14 nt, Escherichia coli CFT073
cccgauacgcuugc

SEQ ID NO: 659046 - RNA, 15 nt, Escherichia coli CFT073
cccgauauaaccauc

SEQ ID NO: 659047 - RNA, 20 nt, Escherichia coli CFT073
ccccaagaaucgucgcccga

SEQ ID NO: 659048 - RNA, 15 nt, Escherichia coli CFT073
ccccaaguuuaugca

SEQ ID NO: 659049 - RNA, 13 nt, Escherichia coli CFT073
ccccaauguggag

SEQ ID NO: 659050 - RNA, 20 nt, Escherichia coli CFT073
ccccaauguggagagcaaca

SEQ ID NO: 659051 - RNA, 19 nt, Escherichia coli CFT073
ccccacaaaauaaccgcca

SEQ ID NO: 659052 - RNA, 19 nt, Escherichia coli CFT073
ccccacagacccagguaga

SEQ ID NO: 659053 - RNA, 21 nt, Escherichia coli CFT073
ccccacagcucugcugucacc

SEQ ID NO: 659054 - RNA, 12 nt, Escherichia coli CFT073
ccccaccgccga

SEQ ID NO: 659055 - RNA, 13 nt, Escherichia coli CFT073
ccccaccagcaaa

SEQ ID NO: 659056 - RNA, 17 nt, Escherichia coli CFT073
cccauucaucgccaccg

SEQ ID NO: 659057 - RNA, 18 nt, Escherichia coli CFT073
cccauucaucgccaccgc

SEQ ID NO: 659058 - RNA, 16 nt, Escherichia coli CFT073
cccauggcacuucaag

SEQ ID NO: 659059 - RNA, 19 nt, Escherichia coli CFT073
cccaugaugcgcggcucca

SEQ ID NO: 659060 - RNA, 23 nt, Escherichia coli CFT073
cccaggucgacaauccagucagc

SEQ ID NO: 659061 - RNA, 23 nt, Escherichia coli CFT073
cccagguaucguugaugcucuug

SEQ ID NO: 659062 - RNA, 19 nt, Escherichia coli CFT073
cccccauugaaacgagugg

SEQ ID NO: 659063 - RNA, 20 nt, Escherichia coli CFT073
cccccagacgacggcugcca

SEQ ID NO: 659064 - RNA, 19 nt, Escherichia coli CFT073
cccccaauguggagagcaa

SEQ ID NO: 659065 - RNA, 13 nt, Escherichia coli CFT073
cccccaccgccgc

SEQ ID NO: 659066 - RNA, 12 nt, Escherichia coli CFT073
cccccaguaauc

SEQ ID NO: 659067 - RNA, 14 nt, Escherichia coli CFT073
ccccacuucuuccu

SEQ ID NO: 659068 - RNA, 20 nt, Escherichia coli CFT073
ccccacugcauggcggcguc

SEQ ID NO: 659069 - RNA, 23 nt, Escherichia coli CFT073
ccccacggcguguagcccaucag

SEQ ID NO: 659070 - RNA, 22 nt, Escherichia coli CFT073
ccccagauacccgacagauaaa

SEQ ID NO: 659071 - RNA, 11 nt, Escherichia coli CFT073
ccccagaugga

SEQ ID NO: 659072 - RNA, 16 nt, Escherichia coli CFT073
cccaaccgcuuucugc

SEQ ID NO: 659073 - RNA, 14 nt, Escherichia coli CFT073
cccacaccaccaug

SEQ ID NO: 659074 - RNA, 19 nt, Escherichia coli CFT073
cccacagcgcgucuucauc

SEQ ID NO: 659075 - RNA, 21 nt, Escherichia coli CFT073
cccacagccauggcauccaag

SEQ ID NO: 659076 - RNA, 13 nt, Escherichia coli CFT073
cccacaccgccca

SEQ ID NO: 659077 - RNA, 22 nt, Escherichia coli CFT073
cccacaccaccgcaaccgccaa

SEQ ID NO: 659078 - RNA, 11 nt, Escherichia coli CFT073
cccaaaucaua

SEQ ID NO: 659079 - RNA, 22 nt, Escherichia coli CFT073
cccaaaugucggaugcggcgcu

SEQ ID NO: 659080 - RNA, 22 nt, Escherichia coli CFT073
cccaaaguguaaaaaaucccag

SEQ ID NO: 659081 - RNA, 18 nt, Escherichia coli CFT073
cccaaaccgcccagcagc

SEQ ID NO: 659082 - RNA, 22 nt, Escherichia coli CFT073
cccaacaaauugguuuuugaau

SEQ ID NO: 659083 - RNA, 20 nt, Escherichia coli CFT073
cccaacacucgaacaaggca

SEQ ID NO: 659084 - RNA, 22 nt, Escherichia coli CFT073
cccaacauggucaucaucauua

SEQ ID NO: 659085 - RNA, 13 nt, Escherichia coli CFT073
cccaccagcaaaa

SEQ ID NO: 659086 - RNA, 12 nt, Escherichia coli CFT073
cccaccaccauc

SEQ ID NO: 659087 - RNA, 12 nt, Escherichia coli CFT073
cccaccucgugc

SEQ ID NO: 659088 - RNA, 15 nt, Escherichia coli CFT073
cccaccugaacuucu

SEQ ID NO: 659089 - RNA, 18 nt, Escherichia coli CFT073
ccauugcagccaaucugc

SEQ ID NO: 659090 - RNA, 23 nt, Escherichia coli CFT073
ccauuguugcuggauccccugcc

SEQ ID NO: 659091 - RNA, 19 nt, Escherichia coli CFT073
ccauuguuguagguacccg

SEQ ID NO: 659092 - RNA, 14 nt, Escherichia coli CFT073
ccauuguuagcaac

SEQ ID NO: 659093 - RNA, 22 nt, Escherichia coli CFT073
ccauuuauccagcggcagccau

SEQ ID NO: 659094 - RNA, 22 nt, Escherichia coli CFT073
ccauuucauaaauuaccaccag

SEQ ID NO: 659095 - RNA, 23 nt, Escherichia coli CFT073
ccauuucauaaauuaccaccagc

SEQ ID NO: 659096 - RNA, 15 nt, Escherichia coli CFT073
ccauuucacugucau

SEQ ID NO: 659097 - RNA, 13 nt, Escherichia coli CFT073
ccaucuuuuggcu

SEQ ID NO: 659098 - RNA, 22 nt, Escherichia coli CFT073
ccauugagaaaauccaucccaa

SEQ ID NO: 659099 - RNA, 21 nt, Escherichia coli CFT073
ccauugaagcaauccauacca

SEQ ID NO: 659100 - RNA, 17 nt, Escherichia coli CFT073
ccauugaauuaaaaugu

SEQ ID NO: 659101 - RNA, 18 nt, Escherichia coli CFT073
ccauugaugagaacauca

SEQ ID NO: 659102 - RNA, 22 nt, Escherichia coli CFT073
ccauugaguagccucugcguua

SEQ ID NO: 659103 - RNA, 23 nt, Escherichia coli CFT073
ccauuuggcggggauuuuuuuau

SEQ ID NO: 659104 - RNA, 20 nt, Escherichia coli CFT073
ccauuucgcugguaccuguc

SEQ ID NO: 659105 - RNA, 13 nt, Escherichia coli CFT073
ccauuucuucugc

SEQ ID NO: 659106 - RNA, 21 nt, Escherichia coli CFT073
ccauuuuggaauaguaaaagg

SEQ ID NO: 659107 - RNA, 22 nt, Escherichia coli CFT073
ccauuuuucagacguucuuccu

SEQ ID NO: 659108 - RNA, 19 nt, Escherichia coli CFT073
ccauuuugcaugagugcca

SEQ ID NO: 659109 - RNA, 21 nt, Escherichia coli CFT073
ccauuuuuugaacuuuuucuu

SEQ ID NO: 659110 - RNA, 23 nt, Escherichia coli CFT073
cccaaaaccuggacaguuucagu

SEQ ID NO: 659111 - RNA, 17 nt, Escherichia coli CFT073
cccagcguugcagagag

SEQ ID NO: 659112 - RNA, 15 nt, Escherichia coli CFT073
cccagcgucagcagc

SEQ ID NO: 659113 - RNA, 10 nt, Escherichia coli CFT073
cccaggccau

SEQ ID NO: 659114 - RNA, 20 nt, Escherichia coli CFT073
cccagcggaugacccagcgc

SEQ ID NO: 659115 - RNA, 14 nt, Escherichia coli CFT073
cccagcgcgaaaga

SEQ ID NO: 659116 - RNA, 17 nt, Escherichia coli CFT073
cccagcgccaugccaac

SEQ ID NO: 659117 - RNA, 18 nt, Escherichia coli CFT073
cccagcgcaagggccgcc

SEQ ID NO: 659118 - RNA, 15 nt, Escherichia coli CFT073
cccagcgaccacaaa

SEQ ID NO: 659119 - RNA, 22 nt, Escherichia coli CFT073
cccacgguuugagagucaucca

SEQ ID NO: 659120 - RNA, 23 nt, Escherichia coli CFT073
cccacgugaguguggccaguucc

SEQ ID NO: 659121 - RNA, 19 nt, Escherichia coli CFT073
cccacuacaccguacuccc

SEQ ID NO: 659122 - RNA, 20 nt, Escherichia coli CFT073
cccacuacaccguacucccg

SEQ ID NO: 659123 - RNA, 14 nt, Escherichia coli CFT073
cccacuaccagcug

SEQ ID NO: 659124 - RNA, 19 nt, Escherichia coli CFT073
cccacuacgcccgcaauca

SEQ ID NO: 659125 - RNA, 13 nt, Escherichia coli CFT073
cccacggcgguaa

SEQ ID NO: 659126 - RNA, 16 nt, Escherichia coli CFT073
cccacggauugccgcu

SEQ ID NO: 659127 - RNA, 16 nt, Escherichia coli CFT073
cccagcaccgcagaga

SEQ ID NO: 659128 - RNA, 16 nt, Escherichia coli CFT073
cccagcacuucgcugg

SEQ ID NO: 659129 - RNA, 15 nt, Escherichia coli CFT073
cccagcagagaucuu

SEQ ID NO: 659130 - RNA, 13 nt, Escherichia coli CFT073
cccagcagcacag

SEQ ID NO: 659131 - RNA, 14 nt, Escherichia coli CFT073
cccagccuuuccag

SEQ ID NO: 659132 - RNA, 18 nt, Escherichia coli CFT073
cccagccgguaaggccaa

SEQ ID NO: 659133 - RNA, 17 nt, Escherichia coli CFT073
cccagccggucagcagg

SEQ ID NO: 659134 - RNA, 23 nt, Escherichia coli CFT073
cccagccgcaaacgacacugcuc

SEQ ID NO: 659135 - RNA, 15 nt, Escherichia coli CFT073
cccagcaucacgccc

SEQ ID NO: 659136 - RNA, 17 nt, Escherichia coli CFT073
cccagccccgccgguaa

SEQ ID NO: 659137 - RNA, 14 nt, Escherichia coli CFT073
ccaguagcugugug

SEQ ID NO: 659138 - RNA, 19 nt, Escherichia coli CFT073
ccaguauauugcugauuuu

SEQ ID NO: 659139 - RNA, 17 nt, Escherichia coli CFT073
ccaguccaccuggccug

SEQ ID NO: 659140 - RNA, 24 nt, Escherichia coli CFT073
ccagucacccugcccggcaaacgu

SEQ ID NO: 659141 - RNA, 15 nt, Escherichia coli CFT073
ccagucacugugacg

SEQ ID NO: 659142 - RNA, 17 nt, Escherichia coli CFT073
ccagucagaauguguua

SEQ ID NO: 659143 - RNA, 14 nt, Escherichia coli CFT073
ccaguagcaccucu

SEQ ID NO: 659144 - RNA, 22 nt, Escherichia coli CFT073
ccagucucccuuuacccgcgcu

SEQ ID NO: 659145 - RNA, 12 nt, Escherichia coli CFT073
ccagucugcuga

SEQ ID NO: 659146 - RNA, 17 nt, Escherichia coli CFT073
ccagugaauacugcgcg

SEQ ID NO: 659147 - RNA, 18 nt, Escherichia coli CFT073
ccagucguuucgcccguu

SEQ ID NO: 659148 - RNA, 14 nt, Escherichia coli CFT073
ccagucggucgauu

SEQ ID NO: 659149 - RNA, 16 nt, Escherichia coli CFT073
ccagucgguagugccg

SEQ ID NO: 659150 - RNA, 22 nt, Escherichia coli CFT073
ccagucgauauggccuucuuca

SEQ ID NO: 659151 - RNA, 18 nt, Escherichia coli CFT073
ccaguccgguggagagca

SEQ ID NO: 659152 - RNA, 20 nt, Escherichia coli CFT073
ccaguccccucgccccuccg

SEQ ID NO: 659153 - RNA, 14 nt, Escherichia coli CFT073
ccaguccaucggca

SEQ ID NO: 659154 - RNA, 21 nt, Escherichia coli CFT073
ccagugccggaugauucacau

SEQ ID NO: 659155 - RNA, 18 nt, Escherichia coli CFT073
ccagugcuacccccagac

SEQ ID NO: 659156 - RNA, 20 nt, Escherichia coli CFT073
ccagugcuacccccagacga

SEQ ID NO: 659157 - RNA, 19 nt, Escherichia coli CFT073
ccagugcuucgcggacauc

SEQ ID NO: 659158 - RNA, 18 nt, Escherichia coli CFT073
ccagugcuuucagugccu

SEQ ID NO: 659159 - RNA, 19 nt, Escherichia coli CFT073
ccaguggaugcgccauacc

SEQ ID NO: 659160 - RNA, 13 nt, Escherichia coli CFT073
ccagugacgccgc

SEQ ID NO: 659161 - RNA, 14 nt, Escherichia coli CFT073
ccagugaucuggcu

SEQ ID NO: 659162 - RNA, 19 nt, Escherichia coli CFT073
ccagugauugcuugcgccu

SEQ ID NO: 659163 - RNA, 18 nt, Escherichia coli CFT073
ccagugauuuuugcugaa

SEQ ID NO: 659164 - RNA, 18 nt, Escherichia coli CFT073
ccagugcagaugcacaag

SEQ ID NO: 659165 - RNA, 13 nt, Escherichia coli CFT073
ccagugcauaucc

SEQ ID NO: 659166 - RNA, 14 nt, Escherichia coli CFT073
ccagugccagaaca

SEQ ID NO: 659167 - RNA, 22 nt, Escherichia coli CFT073
ccagugcccgaccacuucaugc

SEQ ID NO: 659168 - RNA, 18 nt, Escherichia coli CFT073
ccagugccggaugauuca

SEQ ID NO: 659169 - RNA, 19 nt, Escherichia coli CFT073
ccaguucuuccgcagagua

SEQ ID NO: 659170 - RNA, 19 nt, Escherichia coli CFT073
ccaguucuuccgccagaca

SEQ ID NO: 659171 - RNA, 14 nt, Escherichia coli CFT073
ccaguugagugaau

SEQ ID NO: 659172 - RNA, 14 nt, Escherichia coli CFT073
ccaguugcguaaua

SEQ ID NO: 659173 - RNA, 17 nt, Escherichia coli CFT073
ccaguugguguucggca

SEQ ID NO: 659174 - RNA, 22 nt, Escherichia coli CFT073
ccaguugucgguaauugcgccg

SEQ ID NO: 659175 - RNA, 19 nt, Escherichia coli CFT073
ccaguugugcugccagcca

SEQ ID NO: 659176 - RNA, 16 nt, Escherichia coli CFT073
ccaguuguugcgugaa

SEQ ID NO: 659177 - RNA, 13 nt, Escherichia coli CFT073
ccauaaccgccag

SEQ ID NO: 659178 - RNA, 20 nt, Escherichia coli CFT073
ccauaaccgccagcacagcc

SEQ ID NO: 659179 - RNA, 23 nt, Escherichia coli CFT073
ccauaaccggccuguaaggaaua

SEQ ID NO: 659180 - RNA, 20 nt, Escherichia coli CFT073
ccauaaagauguaaucgccu

SEQ ID NO: 659181 - RNA, 14 nt, Escherichia coli CFT073
ccauaaacuucauu

SEQ ID NO: 659182 - RNA, 22 nt, Escherichia coli CFT073
ccauaaaccgcaucauguaaau

SEQ ID NO: 659183 - RNA, 15 nt, Escherichia coli CFT073
ccaguuuaugccugu

SEQ ID NO: 659184 - RNA, 19 nt, Escherichia coli CFT073
ccaguuuauggaacaacac

SEQ ID NO: 659185 - RNA, 13 nt, Escherichia coli CFT073
ccaguuucacagg

SEQ ID NO: 659186 - RNA, 15 nt, Escherichia coli CFT073
ccaguuuccaccaga

SEQ ID NO: 659187 - RNA, 13 nt, Escherichia coli CFT073
ccaucccuucacc

SEQ ID NO: 659188 - RNA, 18 nt, Escherichia coli CFT073
ccauccccuuuucacgca

SEQ ID NO: 659189 - RNA, 17 nt, Escherichia coli CFT073
ccaucccgcucuguaag

SEQ ID NO: 659190 - RNA, 14 nt, Escherichia coli CFT073
ccauccgagcagca

SEQ ID NO: 659191 - RNA, 14 nt, Escherichia coli CFT073
ccauccgcccacac

SEQ ID NO: 659192 - RNA, 13 nt, Escherichia coli CFT073
ccauccggcaaca

SEQ ID NO: 659193 - RNA, 15 nt, Escherichia coli CFT073
ccaucaggcgacacu

SEQ ID NO: 659194 - RNA, 16 nt, Escherichia coli CFT073
ccaucaucgcuuucag

SEQ ID NO: 659195 - RNA, 16 nt, Escherichia coli CFT073
ccaucaucggcaaaca

SEQ ID NO: 659196 - RNA, 13 nt, Escherichia coli CFT073
ccaucauccgcgg

SEQ ID NO: 659197 - RNA, 14 nt, Escherichia coli CFT073
ccaucgccagcagc

SEQ ID NO: 659198 - RNA, 15 nt, Escherichia coli CFT073
ccaucgccagcagcc

SEQ ID NO: 659199 - RNA, 20 nt, Escherichia coli CFT073
ccaucgccagcagccauucc

SEQ ID NO: 659200 - RNA, 21 nt, Escherichia coli CFT073
ccaucgauuuugcaauaaugg

SEQ ID NO: 659201 - RNA, 14 nt, Escherichia coli CFT073
ccaucgucacgauu

SEQ ID NO: 659202 - RNA, 23 nt, Escherichia coli CFT073
ccaucguccagcagcaaugcagg

SEQ ID NO: 659203 - RNA, 16 nt, Escherichia coli CFT073
ccaucgucacaccuuc

SEQ ID NO: 659204 - RNA, 22 nt, Escherichia coli CFT073
ccaucuucugaaucagaucaag

SEQ ID NO: 659205 - RNA, 18 nt, Escherichia coli CFT073
ccaucuucuugcagcuua

SEQ ID NO: 659206 - RNA, 16 nt, Escherichia coli CFT073
ccauaucuauuacagc

SEQ ID NO: 659207 - RNA, 16 nt, Escherichia coli CFT073
ccauauggcugcaucc

SEQ ID NO: 659208 - RNA, 17 nt, Escherichia coli CFT073
ccauauggcugcaucca

SEQ ID NO: 659209 - RNA, 22 nt, Escherichia coli CFT073
ccaucaaguagcagguaaucug

SEQ ID NO: 659210 - RNA, 13 nt, Escherichia coli CFT073
ccaucaagaacac

SEQ ID NO: 659211 - RNA, 20 nt, Escherichia coli CFT073
ccauauucguuaucguacca

SEQ ID NO: 659212 - RNA, 21 nt, Escherichia coli CFT073
ccauaugcagccacugcugcg

SEQ ID NO: 659213 - RNA, 18 nt, Escherichia coli CFT073
ccauauguugaaaagcca

SEQ ID NO: 659214 - RNA, 18 nt, Escherichia coli CFT073
ccauauuaacgcagcaaa

SEQ ID NO: 659215 - RNA, 23 nt, Escherichia coli CFT073
ccauacagcgucgguuccugaug

SEQ ID NO: 659216 - RNA, 19 nt, Escherichia coli CFT073
ccauaucaucaauaugaau

SEQ ID NO: 659217 - RNA, 22 nt, Escherichia coli CFT073
ccauauccagcgcaguuuuucc

SEQ ID NO: 659218 - RNA, 14 nt, Escherichia coli CFT073
ccaucacuugcugc

SEQ ID NO: 659219 - RNA, 17 nt, Escherichia coli CFT073
ccaucacuuugcagaaa

SEQ ID NO: 659220 - RNA, 18 nt, Escherichia coli CFT073
ccaucacaauucaguacg

SEQ ID NO: 659221 - RNA, 15 nt, Escherichia coli CFT073
ccaucacaaaguggg

SEQ ID NO: 659222 - RNA, 13 nt, Escherichia coli CFT073
ccaucacuaccug

SEQ ID NO: 659223 - RNA, 11 nt, Escherichia coli CFT073
ccaucacuccc

SEQ ID NO: 659224 - RNA, 23 nt, Escherichia coli CFT073
ccaucaaguagcagguaaucugc

SEQ ID NO: 659225 - RNA, 14 nt, Escherichia coli CFT073
ccaucaauaaucac

SEQ ID NO: 659226 - RNA, 17 nt, Escherichia coli CFT073
ccaucaauaaucaccga

SEQ ID NO: 659227 - RNA, 20 nt, Escherichia coli CFT073
ccaucaaucacuuugcgcuc

SEQ ID NO: 659228 - RNA, 22 nt, Escherichia coli CFT073
ccaucaauccacuucgccagac

SEQ ID NO: 659229 - RNA, 18 nt, Escherichia coli CFT073
ccaucaauugcucacucc

SEQ ID NO: 659230 - RNA, 15 nt, Escherichia coli CFT073
ccaucagcagcaaca

SEQ ID NO: 659231 - RNA, 18 nt, Escherichia coli CFT073
ccaucagcgccugaugga

SEQ ID NO: 659232 - RNA, 19 nt, Escherichia coli CFT073
ccaucagcggguuuuuccc

SEQ ID NO: 659233 - RNA, 15 nt, Escherichia coli CFT073
ccaucaggccaggcg

SEQ ID NO: 659234 - RNA, 17 nt, Escherichia coli CFT073
ccagcguuuccagcacc

SEQ ID NO: 659235 - RNA, 21 nt, Escherichia coli CFT073
ccagcguuuaucaauauccag

SEQ ID NO: 659236 - RNA, 17 nt, Escherichia coli CFT073
ccagcguguugccgcuu

SEQ ID NO: 659237 - RNA, 16 nt, Escherichia coli CFT073
ccagcguguuggcccc

SEQ ID NO: 659238 - RNA, 14 nt, Escherichia coli CFT073
ccagcguguugccg

SEQ ID NO: 659239 - RNA, 23 nt, Escherichia coli CFT073
ccagcguuaauuuccucuucccg

SEQ ID NO: 659240 - RNA, 16 nt, Escherichia coli CFT073
ccagcguuacccagac

SEQ ID NO: 659241 - RNA, 17 nt, Escherichia coli CFT073
ccagcguuacccagaca

SEQ ID NO: 659242 - RNA, 19 nt, Escherichia coli CFT073
ccagcguuacccagacaaa

SEQ ID NO: 659243 - RNA, 22 nt, Escherichia coli CFT073
ccagcgucaucaauccugcagc

SEQ ID NO: 659244 - RNA, 17 nt, Escherichia coli CFT073
ccagcgucgccagcaga

SEQ ID NO: 659245 - RNA, 14 nt, Escherichia coli CFT073
ccagcucaaccaga

SEQ ID NO: 659246 - RNA, 21 nt, Escherichia coli CFT073
ccagcucgcgauacgcuucaa

SEQ ID NO: 659247 - RNA, 20 nt, Escherichia coli CFT073
ccagcggaaaauaucaccaa

SEQ ID NO: 659248 - RNA, 22 nt, Escherichia coli CFT073
ccagcggaauuccggcuucuuc

SEQ ID NO: 659249 - RNA, 19 nt, Escherichia coli CFT073
ccagcggcaaccagcagca

SEQ ID NO: 659250 - RNA, 15 nt, Escherichia coli CFT073
ccagcggaugaccca

SEQ ID NO: 659251 - RNA, 17 nt, Escherichia coli CFT073
ccagcggaugacccagc

SEQ ID NO: 659252 - RNA, 22 nt, Escherichia coli CFT073
ccagcgcugcggccugcugcac

SEQ ID NO: 659253 - RNA, 21 nt, Escherichia coli CFT073
ccagcgggcgucaaaaucauc

SEQ ID NO: 659254 - RNA, 15 nt, Escherichia coli CFT073
ccagcgucagcagca

SEQ ID NO: 659255 - RNA, 16 nt, Escherichia coli CFT073
ccagcgucagcagcaa

SEQ ID NO: 659256 - RNA, 18 nt, Escherichia coli CFT073
ccagcgucagcagcaaua

SEQ ID NO: 659257 - RNA, 15 nt, Escherichia coli CFT073
ccagcgucagcagga

SEQ ID NO: 659258 - RNA, 13 nt, Escherichia coli CFT073
ccagcgcggcagc

SEQ ID NO: 659259 - RNA, 20 nt, Escherichia coli CFT073
ccagcgcggcggcaaucauc

SEQ ID NO: 659260 - RNA, 21 nt, Escherichia coli CFT073
ccagcgccuggcgaaucgccu

SEQ ID NO: 659261 - RNA, 21 nt, Escherichia coli CFT073
ccagcgcgacacaacagacca

SEQ ID NO: 659262 - RNA, 23 nt, Escherichia coli CFT073
ccagcgcgacacaacagaccaga

SEQ ID NO: 659263 - RNA, 14 nt, Escherichia coli CFT073
ccagcgcgaccgcc

SEQ ID NO: 659264 - RNA, 17 nt, Escherichia coli CFT073
ccagcgccugaauaauc

SEQ ID NO: 659265 - RNA, 15 nt, Escherichia coli CFT073
ccagcgccgcgagca

SEQ ID NO: 659266 - RNA, 18 nt, Escherichia coli CFT073
ccagcgccgcgagcaucg

SEQ ID NO: 659267 - RNA, 13 nt, Escherichia coli CFT073
ccagcgccgcgcg

SEQ ID NO: 659268 - RNA, 18 nt, Escherichia coli CFT073
ccagcgcccguaaaccaa

SEQ ID NO: 659269 - RNA, 16 nt, Escherichia coli CFT073
ccagcgccaguaauuc

SEQ ID NO: 659270 - RNA, 19 nt, Escherichia coli CFT073
ccagcgcauggcggcagcg

SEQ ID NO: 659271 - RNA, 13 nt, Escherichia coli CFT073
ccagcgccaccac

SEQ ID NO: 659272 - RNA, 14 nt, Escherichia coli CFT073
ccagcgccaccacc

SEQ ID NO: 659273 - RNA, 16 nt, Escherichia coli CFT073
ccagcgccaccaccag

SEQ ID NO: 659274 - RNA, 15 nt, Escherichia coli CFT073
ccaggaugcuucaac

SEQ ID NO: 659275 - RNA, 20 nt, Escherichia coli CFT073
ccaggcaaaauccuuccagc

SEQ ID NO: 659276 - RNA, 14 nt, Escherichia coli CFT073
ccaggcaaaccagu

SEQ ID NO: 659277 - RNA, 15 nt, Escherichia coli CFT073
ccaggcaaauucugu

SEQ ID NO: 659278 - RNA, 13 nt, Escherichia coli CFT073
ccaggcauagaaa

SEQ ID NO: 659279 - RNA, 14 nt, Escherichia coli CFT073
ccaggcccaauaau

SEQ ID NO: 659280 - RNA, 23 nt, Escherichia coli CFT073
ccaggaucguucgcugccuuuga

SEQ ID NO: 659281 - RNA, 16 nt, Escherichia coli CFT073
ccaggaccgcugaaau

SEQ ID NO: 659282 - RNA, 17 nt, Escherichia coli CFT073
ccaggacaucagcgcac

SEQ ID NO: 659283 - RNA, 21 nt, Escherichia coli CFT073
ccagcugauguagucauacug

SEQ ID NO: 659284 - RNA, 18 nt, Escherichia coli CFT073
ccagcugcucgcgagaac

SEQ ID NO: 659285 - RNA, 13 nt, Escherichia coli CFT073
ccaggucaaugca

SEQ ID NO: 659286 - RNA, 15 nt, Escherichia coli CFT073
ccaggucaccagaca

SEQ ID NO: 659287 - RNA, 21 nt, Escherichia coli CFT073
ccaggcgucuggcccaugcca

SEQ ID NO: 659288 - RNA, 13 nt, Escherichia coli CFT073
ccaggcgcugaac

SEQ ID NO: 659289 - RNA, 18 nt, Escherichia coli CFT073
ccaggccggugaugaugc

SEQ ID NO: 659290 - RNA, 17 nt, Escherichia coli CFT073
ccagcaguacaguaccg

SEQ ID NO: 659291 - RNA, 15 nt, Escherichia coli CFT073
ccagcaguccccagg

SEQ ID NO: 659292 - RNA, 22 nt, Escherichia coli CFT073
ccagcaguucaauccacugcau

SEQ ID NO: 659293 - RNA, 17 nt, Escherichia coli CFT073
ccagcaguuccagcaua

SEQ ID NO: 659294 - RNA, 21 nt, Escherichia coli CFT073
ccagccauuaaccagccacug

SEQ ID NO: 659295 - RNA, 23 nt, Escherichia coli CFT073
ccagcauaguacgggcaauuuca

SEQ ID NO: 659296 - RNA, 13 nt, Escherichia coli CFT073
ccagcaguuugau

SEQ ID NO: 659297 - RNA, 13 nt, Escherichia coli CFT073
ccagcauaaucac

SEQ ID NO: 659298 - RNA, 17 nt, Escherichia coli CFT073
ccagcauaaucaccauc

SEQ ID NO: 659299 - RNA, 19 nt, Escherichia coli CFT073
ccagccgccaacuccacca

SEQ ID NO: 659300 - RNA, 15 nt, Escherichia coli CFT073
ccagccgaucagcgg

SEQ ID NO: 659301 - RNA, 18 nt, Escherichia coli CFT073
ccagccgcuaacuuccug

SEQ ID NO: 659302 - RNA, 20 nt, Escherichia coli CFT073
ccagccgcuaacuuccugcu

SEQ ID NO: 659303 - RNA, 17 nt, Escherichia coli CFT073
ccagccgaacagugcca

SEQ ID NO: 659304 - RNA, 15 nt, Escherichia coli CFT073
ccagccccagaacuc

SEQ ID NO: 659305 - RNA, 22 nt, Escherichia coli CFT073
ccagcgauccggguaauaaacc

SEQ ID NO: 659306 - RNA, 14 nt, Escherichia coli CFT073
ccagcgcaaacggc

SEQ ID NO: 659307 - RNA, 17 nt, Escherichia coli CFT073
ccagcgcagcuuccggc

SEQ ID NO: 659308 - RNA, 13 nt, Escherichia coli CFT073
ccagcgcaggcag

SEQ ID NO: 659309 - RNA, 13 nt, Escherichia coli CFT073
ccagcgcauggcg

SEQ ID NO: 659310 - RNA, 15 nt, Escherichia coli CFT073
ccagcgaccgcgcca

SEQ ID NO: 659311 - RNA, 21 nt, Escherichia coli CFT073
ccagcgaccgcgccauaaacc

SEQ ID NO: 659312 - RNA, 13 nt, Escherichia coli CFT073
ccagcgacuccag

SEQ ID NO: 659313 - RNA, 13 nt, Escherichia coli CFT073
ccagcgagaagcu

SEQ ID NO: 659314 - RNA, 16 nt, Escherichia coli CFT073
ccagcgacagccagcc

SEQ ID NO: 659315 - RNA, 23 nt, Escherichia coli CFT073
ccagcgacauacucagcgccugc

SEQ ID NO: 659316 - RNA, 12 nt, Escherichia coli CFT073
ccagccuucuuc

SEQ ID NO: 659317 - RNA, 20 nt, Escherichia coli CFT073
ccagccuucuucauccagcg

SEQ ID NO: 659318 - RNA, 18 nt, Escherichia coli CFT073
ccagccuugaggccaucc

SEQ ID NO: 659319 - RNA, 21 nt, Escherichia coli CFT073
ccagcgaaaaaugguuugccc

SEQ ID NO: 659320 - RNA, 15 nt, Escherichia coli CFT073
ccagccuuuccagca

SEQ ID NO: 659321 - RNA, 14 nt, Escherichia coli CFT073
ccagcgaaaccuga

SEQ ID NO: 659322 - RNA, 24 nt, Escherichia coli CFT073
ccagccugaaugccgcgccccauc

SEQ ID NO: 659323 - RNA, 18 nt, Escherichia coli CFT073
ccagccucauccaugcgg

SEQ ID NO: 659324 - RNA, 20 nt, Escherichia coli CFT073
ccagccgggcgguuaacgac

SEQ ID NO: 659325 - RNA, 21 nt, Escherichia coli CFT073
ccagaauauguucgcuuaacu

SEQ ID NO: 659326 - RNA, 19 nt, Escherichia coli CFT073
ccagaauaccuugcugcuc

SEQ ID NO: 659327 - RNA, 23 nt, Escherichia coli CFT073
ccagaaucaccggagcugccagc

SEQ ID NO: 659328 - RNA, 16 nt, Escherichia coli CFT073
ccagauaaaacacauc

SEQ ID NO: 659329 - RNA, 22 nt, Escherichia coli CFT073
ccagauaaaacaucucuuccca

SEQ ID NO: 659330 - RNA, 15 nt, Escherichia coli CFT073
ccagauaaauauuau

SEQ ID NO: 659331 - RNA, 17 nt, Escherichia coli CFT073
ccagauaaauauuauug

SEQ ID NO: 659332 - RNA, 17 nt, Escherichia coli CFT073
ccagauaacaaucauca

SEQ ID NO: 659333 - RNA, 17 nt, Escherichia coli CFT073
ccagauaaauucgacca

SEQ ID NO: 659334 - RNA, 20 nt, Escherichia coli CFT073
ccagauaaucacccgccuuc

SEQ ID NO: 659335 - RNA, 19 nt, Escherichia coli CFT073
ccagauagagccgguuuug

SEQ ID NO: 659336 - RNA, 16 nt, Escherichia coli CFT073
ccagauaauggcuguu

SEQ ID NO: 659337 - RNA, 15 nt, Escherichia coli CFT073
ccagauauugcucua

SEQ ID NO: 659338 - RNA, 18 nt, Escherichia coli CFT073
ccagauauuuaaguugau

SEQ ID NO: 659339 - RNA, 14 nt, Escherichia coli CFT073
ccagaucacgcagc

SEQ ID NO: 659340 - RNA, 15 nt, Escherichia coli CFT073
ccagaucacuucugu

SEQ ID NO: 659341 - RNA, 14 nt, Escherichia coli CFT073
ccagaucagaccca

SEQ ID NO: 659342 - RNA, 17 nt, Escherichia coli CFT073
ccagauuuaacggcagc

SEQ ID NO: 659343 - RNA, 21 nt, Escherichia coli CFT073
ccagauugugugacacuucuu

SEQ ID NO: 659344 - RNA, 22 nt, Escherichia coli CFT073
ccagauugugugacacuucuuc

SEQ ID NO: 659345 - RNA, 23 nt, Escherichia coli CFT073
ccagauugugugacacuucuucg

SEQ ID NO: 659346 - RNA, 12 nt, Escherichia coli CFT073
ccagauuuucuu

SEQ ID NO: 659347 - RNA, 17 nt, Escherichia coli CFT073
ccagcaaaaucaccauc

SEQ ID NO: 659348 - RNA, 15 nt, Escherichia coli CFT073
ccagauuaauuauug

SEQ ID NO: 659349 - RNA, 15 nt, Escherichia coli CFT073
ccagauucuccaccu

SEQ ID NO: 659350 - RNA, 20 nt, Escherichia coli CFT073
ccagauucuccaccugcggc

SEQ ID NO: 659351 - RNA, 17 nt, Escherichia coli CFT073
ccagauucuccagcauc

SEQ ID NO: 659352 - RNA, 19 nt, Escherichia coli CFT073
ccagaugccuugccaggug

SEQ ID NO: 659353 - RNA, 22 nt, Escherichia coli CFT073
ccagauccaauaccgcacuaag

SEQ ID NO: 659354 - RNA, 17 nt, Escherichia coli CFT073
ccagauccagcaagggg

SEQ ID NO: 659355 - RNA, 14 nt, Escherichia coli CFT073
ccagauuaccgccu

SEQ ID NO: 659356 - RNA, 22 nt, Escherichia coli CFT073
ccagauuaccguugcggcucca

SEQ ID NO: 659357 - RNA, 18 nt, Escherichia coli CFT073
ccagauggacaaaagccc

SEQ ID NO: 659358 - RNA, 18 nt, Escherichia coli CFT073
ccagauggcuuugcccuu

SEQ ID NO: 659359 - RNA, 22 nt, Escherichia coli CFT073
ccagcaccacuuuacgggcaau

SEQ ID NO: 659360 - RNA, 16 nt, Escherichia coli CFT073
ccagcacaucucaaau

SEQ ID NO: 659361 - RNA, 20 nt, Escherichia coli CFT073
ccagcacagccagccuccaa

SEQ ID NO: 659362 - RNA, 13 nt, Escherichia coli CFT073
ccagcaacaacag

SEQ ID NO: 659363 - RNA, 14 nt, Escherichia coli CFT073
ccagcaaauccagc

SEQ ID NO: 659364 - RNA, 13 nt, Escherichia coli CFT073
ccagcaaacuggc

SEQ ID NO: 659365 - RNA, 21 nt, Escherichia coli CFT073
ccagcaaagagagauccagcu

SEQ ID NO: 659366 - RNA, 12 nt, Escherichia coli CFT073
ccagcaaagugc

SEQ ID NO: 659367 - RNA, 14 nt, Escherichia coli CFT073
ccagcaaaucaauc

SEQ ID NO: 659368 - RNA, 14 nt, Escherichia coli CFT073
ccagcaacaacagc

SEQ ID NO: 659369 - RNA, 18 nt, Escherichia coli CFT073
ccagcagggcaaucgcgc

SEQ ID NO: 659370 - RNA, 13 nt, Escherichia coli CFT073
ccagcagcuucac

SEQ ID NO: 659371 - RNA, 17 nt, Escherichia coli CFT073
ccagcaggaacgagaac

SEQ ID NO: 659372 - RNA, 15 nt, Escherichia coli CFT073
ccagcagcacagcca

SEQ ID NO: 659373 - RNA, 20 nt, Escherichia coli CFT073
ccagcagaugcugugccucc

SEQ ID NO: 659374 - RNA, 20 nt, Escherichia coli CFT073
ccagcacggauaccgcacgc

SEQ ID NO: 659375 - RNA, 19 nt, Escherichia coli CFT073
ccacuuaacguuaccuuua

SEQ ID NO: 659376 - RNA, 21 nt, Escherichia coli CFT073
ccacuucacgaugcagcgucu

SEQ ID NO: 659377 - RNA, 15 nt, Escherichia coli CFT073
ccacuucaucaagca

SEQ ID NO: 659378 - RNA, 12 nt, Escherichia coli CFT073
ccacuggcuguu

SEQ ID NO: 659379 - RNA, 22 nt, Escherichia coli CFT073
ccacugcgacaccagcauguuc

SEQ ID NO: 659380 - RNA, 16 nt, Escherichia coli CFT073
ccacuggcaauaauau

SEQ ID NO: 659381 - RNA, 15 nt, Escherichia coli CFT073
ccacugcaaaucacc

SEQ ID NO: 659382 - RNA, 15 nt, Escherichia coli CFT073
ccagaaccagcaacc

SEQ ID NO: 659383 - RNA, 16 nt, Escherichia coli CFT073
ccagaaccagcaacca

SEQ ID NO: 659384 - RNA, 21 nt, Escherichia coli CFT073
ccagaaccaguugagugaaua

SEQ ID NO: 659385 - RNA, 12 nt, Escherichia coli CFT073
ccagaacagaaa

SEQ ID NO: 659386 - RNA, 19 nt, Escherichia coli CFT073
ccagaacagcggagcaaga

SEQ ID NO: 659387 - RNA, 18 nt, Escherichia coli CFT073
ccagaacacgcucccagc

SEQ ID NO: 659388 - RNA, 23 nt, Escherichia coli CFT073
ccagaaauagaccggagaaaaga

SEQ ID NO: 659389 - RNA, 17 nt, Escherichia coli CFT073
ccagaaaucagcagcuu

SEQ ID NO: 659390 - RNA, 17 nt, Escherichia coli CFT073
ccagaaaucggccuucc

SEQ ID NO: 659391 - RNA, 20 nt, Escherichia coli CFT073
ccagaaaucggccuuccaua

SEQ ID NO: 659392 - RNA, 20 nt, Escherichia coli CFT073
ccacuucuuccagcggcagg

SEQ ID NO: 659393 - RNA, 14 nt, Escherichia coli CFT073
ccacuuccugcgcc

SEQ ID NO: 659394 - RNA, 16 nt, Escherichia coli CFT073
ccacuuccugcucggu

SEQ ID NO: 659395 - RNA, 14 nt, Escherichia coli CFT073
ccacuuccaccacu

SEQ ID NO: 659396 - RNA, 12 nt, Escherichia coli CFT073
ccacuuccagca

SEQ ID NO: 659397 - RNA, 17 nt, Escherichia coli CFT073
ccacuucccaacgcugc

SEQ ID NO: 659398 - RNA, 14 nt, Escherichia coli CFT073
ccacuuccccucau

SEQ ID NO: 659399 - RNA, 17 nt, Escherichia coli CFT073
ccacuuccgacuucagu

SEQ ID NO: 659400 - RNA, 23 nt, Escherichia coli CFT073
ccacuuccgcgucaaucugcccg

SEQ ID NO: 659401 - RNA, 23 nt, Escherichia coli CFT073
ccacucggcacauagacggugac

SEQ ID NO: 659402 - RNA, 16 nt, Escherichia coli CFT073
ccacucggacguuuuc

SEQ ID NO: 659403 - RNA, 23 nt, Escherichia coli CFT073
ccacugaauaacauuaugucugu

SEQ ID NO: 659404 - RNA, 17 nt, Escherichia coli CFT073
ccacugaccgcccggcc

SEQ ID NO: 659405 - RNA, 23 nt, Escherichia coli CFT073
ccacugacgggaaacucugcugg

SEQ ID NO: 659406 - RNA, 21 nt, Escherichia coli CFT073
ccacucagcccauaccguggu

SEQ ID NO: 659407 - RNA, 14 nt, Escherichia coli CFT073
ccacucacacagcu

SEQ ID NO: 659408 - RNA, 20 nt, Escherichia coli CFT073
ccacguugcaucacccgcug

SEQ ID NO: 659409 - RNA, 21 nt, Escherichia coli CFT073
ccacguugcaucacccgcugc

SEQ ID NO: 659410 - RNA, 14 nt, Escherichia coli CFT073
ccacgucacucuuu

SEQ ID NO: 659411 - RNA, 20 nt, Escherichia coli CFT073
ccacuacgcccgcaaucaac

SEQ ID NO: 659412 - RNA, 13 nt, Escherichia coli CFT073
ccacuacgcugua

SEQ ID NO: 659413 - RNA, 21 nt, Escherichia coli CFT073
ccacuacgcuguagccgccau

SEQ ID NO: 659414 - RNA, 13 nt, Escherichia coli CFT073
ccacuaauuccug

SEQ ID NO: 659415 - RNA, 15 nt, Escherichia coli CFT073
ccacuacaccguacu

SEQ ID NO: 659416 - RNA, 21 nt, Escherichia coli CFT073
ccacuacagcggaacuuuuuu

SEQ ID NO: 659417 - RNA, 21 nt, Escherichia coli CFT073
ccacgguucuccacucugcca

SEQ ID NO: 659418 - RNA, 16 nt, Escherichia coli CFT073
ccacgcucgcuggcgu

SEQ ID NO: 659419 - RNA, 20 nt, Escherichia coli CFT073
ccacgcuaccuaagcgccag

SEQ ID NO: 659420 - RNA, 14 nt, Escherichia coli CFT073
ccacgcgcguugau

SEQ ID NO: 659421 - RNA, 14 nt, Escherichia coli CFT073
ccaccgcaaaacgc

SEQ ID NO: 659422 - RNA, 15 nt, Escherichia coli CFT073
cauuuuuuccccuua

SEQ ID NO: 659423 - RNA, 22 nt, Escherichia coli CFT073
ccacccgcaacgcccugcaacu

SEQ ID NO: 659424 - RNA, 13 nt, Escherichia coli CFT073
ccacccgcagcca

SEQ ID NO: 659425 - RNA, 18 nt, Escherichia coli CFT073
ccaccggcaaucugcugg

SEQ ID NO: 659426 - RNA, 18 nt, Escherichia coli CFT073
ccacgcacagaacaaaau

SEQ ID NO: 659427 - RNA, 18 nt, Escherichia coli CFT073
ccacgcacgccugcaucu

SEQ ID NO: 659428 - RNA, 16 nt, Escherichia coli CFT073
ccacgccacaauacug

SEQ ID NO: 659429 - RNA, 18 nt, Escherichia coli CFT073
ccacgccuuuuucuccga

SEQ ID NO: 659430 - RNA, 20 nt, Escherichia coli CFT073
ccacgccguuuuuacccagc

SEQ ID NO: 659431 - RNA, 16 nt, Escherichia coli CFT073
ccacgccgagagaagc

SEQ ID NO: 659432 - RNA, 23 nt, Escherichia coli CFT073
ccacgaccagcgcaaacggcagc

SEQ ID NO: 659433 - RNA, 20 nt, Escherichia coli CFT073
ccaccugcgaacuguaauga

SEQ ID NO: 659434 - RNA, 21 nt, Escherichia coli CFT073
ccaccugaagaaaauccucaa

SEQ ID NO: 659435 - RNA, 16 nt, Escherichia coli CFT073
ccaccgguuuauuauu

SEQ ID NO: 659436 - RNA, 22 nt, Escherichia coli CFT073
cggccuaccgaacuucgccagc

SEQ ID NO: 659437 - RNA, 15 nt, Escherichia coli CFT073
cggccuaccugacug

SEQ ID NO: 659438 - RNA, 20 nt, Escherichia coli CFT073
cggccuaccaugaucugcaa

SEQ ID NO: 659439 - RNA, 19 nt, Escherichia coli CFT073
cggccccuggucgcgcggc

SEQ ID NO: 659440 - RNA, 15 nt, Escherichia coli CFT073
cggccccgcgccagc

SEQ ID NO: 659441 - RNA, 19 nt, Escherichia coli CFT073
cggcccguacugaacccgg

SEQ ID NO: 659442 - RNA, 16 nt, Escherichia coli CFT073
cggcaucaguaacuua

SEQ ID NO: 659443 - RNA, 20 nt, Escherichia coli CFT073
cggcaucauacacgccgccu

SEQ ID NO: 659444 - RNA, 14 nt, Escherichia coli CFT073
cggccagcgcaccu

SEQ ID NO: 659445 - RNA, 12 nt, Escherichia coli CFT073
cggccagcagcu

SEQ ID NO: 659446 - RNA, 18 nt, Escherichia coli CFT073
cggccauugcccgaggau

SEQ ID NO: 659447 - RNA, 21 nt, Escherichia coli CFT073
cggauaagaugcgccagcauc

SEQ ID NO: 659448 - RNA, 23 nt, Escherichia coli CFT073
cggauaacgcguucacccgcauc

SEQ ID NO: 659449 - RNA, 14 nt, Escherichia coli CFT073
cggaucgccgccgg

SEQ ID NO: 659450 - RNA, 17 nt, Escherichia coli CFT073
cggagcaugcuccggcc

SEQ ID NO: 659451 - RNA, 16 nt, Escherichia coli CFT073
cggagcgcaucaggua

SEQ ID NO: 659452 - RNA, 22 nt, Escherichia coli CFT073
cggaguugaccagcuccagcag

SEQ ID NO: 659453 - RNA, 18 nt, Escherichia coli CFT073
cggagcuucacccgcagc

SEQ ID NO: 659454 - RNA, 17 nt, Escherichia coli CFT073
cggaggagugcgccagu

SEQ ID NO: 659455 - RNA, 16 nt, Escherichia coli CFT073
cggaacugcuccaggg

SEQ ID NO: 659456 - RNA, 15 nt, Escherichia coli CFT073
cggaacuuucaccac

SEQ ID NO: 659457 - RNA, 13 nt, Escherichia coli CFT073
cggaacuuuuuuc

SEQ ID NO: 659458 - RNA, 12 nt, Escherichia coli CFT073
cggagcaaccug

SEQ ID NO: 659459 - RNA, 16 nt, Escherichia coli CFT073
cggagaucgccagccc

SEQ ID NO: 659460 - RNA, 12 nt, Escherichia coli CFT073
cggaaauauauu

SEQ ID NO: 659461 - RNA, 15 nt, Escherichia coli CFT073
cggaaagccccgccu

SEQ ID NO: 659462 - RNA, 19 nt, Escherichia coli CFT073
cggaaaggguuaaaccaua

SEQ ID NO: 659463 - RNA, 14 nt, Escherichia coli CFT073
cggaaaucaugcuc

SEQ ID NO: 659464 - RNA, 20 nt, Escherichia coli CFT073
cggaaccggauuuucaccau

SEQ ID NO: 659465 - RNA, 15 nt, Escherichia coli CFT073
cggaucggcucaaca

SEQ ID NO: 659466 - RNA, 16 nt, Escherichia coli CFT073
cggaugacccagcgcg

SEQ ID NO: 659467 - RNA, 20 nt, Escherichia coli CFT073
cggaugacuucgcuacccug

SEQ ID NO: 659468 - RNA, 19 nt, Escherichia coli CFT073
cggauggauccccgcagca

SEQ ID NO: 659469 - RNA, 18 nt, Escherichia coli CFT073
cggauggcaacagcagcc

SEQ ID NO: 659470 - RNA, 13 nt, Escherichia coli CFT073
cggaugcgcuucu

SEQ ID NO: 659471 - RNA, 15 nt, Escherichia coli CFT073
cggaugcgaugcuga

SEQ ID NO: 659472 - RNA, 18 nt, Escherichia coli CFT073
cggaugcgaugcugacac

SEQ ID NO: 659473 - RNA, 18 nt, Escherichia coli CFT073
cggaugcccggucaauac

SEQ ID NO: 659474 - RNA, 21 nt, Escherichia coli CFT073
cggauuguauugagauccugc

SEQ ID NO: 659475 - RNA, 21 nt, Escherichia coli CFT073
cggauuuuucgcgcgggcaga

SEQ ID NO: 659476 - RNA, 15 nt, Escherichia coli CFT073
cggcaaaacccugcg

SEQ ID NO: 659477 - RNA, 19 nt, Escherichia coli CFT073
cggcaaaacggugcaggcu

SEQ ID NO: 659478 - RNA, 20 nt, Escherichia coli CFT073
cggcaaaacggugcaggcuc

SEQ ID NO: 659479 - RNA, 13 nt, Escherichia coli CFT073
cggauuuuccugc

SEQ ID NO: 659480 - RNA, 19 nt, Escherichia coli CFT073
cggcaaaaucuuccagaau

SEQ ID NO: 659481 - RNA, 18 nt, Escherichia coli CFT073
cggcaaacaguugcugau

SEQ ID NO: 659482 - RNA, 21 nt, Escherichia coli CFT073
cggauguuagucucuucuuug

SEQ ID NO: 659483 - RNA, 16 nt, Escherichia coli CFT073
cggauuacccggcauc

SEQ ID NO: 659484 - RNA, 18 nt, Escherichia coli CFT073
cggauuacggcucaaccc

SEQ ID NO: 659485 - RNA, 23 nt, Escherichia coli CFT073
cggauuagaacuaaaggcuguca

SEQ ID NO: 659486 - RNA, 22 nt, Escherichia coli CFT073
cggaugugaugcauccggcaca

SEQ ID NO: 659487 - RNA, 17 nt, Escherichia coli CFT073
cggauucaguaaaucca

SEQ ID NO: 659488 - RNA, 17 nt, Escherichia coli CFT073
cggcacuuuuucaucag

SEQ ID NO: 659489 - RNA, 18 nt, Escherichia coli CFT073
cggcacugaaaguggaaa

SEQ ID NO: 659490 - RNA, 15 nt, Escherichia coli CFT073
cggcacgccggucgg

SEQ ID NO: 659491 - RNA, 12 nt, Escherichia coli CFT073
cggcacuccgcc

SEQ ID NO: 659492 - RNA, 13 nt, Escherichia coli CFT073
cggcaccgaggau

SEQ ID NO: 659493 - RNA, 21 nt, Escherichia coli CFT073
cggcaacaagauuagccauca

SEQ ID NO: 659494 - RNA, 17 nt, Escherichia coli CFT073
cggcaaccagcagcauc

SEQ ID NO: 659495 - RNA, 13 nt, Escherichia coli CFT073
cggcaaccgcauc

SEQ ID NO: 659496 - RNA, 14 nt, Escherichia coli CFT073
cggcaaauaacaga

SEQ ID NO: 659497 - RNA, 21 nt, Escherichia coli CFT073
cggcaaacgggucgagaacga

SEQ ID NO: 659498 - RNA, 15 nt, Escherichia coli CFT073
cggcaaacugcugau

SEQ ID NO: 659499 - RNA, 17 nt, Escherichia coli CFT073
cggcaaccgcauccaga

SEQ ID NO: 659500 - RNA, 19 nt, Escherichia coli CFT073
cggcaaccgcgccaagccu

SEQ ID NO: 659501 - RNA, 19 nt, Escherichia coli CFT073
cggcaccaaucaccgccaa

SEQ ID NO: 659502 - RNA, 13 nt, Escherichia coli CFT073
cggcaccacauuc

SEQ ID NO: 659503 - RNA, 18 nt, Escherichia coli CFT073
cggcaccacauucugcau

SEQ ID NO: 659504 - RNA, 21 nt, Escherichia coli CFT073
cggcaccauuccaccucccgu

SEQ ID NO: 659505 - RNA, 21 nt, Escherichia coli CFT073
cggcaccccugaagcggcaga

SEQ ID NO: 659506 - RNA, 14 nt, Escherichia coli CFT073
cggcaccagcaccg

SEQ ID NO: 659507 - RNA, 16 nt, Escherichia coli CFT073
cggcaccagcaccgug

SEQ ID NO: 659508 - RNA, 17 nt, Escherichia coli CFT073
cggcaggguuugcgccc

SEQ ID NO: 659509 - RNA, 23 nt, Escherichia coli CFT073
cggcaggugauggcggcuuggcu

SEQ ID NO: 659510 - RNA, 17 nt, Escherichia coli CFT073
cggcagguugaugauga

SEQ ID NO: 659511 - RNA, 19 nt, Escherichia coli CFT073
cggcaguauuaccagaccu

SEQ ID NO: 659512 - RNA, 15 nt, Escherichia coli CFT073
cggcagugacagccc

SEQ ID NO: 659513 - RNA, 22 nt, Escherichia coli CFT073
cggcagugacagccccaguucc

SEQ ID NO: 659514 - RNA, 21 nt, Escherichia coli CFT073
cggcagaaugguaacaccaga

SEQ ID NO: 659515 - RNA, 19 nt, Escherichia coli CFT073
cggcagaaugguuucgcuu

SEQ ID NO: 659516 - RNA, 13 nt, Escherichia coli CFT073
cggcagccuccug

SEQ ID NO: 659517 - RNA, 15 nt, Escherichia coli CFT073
cggcagccugacgcc

SEQ ID NO: 659518 - RNA, 23 nt, Escherichia coli CFT073
cggcaggauaaucagguuggcgc

SEQ ID NO: 659519 - RNA, 19 nt, Escherichia coli CFT073
cggcaggccuaacacaugc

SEQ ID NO: 659520 - RNA, 22 nt, Escherichia coli CFT073
cggcaggccuaacacaugcaag

SEQ ID NO: 659521 - RNA, 19 nt, Escherichia coli CFT073
cgcggaucuccggcgaccg

SEQ ID NO: 659522 - RNA, 14 nt, Escherichia coli CFT073
cgcgccgcugagaa

SEQ ID NO: 659523 - RNA, 15 nt, Escherichia coli CFT073
cgcggauggccucug

SEQ ID NO: 659524 - RNA, 22 nt, Escherichia coli CFT073
cgcggauggccucugccagcug

SEQ ID NO: 659525 - RNA, 17 nt, Escherichia coli CFT073
cgcggcaaacugcauga

SEQ ID NO: 659526 - RNA, 19 nt, Escherichia coli CFT073
cgcggauuuuauucagcag

SEQ ID NO: 659527 - RNA, 14 nt, Escherichia coli CFT073
cgcggcagugacag

SEQ ID NO: 659528 - RNA, 20 nt, Escherichia coli CFT073
cgcggcauaacagaaugcgc

SEQ ID NO: 659529 - RNA, 23 nt, Escherichia coli CFT073
cgcggcugcguaauucgccaccg

SEQ ID NO: 659530 - RNA, 13 nt, Escherichia coli CFT073
cgcggcuccagaa

SEQ ID NO: 659531 - RNA, 20 nt, Escherichia coli CFT073
cgcgguguugauacaggcgc

SEQ ID NO: 659532 - RNA, 20 nt, Escherichia coli CFT073
cgcgguugcugucggcggcg

SEQ ID NO: 659533 - RNA, 16 nt, Escherichia coli CFT073
cgcgguuaugccgccg

SEQ ID NO: 659534 - RNA, 22 nt, Escherichia coli CFT073
cgcgguuauuuuggcacacacc

SEQ ID NO: 659535 - RNA, 14 nt, Escherichia coli CFT073
cgcgguucccagcg

SEQ ID NO: 659536 - RNA, 21 nt, Escherichia coli CFT073
cgcguaaauccagcaccgcuu

SEQ ID NO: 659537 - RNA, 22 nt, Escherichia coli CFT073
cgcguaaauccagcaccgcuuu

SEQ ID NO: 659538 - RNA, 22 nt, Escherichia coli CFT073
cgcguccuguaacgcaggaugu

SEQ ID NO: 659539 - RNA, 12 nt, Escherichia coli CFT073
cgcucacgcagc

SEQ ID NO: 659540 - RNA, 18 nt, Escherichia coli CFT073
cgcucacgcagcggcggc

SEQ ID NO: 659541 - RNA, 13 nt, Escherichia coli CFT073
cgcuacuggcaau

SEQ ID NO: 659542 - RNA, 21 nt, Escherichia coli CFT073
cgcuacuggcaauccugcuuu

SEQ ID NO: 659543 - RNA, 18 nt, Escherichia coli CFT073
cgcuaccggcgacuuccu

SEQ ID NO: 659544 - RNA, 23 nt, Escherichia coli CFT073
cgcuaccggcgacuuccugagcu

SEQ ID NO: 659545 - RNA, 16 nt, Escherichia coli CFT073
cgcuaccugccgccac

SEQ ID NO: 659546 - RNA, 20 nt, Escherichia coli CFT073
cgcuaccugccgccaccaug

SEQ ID NO: 659547 - RNA, 11 nt, Escherichia coli CFT073
cgcuaaauaaa

SEQ ID NO: 659548 - RNA, 23 nt, Escherichia coli CFT073
cgcuaaagacuuugcugccuuuc

SEQ ID NO: 659549 - RNA, 12 nt, Escherichia coli CFT073
cgcuaaagcauu

SEQ ID NO: 659550 - RNA, 20 nt, Escherichia coli CFT073
cgcguuuuaucaggccuccg

SEQ ID NO: 659551 - RNA, 13 nt, Escherichia coli CFT073
cgcuaacagcagc

SEQ ID NO: 659552 - RNA, 15 nt, Escherichia coli CFT073
cgcuaacaugguuaa

SEQ ID NO: 659553 - RNA, 20 nt, Escherichia coli CFT073
cgcuaacaugguuaaaaucu

SEQ ID NO: 659554 - RNA, 21 nt, Escherichia coli CFT073
cgcuacccgaacaccaaucuu

SEQ ID NO: 659555 - RNA, 17 nt, Escherichia coli CFT073
cgcuaacgucugguaaa

SEQ ID NO: 659556 - RNA, 14 nt, Escherichia coli CFT073
cgcuaccgcccuga

SEQ ID NO: 659557 - RNA, 14 nt, Escherichia coli CFT073
cgcgugccucuucu

SEQ ID NO: 659558 - RNA, 15 nt, Escherichia coli CFT073
cgcgugcgccaccgc

SEQ ID NO: 659559 - RNA, 14 nt, Escherichia coli CFT073
cgcugguggcaggc

SEQ ID NO: 659560 - RNA, 16 nt, Escherichia coli CFT073
cgcugguggcaggcaa

SEQ ID NO: 659561 - RNA, 14 nt, Escherichia coli CFT073
cgcugguguacugc

SEQ ID NO: 659562 - RNA, 20 nt, Escherichia coli CFT073
cgcugguaaacgacccugcc

SEQ ID NO: 659563 - RNA, 22 nt, Escherichia coli CFT073
cgcuggcgugcggcguaaugcc

SEQ ID NO: 659564 - RNA, 20 nt, Escherichia coli CFT073
cgcuggcguuguccgccaga

SEQ ID NO: 659565 - RNA, 17 nt, Escherichia coli CFT073
cgcuguuuccggcggca

SEQ ID NO: 659566 - RNA, 20 nt, Escherichia coli CFT073
cgcuuaaccggcuucguuuu

SEQ ID NO: 659567 - RNA, 15 nt, Escherichia coli CFT073
cgcuuaacgcgggcu

SEQ ID NO: 659568 - RNA, 14 nt, Escherichia coli CFT073
cgcuuaauccgcgc

SEQ ID NO: 659569 - RNA, 16 nt, Escherichia coli CFT073
cgcuguugccagcagc

SEQ ID NO: 659570 - RNA, 23 nt, Escherichia coli CFT073
cgcugugcugcugacguagcagc

SEQ ID NO: 659571 - RNA, 15 nt, Escherichia coli CFT073
cgcuguguaaaccca

SEQ ID NO: 659572 - RNA, 13 nt, Escherichia coli CFT073
cgcugugaaacac

SEQ ID NO: 659573 - RNA, 15 nt, Escherichia coli CFT073
cgcugugacauccag

SEQ ID NO: 659574 - RNA, 16 nt, Escherichia coli CFT073
cgcugugagcaggcgu

SEQ ID NO: 659575 - RNA, 15 nt, Escherichia coli CFT073
cgcuguacucaccaa

SEQ ID NO: 659576 - RNA, 21 nt, Escherichia coli CFT073
cgcuguaauuucacaccauca

SEQ ID NO: 659577 - RNA, 23 nt, Escherichia coli CFT073
cgcuuuuuuugucugagauuaca

SEQ ID NO: 659578 - RNA, 13 nt, Escherichia coli CFT073
cggaaaacaacac

SEQ ID NO: 659579 - RNA, 16 nt, Escherichia coli CFT073
cggaaaacaaccgcca

SEQ ID NO: 659580 - RNA, 18 nt, Escherichia coli CFT073
cggaaaacaaccgccaug

SEQ ID NO: 659581 - RNA, 17 nt, Escherichia coli CFT073
cgcuuuuuucagcgcca

SEQ ID NO: 659582 - RNA, 15 nt, Escherichia coli CFT073
cgcuuuuuucaucuc

SEQ ID NO: 659583 - RNA, 13 nt, Escherichia coli CFT073
cggaaaagcaaca

SEQ ID NO: 659584 - RNA, 14 nt, Escherichia coli CFT073
cggaaacuggaugg

SEQ ID NO: 659585 - RNA, 17 nt, Escherichia coli CFT073
cgcuuuugguuuuucaa

SEQ ID NO: 659586 - RNA, 21 nt, Escherichia coli CFT073
cgcuuuuccacucacacagcu

SEQ ID NO: 659587 - RNA, 17 nt, Escherichia coli CFT073
cgcuugcauccggcaug

SEQ ID NO: 659588 - RNA, 13 nt, Escherichia coli CFT073
cgcuugaucuucc

SEQ ID NO: 659589 - RNA, 17 nt, Escherichia coli CFT073
cgcuugaucuuccugau

SEQ ID NO: 659590 - RNA, 19 nt, Escherichia coli CFT073
cgcuugauucuguucagua

SEQ ID NO: 659591 - RNA, 22 nt, Escherichia coli CFT073
cgcuuaucaggccuacgaucuu

SEQ ID NO: 659592 - RNA, 21 nt, Escherichia coli CFT073
cgcuuaccauccacaccaaaa

SEQ ID NO: 659593 - RNA, 19 nt, Escherichia coli CFT073
cgcuuuacucaacuccccg

SEQ ID NO: 659594 - RNA, 22 nt, Escherichia coli CFT073
cgcuuuagaaucggugauaaau

SEQ ID NO: 659595 - RNA, 14 nt, Escherichia coli CFT073
cgcuuuauccagca

SEQ ID NO: 659596 - RNA, 22 nt, Escherichia coli CFT073
cgcuuucaagcuugcagaauug

SEQ ID NO: 659597 - RNA, 23 nt, Escherichia coli CFT073
cgcuuucagcacuucggcaucaa

SEQ ID NO: 659598 - RNA, 20 nt, Escherichia coli CFT073
cgcugauaaaucccgccgcu

SEQ ID NO: 659599 - RNA, 18 nt, Escherichia coli CFT073
cgcugaccacuuugcgcu

SEQ ID NO: 659600 - RNA, 16 nt, Escherichia coli CFT073
cgcugaauaaucccca

SEQ ID NO: 659601 - RNA, 23 nt, Escherichia coli CFT073
cgcugacauuacgcgcuucguug

SEQ ID NO: 659602 - RNA, 23 nt, Escherichia coli CFT073
cgcucucuucguggcccgccagc

SEQ ID NO: 659603 - RNA, 19 nt, Escherichia coli CFT073
cgcucugacgacauaauaa

SEQ ID NO: 659604 - RNA, 16 nt, Escherichia coli CFT073
cgcugaacgggccauc

SEQ ID NO: 659605 - RNA, 22 nt, Escherichia coli CFT073
cgcucucgccgcgcuccaucau

SEQ ID NO: 659606 - RNA, 22 nt, Escherichia coli CFT073
cgcugcugccguugccgcucuu

SEQ ID NO: 659607 - RNA, 13 nt, Escherichia coli CFT073
cgcugcugggcug

SEQ ID NO: 659608 - RNA, 22 nt, Escherichia coli CFT073
cgcuggcaaaaaaguagcgcag

SEQ ID NO: 659609 - RNA, 11 nt, Escherichia coli CFT073
cgcuggaucga

SEQ ID NO: 659610 - RNA, 22 nt, Escherichia coli CFT073
cgcuggcagcaagugcggcgca

SEQ ID NO: 659611 - RNA, 14 nt, Escherichia coli CFT073
cgcuggcagcagaa

SEQ ID NO: 659612 - RNA, 20 nt, Escherichia coli CFT073
cgcuggccuccagcacuucc

SEQ ID NO: 659613 - RNA, 21 nt, Escherichia coli CFT073
cgcuggccuccagcacuuccu

SEQ ID NO: 659614 - RNA, 16 nt, Escherichia coli CFT073
cgcugcgcaggcaaua

SEQ ID NO: 659615 - RNA, 21 nt, Escherichia coli CFT073
cgcugcgccauaaccgccagc

SEQ ID NO: 659616 - RNA, 22 nt, Escherichia coli CFT073
cgcugcgccauaaccgccagca

SEQ ID NO: 659617 - RNA, 15 nt, Escherichia coli CFT073
cgcugcugcacauac

SEQ ID NO: 659618 - RNA, 13 nt, Escherichia coli CFT073
cgcugcuaauuua

SEQ ID NO: 659619 - RNA, 17 nt, Escherichia coli CFT073
cgcugcucacaccaugc

SEQ ID NO: 659620 - RNA, 20 nt, Escherichia coli CFT073
cgcugcguacagcgcgggcu

SEQ ID NO: 659621 - RNA, 19 nt, Escherichia coli CFT073
cgggaaaaauugccugaug

SEQ ID NO: 659622 - RNA, 18 nt, Escherichia coli CFT073
cggcuuuuuuacgccugu

SEQ ID NO: 659623 - RNA, 22 nt, Escherichia coli CFT073
cggcuuuuuuauugcugcacca

SEQ ID NO: 659624 - RNA, 16 nt, Escherichia coli CFT073
cggcuuuuuucauuuc

SEQ ID NO: 659625 - RNA, 13 nt, Escherichia coli CFT073
cggcuuuuuucuc

SEQ ID NO: 659626 - RNA, 15 nt, Escherichia coli CFT073
cgggaagugcgccca

SEQ ID NO: 659627 - RNA, 14 nt, Escherichia coli CFT073
cgggaauagcucag

SEQ ID NO: 659628 - RNA, 17 nt, Escherichia coli CFT073
cgggcaggguagcgcag

SEQ ID NO: 659629 - RNA, 20 nt, Escherichia coli CFT073
cgggcaggcuucaacacagg

SEQ ID NO: 659630 - RNA, 16 nt, Escherichia coli CFT073
cgggccugaacaagca

SEQ ID NO: 659631 - RNA, 17 nt, Escherichia coli CFT073
cgggccguaacugugcc

SEQ ID NO: 659632 - RNA, 21 nt, Escherichia coli CFT073
cgggccgcaaaccagcgcaug

SEQ ID NO: 659633 - RNA, 13 nt, Escherichia coli CFT073
cgggccgcagaga

SEQ ID NO: 659634 - RNA, 15 nt, Escherichia coli CFT073
cgggccgcaaaccag

SEQ ID NO: 659635 - RNA, 16 nt, Escherichia coli CFT073
cgggcgugcugccuuu

SEQ ID NO: 659636 - RNA, 23 nt, Escherichia coli CFT073
cgggcgucgaaaauaucgagcag

SEQ ID NO: 659637 - RNA, 13 nt, Escherichia coli CFT073
cgggcgcugaggu

SEQ ID NO: 659638 - RNA, 20 nt, Escherichia coli CFT073
cgggcgcuuccagccaugcc

SEQ ID NO: 659639 - RNA, 22 nt, Escherichia coli CFT073
cggguaggcugcuugagccagu

SEQ ID NO: 659640 - RNA, 17 nt, Escherichia coli CFT073
cggguagcgcggcagcg

SEQ ID NO: 659641 - RNA, 17 nt, Escherichia coli CFT073
cggguacgguaaaggac

SEQ ID NO: 659642 - RNA, 20 nt, Escherichia coli CFT073
cgggcuguuuuccagcacca

SEQ ID NO: 659643 - RNA, 17 nt, Escherichia coli CFT073
cggcgcucaucaggcca

SEQ ID NO: 659644 - RNA, 14 nt, Escherichia coli CFT073
cggcgcugaccacu

SEQ ID NO: 659645 - RNA, 10 nt, Escherichia coli CFT073
cggcggcgga

SEQ ID NO: 659646 - RNA, 21 nt, Escherichia coli CFT073
cggcggcucuuuugcugacuu

SEQ ID NO: 659647 - RNA, 15 nt, Escherichia coli CFT073
cggcguaaacgccuu

SEQ ID NO: 659648 - RNA, 13 nt, Escherichia coli CFT073
cggcuucaucuuu

SEQ ID NO: 659649 - RNA, 23 nt, Escherichia coli CFT073
cggcuuauugcuucaagaugcca

SEQ ID NO: 659650 - RNA, 13 nt, Escherichia coli CFT073
cggcuucacgccc

SEQ ID NO: 659651 - RNA, 14 nt, Escherichia coli CFT073
cggcuguccggcac

SEQ ID NO: 659652 - RNA, 15 nt, Escherichia coli CFT073
cggcuguuccggcac

SEQ ID NO: 659653 - RNA, 19 nt, Escherichia coli CFT073
cggcuuaaugcacggcaga

SEQ ID NO: 659654 - RNA, 17 nt, Escherichia coli CFT073
cggcuuaauugcccaaa

SEQ ID NO: 659655 - RNA, 15 nt, Escherichia coli CFT073
cggcuuaucggucag

SEQ ID NO: 659656 - RNA, 20 nt, Escherichia coli CFT073
cggcuucgcaucccgguauc

SEQ ID NO: 659657 - RNA, 16 nt, Escherichia coli CFT073
cggcuggguagcuucc

SEQ ID NO: 659658 - RNA, 23 nt, Escherichia coli CFT073
cggcuguagagcuaccggcagga

SEQ ID NO: 659659 - RNA, 21 nt, Escherichia coli CFT073
cggcugggaaaucaccaccag

SEQ ID NO: 659660 - RNA, 14 nt, Escherichia coli CFT073
cggcugccagccag

SEQ ID NO: 659661 - RNA, 13 nt, Escherichia coli CFT073
cggcgugccgucg

SEQ ID NO: 659662 - RNA, 14 nt, Escherichia coli CFT073
cggcucaccugcac

SEQ ID NO: 659663 - RNA, 19 nt, Escherichia coli CFT073
cggcuauauacagcgccuc

SEQ ID NO: 659664 - RNA, 21 nt, Escherichia coli CFT073
cggcucacccccaucagcauc

SEQ ID NO: 659665 - RNA, 20 nt, Escherichia coli CFT073
cgucaauuugcuccgccagu

SEQ ID NO: 659666 - RNA, 13 nt, Escherichia coli CFT073
cgucaaucugccc

SEQ ID NO: 659667 - RNA, 20 nt, Escherichia coli CFT073
cgucaaucugcccgaccaga

SEQ ID NO: 659668 - RNA, 16 nt, Escherichia coli CFT073
cgucaccaccugggug

SEQ ID NO: 659669 - RNA, 19 nt, Escherichia coli CFT073
cgucacaggcacaccgccg

SEQ ID NO: 659670 - RNA, 18 nt, Escherichia coli CFT073
cgucacaggccucaagcu

SEQ ID NO: 659671 - RNA, 13 nt, Escherichia coli CFT073
cgucaaauccaga

SEQ ID NO: 659672 - RNA, 17 nt, Escherichia coli CFT073
cgucaaccugaccaaau

SEQ ID NO: 659673 - RNA, 13 nt, Escherichia coli CFT073
cgucaacuucuuu

SEQ ID NO: 659674 - RNA, 14 nt, Escherichia coli CFT073
cgucaacgccgcgu

SEQ ID NO: 659675 - RNA, 22 nt, Escherichia coli CFT073
cgucaagcgguaaccauccaua

SEQ ID NO: 659676 - RNA, 20 nt, Escherichia coli CFT073
cgucacuggugugucaucug

SEQ ID NO: 659677 - RNA, 21 nt, Escherichia coli CFT073
cgucacuggugugucaucugc

SEQ ID NO: 659678 - RNA, 17 nt, Escherichia coli CFT073
cgucacguaggcuucau

SEQ ID NO: 659679 - RNA, 20 nt, Escherichia coli CFT073
cgucacgcaccaacuccucu

SEQ ID NO: 659680 - RNA, 12 nt, Escherichia coli CFT073
cgucaccagcau

SEQ ID NO: 659681 - RNA, 14 nt, Escherichia coli CFT073
cgucaccugcccgg

SEQ ID NO: 659682 - RNA, 21 nt, Escherichia coli CFT073
cgucaguaaugaucugaucaa

SEQ ID NO: 659683 - RNA, 15 nt, Escherichia coli CFT073
cgucaucagcaauuu

SEQ ID NO: 659684 - RNA, 22 nt, Escherichia coli CFT073
cgucauacgaucaguuacucug

SEQ ID NO: 659685 - RNA, 19 nt, Escherichia coli CFT073
cgucaucggcguugcccau

SEQ ID NO: 659686 - RNA, 15 nt, Escherichia coli CFT073
cgucaugcuccugau

SEQ ID NO: 659687 - RNA, 14 nt, Escherichia coli CFT073
cgucaggauaaacu

SEQ ID NO: 659688 - RNA, 23 nt, Escherichia coli CFT073
cgucaggccaacauccaucagcg

SEQ ID NO: 659689 - RNA, 23 nt, Escherichia coli CFT073
cgucaggauuaaacuggcacgcu

SEQ ID NO: 659690 - RNA, 14 nt, Escherichia coli CFT073
cgucaggccgccac

SEQ ID NO: 659691 - RNA, 14 nt, Escherichia coli CFT073
cgucagcuucagau

SEQ ID NO: 659692 - RNA, 20 nt, Escherichia coli CFT073
cgucagaaauuaaacugucg

SEQ ID NO: 659693 - RNA, 16 nt, Escherichia coli CFT073
cgucagauccgccagu

SEQ ID NO: 659694 - RNA, 17 nt, Escherichia coli CFT073
cgucagcaaaauacuga

SEQ ID NO: 659695 - RNA, 22 nt, Escherichia coli CFT073
cgucagauuauucaaaaacaga

SEQ ID NO: 659696 - RNA, 17 nt, Escherichia coli CFT073
cgucagcacucacgcca

SEQ ID NO: 659697 - RNA, 11 nt, Escherichia coli CFT073
cgucagccaca

SEQ ID NO: 659698 - RNA, 14 nt, Escherichia coli CFT073
cgucagccgcccgc

SEQ ID NO: 659699 - RNA, 18 nt, Escherichia coli CFT073
cguauuggugcauaacac

SEQ ID NO: 659700 - RNA, 10 nt, Escherichia coli CFT073
cgucaaaagg

SEQ ID NO: 659701 - RNA, 22 nt, Escherichia coli CFT073
cguaucuuuaaagcccgcagcg

SEQ ID NO: 659702 - RNA, 14 nt, Escherichia coli CFT073
cguaucuccaguaa

SEQ ID NO: 659703 - RNA, 19 nt, Escherichia coli CFT073
cguaucgaccagaauaagu

SEQ ID NO: 659704 - RNA, 16 nt, Escherichia coli CFT073
cguauccgguuuucca

SEQ ID NO: 659705 - RNA, 14 nt, Escherichia coli CFT073
cguaugcccagcgc

SEQ ID NO: 659706 - RNA, 14 nt, Escherichia coli CFT073
cguaugcagccagg

SEQ ID NO: 659707 - RNA, 13 nt, Escherichia coli CFT073
cguauuacugaga

SEQ ID NO: 659708 - RNA, 14 nt, Escherichia coli CFT073
cguauuacugagau

SEQ ID NO: 659709 - RNA, 14 nt, Escherichia coli CFT073
cguauuaugcacac

SEQ ID NO: 659710 - RNA, 20 nt, Escherichia coli CFT073
cguauaccugauuaccaaaa

SEQ ID NO: 659711 - RNA, 18 nt, Escherichia coli CFT073
cguaguacccucugcacc

SEQ ID NO: 659712 - RNA, 21 nt, Escherichia coli CFT073
cguaguacccucugcaccaga

SEQ ID NO: 659713 - RNA, 13 nt, Escherichia coli CFT073
cguaggucaugcc

SEQ ID NO: 659714 - RNA, 22 nt, Escherichia coli CFT073
cguaguacuuuaacucacggcg

SEQ ID NO: 659715 - RNA, 18 nt, Escherichia coli CFT073
cguagucugaccucuucu

SEQ ID NO: 659716 - RNA, 18 nt, Escherichia coli CFT073
cguaguguaaaugcaaau

SEQ ID NO: 659717 - RNA, 17 nt, Escherichia coli CFT073
cguaguuugucuucaau

SEQ ID NO: 659718 - RNA, 16 nt, Escherichia coli CFT073
cguaacggaaagagua

SEQ ID NO: 659719 - RNA, 20 nt, Escherichia coli CFT073
cguagaagccagagaacaga

SEQ ID NO: 659720 - RNA, 14 nt, Escherichia coli CFT073
cguagacauaaccg

SEQ ID NO: 659721 - RNA, 21 nt, Escherichia coli CFT073
cguagacuuccccacaaaaua

SEQ ID NO: 659722 - RNA, 16 nt, Escherichia coli CFT073
cguagagaaaaccagu

SEQ ID NO: 659723 - RNA, 13 nt, Escherichia coli CFT073
cguagcaggaaau

SEQ ID NO: 659724 - RNA, 15 nt, Escherichia coli CFT073
cguagcaagcauccc

SEQ ID NO: 659725 - RNA, 15 nt, Escherichia coli CFT073
cguagccaggcuuug

SEQ ID NO: 659726 - RNA, 14 nt, Escherichia coli CFT073
cguagccauuacca

SEQ ID NO: 659727 - RNA, 19 nt, Escherichia coli CFT073
cguagccccagucuuccug

SEQ ID NO: 659728 - RNA, 23 nt, Escherichia coli CFT073
cguaggcuucauuacgcgcuggg

SEQ ID NO: 659729 - RNA, 14 nt, Escherichia coli CFT073
cguaggccugauaa

SEQ ID NO: 659730 - RNA, 14 nt, Escherichia coli CFT073
cguaggagugcccc

SEQ ID NO: 659731 - RNA, 14 nt, Escherichia coli CFT073
cguagcucaucuuc

SEQ ID NO: 659732 - RNA, 13 nt, Escherichia coli CFT073
cguagcgcaucag

SEQ ID NO: 659733 - RNA, 19 nt, Escherichia coli CFT073
cguagcguuuuuucauuuc

SEQ ID NO: 659734 - RNA, 22 nt, Escherichia coli CFT073
cguagcuuauuguacagcgccc

SEQ ID NO: 659735 - RNA, 19 nt, Escherichia coli CFT073
cgguugcggaacccagcgc

SEQ ID NO: 659736 - RNA, 12 nt, Escherichia coli CFT073
cgguuauccugc

SEQ ID NO: 659737 - RNA, 18 nt, Escherichia coli CFT073
cgguuauccugcaaauaa

SEQ ID NO: 659738 - RNA, 16 nt, Escherichia coli CFT073
cgguucaauaucuucc

SEQ ID NO: 659739 - RNA, 12 nt, Escherichia coli CFT073
cgguugccauaa

SEQ ID NO: 659740 - RNA, 13 nt, Escherichia coli CFT073
cgguuucuuuauc

SEQ ID NO: 659741 - RNA, 16 nt, Escherichia coli CFT073
cgguuucucuucugcu

SEQ ID NO: 659742 - RNA, 15 nt, Escherichia coli CFT073
cgguuuccacuucca

SEQ ID NO: 659743 - RNA, 15 nt, Escherichia coli CFT073
cgguuucaucagcca

SEQ ID NO: 659744 - RNA, 14 nt, Escherichia coli CFT073
cgguuucagccagg

SEQ ID NO: 659745 - RNA, 19 nt, Escherichia coli CFT073
cgguuuccaggcagccaua

SEQ ID NO: 659746 - RNA, 20 nt, Escherichia coli CFT073
cgguuuccaggcagccauaa

SEQ ID NO: 659747 - RNA, 23 nt, Escherichia coli CFT073
cgguuguucaaccaccggcacca

SEQ ID NO: 659748 - RNA, 20 nt, Escherichia coli CFT073
cgguugugugcuggccauca

SEQ ID NO: 659749 - RNA, 22 nt, Escherichia coli CFT073
cgguuguucaaccaccggcacc

SEQ ID NO: 659750 - RNA, 13 nt, Escherichia coli CFT073
cgguuuaccauca

SEQ ID NO: 659751 - RNA, 14 nt, Escherichia coli CFT073
cgguuuacccugcu

SEQ ID NO: 659752 - RNA, 22 nt, Escherichia coli CFT073
cgguuuaccgaugccgcggcgc

SEQ ID NO: 659753 - RNA, 15 nt, Escherichia coli CFT073
cgguuucaauccagg

SEQ ID NO: 659754 - RNA, 23 nt, Escherichia coli CFT073
cguaaacagggggaggcaucuuc

SEQ ID NO: 659755 - RNA, 18 nt, Escherichia coli CFT073
cguaaaccacugacacag

SEQ ID NO: 659756 - RNA, 16 nt, Escherichia coli CFT073
cgguuuucugccuggu

SEQ ID NO: 659757 - RNA, 19 nt, Escherichia coli CFT073
cgguuuuguugccgcccgu

SEQ ID NO: 659758 - RNA, 15 nt, Escherichia coli CFT073
cguaaaaugcggaaa

SEQ ID NO: 659759 - RNA, 18 nt, Escherichia coli CFT073
cgguuugagagucaucca

SEQ ID NO: 659760 - RNA, 17 nt, Escherichia coli CFT073
cguaacgccagaaagac

SEQ ID NO: 659761 - RNA, 22 nt, Escherichia coli CFT073
cguaacgccgcgauagagagca

SEQ ID NO: 659762 - RNA, 23 nt, Escherichia coli CFT073
cguaacgccgcgauagagagcag

SEQ ID NO: 659763 - RNA, 12 nt, Escherichia coli CFT073
cguaacgacggc

SEQ ID NO: 659764 - RNA, 13 nt, Escherichia coli CFT073
cguaacgacugac

SEQ ID NO: 659765 - RNA, 19 nt, Escherichia coli CFT073
cguaaccaccagcacugau

SEQ ID NO: 659766 - RNA, 16 nt, Escherichia coli CFT073
cguaaccagcgcagac

SEQ ID NO: 659767 - RNA, 17 nt, Escherichia coli CFT073
cguaaccagcgcagaca

SEQ ID NO: 659768 - RNA, 18 nt, Escherichia coli CFT073
cguaaagcaucagacugc

SEQ ID NO: 659769 - RNA, 18 nt, Escherichia coli CFT073
cguaaacuuuagcacaau

SEQ ID NO: 659770 - RNA, 18 nt, Escherichia coli CFT073
cgguuagcggcuucaaag

SEQ ID NO: 659771 - RNA, 17 nt, Escherichia coli CFT073
cgguuacggauuucccg

SEQ ID NO: 659772 - RNA, 14 nt, Escherichia coli CFT073
cgguuaauuccagc

SEQ ID NO: 659773 - RNA, 12 nt, Escherichia coli CFT073
cgguuaacaaua

SEQ ID NO: 659774 - RNA, 18 nt, Escherichia coli CFT073
cgguuaacgccagccaca

SEQ ID NO: 659775 - RNA, 18 nt, Escherichia coli CFT073
cgguuaacugcaugucag

SEQ ID NO: 659776 - RNA, 18 nt, Escherichia coli CFT073
cgguuaaaaacagccagc

SEQ ID NO: 659777 - RNA, 23 nt, Escherichia coli CFT073
cgguuaaaacaauuaacccgcga

SEQ ID NO: 659778 - RNA, 13 nt, Escherichia coli CFT073
cggugggcugaca

SEQ ID NO: 659779 - RNA, 18 nt, Escherichia coli CFT073
cggugucgccgaagcagc

SEQ ID NO: 659780 - RNA, 15 nt, Escherichia coli CFT073
cgguguccacuuccg

SEQ ID NO: 659781 - RNA, 17 nt, Escherichia coli CFT073
cgguguauuaccuccgc

SEQ ID NO: 659782 - RNA, 21 nt, Escherichia coli CFT073
cggugcaccuuguuucagcac

SEQ ID NO: 659783 - RNA, 18 nt, Escherichia coli CFT073
cggugccaaagucaucaa

SEQ ID NO: 659784 - RNA, 16 nt, Escherichia coli CFT073
cggugccaucuccagu

SEQ ID NO: 659785 - RNA, 23 nt, Escherichia coli CFT073
cgguggcaguagcgccucuucca

SEQ ID NO: 659786 - RNA, 14 nt, Escherichia coli CFT073
cgguggccacagca

SEQ ID NO: 659787 - RNA, 13 nt, Escherichia coli CFT073
cgguggcaagcag

SEQ ID NO: 659788 - RNA, 20 nt, Escherichia coli CFT073
cggucgugacugccgccagc

SEQ ID NO: 659789 - RNA, 21 nt, Escherichia coli CFT073
cggucgugacugccgccagca

SEQ ID NO: 659790 - RNA, 23 nt, Escherichia coli CFT073
cggucgugacugccgccagcauu

SEQ ID NO: 659791 - RNA, 18 nt, Escherichia coli CFT073
cggucgguaaacccggcc

SEQ ID NO: 659792 - RNA, 20 nt, Escherichia coli CFT073
cggugaccgagcgcccgcca

SEQ ID NO: 659793 - RNA, 14 nt, Escherichia coli CFT073
cggugacuggcuua

SEQ ID NO: 659794 - RNA, 20 nt, Escherichia coli CFT073
cggugacuggcuuaauaauu

SEQ ID NO: 659795 - RNA, 13 nt, Escherichia coli CFT073
cggugaugaugcu

SEQ ID NO: 659796 - RNA, 16 nt, Escherichia coli CFT073
cggucgcugccgccau

SEQ ID NO: 659797 - RNA, 17 nt, Escherichia coli CFT073
cggucacaucgcugaca

SEQ ID NO: 659798 - RNA, 21 nt, Escherichia coli CFT073
cgggucgcaaacaacgccaca

SEQ ID NO: 659799 - RNA, 16 nt, Escherichia coli CFT073
cgguccacuuccugcg

SEQ ID NO: 659800 - RNA, 13 nt, Escherichia coli CFT073
cgguccuucaucu

SEQ ID NO: 659801 - RNA, 21 nt, Escherichia coli CFT073
cgguccgccacauaccacggc

SEQ ID NO: 659802 - RNA, 16 nt, Escherichia coli CFT073
cgccgagcaaaccaca

SEQ ID NO: 659803 - RNA, 21 nt, Escherichia coli CFT073
cgccgacggucaggcuaauac

SEQ ID NO: 659804 - RNA, 16 nt, Escherichia coli CFT073
cgccgagcaaugagcu

SEQ ID NO: 659805 - RNA, 18 nt, Escherichia coli CFT073
cgccgaagcagcugcugg

SEQ ID NO: 659806 - RNA, 14 nt, Escherichia coli CFT073
cgcccuucccccau

SEQ ID NO: 659807 - RNA, 16 nt, Escherichia coli CFT073
cgcccuguaauucgua

SEQ ID NO: 659808 - RNA, 13 nt, Escherichia coli CFT073
cgcccuuuaugca

SEQ ID NO: 659809 - RNA, 12 nt, Escherichia coli CFT073
cgcccugccuuu

SEQ ID NO: 659810 - RNA, 20 nt, Escherichia coli CFT073
cgcccugaauuucaauaauu

SEQ ID NO: 659811 - RNA, 14 nt, Escherichia coli CFT073
cgcccguucuuccu

SEQ ID NO: 659812 - RNA, 16 nt, Escherichia coli CFT073
cgcccguucuuccuca

SEQ ID NO: 659813 - RNA, 19 nt, Escherichia coli CFT073
cgccgauaucgcuggcaga

SEQ ID NO: 659814 - RNA, 17 nt, Escherichia coli CFT073
cgccgauacgcauaaac

SEQ ID NO: 659815 - RNA, 18 nt, Escherichia coli CFT073
cgccgaggugcuuuccac

SEQ ID NO: 659816 - RNA, 13 nt, Escherichia coli CFT073
cgccgcacccggc

SEQ ID NO: 659817 - RNA, 19 nt, Escherichia coli CFT073
cgccgcaauauuccggcau

SEQ ID NO: 659818 - RNA, 22 nt, Escherichia coli CFT073
cgccgcacaagucagcaacgau

SEQ ID NO: 659819 - RNA, 21 nt, Escherichia coli CFT073
cgccgauuucucaucaauuaa

SEQ ID NO: 659820 - RNA, 14 nt, Escherichia coli CFT073
cgccgcaaaaccca

SEQ ID NO: 659821 - RNA, 13 nt, Escherichia coli CFT073
cgccgccaaucgc

SEQ ID NO: 659822 - RNA, 21 nt, Escherichia coli CFT073
cgccgccaaucgcccgggcuu

SEQ ID NO: 659823 - RNA, 24 nt, Escherichia coli CFT073
cgccgccaaacugugcaccgcccu

SEQ ID NO: 659824 - RNA, 12 nt, Escherichia coli CFT073
cgccgccaaagg

SEQ ID NO: 659825 - RNA, 16 nt, Escherichia coli CFT073
cgccgccaccgccaga

SEQ ID NO: 659826 - RNA, 19 nt, Escherichia coli CFT073
cgccgcauuauggugaaga

SEQ ID NO: 659827 - RNA, 15 nt, Escherichia coli CFT073
cgccgcauccggcau

SEQ ID NO: 659828 - RNA, 17 nt, Escherichia coli CFT073
cgccgcagucagggucu

SEQ ID NO: 659829 - RNA, 17 nt, Escherichia coli CFT073
cgccgcauaauaucuuu

SEQ ID NO: 659830 - RNA, 20 nt, Escherichia coli CFT073
cgccgcauaauaucuuuccu

SEQ ID NO: 659831 - RNA, 23 nt, Escherichia coli CFT073
cgccgcagguagcagcagcgcca

SEQ ID NO: 659832 - RNA, 21 nt, Escherichia coli CFT073
cgccgcccccacugccgccuu

SEQ ID NO: 659833 - RNA, 14 nt, Escherichia coli CFT073
cgccgccagcgggg

SEQ ID NO: 659834 - RNA, 14 nt, Escherichia coli CFT073
cgccgccagauccu

SEQ ID NO: 659835 - RNA, 20 nt, Escherichia coli CFT073
cgccgccagauguuccgcca

SEQ ID NO: 659836 - RNA, 22 nt, Escherichia coli CFT073
cgccgccacuugagccgccacc

SEQ ID NO: 659837 - RNA, 11 nt, Escherichia coli CFT073
cgccgccgccc

SEQ ID NO: 659838 - RNA, 18 nt, Escherichia coli CFT073
cgccgcgagcaucgcgag

SEQ ID NO: 659839 - RNA, 18 nt, Escherichia coli CFT073
cgccgcgauaaaauccca

SEQ ID NO: 659840 - RNA, 16 nt, Escherichia coli CFT073
cgccgcgugccaccau

SEQ ID NO: 659841 - RNA, 16 nt, Escherichia coli CFT073
cgccgcguacgccgcu

SEQ ID NO: 659842 - RNA, 14 nt, Escherichia coli CFT073
cgccgcggcgcagc

SEQ ID NO: 659843 - RNA, 13 nt, Escherichia coli CFT073
cgccgcgcuccau

SEQ ID NO: 659844 - RNA, 14 nt, Escherichia coli CFT073
cgccgcuccucauc

SEQ ID NO: 659845 - RNA, 19 nt, Escherichia coli CFT073
cgccgcuucgucgucgucc

SEQ ID NO: 659846 - RNA, 23 nt, Escherichia coli CFT073
cgccggagagggaaauacccugg

SEQ ID NO: 659847 - RNA, 21 nt, Escherichia coli CFT073
cgccggauagcuaaucaucug

SEQ ID NO: 659848 - RNA, 17 nt, Escherichia coli CFT073
cgccggaugcggcaggc

SEQ ID NO: 659849 - RNA, 14 nt, Escherichia coli CFT073
cgccggucacgccg

SEQ ID NO: 659850 - RNA, 20 nt, Escherichia coli CFT073
cgccgguuaaucuaaucugu

SEQ ID NO: 659851 - RNA, 12 nt, Escherichia coli CFT073
cgccguccagga

SEQ ID NO: 659852 - RNA, 15 nt, Escherichia coli CFT073
cgccguccaggaacc

SEQ ID NO: 659853 - RNA, 18 nt, Escherichia coli CFT073
cgccgucaucacgcaggc

SEQ ID NO: 659854 - RNA, 20 nt, Escherichia coli CFT073
cgccgucaucacgcaggcug

SEQ ID NO: 659855 - RNA, 17 nt, Escherichia coli CFT073
cgcgccaaucagcgcag

SEQ ID NO: 659856 - RNA, 18 nt, Escherichia coli CFT073
cgcgccaagauagaacca

SEQ ID NO: 659857 - RNA, 20 nt, Escherichia coli CFT073
cgcgcagcucuuuauccagc

SEQ ID NO: 659858 - RNA, 22 nt, Escherichia coli CFT073
cgcgcagggugcagaaucaauc

SEQ ID NO: 659859 - RNA, 15 nt, Escherichia coli CFT073
cgcgcaccuacagcc

SEQ ID NO: 659860 - RNA, 20 nt, Escherichia coli CFT073
cgcgcaccggaacaacccag

SEQ ID NO: 659861 - RNA, 22 nt, Escherichia coli CFT073
cgcgcccagccugaaugccgcg

SEQ ID NO: 659862 - RNA, 13 nt, Escherichia coli CFT073
cgcgcccaaccag

SEQ ID NO: 659863 - RNA, 16 nt, Escherichia coli CFT073
cgcgcccaaccagcag

SEQ ID NO: 659864 - RNA, 22 nt, Escherichia coli CFT073
cgcgccaguaccgccgcaguca

SEQ ID NO: 659865 - RNA, 14 nt, Escherichia coli CFT073
cgcgccgccaaccc

SEQ ID NO: 659866 - RNA, 15 nt, Escherichia coli CFT073
cgcgccgccaacccc

SEQ ID NO: 659867 - RNA, 14 nt, Escherichia coli CFT073
cgcgccgccaccgc

SEQ ID NO: 659868 - RNA, 12 nt, Escherichia coli CFT073
cgcgccgccagc

SEQ ID NO: 659869 - RNA, 15 nt, Escherichia coli CFT073
cgcgccgccagccac

SEQ ID NO: 659870 - RNA, 16 nt, Escherichia coli CFT073
cgcgccgccagccaca

SEQ ID NO: 659871 - RNA, 19 nt, Escherichia coli CFT073
cgcgccgccagccacaggc

SEQ ID NO: 659872 - RNA, 16 nt, Escherichia coli CFT073
cgcgcacaucaggacg

SEQ ID NO: 659873 - RNA, 21 nt, Escherichia coli CFT073
cgcgauggcuggaaucaucaa

SEQ ID NO: 659874 - RNA, 15 nt, Escherichia coli CFT073
cgcgcaaauccacgu

SEQ ID NO: 659875 - RNA, 15 nt, Escherichia coli CFT073
cgcgcaaccacaacg

SEQ ID NO: 659876 - RNA, 15 nt, Escherichia coli CFT073
cgcgcaaacccucua

SEQ ID NO: 659877 - RNA, 18 nt, Escherichia coli CFT073
cgcgaguagguagaauau

SEQ ID NO: 659878 - RNA, 17 nt, Escherichia coli CFT073
cgcgauaaaaucccaua

SEQ ID NO: 659879 - RNA, 14 nt, Escherichia coli CFT073
cgcgauauugcugc

SEQ ID NO: 659880 - RNA, 19 nt, Escherichia coli CFT073
cgcgacaaucgcccccauc

SEQ ID NO: 659881 - RNA, 15 nt, Escherichia coli CFT073
cgcgacauaucgcca

SEQ ID NO: 659882 - RNA, 12 nt, Escherichia coli CFT073
cgcgaccaccuc

SEQ ID NO: 659883 - RNA, 17 nt, Escherichia coli CFT073
cgcgaccagaccgcuuu

SEQ ID NO: 659884 - RNA, 20 nt, Escherichia coli CFT073
cgcgaccaucggaucggcca

SEQ ID NO: 659885 - RNA, 16 nt, Escherichia coli CFT073
cgcgacucccugacug

SEQ ID NO: 659886 - RNA, 17 nt, Escherichia coli CFT073
cgccugcgugcaguucc

SEQ ID NO: 659887 - RNA, 21 nt, Escherichia coli CFT073
cgccugcgugcaguuccugcu

SEQ ID NO: 659888 - RNA, 20 nt, Escherichia coli CFT073
cgccugcugcgucgcggccu

SEQ ID NO: 659889 - RNA, 19 nt, Escherichia coli CFT073
cgccugcuggcuagccucc

SEQ ID NO: 659890 - RNA, 15 nt, Escherichia coli CFT073
cgccugcugcacacc

SEQ ID NO: 659891 - RNA, 18 nt, Escherichia coli CFT073
cgccugcauaaaggcaaa

SEQ ID NO: 659892 - RNA, 16 nt, Escherichia coli CFT073
cgccugccuucccuuc

SEQ ID NO: 659893 - RNA, 17 nt, Escherichia coli CFT073
cgccugccuucccuucu

SEQ ID NO: 659894 - RNA, 19 nt, Escherichia coli CFT073
cgccugucaccgccuccac

SEQ ID NO: 659895 - RNA, 13 nt, Escherichia coli CFT073
cgccuggcagcau

SEQ ID NO: 659896 - RNA, 23 nt, Escherichia coli CFT073
cgccuguugauugcguucaaucu

SEQ ID NO: 659897 - RNA, 16 nt, Escherichia coli CFT073
cgccuuauccggccug

SEQ ID NO: 659898 - RNA, 18 nt, Escherichia coli CFT073
cgccuucauucaccaguu

SEQ ID NO: 659899 - RNA, 13 nt, Escherichia coli CFT073
cgcgaagaaacga

SEQ ID NO: 659900 - RNA, 12 nt, Escherichia coli CFT073
cgcgaagcuggu

SEQ ID NO: 659901 - RNA, 15 nt, Escherichia coli CFT073
cgcgaaucuucauag

SEQ ID NO: 659902 - RNA, 14 nt, Escherichia coli CFT073
cgcgaaaccuuacg

SEQ ID NO: 659903 - RNA, 20 nt, Escherichia coli CFT073
cgcgaaaacccucgaccauc

SEQ ID NO: 659904 - RNA, 17 nt, Escherichia coli CFT073
cgcgaaaaugccccagc

SEQ ID NO: 659905 - RNA, 19 nt, Escherichia coli CFT073
cgcgaaagauaagguguca

SEQ ID NO: 659906 - RNA, 19 nt, Escherichia coli CFT073
cgcgaaaguuaccgcgcca

SEQ ID NO: 659907 - RNA, 19 nt, Escherichia coli CFT073
cgcgaacggggcugccagc

SEQ ID NO: 659908 - RNA, 12 nt, Escherichia coli CFT073
cgcgaacgugug

SEQ ID NO: 659909 - RNA, 17 nt, Escherichia coli CFT073
cgcgaacuaaacaacgc

SEQ ID NO: 659910 - RNA, 20 nt, Escherichia coli CFT073
cgcgaacuaaacaacgccgc

SEQ ID NO: 659911 - RNA, 15 nt, Escherichia coli CFT073
cgcgaaccagaccag

SEQ ID NO: 659912 - RNA, 16 nt, Escherichia coli CFT073
cgcgaaccagagacag

SEQ ID NO: 659913 - RNA, 17 nt, Escherichia coli CFT073
cgccuuucagccccagc

SEQ ID NO: 659914 - RNA, 19 nt, Escherichia coli CFT073
cgccuuuuuucgccgcagc

SEQ ID NO: 659915 - RNA, 18 nt, Escherichia coli CFT073
cgccuuuuucuccgagca

SEQ ID NO: 659916 - RNA, 15 nt, Escherichia coli CFT073
cgccuucuccggccu

SEQ ID NO: 659917 - RNA, 16 nt, Escherichia coli CFT073
cgccuucguucagcca

SEQ ID NO: 659918 - RNA, 17 nt, Escherichia coli CFT073
cgccucuucauacaucu

SEQ ID NO: 659919 - RNA, 11 nt, Escherichia coli CFT073
cgccucuucca

SEQ ID NO: 659920 - RNA, 12 nt, Escherichia coli CFT073
cgccucuucaua

SEQ ID NO: 659921 - RNA, 21 nt, Escherichia coli CFT073
cgccugcacaaagcgccagaa

SEQ ID NO: 659922 - RNA, 13 nt, Escherichia coli CFT073
cgccugcaaauaa

SEQ ID NO: 659923 - RNA, 20 nt, Escherichia coli CFT073
cgccugcaagcgucgcgcca

SEQ ID NO: 659924 - RNA, 20 nt, Escherichia coli CFT073
cgccugcagaggccgccgca

SEQ ID NO: 659925 - RNA, 17 nt, Escherichia coli CFT073
cgccugauagcccgcac

SEQ ID NO: 659926 - RNA, 14 nt, Escherichia coli CFT073
cgccucagccagaa

SEQ ID NO: 659927 - RNA, 14 nt, Escherichia coli CFT073
cgccuaccgccagu

SEQ ID NO: 659928 - RNA, 20 nt, Escherichia coli CFT073
cgccuaaauuuuuccacugg

SEQ ID NO: 659929 - RNA, 17 nt, Escherichia coli CFT073
cgccuacggcauucugc

SEQ ID NO: 659930 - RNA, 19 nt, Escherichia coli CFT073
cgccuaccggaaucgcgcg

SEQ ID NO: 659931 - RNA, 17 nt, Escherichia coli CFT073
cgccuauaaacguuccc

SEQ ID NO: 659932 - RNA, 23 nt, Escherichia coli CFT073
cgccuauuauccggcaaccaccg

SEQ ID NO: 659933 - RNA, 14 nt, Escherichia coli CFT073
cgccucacgccagc

SEQ ID NO: 659934 - RNA, 22 nt, Escherichia coli CFT073
cgccguugcuggcaaucaccuc

SEQ ID NO: 659935 - RNA, 20 nt, Escherichia coli CFT073
cgccguuuuuacccagcagc

SEQ ID NO: 659936 - RNA, 13 nt, Escherichia coli CFT073
cgccgucgcgaag

SEQ ID NO: 659937 - RNA, 20 nt, Escherichia coli CFT073
cgccaugugcgacgggccaa

SEQ ID NO: 659938 - RNA, 21 nt, Escherichia coli CFT073
cgccauuaaacaacccaagcg

SEQ ID NO: 659939 - RNA, 22 nt, Escherichia coli CFT073
cgccauuagcgaugaaaucaug

SEQ ID NO: 659940 - RNA, 19 nt, Escherichia coli CFT073
cgccauucucaccuacagc

SEQ ID NO: 659941 - RNA, 17 nt, Escherichia coli CFT073
cgccaugccaacgcggc

SEQ ID NO: 659942 - RNA, 16 nt, Escherichia coli CFT073
cgccauuuugcgcggc

SEQ ID NO: 659943 - RNA, 18 nt, Escherichia coli CFT073
cgccauuuugcgcggcau

SEQ ID NO: 659944 - RNA, 20 nt, Escherichia coli CFT073
cgccauuuuuuugccugcua

SEQ ID NO: 659945 - RNA, 13 nt, Escherichia coli CFT073
cgccauuuccagc

SEQ ID NO: 659946 - RNA, 18 nt, Escherichia coli CFT073
cgccauuuagcagggcag

SEQ ID NO: 659947 - RNA, 19 nt, Escherichia coli CFT073
cgccauuggccccauaauc

SEQ ID NO: 659948 - RNA, 15 nt, Escherichia coli CFT073
cgcccacauaaccaa

SEQ ID NO: 659949 - RNA, 12 nt, Escherichia coli CFT073
cgcccaacacuu

SEQ ID NO: 659950 - RNA, 14 nt, Escherichia coli CFT073
cgcccaacacuucc

SEQ ID NO: 659951 - RNA, 13 nt, Escherichia coli CFT073
cgcccaagcacaa

SEQ ID NO: 659952 - RNA, 14 nt, Escherichia coli CFT073
cgccaugaagaugg

SEQ ID NO: 659953 - RNA, 20 nt, Escherichia coli CFT073
cgccaucguuaaaaaacagu

SEQ ID NO: 659954 - RNA, 22 nt, Escherichia coli CFT073
cgccaucguuaaaaaacagugc

SEQ ID NO: 659955 - RNA, 13 nt, Escherichia coli CFT073
cgccaucgcgcau

SEQ ID NO: 659956 - RNA, 14 nt, Escherichia coli CFT073
cgccauccagguag

SEQ ID NO: 659957 - RNA, 13 nt, Escherichia coli CFT073
cgccaucaccagu

SEQ ID NO: 659958 - RNA, 17 nt, Escherichia coli CFT073
cgccaucagccacuuca

SEQ ID NO: 659959 - RNA, 18 nt, Escherichia coli CFT073
cgccaucagccacuucaa

SEQ ID NO: 659960 - RNA, 13 nt, Escherichia coli CFT073
cgccaucaggcag

SEQ ID NO: 659961 - RNA, 14 nt, Escherichia coli CFT073
cgcccaccgccagg

SEQ ID NO: 659962 - RNA, 15 nt, Escherichia coli CFT073
cgcccaccgccaggc

SEQ ID NO: 659963 - RNA, 19 nt, Escherichia coli CFT073
cgcccagaccgugcgcagc

SEQ ID NO: 659964 - RNA, 18 nt, Escherichia coli CFT073
cgcccagcgaccacaaau

SEQ ID NO: 659965 - RNA, 20 nt, Escherichia coli CFT073
cgcccagcgaccacaaauac

SEQ ID NO: 659966 - RNA, 20 nt, Escherichia coli CFT073
cgcccagcagcgccgcgccu

SEQ ID NO: 659967 - RNA, 13 nt, Escherichia coli CFT073
cgcccagcgcagg

SEQ ID NO: 659968 - RNA, 21 nt, Escherichia coli CFT073
cgcccagcuuaguaagcccag

SEQ ID NO: 659969 - RNA, 21 nt, Escherichia coli CFT073
cgcccagcguacguaacuucu

SEQ ID NO: 659970 - RNA, 19 nt, Escherichia coli CFT073
cgcccauacucaucuucca

SEQ ID NO: 659971 - RNA, 20 nt, Escherichia coli CFT073
cgcccauacucaucuuccau

SEQ ID NO: 659972 - RNA, 17 nt, Escherichia coli CFT073
cgcccaguagugcgcag

SEQ ID NO: 659973 - RNA, 23 nt, Escherichia coli CFT073
cgcccagucacggcuggagccug

SEQ ID NO: 659974 - RNA, 14 nt, Escherichia coli CFT073
cgcccaucgcgccc

SEQ ID NO: 659975 - RNA, 11 nt, Escherichia coli CFT073
cgccccugaca

SEQ ID NO: 659976 - RNA, 19 nt, Escherichia coli CFT073
cgcccgacaauaugcagca

SEQ ID NO: 659977 - RNA, 17 nt, Escherichia coli CFT073
cgccccgcucacgcagc

SEQ ID NO: 659978 - RNA, 13 nt, Escherichia coli CFT073
cgccccggaagcc

SEQ ID NO: 659979 - RNA, 20 nt, Escherichia coli CFT073
cgccccacaagcccgccaga

SEQ ID NO: 659980 - RNA, 13 nt, Escherichia coli CFT073
cgcccauugagcc

SEQ ID NO: 659981 - RNA, 21 nt, Escherichia coli CFT073
cgccccagaccugaauuugcu

SEQ ID NO: 659982 - RNA, 21 nt, Escherichia coli CFT073
cgccccagaauccccacaaac

SEQ ID NO: 659983 - RNA, 18 nt, Escherichia coli CFT073
cgcccgaugccagcacag

SEQ ID NO: 659984 - RNA, 19 nt, Escherichia coli CFT073
cgcccggcguggugcagcc

SEQ ID NO: 659985 - RNA, 18 nt, Escherichia coli CFT073
cgcccgcuguaagccaag

SEQ ID NO: 659986 - RNA, 16 nt, Escherichia coli CFT073
cgccaggcuguucgga

SEQ ID NO: 659987 - RNA, 17 nt, Escherichia coli CFT073
cgccaggcacaccagca

SEQ ID NO: 659988 - RNA, 18 nt, Escherichia coli CFT073
cgccaggcacaccagcaa

SEQ ID NO: 659989 - RNA, 17 nt, Escherichia coli CFT073
cgccaggaugggcugcc

SEQ ID NO: 659990 - RNA, 19 nt, Escherichia coli CFT073
cgccagcucugcgcccugc

SEQ ID NO: 659991 - RNA, 24 nt, Escherichia coli CFT073
cgccagcucugcgcccugcaucac

SEQ ID NO: 659992 - RNA, 16 nt, Escherichia coli CFT073
cgccagcuucacgcgc

SEQ ID NO: 659993 - RNA, 20 nt, Escherichia coli CFT073
cgccagcuucacgcgcuggg

SEQ ID NO: 659994 - RNA, 19 nt, Escherichia coli CFT073
cgccagcuucgcuucccaa

SEQ ID NO: 659995 - RNA, 23 nt, Escherichia coli CFT073
cgccagcuuugacguuccccaac

SEQ ID NO: 659996 - RNA, 22 nt, Escherichia coli CFT073
cgccagcgguuguucacccaac

SEQ ID NO: 659997 - RNA, 19 nt, Escherichia coli CFT073
cgccagcggggcgaaaucu

SEQ ID NO: 659998 - RNA, 14 nt, Escherichia coli CFT073
cgccagcgcgcggc

SEQ ID NO: 659999 - RNA, 22 nt, Escherichia coli CFT073
cgccagcgccaucgguagcacc

SEQ ID NO: 660000 - RNA, 20 nt, Escherichia coli CFT073
cgccagcgaaccaccaaacu

SEQ ID NO: 660001 - RNA, 15 nt, Escherichia coli CFT073
cgccagcgccaaagc

SEQ ID NO: 660002 - RNA, 13 nt, Escherichia coli CFT073
cgccauaucacca

SEQ ID NO: 660003 - RNA, 18 nt, Escherichia coli CFT073
cgccaucaauaaccagcg

SEQ ID NO: 660004 - RNA, 18 nt, Escherichia coli CFT073
cgccauaccaugcaccaa

SEQ ID NO: 660005 - RNA, 20 nt, Escherichia coli CFT073
cgccauaccaugcaccaacc

SEQ ID NO: 660006 - RNA, 19 nt, Escherichia coli CFT073
cgccauaaacaccagcagc

SEQ ID NO: 660007 - RNA, 16 nt, Escherichia coli CFT073
cgccauaaacuucauu

SEQ ID NO: 660008 - RNA, 18 nt, Escherichia coli CFT073
cgccauaaccgccagcac

SEQ ID NO: 660009 - RNA, 22 nt, Escherichia coli CFT073
cgccauaaccgccagcacagcc

SEQ ID NO: 660010 - RNA, 14 nt, Escherichia coli CFT073
cgccauaacaaaua

SEQ ID NO: 660011 - RNA, 17 nt, Escherichia coli CFT073
cgccaguucgauaucca

SEQ ID NO: 660012 - RNA, 15 nt, Escherichia coli CFT073
cgccaguuugcaggc

SEQ ID NO: 660013 - RNA, 16 nt, Escherichia coli CFT073
cgccaguguucuuccg

SEQ ID NO: 660014 - RNA, 14 nt, Escherichia coli CFT073
cgccaguucaucca

SEQ ID NO: 660015 - RNA, 14 nt, Escherichia coli CFT073
cgccaguucccccu

SEQ ID NO: 660016 - RNA, 19 nt, Escherichia coli CFT073
cgccagucuccaggcagaa

SEQ ID NO: 660017 - RNA, 22 nt, Escherichia coli CFT073
cgccagguguuuaaccaacaca

SEQ ID NO: 660018 - RNA, 15 nt, Escherichia coli CFT073
cgccagguucaucaa

SEQ ID NO: 660019 - RNA, 15 nt, Escherichia coli CFT073
cgccagguuuuggaa

SEQ ID NO: 660020 - RNA, 15 nt, Escherichia coli CFT073
cgccaguaauccacc

SEQ ID NO: 660021 - RNA, 15 nt, Escherichia coli CFT073
cgccaguacgcgccc

SEQ ID NO: 660022 - RNA, 18 nt, Escherichia coli CFT073
cgcauaacucaccaucaa

SEQ ID NO: 660023 - RNA, 19 nt, Escherichia coli CFT073
cgcauaaagaguuuucuua

SEQ ID NO: 660024 - RNA, 22 nt, Escherichia coli CFT073
cgcauaccauccaggagauauu

SEQ ID NO: 660025 - RNA, 24 nt, Escherichia coli CFT073
cgccaaugaucccgccaucgcggc

SEQ ID NO: 660026 - RNA, 20 nt, Escherichia coli CFT073
cgccaauggcugccgccagg

SEQ ID NO: 660027 - RNA, 23 nt, Escherichia coli CFT073
cgccacaacgauaauccagcaga

SEQ ID NO: 660028 - RNA, 15 nt, Escherichia coli CFT073
cgccacauugcugca

SEQ ID NO: 660029 - RNA, 13 nt, Escherichia coli CFT073
cgccaccacaaaa

SEQ ID NO: 660030 - RNA, 13 nt, Escherichia coli CFT073
cgccaccacaaca

SEQ ID NO: 660031 - RNA, 14 nt, Escherichia coli CFT073
cgccaccccacacc

SEQ ID NO: 660032 - RNA, 14 nt, Escherichia coli CFT073
cgccaccagcgcca

SEQ ID NO: 660033 - RNA, 14 nt, Escherichia coli CFT073
cgccaccacgccca

SEQ ID NO: 660034 - RNA, 14 nt, Escherichia coli CFT073
cgccaccacaacau

SEQ ID NO: 660035 - RNA, 14 nt, Escherichia coli CFT073
cgccaccaccagcg

SEQ ID NO: 660036 - RNA, 13 nt, Escherichia coli CFT073
cgccaccaccagc

SEQ ID NO: 660037 - RNA, 20 nt, Escherichia coli CFT073
cgccaccucuuucaccaacg

SEQ ID NO: 660038 - RNA, 14 nt, Escherichia coli CFT073
cgccaccucuuuca

SEQ ID NO: 660039 - RNA, 18 nt, Escherichia coli CFT073
cgccaccgcuuccggcgu

SEQ ID NO: 660040 - RNA, 21 nt, Escherichia coli CFT073
cgccaccggcuuucgcuucaa

SEQ ID NO: 660041 - RNA, 13 nt, Escherichia coli CFT073
cgccagcacuucc

SEQ ID NO: 660042 - RNA, 14 nt, Escherichia coli CFT073
cgccagcacuuccu

SEQ ID NO: 660043 - RNA, 23 nt, Escherichia coli CFT073
cgccagcagcucacgcagcuucu

SEQ ID NO: 660044 - RNA, 18 nt, Escherichia coli CFT073
cgccacuccacugcgcau

SEQ ID NO: 660045 - RNA, 23 nt, Escherichia coli CFT073
cgccacgguaucaagcccgccgg

SEQ ID NO: 660046 - RNA, 22 nt, Escherichia coli CFT073
cgccacgacucaaaucacgcag

SEQ ID NO: 660047 - RNA, 16 nt, Escherichia coli CFT073
cgccagccagccaagc

SEQ ID NO: 660048 - RNA, 12 nt, Escherichia coli CFT073
cgccagccaugu

SEQ ID NO: 660049 - RNA, 18 nt, Escherichia coli CFT073
cgccagccaugucgccac

SEQ ID NO: 660050 - RNA, 22 nt, Escherichia coli CFT073
cgccagccaugucgccaccugu

SEQ ID NO: 660051 - RNA, 14 nt, Escherichia coli CFT073
cgccagccauucaa

SEQ ID NO: 660052 - RNA, 16 nt, Escherichia coli CFT073
cgccagcaugccgcca

SEQ ID NO: 660053 - RNA, 19 nt, Escherichia coli CFT073
cgccagcauugucaggauc

SEQ ID NO: 660054 - RNA, 19 nt, Escherichia coli CFT073
cgccagcagggcaaacagc

SEQ ID NO: 660055 - RNA, 16 nt, Escherichia coli CFT073
cgccagcccuuucagc

SEQ ID NO: 660056 - RNA, 22 nt, Escherichia coli CFT073
cgccagccgauaucuuuccggc

SEQ ID NO: 660057 - RNA, 20 nt, Escherichia coli CFT073
cgccagcgaagccagcuccc

SEQ ID NO: 660058 - RNA, 15 nt, Escherichia coli CFT073
cgccagcgaagguaa

SEQ ID NO: 660059 - RNA, 16 nt, Escherichia coli CFT073
cgccagcgaauuccag

SEQ ID NO: 660060 - RNA, 18 nt, Escherichia coli CFT073
cgaucccgguuaacugca

SEQ ID NO: 660061 - RNA, 19 nt, Escherichia coli CFT073
cgauccagugauuccaguc

SEQ ID NO: 660062 - RNA, 15 nt, Escherichia coli CFT073
cgaucccaugccgaa

SEQ ID NO: 660063 - RNA, 19 nt, Escherichia coli CFT073
cgauccccaaagagagcac

SEQ ID NO: 660064 - RNA, 23 nt, Escherichia coli CFT073
cgauccugauacagaccgcgcag

SEQ ID NO: 660065 - RNA, 14 nt, Escherichia coli CFT073
cgauccuggucagg

SEQ ID NO: 660066 - RNA, 21 nt, Escherichia coli CFT073
cgaucgcgaauaugcugggcg

SEQ ID NO: 660067 - RNA, 19 nt, Escherichia coli CFT073
cgaucgccgcacccgccag

SEQ ID NO: 660068 - RNA, 17 nt, Escherichia coli CFT073
cgaucgcccggcaccag

SEQ ID NO: 660069 - RNA, 19 nt, Escherichia coli CFT073
cgaucauuccgcccagacc

SEQ ID NO: 660070 - RNA, 13 nt, Escherichia coli CFT073
cgaucaucgacag

SEQ ID NO: 660071 - RNA, 15 nt, Escherichia coli CFT073
cgaucaucauccagc

SEQ ID NO: 660072 - RNA, 18 nt, Escherichia coli CFT073
cgaucaguuacucugcaa

SEQ ID NO: 660073 - RNA, 21 nt, Escherichia coli CFT073
cgaucaggaacuguugcaaaa

SEQ ID NO: 660074 - RNA, 17 nt, Escherichia coli CFT073
cgauaucccaggcaaaa

SEQ ID NO: 660075 - RNA, 20 nt, Escherichia coli CFT073
cgauauauuuuguaccguac

SEQ ID NO: 660076 - RNA, 21 nt, Escherichia coli CFT073
cgauaucgcugucgccacccc

SEQ ID NO: 660077 - RNA, 19 nt, Escherichia coli CFT073
cgaucagcaauuucuccgc

SEQ ID NO: 660078 - RNA, 14 nt, Escherichia coli CFT073
cgauagaaaucaga

SEQ ID NO: 660079 - RNA, 16 nt, Escherichia coli CFT073
cgauagaaaucagacu

SEQ ID NO: 660080 - RNA, 15 nt, Escherichia coli CFT073
cgauagacacugccg

SEQ ID NO: 660081 - RNA, 17 nt, Escherichia coli CFT073
cgauagagagcagucag

SEQ ID NO: 660082 - RNA, 17 nt, Escherichia coli CFT073
cgauaacaaucaccaaa

SEQ ID NO: 660083 - RNA, 19 nt, Escherichia coli CFT073
cgauaacgccccaauccac

SEQ ID NO: 660084 - RNA, 22 nt, Escherichia coli CFT073
cgauacgcauaaacaucuucca

SEQ ID NO: 660085 - RNA, 22 nt, Escherichia coli CFT073
cgauacgguuaaaucaggaaaa

SEQ ID NO: 660086 - RNA, 13 nt, Escherichia coli CFT073
cgauaaaacauua

SEQ ID NO: 660087 - RNA, 15 nt, Escherichia coli CFT073
cgauaaaacauuacu

SEQ ID NO: 660088 - RNA, 14 nt, Escherichia coli CFT073
cgauaaagcugggu

SEQ ID NO: 660089 - RNA, 14 nt, Escherichia coli CFT073
cgauaaaguugaag

SEQ ID NO: 660090 - RNA, 12 nt, Escherichia coli CFT073
ccuucauccagg

SEQ ID NO: 660091 - RNA, 13 nt, Escherichia coli CFT073
ccuucauccaggg

SEQ ID NO: 660092 - RNA, 20 nt, Escherichia coli CFT073
ccuucauccaucggcgcuuc

SEQ ID NO: 660093 - RNA, 23 nt, Escherichia coli CFT073
ccuucaucacgcagugucagcac

SEQ ID NO: 660094 - RNA, 19 nt, Escherichia coli CFT073
ccuucagucauauuucugu

SEQ ID NO: 660095 - RNA, 14 nt, Escherichia coli CFT073
ccuucauaaugaau

SEQ ID NO: 660096 - RNA, 13 nt, Escherichia coli CFT073
cgaugaccgccac

SEQ ID NO: 660097 - RNA, 21 nt, Escherichia coli CFT073
cgaugaaugcaacugcccagg

SEQ ID NO: 660098 - RNA, 14 nt, Escherichia coli CFT073
cgaucuuccgaccg

SEQ ID NO: 660099 - RNA, 15 nt, Escherichia coli CFT073
cgaucuuccucuacg

SEQ ID NO: 660100 - RNA, 19 nt, Escherichia coli CFT073
cgaucuguuuaucgcgcaa

SEQ ID NO: 660101 - RNA, 19 nt, Escherichia coli CFT073
cgaugaacaugcagcaacu

SEQ ID NO: 660102 - RNA, 15 nt, Escherichia coli CFT073
cgaucggcaggaaaa

SEQ ID NO: 660103 - RNA, 22 nt, Escherichia coli CFT073
cgaucgcuuucgcuuucucuuc

SEQ ID NO: 660104 - RNA, 20 nt, Escherichia coli CFT073
cgaucgcgccaaucagcgca

SEQ ID NO: 660105 - RNA, 20 nt, Escherichia coli CFT073
cgaucgcuaaagcauucucc

SEQ ID NO: 660106 - RNA, 14 nt, Escherichia coli CFT073
cgaucguccagcug

SEQ ID NO: 660107 - RNA, 21 nt, Escherichia coli CFT073
cgaucucccgcuuuggcaucu

SEQ ID NO: 660108 - RNA, 17 nt, Escherichia coli CFT073
cgaucucuuuauuugau

SEQ ID NO: 660109 - RNA, 20 nt, Escherichia coli CFT073
cgaugaucgccaucagcgcu

SEQ ID NO: 660110 - RNA, 24 nt, Escherichia coli CFT073
cgaugaucgccgccagugccacca

SEQ ID NO: 660111 - RNA, 22 nt, Escherichia coli CFT073
cgaugcccccaggagcgcggca

SEQ ID NO: 660112 - RNA, 22 nt, Escherichia coli CFT073
cgaugcacucgccaggaugggc

SEQ ID NO: 660113 - RNA, 13 nt, Escherichia coli CFT073
cgaugauuguccc

SEQ ID NO: 660114 - RNA, 16 nt, Escherichia coli CFT073
cgaugcaaauuuuuaa

SEQ ID NO: 660115 - RNA, 16 nt, Escherichia coli CFT073
cgaugccaauauccug

SEQ ID NO: 660116 - RNA, 22 nt, Escherichia coli CFT073
cgauggcaggccccgucagcaa

SEQ ID NO: 660117 - RNA, 14 nt, Escherichia coli CFT073
cgauggcccgcuug

SEQ ID NO: 660118 - RNA, 20 nt, Escherichia coli CFT073
cgauggcagaaaucaacggc

SEQ ID NO: 660119 - RNA, 22 nt, Escherichia coli CFT073
cgcagcgccaacgcaacgcgcu

SEQ ID NO: 660120 - RNA, 13 nt, Escherichia coli CFT073
cgcagcggcggca

SEQ ID NO: 660121 - RNA, 15 nt, Escherichia coli CFT073
cgcaggagcggcgga

SEQ ID NO: 660122 - RNA, 15 nt, Escherichia coli CFT073
cgcaguaaacgccag

SEQ ID NO: 660123 - RNA, 13 nt, Escherichia coli CFT073
cgcagucaccagc

SEQ ID NO: 660124 - RNA, 21 nt, Escherichia coli CFT073
cgcaguuguucggcgcugaaa

SEQ ID NO: 660125 - RNA, 14 nt, Escherichia coli CFT073
cgcaggcgcugaaa

SEQ ID NO: 660126 - RNA, 20 nt, Escherichia coli CFT073
cgcagaaauaccccgccagc

SEQ ID NO: 660127 - RNA, 19 nt, Escherichia coli CFT073
cgcagaaaugcgaaaauua

SEQ ID NO: 660128 - RNA, 22 nt, Escherichia coli CFT073
cgcagaaauucguaauccauag

SEQ ID NO: 660129 - RNA, 19 nt, Escherichia coli CFT073
cgcacuuucuccggcagcu

SEQ ID NO: 660130 - RNA, 19 nt, Escherichia coli CFT073
cgcacuggguggcccggag

SEQ ID NO: 660131 - RNA, 20 nt, Escherichia coli CFT073
cgcacuggcgagcgccagca

SEQ ID NO: 660132 - RNA, 17 nt, Escherichia coli CFT073
cgcacuggcgcgccugu

SEQ ID NO: 660133 - RNA, 16 nt, Escherichia coli CFT073
cgcacuucuuccgggc

SEQ ID NO: 660134 - RNA, 13 nt, Escherichia coli CFT073
cgcacugcaauau

SEQ ID NO: 660135 - RNA, 17 nt, Escherichia coli CFT073
cgcacugccgccaugcg

SEQ ID NO: 660136 - RNA, 16 nt, Escherichia coli CFT073
cgcagcaucggccugc

SEQ ID NO: 660137 - RNA, 12 nt, Escherichia coli CFT073
cgcagccagcac

SEQ ID NO: 660138 - RNA, 14 nt, Escherichia coli CFT073
cgcagccagcgcac

SEQ ID NO: 660139 - RNA, 12 nt, Escherichia coli CFT073
cgcagccccagc

SEQ ID NO: 660140 - RNA, 22 nt, Escherichia coli CFT073
cgcaaaugucucgacgguugaa

SEQ ID NO: 660141 - RNA, 17 nt, Escherichia coli CFT073
cgcaacgguucugcugc

SEQ ID NO: 660142 - RNA, 14 nt, Escherichia coli CFT073
cgcaauagccugau

SEQ ID NO: 660143 - RNA, 15 nt, Escherichia coli CFT073
cgcaauacagccagc

SEQ ID NO: 660144 - RNA, 17 nt, Escherichia coli CFT073
cgcaauagugauguucu

SEQ ID NO: 660145 - RNA, 22 nt, Escherichia coli CFT073
cgcaauagugauguucuggcga

SEQ ID NO: 660146 - RNA, 15 nt, Escherichia coli CFT073
cgcaauaaucaucuc

SEQ ID NO: 660147 - RNA, 13 nt, Escherichia coli CFT073
cgcaacuguccca

SEQ ID NO: 660148 - RNA, 17 nt, Escherichia coli CFT073
cgcaaagggacuuuuca

SEQ ID NO: 660149 - RNA, 17 nt, Escherichia coli CFT073
cgcaaagcccgccgcca

SEQ ID NO: 660150 - RNA, 20 nt, Escherichia coli CFT073
cgcaaacagugaccaucuuc

SEQ ID NO: 660151 - RNA, 21 nt, Escherichia coli CFT073
cgcaaaccagacaacagucaa

SEQ ID NO: 660152 - RNA, 13 nt, Escherichia coli CFT073
cgcaaacugcugu

SEQ ID NO: 660153 - RNA, 20 nt, Escherichia coli CFT073
cgcaaacaggcgcagaacuu

SEQ ID NO: 660154 - RNA, 20 nt, Escherichia coli CFT073
cgcaaacaacgccacacgca

SEQ ID NO: 660155 - RNA, 13 nt, Escherichia coli CFT073
cgauucagcaaca

SEQ ID NO: 660156 - RNA, 21 nt, Escherichia coli CFT073
cgauucaggguuuacaggcuc

SEQ ID NO: 660157 - RNA, 14 nt, Escherichia coli CFT073
cgauuauuuauucc

SEQ ID NO: 660158 - RNA, 21 nt, Escherichia coli CFT073
cgauuauuuauucccgccaga

SEQ ID NO: 660159 - RNA, 17 nt, Escherichia coli CFT073
cgauuacguuugcagca

SEQ ID NO: 660160 - RNA, 23 nt, Escherichia coli CFT073
cgauuagcgauaaaacgccgcug

SEQ ID NO: 660161 - RNA, 16 nt, Escherichia coli CFT073
cgauuaccauuucacu

SEQ ID NO: 660162 - RNA, 14 nt, Escherichia coli CFT073
cgauuaccgccagc

SEQ ID NO: 660163 - RNA, 13 nt, Escherichia coli CFT073
cgauuaauccagu

SEQ ID NO: 660164 - RNA, 22 nt, Escherichia coli CFT073
cgcaccagcggaaugcagucac

SEQ ID NO: 660165 - RNA, 12 nt, Escherichia coli CFT073
cgcaccaggcga

SEQ ID NO: 660166 - RNA, 18 nt, Escherichia coli CFT073
cgcaccagcacaucaccu

SEQ ID NO: 660167 - RNA, 17 nt, Escherichia coli CFT073
cgcacaccgagauaaug

SEQ ID NO: 660168 - RNA, 17 nt, Escherichia coli CFT073
cgcacgcguaauaucca

SEQ ID NO: 660169 - RNA, 16 nt, Escherichia coli CFT073
cgcacgcugucgccag

SEQ ID NO: 660170 - RNA, 16 nt, Escherichia coli CFT073
cgcacggcguucaggc

SEQ ID NO: 660171 - RNA, 14 nt, Escherichia coli CFT073
cgcacuccaacucu

SEQ ID NO: 660172 - RNA, 18 nt, Escherichia coli CFT073
cgcaccuuucaacggucg

SEQ ID NO: 660173 - RNA, 23 nt, Escherichia coli CFT073
cgcaccuucauucaggccaaagc

SEQ ID NO: 660174 - RNA, 15 nt, Escherichia coli CFT073
cgcaccugccagcgc

SEQ ID NO: 660175 - RNA, 16 nt, Escherichia coli CFT073
cgcaccugccagcgcc

SEQ ID NO: 660176 - RNA, 12 nt, Escherichia coli CFT073
cgcaccugccag

SEQ ID NO: 660177 - RNA, 22 nt, Escherichia coli CFT073
cuuccagguaagcaaucagguc

SEQ ID NO: 660178 - RNA, 16 nt, Escherichia coli CFT073
cuucccauacccacca

SEQ ID NO: 660179 - RNA, 23 nt, Escherichia coli CFT073
cuuccagcuucgcuaccugaguc

SEQ ID NO: 660180 - RNA, 22 nt, Escherichia coli CFT073
cuuccaggcucauaccuuccac

SEQ ID NO: 660181 - RNA, 15 nt, Escherichia coli CFT073
cuuccaggguaaaca

SEQ ID NO: 660182 - RNA, 17 nt, Escherichia coli CFT073
cuuccagcggcaggccg

SEQ ID NO: 660183 - RNA, 13 nt, Escherichia coli CFT073
cuuccagcuccag

SEQ ID NO: 660184 - RNA, 17 nt, Escherichia coli CFT073
cuuccagcugcacgcca

SEQ ID NO: 660185 - RNA, 22 nt, Escherichia coli CFT073
cuuccccucauuaagccacggu

SEQ ID NO: 660186 - RNA, 19 nt, Escherichia coli CFT073
cuucccgcaaugcaaucaa

SEQ ID NO: 660187 - RNA, 20 nt, Escherichia coli CFT073
cuucccgcagaccuucugcc

SEQ ID NO: 660188 - RNA, 15 nt, Escherichia coli CFT073
cuucccgcagccacg

SEQ ID NO: 660189 - RNA, 14 nt, Escherichia coli CFT073
cuuccuccaccacu

SEQ ID NO: 660190 - RNA, 22 nt, Escherichia coli CFT073
cuuccucaugcggcgcgcccca

SEQ ID NO: 660191 - RNA, 23 nt, Escherichia coli CFT073
cuuccgugguuugcgcauucaga

SEQ ID NO: 660192 - RNA, 16 nt, Escherichia coli CFT073
cuucccuauccggaaa

SEQ ID NO: 660193 - RNA, 20 nt, Escherichia coli CFT073
cuucccugcaguaaagcccg

SEQ ID NO: 660194 - RNA, 16 nt, Escherichia coli CFT073
cuuccggguuuucucc

SEQ ID NO: 660195 - RNA, 13 nt, Escherichia coli CFT073
cuuccgguacacg

SEQ ID NO: 660196 - RNA, 16 nt, Escherichia coli CFT073
cuuccuuaagccgcug

SEQ ID NO: 660197 - RNA, 20 nt, Escherichia coli CFT073
cuuccugccgcaaucuuucc

SEQ ID NO: 660198 - RNA, 14 nt, Escherichia coli CFT073
cuuccugucuuccc

SEQ ID NO: 660199 - RNA, 16 nt, Escherichia coli CFT073
cuuccuucacauccau

SEQ ID NO: 660200 - RNA, 14 nt, Escherichia coli CFT073
cuucacuggcgaca

SEQ ID NO: 660201 - RNA, 13 nt, Escherichia coli CFT073
cuucacucucuuu

SEQ ID NO: 660202 - RNA, 11 nt, Escherichia coli CFT073
cuucacugaau

SEQ ID NO: 660203 - RNA, 18 nt, Escherichia coli CFT073
cuucaucguaguaguuca

SEQ ID NO: 660204 - RNA, 13 nt, Escherichia coli CFT073
cuucaugaccuuc

SEQ ID NO: 660205 - RNA, 15 nt, Escherichia coli CFT073
cuucaucuuuaucaa

SEQ ID NO: 660206 - RNA, 18 nt, Escherichia coli CFT073
cuuccacaccacuucauu

SEQ ID NO: 660207 - RNA, 16 nt, Escherichia coli CFT073
cuuccaccaccacuga

SEQ ID NO: 660208 - RNA, 16 nt, Escherichia coli CFT073
cuuccaccacuuccug

SEQ ID NO: 660209 - RNA, 18 nt, Escherichia coli CFT073
cuuccaccacuuccugcu

SEQ ID NO: 660210 - RNA, 14 nt, Escherichia coli CFT073
cuuccaccagcggc

SEQ ID NO: 660211 - RNA, 16 nt, Escherichia coli CFT073
cuuccacuuccugcgg

SEQ ID NO: 660212 - RNA, 19 nt, Escherichia coli CFT073
cuuccagcaucgcccccau

SEQ ID NO: 660213 - RNA, 17 nt, Escherichia coli CFT073
cuuccagccacugcgca

SEQ ID NO: 660214 - RNA, 18 nt, Escherichia coli CFT073
cuuccagcaguucgcccg

SEQ ID NO: 660215 - RNA, 20 nt, Escherichia coli CFT073
cuuccagcaguucgcccgcu

SEQ ID NO: 660216 - RNA, 11 nt, Escherichia coli CFT073
cuuccagcauc

SEQ ID NO: 660217 - RNA, 15 nt, Escherichia coli CFT073
cuuccagcauuucca

SEQ ID NO: 660218 - RNA, 15 nt, Escherichia coli CFT073
cuuccagcggcaggc

SEQ ID NO: 660219 - RNA, 19 nt, Escherichia coli CFT073
cuuccagcagaccagcaau

SEQ ID NO: 660220 - RNA, 22 nt, Escherichia coli CFT073
cuuccagcagaccagcaauaac

SEQ ID NO: 660221 - RNA, 12 nt, Escherichia coli CFT073
cuuccagcagcu

SEQ ID NO: 660222 - RNA, 22 nt, Escherichia coli CFT073
cuuccagcagcuugcgccgccc

SEQ ID NO: 660223 - RNA, 13 nt, Escherichia coli CFT073
cuucguccccagu

SEQ ID NO: 660224 - RNA, 19 nt, Escherichia coli CFT073
cuucggugaauuucacuuu

SEQ ID NO: 660225 - RNA, 13 nt, Escherichia coli CFT073
cuucguguaauuc

SEQ ID NO: 660226 - RNA, 22 nt, Escherichia coli CFT073
cuucguuaacgugucauaacug

SEQ ID NO: 660227 - RNA, 15 nt, Escherichia coli CFT073
cuucguuaucccagg

SEQ ID NO: 660228 - RNA, 15 nt, Escherichia coli CFT073
cuucguucagccaac

SEQ ID NO: 660229 - RNA, 23 nt, Escherichia coli CFT073
cuucuaccuuaacgguaucuuuc

SEQ ID NO: 660230 - RNA, 22 nt, Escherichia coli CFT073
cuucuaggcuguguucaccaag

SEQ ID NO: 660231 - RNA, 18 nt, Escherichia coli CFT073
cuucuaauuuuuccagca

SEQ ID NO: 660232 - RNA, 18 nt, Escherichia coli CFT073
cuucuacauuucuguagu

SEQ ID NO: 660233 - RNA, 15 nt, Escherichia coli CFT073
cuucuaacaucauga

SEQ ID NO: 660234 - RNA, 16 nt, Escherichia coli CFT073
cuucgcuaucaaacug

SEQ ID NO: 660235 - RNA, 19 nt, Escherichia coli CFT073
cuucgcugacgccugccag

SEQ ID NO: 660236 - RNA, 13 nt, Escherichia coli CFT073
cuucgcugauuua

SEQ ID NO: 660237 - RNA, 18 nt, Escherichia coli CFT073
cuucgcuuaucaggcauu

SEQ ID NO: 660238 - RNA, 19 nt, Escherichia coli CFT073
cuucgaguacauccacugc

SEQ ID NO: 660239 - RNA, 13 nt, Escherichia coli CFT073
cuucgagcggggg

SEQ ID NO: 660240 - RNA, 19 nt, Escherichia coli CFT073
cuucgauauugacgaucuc

SEQ ID NO: 660241 - RNA, 15 nt, Escherichia coli CFT073
cuucgaaugccgcag

SEQ ID NO: 660242 - RNA, 22 nt, Escherichia coli CFT073
cuucgaauagagccuggcugcg

SEQ ID NO: 660243 - RNA, 15 nt, Escherichia coli CFT073
cuuccuugcugauuu

SEQ ID NO: 660244 - RNA, 13 nt, Escherichia coli CFT073
cuucgaagaaaaa

SEQ ID NO: 660245 - RNA, 14 nt, Escherichia coli CFT073
cuucgaagaaaaac

SEQ ID NO: 660246 - RNA, 16 nt, Escherichia coli CFT073
cuucggcuuucauuuc

SEQ ID NO: 660247 - RNA, 19 nt, Escherichia coli CFT073
cuucgggcuggcauuuuuu

SEQ ID NO: 660248 - RNA, 22 nt, Escherichia coli CFT073
cuucggcgccuuuuucgcuugu

SEQ ID NO: 660249 - RNA, 21 nt, Escherichia coli CFT073
cuucggcaauuucagugcuga

SEQ ID NO: 660250 - RNA, 22 nt, Escherichia coli CFT073
cuucggcgaaaaucauuuaucu

SEQ ID NO: 660251 - RNA, 20 nt, Escherichia coli CFT073
cuucggaauaguucuggucu

SEQ ID NO: 660252 - RNA, 22 nt, Escherichia coli CFT073
cuucggaauaguucuggucugg

SEQ ID NO: 660253 - RNA, 15 nt, Escherichia coli CFT073
cuucgcuuucaagcu

SEQ ID NO: 660254 - RNA, 21 nt, Escherichia coli CFT073
cuucgcuucaccgacaucuuu

SEQ ID NO: 660255 - RNA, 15 nt, Escherichia coli CFT073
cuucaaucugagcga

SEQ ID NO: 660256 - RNA, 11 nt, Escherichia coli CFT073
cuucaaucgcc

SEQ ID NO: 660257 - RNA, 21 nt, Escherichia coli CFT073
cuucaauggcugaaagcgccg

SEQ ID NO: 660258 - RNA, 20 nt, Escherichia coli CFT073
cuucaaguguggccgccagu

SEQ ID NO: 660259 - RNA, 22 nt, Escherichia coli CFT073
cuucaauaucaucauccgcaau

SEQ ID NO: 660260 - RNA, 20 nt, Escherichia coli CFT073
cuucaaucaacauauuucuc

SEQ ID NO: 660261 - RNA, 16 nt, Escherichia coli CFT073
cuucaaucgccaccac

SEQ ID NO: 660262 - RNA, 15 nt, Escherichia coli CFT073
cuucaccucauguaa

SEQ ID NO: 660263 - RNA, 22 nt, Escherichia coli CFT073
cuucaccuucggugaauuucac

SEQ ID NO: 660264 - RNA, 16 nt, Escherichia coli CFT073
cuucaccugccugcag

SEQ ID NO: 660265 - RNA, 18 nt, Escherichia coli CFT073
cuucaccugccugcagcu

SEQ ID NO: 660266 - RNA, 20 nt, Escherichia coli CFT073
cuucaccugccugcagcugc

SEQ ID NO: 660267 - RNA, 19 nt, Escherichia coli CFT073
cuucaccagugaucuggcu

SEQ ID NO: 660268 - RNA, 20 nt, Escherichia coli CFT073
cuucaccgguaguaagcguu

SEQ ID NO: 660269 - RNA, 15 nt, Escherichia coli CFT073
cuucaagaauuaaaa

SEQ ID NO: 660270 - RNA, 17 nt, Escherichia coli CFT073
cuucaagaauuaaaaua

SEQ ID NO: 660271 - RNA, 20 nt, Escherichia coli CFT073
cuucaacuacggcuuuuuuc

SEQ ID NO: 660272 - RNA, 22 nt, Escherichia coli CFT073
cuucaacuacggcuuuuuucau

SEQ ID NO: 660273 - RNA, 23 nt, Escherichia coli CFT073
cuucaacuacggcuuuuuucauu

SEQ ID NO: 660274 - RNA, 15 nt, Escherichia coli CFT073
cuucaagcuggugcu

SEQ ID NO: 660275 - RNA, 22 nt, Escherichia coli CFT073
cuucaagcaucggcgcagcuaa

SEQ ID NO: 660276 - RNA, 18 nt, Escherichia coli CFT073
cuucaagccaggcuuuaa

SEQ ID NO: 660277 - RNA, 18 nt, Escherichia coli CFT073
cuucaacaccaacugccu

SEQ ID NO: 660278 - RNA, 21 nt, Escherichia coli CFT073
cuucaacacgacgcauugcca

SEQ ID NO: 660279 - RNA, 13 nt, Escherichia coli CFT073
cuucaacacuuca

SEQ ID NO: 660280 - RNA, 14 nt, Escherichia coli CFT073
cuucaaccacauuc

SEQ ID NO: 660281 - RNA, 22 nt, Escherichia coli CFT073
cuucaaccaguuucuccaguga

SEQ ID NO: 660282 - RNA, 14 nt, Escherichia coli CFT073
cuucaaccagugca

SEQ ID NO: 660283 - RNA, 18 nt, Escherichia coli CFT073
cuucaacgaaagcgccuc

SEQ ID NO: 660284 - RNA, 21 nt, Escherichia coli CFT073
cuucaacgaaagcgccucaag

SEQ ID NO: 660285 - RNA, 19 nt, Escherichia coli CFT073
cuucaacgcugcggcgugc

SEQ ID NO: 660286 - RNA, 14 nt, Escherichia coli CFT073
cuuauuuuucucua

SEQ ID NO: 660287 - RNA, 19 nt, Escherichia coli CFT073
cuuauuuaaacugaagacu

SEQ ID NO: 660288 - RNA, 17 nt, Escherichia coli CFT073
cuuauuguacagcgccc

SEQ ID NO: 660289 - RNA, 20 nt, Escherichia coli CFT073
cuucaaaaauaaguugccac

SEQ ID NO: 660290 - RNA, 12 nt, Escherichia coli CFT073
cuucaaaaauaa

SEQ ID NO: 660291 - RNA, 13 nt, Escherichia coli CFT073
cuucaaaaaaguc

SEQ ID NO: 660292 - RNA, 14 nt, Escherichia coli CFT073
cuucaaaaaaguca

SEQ ID NO: 660293 - RNA, 15 nt, Escherichia coli CFT073
cuucaaaguucugcg

SEQ ID NO: 660294 - RNA, 18 nt, Escherichia coli CFT073
cuucaaaguucugcgucu

SEQ ID NO: 660295 - RNA, 13 nt, Escherichia coli CFT073
cuucaaacgcuga

SEQ ID NO: 660296 - RNA, 15 nt, Escherichia coli CFT073
cuuaugcagcugcuc

SEQ ID NO: 660297 - RNA, 16 nt, Escherichia coli CFT073
cuuauucccacuuuuc

SEQ ID NO: 660298 - RNA, 18 nt, Escherichia coli CFT073
cuuauucugugaacuuca

SEQ ID NO: 660299 - RNA, 19 nt, Escherichia coli CFT073
cuuauucuucaacaauuga

SEQ ID NO: 660300 - RNA, 22 nt, Escherichia coli CFT073
cuuauucauaucuucaggccaa

SEQ ID NO: 660301 - RNA, 19 nt, Escherichia coli CFT073
cuuauucaaucucuucaca

SEQ ID NO: 660302 - RNA, 17 nt, Escherichia coli CFT073
cuuauucggccuaccau

SEQ ID NO: 660303 - RNA, 22 nt, Escherichia coli CFT073
cuuauucggccuaccaugaucu

SEQ ID NO: 660304 - RNA, 18 nt, Escherichia coli CFT073
cuuauucaaucucuucac

SEQ ID NO: 660305 - RNA, 18 nt, Escherichia coli CFT073
cuuaugcccggcacguuu

SEQ ID NO: 660306 - RNA, 17 nt, Escherichia coli CFT073
cuuaauaccggcaucca

SEQ ID NO: 660307 - RNA, 17 nt, Escherichia coli CFT073
cuuaauaagcaggccau

SEQ ID NO: 660308 - RNA, 17 nt, Escherichia coli CFT073
cuuaagguucacuuaau

SEQ ID NO: 660309 - RNA, 18 nt, Escherichia coli CFT073
cuuaagguuuuuuccuuc

SEQ ID NO: 660310 - RNA, 23 nt, Escherichia coli CFT073
cuuaacucaccguaggcaauaaa

SEQ ID NO: 660311 - RNA, 20 nt, Escherichia coli CFT073
cuuaacgcgggcuucuucuu

SEQ ID NO: 660312 - RNA, 22 nt, Escherichia coli CFT073
cuuaacgcgggcuucuucuuuc

SEQ ID NO: 660313 - RNA, 22 nt, Escherichia coli CFT073
cuuaacugccauuucauaaauu

SEQ ID NO: 660314 - RNA, 15 nt, Escherichia coli CFT073
cuuaagaucaacuuc

SEQ ID NO: 660315 - RNA, 22 nt, Escherichia coli CFT073
cuuaagauucggcuucuuccuc

SEQ ID NO: 660316 - RNA, 22 nt, Escherichia coli CFT073
cuuaagccgcuguguguaggcc

SEQ ID NO: 660317 - RNA, 15 nt, Escherichia coli CFT073
cuguucgccagugca

SEQ ID NO: 660318 - RNA, 18 nt, Escherichia coli CFT073
cuguucgccagugcauua

SEQ ID NO: 660319 - RNA, 20 nt, Escherichia coli CFT073
cuguucgcaaccuaaccaaa

SEQ ID NO: 660320 - RNA, 19 nt, Escherichia coli CFT073
cuguucgagguaauccagc

SEQ ID NO: 660321 - RNA, 14 nt, Escherichia coli CFT073
cuguucgccgccgc

SEQ ID NO: 660322 - RNA, 21 nt, Escherichia coli CFT073
cuuaaaugcacccgccagaga

SEQ ID NO: 660323 - RNA, 16 nt, Escherichia coli CFT073
cuguuccggcggcagg

SEQ ID NO: 660324 - RNA, 21 nt, Escherichia coli CFT073
cuuaacaccggcgcacuggcg

SEQ ID NO: 660325 - RNA, 12 nt, Escherichia coli CFT073
cuuaacaccccc

SEQ ID NO: 660326 - RNA, 20 nt, Escherichia coli CFT073
cuuaacaacgggcaccgccg

SEQ ID NO: 660327 - RNA, 13 nt, Escherichia coli CFT073
cuuaaauuucuua

SEQ ID NO: 660328 - RNA, 11 nt, Escherichia coli CFT073
cuuacauucug

SEQ ID NO: 660329 - RNA, 17 nt, Escherichia coli CFT073
cuuacauucugucucau

SEQ ID NO: 660330 - RNA, 16 nt, Escherichia coli CFT073
cuuaaugagauaauca

SEQ ID NO: 660331 - RNA, 17 nt, Escherichia coli CFT073
cuuaaugagauaaucaa

SEQ ID NO: 660332 - RNA, 20 nt, Escherichia coli CFT073
cuuaaugcaggcagcacugc

SEQ ID NO: 660333 - RNA, 19 nt, Escherichia coli CFT073
cuuaaugcccaucucuucu

SEQ ID NO: 660334 - RNA, 21 nt, Escherichia coli CFT073
cuuaaugcccaucucuucuuc

SEQ ID NO: 660335 - RNA, 22 nt, Escherichia coli CFT073
cuuacuuccugucuucccugcu

SEQ ID NO: 660336 - RNA, 13 nt, Escherichia coli CFT073
cuuacuucaacac

SEQ ID NO: 660337 - RNA, 23 nt, Escherichia coli CFT073
cuuaccccuacggcgacagcaaa

SEQ ID NO: 660338 - RNA, 15 nt, Escherichia coli CFT073
cuuacccuuacucac

SEQ ID NO: 660339 - RNA, 19 nt, Escherichia coli CFT073
cuuaguuaaaccagcuguc

SEQ ID NO: 660340 - RNA, 15 nt, Escherichia coli CFT073
cuuagucuccccaac

SEQ ID NO: 660341 - RNA, 17 nt, Escherichia coli CFT073
cuuaggucggauaagac

SEQ ID NO: 660342 - RNA, 13 nt, Escherichia coli CFT073
cuuagcguucugc

SEQ ID NO: 660343 - RNA, 22 nt, Escherichia coli CFT073
cuuagacaucaaaauuaccuuu

SEQ ID NO: 660344 - RNA, 20 nt, Escherichia coli CFT073
cuuuggcggcaucugccacc

SEQ ID NO: 660345 - RNA, 17 nt, Escherichia coli CFT073
cuuugcugcaaugaagg

SEQ ID NO: 660346 - RNA, 12 nt, Escherichia coli CFT073
cuuugcugugaa

SEQ ID NO: 660347 - RNA, 16 nt, Escherichia coli CFT073
cuuugcuuauaaccau

SEQ ID NO: 660348 - RNA, 20 nt, Escherichia coli CFT073
cuuugcuuuguaaagcgcca

SEQ ID NO: 660349 - RNA, 13 nt, Escherichia coli CFT073
cuuugcccuuucu

SEQ ID NO: 660350 - RNA, 22 nt, Escherichia coli CFT073
cuuugcccucugaauaacaccc

SEQ ID NO: 660351 - RNA, 21 nt, Escherichia coli CFT073
cuuugcgagucugcuccagaa

SEQ ID NO: 660352 - RNA, 21 nt, Escherichia coli CFT073
cuuugauggcacuauaucccu

SEQ ID NO: 660353 - RNA, 15 nt, Escherichia coli CFT073
cuuugauuaaccguu

SEQ ID NO: 660354 - RNA, 22 nt, Escherichia coli CFT073
cuuugaucgguugcugaacagc

SEQ ID NO: 660355 - RNA, 17 nt, Escherichia coli CFT073
cuuugcagguucugcuc

SEQ ID NO: 660356 - RNA, 17 nt, Escherichia coli CFT073
cuuugauuuccucccca

SEQ ID NO: 660357 - RNA, 13 nt, Escherichia coli CFT073
cuuugcaagcguu

SEQ ID NO: 660358 - RNA, 18 nt, Escherichia coli CFT073
cuuucguacgagcucuuc

SEQ ID NO: 660359 - RNA, 19 nt, Escherichia coli CFT073
cuuucguggugagggcaaa

SEQ ID NO: 660360 - RNA, 13 nt, Escherichia coli CFT073
cuuucgguagcag

SEQ ID NO: 660361 - RNA, 15 nt, Escherichia coli CFT073
cuuuccagccacagu

SEQ ID NO: 660362 - RNA, 19 nt, Escherichia coli CFT073
cuuucauuucgucgaacuc

SEQ ID NO: 660363 - RNA, 21 nt, Escherichia coli CFT073
cuuucguggugagggcaaaca

SEQ ID NO: 660364 - RNA, 16 nt, Escherichia coli CFT073
cuuucugcaaccagaa

SEQ ID NO: 660365 - RNA, 18 nt, Escherichia coli CFT073
cuuucugcauccguucuu

SEQ ID NO: 660366 - RNA, 23 nt, Escherichia coli CFT073
cuuucugcccgcguuuccacgcu

SEQ ID NO: 660367 - RNA, 17 nt, Escherichia coli CFT073
cuuucuuauucgcugcu

SEQ ID NO: 660368 - RNA, 16 nt, Escherichia coli CFT073
cuuucuuauuuuucuc

SEQ ID NO: 660369 - RNA, 14 nt, Escherichia coli CFT073
cuuucuucagcuuu

SEQ ID NO: 660370 - RNA, 23 nt, Escherichia coli CFT073
cuuucuucccguuuucaguccuc

SEQ ID NO: 660371 - RNA, 21 nt, Escherichia coli CFT073
cuuucuucgcagcaaaucuca

SEQ ID NO: 660372 - RNA, 21 nt, Escherichia coli CFT073
cuuugaaaucgaacagguugg

SEQ ID NO: 660373 - RNA, 23 nt, Escherichia coli CFT073
cuuugagcgucaaacuuuuaaau

SEQ ID NO: 660374 - RNA, 16 nt, Escherichia coli CFT073
cuuugacacuucauug

SEQ ID NO: 660375 - RNA, 21 nt, Escherichia coli CFT073
cuuugacagcuuuuacaaaau

SEQ ID NO: 660376 - RNA, 15 nt, Escherichia coli CFT073
cuuuauaacugucuu

SEQ ID NO: 660377 - RNA, 23 nt, Escherichia coli CFT073
cuuuauccugcccgcuccagcua

SEQ ID NO: 660378 - RNA, 23 nt, Escherichia coli CFT073
cuuuagggggggcucuuuccauc

SEQ ID NO: 660379 - RNA, 13 nt, Escherichia coli CFT073
cuuuaggaacgcg

SEQ ID NO: 660380 - RNA, 18 nt, Escherichia coli CFT073
cuuuaguugagcuuuuuc

SEQ ID NO: 660381 - RNA, 21 nt, Escherichia coli CFT073
cuuuaucuuucaguauaguga

SEQ ID NO: 660382 - RNA, 14 nt, Escherichia coli CFT073
cuuucacuccauug

SEQ ID NO: 660383 - RNA, 22 nt, Escherichia coli CFT073
cuuucacuccauugucuuuucg

SEQ ID NO: 660384 - RNA, 21 nt, Escherichia coli CFT073
cuuucacuucagcaacgugcu

SEQ ID NO: 660385 - RNA, 23 nt, Escherichia coli CFT073
cuuucacuugacuaagcguuuuc

SEQ ID NO: 660386 - RNA, 16 nt, Escherichia coli CFT073
cuuucacuuuugccag

SEQ ID NO: 660387 - RNA, 20 nt, Escherichia coli CFT073
cuuucagaugcaccugcguu

SEQ ID NO: 660388 - RNA, 15 nt, Escherichia coli CFT073
cuuucagcaccagcc

SEQ ID NO: 660389 - RNA, 21 nt, Escherichia coli CFT073
cuuucagcaguucagucagca

SEQ ID NO: 660390 - RNA, 19 nt, Escherichia coli CFT073
cuuucagccacuucauuua

SEQ ID NO: 660391 - RNA, 19 nt, Escherichia coli CFT073
cuuucagcgccagaaaggu

SEQ ID NO: 660392 - RNA, 17 nt, Escherichia coli CFT073
cuuucagcgucugcgcu

SEQ ID NO: 660393 - RNA, 21 nt, Escherichia coli CFT073
cuuucaggaacagcgacagau

SEQ ID NO: 660394 - RNA, 16 nt, Escherichia coli CFT073
cuuucaggccgcgcag

SEQ ID NO: 660395 - RNA, 19 nt, Escherichia coli CFT073
cuuucaauaaccgcugcca

SEQ ID NO: 660396 - RNA, 20 nt, Escherichia coli CFT073
cuuucaacgcgcuaauuuca

SEQ ID NO: 660397 - RNA, 20 nt, Escherichia coli CFT073
cuuucaaagagagcagucca

SEQ ID NO: 660398 - RNA, 13 nt, Escherichia coli CFT073
cuuucaacaaccu

SEQ ID NO: 660399 - RNA, 23 nt, Escherichia coli CFT073
cuuuacuguuccgauaaguucag

SEQ ID NO: 660400 - RNA, 16 nt, Escherichia coli CFT073
cuuuagacacaucagc

SEQ ID NO: 660401 - RNA, 22 nt, Escherichia coli CFT073
cuuuacuaauagcaaaauauaa

SEQ ID NO: 660402 - RNA, 17 nt, Escherichia coli CFT073
cuuuacucauccccuga

SEQ ID NO: 660403 - RNA, 22 nt, Escherichia coli CFT073
cuuuacuccuaauggagaaacg

SEQ ID NO: 660404 - RNA, 16 nt, Escherichia coli CFT073
cuuuacuaaaaaguga

SEQ ID NO: 660405 - RNA, 11 nt, Escherichia coli CFT073
cuuuacagcca

SEQ ID NO: 660406 - RNA, 20 nt, Escherichia coli CFT073
cuuuaauuuugugcagcaca

SEQ ID NO: 660407 - RNA, 21 nt, Escherichia coli CFT073
cuuuaauuaaucaucaugcuu

SEQ ID NO: 660408 - RNA, 19 nt, Escherichia coli CFT073
cuuuaagaauagccugguu

SEQ ID NO: 660409 - RNA, 22 nt, Escherichia coli CFT073
cuuuaacugccgcacauuuccc

SEQ ID NO: 660410 - RNA, 21 nt, Escherichia coli CFT073
cuugucgguaauuucacuggu

SEQ ID NO: 660411 - RNA, 13 nt, Escherichia coli CFT073
cuugucaggccug

SEQ ID NO: 660412 - RNA, 20 nt, Escherichia coli CFT073
cuugucaccguaaccaccag

SEQ ID NO: 660413 - RNA, 22 nt, Escherichia coli CFT073
cuuguaucacuggccucuucuc

SEQ ID NO: 660414 - RNA, 16 nt, Escherichia coli CFT073
cuugccgaugucuuug

SEQ ID NO: 660415 - RNA, 15 nt, Escherichia coli CFT073
cuugccgcgucuuau

SEQ ID NO: 660416 - RNA, 16 nt, Escherichia coli CFT073
cuugcugguacguuua

SEQ ID NO: 660417 - RNA, 19 nt, Escherichia coli CFT073
cuugcugguacguuuauua

SEQ ID NO: 660418 - RNA, 18 nt, Escherichia coli CFT073
cuugcgauauggcugcgc

SEQ ID NO: 660419 - RNA, 19 nt, Escherichia coli CFT073
cuugcgauauggcugcgcu

SEQ ID NO: 660420 - RNA, 20 nt, Escherichia coli CFT073
cuugcgauauggcugcgcuu

SEQ ID NO: 660421 - RNA, 14 nt, Escherichia coli CFT073
cuugcgacucagcc

SEQ ID NO: 660422 - RNA, 16 nt, Escherichia coli CFT073
cuugcgauccugcaga

SEQ ID NO: 660423 - RNA, 15 nt, Escherichia coli CFT073
cuugcgcaaugaguu

SEQ ID NO: 660424 - RNA, 17 nt, Escherichia coli CFT073
cuugccaaauuuacugu

SEQ ID NO: 660425 - RNA, 16 nt, Escherichia coli CFT073
cuugccaaggucgggg

SEQ ID NO: 660426 - RNA, 17 nt, Escherichia coli CFT073
cuugcauuguguaauua

SEQ ID NO: 660427 - RNA, 13 nt, Escherichia coli CFT073
cuugccaggccga

SEQ ID NO: 660428 - RNA, 15 nt, Escherichia coli CFT073
cuugccagguaaaca

SEQ ID NO: 660429 - RNA, 17 nt, Escherichia coli CFT073
cuugccauucacuucau

SEQ ID NO: 660430 - RNA, 18 nt, Escherichia coli CFT073
cuugccauucacuucaua

SEQ ID NO: 660431 - RNA, 11 nt, Escherichia coli CFT073
cuugagaaaau

SEQ ID NO: 660432 - RNA, 21 nt, Escherichia coli CFT073
cuugacgcgucuuaucaggcc

SEQ ID NO: 660433 - RNA, 23 nt, Escherichia coli CFT073
cuugacgcgucuuaucaggccua

SEQ ID NO: 660434 - RNA, 12 nt, Escherichia coli CFT073
cuugaauuuauc

SEQ ID NO: 660435 - RNA, 22 nt, Escherichia coli CFT073
cuugaacgacaaaaacgccgcu

SEQ ID NO: 660436 - RNA, 13 nt, Escherichia coli CFT073
cuucucaaucccu

SEQ ID NO: 660437 - RNA, 17 nt, Escherichia coli CFT073
cuucucaaucccuuucu

SEQ ID NO: 660438 - RNA, 15 nt, Escherichia coli CFT073
cuucucagauauaaa

SEQ ID NO: 660439 - RNA, 15 nt, Escherichia coli CFT073
cuucucaccaucaaa

SEQ ID NO: 660440 - RNA, 20 nt, Escherichia coli CFT073
cuucucacggauccagaacu

SEQ ID NO: 660441 - RNA, 21 nt, Escherichia coli CFT073
cuucucacggauccagaacug

SEQ ID NO: 660442 - RNA, 13 nt, Escherichia coli CFT073
cuucucacugccc

SEQ ID NO: 660443 - RNA, 12 nt, Escherichia coli CFT073
cuucuccacgcc

SEQ ID NO: 660444 - RNA, 12 nt, Escherichia coli CFT073
cuucucaucuuu

SEQ ID NO: 660445 - RNA, 20 nt, Escherichia coli CFT073
cuguguaaacccagccgcgu

SEQ ID NO: 660446 - RNA, 22 nt, Escherichia coli CFT073
cuguguaaacccagccgcgucu

SEQ ID NO: 660447 - RNA, 17 nt, Escherichia coli CFT073
cuguggaucuuccccuu

SEQ ID NO: 660448 - RNA, 22 nt, Escherichia coli CFT073
cuguggaucuuccccuuuugcc

SEQ ID NO: 660449 - RNA, 20 nt, Escherichia coli CFT073
cuguggaauaugcgccacuc

SEQ ID NO: 660450 - RNA, 17 nt, Escherichia coli CFT073
cugugcuugcagauaau

SEQ ID NO: 660451 - RNA, 19 nt, Escherichia coli CFT073
cuguggaaagagcaaugug

SEQ ID NO: 660452 - RNA, 14 nt, Escherichia coli CFT073
cuguggcuuuuuug

SEQ ID NO: 660453 - RNA, 16 nt, Escherichia coli CFT073
cuguggcgcgaccaga

SEQ ID NO: 660454 - RNA, 15 nt, Escherichia coli CFT073
cuguuacucaacuga

SEQ ID NO: 660455 - RNA, 20 nt, Escherichia coli CFT073
cuguucagugauggcacacc

SEQ ID NO: 660456 - RNA, 17 nt, Escherichia coli CFT073
cuguucauuuuguaggc

SEQ ID NO: 660457 - RNA, 20 nt, Escherichia coli CFT073
cuguucauuuuguaggccug

SEQ ID NO: 660458 - RNA, 21 nt, Escherichia coli CFT073
cuguucaaaugcgcucagagu

SEQ ID NO: 660459 - RNA, 13 nt, Escherichia coli CFT073
cuguguguaggcc

SEQ ID NO: 660460 - RNA, 21 nt, Escherichia coli CFT073
cuguguuggguucacuuuccc

SEQ ID NO: 660461 - RNA, 12 nt, Escherichia coli CFT073
cuguguuguucu

SEQ ID NO: 660462 - RNA, 14 nt, Escherichia coli CFT073
cuguccugaaaauu

SEQ ID NO: 660463 - RNA, 20 nt, Escherichia coli CFT073
cuguccauaccggacuccag

SEQ ID NO: 660464 - RNA, 16 nt, Escherichia coli CFT073
cuguccgccagaccaa

SEQ ID NO: 660465 - RNA, 13 nt, Escherichia coli CFT073
cugucgaggccaa

SEQ ID NO: 660466 - RNA, 23 nt, Escherichia coli CFT073
cugucgacaaagccgcaggcgug

SEQ ID NO: 660467 - RNA, 13 nt, Escherichia coli CFT073
cugucuuccugcg

SEQ ID NO: 660468 - RNA, 14 nt, Escherichia coli CFT073
cugucuuacagggc

SEQ ID NO: 660469 - RNA, 15 nt, Escherichia coli CFT073
cugugaaacaccugc

SEQ ID NO: 660470 - RNA, 18 nt, Escherichia coli CFT073
cugugaagugcugcaacc

SEQ ID NO: 660471 - RNA, 21 nt, Escherichia coli CFT073
cugugaauccugcauaccauu

SEQ ID NO: 660472 - RNA, 17 nt, Escherichia coli CFT073
cugugaauuacugcugc

SEQ ID NO: 660473 - RNA, 18 nt, Escherichia coli CFT073
cugugaauuacugcugcg

SEQ ID NO: 660474 - RNA, 16 nt, Escherichia coli CFT073
cugugccgcgaccacc

SEQ ID NO: 660475 - RNA, 22 nt, Escherichia coli CFT073
cugugcggucugauacaugcug

SEQ ID NO: 660476 - RNA, 17 nt, Escherichia coli CFT073
cugugcgacuucauuca

SEQ ID NO: 660477 - RNA, 16 nt, Escherichia coli CFT073
cugugccagcggcagu

SEQ ID NO: 660478 - RNA, 23 nt, Escherichia coli CFT073
cugugccagcucgugcagaacau

SEQ ID NO: 660479 - RNA, 14 nt, Escherichia coli CFT073
cugugccagcucca

SEQ ID NO: 660480 - RNA, 18 nt, Escherichia coli CFT073
cugugccacggcuuugca

SEQ ID NO: 660481 - RNA, 17 nt, Escherichia coli CFT073
cugugcauguuuaacca

SEQ ID NO: 660482 - RNA, 22 nt, Escherichia coli CFT073
cugugauuucuuuauugauaaa

SEQ ID NO: 660483 - RNA, 22 nt, Escherichia coli CFT073
cugugcaccgcccugcaucaug

SEQ ID NO: 660484 - RNA, 18 nt, Escherichia coli CFT073
cugugcaccgcgcuggcu

SEQ ID NO: 660485 - RNA, 18 nt, Escherichia coli CFT073
cugugcagccaaaaauga

SEQ ID NO: 660486 - RNA, 17 nt, Escherichia coli CFT073
cuguaugacaaaagaau

SEQ ID NO: 660487 - RNA, 15 nt, Escherichia coli CFT073
cuguccacgacagaa

SEQ ID NO: 660488 - RNA, 19 nt, Escherichia coli CFT073
cuguccaaauccuucagca

SEQ ID NO: 660489 - RNA, 14 nt, Escherichia coli CFT073
cuguaucaggcuga

SEQ ID NO: 660490 - RNA, 13 nt, Escherichia coli CFT073
cuguaucccagcc

SEQ ID NO: 660491 - RNA, 14 nt, Escherichia coli CFT073
cuguaucccagccc

SEQ ID NO: 660492 - RNA, 14 nt, Escherichia coli CFT073
cuguagaacaccug

SEQ ID NO: 660493 - RNA, 21 nt, Escherichia coli CFT073
cuguagcaacgauaacaauca

SEQ ID NO: 660494 - RNA, 16 nt, Escherichia coli CFT073
cuguagauauucuucc

SEQ ID NO: 660495 - RNA, 23 nt, Escherichia coli CFT073
cuguagauauucuuccaguggcu

SEQ ID NO: 660496 - RNA, 22 nt, Escherichia coli CFT073
cuguaaugucaucucuggcacg

SEQ ID NO: 660497 - RNA, 21 nt, Escherichia coli CFT073
cuguaaugcuauaaaaauaaa

SEQ ID NO: 660498 - RNA, 18 nt, Escherichia coli CFT073
cuguacucaccaacgcag

SEQ ID NO: 660499 - RNA, 20 nt, Escherichia coli CFT073
cuguaaguuacuaaaaguaa

SEQ ID NO: 660500 - RNA, 13 nt, Escherichia coli CFT073
cuguaauccauug

SEQ ID NO: 660501 - RNA, 21 nt, Escherichia coli CFT073
cuguaauccauugcaacuggc

SEQ ID NO: 660502 - RNA, 19 nt, Escherichia coli CFT073
cuguaacguuuggcacgcc

SEQ ID NO: 660503 - RNA, 23 nt, Escherichia coli CFT073
cuguaauaccagccuucuucauc

SEQ ID NO: 660504 - RNA, 18 nt, Escherichia coli CFT073
cuguaaggugaaagcaau

SEQ ID NO: 660505 - RNA, 14 nt, Escherichia coli CFT073
cugguuucucuccg

SEQ ID NO: 660506 - RNA, 23 nt, Escherichia coli CFT073
cugguuucagcaucccaggcauc

SEQ ID NO: 660507 - RNA, 22 nt, Escherichia coli CFT073
cugguugaucaauucgagcauc

SEQ ID NO: 660508 - RNA, 16 nt, Escherichia coli CFT073
cugguugauuuuaaag

SEQ ID NO: 660509 - RNA, 20 nt, Escherichia coli CFT073
cugguugauuuuaaaggauu

SEQ ID NO: 660510 - RNA, 15 nt, Escherichia coli CFT073
cuggugugcguugca

SEQ ID NO: 660511 - RNA, 20 nt, Escherichia coli CFT073
cuggugugucuuuucaggcc

SEQ ID NO: 660512 - RNA, 22 nt, Escherichia coli CFT073
cugguguucgauaaccaucccu

SEQ ID NO: 660513 - RNA, 16 nt, Escherichia coli CFT073
cugguucccaacaaca

SEQ ID NO: 660514 - RNA, 11 nt, Escherichia coli CFT073
cugguucccag

SEQ ID NO: 660515 - RNA, 15 nt, Escherichia coli CFT073
cugguucguuuauua

SEQ ID NO: 660516 - RNA, 22 nt, Escherichia coli CFT073
cugguuagcaaccgccgcugcu

SEQ ID NO: 660517 - RNA, 20 nt, Escherichia coli CFT073
cugguucaggcguuucuuca

SEQ ID NO: 660518 - RNA, 14 nt, Escherichia coli CFT073
cuggguuuucacag

SEQ ID NO: 660519 - RNA, 20 nt, Escherichia coli CFT073
cugguaaacgacccugccac

SEQ ID NO: 660520 - RNA, 22 nt, Escherichia coli CFT073
cugguaaacgacccugccacag

SEQ ID NO: 660521 - RNA, 13 nt, Escherichia coli CFT073
cuggugcugcgcu

SEQ ID NO: 660522 - RNA, 16 nt, Escherichia coli CFT073
cugguggcaagaccug

SEQ ID NO: 660523 - RNA, 22 nt, Escherichia coli CFT073
cugguggggcaaaaacccuucu

SEQ ID NO: 660524 - RNA, 16 nt, Escherichia coli CFT073
cugguggugaugguau

SEQ ID NO: 660525 - RNA, 13 nt, Escherichia coli CFT073
cugggccagcacc

SEQ ID NO: 660526 - RNA, 18 nt, Escherichia coli CFT073
cugggaucugauuuucuu

SEQ ID NO: 660527 - RNA, 19 nt, Escherichia coli CFT073
cugggauuuggcagcaccc

SEQ ID NO: 660528 - RNA, 16 nt, Escherichia coli CFT073
cugggcaauggugaac

SEQ ID NO: 660529 - RNA, 22 nt, Escherichia coli CFT073
cugggagaugauaaccccgcaa

SEQ ID NO: 660530 - RNA, 16 nt, Escherichia coli CFT073
cugggaaaucaccacc

SEQ ID NO: 660531 - RNA, 18 nt, Escherichia coli CFT073
cugggaaaucaccaccag

SEQ ID NO: 660532 - RNA, 20 nt, Escherichia coli CFT073
cuggcuaagcaucgcaauac

SEQ ID NO: 660533 - RNA, 18 nt, Escherichia coli CFT073
cuggcucgccgcagccaa

SEQ ID NO: 660534 - RNA, 18 nt, Escherichia coli CFT073
cuggcucaucgccuucca

SEQ ID NO: 660535 - RNA, 20 nt, Escherichia coli CFT073
cuggcgcacguucugucgcu

SEQ ID NO: 660536 - RNA, 13 nt, Escherichia coli CFT073
cuggcugaccuga

SEQ ID NO: 660537 - RNA, 23 nt, Escherichia coli CFT073
cuggcugagcaaacaguucugca

SEQ ID NO: 660538 - RNA, 22 nt, Escherichia coli CFT073
cuggcugauggaagugacaccg

SEQ ID NO: 660539 - RNA, 18 nt, Escherichia coli CFT073
cuggcucguuauagguau

SEQ ID NO: 660540 - RNA, 23 nt, Escherichia coli CFT073
cuggcugaacgccugcaccagcc

SEQ ID NO: 660541 - RNA, 20 nt, Escherichia coli CFT073
cuggcuggcgcuacugaagc

SEQ ID NO: 660542 - RNA, 16 nt, Escherichia coli CFT073
cuggcuggcaacccag

SEQ ID NO: 660543 - RNA, 20 nt, Escherichia coli CFT073
cuggcuguuucgcuucuuca

SEQ ID NO: 660544 - RNA, 15 nt, Escherichia coli CFT073
cuggcuuaauaauuc

SEQ ID NO: 660545 - RNA, 17 nt, Escherichia coli CFT073
cuggcuguuaucgcuga

SEQ ID NO: 660546 - RNA, 18 nt, Escherichia coli CFT073
cuggcugggcgucauccc

SEQ ID NO: 660547 - RNA, 22 nt, Escherichia coli CFT073
cuggcuggggaaggcaaagucc

SEQ ID NO: 660548 - RNA, 14 nt, Escherichia coli CFT073
cuggcugguggaac

SEQ ID NO: 660549 - RNA, 16 nt, Escherichia coli CFT073
cuggcuguauuuuucc

SEQ ID NO: 660550 - RNA, 23 nt, Escherichia coli CFT073
cuggcuucgagaaugaagucacc

SEQ ID NO: 660551 - RNA, 19 nt, Escherichia coli CFT073
cuggcuucuaucuucaucu

SEQ ID NO: 660552 - RNA, 18 nt, Escherichia coli CFT073
cuggaucaaagucaucaa

SEQ ID NO: 660553 - RNA, 22 nt, Escherichia coli CFT073
cuggauauacgcuuucagcacu

SEQ ID NO: 660554 - RNA, 15 nt, Escherichia coli CFT073
cugcuucaaaguuuu

SEQ ID NO: 660555 - RNA, 16 nt, Escherichia coli CFT073
cugcuuaucgcccugc

SEQ ID NO: 660556 - RNA, 12 nt, Escherichia coli CFT073
cugcuguuuagu

SEQ ID NO: 660557 - RNA, 14 nt, Escherichia coli CFT073
cuggcaaaaauaag

SEQ ID NO: 660558 - RNA, 15 nt, Escherichia coli CFT073
cuggauuugugucag

SEQ ID NO: 660559 - RNA, 19 nt, Escherichia coli CFT073
cuggcaaacgucaguacaa

SEQ ID NO: 660560 - RNA, 15 nt, Escherichia coli CFT073
cuggcaaaguagagc

SEQ ID NO: 660561 - RNA, 16 nt, Escherichia coli CFT073
cuggaucuucuucaug

SEQ ID NO: 660562 - RNA, 15 nt, Escherichia coli CFT073
cuggaugaucccuuc

SEQ ID NO: 660563 - RNA, 17 nt, Escherichia coli CFT073
cuggaugccugcauuug

SEQ ID NO: 660564 - RNA, 18 nt, Escherichia coli CFT073
cuggauggcgcuccagca

SEQ ID NO: 660565 - RNA, 12 nt, Escherichia coli CFT073
cuggccaguucg

SEQ ID NO: 660566 - RNA, 19 nt, Escherichia coli CFT073
cuggcagcaagugcggcgc

SEQ ID NO: 660567 - RNA, 17 nt, Escherichia coli CFT073
cuggcagccauaaucac

SEQ ID NO: 660568 - RNA, 17 nt, Escherichia coli CFT073
cuggcagccccguucgc

SEQ ID NO: 660569 - RNA, 13 nt, Escherichia coli CFT073
cuggcacugccga

SEQ ID NO: 660570 - RNA, 18 nt, Escherichia coli CFT073
cuggcacucuccggcaga

SEQ ID NO: 660571 - RNA, 16 nt, Escherichia coli CFT073
cuggcacucuuccaga

SEQ ID NO: 660572 - RNA, 14 nt, Escherichia coli CFT073
cuggcgaaaggagg

SEQ ID NO: 660573 - RNA, 15 nt, Escherichia coli CFT073
cuggcgaacucugac

SEQ ID NO: 660574 - RNA, 14 nt, Escherichia coli CFT073
cuggcgaauuuaua

SEQ ID NO: 660575 - RNA, 14 nt, Escherichia coli CFT073
cugccuugcucuuc

SEQ ID NO: 660576 - RNA, 17 nt, Escherichia coli CFT073
cugccuucccuucucuu

SEQ ID NO: 660577 - RNA, 18 nt, Escherichia coli CFT073
cugccuuuuuuauugcuu

SEQ ID NO: 660578 - RNA, 13 nt, Escherichia coli CFT073
cugccuuucccuu

SEQ ID NO: 660579 - RNA, 17 nt, Escherichia coli CFT073
cugccgcgccagaucag

SEQ ID NO: 660580 - RNA, 14 nt, Escherichia coli CFT073
cugccgccaccaug

SEQ ID NO: 660581 - RNA, 20 nt, Escherichia coli CFT073
cugccgccaccauguugcgc

SEQ ID NO: 660582 - RNA, 23 nt, Escherichia coli CFT073
cugccgccaccauguugcgcaga

SEQ ID NO: 660583 - RNA, 14 nt, Escherichia coli CFT073
cugcgacgucugau

SEQ ID NO: 660584 - RNA, 18 nt, Escherichia coli CFT073
cugcgacgugcccuuuca

SEQ ID NO: 660585 - RNA, 20 nt, Escherichia coli CFT073
cugcgagaugaccgacaggu

SEQ ID NO: 660586 - RNA, 20 nt, Escherichia coli CFT073
cugcgauaguggaacaaaga

SEQ ID NO: 660587 - RNA, 22 nt, Escherichia coli CFT073
cugcgaucgauauucaccguca

SEQ ID NO: 660588 - RNA, 21 nt, Escherichia coli CFT073
cugcgaccggcguaacggcca

SEQ ID NO: 660589 - RNA, 18 nt, Escherichia coli CFT073
cugcgaaucgcuucauuu

SEQ ID NO: 660590 - RNA, 16 nt, Escherichia coli CFT073
cugcgaauuuccugcc

SEQ ID NO: 660591 - RNA, 15 nt, Escherichia coli CFT073
cugcgauucaggguu

SEQ ID NO: 660592 - RNA, 12 nt, Escherichia coli CFT073
cugcgccagcca

SEQ ID NO: 660593 - RNA, 16 nt, Escherichia coli CFT073
cugcgccaccacaaca

SEQ ID NO: 660594 - RNA, 17 nt, Escherichia coli CFT073
cugcgcuaaaauuucuu

SEQ ID NO: 660595 - RNA, 17 nt, Escherichia coli CFT073
cugcgcuggcaggccug

SEQ ID NO: 660596 - RNA, 18 nt, Escherichia coli CFT073
cugcgcuggcaggccugc

SEQ ID NO: 660597 - RNA, 15 nt, Escherichia coli CFT073
cugcgcucuucuggc

SEQ ID NO: 660598 - RNA, 14 nt, Escherichia coli CFT073
cugcgcugacucua

SEQ ID NO: 660599 - RNA, 15 nt, Escherichia coli CFT073
cugcgccauaaccgc

SEQ ID NO: 660600 - RNA, 14 nt, Escherichia coli CFT073
cugcgccagcggga

SEQ ID NO: 660601 - RNA, 13 nt, Escherichia coli CFT073
cugcgccagugcc

SEQ ID NO: 660602 - RNA, 22 nt, Escherichia coli CFT073
cugcggcgaugaccgccacggu

SEQ ID NO: 660603 - RNA, 16 nt, Escherichia coli CFT073
cugcggcauuuccaga

SEQ ID NO: 660604 - RNA, 14 nt, Escherichia coli CFT073
cugcggccagcagc

SEQ ID NO: 660605 - RNA, 23 nt, Escherichia coli CFT073
cugcggcaagaauuacuucuuga

SEQ ID NO: 660606 - RNA, 17 nt, Escherichia coli CFT073
cugcuccuguugaugug

SEQ ID NO: 660607 - RNA, 19 nt, Escherichia coli CFT073
cugcucgcaaaauaaaaac

SEQ ID NO: 660608 - RNA, 16 nt, Escherichia coli CFT073
cugcuccagaaaauaa

SEQ ID NO: 660609 - RNA, 13 nt, Escherichia coli CFT073
cugcgucuuccac

SEQ ID NO: 660610 - RNA, 17 nt, Escherichia coli CFT073
cugcgucuuccacuuca

SEQ ID NO: 660611 - RNA, 18 nt, Escherichia coli CFT073
cugcgucuuccacuucau

SEQ ID NO: 660612 - RNA, 16 nt, Escherichia coli CFT073
cugcgucgcuuuccag

SEQ ID NO: 660613 - RNA, 19 nt, Escherichia coli CFT073
cugcgucgcuuuccagucg

SEQ ID NO: 660614 - RNA, 18 nt, Escherichia coli CFT073
cugcgucgcgcguaacau

SEQ ID NO: 660615 - RNA, 17 nt, Escherichia coli CFT073
cugcgucgcaucuggca

SEQ ID NO: 660616 - RNA, 19 nt, Escherichia coli CFT073
cugcucuuuuugcauaauu

SEQ ID NO: 660617 - RNA, 19 nt, Escherichia coli CFT073
cugcucuuucagcaccgcg

SEQ ID NO: 660618 - RNA, 21 nt, Escherichia coli CFT073
cugcucuauacgcucauuuuc

SEQ ID NO: 660619 - RNA, 22 nt, Escherichia coli CFT073
cugcucuauacgcucauuuucu

SEQ ID NO: 660620 - RNA, 16 nt, Escherichia coli CFT073
cugcucuggcagcacc

SEQ ID NO: 660621 - RNA, 15 nt, Escherichia coli CFT073
cugcucuuccggcgu

SEQ ID NO: 660622 - RNA, 22 nt, Escherichia coli CFT073
cugcucguaaagcaucagacug

SEQ ID NO: 660623 - RNA, 14 nt, Escherichia coli CFT073
cugcucguaaagca

SEQ ID NO: 660624 - RNA, 19 nt, Escherichia coli CFT073
cugcucguaaagcaucaga

SEQ ID NO: 660625 - RNA, 16 nt, Escherichia coli CFT073
cugcucggaaauauuc

SEQ ID NO: 660626 - RNA, 14 nt, Escherichia coli CFT073
cugcugcacaccau

SEQ ID NO: 660627 - RNA, 16 nt, Escherichia coli CFT073
cugcugcacgcccuga

SEQ ID NO: 660628 - RNA, 23 nt, Escherichia coli CFT073
cugcugcacgcccugauaaauca

SEQ ID NO: 660629 - RNA, 20 nt, Escherichia coli CFT073
cugcugauaaccgccgccaa

SEQ ID NO: 660630 - RNA, 19 nt, Escherichia coli CFT073
cugcugccguagccgaugu

SEQ ID NO: 660631 - RNA, 21 nt, Escherichia coli CFT073
cugcugccguagccgaugucg

SEQ ID NO: 660632 - RNA, 23 nt, Escherichia coli CFT073
cugcugcgcacaaacaucccuga

SEQ ID NO: 660633 - RNA, 18 nt, Escherichia coli CFT073
cugcugcggaauagcaau

SEQ ID NO: 660634 - RNA, 16 nt, Escherichia coli CFT073
cugcuguuaccagaca

SEQ ID NO: 660635 - RNA, 19 nt, Escherichia coli CFT073
cugcuguuaccagacagaa

SEQ ID NO: 660636 - RNA, 11 nt, Escherichia coli CFT073
cugcugugacu

SEQ ID NO: 660637 - RNA, 16 nt, Escherichia coli CFT073
cugcugugccagcucc

SEQ ID NO: 660638 - RNA, 18 nt, Escherichia coli CFT073
cugcugugucucuucuuu

SEQ ID NO: 660639 - RNA, 15 nt, Escherichia coli CFT073
cugcugugugaucca

SEQ ID NO: 660640 - RNA, 19 nt, Escherichia coli CFT073
cugcugugugauccacugc

SEQ ID NO: 660641 - RNA, 19 nt, Escherichia coli CFT073
cugcuguaaagucuggaag

SEQ ID NO: 660642 - RNA, 18 nt, Escherichia coli CFT073
cugcuggacgauuucacc

SEQ ID NO: 660643 - RNA, 18 nt, Escherichia coli CFT073
cugcugcuuuuccccauc

SEQ ID NO: 660644 - RNA, 19 nt, Escherichia coli CFT073
cugcuggaaaggccgcgaa

SEQ ID NO: 660645 - RNA, 22 nt, Escherichia coli CFT073
cugcaugaugucgaauuucucg

SEQ ID NO: 660646 - RNA, 17 nt, Escherichia coli CFT073
cugcauggcaacuuuaa

SEQ ID NO: 660647 - RNA, 14 nt, Escherichia coli CFT073
cugcauguuggcga

SEQ ID NO: 660648 - RNA, 20 nt, Escherichia coli CFT073
cugcauuagccaggcaccaa

SEQ ID NO: 660649 - RNA, 21 nt, Escherichia coli CFT073
cugcauccguucuucggcgcu

SEQ ID NO: 660650 - RNA, 13 nt, Escherichia coli CFT073
cugcauugucgga

SEQ ID NO: 660651 - RNA, 23 nt, Escherichia coli CFT073
cugcauuuacggccauggaacau

SEQ ID NO: 660652 - RNA, 18 nt, Escherichia coli CFT073
cugcauuucuggaaugcg

SEQ ID NO: 660653 - RNA, 18 nt, Escherichia coli CFT073
cugcauuuggacaccauu

SEQ ID NO: 660654 - RNA, 13 nt, Escherichia coli CFT073
cugcauuuucucg

SEQ ID NO: 660655 - RNA, 18 nt, Escherichia coli CFT073
cugccaacgaacacaugc

SEQ ID NO: 660656 - RNA, 18 nt, Escherichia coli CFT073
cugccaauaaugcccgca

SEQ ID NO: 660657 - RNA, 20 nt, Escherichia coli CFT073
cugccaauaaugcccgcacc

SEQ ID NO: 660658 - RNA, 21 nt, Escherichia coli CFT073
cugcagcggucacauguucca

SEQ ID NO: 660659 - RNA, 22 nt, Escherichia coli CFT073
cugcauacugaguaauuuucaa

SEQ ID NO: 660660 - RNA, 18 nt, Escherichia coli CFT073
cugcaucccggcaggaau

SEQ ID NO: 660661 - RNA, 19 nt, Escherichia coli CFT073
cugcaucagcgccuuacca

SEQ ID NO: 660662 - RNA, 16 nt, Escherichia coli CFT073
cugcaucaaccagcac

SEQ ID NO: 660663 - RNA, 16 nt, Escherichia coli CFT073
cugcccaauauacaaa

SEQ ID NO: 660664 - RNA, 23 nt, Escherichia coli CFT073
cugcccacgcgguauggucacug

SEQ ID NO: 660665 - RNA, 15 nt, Escherichia coli CFT073
cugccauuguugcug

SEQ ID NO: 660666 - RNA, 18 nt, Escherichia coli CFT073
cugccauuguugcuggau

SEQ ID NO: 660667 - RNA, 22 nt, Escherichia coli CFT073
cugccauuggcaggcucugacu

SEQ ID NO: 660668 - RNA, 18 nt, Escherichia coli CFT073
cugccagcguaccaugau

SEQ ID NO: 660669 - RNA, 12 nt, Escherichia coli CFT073
cugccagcucuc

SEQ ID NO: 660670 - RNA, 24 nt, Escherichia coli CFT073
cugccagaucaucguuuccgaugg

SEQ ID NO: 660671 - RNA, 15 nt, Escherichia coli CFT073
cugccagcaucucca

SEQ ID NO: 660672 - RNA, 18 nt, Escherichia coli CFT073
cugccagccacacugcgg

SEQ ID NO: 660673 - RNA, 17 nt, Escherichia coli CFT073
cugccagccacaggccg

SEQ ID NO: 660674 - RNA, 15 nt, Escherichia coli CFT073
cugccacauuucucu

SEQ ID NO: 660675 - RNA, 17 nt, Escherichia coli CFT073
cugccacauccccuccc

SEQ ID NO: 660676 - RNA, 15 nt, Escherichia coli CFT073
cugccagauucucca

SEQ ID NO: 660677 - RNA, 15 nt, Escherichia coli CFT073
cugccacacugccuu

SEQ ID NO: 660678 - RNA, 18 nt, Escherichia coli CFT073
cugccccgccaacagugc

SEQ ID NO: 660679 - RNA, 20 nt, Escherichia coli CFT073
cugccccgccaacagugccg

SEQ ID NO: 660680 - RNA, 16 nt, Escherichia coli CFT073
cugccccgccagugcu

SEQ ID NO: 660681 - RNA, 19 nt, Escherichia coli CFT073
cugcccgugggcaggccag

SEQ ID NO: 660682 - RNA, 20 nt, Escherichia coli CFT073
cugcccucuuuagcauucag

SEQ ID NO: 660683 - RNA, 14 nt, Escherichia coli CFT073
cugcaccaggcggg

SEQ ID NO: 660684 - RNA, 12 nt, Escherichia coli CFT073
cugcaccagcag

SEQ ID NO: 660685 - RNA, 19 nt, Escherichia coli CFT073
cugcaccagcagcgucagc

SEQ ID NO: 660686 - RNA, 19 nt, Escherichia coli CFT073
cugcacaguguuuguugaa

SEQ ID NO: 660687 - RNA, 14 nt, Escherichia coli CFT073
cugcacaaugccuu

SEQ ID NO: 660688 - RNA, 15 nt, Escherichia coli CFT073
cugcacaccaaccgc

SEQ ID NO: 660689 - RNA, 12 nt, Escherichia coli CFT073
cugcacagagcu

SEQ ID NO: 660690 - RNA, 21 nt, Escherichia coli CFT073
cugcacagcauucagcuucca

SEQ ID NO: 660691 - RNA, 19 nt, Escherichia coli CFT073
cugcaacacuuccgcuucc

SEQ ID NO: 660692 - RNA, 18 nt, Escherichia coli CFT073
cugcaaauuaugccugau

SEQ ID NO: 660693 - RNA, 14 nt, Escherichia coli CFT073
cugcaaauucaaua

SEQ ID NO: 660694 - RNA, 16 nt, Escherichia coli CFT073
cugcaaaaguaccauu

SEQ ID NO: 660695 - RNA, 16 nt, Escherichia coli CFT073
cugcaaaauaccaaua

SEQ ID NO: 660696 - RNA, 22 nt, Escherichia coli CFT073
cugcaaaauaccaauaaucaau

SEQ ID NO: 660697 - RNA, 18 nt, Escherichia coli CFT073
cugcacgccgguucccag

SEQ ID NO: 660698 - RNA, 21 nt, Escherichia coli CFT073
cugcacgcgauggcuuuccac

SEQ ID NO: 660699 - RNA, 16 nt, Escherichia coli CFT073
cugcaccucaaaacca

SEQ ID NO: 660700 - RNA, 16 nt, Escherichia coli CFT073
cugcaccucuuccuga

SEQ ID NO: 660701 - RNA, 17 nt, Escherichia coli CFT073
cugcaccccacaaacag

SEQ ID NO: 660702 - RNA, 15 nt, Escherichia coli CFT073
cugcacccuuuuuua

SEQ ID NO: 660703 - RNA, 21 nt, Escherichia coli CFT073
cugauguacccgcugcaacuc

SEQ ID NO: 660704 - RNA, 16 nt, Escherichia coli CFT073
cugauggucggcgggc

SEQ ID NO: 660705 - RNA, 18 nt, Escherichia coli CFT073
cugauuccgggccaccau

SEQ ID NO: 660706 - RNA, 16 nt, Escherichia coli CFT073
cugauucccugccuga

SEQ ID NO: 660707 - RNA, 23 nt, Escherichia coli CFT073
cugauugacgcguucgcuaaaga

SEQ ID NO: 660708 - RNA, 18 nt, Escherichia coli CFT073
cugauuuucaucuucuuc

SEQ ID NO: 660709 - RNA, 12 nt, Escherichia coli CFT073
cugaugccacug

SEQ ID NO: 660710 - RNA, 18 nt, Escherichia coli CFT073
cugaugcaucaacaucau

SEQ ID NO: 660711 - RNA, 14 nt, Escherichia coli CFT073
cugaugcaccuuca

SEQ ID NO: 660712 - RNA, 16 nt, Escherichia coli CFT073
cugaugcgacgcggca

SEQ ID NO: 660713 - RNA, 15 nt, Escherichia coli CFT073
cugaugcgacgcuga

SEQ ID NO: 660714 - RNA, 22 nt, Escherichia coli CFT073
cugaugcgacgcugauagcguc

SEQ ID NO: 660715 - RNA, 20 nt, Escherichia coli CFT073
cugaugcuuuccgccgucau

SEQ ID NO: 660716 - RNA, 23 nt, Escherichia coli CFT073
cugaugcugugaauauucauuuc

SEQ ID NO: 660717 - RNA, 16 nt, Escherichia coli CFT073
cugaugacugaugcuu

SEQ ID NO: 660718 - RNA, 21 nt, Escherichia coli CFT073
cugaugauuugccgauaagca

SEQ ID NO: 660719 - RNA, 18 nt, Escherichia coli CFT073
cugaugagcaaaucgcgg

SEQ ID NO: 660720 - RNA, 15 nt, Escherichia coli CFT073
cugaugauauuuuuc

SEQ ID NO: 660721 - RNA, 19 nt, Escherichia coli CFT073
cugagcguaggucaugccu

SEQ ID NO: 660722 - RNA, 20 nt, Escherichia coli CFT073
cugagcgugccccugaauaa

SEQ ID NO: 660723 - RNA, 22 nt, Escherichia coli CFT073
cugagcgugccccugaauaauc

SEQ ID NO: 660724 - RNA, 20 nt, Escherichia coli CFT073
cugaugacaaagucuaaaaa

SEQ ID NO: 660725 - RNA, 21 nt, Escherichia coli CFT073
cugagcaacaauuuucccuuc

SEQ ID NO: 660726 - RNA, 21 nt, Escherichia coli CFT073
cugagcagcgauaucugccga

SEQ ID NO: 660727 - RNA, 21 nt, Escherichia coli CFT073
cugagaucggaaagccccgcc

SEQ ID NO: 660728 - RNA, 14 nt, Escherichia coli CFT073
cugagaucugccuu

SEQ ID NO: 660729 - RNA, 14 nt, Escherichia coli CFT073
cugagauggcuuca

SEQ ID NO: 660730 - RNA, 15 nt, Escherichia coli CFT073
cugagauuacauugg

SEQ ID NO: 660731 - RNA, 21 nt, Escherichia coli CFT073
cugagauuacauugggaagau

SEQ ID NO: 660732 - RNA, 17 nt, Escherichia coli CFT073
cugagccaguuuuucuu

SEQ ID NO: 660733 - RNA, 22 nt, Escherichia coli CFT073
cugagcaucacauaaucgaaaa

SEQ ID NO: 660734 - RNA, 21 nt, Escherichia coli CFT073
cugagcggcguacccuccggg

SEQ ID NO: 660735 - RNA, 19 nt, Escherichia coli CFT073
cugagaaaauguauuucau

SEQ ID NO: 660736 - RNA, 22 nt, Escherichia coli CFT073
cugagaacaagauugccugaug

SEQ ID NO: 660737 - RNA, 23 nt, Escherichia coli CFT073
cugagaaauuagcgucaccaucc

SEQ ID NO: 660738 - RNA, 21 nt, Escherichia coli CFT073
cugagaacaagauugccugau

SEQ ID NO: 660739 - RNA, 18 nt, Escherichia coli CFT073
cugacuuuaccugccuga

SEQ ID NO: 660740 - RNA, 17 nt, Escherichia coli CFT073
cugacuuucuuuucccu

SEQ ID NO: 660741 - RNA, 18 nt, Escherichia coli CFT073
cugagaacauaaacaccc

SEQ ID NO: 660742 - RNA, 21 nt, Escherichia coli CFT073
cugagaacuucggcagagaaa

SEQ ID NO: 660743 - RNA, 15 nt, Escherichia coli CFT073
cugagacccggccau

SEQ ID NO: 660744 - RNA, 20 nt, Escherichia coli CFT073
cugacuuuccggggaaaugc

SEQ ID NO: 660745 - RNA, 12 nt, Escherichia coli CFT073
cugacuuccacu

SEQ ID NO: 660746 - RNA, 16 nt, Escherichia coli CFT073
cugacuuccacuuccu

SEQ ID NO: 660747 - RNA, 19 nt, Escherichia coli CFT073
cugacuguuuuuccagcuu

SEQ ID NO: 660748 - RNA, 17 nt, Escherichia coli CFT073
cugacuggcucuuuuuc

SEQ ID NO: 660749 - RNA, 22 nt, Escherichia coli CFT073
cugacugguuaguuucagcgcg

SEQ ID NO: 660750 - RNA, 21 nt, Escherichia coli CFT073
cugacuguuagaagcaucgug

SEQ ID NO: 660751 - RNA, 13 nt, Escherichia coli CFT073
cugacguagcagc

SEQ ID NO: 660752 - RNA, 18 nt, Escherichia coli CFT073
cugacguugcggauuaaa

SEQ ID NO: 660753 - RNA, 16 nt, Escherichia coli CFT073
cugacgcgcagugccu

SEQ ID NO: 660754 - RNA, 21 nt, Escherichia coli CFT073
cugacgcucucaacgcccugu

SEQ ID NO: 660755 - RNA, 14 nt, Escherichia coli CFT073
cugacgcugcucag

SEQ ID NO: 660756 - RNA, 16 nt, Escherichia coli CFT073
cugacgcugcucaggc

SEQ ID NO: 660757 - RNA, 22 nt, Escherichia coli CFT073
cugacggaaaucauccagcacg

SEQ ID NO: 660758 - RNA, 13 nt, Escherichia coli CFT073
cugacggccuucg

SEQ ID NO: 660759 - RNA, 14 nt, Escherichia coli CFT073
cugacgcaucaguc

SEQ ID NO: 660760 - RNA, 13 nt, Escherichia coli CFT073
cugacgcaucuua

SEQ ID NO: 660761 - RNA, 16 nt, Escherichia coli CFT073
cugacgcaucuuaucc

SEQ ID NO: 660762 - RNA, 13 nt, Escherichia coli CFT073
cugacgaucaagc

SEQ ID NO: 660763 - RNA, 21 nt, Escherichia coli CFT073
cugaccguucgccccauacag

SEQ ID NO: 660764 - RNA, 14 nt, Escherichia coli CFT073
cugaccguugcuca

SEQ ID NO: 660765 - RNA, 20 nt, Escherichia coli CFT073
cugaccugaauuaaugccuc

SEQ ID NO: 660766 - RNA, 14 nt, Escherichia coli CFT073
cugaccuuaauaaa

SEQ ID NO: 660767 - RNA, 22 nt, Escherichia coli CFT073
cugaccuuaauaaacucacuua

SEQ ID NO: 660768 - RNA, 22 nt, Escherichia coli CFT073
cugaccugaauuaaugccucuc

SEQ ID NO: 660769 - RNA, 15 nt, Escherichia coli CFT073
cugaccuuuuuucag

SEQ ID NO: 660770 - RNA, 18 nt, Escherichia coli CFT073
cugacagcuccuccggga

SEQ ID NO: 660771 - RNA, 21 nt, Escherichia coli CFT073
cugacauaaacaccagcaaua

SEQ ID NO: 660772 - RNA, 21 nt, Escherichia coli CFT073
cugacagcagagcaugguuaa

SEQ ID NO: 660773 - RNA, 21 nt, Escherichia coli CFT073
cugacagcgcgucuuguacuu

SEQ ID NO: 660774 - RNA, 21 nt, Escherichia coli CFT073
cugacauacggcgguucuuuc

SEQ ID NO: 660775 - RNA, 18 nt, Escherichia coli CFT073
cugacauagacgccaccc

SEQ ID NO: 660776 - RNA, 17 nt, Escherichia coli CFT073
cugacauagccacucac

SEQ ID NO: 660777 - RNA, 17 nt, Escherichia coli CFT073
cugacauuaucagacac

SEQ ID NO: 660778 - RNA, 20 nt, Escherichia coli CFT073
cugacacugccacuuuuucc

SEQ ID NO: 660779 - RNA, 21 nt, Escherichia coli CFT073
cugacacugccacuuuuuccc

SEQ ID NO: 660780 - RNA, 14 nt, Escherichia coli CFT073
cugacacaucuuuu

SEQ ID NO: 660781 - RNA, 16 nt, Escherichia coli CFT073
cugaauuugcuccaga

SEQ ID NO: 660782 - RNA, 20 nt, Escherichia coli CFT073
cugaauugacuacaaaaaaa

SEQ ID NO: 660783 - RNA, 12 nt, Escherichia coli CFT073
cugacaaaauca

SEQ ID NO: 660784 - RNA, 12 nt, Escherichia coli CFT073
cugacaaacugc

SEQ ID NO: 660785 - RNA, 16 nt, Escherichia coli CFT073
cugaccagguuucgga

SEQ ID NO: 660786 - RNA, 14 nt, Escherichia coli CFT073
cugaccacggccau

SEQ ID NO: 660787 - RNA, 13 nt, Escherichia coli CFT073
cugaccagccagc

SEQ ID NO: 660788 - RNA, 17 nt, Escherichia coli CFT073
cugaccaaauacacgca

SEQ ID NO: 660789 - RNA, 17 nt, Escherichia coli CFT073
cugaccaccagcacgcu

SEQ ID NO: 660790 - RNA, 15 nt, Escherichia coli CFT073
cugaccaccagcacg

SEQ ID NO: 660791 - RNA, 13 nt, Escherichia coli CFT073
cugaccacgacuc

SEQ ID NO: 660792 - RNA, 13 nt, Escherichia coli CFT073
cugaccacggcca

SEQ ID NO: 660793 - RNA, 13 nt, Escherichia coli CFT073
cugacccagcacc

SEQ ID NO: 660794 - RNA, 16 nt, Escherichia coli CFT073
cugaccaucagcagcg

SEQ ID NO: 660795 - RNA, 14 nt, Escherichia coli CFT073
cugacccagaagac

SEQ ID NO: 660796 - RNA, 18 nt, Escherichia coli CFT073
cugaccgucaaagcgcca

SEQ ID NO: 660797 - RNA, 19 nt, Escherichia coli CFT073
cugaccgucgcagccagcg

SEQ ID NO: 660798 - RNA, 13 nt, Escherichia coli CFT073
cugaccgucgccu

SEQ ID NO: 660799 - RNA, 20 nt, Escherichia coli CFT073
cugaagguaagcaacagaug

SEQ ID NO: 660800 - RNA, 19 nt, Escherichia coli CFT073
cugaaggugccuuuauugc

SEQ ID NO: 660801 - RNA, 23 nt, Escherichia coli CFT073
cugaaguaaagaaacugguugca

SEQ ID NO: 660802 - RNA, 19 nt, Escherichia coli CFT073
cugaagcuaaaaccugcac

SEQ ID NO: 660803 - RNA, 15 nt, Escherichia coli CFT073
cugaagcgucuuauc

SEQ ID NO: 660804 - RNA, 13 nt, Escherichia coli CFT073
cugaaggcaaacg

SEQ ID NO: 660805 - RNA, 16 nt, Escherichia coli CFT073
cugaauaucaucaccc

SEQ ID NO: 660806 - RNA, 20 nt, Escherichia coli CFT073
cugaauaucaucacccugcg

SEQ ID NO: 660807 - RNA, 23 nt, Escherichia coli CFT073
cugaauaucaucacccugcgauu

SEQ ID NO: 660808 - RNA, 11 nt, Escherichia coli CFT073
cugaauaaucg

SEQ ID NO: 660809 - RNA, 19 nt, Escherichia coli CFT073
cugaagucggcuucuggcc

SEQ ID NO: 660810 - RNA, 17 nt, Escherichia coli CFT073
cugaauacacugcugau

SEQ ID NO: 660811 - RNA, 20 nt, Escherichia coli CFT073
cugaauuaucuauauuuauu

SEQ ID NO: 660812 - RNA, 16 nt, Escherichia coli CFT073
cugaauggugaccugc

SEQ ID NO: 660813 - RNA, 20 nt, Escherichia coli CFT073
cugaauggauucagucuuaa

SEQ ID NO: 660814 - RNA, 17 nt, Escherichia coli CFT073
cugaauuggguucuuuc

SEQ ID NO: 660815 - RNA, 19 nt, Escherichia coli CFT073
cugaauuggguucuuuccu

SEQ ID NO: 660816 - RNA, 21 nt, Escherichia coli CFT073
cugaauuggguucuuuccugc

SEQ ID NO: 660817 - RNA, 15 nt, Escherichia coli CFT073
cugaauugugauggu

SEQ ID NO: 660818 - RNA, 12 nt, Escherichia coli CFT073
cugaauuccccu

SEQ ID NO: 660819 - RNA, 12 nt, Escherichia coli CFT073
cugaauuucaau

SEQ ID NO: 660820 - RNA, 21 nt, Escherichia coli CFT073
cugaauauucggcuccagauu

SEQ ID NO: 660821 - RNA, 17 nt, Escherichia coli CFT073
cugaauccacuggcugu

SEQ ID NO: 660822 - RNA, 11 nt, Escherichia coli CFT073
cugaacagcuu

SEQ ID NO: 660823 - RNA, 14 nt, Escherichia coli CFT073
cugaacagcuuuuu

SEQ ID NO: 660824 - RNA, 17 nt, Escherichia coli CFT073
cugaacagcuuuuuccu

SEQ ID NO: 660825 - RNA, 14 nt, Escherichia coli CFT073
cugaacagucgcug

SEQ ID NO: 660826 - RNA, 22 nt, Escherichia coli CFT073
cugaacauuuucuucugccagg

SEQ ID NO: 660827 - RNA, 14 nt, Escherichia coli CFT073
cugaaccagcgccg

SEQ ID NO: 660828 - RNA, 21 nt, Escherichia coli CFT073
cugaaauuccugagaggauga

SEQ ID NO: 660829 - RNA, 18 nt, Escherichia coli CFT073
cugaaaucaccgccacca

SEQ ID NO: 660830 - RNA, 20 nt, Escherichia coli CFT073
cugaaaucaccgccaccagc

SEQ ID NO: 660831 - RNA, 22 nt, Escherichia coli CFT073
cugaacaacaguuuuaucucca

SEQ ID NO: 660832 - RNA, 16 nt, Escherichia coli CFT073
cugaacaagcaagagu

SEQ ID NO: 660833 - RNA, 14 nt, Escherichia coli CFT073
cugaacgccugcac

SEQ ID NO: 660834 - RNA, 18 nt, Escherichia coli CFT073
cugaacgccugcaccagc

SEQ ID NO: 660835 - RNA, 22 nt, Escherichia coli CFT073
cugaacgugcucugcgccgccu

SEQ ID NO: 660836 - RNA, 20 nt, Escherichia coli CFT073
cugaacuuguuuacaaauaa

SEQ ID NO: 660837 - RNA, 14 nt, Escherichia coli CFT073
cugaacuuucucuc

SEQ ID NO: 660838 - RNA, 21 nt, Escherichia coli CFT073
cugaagaaaauccucaacgcc

SEQ ID NO: 660839 - RNA, 18 nt, Escherichia coli CFT073
cugaagcgaccaccaccc

SEQ ID NO: 660840 - RNA, 19 nt, Escherichia coli CFT073
cucuuuuucggggcugugg

SEQ ID NO: 660841 - RNA, 16 nt, Escherichia coli CFT073
cugaaaaaaagugcau

SEQ ID NO: 660842 - RNA, 13 nt, Escherichia coli CFT073
cugaaaaaugagc

SEQ ID NO: 660843 - RNA, 21 nt, Escherichia coli CFT073
cucuuuugacgcccccagacu

SEQ ID NO: 660844 - RNA, 21 nt, Escherichia coli CFT073
cucuuuguaggccugauaaga

SEQ ID NO: 660845 - RNA, 21 nt, Escherichia coli CFT073
cucuuugaacagccagaagcc

SEQ ID NO: 660846 - RNA, 13 nt, Escherichia coli CFT073
cucuuucuucagc

SEQ ID NO: 660847 - RNA, 20 nt, Escherichia coli CFT073
cugaaagagucgccagcugc

SEQ ID NO: 660848 - RNA, 19 nt, Escherichia coli CFT073
cugaaagcgccgggaaugc

SEQ ID NO: 660849 - RNA, 21 nt, Escherichia coli CFT073
cugaaagugacacugucaccu

SEQ ID NO: 660850 - RNA, 19 nt, Escherichia coli CFT073
cugaaaaggcuaaaauugu

SEQ ID NO: 660851 - RNA, 17 nt, Escherichia coli CFT073
cugaaaauauucccguc

SEQ ID NO: 660852 - RNA, 23 nt, Escherichia coli CFT073
cugaaaauuaacgggcaggucac

SEQ ID NO: 660853 - RNA, 22 nt, Escherichia coli CFT073
cugaaacgcggcguaaccaccc

SEQ ID NO: 660854 - RNA, 13 nt, Escherichia coli CFT073
cugaaaccaccau

SEQ ID NO: 660855 - RNA, 22 nt, Escherichia coli CFT073
cucuucuucacgauaaaucaga

SEQ ID NO: 660856 - RNA, 19 nt, Escherichia coli CFT073
cucuugauacguuauaucu

SEQ ID NO: 660857 - RNA, 15 nt, Escherichia coli CFT073
cucuucuaguucaug

SEQ ID NO: 660858 - RNA, 20 nt, Escherichia coli CFT073
cucuucguggcccgccagca

SEQ ID NO: 660859 - RNA, 17 nt, Escherichia coli CFT073
cucuucguuuucaacgu

SEQ ID NO: 660860 - RNA, 23 nt, Escherichia coli CFT073
cucuucgcguaauguuuccagca

SEQ ID NO: 660861 - RNA, 16 nt, Escherichia coli CFT073
cucuucgcccagggcg

SEQ ID NO: 660862 - RNA, 17 nt, Escherichia coli CFT073
cucuucgguaaugcacu

SEQ ID NO: 660863 - RNA, 21 nt, Escherichia coli CFT073
cucuucgguaaugcacuccgc

SEQ ID NO: 660864 - RNA, 16 nt, Escherichia coli CFT073
cucuuuauuuccugcg

SEQ ID NO: 660865 - RNA, 14 nt, Escherichia coli CFT073
cucuuuccauucuu

SEQ ID NO: 660866 - RNA, 23 nt, Escherichia coli CFT073
cucuuuaccggucaugucggcau

SEQ ID NO: 660867 - RNA, 14 nt, Escherichia coli CFT073
cucuuuauaaagua

SEQ ID NO: 660868 - RNA, 14 nt, Escherichia coli CFT073
cucuugucacuggc

SEQ ID NO: 660869 - RNA, 13 nt, Escherichia coli CFT073
cucuuuaaacaga

SEQ ID NO: 660870 - RNA, 18 nt, Escherichia coli CFT073
cucuuaaugcaggcagca

SEQ ID NO: 660871 - RNA, 19 nt, Escherichia coli CFT073
cucuuauacacaagucccc

SEQ ID NO: 660872 - RNA, 21 nt, Escherichia coli CFT073
cucuucaacacacugaauaaa

SEQ ID NO: 660873 - RNA, 20 nt, Escherichia coli CFT073
cucuguucagugauggcaca

SEQ ID NO: 660874 - RNA, 12 nt, Escherichia coli CFT073
cucuguucugcg

SEQ ID NO: 660875 - RNA, 23 nt, Escherichia coli CFT073
cucuguuaugguacuuucugauu

SEQ ID NO: 660876 - RNA, 18 nt, Escherichia coli CFT073
cucugugcgucugcuuuu

SEQ ID NO: 660877 - RNA, 20 nt, Escherichia coli CFT073
cucuguggaaagagcaaugu

SEQ ID NO: 660878 - RNA, 17 nt, Escherichia coli CFT073
cucuguaaacuccuuuc

SEQ ID NO: 660879 - RNA, 19 nt, Escherichia coli CFT073
cucuguaaacuccuuucug

SEQ ID NO: 660880 - RNA, 20 nt, Escherichia coli CFT073
cucugguguggagugcagca

SEQ ID NO: 660881 - RNA, 21 nt, Escherichia coli CFT073
cucugguguggagugcagcac

SEQ ID NO: 660882 - RNA, 18 nt, Escherichia coli CFT073
cucuucacgcccgcccca

SEQ ID NO: 660883 - RNA, 14 nt, Escherichia coli CFT073
cucuucacauccug

SEQ ID NO: 660884 - RNA, 18 nt, Escherichia coli CFT073
cucuucacauccugccag

SEQ ID NO: 660885 - RNA, 18 nt, Escherichia coli CFT073
cucuucaacuucagcagc

SEQ ID NO: 660886 - RNA, 14 nt, Escherichia coli CFT073
cucuucaagauuaa

SEQ ID NO: 660887 - RNA, 21 nt, Escherichia coli CFT073
cucuucaauggcaucacgcaa

SEQ ID NO: 660888 - RNA, 19 nt, Escherichia coli CFT073
cucuucauacaucugcaaa

SEQ ID NO: 660889 - RNA, 22 nt, Escherichia coli CFT073
cucuucagccaacgcauuagca

SEQ ID NO: 660890 - RNA, 17 nt, Escherichia coli CFT073
cucuuccggcucccgca

SEQ ID NO: 660891 - RNA, 17 nt, Escherichia coli CFT073
cucuuccagguaagcaa

SEQ ID NO: 660892 - RNA, 15 nt, Escherichia coli CFT073
cucuucccacggauu

SEQ ID NO: 660893 - RNA, 22 nt, Escherichia coli CFT073
cucuucgauggucauauccagc

SEQ ID NO: 660894 - RNA, 14 nt, Escherichia coli CFT073
cucuuccuuaagca

SEQ ID NO: 660895 - RNA, 22 nt, Escherichia coli CFT073
cucuuccuuaagcacaauccgc

SEQ ID NO: 660896 - RNA, 16 nt, Escherichia coli CFT073
cucugggaucgccggg

SEQ ID NO: 660897 - RNA, 12 nt, Escherichia coli CFT073
cucuggagaaau

SEQ ID NO: 660898 - RNA, 16 nt, Escherichia coli CFT073
cucuggagaaauauaa

SEQ ID NO: 660899 - RNA, 23 nt, Escherichia coli CFT073
cucugcuguaguuguucaacagu

SEQ ID NO: 660900 - RNA, 20 nt, Escherichia coli CFT073
cucugcuggcggaacaucgc

SEQ ID NO: 660901 - RNA, 19 nt, Escherichia coli CFT073
cucuggcagcaccacgcag

SEQ ID NO: 660902 - RNA, 13 nt, Escherichia coli CFT073
cucuggcaggcuu

SEQ ID NO: 660903 - RNA, 21 nt, Escherichia coli CFT073
cucugccguaccaucgccagc

SEQ ID NO: 660904 - RNA, 23 nt, Escherichia coli CFT073
cucugcgccuuugaugccaccag

SEQ ID NO: 660905 - RNA, 13 nt, Escherichia coli CFT073
cucugcggaggcc

SEQ ID NO: 660906 - RNA, 12 nt, Escherichia coli CFT073
cucugcggcaag

SEQ ID NO: 660907 - RNA, 12 nt, Escherichia coli CFT073
cucugcugccac

SEQ ID NO: 660908 - RNA, 15 nt, Escherichia coli CFT073
cucugacauaaaaaa

SEQ ID NO: 660909 - RNA, 20 nt, Escherichia coli CFT073
cucugacgcgcauacucucc

SEQ ID NO: 660910 - RNA, 21 nt, Escherichia coli CFT073
cucugacugaugacaaagucu

SEQ ID NO: 660911 - RNA, 14 nt, Escherichia coli CFT073
cucucuuucuccag

SEQ ID NO: 660912 - RNA, 21 nt, Escherichia coli CFT073
cucugcaacucggcuauacga

SEQ ID NO: 660913 - RNA, 23 nt, Escherichia coli CFT073
cucugcaagagauaaagcuguca

SEQ ID NO: 660914 - RNA, 18 nt, Escherichia coli CFT073
cucugcaucccggcagga

SEQ ID NO: 660915 - RNA, 18 nt, Escherichia coli CFT073
cucugccagcugcucaua

SEQ ID NO: 660916 - RNA, 12 nt, Escherichia coli CFT073
cucugccaggca

SEQ ID NO: 660917 - RNA, 23 nt, Escherichia coli CFT073
cucugccagcgacagugaugacg

SEQ ID NO: 660918 - RNA, 18 nt, Escherichia coli CFT073
cucugaugacgcgucugg

SEQ ID NO: 660919 - RNA, 16 nt, Escherichia coli CFT073
cucugcaccagaacuc

SEQ ID NO: 660920 - RNA, 24 nt, Escherichia coli CFT073
cucugcaccagaacucccuguucc

SEQ ID NO: 660921 - RNA, 18 nt, Escherichia coli CFT073
cucugcaccgccuccagc

SEQ ID NO: 660922 - RNA, 17 nt, Escherichia coli CFT073
cucugcaagucuugcug

SEQ ID NO: 660923 - RNA, 22 nt, Escherichia coli CFT073
cucugcaagucuugcugcgcuu

SEQ ID NO: 660924 - RNA, 17 nt, Escherichia coli CFT073
cucugcaacgucuuccc

SEQ ID NO: 660925 - RNA, 18 nt, Escherichia coli CFT073
cucugcaacgucuucccg

SEQ ID NO: 660926 - RNA, 14 nt, Escherichia coli CFT073
cucucuggcggcca

SEQ ID NO: 660927 - RNA, 18 nt, Escherichia coli CFT073
cucucuucaaacgcuucu

SEQ ID NO: 660928 - RNA, 11 nt, Escherichia coli CFT073
cucucuucauc

SEQ ID NO: 660929 - RNA, 12 nt, Escherichia coli CFT073
cucucuucaucg

SEQ ID NO: 660930 - RNA, 22 nt, Escherichia coli CFT073
cucucgaaaaaccugacgcugc

SEQ ID NO: 660931 - RNA, 19 nt, Escherichia coli CFT073
cucucgccgcgcuccauca

SEQ ID NO: 660932 - RNA, 18 nt, Escherichia coli CFT073
cucucgcgucgugguauc

SEQ ID NO: 660933 - RNA, 17 nt, Escherichia coli CFT073
cucucgggcaguaaauc

SEQ ID NO: 660934 - RNA, 21 nt, Escherichia coli CFT073
cucucgggcaguaaaucaaua

SEQ ID NO: 660935 - RNA, 17 nt, Escherichia coli CFT073
cucuccggcagaccauc

SEQ ID NO: 660936 - RNA, 15 nt, Escherichia coli CFT073
cucucagagaaucau

SEQ ID NO: 660937 - RNA, 14 nt, Escherichia coli CFT073
cucgggcggcaggu

SEQ ID NO: 660938 - RNA, 20 nt, Escherichia coli CFT073
cucgguaaaaucaacgccgc

SEQ ID NO: 660939 - RNA, 21 nt, Escherichia coli CFT073
cucgguaacgucauugcaauc

SEQ ID NO: 660940 - RNA, 19 nt, Escherichia coli CFT073
cucggucacugacaccagc

SEQ ID NO: 660941 - RNA, 20 nt, Escherichia coli CFT073
cucgcgaaccgccuggcgcu

SEQ ID NO: 660942 - RNA, 15 nt, Escherichia coli CFT073
cucgccuuuucgccc

SEQ ID NO: 660943 - RNA, 17 nt, Escherichia coli CFT073
cucgcgaaaagaaacug

SEQ ID NO: 660944 - RNA, 15 nt, Escherichia coli CFT073
cucgccuuucacacg

SEQ ID NO: 660945 - RNA, 20 nt, Escherichia coli CFT073
cucggcacccguaggccgga

SEQ ID NO: 660946 - RNA, 16 nt, Escherichia coli CFT073
cucggcgagcaacgca

SEQ ID NO: 660947 - RNA, 20 nt, Escherichia coli CFT073
cucggcgagcaacgcagcgg

SEQ ID NO: 660948 - RNA, 17 nt, Escherichia coli CFT073
cucggccaccguccaga

SEQ ID NO: 660949 - RNA, 21 nt, Escherichia coli CFT073
cucguagguuucugccagcgu

SEQ ID NO: 660950 - RNA, 16 nt, Escherichia coli CFT073
cucgucacuuuucuua

SEQ ID NO: 660951 - RNA, 21 nt, Escherichia coli CFT073
cucgucgcgacgaccacccac

SEQ ID NO: 660952 - RNA, 12 nt, Escherichia coli CFT073
cucgucgcgcac

SEQ ID NO: 660953 - RNA, 18 nt, Escherichia coli CFT073
cucguugauguucggcaa

SEQ ID NO: 660954 - RNA, 23 nt, Escherichia coli CFT073
cucguucacauauugcagcuucu

SEQ ID NO: 660955 - RNA, 17 nt, Escherichia coli CFT073
cucguuaacuucauccc

SEQ ID NO: 660956 - RNA, 18 nt, Escherichia coli CFT073
cucguuaccagcgccgcc

SEQ ID NO: 660957 - RNA, 15 nt, Escherichia coli CFT073
cucuaagucuuucug

SEQ ID NO: 660958 - RNA, 16 nt, Escherichia coli CFT073
cucgaauugucaccgu

SEQ ID NO: 660959 - RNA, 21 nt, Escherichia coli CFT073
cucgaccuuacgcagucgcug

SEQ ID NO: 660960 - RNA, 14 nt, Escherichia coli CFT073
cucgaaaucacugg

SEQ ID NO: 660961 - RNA, 15 nt, Escherichia coli CFT073
cucgaacauccccac

SEQ ID NO: 660962 - RNA, 23 nt, Escherichia coli CFT073
cucgagccgcauccgacacuggc

SEQ ID NO: 660963 - RNA, 18 nt, Escherichia coli CFT073
cucgaggaaaugcaauua

SEQ ID NO: 660964 - RNA, 20 nt, Escherichia coli CFT073
cucgcagaaauaccccgcca

SEQ ID NO: 660965 - RNA, 19 nt, Escherichia coli CFT073
cucgcagcccguggcgcga

SEQ ID NO: 660966 - RNA, 23 nt, Escherichia coli CFT073
cucgcagcccguggcgcgaaagu

SEQ ID NO: 660967 - RNA, 18 nt, Escherichia coli CFT073
cucgcagguuauaccuuu

SEQ ID NO: 660968 - RNA, 17 nt, Escherichia coli CFT073
cucgcccgucuuccaga

SEQ ID NO: 660969 - RNA, 20 nt, Escherichia coli CFT073
cucgccgcgcuccaucaugu

SEQ ID NO: 660970 - RNA, 14 nt, Escherichia coli CFT073
cucgccgcgcucca

SEQ ID NO: 660971 - RNA, 22 nt, Escherichia coli CFT073
cucgccgcaaaacccaggcuua

SEQ ID NO: 660972 - RNA, 14 nt, Escherichia coli CFT073
cucgccgcagagau

SEQ ID NO: 660973 - RNA, 15 nt, Escherichia coli CFT073
cucgccgcagagauc

SEQ ID NO: 660974 - RNA, 20 nt, Escherichia coli CFT073
cuccacaagaaugccugcca

SEQ ID NO: 660975 - RNA, 23 nt, Escherichia coli CFT073
cuccccuuucuuauuuuucugca

SEQ ID NO: 660976 - RNA, 20 nt, Escherichia coli CFT073
cucccggauaccccagcugg

SEQ ID NO: 660977 - RNA, 16 nt, Escherichia coli CFT073
cucccggcaaugcgcc

SEQ ID NO: 660978 - RNA, 17 nt, Escherichia coli CFT073
cuccccgccguugcucu

SEQ ID NO: 660979 - RNA, 20 nt, Escherichia coli CFT073
cuccccgguagccauuuuuu

SEQ ID NO: 660980 - RNA, 15 nt, Escherichia coli CFT073
cucccgucgcccaca

SEQ ID NO: 660981 - RNA, 17 nt, Escherichia coli CFT073
cuccuccagcgcuucca

SEQ ID NO: 660982 - RNA, 18 nt, Escherichia coli CFT073
cuccugcggcuucaacug

SEQ ID NO: 660983 - RNA, 23 nt, Escherichia coli CFT073
cuccugcgggagcgcuuuuuccu

SEQ ID NO: 660984 - RNA, 14 nt, Escherichia coli CFT073
cuccucuuuuucca

SEQ ID NO: 660985 - RNA, 14 nt, Escherichia coli CFT073
cuccugaaacaauu

SEQ ID NO: 660986 - RNA, 20 nt, Escherichia coli CFT073
cuccugcgccucuccacacg

SEQ ID NO: 660987 - RNA, 14 nt, Escherichia coli CFT073
cuccgcucuucauc

SEQ ID NO: 660988 - RNA, 16 nt, Escherichia coli CFT073
cuccgcucuucaucuu

SEQ ID NO: 660989 - RNA, 20 nt, Escherichia coli CFT073
cuccgcuaaauccgccgcca

SEQ ID NO: 660990 - RNA, 21 nt, Escherichia coli CFT073
cuccgcuaaauccgccgccac

SEQ ID NO: 660991 - RNA, 23 nt, Escherichia coli CFT073
cuccggaaaauuggggccguccc

SEQ ID NO: 660992 - RNA, 21 nt, Escherichia coli CFT073
cuccgugggcuaacacugcca

SEQ ID NO: 660993 - RNA, 14 nt, Escherichia coli CFT073
cuccgucuggccag

SEQ ID NO: 660994 - RNA, 17 nt, Escherichia coli CFT073
cuccucaacaaucguca

SEQ ID NO: 660995 - RNA, 13 nt, Escherichia coli CFT073
cuccgucauccug

SEQ ID NO: 660996 - RNA, 17 nt, Escherichia coli CFT073
cuccgguuucccggcaa

SEQ ID NO: 660997 - RNA, 18 nt, Escherichia coli CFT073
cucaggcgaggcagacug

SEQ ID NO: 660998 - RNA, 23 nt, Escherichia coli CFT073
cucaggcgguggaacaagucagc

SEQ ID NO: 660999 - RNA, 12 nt, Escherichia coli CFT073
cucacucugcac

SEQ ID NO: 661000 - RNA, 15 nt, Escherichia coli CFT073
cucagcgccugcugc

SEQ ID NO: 661001 - RNA, 16 nt, Escherichia coli CFT073
cucagcgccugcugca

SEQ ID NO: 661002 - RNA, 19 nt, Escherichia coli CFT073
cucauaccuuccacuuuca

SEQ ID NO: 661003 - RNA, 14 nt, Escherichia coli CFT073
cucauagaccauug

SEQ ID NO: 661004 - RNA, 16 nt, Escherichia coli CFT073
cucagugucagguacu

SEQ ID NO: 661005 - RNA, 19 nt, Escherichia coli CFT073
cucagucggcgcuuuugca

SEQ ID NO: 661006 - RNA, 18 nt, Escherichia coli CFT073
cucaguugguagagcacg

SEQ ID NO: 661007 - RNA, 23 nt, Escherichia coli CFT073
cucaguugguagagcacgaccuu

SEQ ID NO: 661008 - RNA, 19 nt, Escherichia coli CFT073
cucaguugguuagagcaca

SEQ ID NO: 661009 - RNA, 16 nt, Escherichia coli CFT073
cucauaacguaaacca

SEQ ID NO: 661010 - RNA, 17 nt, Escherichia coli CFT073
cucauuguuaucagcaa

SEQ ID NO: 661011 - RNA, 14 nt, Escherichia coli CFT073
cucauuccgccgcc

SEQ ID NO: 661012 - RNA, 18 nt, Escherichia coli CFT073
cuccaaccagauaucccg

SEQ ID NO: 661013 - RNA, 14 nt, Escherichia coli CFT073
cuccaaccagcugu

SEQ ID NO: 661014 - RNA, 15 nt, Escherichia coli CFT073
cucauuaguuaauuc

SEQ ID NO: 661015 - RNA, 18 nt, Escherichia coli CFT073
cucauccaucucgguuuu

SEQ ID NO: 661016 - RNA, 13 nt, Escherichia coli CFT073
cucaucagcuuac

SEQ ID NO: 661017 - RNA, 20 nt, Escherichia coli CFT073
cucauaucuucuccugucau

SEQ ID NO: 661018 - RNA, 14 nt, Escherichia coli CFT073
cucauaugcagcau

SEQ ID NO: 661019 - RNA, 19 nt, Escherichia coli CFT073
cucauauuccugcauugcu

SEQ ID NO: 661020 - RNA, 16 nt, Escherichia coli CFT073
cucaucagguauugcu

SEQ ID NO: 661021 - RNA, 12 nt, Escherichia coli CFT073
cucauccaucaa

SEQ ID NO: 661022 - RNA, 19 nt, Escherichia coli CFT073
cucacaaucaucgcaucca

SEQ ID NO: 661023 - RNA, 15 nt, Escherichia coli CFT073
cucacacagcuuucu

SEQ ID NO: 661024 - RNA, 17 nt, Escherichia coli CFT073
cucacaccacaacagcc

SEQ ID NO: 661025 - RNA, 22 nt, Escherichia coli CFT073
cucacagaggucuuuucucguu

SEQ ID NO: 661026 - RNA, 19 nt, Escherichia coli CFT073
cucacagaguauuuccagc

SEQ ID NO: 661027 - RNA, 15 nt, Escherichia coli CFT073
cucacagcuaaucau

SEQ ID NO: 661028 - RNA, 13 nt, Escherichia coli CFT073
cucaaucaaaaga

SEQ ID NO: 661029 - RNA, 21 nt, Escherichia coli CFT073
cucaauaaucauucgcccgcc

SEQ ID NO: 661030 - RNA, 23 nt, Escherichia coli CFT073
cucaauaaucauucgcccgccga

SEQ ID NO: 661031 - RNA, 19 nt, Escherichia coli CFT073
cucaauaauuucuucauug

SEQ ID NO: 661032 - RNA, 15 nt, Escherichia coli CFT073
cucaauacccagcgu

SEQ ID NO: 661033 - RNA, 14 nt, Escherichia coli CFT073
cucaaguugcgaaa

SEQ ID NO: 661034 - RNA, 15 nt, Escherichia coli CFT073
cucacccgccagcgc

SEQ ID NO: 661035 - RNA, 16 nt, Escherichia coli CFT073
cucacccgccagcgcg

SEQ ID NO: 661036 - RNA, 17 nt, Escherichia coli CFT073
cucacgaagcguuguca

SEQ ID NO: 661037 - RNA, 20 nt, Escherichia coli CFT073
cucaccgauagucguugcca

SEQ ID NO: 661038 - RNA, 16 nt, Escherichia coli CFT073
cucacgaauagcuuua

SEQ ID NO: 661039 - RNA, 13 nt, Escherichia coli CFT073
cucacgcacuucc

SEQ ID NO: 661040 - RNA, 14 nt, Escherichia coli CFT073
cucacgcacuuccg

SEQ ID NO: 661041 - RNA, 13 nt, Escherichia coli CFT073
cucacgcagcuuc

SEQ ID NO: 661042 - RNA, 19 nt, Escherichia coli CFT073
cucacuaccagugccagaa

SEQ ID NO: 661043 - RNA, 20 nt, Escherichia coli CFT073
cuauugcaggggcuuauaua

SEQ ID NO: 661044 - RNA, 22 nt, Escherichia coli CFT073
cuauugcaggggcuuauauagg

SEQ ID NO: 661045 - RNA, 18 nt, Escherichia coli CFT073
cuauugcuuuagacagcu

SEQ ID NO: 661046 - RNA, 16 nt, Escherichia coli CFT073
cuauugcugccacucu

SEQ ID NO: 661047 - RNA, 20 nt, Escherichia coli CFT073
cuauugccguaaucgccucc

SEQ ID NO: 661048 - RNA, 12 nt, Escherichia coli CFT073
cuauugguucac

SEQ ID NO: 661049 - RNA, 12 nt, Escherichia coli CFT073
cucaaaaagaaa

SEQ ID NO: 661050 - RNA, 13 nt, Escherichia coli CFT073
cucaaaagguuca

SEQ ID NO: 661051 - RNA, 14 nt, Escherichia coli CFT073
cucaaaauacugcc

SEQ ID NO: 661052 - RNA, 21 nt, Escherichia coli CFT073
cucaaaacgcgugacaccauc

SEQ ID NO: 661053 - RNA, 20 nt, Escherichia coli CFT073
cucaacggugaccucagguu

SEQ ID NO: 661054 - RNA, 14 nt, Escherichia coli CFT073
cucaacuccccgca

SEQ ID NO: 661055 - RNA, 21 nt, Escherichia coli CFT073
cucaacugacugacgugauga

SEQ ID NO: 661056 - RNA, 14 nt, Escherichia coli CFT073
cucaacuuccugaa

SEQ ID NO: 661057 - RNA, 20 nt, Escherichia coli CFT073
cucaacuugcucaagccaga

SEQ ID NO: 661058 - RNA, 18 nt, Escherichia coli CFT073
cucaagccacuuccuuua

SEQ ID NO: 661059 - RNA, 17 nt, Escherichia coli CFT073
cucaagcacccaaugcc

SEQ ID NO: 661060 - RNA, 18 nt, Escherichia coli CFT073
cucaagcacccaaugcca

SEQ ID NO: 661061 - RNA, 15 nt, Escherichia coli CFT073
cucaagaaugaccgc

SEQ ID NO: 661062 - RNA, 12 nt, Escherichia coli CFT073
cucaacaaacgc

SEQ ID NO: 661063 - RNA, 18 nt, Escherichia coli CFT073
cucaacaaccaggccagc

SEQ ID NO: 661064 - RNA, 22 nt, Escherichia coli CFT073
cucaacgcccuguaaaaaagaa

SEQ ID NO: 661065 - RNA, 16 nt, Escherichia coli CFT073
cucaacagguugcgga

SEQ ID NO: 661066 - RNA, 17 nt, Escherichia coli CFT073
cuauuauuauuuuugug

SEQ ID NO: 661067 - RNA, 14 nt, Escherichia coli CFT073
cuauucauugcuau

SEQ ID NO: 661068 - RNA, 20 nt, Escherichia coli CFT073
cuauucauugcuauuucccc

SEQ ID NO: 661069 - RNA, 12 nt, Escherichia coli CFT073
cuauucagcagu

SEQ ID NO: 661070 - RNA, 20 nt, Escherichia coli CFT073
cuaucgcugauauacccuuc

SEQ ID NO: 661071 - RNA, 21 nt, Escherichia coli CFT073
cuaucggcagaguugagcagu

SEQ ID NO: 661072 - RNA, 20 nt, Escherichia coli CFT073
cuaugcgccaguuuuccacu

SEQ ID NO: 661073 - RNA, 14 nt, Escherichia coli CFT073
cuaugcgcaucaag

SEQ ID NO: 661074 - RNA, 17 nt, Escherichia coli CFT073
cuaugauuuuccugagg

SEQ ID NO: 661075 - RNA, 13 nt, Escherichia coli CFT073
cuaugcauacaca

SEQ ID NO: 661076 - RNA, 16 nt, Escherichia coli CFT073
cuaugcauacacagau

SEQ ID NO: 661077 - RNA, 15 nt, Escherichia coli CFT073
cuagugcuacccacu

SEQ ID NO: 661078 - RNA, 14 nt, Escherichia coli CFT073
cuauagccgcaacu

SEQ ID NO: 661079 - RNA, 16 nt, Escherichia coli CFT073
cuauccgaugcaaaaa

SEQ ID NO: 661080 - RNA, 14 nt, Escherichia coli CFT073
cuaucaauacuuuc

SEQ ID NO: 661081 - RNA, 15 nt, Escherichia coli CFT073
cuagcaacaaaaaaa

SEQ ID NO: 661082 - RNA, 20 nt, Escherichia coli CFT073
cuacuucuuucaccaucgca

SEQ ID NO: 661083 - RNA, 13 nt, Escherichia coli CFT073
cuacuuuuucuua

SEQ ID NO: 661084 - RNA, 15 nt, Escherichia coli CFT073
cuacucgccugccac

SEQ ID NO: 661085 - RNA, 14 nt, Escherichia coli CFT073
cuacugcuugccac

SEQ ID NO: 661086 - RNA, 14 nt, Escherichia coli CFT073
cuacugccagauuc

SEQ ID NO: 661087 - RNA, 17 nt, Escherichia coli CFT073
cuacugccugcggcuug

SEQ ID NO: 661088 - RNA, 16 nt, Escherichia coli CFT073
cuacccaugaagaaaa

SEQ ID NO: 661089 - RNA, 12 nt, Escherichia coli CFT073
cuacccgccagu

SEQ ID NO: 661090 - RNA, 16 nt, Escherichia coli CFT073
cuacccgcgccaauaa

SEQ ID NO: 661091 - RNA, 13 nt, Escherichia coli CFT073
cuacccuggcgag

SEQ ID NO: 661092 - RNA, 19 nt, Escherichia coli CFT073
cuaccgauccggcaccaau

SEQ ID NO: 661093 - RNA, 22 nt, Escherichia coli CFT073
cuaccgccaguaagguaacgcu

SEQ ID NO: 661094 - RNA, 20 nt, Escherichia coli CFT073
cuaauguagcgaccauaaca

SEQ ID NO: 661095 - RNA, 14 nt, Escherichia coli CFT073
cuaauuaagacuga

SEQ ID NO: 661096 - RNA, 16 nt, Escherichia coli CFT073
cuaauuaauaauauaa

SEQ ID NO: 661097 - RNA, 17 nt, Escherichia coli CFT073
cuaauuaauaauauaaa

SEQ ID NO: 661098 - RNA, 21 nt, Escherichia coli CFT073
cuaauuauuaccgucagaaau

SEQ ID NO: 661099 - RNA, 16 nt, Escherichia coli CFT073
cuaauuauuacucaac

SEQ ID NO: 661100 - RNA, 11 nt, Escherichia coli CFT073
cuaaucugaac

SEQ ID NO: 661101 - RNA, 23 nt, Escherichia coli CFT073
cuaaucuggcggaucugaucagc

SEQ ID NO: 661102 - RNA, 15 nt, Escherichia coli CFT073
cuaauaucgcgacug

SEQ ID NO: 661103 - RNA, 21 nt, Escherichia coli CFT073
cuaauaucaacgcuauuugcu

SEQ ID NO: 661104 - RNA, 22 nt, Escherichia coli CFT073
cuaauauucuuuuuuuucacau

SEQ ID NO: 661105 - RNA, 20 nt, Escherichia coli CFT073
cuaaucagcuuuuccauauc

SEQ ID NO: 661106 - RNA, 12 nt, Escherichia coli CFT073
cuaauaaacauu

SEQ ID NO: 661107 - RNA, 17 nt, Escherichia coli CFT073
cuaaggucaccaguuca

SEQ ID NO: 661108 - RNA, 17 nt, Escherichia coli CFT073
cuaagguaaaacaagug

SEQ ID NO: 661109 - RNA, 22 nt, Escherichia coli CFT073
cuaacucauugauuuucaaauc

SEQ ID NO: 661110 - RNA, 17 nt, Escherichia coli CFT073
cuaacuccugauuccag

SEQ ID NO: 661111 - RNA, 22 nt, Escherichia coli CFT073
cuaacuccugcgucggaacauc

SEQ ID NO: 661112 - RNA, 18 nt, Escherichia coli CFT073
cuaacugaucacguuuuc

SEQ ID NO: 661113 - RNA, 20 nt, Escherichia coli CFT073
cuaacguuuuacgcgucaca

SEQ ID NO: 661114 - RNA, 14 nt, Escherichia coli CFT073
cuaauuugaaauga

SEQ ID NO: 661115 - RNA, 15 nt, Escherichia coli CFT073
cuaauuuuuugcgcc

SEQ ID NO: 661116 - RNA, 22 nt, Escherichia coli CFT073
cuacaaguccguugaaauugcu

SEQ ID NO: 661117 - RNA, 14 nt, Escherichia coli CFT073
cuacaagcagagag

SEQ ID NO: 661118 - RNA, 17 nt, Escherichia coli CFT073
cuacaagcagagagacg

SEQ ID NO: 661119 - RNA, 22 nt, Escherichia coli CFT073
cuacaaucccguugaaaaugcu

SEQ ID NO: 661120 - RNA, 23 nt, Escherichia coli CFT073
cuacaacaaccuuuguauuuuuc

SEQ ID NO: 661121 - RNA, 13 nt, Escherichia coli CFT073
cuacaagcagaga

SEQ ID NO: 661122 - RNA, 20 nt, Escherichia coli CFT073
cuacaauugguaaauaagcg

SEQ ID NO: 661123 - RNA, 21 nt, Escherichia coli CFT073
cuacacauuaucucaacacac

SEQ ID NO: 661124 - RNA, 16 nt, Escherichia coli CFT073
cuacacgcccgcgaag

SEQ ID NO: 661125 - RNA, 16 nt, Escherichia coli CFT073
cuacagugccccaaau

SEQ ID NO: 661126 - RNA, 22 nt, Escherichia coli CFT073
cuacagugccccaaaugucgga

SEQ ID NO: 661127 - RNA, 14 nt, Escherichia coli CFT073
cuacagaacgcugc

SEQ ID NO: 661128 - RNA, 15 nt, Escherichia coli CFT073
cuacagcggaacuuu

SEQ ID NO: 661129 - RNA, 18 nt, Escherichia coli CFT073
cuacagcggaacuuuuuu

SEQ ID NO: 661130 - RNA, 13 nt, Escherichia coli CFT073
cuacagcaacagg

SEQ ID NO: 661131 - RNA, 15 nt, Escherichia coli CFT073
cuacaugccaucaca

SEQ ID NO: 661132 - RNA, 17 nt, Escherichia coli CFT073
cuacaugccaucacacc

SEQ ID NO: 661133 - RNA, 20 nt, Escherichia coli CFT073
cuaccaacgcacccgcgccg

SEQ ID NO: 661134 - RNA, 19 nt, Escherichia coli CFT073
cuaccaaucagauugauca

SEQ ID NO: 661135 - RNA, 13 nt, Escherichia coli CFT073
cuaccacuuccca

SEQ ID NO: 661136 - RNA, 17 nt, Escherichia coli CFT073
cuaccacgccgauaauc

SEQ ID NO: 661137 - RNA, 22 nt, Escherichia coli CFT073
cuaccagcugaaaucaccgcca

SEQ ID NO: 661138 - RNA, 11 nt, Escherichia coli CFT073
cuaccagcacc

SEQ ID NO: 661139 - RNA, 17 nt, Escherichia coli CFT073
cuaccaguagugaaaaa

SEQ ID NO: 661140 - RNA, 23 nt, Escherichia coli CFT073
cuaccaucagguaauaggcaggc

SEQ ID NO: 661141 - RNA, 19 nt, Escherichia coli CFT073
cuaccauuuguucuuuuuu

SEQ ID NO: 661142 - RNA, 20 nt, Escherichia coli CFT073
cguuuaugucgcauccugca

SEQ ID NO: 661143 - RNA, 15 nt, Escherichia coli CFT073
cguuuaucaauaucc

SEQ ID NO: 661144 - RNA, 16 nt, Escherichia coli CFT073
cguuuaucaauaucca

SEQ ID NO: 661145 - RNA, 20 nt, Escherichia coli CFT073
cguuucacauucuccgccga

SEQ ID NO: 661146 - RNA, 12 nt, Escherichia coli CFT073
cguugucuguaa

SEQ ID NO: 661147 - RNA, 19 nt, Escherichia coli CFT073
cguugucuguaauguccau

SEQ ID NO: 661148 - RNA, 21 nt, Escherichia coli CFT073
cguugugauuucugacuuccc

SEQ ID NO: 661149 - RNA, 23 nt, Escherichia coli CFT073
cguugugcaucaggcaaacuuca

SEQ ID NO: 661150 - RNA, 20 nt, Escherichia coli CFT073
cguugugcgccaguucaucc

SEQ ID NO: 661151 - RNA, 16 nt, Escherichia coli CFT073
cguuguuaaggguaaa

SEQ ID NO: 661152 - RNA, 12 nt, Escherichia coli CFT073
cguugcucagaa

SEQ ID NO: 661153 - RNA, 23 nt, Escherichia coli CFT073
cguuucuuccacaccacuucauu

SEQ ID NO: 661154 - RNA, 22 nt, Escherichia coli CFT073
cguuucuucgacacguuccuca

SEQ ID NO: 661155 - RNA, 15 nt, Escherichia coli CFT073
cguuucuggcaauuc

SEQ ID NO: 661156 - RNA, 13 nt, Escherichia coli CFT073
cguuucugccggu

SEQ ID NO: 661157 - RNA, 14 nt, Escherichia coli CFT073
cguuucuccacugg

SEQ ID NO: 661158 - RNA, 16 nt, Escherichia coli CFT073
cguuucuccacuggca

SEQ ID NO: 661159 - RNA, 17 nt, Escherichia coli CFT073
cguuuucugaccaaacu

SEQ ID NO: 661160 - RNA, 12 nt, Escherichia coli CFT073
cguuuucugcca

SEQ ID NO: 661161 - RNA, 17 nt, Escherichia coli CFT073
cguuuugcccgguguca

SEQ ID NO: 661162 - RNA, 15 nt, Escherichia coli CFT073
cguuuugucgccggg

SEQ ID NO: 661163 - RNA, 17 nt, Escherichia coli CFT073
cguuuuuaucgcugcgc

SEQ ID NO: 661164 - RNA, 23 nt, Escherichia coli CFT073
cguuuuuauuauuaaaccaggaa

SEQ ID NO: 661165 - RNA, 19 nt, Escherichia coli CFT073
cuaaacgcgccgcuuuuuc

SEQ ID NO: 661166 - RNA, 15 nt, Escherichia coli CFT073
cuaaacagagcugca

SEQ ID NO: 661167 - RNA, 16 nt, Escherichia coli CFT073
cuaaacagagcugcaa

SEQ ID NO: 661168 - RNA, 20 nt, Escherichia coli CFT073
cuaaaauuucuuuuuuucau

SEQ ID NO: 661169 - RNA, 18 nt, Escherichia coli CFT073
cguuuuucauccagcggc

SEQ ID NO: 661170 - RNA, 20 nt, Escherichia coli CFT073
cuaaaaguuauuaaaaaugg

SEQ ID NO: 661171 - RNA, 19 nt, Escherichia coli CFT073
cuaaaaucgccaaacuuaa

SEQ ID NO: 661172 - RNA, 18 nt, Escherichia coli CFT073
cuaaaguacguaaaacaa

SEQ ID NO: 661173 - RNA, 16 nt, Escherichia coli CFT073
cuaaaggcaaaaugcc

SEQ ID NO: 661174 - RNA, 17 nt, Escherichia coli CFT073
cuaaacugaucuuuauc

SEQ ID NO: 661175 - RNA, 19 nt, Escherichia coli CFT073
cuaaacugaucuuuaucaa

SEQ ID NO: 661176 - RNA, 21 nt, Escherichia coli CFT073
cguuccggcggcacagccagc

SEQ ID NO: 661177 - RNA, 22 nt, Escherichia coli CFT073
cguuccuugcugcgcggugaca

SEQ ID NO: 661178 - RNA, 14 nt, Escherichia coli CFT073
cguucgggaaaaua

SEQ ID NO: 661179 - RNA, 19 nt, Escherichia coli CFT073
cguucgacugcgccuucca

SEQ ID NO: 661180 - RNA, 22 nt, Escherichia coli CFT073
cguucgauagcgcgccagccga

SEQ ID NO: 661181 - RNA, 13 nt, Escherichia coli CFT073
cguucaguuuacc

SEQ ID NO: 661182 - RNA, 22 nt, Escherichia coli CFT073
cguucccuuguugugccagacc

SEQ ID NO: 661183 - RNA, 16 nt, Escherichia coli CFT073
cguucauggcgugaca

SEQ ID NO: 661184 - RNA, 23 nt, Escherichia coli CFT073
cguucauuaacgccccaaucaga

SEQ ID NO: 661185 - RNA, 21 nt, Escherichia coli CFT073
cgucauuuucauugcuuucuu

SEQ ID NO: 661186 - RNA, 21 nt, Escherichia coli CFT073
cgucaugguauagagauagca

SEQ ID NO: 661187 - RNA, 20 nt, Escherichia coli CFT073
cguccaccagaacgacgacc

SEQ ID NO: 661188 - RNA, 15 nt, Escherichia coli CFT073
cguccaccagagcuu

SEQ ID NO: 661189 - RNA, 14 nt, Escherichia coli CFT073
cguuauagguauuc

SEQ ID NO: 661190 - RNA, 21 nt, Escherichia coli CFT073
cguuauccggccaacaaaaaa

SEQ ID NO: 661191 - RNA, 18 nt, Escherichia coli CFT073
cguugaucuucucuuaua

SEQ ID NO: 661192 - RNA, 16 nt, Escherichia coli CFT073
cguugagggauaggug

SEQ ID NO: 661193 - RNA, 13 nt, Escherichia coli CFT073
cguugaucgcuuu

SEQ ID NO: 661194 - RNA, 21 nt, Escherichia coli CFT073
cguugaggaacucaaaccauu

SEQ ID NO: 661195 - RNA, 14 nt, Escherichia coli CFT073
cguugagagauaau

SEQ ID NO: 661196 - RNA, 21 nt, Escherichia coli CFT073
cguugaaucuuuagcggcgga

SEQ ID NO: 661197 - RNA, 18 nt, Escherichia coli CFT073
cguugaaguacccgccgu

SEQ ID NO: 661198 - RNA, 23 nt, Escherichia coli CFT073
cguugaacccggcaucaaccagc

SEQ ID NO: 661199 - RNA, 15 nt, Escherichia coli CFT073
cguugaauuucaggu

SEQ ID NO: 661200 - RNA, 23 nt, Escherichia coli CFT073
cguugaauuucagguucugacca

SEQ ID NO: 661201 - RNA, 14 nt, Escherichia coli CFT073
cguucggugcgcgc

SEQ ID NO: 661202 - RNA, 15 nt, Escherichia coli CFT073
cguucggugcgcgcu

SEQ ID NO: 661203 - RNA, 16 nt, Escherichia coli CFT073
cguugauuucaccauc

SEQ ID NO: 661204 - RNA, 20 nt, Escherichia coli CFT073
cguugcaccaaguucuucac

SEQ ID NO: 661205 - RNA, 16 nt, Escherichia coli CFT073
cguugcauaaagcuca

SEQ ID NO: 661206 - RNA, 16 nt, Escherichia coli CFT073
cguugccgcucccggc

SEQ ID NO: 661207 - RNA, 15 nt, Escherichia coli CFT073
cguugccggaucuuu

SEQ ID NO: 661208 - RNA, 17 nt, Escherichia coli CFT073
cguugcgacaaaccagg

SEQ ID NO: 661209 - RNA, 13 nt, Escherichia coli CFT073
aaaaaaacucauu

SEQ ID NO: 661210 - RNA, 11 nt, Escherichia coli CFT073
aaaaaaaagau

SEQ ID NO: 661211 - RNA, 16 nt, Escherichia coli CFT073
aaaaaaauuaauuuuu

SEQ ID NO: 661212 - RNA, 18 nt, Escherichia coli CFT073
aaaaaauacgcaucauau

SEQ ID NO: 661213 - RNA, 21 nt, Escherichia coli CFT073
aaaaaagugauuuacuuucuu

SEQ ID NO: 661214 - RNA, 16 nt, Escherichia coli CFT073
aaaaaagcaagauuaa

SEQ ID NO: 661215 - RNA, 21 nt, Escherichia coli CFT073
aaaaaagcaagauuaaaauau

SEQ ID NO: 661216 - RNA, 10 nt, Escherichia coli CFT073
aaaaaacagu

SEQ ID NO: 661217 - RNA, 12 nt, Escherichia coli CFT073
aaaaaagcuaua

SEQ ID NO: 661218 - RNA, 13 nt, Escherichia coli CFT073
aaaaaagccacgg

SEQ ID NO: 661219 - RNA, 17 nt, Escherichia coli CFT073
aaaaaagccccgcagcc

SEQ ID NO: 661220 - RNA, 12 nt, Escherichia coli CFT073
aaaaacagccag

SEQ ID NO: 661221 - RNA, 21 nt, Escherichia coli CFT073
aaaaacaguaugcaacaacuc

SEQ ID NO: 661222 - RNA, 18 nt, Escherichia coli CFT073
aaaaaaucccgaucuucu

SEQ ID NO: 661223 - RNA, 15 nt, Escherichia coli CFT073
aaaaacacucuucaa

SEQ ID NO: 661224 - RNA, 16 nt, Escherichia coli CFT073
aaaaacagccagcagc

SEQ ID NO: 661225 - RNA, 23 nt, Escherichia coli CFT073
aaaaacaccccauugccccaugu

SEQ ID NO: 661226 - RNA, 14 nt, Escherichia coli CFT073
aaaaaccaucaccu

SEQ ID NO: 661227 - RNA, 19 nt, Escherichia coli CFT073
aaaaaaucuucacugaaua

SEQ ID NO: 661228 - RNA, 14 nt, Escherichia coli CFT073
aaaacacucuuuuu

SEQ ID NO: 661229 - RNA, 18 nt, Escherichia coli CFT073
aaaacauuuuaaacauca

SEQ ID NO: 661230 - RNA, 22 nt, Escherichia coli CFT073
aaaacauguggauuaaauugcg

SEQ ID NO: 661231 - RNA, 11 nt, Escherichia coli CFT073
aaaacauuacu

SEQ ID NO: 661232 - RNA, 21 nt, Escherichia coli CFT073
aaaacacauuaaacuuaagau

SEQ ID NO: 661233 - RNA, 15 nt, Escherichia coli CFT073
aaaaauuaauuuuuu

SEQ ID NO: 661234 - RNA, 17 nt, Escherichia coli CFT073
aaaaaucgacuguggua

SEQ ID NO: 661235 - RNA, 16 nt, Escherichia coli CFT073
aaaacaagcagcugcc

SEQ ID NO: 661236 - RNA, 21 nt, Escherichia coli CFT073
aaaaauaguuacuaucuucaa

SEQ ID NO: 661237 - RNA, 12 nt, Escherichia coli CFT073
aaaaaucccagc

SEQ ID NO: 661238 - RNA, 21 nt, Escherichia coli CFT073
aaaaauaccauuagucacauu

SEQ ID NO: 661239 - RNA, 14 nt, Escherichia coli CFT073
aaaaauaccgagca

SEQ ID NO: 661240 - RNA, 14 nt, Escherichia coli CFT073
aaaaauaaugccac

SEQ ID NO: 661241 - RNA, 21 nt, Escherichia coli CFT073
aaaaauaccaccaauguggaa

SEQ ID NO: 661242 - RNA, 16 nt, Escherichia coli CFT073
aaaaauacgcaucaua

SEQ ID NO: 661243 - RNA, 17 nt, Escherichia coli CFT073
aaaaauacgcaucauau

SEQ ID NO: 661244 - RNA, 12 nt, Escherichia coli CFT073
aaaaacccgccc

SEQ ID NO: 661245 - RNA, 22 nt, Escherichia coli CFT073
aaaaaccagaaagggaagaaca

SEQ ID NO: 661246 - RNA, 22 nt, Escherichia coli CFT073
aaaaaccagggugcguugaaga

SEQ ID NO: 661247 - RNA, 12 nt, Escherichia coli CFT073
aaaaaccagaga

SEQ ID NO: 661248 - RNA, 22 nt, Escherichia coli CFT073
aaaaacagcgccugcacaaagc

SEQ ID NO: 661249 - RNA, 13 nt, Escherichia coli CFT073
aaaaacccuucuu

SEQ ID NO: 661250 - RNA, 14 nt, Escherichia coli CFT073
aaaaauaacaguga

SEQ ID NO: 661251 - RNA, 14 nt, Escherichia coli CFT073
aaaaauaaucaucu

SEQ ID NO: 661252 - RNA, 13 nt, Escherichia coli CFT073
aaaagauuaagaa

SEQ ID NO: 661253 - RNA, 21 nt, Escherichia coli CFT073
aaaagcacagaaucuaagauc

SEQ ID NO: 661254 - RNA, 17 nt, Escherichia coli CFT073
aaaagacuauauuaaag

SEQ ID NO: 661255 - RNA, 15 nt, Escherichia coli CFT073
aaaagagaugaauga

SEQ ID NO: 661256 - RNA, 17 nt, Escherichia coli CFT073
aaaagaaugacccauuu

SEQ ID NO: 661257 - RNA, 22 nt, Escherichia coli CFT073
aaaagaaugcgcucaauauaac

SEQ ID NO: 661258 - RNA, 15 nt, Escherichia coli CFT073
aaaagaauaaauauc

SEQ ID NO: 661259 - RNA, 12 nt, Escherichia coli CFT073
aaaagaacacaa

SEQ ID NO: 661260 - RNA, 21 nt, Escherichia coli CFT073
aaaacuucauuugucucaaaa

SEQ ID NO: 661261 - RNA, 20 nt, Escherichia coli CFT073
aaaacugggugaagacggcc

SEQ ID NO: 661262 - RNA, 16 nt, Escherichia coli CFT073
aaaacuguaucccagc

SEQ ID NO: 661263 - RNA, 21 nt, Escherichia coli CFT073
aaaacugcccgugaugcaacu

SEQ ID NO: 661264 - RNA, 14 nt, Escherichia coli CFT073
aaaacucaaaaaaa

SEQ ID NO: 661265 - RNA, 19 nt, Escherichia coli CFT073
aaaacucgccuuugucuuu

SEQ ID NO: 661266 - RNA, 18 nt, Escherichia coli CFT073
aaaacguggccuccaaaa

SEQ ID NO: 661267 - RNA, 16 nt, Escherichia coli CFT073
aaaacgugcagcugcc

SEQ ID NO: 661268 - RNA, 19 nt, Escherichia coli CFT073
aaaacgguaguugaacucg

SEQ ID NO: 661269 - RNA, 17 nt, Escherichia coli CFT073
aaaacgguggccacagc

SEQ ID NO: 661270 - RNA, 18 nt, Escherichia coli CFT073
aaaacgguggccacagca

SEQ ID NO: 661271 - RNA, 17 nt, Escherichia coli CFT073
aaaacggcgcauugccu

SEQ ID NO: 661272 - RNA, 18 nt, Escherichia coli CFT073
aaaacgggucaccuucug

SEQ ID NO: 661273 - RNA, 11 nt, Escherichia coli CFT073
aaaaccaaugg

SEQ ID NO: 661274 - RNA, 21 nt, Escherichia coli CFT073
aaaaccaaaccagccgccaac

SEQ ID NO: 661275 - RNA, 12 nt, Escherichia coli CFT073
aaaauaaaaacg

SEQ ID NO: 661276 - RNA, 10 nt, Escherichia coli CFT073
aaaauaaugc

SEQ ID NO: 661277 - RNA, 13 nt, Escherichia coli CFT073
aaaauaaucucac

SEQ ID NO: 661278 - RNA, 21 nt, Escherichia coli CFT073
aaaauaagucagaccaaaacc

SEQ ID NO: 661279 - RNA, 13 nt, Escherichia coli CFT073
aaaauaaggcugc

SEQ ID NO: 661280 - RNA, 14 nt, Escherichia coli CFT073
aaaagccuaagaag

SEQ ID NO: 661281 - RNA, 14 nt, Escherichia coli CFT073
aaaagcccuggcag

SEQ ID NO: 661282 - RNA, 22 nt, Escherichia coli CFT073
aaaagccaccaaccacaaccca

SEQ ID NO: 661283 - RNA, 16 nt, Escherichia coli CFT073
aaaaguagcgcagcag

SEQ ID NO: 661284 - RNA, 20 nt, Escherichia coli CFT073
aaaaguagcgcagcagauaa

SEQ ID NO: 661285 - RNA, 15 nt, Escherichia coli CFT073
aaaaguaaucaaugc

SEQ ID NO: 661286 - RNA, 22 nt, Escherichia coli CFT073
aaaaguaaaccagcgagaagcu

SEQ ID NO: 661287 - RNA, 22 nt, Escherichia coli CFT073
aaaagcgauauccgggcaaaaa

SEQ ID NO: 661288 - RNA, 14 nt, Escherichia coli CFT073
aaaauccagcagaa

SEQ ID NO: 661289 - RNA, 21 nt, Escherichia coli CFT073
aaaauccacuuaagaagguag

SEQ ID NO: 661290 - RNA, 18 nt, Escherichia coli CFT073
aaaaucaccgcgaccaga

SEQ ID NO: 661291 - RNA, 22 nt, Escherichia coli CFT073
aaaaucaccucaucaccacaga

SEQ ID NO: 661292 - RNA, 23 nt, Escherichia coli CFT073
aaaaucauuuaucucgucacuuu

SEQ ID NO: 661293 - RNA, 21 nt, Escherichia coli CFT073
aaaauccgcuggugcuuuaaa

SEQ ID NO: 661294 - RNA, 11 nt, Escherichia coli CFT073
aaaaucccagc

SEQ ID NO: 661295 - RNA, 23 nt, Escherichia coli CFT073
aaaaucaaaguuaguaaaacuau

SEQ ID NO: 661296 - RNA, 13 nt, Escherichia coli CFT073
aaaaucaccauca

SEQ ID NO: 661297 - RNA, 16 nt, Escherichia coli CFT073
aaaauacuggcgauuu

SEQ ID NO: 661298 - RNA, 18 nt, Escherichia coli CFT073
aaaauacguuuucaccuc

SEQ ID NO: 661299 - RNA, 17 nt, Escherichia coli CFT073
aaaauaccgaacaugcc

SEQ ID NO: 661300 - RNA, 16 nt, Escherichia coli CFT073
aaaauaccgagcagcc

SEQ ID NO: 661301 - RNA, 17 nt, Escherichia coli CFT073
aaaauagaaauuuagua

SEQ ID NO: 661302 - RNA, 16 nt, Escherichia coli CFT073
aaaauagcaaaguagu

SEQ ID NO: 661303 - RNA, 23 nt, Escherichia coli CFT073
aaaauaggaauccgggucuguaa

SEQ ID NO: 661304 - RNA, 15 nt, Escherichia coli CFT073
aaaaugcgaaaaaaa

SEQ ID NO: 661305 - RNA, 16 nt, Escherichia coli CFT073
aaaaugccgcacauca

SEQ ID NO: 661306 - RNA, 13 nt, Escherichia coli CFT073
aaaaugccacugc

SEQ ID NO: 661307 - RNA, 19 nt, Escherichia coli CFT073
aaaaucguaagcaggagau

SEQ ID NO: 661308 - RNA, 18 nt, Escherichia coli CFT073
aaaaucuacggaagaguu

SEQ ID NO: 661309 - RNA, 13 nt, Escherichia coli CFT073
aaaaugcaagcau

SEQ ID NO: 661310 - RNA, 18 nt, Escherichia coli CFT073
aaaaugaugucaaccauc

SEQ ID NO: 661311 - RNA, 20 nt, Escherichia coli CFT073
aaaaucgccugaacaccaga

SEQ ID NO: 661312 - RNA, 16 nt, Escherichia coli CFT073
aaaaucguaagcagga

SEQ ID NO: 661313 - RNA, 17 nt, Escherichia coli CFT073
aaaauccugccagcgug

SEQ ID NO: 661314 - RNA, 15 nt, Escherichia coli CFT073
aaaaucgauggguuu

SEQ ID NO: 661315 - RNA, 18 nt, Escherichia coli CFT073
aaaauuucuuuuuuucau

SEQ ID NO: 661316 - RNA, 13 nt, Escherichia coli CFT073
aaaauuucacaua

SEQ ID NO: 661317 - RNA, 20 nt, Escherichia coli CFT073
aaaauuucccccacagcucu

SEQ ID NO: 661318 - RNA, 13 nt, Escherichia coli CFT073
aaaauucaucaaa

SEQ ID NO: 661319 - RNA, 15 nt, Escherichia coli CFT073
aaaauucaucaaaug

SEQ ID NO: 661320 - RNA, 14 nt, Escherichia coli CFT073
aaacaacaugcuau

SEQ ID NO: 661321 - RNA, 15 nt, Escherichia coli CFT073
aaacaaacaugaauc

SEQ ID NO: 661322 - RNA, 14 nt, Escherichia coli CFT073
aaacaaaaaaccua

SEQ ID NO: 661323 - RNA, 22 nt, Escherichia coli CFT073
aaauuauucagcguuugcugaa

SEQ ID NO: 661324 - RNA, 22 nt, Escherichia coli CFT073
aaauuauuaauuaaacaaauaa

SEQ ID NO: 661325 - RNA, 14 nt, Escherichia coli CFT073
aaauuauuaccauc

SEQ ID NO: 661326 - RNA, 13 nt, Escherichia coli CFT073
aaauuauggauca

SEQ ID NO: 661327 - RNA, 20 nt, Escherichia coli CFT073
aaauuaccuuuacaugaaaa

SEQ ID NO: 661328 - RNA, 20 nt, Escherichia coli CFT073
aaauuauccaacuuuuccca

SEQ ID NO: 661329 - RNA, 20 nt, Escherichia coli CFT073
aaauuauugccuugaugaaa

SEQ ID NO: 661330 - RNA, 22 nt, Escherichia coli CFT073
aaauuauugccuugaugaaaaa

SEQ ID NO: 661331 - RNA, 21 nt, Escherichia coli CFT073
aaauucagcauuacccgucug

SEQ ID NO: 661332 - RNA, 16 nt, Escherichia coli CFT073
aaauucagacuacuga

SEQ ID NO: 661333 - RNA, 23 nt, Escherichia coli CFT073
aaauuccuguagcggaaaaucgg

SEQ ID NO: 661334 - RNA, 19 nt, Escherichia coli CFT073
aaaugugccggaugcauca

SEQ ID NO: 661335 - RNA, 19 nt, Escherichia coli CFT073
aaauguguacuucucugug

SEQ ID NO: 661336 - RNA, 17 nt, Escherichia coli CFT073
aaauggauaagaaagau

SEQ ID NO: 661337 - RNA, 21 nt, Escherichia coli CFT073
aaaaagccaccaccucuucca

SEQ ID NO: 661338 - RNA, 15 nt, Escherichia coli CFT073
aaaaagccccgcagc

SEQ ID NO: 661339 - RNA, 23 nt, Escherichia coli CFT073
aaauuaccaccagcgacagccag

SEQ ID NO: 661340 - RNA, 20 nt, Escherichia coli CFT073
aaauuacccuucguuuuccg

SEQ ID NO: 661341 - RNA, 22 nt, Escherichia coli CFT073
aaaugcggacgucgacacuaca

SEQ ID NO: 661342 - RNA, 19 nt, Escherichia coli CFT073
aaaugcgggcuuggcuggu

SEQ ID NO: 661343 - RNA, 20 nt, Escherichia coli CFT073
aaaugcguagguuaacccag

SEQ ID NO: 661344 - RNA, 19 nt, Escherichia coli CFT073
aaaugcugcaauugcggca

SEQ ID NO: 661345 - RNA, 15 nt, Escherichia coli CFT073
aaaugcugguuuugu

SEQ ID NO: 661346 - RNA, 16 nt, Escherichia coli CFT073
aaaugcgaaaaaaacu

SEQ ID NO: 661347 - RNA, 13 nt, Escherichia coli CFT073
aaaugcgccgcca

SEQ ID NO: 661348 - RNA, 15 nt, Escherichia coli CFT073
aaaugcgcucagagu

SEQ ID NO: 661349 - RNA, 11 nt, Escherichia coli CFT073
aaaugcgcaug

SEQ ID NO: 661350 - RNA, 19 nt, Escherichia coli CFT073
aaaugcccgacaaaaauua

SEQ ID NO: 661351 - RNA, 23 nt, Escherichia coli CFT073
aaaugcccuuuuuuuaugucagu

SEQ ID NO: 661352 - RNA, 15 nt, Escherichia coli CFT073
aaaugaugauugacc

SEQ ID NO: 661353 - RNA, 13 nt, Escherichia coli CFT073
aaaugaugcacca

SEQ ID NO: 661354 - RNA, 13 nt, Escherichia coli CFT073
aaaugaaagcagc

SEQ ID NO: 661355 - RNA, 13 nt, Escherichia coli CFT073
aaaucuucguuau

SEQ ID NO: 661356 - RNA, 22 nt, Escherichia coli CFT073
aaaucgcaacgguucugcugcc

SEQ ID NO: 661357 - RNA, 15 nt, Escherichia coli CFT073
aaaucgcaauaucau

SEQ ID NO: 661358 - RNA, 24 nt, Escherichia coli CFT073
aaaucgcccgucaguucauccauu

SEQ ID NO: 661359 - RNA, 20 nt, Escherichia coli CFT073
aaaucgccgacaaucucuuc

SEQ ID NO: 661360 - RNA, 18 nt, Escherichia coli CFT073
aaaucgccggaugcggca

SEQ ID NO: 661361 - RNA, 13 nt, Escherichia coli CFT073
aaaucgccgggau

SEQ ID NO: 661362 - RNA, 20 nt, Escherichia coli CFT073
aaaucgccgggauauauguc

SEQ ID NO: 661363 - RNA, 22 nt, Escherichia coli CFT073
aaaucaugaauuuugaaggaaa

SEQ ID NO: 661364 - RNA, 20 nt, Escherichia coli CFT073
aaaucaucggcaucuucuuc

SEQ ID NO: 661365 - RNA, 21 nt, Escherichia coli CFT073
aaaucaucggcaucuucuucu

SEQ ID NO: 661366 - RNA, 16 nt, Escherichia coli CFT073
aaaucauccuguucau

SEQ ID NO: 661367 - RNA, 12 nt, Escherichia coli CFT073
aaaucauccagc

SEQ ID NO: 661368 - RNA, 19 nt, Escherichia coli CFT073
aaaucaucauugcuguuuu

SEQ ID NO: 661369 - RNA, 22 nt, Escherichia coli CFT073
aaaucaucauugcuguuuuaca

SEQ ID NO: 661370 - RNA, 21 nt, Escherichia coli CFT073
aaaucaucaguaccaguccua

SEQ ID NO: 661371 - RNA, 13 nt, Escherichia coli CFT073
aaaucgcucccuc

SEQ ID NO: 661372 - RNA, 19 nt, Escherichia coli CFT073
aaaucucacuacaacaacc

SEQ ID NO: 661373 - RNA, 17 nt, Escherichia coli CFT073
aaaucuauuauuauuuu

SEQ ID NO: 661374 - RNA, 13 nt, Escherichia coli CFT073
aaaucuccauuuc

SEQ ID NO: 661375 - RNA, 14 nt, Escherichia coli CFT073
aaaucuccauuuca

SEQ ID NO: 661376 - RNA, 16 nt, Escherichia coli CFT073
aaauacguuuucaccu

SEQ ID NO: 661377 - RNA, 13 nt, Escherichia coli CFT073
aaauacuaaauau

SEQ ID NO: 661378 - RNA, 16 nt, Escherichia coli CFT073
aaauacuaaauaugaa

SEQ ID NO: 661379 - RNA, 17 nt, Escherichia coli CFT073
aaauacuaaauaugaaa

SEQ ID NO: 661380 - RNA, 14 nt, Escherichia coli CFT073
aaauacucauuaau

SEQ ID NO: 661381 - RNA, 12 nt, Escherichia coli CFT073
aaauaauauccc

SEQ ID NO: 661382 - RNA, 22 nt, Escherichia coli CFT073
aaauaaucgacgaggaaaauga

SEQ ID NO: 661383 - RNA, 15 nt, Escherichia coli CFT073
aaauaaucucaccau

SEQ ID NO: 661384 - RNA, 17 nt, Escherichia coli CFT073
aaauaaucucaccauuu

SEQ ID NO: 661385 - RNA, 16 nt, Escherichia coli CFT073
aaauaauauuucccca

SEQ ID NO: 661386 - RNA, 14 nt, Escherichia coli CFT073
aaauaauccgcugu

SEQ ID NO: 661387 - RNA, 23 nt, Escherichia coli CFT073
aaauaggaauccgggucuguaaa

SEQ ID NO: 661388 - RNA, 18 nt, Escherichia coli CFT073
aaauagcgccauaaaacu

SEQ ID NO: 661389 - RNA, 18 nt, Escherichia coli CFT073
aaauagcggguuuguuau

SEQ ID NO: 661390 - RNA, 23 nt, Escherichia coli CFT073
aaauacuguuuaccggugccagc

SEQ ID NO: 661391 - RNA, 16 nt, Escherichia coli CFT073
aaauagccagcagagc

SEQ ID NO: 661392 - RNA, 23 nt, Escherichia coli CFT073
aaauagccagcagagcaaaaauc

SEQ ID NO: 661393 - RNA, 23 nt, Escherichia coli CFT073
aaauaaaugcuugacucuguagc

SEQ ID NO: 661394 - RNA, 15 nt, Escherichia coli CFT073
aaauaacaaauaauu

SEQ ID NO: 661395 - RNA, 19 nt, Escherichia coli CFT073
aaagucgcguuauuuuuga

SEQ ID NO: 661396 - RNA, 16 nt, Escherichia coli CFT073
aaagucguaggccuga

SEQ ID NO: 661397 - RNA, 19 nt, Escherichia coli CFT073
aaagucguaggccugauaa

SEQ ID NO: 661398 - RNA, 20 nt, Escherichia coli CFT073
aaagucccuucccagccggg

SEQ ID NO: 661399 - RNA, 14 nt, Escherichia coli CFT073
aaauaacgucgcca

SEQ ID NO: 661400 - RNA, 17 nt, Escherichia coli CFT073
aaauaacgaaaguaucu

SEQ ID NO: 661401 - RNA, 15 nt, Escherichia coli CFT073
aaauaacgaucauca

SEQ ID NO: 661402 - RNA, 18 nt, Escherichia coli CFT073
aaauaacgaucaucacga

SEQ ID NO: 661403 - RNA, 19 nt, Escherichia coli CFT073
aaauaaccgccaccaggaa

SEQ ID NO: 661404 - RNA, 22 nt, Escherichia coli CFT073
aaauaaccgguauugcuccaga

SEQ ID NO: 661405 - RNA, 20 nt, Escherichia coli CFT073
aaauaacgccccggcaaaac

SEQ ID NO: 661406 - RNA, 20 nt, Escherichia coli CFT073
aaauaagaugcgaguaaaca

SEQ ID NO: 661407 - RNA, 15 nt, Escherichia coli CFT073
aaauaugaugaagga

SEQ ID NO: 661408 - RNA, 17 nt, Escherichia coli CFT073
aaauauuauuggcaucg

SEQ ID NO: 661409 - RNA, 15 nt, Escherichia coli CFT073
aaaucaaacagaaua

SEQ ID NO: 661410 - RNA, 16 nt, Escherichia coli CFT073
aaaucaaacagaauau

SEQ ID NO: 661411 - RNA, 16 nt, Escherichia coli CFT073
aaaucaaaguuaguaa

SEQ ID NO: 661412 - RNA, 17 nt, Escherichia coli CFT073
aaauauugcuguaaagu

SEQ ID NO: 661413 - RNA, 13 nt, Escherichia coli CFT073
aaaucacgcgccu

SEQ ID NO: 661414 - RNA, 20 nt, Escherichia coli CFT073
aaaucacgcgccugccaggc

SEQ ID NO: 661415 - RNA, 16 nt, Escherichia coli CFT073
aaaucacuaaacccga

SEQ ID NO: 661416 - RNA, 18 nt, Escherichia coli CFT073
aaaucaguugauuaugau

SEQ ID NO: 661417 - RNA, 22 nt, Escherichia coli CFT073
aaaucaguccacggcugcggcc

SEQ ID NO: 661418 - RNA, 18 nt, Escherichia coli CFT073
aaaucagccguuucacca

SEQ ID NO: 661419 - RNA, 16 nt, Escherichia coli CFT073
aaaucagccuuaaucu

SEQ ID NO: 661420 - RNA, 13 nt, Escherichia coli CFT073
aaaucaaugccac

SEQ ID NO: 661421 - RNA, 23 nt, Escherichia coli CFT073
aaaucaccauauucagcagcaga

SEQ ID NO: 661422 - RNA, 17 nt, Escherichia coli CFT073
aaaucaccaucacaauu

SEQ ID NO: 661423 - RNA, 14 nt, Escherichia coli CFT073
aaaucaagcgccgc

SEQ ID NO: 661424 - RNA, 14 nt, Escherichia coli CFT073
aaaucaauacauca

SEQ ID NO: 661425 - RNA, 14 nt, Escherichia coli CFT073
aaaucaacaaauuc

SEQ ID NO: 661426 - RNA, 17 nt, Escherichia coli CFT073
aaaguaucaaacagaaa

SEQ ID NO: 661427 - RNA, 20 nt, Escherichia coli CFT073
aaaguaucaaacagaaaaac

SEQ ID NO: 661428 - RNA, 20 nt, Escherichia coli CFT073
aaaguauaugagaagacugu

SEQ ID NO: 661429 - RNA, 15 nt, Escherichia coli CFT073
aaaguacacauugcc

SEQ ID NO: 661430 - RNA, 13 nt, Escherichia coli CFT073
aaagucagcguau

SEQ ID NO: 661431 - RNA, 19 nt, Escherichia coli CFT073
aaagucaggcaauucuuuc

SEQ ID NO: 661432 - RNA, 22 nt, Escherichia coli CFT073
aaagucacgccaauaaucgauu

SEQ ID NO: 661433 - RNA, 22 nt, Escherichia coli CFT073
aaaguauggacgugcucugguu

SEQ ID NO: 661434 - RNA, 16 nt, Escherichia coli CFT073
aaagggggcgacauuu

SEQ ID NO: 661435 - RNA, 18 nt, Escherichia coli CFT073
aaaggccagcaaucccca

SEQ ID NO: 661436 - RNA, 17 nt, Escherichia coli CFT073
aaaggccagcaaucccc

SEQ ID NO: 661437 - RNA, 11 nt, Escherichia coli CFT073
aaagggaugcc

SEQ ID NO: 661438 - RNA, 14 nt, Escherichia coli CFT073
aaagcccugcucgc

SEQ ID NO: 661439 - RNA, 20 nt, Escherichia coli CFT073
aaagcccaucguugaaaaaa

SEQ ID NO: 661440 - RNA, 17 nt, Escherichia coli CFT073
aaagcccauaccacagc

SEQ ID NO: 661441 - RNA, 23 nt, Escherichia coli CFT073
aaagcccaucaccgccaggccua

SEQ ID NO: 661442 - RNA, 20 nt, Escherichia coli CFT073
aaagcccaccccaauguuuu

SEQ ID NO: 661443 - RNA, 13 nt, Escherichia coli CFT073
aaagccccgcagc

SEQ ID NO: 661444 - RNA, 23 nt, Escherichia coli CFT073
aaagcccccacaacauugcgccu

SEQ ID NO: 661445 - RNA, 15 nt, Escherichia coli CFT073
aaagcccgcuucaaa

SEQ ID NO: 661446 - RNA, 15 nt, Escherichia coli CFT073
aaagcuaacagcgcc

SEQ ID NO: 661447 - RNA, 22 nt, Escherichia coli CFT073
aaagcgucucgccagaguugau

SEQ ID NO: 661448 - RNA, 20 nt, Escherichia coli CFT073
aaagcguuucaggucaccca

SEQ ID NO: 661449 - RNA, 13 nt, Escherichia coli CFT073
aaagccgcuuaau

SEQ ID NO: 661450 - RNA, 22 nt, Escherichia coli CFT073
aaagccggagcgacaaacuccg

SEQ ID NO: 661451 - RNA, 21 nt, Escherichia coli CFT073
aaagccggaggaaacuugccu

SEQ ID NO: 661452 - RNA, 15 nt, Escherichia coli CFT073
aaaggacagaguguu

SEQ ID NO: 661453 - RNA, 16 nt, Escherichia coli CFT073
aaaggcaaaaugccag

SEQ ID NO: 661454 - RNA, 17 nt, Escherichia coli CFT073
aaaggcacucauuuucu

SEQ ID NO: 661455 - RNA, 12 nt, Escherichia coli CFT073
aaaggcagaaac

SEQ ID NO: 661456 - RNA, 17 nt, Escherichia coli CFT073
aaagcugucaccaauca

SEQ ID NO: 661457 - RNA, 21 nt, Escherichia coli CFT073
aaagcuguuaucgauauacaa

SEQ ID NO: 661458 - RNA, 19 nt, Escherichia coli CFT073
aaagcuguaaggugaaagc

SEQ ID NO: 661459 - RNA, 20 nt, Escherichia coli CFT073
aaagcuguaaggugaaagca

SEQ ID NO: 661460 - RNA, 19 nt, Escherichia coli CFT073
aaagcugcugaccaccagc

SEQ ID NO: 661461 - RNA, 21 nt, Escherichia coli CFT073
aaagcugcugaccaccagcac

SEQ ID NO: 661462 - RNA, 15 nt, Escherichia coli CFT073
aaagccaacagcagc

SEQ ID NO: 661463 - RNA, 20 nt, Escherichia coli CFT073
aaagccaaccugcagguugg

SEQ ID NO: 661464 - RNA, 21 nt, Escherichia coli CFT073
aaagccaccaccucuuccagc

SEQ ID NO: 661465 - RNA, 12 nt, Escherichia coli CFT073
aaagcagcgaag

SEQ ID NO: 661466 - RNA, 19 nt, Escherichia coli CFT073
aaagcagcaagaacuuccg

SEQ ID NO: 661467 - RNA, 16 nt, Escherichia coli CFT073
aaagcagcagcuguuu

SEQ ID NO: 661468 - RNA, 17 nt, Escherichia coli CFT073
aaagcagauaacccagc

SEQ ID NO: 661469 - RNA, 20 nt, Escherichia coli CFT073
aaagcagauaacccagcagc

SEQ ID NO: 661470 - RNA, 20 nt, Escherichia coli CFT073
aaagcacuguucgccgcagc

SEQ ID NO: 661471 - RNA, 20 nt, Escherichia coli CFT073
aaagcagacuuuuugcggca

SEQ ID NO: 661472 - RNA, 22 nt, Escherichia coli CFT073
aaagcacgccagacaucaccag

SEQ ID NO: 661473 - RNA, 18 nt, Escherichia coli CFT073
aaagauacaaaacaugug

SEQ ID NO: 661474 - RNA, 21 nt, Escherichia coli CFT073
aaagauacaaaacauguggau

SEQ ID NO: 661475 - RNA, 23 nt, Escherichia coli CFT073
aaagauauuggggguaauucccu

SEQ ID NO: 661476 - RNA, 18 nt, Escherichia coli CFT073
aaagaucaacugccgccu

SEQ ID NO: 661477 - RNA, 21 nt, Escherichia coli CFT073
aaagaucacaauguaaaucau

SEQ ID NO: 661478 - RNA, 12 nt, Escherichia coli CFT073
aaagcaaaaaag

SEQ ID NO: 661479 - RNA, 19 nt, Escherichia coli CFT073
aaagcaaaaaagaaggaaa

SEQ ID NO: 661480 - RNA, 17 nt, Escherichia coli CFT073
aaagcaaauaaugucca

SEQ ID NO: 661481 - RNA, 17 nt, Escherichia coli CFT073
aaagacgacgaacuuca

SEQ ID NO: 661482 - RNA, 15 nt, Escherichia coli CFT073
aaagacgaugaaugc

SEQ ID NO: 661483 - RNA, 15 nt, Escherichia coli CFT073
aaagacgccaucaau

SEQ ID NO: 661484 - RNA, 12 nt, Escherichia coli CFT073
aaagaauauagg

SEQ ID NO: 661485 - RNA, 17 nt, Escherichia coli CFT073
aaagaauauaggcaccg

SEQ ID NO: 661486 - RNA, 23 nt, Escherichia coli CFT073
aaacuuuucaccagcgucaguuc

SEQ ID NO: 661487 - RNA, 17 nt, Escherichia coli CFT073
aaagaagugcucuuugc

SEQ ID NO: 661488 - RNA, 16 nt, Escherichia coli CFT073
aaagagaguuacuggc

SEQ ID NO: 661489 - RNA, 18 nt, Escherichia coli CFT073
aaagacuuugcugccuuu

SEQ ID NO: 661490 - RNA, 15 nt, Escherichia coli CFT073
aaagauaaccucauu

SEQ ID NO: 661491 - RNA, 22 nt, Escherichia coli CFT073
aaagaguugccccucuaacucu

SEQ ID NO: 661492 - RNA, 18 nt, Escherichia coli CFT073
aaagagugcgccagucac

SEQ ID NO: 661493 - RNA, 21 nt, Escherichia coli CFT073
aaagagugugaauauucagaa

SEQ ID NO: 661494 - RNA, 14 nt, Escherichia coli CFT073
aaagagaugaauga

SEQ ID NO: 661495 - RNA, 17 nt, Escherichia coli CFT073
aaagagcaagaacccca

SEQ ID NO: 661496 - RNA, 18 nt, Escherichia coli CFT073
aaacuuauuuaaacccuu

SEQ ID NO: 661497 - RNA, 19 nt, Escherichia coli CFT073
aaacuuauuuaaacccuuu

SEQ ID NO: 661498 - RNA, 13 nt, Escherichia coli CFT073
aaacuucugcaac

SEQ ID NO: 661499 - RNA, 12 nt, Escherichia coli CFT073
aaacuucgccac

SEQ ID NO: 661500 - RNA, 16 nt, Escherichia coli CFT073
aaacuuucauaaacac

SEQ ID NO: 661501 - RNA, 16 nt, Escherichia coli CFT073
aaacuugguuacgcac

SEQ ID NO: 661502 - RNA, 19 nt, Escherichia coli CFT073
aaacugaucuuuaucaagc

SEQ ID NO: 661503 - RNA, 15 nt, Escherichia coli CFT073
aaacuggaauagcgc

SEQ ID NO: 661504 - RNA, 17 nt, Escherichia coli CFT073
aaacugcgugugacaaa

SEQ ID NO: 661505 - RNA, 19 nt, Escherichia coli CFT073
aaacuguucgguacaauca

SEQ ID NO: 661506 - RNA, 16 nt, Escherichia coli CFT073
aaacugugauugugau

SEQ ID NO: 661507 - RNA, 13 nt, Escherichia coli CFT073
aaacuguuuccag

SEQ ID NO: 661508 - RNA, 24 nt, Escherichia coli CFT073
aaacuguaucccagcccagcggaa

SEQ ID NO: 661509 - RNA, 16 nt, Escherichia coli CFT073
aaacugguugaaauaa

SEQ ID NO: 661510 - RNA, 20 nt, Escherichia coli CFT073
aaacugguugcaacaucaaa

SEQ ID NO: 661511 - RNA, 16 nt, Escherichia coli CFT073
aaacugucaacaccag

SEQ ID NO: 661512 - RNA, 15 nt, Escherichia coli CFT073
aaacuggcugaugcu

SEQ ID NO: 661513 - RNA, 13 nt, Escherichia coli CFT073
aaacuggcugugc

SEQ ID NO: 661514 - RNA, 21 nt, Escherichia coli CFT073
aaacuggguuuugaucuccag

SEQ ID NO: 661515 - RNA, 18 nt, Escherichia coli CFT073
aaacucaagcuaaaccaa

SEQ ID NO: 661516 - RNA, 19 nt, Escherichia coli CFT073
aaacucaagcuaaaccaau

SEQ ID NO: 661517 - RNA, 20 nt, Escherichia coli CFT073
aaacucaagcuaaaccaaua

SEQ ID NO: 661518 - RNA, 14 nt, Escherichia coli CFT073
aaacucaaucaggc

SEQ ID NO: 661519 - RNA, 14 nt, Escherichia coli CFT073
aaacuaucugaaaa

SEQ ID NO: 661520 - RNA, 16 nt, Escherichia coli CFT073
aaacuacagaugaaau

SEQ ID NO: 661521 - RNA, 19 nt, Escherichia coli CFT073
aaacucgugauaguccagc

SEQ ID NO: 661522 - RNA, 19 nt, Escherichia coli CFT073
aaacucgcggcuaacacuu

SEQ ID NO: 661523 - RNA, 14 nt, Escherichia coli CFT073
aaacucucccaugc

SEQ ID NO: 661524 - RNA, 14 nt, Escherichia coli CFT073
aaacuccagcccuu

SEQ ID NO: 661525 - RNA, 16 nt, Escherichia coli CFT073
aaacucaccauccuga

SEQ ID NO: 661526 - RNA, 15 nt, Escherichia coli CFT073
aaacucaccgcucug

SEQ ID NO: 661527 - RNA, 14 nt, Escherichia coli CFT073
aaacucaugggucu

SEQ ID NO: 661528 - RNA, 19 nt, Escherichia coli CFT073
aaacgccccuaaauaaaca

SEQ ID NO: 661529 - RNA, 15 nt, Escherichia coli CFT073
aaacgcccccaaaau

SEQ ID NO: 661530 - RNA, 13 nt, Escherichia coli CFT073
aaacgccagcaug

SEQ ID NO: 661531 - RNA, 13 nt, Escherichia coli CFT073
aaacgccagcagc

SEQ ID NO: 661532 - RNA, 14 nt, Escherichia coli CFT073
aaacgccaccagau

SEQ ID NO: 661533 - RNA, 19 nt, Escherichia coli CFT073
aaacgcaagguuguugaaa

SEQ ID NO: 661534 - RNA, 19 nt, Escherichia coli CFT073
aaacgauauccugcugaga

SEQ ID NO: 661535 - RNA, 14 nt, Escherichia coli CFT073
aaacgauaaauaac

SEQ ID NO: 661536 - RNA, 15 nt, Escherichia coli CFT073
aaacgauuaucaaca

SEQ ID NO: 661537 - RNA, 18 nt, Escherichia coli CFT073
aaacgauuaucaacacau

SEQ ID NO: 661538 - RNA, 23 nt, Escherichia coli CFT073
aaacgacagcguguuaaugccca

SEQ ID NO: 661539 - RNA, 13 nt, Escherichia coli CFT073
aaacgaccacucu

SEQ ID NO: 661540 - RNA, 17 nt, Escherichia coli CFT073
aaacgaccacucuuucg

SEQ ID NO: 661541 - RNA, 23 nt, Escherichia coli CFT073
aaacgacccugccacaguuuuuc

SEQ ID NO: 661542 - RNA, 15 nt, Escherichia coli CFT073
aaacgagccauaaaa

SEQ ID NO: 661543 - RNA, 19 nt, Escherichia coli CFT073
aaacgagccauaaaaucac

SEQ ID NO: 661544 - RNA, 13 nt, Escherichia coli CFT073
aaacgaaacccaa

SEQ ID NO: 661545 - RNA, 14 nt, Escherichia coli CFT073
aaacgaaacccaaa

SEQ ID NO: 661546 - RNA, 14 nt, Escherichia coli CFT073
aaaccuuguuuaau

SEQ ID NO: 661547 - RNA, 22 nt, Escherichia coli CFT073
aaaccuuagguugugaucaucc

SEQ ID NO: 661548 - RNA, 20 nt, Escherichia coli CFT073
aaacaagaucgcccugaggg

SEQ ID NO: 661549 - RNA, 19 nt, Escherichia coli CFT073
aaaccugacgcugcucagg

SEQ ID NO: 661550 - RNA, 23 nt, Escherichia coli CFT073
aaacgccggagagaaaaaucucc

SEQ ID NO: 661551 - RNA, 14 nt, Escherichia coli CFT073
aaacgcgccaggua

SEQ ID NO: 661552 - RNA, 21 nt, Escherichia coli CFT073
aaacgcgcggcaaugggguuu

SEQ ID NO: 661553 - RNA, 12 nt, Escherichia coli CFT073
aaacgcucggca

SEQ ID NO: 661554 - RNA, 18 nt, Escherichia coli CFT073
aaacgcucccagccaguc

SEQ ID NO: 661555 - RNA, 19 nt, Escherichia coli CFT073
aaacgcucccagccagucc

SEQ ID NO: 661556 - RNA, 20 nt, Escherichia coli CFT073
aaacgcuccugcuacaccau

SEQ ID NO: 661557 - RNA, 20 nt, Escherichia coli CFT073
aaacggaauuuaaaugacaa

SEQ ID NO: 661558 - RNA, 21 nt, Escherichia coli CFT073
aaacggaccgcaugcagcaug

SEQ ID NO: 661559 - RNA, 15 nt, Escherichia coli CFT073
aaacgcuucucaaga

SEQ ID NO: 661560 - RNA, 18 nt, Escherichia coli CFT073
aaacguagcggaaaucac

SEQ ID NO: 661561 - RNA, 20 nt, Escherichia coli CFT073
aaacguagcggaaaucacag

SEQ ID NO: 661562 - RNA, 23 nt, Escherichia coli CFT073
aaacguauuaugugaucaacaca

SEQ ID NO: 661563 - RNA, 15 nt, Escherichia coli CFT073
aaacguaaaugccag

SEQ ID NO: 661564 - RNA, 18 nt, Escherichia coli CFT073
aaacggucuacauugcuc

SEQ ID NO: 661565 - RNA, 15 nt, Escherichia coli CFT073
aaacgucuugucaac

SEQ ID NO: 661566 - RNA, 15 nt, Escherichia coli CFT073
aaacgugaauuuuua

SEQ ID NO: 661567 - RNA, 15 nt, Escherichia coli CFT073
aaacguggugccauu

SEQ ID NO: 661568 - RNA, 22 nt, Escherichia coli CFT073
aaacguuaacgccccacuccuc

SEQ ID NO: 661569 - RNA, 23 nt, Escherichia coli CFT073
aagcugauuuuauuucaaaauua

SEQ ID NO: 661570 - RNA, 20 nt, Escherichia coli CFT073
aagcugauaacgccacgcca

SEQ ID NO: 661571 - RNA, 23 nt, Escherichia coli CFT073
aagcugagguauuucgucuaagc

SEQ ID NO: 661572 - RNA, 22 nt, Escherichia coli CFT073
aagcugagcacaaaacaggucg

SEQ ID NO: 661573 - RNA, 14 nt, Escherichia coli CFT073
aagcugagcacaaa

SEQ ID NO: 661574 - RNA, 20 nt, Escherichia coli CFT073
aagcugacaggcgcugauga

SEQ ID NO: 661575 - RNA, 17 nt, Escherichia coli CFT073
aagcugucaccaaucag

SEQ ID NO: 661576 - RNA, 14 nt, Escherichia coli CFT073
aagcuguacccguu

SEQ ID NO: 661577 - RNA, 18 nt, Escherichia coli CFT073
aagcuuaucacagaggaa

SEQ ID NO: 661578 - RNA, 19 nt, Escherichia coli CFT073
aagcuguucagauacacca

SEQ ID NO: 661579 - RNA, 18 nt, Escherichia coli CFT073
aagcuguacacuucccag

SEQ ID NO: 661580 - RNA, 11 nt, Escherichia coli CFT073
aagcugcugcu

SEQ ID NO: 661581 - RNA, 13 nt, Escherichia coli CFT073
aagcugcugacau

SEQ ID NO: 661582 - RNA, 20 nt, Escherichia coli CFT073
aagcugcucggcaauuugug

SEQ ID NO: 661583 - RNA, 20 nt, Escherichia coli CFT073
aagcugcggauccugagcaa

SEQ ID NO: 661584 - RNA, 21 nt, Escherichia coli CFT073
aagcugcggauccugagcaaa

SEQ ID NO: 661585 - RNA, 17 nt, Escherichia coli CFT073
aagcuuuccggaaaaau

SEQ ID NO: 661586 - RNA, 16 nt, Escherichia coli CFT073
aaggagucagggagaa

SEQ ID NO: 661587 - RNA, 18 nt, Escherichia coli CFT073
aaggauaaaaaaggguga

SEQ ID NO: 661588 - RNA, 16 nt, Escherichia coli CFT073
aagccgcuaacagcag

SEQ ID NO: 661589 - RNA, 17 nt, Escherichia coli CFT073
aagccgcgaaacugcgu

SEQ ID NO: 661590 - RNA, 17 nt, Escherichia coli CFT073
aagcgcguccugaucga

SEQ ID NO: 661591 - RNA, 22 nt, Escherichia coli CFT073
aagccgauggugcuaagccccu

SEQ ID NO: 661592 - RNA, 20 nt, Escherichia coli CFT073
aagccgccgccaucuaccac

SEQ ID NO: 661593 - RNA, 15 nt, Escherichia coli CFT073
aagccgcauccggcg

SEQ ID NO: 661594 - RNA, 23 nt, Escherichia coli CFT073
aagccgcauccggcgacaggaac

SEQ ID NO: 661595 - RNA, 20 nt, Escherichia coli CFT073
aagcgcucccgcaggagcgc

SEQ ID NO: 661596 - RNA, 20 nt, Escherichia coli CFT073
aagcgcguuucugcgcuucu

SEQ ID NO: 661597 - RNA, 21 nt, Escherichia coli CFT073
aagcggcacugcucuuuaaca

SEQ ID NO: 661598 - RNA, 23 nt, Escherichia coli CFT073
aagcgucgcauccggcaucaacc

SEQ ID NO: 661599 - RNA, 13 nt, Escherichia coli CFT073
aagcuaaaccaau

SEQ ID NO: 661600 - RNA, 15 nt, Escherichia coli CFT073
aagcuaaaccaauaa

SEQ ID NO: 661601 - RNA, 19 nt, Escherichia coli CFT073
aagcguuccacgucacagg

SEQ ID NO: 661602 - RNA, 14 nt, Escherichia coli CFT073
aagcucguuguuua

SEQ ID NO: 661603 - RNA, 23 nt, Escherichia coli CFT073
aagcugaacagucgcugaucacc

SEQ ID NO: 661604 - RNA, 13 nt, Escherichia coli CFT073
aagcucucagcau

SEQ ID NO: 661605 - RNA, 14 nt, Escherichia coli CFT073
aaggcaacgcagcc

SEQ ID NO: 661606 - RNA, 23 nt, Escherichia coli CFT073
aaggcaacgcagccccagcgcau

SEQ ID NO: 661607 - RNA, 15 nt, Escherichia coli CFT073
aaggcgacaauaaau

SEQ ID NO: 661608 - RNA, 23 nt, Escherichia coli CFT073
aaggcgcauugcuggcugcggga

SEQ ID NO: 661609 - RNA, 18 nt, Escherichia coli CFT073
aaggcgcgagguuuuccu

SEQ ID NO: 661610 - RNA, 19 nt, Escherichia coli CFT073
aaggcgcgagguuuuccuu

SEQ ID NO: 661611 - RNA, 16 nt, Escherichia coli CFT073
aaggcgggaauaauuu

SEQ ID NO: 661612 - RNA, 18 nt, Escherichia coli CFT073
aagggugacagcaggaaa

SEQ ID NO: 661613 - RNA, 14 nt, Escherichia coli CFT073
aagggugcaggaga

SEQ ID NO: 661614 - RNA, 16 nt, Escherichia coli CFT073
aagguaacaccaguuu

SEQ ID NO: 661615 - RNA, 23 nt, Escherichia coli CFT073
aaggguauagaaaccauccagca

SEQ ID NO: 661616 - RNA, 19 nt, Escherichia coli CFT073
aaggguaugcuguaaacaa

SEQ ID NO: 661617 - RNA, 16 nt, Escherichia coli CFT073
aagggcagcaggauca

SEQ ID NO: 661618 - RNA, 16 nt, Escherichia coli CFT073
aagggaugcugugcuc

SEQ ID NO: 661619 - RNA, 16 nt, Escherichia coli CFT073
aaggcguuugaacuga

SEQ ID NO: 661620 - RNA, 17 nt, Escherichia coli CFT073
aaggcguuuuagccgca

SEQ ID NO: 661621 - RNA, 18 nt, Escherichia coli CFT073
aaggcguuaaacuggaaa

SEQ ID NO: 661622 - RNA, 19 nt, Escherichia coli CFT073
aaggcguuaaacuggaaaa

SEQ ID NO: 661623 - RNA, 22 nt, Escherichia coli CFT073
aaggcgggaauaauuucccgcc

SEQ ID NO: 661624 - RNA, 19 nt, Escherichia coli CFT073
aaggugaacgccaccaacg

SEQ ID NO: 661625 - RNA, 22 nt, Escherichia coli CFT073
aaggugaguuuugcgacucacc

SEQ ID NO: 661626 - RNA, 20 nt, Escherichia coli CFT073
aagguauagucacaaaauaa

SEQ ID NO: 661627 - RNA, 18 nt, Escherichia coli CFT073
aagguaucgcgaaaaaaa

SEQ ID NO: 661628 - RNA, 19 nt, Escherichia coli CFT073
aagguaccgacgaucaaca

SEQ ID NO: 661629 - RNA, 22 nt, Escherichia coli CFT073
aagguaccgacgaucaacagaa

SEQ ID NO: 661630 - RNA, 20 nt, Escherichia coli CFT073
aaggugauuuauuucucauu

SEQ ID NO: 661631 - RNA, 16 nt, Escherichia coli CFT073
aaggugcauugaaggc

SEQ ID NO: 661632 - RNA, 23 nt, Escherichia coli CFT073
aaggugccuuuaauaccaucggc

SEQ ID NO: 661633 - RNA, 20 nt, Escherichia coli CFT073
aaggugcguuaccagcuaag

SEQ ID NO: 661634 - RNA, 22 nt, Escherichia coli CFT073
  misc_feature (6)..(6): n is a, c, g or u
aaggunauuuagcgaucuguuc

SEQ ID NO: 661635 - RNA, 16 nt, Escherichia coli CFT073
aagguuaaaccgccag

SEQ ID NO: 661636 - RNA, 17 nt, Escherichia coli CFT073
aagguuaacuguggcgu

SEQ ID NO: 661637 - RNA, 19 nt, Escherichia coli CFT073
aagguggucagacggaaca

SEQ ID NO: 661638 - RNA, 19 nt, Escherichia coli CFT073
aagguugccauaucuuccc

SEQ ID NO: 661639 - RNA, 12 nt, Escherichia coli CFT073
aagguuccugca

SEQ ID NO: 661640 - RNA, 14 nt, Escherichia coli CFT073
aagguuguugaaag

SEQ ID NO: 661641 - RNA, 17 nt, Escherichia coli CFT073
aagguuuaauugucugu

SEQ ID NO: 661642 - RNA, 16 nt, Escherichia coli CFT073
aaguaaauaagaaaau

SEQ ID NO: 661643 - RNA, 21 nt, Escherichia coli CFT073
aagcauuacgucgccaucuuc

SEQ ID NO: 661644 - RNA, 17 nt, Escherichia coli CFT073
aagccaaauccagcacc

SEQ ID NO: 661645 - RNA, 14 nt, Escherichia coli CFT073
aagccaacagcagc

SEQ ID NO: 661646 - RNA, 15 nt, Escherichia coli CFT073
aagccaacagcagcc

SEQ ID NO: 661647 - RNA, 15 nt, Escherichia coli CFT073
aagccaagccagagc

SEQ ID NO: 661648 - RNA, 17 nt, Escherichia coli CFT073
aagccaauuacaaaaag

SEQ ID NO: 661649 - RNA, 18 nt, Escherichia coli CFT073
aagccaaucugcuggaaa

SEQ ID NO: 661650 - RNA, 12 nt, Escherichia coli CFT073
aagccaaucugu

SEQ ID NO: 661651 - RNA, 14 nt, Escherichia coli CFT073
aagccaaucugugu

SEQ ID NO: 661652 - RNA, 17 nt, Escherichia coli CFT073
aagccaccacgccaaga

SEQ ID NO: 661653 - RNA, 20 nt, Escherichia coli CFT073
aagccaccgaacaaaacagc

SEQ ID NO: 661654 - RNA, 15 nt, Escherichia coli CFT073
aagccagcauacagc

SEQ ID NO: 661655 - RNA, 23 nt, Escherichia coli CFT073
aagccagcggcaccgaggaugaa

SEQ ID NO: 661656 - RNA, 21 nt, Escherichia coli CFT073
aagccagauauuaagcggcac

SEQ ID NO: 661657 - RNA, 18 nt, Escherichia coli CFT073
aagccaucaagcgaaaau

SEQ ID NO: 661658 - RNA, 15 nt, Escherichia coli CFT073
aagccaucaccggca

SEQ ID NO: 661659 - RNA, 20 nt, Escherichia coli CFT073
aagccauucuggcgcaacac

SEQ ID NO: 661660 - RNA, 20 nt, Escherichia coli CFT073
aagcccaccacaaaccagcc

SEQ ID NO: 661661 - RNA, 18 nt, Escherichia coli CFT073
aagcccauaccacagcaa

SEQ ID NO: 661662 - RNA, 21 nt, Escherichia coli CFT073
aagcccaguaccgccagugca

SEQ ID NO: 661663 - RNA, 20 nt, Escherichia coli CFT073
aagcccaucaccgccaggcc

SEQ ID NO: 661664 - RNA, 20 nt, Escherichia coli CFT073
aagcccaucguugaaaaaau

SEQ ID NO: 661665 - RNA, 15 nt, Escherichia coli CFT073
aagccccgcagccau

SEQ ID NO: 661666 - RNA, 21 nt, Escherichia coli CFT073
aagccccugagcgaauacccc

SEQ ID NO: 661667 - RNA, 18 nt, Escherichia coli CFT073
aagcccgauguuaauuuc

SEQ ID NO: 661668 - RNA, 17 nt, Escherichia coli CFT073
aagccgaacagucgcug

SEQ ID NO: 661669 - RNA, 16 nt, Escherichia coli CFT073
aagcccggaugcgcgu

SEQ ID NO: 661670 - RNA, 24 nt, Escherichia coli CFT073
aagcccgcagcguccagcgccugg

SEQ ID NO: 661671 - RNA, 17 nt, Escherichia coli CFT073
aagcaggguugcagcgg

SEQ ID NO: 661672 - RNA, 20 nt, Escherichia coli CFT073
aagcagguagcgccuuuacu

SEQ ID NO: 661673 - RNA, 18 nt, Escherichia coli CFT073
aagcagugaauacccaga

SEQ ID NO: 661674 - RNA, 14 nt, Escherichia coli CFT073
aagcaguggcacua

SEQ ID NO: 661675 - RNA, 16 nt, Escherichia coli CFT073
aagcaguuuauaaaau

SEQ ID NO: 661676 - RNA, 17 nt, Escherichia coli CFT073
aagcauaaccgagcaga

SEQ ID NO: 661677 - RNA, 13 nt, Escherichia coli CFT073
aagcauaccggac

SEQ ID NO: 661678 - RNA, 13 nt, Escherichia coli CFT073
aagcauagcccca

SEQ ID NO: 661679 - RNA, 12 nt, Escherichia coli CFT073
aagcaucugcuu

SEQ ID NO: 661680 - RNA, 14 nt, Escherichia coli CFT073
aagcaucauuuugu

SEQ ID NO: 661681 - RNA, 21 nt, Escherichia coli CFT073
aagcaucgcaacgcaucuuuu

SEQ ID NO: 661682 - RNA, 17 nt, Escherichia coli CFT073
aagcagcauacccaccg

SEQ ID NO: 661683 - RNA, 15 nt, Escherichia coli CFT073
aagcagcuccagaau

SEQ ID NO: 661684 - RNA, 13 nt, Escherichia coli CFT073
aagcagcgcugga

SEQ ID NO: 661685 - RNA, 15 nt, Escherichia coli CFT073
aagcagcgcuggaga

SEQ ID NO: 661686 - RNA, 16 nt, Escherichia coli CFT073
aagcagcgcuggagag

SEQ ID NO: 661687 - RNA, 18 nt, Escherichia coli CFT073
aagcagaucggcauucac

SEQ ID NO: 661688 - RNA, 19 nt, Escherichia coli CFT073
aagcaccgaacaagaaaca

SEQ ID NO: 661689 - RNA, 15 nt, Escherichia coli CFT073
aagcaccuaaaucca

SEQ ID NO: 661690 - RNA, 13 nt, Escherichia coli CFT073
aagcacggcauca

SEQ ID NO: 661691 - RNA, 16 nt, Escherichia coli CFT073
aagcacggcaucaaug

SEQ ID NO: 661692 - RNA, 19 nt, Escherichia coli CFT073
aagcacucguaagaggcgu

SEQ ID NO: 661693 - RNA, 20 nt, Escherichia coli CFT073
aagcacuuuaucgaucacau

SEQ ID NO: 661694 - RNA, 19 nt, Escherichia coli CFT073
aagcagaaggccaguggua

SEQ ID NO: 661695 - RNA, 19 nt, Escherichia coli CFT073
aagcacuguucgccgcagc

SEQ ID NO: 661696 - RNA, 22 nt, Escherichia coli CFT073
aagcacuguucgccgcagccag

SEQ ID NO: 661697 - RNA, 19 nt, Escherichia coli CFT073
aagcacuugcaggaacaau

SEQ ID NO: 661698 - RNA, 16 nt, Escherichia coli CFT073
aagcacaaagcaauau

SEQ ID NO: 661699 - RNA, 15 nt, Escherichia coli CFT073
aagcaauuauucaua

SEQ ID NO: 661700 - RNA, 20 nt, Escherichia coli CFT073
aagcacaauccgccaggaca

SEQ ID NO: 661701 - RNA, 15 nt, Escherichia coli CFT073
aagcaccacuccuca

SEQ ID NO: 661702 - RNA, 16 nt, Escherichia coli CFT073
aagcaauaauuucaac

SEQ ID NO: 661703 - RNA, 24 nt, Escherichia coli CFT073
aagcaauaauuucaacagauuuug

SEQ ID NO: 661704 - RNA, 13 nt, Escherichia coli CFT073
aagcaauccauac

SEQ ID NO: 661705 - RNA, 21 nt, Escherichia coli CFT073
aagcaauuaacagugacagug

SEQ ID NO: 661706 - RNA, 21 nt, Escherichia coli CFT073
aagcaauaagggcugacaguu

SEQ ID NO: 661707 - RNA, 14 nt, Escherichia coli CFT073
aagcaaucaagccc

SEQ ID NO: 661708 - RNA, 16 nt, Escherichia coli CFT073
aagcaaucaagcccug

SEQ ID NO: 661709 - RNA, 13 nt, Escherichia coli CFT073
aagcaauauuaug

SEQ ID NO: 661710 - RNA, 16 nt, Escherichia coli CFT073
aagauuguucuuuauc

SEQ ID NO: 661711 - RNA, 22 nt, Escherichia coli CFT073
aagcaaaauaaccggcaagcaa

SEQ ID NO: 661712 - RNA, 14 nt, Escherichia coli CFT073
aagcaaaaauaaau

SEQ ID NO: 661713 - RNA, 16 nt, Escherichia coli CFT073
aagcaaaaaaagaauc

SEQ ID NO: 661714 - RNA, 15 nt, Escherichia coli CFT073
aagcaaaaaagaagg

SEQ ID NO: 661715 - RNA, 12 nt, Escherichia coli CFT073
aagcaacuccau

SEQ ID NO: 661716 - RNA, 15 nt, Escherichia coli CFT073
aagcaaauaauuccc

SEQ ID NO: 661717 - RNA, 19 nt, Escherichia coli CFT073
aagcaaacugugcaaugaa

SEQ ID NO: 661718 - RNA, 21 nt, Escherichia coli CFT073
aagcaaacugugcaaugaaaa

SEQ ID NO: 661719 - RNA, 12 nt, Escherichia coli CFT073
aagcaacaaagu

SEQ ID NO: 661720 - RNA, 15 nt, Escherichia coli CFT073
aagaucuuauugcca

SEQ ID NO: 661721 - RNA, 12 nt, Escherichia coli CFT073
aagaugaagagu

SEQ ID NO: 661722 - RNA, 19 nt, Escherichia coli CFT073
aagaugaaauaguugcauu

SEQ ID NO: 661723 - RNA, 12 nt, Escherichia coli CFT073
aagaucuuugcg

SEQ ID NO: 661724 - RNA, 14 nt, Escherichia coli CFT073
aagaugaagaaaau

SEQ ID NO: 661725 - RNA, 13 nt, Escherichia coli CFT073
aagaauuaaaaua

SEQ ID NO: 661726 - RNA, 14 nt, Escherichia coli CFT073
aagaauuaaaauau

SEQ ID NO: 661727 - RNA, 21 nt, Escherichia coli CFT073
aagaauuaaaauaucaggcug

SEQ ID NO: 661728 - RNA, 14 nt, Escherichia coli CFT073
aagauguagucugu

SEQ ID NO: 661729 - RNA, 22 nt, Escherichia coli CFT073
aagauguuguuuuccguugugc

SEQ ID NO: 661730 - RNA, 20 nt, Escherichia coli CFT073
aagaugugguuagcuggaga

SEQ ID NO: 661731 - RNA, 12 nt, Escherichia coli CFT073
aagauguuuugc

SEQ ID NO: 661732 - RNA, 16 nt, Escherichia coli CFT073
aagauguaaucgccuu

SEQ ID NO: 661733 - RNA, 17 nt, Escherichia coli CFT073
aaaaauaaucucaccau

SEQ ID NO: 661734 - RNA, 16 nt, Escherichia coli CFT073
aaaaauaccgagcagc

SEQ ID NO: 661735 - RNA, 22 nt, Escherichia coli CFT073
aauaacucaaguuguaauuccu

SEQ ID NO: 661736 - RNA, 20 nt, Escherichia coli CFT073
aauaauaccguucucuuuau

SEQ ID NO: 661737 - RNA, 19 nt, Escherichia coli CFT073
aauaacgugaucgaacauu

SEQ ID NO: 661738 - RNA, 21 nt, Escherichia coli CFT073
aauaacgccccggcaaaacca

SEQ ID NO: 661739 - RNA, 15 nt, Escherichia coli CFT073
aauaacggccuggca

SEQ ID NO: 661740 - RNA, 20 nt, Escherichia coli CFT073
aauaacggcugauaacaaua

SEQ ID NO: 661741 - RNA, 21 nt, Escherichia coli CFT073
aauaacgagcgagaauacaua

SEQ ID NO: 661742 - RNA, 15 nt, Escherichia coli CFT073
aauaacgaucaucac

SEQ ID NO: 661743 - RNA, 14 nt, Escherichia coli CFT073
aauaaccuuauuau

SEQ ID NO: 661744 - RNA, 19 nt, Escherichia coli CFT073
aauaaccucaugguuuuua

SEQ ID NO: 661745 - RNA, 22 nt, Escherichia coli CFT073
aauaaccucaugguuuuuaugg

SEQ ID NO: 661746 - RNA, 13 nt, Escherichia coli CFT073
aaaaauauauucc

SEQ ID NO: 661747 - RNA, 18 nt, Escherichia coli CFT073
aaaaauauauuccuauau

SEQ ID NO: 661748 - RNA, 12 nt, Escherichia coli CFT073
aaaaaucaacag

SEQ ID NO: 661749 - RNA, 21 nt, Escherichia coli CFT073
aaaaaucaccguacuccugug

SEQ ID NO: 661750 - RNA, 20 nt, Escherichia coli CFT073
aauaaucaaaugaaugccaa

SEQ ID NO: 661751 - RNA, 14 nt, Escherichia coli CFT073
aauaauauuucccc

SEQ ID NO: 661752 - RNA, 15 nt, Escherichia coli CFT073
aauaauauccgguuu

SEQ ID NO: 661753 - RNA, 14 nt, Escherichia coli CFT073
aauaaucaccacac

SEQ ID NO: 661754 - RNA, 12 nt, Escherichia coli CFT073
aauaaucaccag

SEQ ID NO: 661755 - RNA, 13 nt, Escherichia coli CFT073
aauaaucguuccu

SEQ ID NO: 661756 - RNA, 15 nt, Escherichia coli CFT073
aauaaucucaauauc

SEQ ID NO: 661757 - RNA, 16 nt, Escherichia coli CFT073
aauaaucugaaaacca

SEQ ID NO: 661758 - RNA, 18 nt, Escherichia coli CFT073
aauaaucgggaauacaga

SEQ ID NO: 661759 - RNA, 22 nt, Escherichia coli CFT073
aauaaucgggaauacagaaaau

SEQ ID NO: 661760 - RNA, 17 nt, Escherichia coli CFT073
aauaaucgacgaggaaa

SEQ ID NO: 661761 - RNA, 22 nt, Escherichia coli CFT073
aauaaucgacgaggaaaaugau

SEQ ID NO: 661762 - RNA, 22 nt, Escherichia coli CFT073
aauaaucgaucacguaauaaaa

SEQ ID NO: 661763 - RNA, 16 nt, Escherichia coli CFT073
aauaauucaaaaaccu

SEQ ID NO: 661764 - RNA, 14 nt, Escherichia coli CFT073
aauaauucaucuuu

SEQ ID NO: 661765 - RNA, 21 nt, Escherichia coli CFT073
aauaauugccauuacuacaaa

SEQ ID NO: 661766 - RNA, 13 nt, Escherichia coli CFT073
aauaauugugcaa

SEQ ID NO: 661767 - RNA, 17 nt, Escherichia coli CFT073
aauacagcaauggaaaa

SEQ ID NO: 661768 - RNA, 20 nt, Escherichia coli CFT073
aauacagcaauggaaaaagu

SEQ ID NO: 661769 - RNA, 18 nt, Escherichia coli CFT073
aauacaggcuacucccag

SEQ ID NO: 661770 - RNA, 21 nt, Escherichia coli CFT073
aauacagccagccagcaccag

SEQ ID NO: 661771 - RNA, 16 nt, Escherichia coli CFT073
aauagagacaaaguaa

SEQ ID NO: 661772 - RNA, 20 nt, Escherichia coli CFT073
aauagaaccuaagaaccaga

SEQ ID NO: 661773 - RNA, 19 nt, Escherichia coli CFT073
aauagaaaguugccagaua

SEQ ID NO: 661774 - RNA, 21 nt, Escherichia coli CFT073
aauacuucaacauaagcaaau

SEQ ID NO: 661775 - RNA, 13 nt, Escherichia coli CFT073
aauacucauuaau

SEQ ID NO: 661776 - RNA, 17 nt, Escherichia coli CFT073
aauacucauuaauuuca

SEQ ID NO: 661777 - RNA, 20 nt, Escherichia coli CFT073
aauacucauuaauuucaggc

SEQ ID NO: 661778 - RNA, 14 nt, Escherichia coli CFT073
aauacgaaucacau

SEQ ID NO: 661779 - RNA, 22 nt, Escherichia coli CFT073
aauaccgcgagauauccacauu

SEQ ID NO: 661780 - RNA, 17 nt, Escherichia coli CFT073
aauaccguaugauguau

SEQ ID NO: 661781 - RNA, 16 nt, Escherichia coli CFT073
aauaccgccaacaugc

SEQ ID NO: 661782 - RNA, 23 nt, Escherichia coli CFT073
aauaccgaagaguaaccaaacgu

SEQ ID NO: 661783 - RNA, 20 nt, Escherichia coli CFT073
aauacauauagccaaaacuc

SEQ ID NO: 661784 - RNA, 14 nt, Escherichia coli CFT073
aauacauagaagcu

SEQ ID NO: 661785 - RNA, 20 nt, Escherichia coli CFT073
aauacgcucgaacagcuggu

SEQ ID NO: 661786 - RNA, 15 nt, Escherichia coli CFT073
aauacgcgauuuuuc

SEQ ID NO: 661787 - RNA, 20 nt, Escherichia coli CFT073
aauacgcgguacguuuucca

SEQ ID NO: 661788 - RNA, 24 nt, Escherichia coli CFT073
aauacgcccgguggcgguuuuguc

SEQ ID NO: 661789 - RNA, 15 nt, Escherichia coli CFT073
aauacgccccagaau

SEQ ID NO: 661790 - RNA, 17 nt, Escherichia coli CFT073
aauacgcuaaauaaaca

SEQ ID NO: 661791 - RNA, 20 nt, Escherichia coli CFT073
aauacgacugauaucugccc

SEQ ID NO: 661792 - RNA, 22 nt, Escherichia coli CFT073
aauacgagcgcguaguucagga

SEQ ID NO: 661793 - RNA, 13 nt, Escherichia coli CFT073
aauacgcaccaca

SEQ ID NO: 661794 - RNA, 22 nt, Escherichia coli CFT073
aauacgcaucauauucauagca

SEQ ID NO: 661795 - RNA, 15 nt, Escherichia coli CFT073
aauacgucuuuagga

SEQ ID NO: 661796 - RNA, 20 nt, Escherichia coli CFT073
aauacuaaauaugaaaaugc

SEQ ID NO: 661797 - RNA, 19 nt, Escherichia coli CFT073
aauacguuucagccacgcg

SEQ ID NO: 661798 - RNA, 19 nt, Escherichia coli CFT073
aauacuaaaaagcgcgucc

SEQ ID NO: 661799 - RNA, 22 nt, Escherichia coli CFT073
aaguaaucauaauuauaauaaa

SEQ ID NO: 661800 - RNA, 13 nt, Escherichia coli CFT073
aaguaaucuauau

SEQ ID NO: 661801 - RNA, 15 nt, Escherichia coli CFT073
aaguaaauaagaaaa

SEQ ID NO: 661802 - RNA, 19 nt, Escherichia coli CFT073
aaguaacaauagcgaacag

SEQ ID NO: 661803 - RNA, 14 nt, Escherichia coli CFT073
aaguggaaaucccc

SEQ ID NO: 661804 - RNA, 14 nt, Escherichia coli CFT073
aaguggacgaacag

SEQ ID NO: 661805 - RNA, 19 nt, Escherichia coli CFT073
aagugcagccauuuuacuc

SEQ ID NO: 661806 - RNA, 17 nt, Escherichia coli CFT073
aaguggagcccucaagc

SEQ ID NO: 661807 - RNA, 20 nt, Escherichia coli CFT073
aaguggcgacaaaguggcgg

SEQ ID NO: 661808 - RNA, 17 nt, Escherichia coli CFT073
aaguggcgauacagugc

SEQ ID NO: 661809 - RNA, 23 nt, Escherichia coli CFT073
aaguggcgcagagccugaauaaa

SEQ ID NO: 661810 - RNA, 23 nt, Escherichia coli CFT073
aaguggcggggucgugcagaacg

SEQ ID NO: 661811 - RNA, 16 nt, Escherichia coli CFT073
aagugggcgacaaagu

SEQ ID NO: 661812 - RNA, 17 nt, Escherichia coli CFT073
aagugggcgacaaaguu

SEQ ID NO: 661813 - RNA, 22 nt, Escherichia coli CFT073
aagugggcgacaaaguugaagc

SEQ ID NO: 661814 - RNA, 15 nt, Escherichia coli CFT073
aaguggcugaccauc

SEQ ID NO: 661815 - RNA, 21 nt, Escherichia coli CFT073
aaguuucccagcuuauuaaca

SEQ ID NO: 661816 - RNA, 19 nt, Escherichia coli CFT073
aaguuuauuacucagcgca

SEQ ID NO: 661817 - RNA, 20 nt, Escherichia coli CFT073
aaguuugcaaacccacagag

SEQ ID NO: 661818 - RNA, 20 nt, Escherichia coli CFT073
aaguuugcaacuuucgcuuu

SEQ ID NO: 661819 - RNA, 22 nt, Escherichia coli CFT073
aaguuggcgauaaaguugaagc

SEQ ID NO: 661820 - RNA, 18 nt, Escherichia coli CFT073
aaguuggcguucacugcc

SEQ ID NO: 661821 - RNA, 19 nt, Escherichia coli CFT073
aaguuggcguucacugccg

SEQ ID NO: 661822 - RNA, 19 nt, Escherichia coli CFT073
aaguugauuuuguaaucaa

SEQ ID NO: 661823 - RNA, 21 nt, Escherichia coli CFT073
aaguugaaaaccauaaugaug

SEQ ID NO: 661824 - RNA, 18 nt, Escherichia coli CFT073
aaguucgaaccaacaaua

SEQ ID NO: 661825 - RNA, 17 nt, Escherichia coli CFT073
aagugugcaaacgauaa

SEQ ID NO: 661826 - RNA, 22 nt, Escherichia coli CFT073
aaguuagaguagccaauaccaa

SEQ ID NO: 661827 - RNA, 17 nt, Escherichia coli CFT073
aaguuagacggaaaaga

SEQ ID NO: 661828 - RNA, 19 nt, Escherichia coli CFT073
aaguguccaguugagcucc

SEQ ID NO: 661829 - RNA, 23 nt, Escherichia coli CFT073
aaguguagucagcaauuuggcuu

SEQ ID NO: 661830 - RNA, 18 nt, Escherichia coli CFT073
aaguggugaugauacuug

SEQ ID NO: 661831 - RNA, 13 nt, Escherichia coli CFT073
aaguggugauuca

SEQ ID NO: 661832 - RNA, 21 nt, Escherichia coli CFT073
aaguggugauugauugucauu

SEQ ID NO: 661833 - RNA, 17 nt, Escherichia coli CFT073
aauaaauuuuuucugac

SEQ ID NO: 661834 - RNA, 20 nt, Escherichia coli CFT073
aauaaauuugggugcaauga

SEQ ID NO: 661835 - RNA, 13 nt, Escherichia coli CFT073
aauaacacugagc

SEQ ID NO: 661836 - RNA, 16 nt, Escherichia coli CFT073
aauaacagugauugcu

SEQ ID NO: 661837 - RNA, 16 nt, Escherichia coli CFT073
aauaaccgucuuugcu

SEQ ID NO: 661838 - RNA, 18 nt, Escherichia coli CFT073
aauaaacgcgcagggugc

SEQ ID NO: 661839 - RNA, 15 nt, Escherichia coli CFT073
aauaaacgguacacg

SEQ ID NO: 661840 - RNA, 14 nt, Escherichia coli CFT073
aauaaaagccagga

SEQ ID NO: 661841 - RNA, 12 nt, Escherichia coli CFT073
aauaaaauaacc

SEQ ID NO: 661842 - RNA, 11 nt, Escherichia coli CFT073
aauaaaagaaa

SEQ ID NO: 661843 - RNA, 15 nt, Escherichia coli CFT073
aauaaaacaagcagc

SEQ ID NO: 661844 - RNA, 14 nt, Escherichia coli CFT073
aauaaaacagggcg

SEQ ID NO: 661845 - RNA, 14 nt, Escherichia coli CFT073
aauaaaacaucacc

SEQ ID NO: 661846 - RNA, 18 nt, Escherichia coli CFT073
aauaaacagcagauggca

SEQ ID NO: 661847 - RNA, 14 nt, Escherichia coli CFT073
aauaaacacugcua

SEQ ID NO: 661848 - RNA, 14 nt, Escherichia coli CFT073
aauaaacaacaaaa

SEQ ID NO: 661849 - RNA, 12 nt, Escherichia coli CFT073
aaguuuuccuca

SEQ ID NO: 661850 - RNA, 13 nt, Escherichia coli CFT073
aaguuuuccucag

SEQ ID NO: 661851 - RNA, 16 nt, Escherichia coli CFT073
aaguuuguuaaccacc

SEQ ID NO: 661852 - RNA, 19 nt, Escherichia coli CFT073
aaguuuugucgcugauucg

SEQ ID NO: 661853 - RNA, 14 nt, Escherichia coli CFT073
aauaaaaagaauga

SEQ ID NO: 661854 - RNA, 13 nt, Escherichia coli CFT073
aauaaaacaaaua

SEQ ID NO: 661855 - RNA, 13 nt, Escherichia coli CFT073
aagaaggaaaaua

SEQ ID NO: 661856 - RNA, 16 nt, Escherichia coli CFT073
aagaaggaaaauacag

SEQ ID NO: 661857 - RNA, 16 nt, Escherichia coli CFT073
aagaagugcucuuugc

SEQ ID NO: 661858 - RNA, 16 nt, Escherichia coli CFT073
aagaauaucuucuguu

SEQ ID NO: 661859 - RNA, 17 nt, Escherichia coli CFT073
aagaaucaugccaaaaa

SEQ ID NO: 661860 - RNA, 16 nt, Escherichia coli CFT073
aagaagaucagcaaau

SEQ ID NO: 661861 - RNA, 12 nt, Escherichia coli CFT073
aagaagaucauc

SEQ ID NO: 661862 - RNA, 23 nt, Escherichia coli CFT073
aagaagcggcuauucuggccgcu

SEQ ID NO: 661863 - RNA, 18 nt, Escherichia coli CFT073
aagaacuaguagcaugaa

SEQ ID NO: 661864 - RNA, 12 nt, Escherichia coli CFT073
aagaaagcuuug

SEQ ID NO: 661865 - RNA, 21 nt, Escherichia coli CFT073
aagaaagauacaaaacaugug

SEQ ID NO: 661866 - RNA, 15 nt, Escherichia coli CFT073
aagaaccugaacgcc

SEQ ID NO: 661867 - RNA, 14 nt, Escherichia coli CFT073
aagaacccggcaau

SEQ ID NO: 661868 - RNA, 22 nt, Escherichia coli CFT073
aagaaccaugcaaucacugcca

SEQ ID NO: 661869 - RNA, 15 nt, Escherichia coli CFT073
aagaaccccagccag

SEQ ID NO: 661870 - RNA, 18 nt, Escherichia coli CFT073
aagaaccccagccaggug

SEQ ID NO: 661871 - RNA, 16 nt, Escherichia coli CFT073
aagaaccaagccugcu

SEQ ID NO: 661872 - RNA, 22 nt, Escherichia coli CFT073
aagaaacggaagccccagguca

SEQ ID NO: 661873 - RNA, 20 nt, Escherichia coli CFT073
aagaaacggagccuuucggc

SEQ ID NO: 661874 - RNA, 17 nt, Escherichia coli CFT073
aagaaaacguuccacgc

SEQ ID NO: 661875 - RNA, 13 nt, Escherichia coli CFT073
aagaaaagcagug

SEQ ID NO: 661876 - RNA, 12 nt, Escherichia coli CFT073
aagaaaacauuu

SEQ ID NO: 661877 - RNA, 22 nt, Escherichia coli CFT073
aagaaaacauuuuaaacaucag

SEQ ID NO: 661878 - RNA, 18 nt, Escherichia coli CFT073
aagaaaaaaggugaguuu

SEQ ID NO: 661879 - RNA, 19 nt, Escherichia coli CFT073
aagaaaaaccguauucauc

SEQ ID NO: 661880 - RNA, 18 nt, Escherichia coli CFT073
aacuugcgacagccaucc

SEQ ID NO: 661881 - RNA, 13 nt, Escherichia coli CFT073
aacuugccaggcc

SEQ ID NO: 661882 - RNA, 21 nt, Escherichia coli CFT073
aacuuaucuuauucccacuuu

SEQ ID NO: 661883 - RNA, 18 nt, Escherichia coli CFT073
aacuuauggcguacugaa

SEQ ID NO: 661884 - RNA, 17 nt, Escherichia coli CFT073
aacuuaucggaacagua

SEQ ID NO: 661885 - RNA, 11 nt, Escherichia coli CFT073
aacuuaucaag

SEQ ID NO: 661886 - RNA, 18 nt, Escherichia coli CFT073
aacuuaucaagaaagcuu

SEQ ID NO: 661887 - RNA, 23 nt, Escherichia coli CFT073
aacuuaucaucgcaaaugaugca

SEQ ID NO: 661888 - RNA, 22 nt, Escherichia coli CFT073
aacuucuuuacuggcuuucauu

SEQ ID NO: 661889 - RNA, 19 nt, Escherichia coli CFT073
aacuucuuaaaaugaugcu

SEQ ID NO: 661890 - RNA, 14 nt, Escherichia coli CFT073
aacuucuucaguuu

SEQ ID NO: 661891 - RNA, 14 nt, Escherichia coli CFT073
aacuucaccagcac

SEQ ID NO: 661892 - RNA, 20 nt, Escherichia coli CFT073
aacuucaccagcacuucgcu

SEQ ID NO: 661893 - RNA, 21 nt, Escherichia coli CFT073
aacuucaccgguucaucacga

SEQ ID NO: 661894 - RNA, 17 nt, Escherichia coli CFT073
aacuugaaguaugacga

SEQ ID NO: 661895 - RNA, 16 nt, Escherichia coli CFT073
aacuggcugaugcugg

SEQ ID NO: 661896 - RNA, 18 nt, Escherichia coli CFT073
aacuggcugaugcuggca

SEQ ID NO: 661897 - RNA, 17 nt, Escherichia coli CFT073
aacugggagauaaaauc

SEQ ID NO: 661898 - RNA, 18 nt, Escherichia coli CFT073
aacugguauaggccaugc

SEQ ID NO: 661899 - RNA, 20 nt, Escherichia coli CFT073
aacugguugaaauaaaccag

SEQ ID NO: 661900 - RNA, 12 nt, Escherichia coli CFT073
aacuuaagucuc

SEQ ID NO: 661901 - RNA, 17 nt, Escherichia coli CFT073
aacucaaaaaaaauuuu

SEQ ID NO: 661902 - RNA, 20 nt, Escherichia coli CFT073
aacucaaaaauaaucaucuc

SEQ ID NO: 661903 - RNA, 23 nt, Escherichia coli CFT073
aacucuuugggcagaaaauccag

SEQ ID NO: 661904 - RNA, 19 nt, Escherichia coli CFT073
aacucuucugaaaagguua

SEQ ID NO: 661905 - RNA, 19 nt, Escherichia coli CFT073
aacucaaaaauaaucaucu

SEQ ID NO: 661906 - RNA, 17 nt, Escherichia coli CFT073
aacucaagcuaaaccaa

SEQ ID NO: 661907 - RNA, 19 nt, Escherichia coli CFT073
aacucaagcuaaaccaaua

SEQ ID NO: 661908 - RNA, 19 nt, Escherichia coli CFT073
aacucuuccgggaaaacau

SEQ ID NO: 661909 - RNA, 20 nt, Escherichia coli CFT073
aacugauuuucaucuucuuc

SEQ ID NO: 661910 - RNA, 20 nt, Escherichia coli CFT073
aacugcaaggagagccagua

SEQ ID NO: 661911 - RNA, 16 nt, Escherichia coli CFT073
aacugauuuucaucuu

SEQ ID NO: 661912 - RNA, 18 nt, Escherichia coli CFT073
aacugauuuagcaucagc

SEQ ID NO: 661913 - RNA, 23 nt, Escherichia coli CFT073
aacucuuucugacgaauuaccaa

SEQ ID NO: 661914 - RNA, 13 nt, Escherichia coli CFT073
aacugaacuugcu

SEQ ID NO: 661915 - RNA, 23 nt, Escherichia coli CFT073
aacugaucuuuaucaagcaccaa

SEQ ID NO: 661916 - RNA, 21 nt, Escherichia coli CFT073
aacugcuggacgauuucaccc

SEQ ID NO: 661917 - RNA, 15 nt, Escherichia coli CFT073
aacugcuguugcugc

SEQ ID NO: 661918 - RNA, 23 nt, Escherichia coli CFT073
aacugcucguucagcacuucacc

SEQ ID NO: 661919 - RNA, 20 nt, Escherichia coli CFT073
aacugcguagaguccagcgc

SEQ ID NO: 661920 - RNA, 15 nt, Escherichia coli CFT073
aacugcgugugacaa

SEQ ID NO: 661921 - RNA, 16 nt, Escherichia coli CFT073
aacguuuuaagcaaau

SEQ ID NO: 661922 - RNA, 11 nt, Escherichia coli CFT073
aacguuuucac

SEQ ID NO: 661923 - RNA, 14 nt, Escherichia coli CFT073
aacguuuaucugcc

SEQ ID NO: 661924 - RNA, 17 nt, Escherichia coli CFT073
aacguuuaccuuugcug

SEQ ID NO: 661925 - RNA, 21 nt, Escherichia coli CFT073
aacguucugcuguucuucugc

SEQ ID NO: 661926 - RNA, 17 nt, Escherichia coli CFT073
aacguugggugcaauca

SEQ ID NO: 661927 - RNA, 23 nt, Escherichia coli CFT073
aacgugguuuaccaccagcggaa

SEQ ID NO: 661928 - RNA, 14 nt, Escherichia coli CFT073
aacgugggccaggc

SEQ ID NO: 661929 - RNA, 17 nt, Escherichia coli CFT073
aacgugccacugacauc

SEQ ID NO: 661930 - RNA, 15 nt, Escherichia coli CFT073
aacguuaccuuuaau

SEQ ID NO: 661931 - RNA, 19 nt, Escherichia coli CFT073
aacguuauccguuaacgcc

SEQ ID NO: 661932 - RNA, 13 nt, Escherichia coli CFT073
aacgucuugcugu

SEQ ID NO: 661933 - RNA, 15 nt, Escherichia coli CFT073
aacgugaauuuuuac

SEQ ID NO: 661934 - RNA, 16 nt, Escherichia coli CFT073
aacgugaauuuuuacu

SEQ ID NO: 661935 - RNA, 17 nt, Escherichia coli CFT073
aacgugaauuuuuacuu

SEQ ID NO: 661936 - RNA, 20 nt, Escherichia coli CFT073
aacgugacauagagauaacu

SEQ ID NO: 661937 - RNA, 20 nt, Escherichia coli CFT073
aacgugaccgcuuuuugaua

SEQ ID NO: 661938 - RNA, 18 nt, Escherichia coli CFT073
aacgucgcaucuggucag

SEQ ID NO: 661939 - RNA, 13 nt, Escherichia coli CFT073
aacgucgccagcg

SEQ ID NO: 661940 - RNA, 17 nt, Escherichia coli CFT073
aacguccaguugaagcu

SEQ ID NO: 661941 - RNA, 18 nt, Escherichia coli CFT073
aacgucucuauuucaccc

SEQ ID NO: 661942 - RNA, 22 nt, Escherichia coli CFT073
aacgucugccugguuucucucc

SEQ ID NO: 661943 - RNA, 17 nt, Escherichia coli CFT073
aacguccgguuaaaucg

SEQ ID NO: 661944 - RNA, 20 nt, Escherichia coli CFT073
aacgucaggugagcgucauu

SEQ ID NO: 661945 - RNA, 19 nt, Escherichia coli CFT073
aacgucaccucaggaaaag

SEQ ID NO: 661946 - RNA, 16 nt, Escherichia coli CFT073
aacgucagucccaacu

SEQ ID NO: 661947 - RNA, 21 nt, Escherichia coli CFT073
aacguauuaugugaucaacac

SEQ ID NO: 661948 - RNA, 16 nt, Escherichia coli CFT073
aacguaacaguacaau

SEQ ID NO: 661949 - RNA, 14 nt, Escherichia coli CFT073
aacguacugcugaa

SEQ ID NO: 661950 - RNA, 14 nt, Escherichia coli CFT073
aacguaaugucugu

SEQ ID NO: 661951 - RNA, 21 nt, Escherichia coli CFT073
aacuacggcuuuuuucauuuc

SEQ ID NO: 661952 - RNA, 23 nt, Escherichia coli CFT073
aacuacggcuuuuuucauuuccc

SEQ ID NO: 661953 - RNA, 15 nt, Escherichia coli CFT073
aacuacagcauuuug

SEQ ID NO: 661954 - RNA, 16 nt, Escherichia coli CFT073
aacuacagaugaaaua

SEQ ID NO: 661955 - RNA, 13 nt, Escherichia coli CFT073
aacuaaaggcugu

SEQ ID NO: 661956 - RNA, 12 nt, Escherichia coli CFT073
aacuaaacaacg

SEQ ID NO: 661957 - RNA, 15 nt, Escherichia coli CFT073
aacuaaccagacgcc

SEQ ID NO: 661958 - RNA, 14 nt, Escherichia coli CFT073
aacuaacagcacau

SEQ ID NO: 661959 - RNA, 21 nt, Escherichia coli CFT073
aacgcugacggugccagguaa

SEQ ID NO: 661960 - RNA, 19 nt, Escherichia coli CFT073
aacgcugcauacucugcaa

SEQ ID NO: 661961 - RNA, 22 nt, Escherichia coli CFT073
aacgcugauuucucuggagaaa

SEQ ID NO: 661962 - RNA, 15 nt, Escherichia coli CFT073
aacgccgucgccuuc

SEQ ID NO: 661963 - RNA, 21 nt, Escherichia coli CFT073
aacgccuaacucuugccagau

SEQ ID NO: 661964 - RNA, 17 nt, Escherichia coli CFT073
aacgcuucaaccagugc

SEQ ID NO: 661965 - RNA, 22 nt, Escherichia coli CFT073
aacgcuuucucaccaugaccga

SEQ ID NO: 661966 - RNA, 17 nt, Escherichia coli CFT073
aacgcuuugcugauugc

SEQ ID NO: 661967 - RNA, 20 nt, Escherichia coli CFT073
aacgcuuuacucaacucccc

SEQ ID NO: 661968 - RNA, 13 nt, Escherichia coli CFT073
aacggucacggcu

SEQ ID NO: 661969 - RNA, 21 nt, Escherichia coli CFT073
aacgguggugcuguuuucucc

SEQ ID NO: 661970 - RNA, 14 nt, Escherichia coli CFT073
aacgguugcaauau

SEQ ID NO: 661971 - RNA, 18 nt, Escherichia coli CFT073
aacgguuucaaccagcag

SEQ ID NO: 661972 - RNA, 19 nt, Escherichia coli CFT073
aacgguuucaaccagcagg

SEQ ID NO: 661973 - RNA, 20 nt, Escherichia coli CFT073
aacggaauuuaaaugacaau

SEQ ID NO: 661974 - RNA, 23 nt, Escherichia coli CFT073
aacggggguuuuacuuuuuaacu

SEQ ID NO: 661975 - RNA, 19 nt, Escherichia coli CFT073
aacgcccacgcuacucgcc

SEQ ID NO: 661976 - RNA, 21 nt, Escherichia coli CFT073
aacgcccauacucaucuucca

SEQ ID NO: 661977 - RNA, 22 nt, Escherichia coli CFT073
aacgcccauacucaucuuccau

SEQ ID NO: 661978 - RNA, 18 nt, Escherichia coli CFT073
aacgccccuucugccgca

SEQ ID NO: 661979 - RNA, 19 nt, Escherichia coli CFT073
aacgcccgauagcgaaagu

SEQ ID NO: 661980 - RNA, 15 nt, Escherichia coli CFT073
aacgcccugcaacug

SEQ ID NO: 661981 - RNA, 19 nt, Escherichia coli CFT073
aacgcccuguaaaaaagaa

SEQ ID NO: 661982 - RNA, 19 nt, Escherichia coli CFT073
aacgccagccacaaaccau

SEQ ID NO: 661983 - RNA, 15 nt, Escherichia coli CFT073
aacgccagaaucaaa

SEQ ID NO: 661984 - RNA, 13 nt, Escherichia coli CFT073
aacgccagauaaa

SEQ ID NO: 661985 - RNA, 13 nt, Escherichia coli CFT073
aacgccagcgaag

SEQ ID NO: 661986 - RNA, 19 nt, Escherichia coli CFT073
aacgccagcgaagccagcu

SEQ ID NO: 661987 - RNA, 14 nt, Escherichia coli CFT073
aacgcaaagagaga

SEQ ID NO: 661988 - RNA, 20 nt, Escherichia coli CFT073
aacgcaaagagagaagccag

SEQ ID NO: 661989 - RNA, 14 nt, Escherichia coli CFT073
aacgcaaucaaauu

SEQ ID NO: 661990 - RNA, 20 nt, Escherichia coli CFT073
aacgcaaucaaauuugccag

SEQ ID NO: 661991 - RNA, 15 nt, Escherichia coli CFT073
aaccgggaagaucca

SEQ ID NO: 661992 - RNA, 13 nt, Escherichia coli CFT073
aaccggcaagcaa

SEQ ID NO: 661993 - RNA, 13 nt, Escherichia coli CFT073
aaccgcuuucugc

SEQ ID NO: 661994 - RNA, 19 nt, Escherichia coli CFT073
aaccggaaauccaggucag

SEQ ID NO: 661995 - RNA, 15 nt, Escherichia coli CFT073
aaccggaaccagcgc

SEQ ID NO: 661996 - RNA, 16 nt, Escherichia coli CFT073
aaccggagcacagacu

SEQ ID NO: 661997 - RNA, 14 nt, Escherichia coli CFT073
aaccggauacccug

SEQ ID NO: 661998 - RNA, 16 nt, Escherichia coli CFT073
aacgauuuuuuccgca

SEQ ID NO: 661999 - RNA, 19 nt, Escherichia coli CFT073
aacgauucggcaaucacaa

SEQ ID NO: 662000 - RNA, 21 nt, Escherichia coli CFT073
aacgcaaaaccaagcugggca

SEQ ID NO: 662001 - RNA, 17 nt, Escherichia coli CFT073
aacgcaaaacccgcuuc

SEQ ID NO: 662002 - RNA, 12 nt, Escherichia coli CFT073
aacgcaaaacug

SEQ ID NO: 662003 - RNA, 17 nt, Escherichia coli CFT073
aacgaucuggcgucagc

SEQ ID NO: 662004 - RNA, 13 nt, Escherichia coli CFT073
aacgaucccaacu

SEQ ID NO: 662005 - RNA, 22 nt, Escherichia coli CFT073
aacgaugaagucgaucagaccg

SEQ ID NO: 662006 - RNA, 23 nt, Escherichia coli CFT073
aacgaugcuuuacguauccguuc

SEQ ID NO: 662007 - RNA, 17 nt, Escherichia coli CFT073
aaccauuaaacguacug

SEQ ID NO: 662008 - RNA, 15 nt, Escherichia coli CFT073
aaccaugucaucaau

SEQ ID NO: 662009 - RNA, 22 nt, Escherichia coli CFT073
aaccauccacauuuucagccag

SEQ ID NO: 662010 - RNA, 16 nt, Escherichia coli CFT073
aaccaucugauucuuc

SEQ ID NO: 662011 - RNA, 22 nt, Escherichia coli CFT073
aaccaucgccguaaagccggug

SEQ ID NO: 662012 - RNA, 17 nt, Escherichia coli CFT073
aaccaucgguacgcuuu

SEQ ID NO: 662013 - RNA, 22 nt, Escherichia coli CFT073
aaccacuaauuccugcaaacag

SEQ ID NO: 662014 - RNA, 19 nt, Escherichia coli CFT073
aaccacuaccguaguaaau

SEQ ID NO: 662015 - RNA, 23 nt, Escherichia coli CFT073
aaccacgccuaaaauccacaucg

SEQ ID NO: 662016 - RNA, 23 nt, Escherichia coli CFT073
aacccagaagaaagccggaugau

SEQ ID NO: 662017 - RNA, 16 nt, Escherichia coli CFT073
aacccagacaaauaac

SEQ ID NO: 662018 - RNA, 17 nt, Escherichia coli CFT073
aacccagcaccaacaaa

SEQ ID NO: 662019 - RNA, 23 nt, Escherichia coli CFT073
aacccagcagcccgagcaacagu

SEQ ID NO: 662020 - RNA, 15 nt, Escherichia coli CFT073
aacccaaccugccag

SEQ ID NO: 662021 - RNA, 16 nt, Escherichia coli CFT073
aacccaaccugccaga

SEQ ID NO: 662022 - RNA, 17 nt, Escherichia coli CFT073
aacccaaccugccagag

SEQ ID NO: 662023 - RNA, 17 nt, Escherichia coli CFT073
aacccaacggcaaacau

SEQ ID NO: 662024 - RNA, 19 nt, Escherichia coli CFT073
aacccaacggcaaacaucg

SEQ ID NO: 662025 - RNA, 13 nt, Escherichia coli CFT073
aacccacaaaaac

SEQ ID NO: 662026 - RNA, 18 nt, Escherichia coli CFT073
aacccacaaaaacaccgc

SEQ ID NO: 662027 - RNA, 17 nt, Escherichia coli CFT073
aacccaaauccgccauc

SEQ ID NO: 662028 - RNA, 22 nt, Escherichia coli CFT073
aacccaaauccgccaucaacac

SEQ ID NO: 662029 - RNA, 17 nt, Escherichia coli CFT073
aaccauugcagccaauc

SEQ ID NO: 662030 - RNA, 14 nt, Escherichia coli CFT073
aacccggccugaua

SEQ ID NO: 662031 - RNA, 19 nt, Escherichia coli CFT073
aacccggccugauauauca

SEQ ID NO: 662032 - RNA, 14 nt, Escherichia coli CFT073
aacccguugcuuca

SEQ ID NO: 662033 - RNA, 21 nt, Escherichia coli CFT073
aacccagcgauggacgcagac

SEQ ID NO: 662034 - RNA, 22 nt, Escherichia coli CFT073
aacccagcggaugacccagcgc

SEQ ID NO: 662035 - RNA, 13 nt, Escherichia coli CFT073
aacccauccagca

SEQ ID NO: 662036 - RNA, 17 nt, Escherichia coli CFT073
aacccauccagcagaga

SEQ ID NO: 662037 - RNA, 21 nt, Escherichia coli CFT073
aaccgcaucauguaaaucaau

SEQ ID NO: 662038 - RNA, 17 nt, Escherichia coli CFT073
aaccgcauccagauucu

SEQ ID NO: 662039 - RNA, 19 nt, Escherichia coli CFT073
aaccgccagcacagccagc

SEQ ID NO: 662040 - RNA, 20 nt, Escherichia coli CFT073
aaccgccagcacagccagcc

SEQ ID NO: 662041 - RNA, 21 nt, Escherichia coli CFT073
aaccgccaguucccccugcca

SEQ ID NO: 662042 - RNA, 13 nt, Escherichia coli CFT073
aaccgauaccgac

SEQ ID NO: 662043 - RNA, 14 nt, Escherichia coli CFT073
aaccgcccagcagc

SEQ ID NO: 662044 - RNA, 18 nt, Escherichia coli CFT073
aaccgcccagugccagca

SEQ ID NO: 662045 - RNA, 15 nt, Escherichia coli CFT073
aaccgcugccaggca

SEQ ID NO: 662046 - RNA, 19 nt, Escherichia coli CFT073
aaccgacggggacucuccc

SEQ ID NO: 662047 - RNA, 18 nt, Escherichia coli CFT073
aaccgagauaaaugccaa

SEQ ID NO: 662048 - RNA, 19 nt, Escherichia coli CFT073
aaccgagauaaaugccaaa

SEQ ID NO: 662049 - RNA, 16 nt, Escherichia coli CFT073
aacccuaaagcaccca

SEQ ID NO: 662050 - RNA, 17 nt, Escherichia coli CFT073
aacccuaacccaacauu

SEQ ID NO: 662051 - RNA, 14 nt, Escherichia coli CFT073
aacccuucgccagc

SEQ ID NO: 662052 - RNA, 18 nt, Escherichia coli CFT073
aacccuguggaucuuccc

SEQ ID NO: 662053 - RNA, 19 nt, Escherichia coli CFT073
aacccuguggaucuucccc

SEQ ID NO: 662054 - RNA, 18 nt, Escherichia coli CFT073
aacauauuacgaaugaca

SEQ ID NO: 662055 - RNA, 13 nt, Escherichia coli CFT073
aacauacuuucuc

SEQ ID NO: 662056 - RNA, 13 nt, Escherichia coli CFT073
aacauacggcaua

SEQ ID NO: 662057 - RNA, 20 nt, Escherichia coli CFT073
aacauacgacuuugcgcagg

SEQ ID NO: 662058 - RNA, 22 nt, Escherichia coli CFT073
aacauacgacuuugcgcaggca

SEQ ID NO: 662059 - RNA, 24 nt, Escherichia coli CFT073
aacauacgacuuugcgcaggcaag

SEQ ID NO: 662060 - RNA, 19 nt, Escherichia coli CFT073
aacauacaaauagccaauu

SEQ ID NO: 662061 - RNA, 19 nt, Escherichia coli CFT073
aacauaauccagccuucua

SEQ ID NO: 662062 - RNA, 21 nt, Escherichia coli CFT073
aacauaaugccgacaucaaac

SEQ ID NO: 662063 - RNA, 23 nt, Escherichia coli CFT073
aacauaaugccgacaucaaacag

SEQ ID NO: 662064 - RNA, 14 nt, Escherichia coli CFT073
aacagccaucgcca

SEQ ID NO: 662065 - RNA, 17 nt, Escherichia coli CFT073
aacagccccugacuggu

SEQ ID NO: 662066 - RNA, 14 nt, Escherichia coli CFT073
aacagcccgccaau

SEQ ID NO: 662067 - RNA, 22 nt, Escherichia coli CFT073
aacagcgcaccagaaacaauaa

SEQ ID NO: 662068 - RNA, 15 nt, Escherichia coli CFT073
aacagcgacaccagc

SEQ ID NO: 662069 - RNA, 17 nt, Escherichia coli CFT073
aacagcgacaccagcca

SEQ ID NO: 662070 - RNA, 22 nt, Escherichia coli CFT073
aacauccccagcgucagcagca

SEQ ID NO: 662071 - RNA, 23 nt, Escherichia coli CFT073
aacauccccagcgucagcagcaa

SEQ ID NO: 662072 - RNA, 19 nt, Escherichia coli CFT073
aacauccccauaucccgga

SEQ ID NO: 662073 - RNA, 17 nt, Escherichia coli CFT073
aacauccggcaaauuaa

SEQ ID NO: 662074 - RNA, 18 nt, Escherichia coli CFT073
aacauccgguuucaucag

SEQ ID NO: 662075 - RNA, 21 nt, Escherichia coli CFT073
aacaucuuaauagcugccagc

SEQ ID NO: 662076 - RNA, 17 nt, Escherichia coli CFT073
aacaucuuccacaugcc

SEQ ID NO: 662077 - RNA, 23 nt, Escherichia coli CFT073
aacauauugcuccauaauugcca

SEQ ID NO: 662078 - RNA, 19 nt, Escherichia coli CFT073
aacauauuccggugccgga

SEQ ID NO: 662079 - RNA, 17 nt, Escherichia coli CFT073
aacaucaaacuguucgg

SEQ ID NO: 662080 - RNA, 21 nt, Escherichia coli CFT073
aacaucauugccgccugggug

SEQ ID NO: 662081 - RNA, 18 nt, Escherichia coli CFT073
aaccacaaccacuuugua

SEQ ID NO: 662082 - RNA, 15 nt, Escherichia coli CFT073
aaccacaaccucagc

SEQ ID NO: 662083 - RNA, 13 nt, Escherichia coli CFT073
aaccaaucuccca

SEQ ID NO: 662084 - RNA, 13 nt, Escherichia coli CFT073
aaccaaugccacc

SEQ ID NO: 662085 - RNA, 13 nt, Escherichia coli CFT073
aaccaaccgcaau

SEQ ID NO: 662086 - RNA, 23 nt, Escherichia coli CFT073
aaccaaccgcaauaaccaucagc

SEQ ID NO: 662087 - RNA, 21 nt, Escherichia coli CFT073
aaccaacgcauagacagccac

SEQ ID NO: 662088 - RNA, 20 nt, Escherichia coli CFT073
aaccaacgcuagcagcagcg

SEQ ID NO: 662089 - RNA, 19 nt, Escherichia coli CFT073
aaccaacaagcaccggcac

SEQ ID NO: 662090 - RNA, 13 nt, Escherichia coli CFT073
aaccaacaauaca

SEQ ID NO: 662091 - RNA, 13 nt, Escherichia coli CFT073
aacauugcugcug

SEQ ID NO: 662092 - RNA, 19 nt, Escherichia coli CFT073
aacauugcugcugaagcaa

SEQ ID NO: 662093 - RNA, 17 nt, Escherichia coli CFT073
aacauugauaagcaagu

SEQ ID NO: 662094 - RNA, 12 nt, Escherichia coli CFT073
aacauuggcuca

SEQ ID NO: 662095 - RNA, 19 nt, Escherichia coli CFT073
aacauucccaucaguagca

SEQ ID NO: 662096 - RNA, 22 nt, Escherichia coli CFT073
aacauucccgguuucaggauga

SEQ ID NO: 662097 - RNA, 17 nt, Escherichia coli CFT073
aacauuacuaaacauuu

SEQ ID NO: 662098 - RNA, 12 nt, Escherichia coli CFT073
aacauucaucau

SEQ ID NO: 662099 - RNA, 15 nt, Escherichia coli CFT073
aacauucaucauuuc

SEQ ID NO: 662100 - RNA, 15 nt, Escherichia coli CFT073
aacauucggcaaugg

SEQ ID NO: 662101 - RNA, 22 nt, Escherichia coli CFT073
aacauucguugcaguaaaauuu

SEQ ID NO: 662102 - RNA, 18 nt, Escherichia coli CFT073
aacauguuccugccaguc

SEQ ID NO: 662103 - RNA, 15 nt, Escherichia coli CFT073
aacagauaaauggca

SEQ ID NO: 662104 - RNA, 14 nt, Escherichia coli CFT073
aacagaguagaaau

SEQ ID NO: 662105 - RNA, 24 nt, Escherichia coli CFT073
aacagauacuggaagugaucuuuc

SEQ ID NO: 662106 - RNA, 17 nt, Escherichia coli CFT073
aacacuuuaucugccau

SEQ ID NO: 662107 - RNA, 21 nt, Escherichia coli CFT073
aacagaagguuuauauaguaa

SEQ ID NO: 662108 - RNA, 20 nt, Escherichia coli CFT073
aacagaaugauauugauaau

SEQ ID NO: 662109 - RNA, 17 nt, Escherichia coli CFT073
aacagaauggugccgac

SEQ ID NO: 662110 - RNA, 18 nt, Escherichia coli CFT073
aacagaauggugccgaca

SEQ ID NO: 662111 - RNA, 13 nt, Escherichia coli CFT073
aacagacaaaaag

SEQ ID NO: 662112 - RNA, 15 nt, Escherichia coli CFT073
aacagacaaaaagaa

SEQ ID NO: 662113 - RNA, 21 nt, Escherichia coli CFT073
aacagaugaguugaaauugau

SEQ ID NO: 662114 - RNA, 15 nt, Escherichia coli CFT073
aacagaugaaugaaa

SEQ ID NO: 662115 - RNA, 16 nt, Escherichia coli CFT073
aacagcaaccuccguc

SEQ ID NO: 662116 - RNA, 11 nt, Escherichia coli CFT073
aacagcaccau

SEQ ID NO: 662117 - RNA, 13 nt, Escherichia coli CFT073
aacagcaccaucc

SEQ ID NO: 662118 - RNA, 14 nt, Escherichia coli CFT073
aacagcacagccag

SEQ ID NO: 662119 - RNA, 14 nt, Escherichia coli CFT073
aacagcaacucagc

SEQ ID NO: 662120 - RNA, 23 nt, Escherichia coli CFT073
aacagcagccacggcagcaacuu

SEQ ID NO: 662121 - RNA, 17 nt, Escherichia coli CFT073
aacagcaggcagaucca

SEQ ID NO: 662122 - RNA, 16 nt, Escherichia coli CFT073
aacagccacucuuaac

SEQ ID NO: 662123 - RNA, 13 nt, Escherichia coli CFT073
aacagccagaagc

SEQ ID NO: 662124 - RNA, 15 nt, Escherichia coli CFT073
aacacccaucgccgu

SEQ ID NO: 662125 - RNA, 16 nt, Escherichia coli CFT073
aacacccaucgccgua

SEQ ID NO: 662126 - RNA, 20 nt, Escherichia coli CFT073
aacacccccugcaaaacugg

SEQ ID NO: 662127 - RNA, 21 nt, Escherichia coli CFT073
aacaccgagucgccuuuuucc

SEQ ID NO: 662128 - RNA, 22 nt, Escherichia coli CFT073
aacaccgauagaaccaaaguuu

SEQ ID NO: 662129 - RNA, 15 nt, Escherichia coli CFT073
aacaccguaccauca

SEQ ID NO: 662130 - RNA, 14 nt, Escherichia coli CFT073
aacaccgugacaaa

SEQ ID NO: 662131 - RNA, 18 nt, Escherichia coli CFT073
aacaccgcuucaacagcg

SEQ ID NO: 662132 - RNA, 20 nt, Escherichia coli CFT073
aacaccggugaccaucagca

SEQ ID NO: 662133 - RNA, 17 nt, Escherichia coli CFT073
aacaccucauccgaugg

SEQ ID NO: 662134 - RNA, 18 nt, Escherichia coli CFT073
aacaccugggcaauggug

SEQ ID NO: 662135 - RNA, 16 nt, Escherichia coli CFT073
aacaccuucguccagc

SEQ ID NO: 662136 - RNA, 15 nt, Escherichia coli CFT073
aacacgaauaccaag

SEQ ID NO: 662137 - RNA, 17 nt, Escherichia coli CFT073
aacacgaauaccaagca

SEQ ID NO: 662138 - RNA, 20 nt, Escherichia coli CFT073
aacacgaggaauaucagccc

SEQ ID NO: 662139 - RNA, 19 nt, Escherichia coli CFT073
aacacgggguuaaauugau

SEQ ID NO: 662140 - RNA, 15 nt, Escherichia coli CFT073
aacacguugcaacug

SEQ ID NO: 662141 - RNA, 24 nt, Escherichia coli CFT073
aacacgauucguauaauuuauuag

SEQ ID NO: 662142 - RNA, 17 nt, Escherichia coli CFT073
aacacgcaacaccagca

SEQ ID NO: 662143 - RNA, 18 nt, Escherichia coli CFT073
aacacgcucccagcagug

SEQ ID NO: 662144 - RNA, 13 nt, Escherichia coli CFT073
aacacucuaucca

SEQ ID NO: 662145 - RNA, 15 nt, Escherichia coli CFT073
aacacucguccaguc

SEQ ID NO: 662146 - RNA, 19 nt, Escherichia coli CFT073
aacacucguccagucgccu

SEQ ID NO: 662147 - RNA, 23 nt, Escherichia coli CFT073
aacacucguccagucgccugcuu

SEQ ID NO: 662148 - RNA, 21 nt, Escherichia coli CFT073
aacacugcgcucuucuggcac

SEQ ID NO: 662149 - RNA, 23 nt, Escherichia coli CFT073
aacacucuuuuugacguuuuuac

SEQ ID NO: 662150 - RNA, 19 nt, Escherichia coli CFT073
aacacuucuuugaugccuu

SEQ ID NO: 662151 - RNA, 18 nt, Escherichia coli CFT073
aacaauucacacucugcc

SEQ ID NO: 662152 - RNA, 22 nt, Escherichia coli CFT073
aacaauucgugugguaaaaccu

SEQ ID NO: 662153 - RNA, 15 nt, Escherichia coli CFT073
aacaauuugccaggc

SEQ ID NO: 662154 - RNA, 22 nt, Escherichia coli CFT073
aacaauuuccgcagcuccagcc

SEQ ID NO: 662155 - RNA, 16 nt, Escherichia coli CFT073
aacaauugaagaauau

SEQ ID NO: 662156 - RNA, 20 nt, Escherichia coli CFT073
aacaauccucccuuacccuu

SEQ ID NO: 662157 - RNA, 19 nt, Escherichia coli CFT073
aacaauauuggguuguugc

SEQ ID NO: 662158 - RNA, 21 nt, Escherichia coli CFT073
aacaauaaauucgccagacag

SEQ ID NO: 662159 - RNA, 13 nt, Escherichia coli CFT073
aacaauaacaauu

SEQ ID NO: 662160 - RNA, 15 nt, Escherichia coli CFT073
aaauucuguuucauu

SEQ ID NO: 662161 - RNA, 21 nt, Escherichia coli CFT073
aacacacaauuaccuuccaca

SEQ ID NO: 662162 - RNA, 22 nt, Escherichia coli CFT073
aacacaagccaaucugcuggaa

SEQ ID NO: 662163 - RNA, 22 nt, Escherichia coli CFT073
aacacacuuuccaguuccggca

SEQ ID NO: 662164 - RNA, 15 nt, Escherichia coli CFT073
aacacaccacagcac

SEQ ID NO: 662165 - RNA, 18 nt, Escherichia coli CFT073
aacacaccguaauugcca

SEQ ID NO: 662166 - RNA, 16 nt, Escherichia coli CFT073
aacacagcaauaauaa

SEQ ID NO: 662167 - RNA, 20 nt, Escherichia coli CFT073
aacacaguacgaugauugcc

SEQ ID NO: 662168 - RNA, 19 nt, Escherichia coli CFT073
aaaaaggggaaaaauucag

SEQ ID NO: 662169 - RNA, 19 nt, Escherichia coli CFT073
aacacaucagugauacauc

SEQ ID NO: 662170 - RNA, 16 nt, Escherichia coli CFT073
aacaccaguucaccac

SEQ ID NO: 662171 - RNA, 12 nt, Escherichia coli CFT073
aacaccauaaug

SEQ ID NO: 662172 - RNA, 18 nt, Escherichia coli CFT073
aacaccaggcuaaauugc

SEQ ID NO: 662173 - RNA, 12 nt, Escherichia coli CFT073
aacaccagcagc

SEQ ID NO: 662174 - RNA, 13 nt, Escherichia coli CFT073
aacaccagcagca

SEQ ID NO: 662175 - RNA, 20 nt, Escherichia coli CFT073
aacaccagcaggugauacau

SEQ ID NO: 662176 - RNA, 12 nt, Escherichia coli CFT073
aacaccagcagu

SEQ ID NO: 662177 - RNA, 14 nt, Escherichia coli CFT073
aacaccaacugccu

SEQ ID NO: 662178 - RNA, 14 nt, Escherichia coli CFT073
aacaccaccagcgc

SEQ ID NO: 662179 - RNA, 18 nt, Escherichia coli CFT073
aacaccacgccagccgcc

SEQ ID NO: 662180 - RNA, 23 nt, Escherichia coli CFT073
aacaccacgucgccgggauaaug

SEQ ID NO: 662181 - RNA, 15 nt, Escherichia coli CFT073
aacaccacucuugcc

SEQ ID NO: 662182 - RNA, 19 nt, Escherichia coli CFT073
aaaaaggugauuuauuucu

SEQ ID NO: 662183 - RNA, 21 nt, Escherichia coli CFT073
aaaaagugcauauacaaccaa

SEQ ID NO: 662184 - RNA, 23 nt, Escherichia coli CFT073
aaaaagugcauauacaaccaaua

SEQ ID NO: 662185 - RNA, 18 nt, Escherichia coli CFT073
aacacauguguucccugu

SEQ ID NO: 662186 - RNA, 18 nt, Escherichia coli CFT073
aaucauggcguuuuuccc

SEQ ID NO: 662187 - RNA, 14 nt, Escherichia coli CFT073
aaucauuucugcaa

SEQ ID NO: 662188 - RNA, 17 nt, Escherichia coli CFT073
aaucaugccaaaaauaa

SEQ ID NO: 662189 - RNA, 11 nt, Escherichia coli CFT073
aaucagaucaa

SEQ ID NO: 662190 - RNA, 20 nt, Escherichia coli CFT073
aaucagcacuacugccagau

SEQ ID NO: 662191 - RNA, 20 nt, Escherichia coli CFT073
aaucagcagauaucccgcca

SEQ ID NO: 662192 - RNA, 11 nt, Escherichia coli CFT073
aaucagcacac

SEQ ID NO: 662193 - RNA, 16 nt, Escherichia coli CFT073
aaucagcacacauaac

SEQ ID NO: 662194 - RNA, 14 nt, Escherichia coli CFT073
aaucagcacaauaa

SEQ ID NO: 662195 - RNA, 16 nt, Escherichia coli CFT073
aaucagcauacuccag

SEQ ID NO: 662196 - RNA, 14 nt, Escherichia coli CFT073
aaucagcaucaacc

SEQ ID NO: 662197 - RNA, 23 nt, Escherichia coli CFT073
aaucaucugccgguuccagcuuc

SEQ ID NO: 662198 - RNA, 17 nt, Escherichia coli CFT073
aaucaucugcgcccugg

SEQ ID NO: 662199 - RNA, 20 nt, Escherichia coli CFT073
aauccagacugcgcauuaaa

SEQ ID NO: 662200 - RNA, 12 nt, Escherichia coli CFT073
aauccagaacac

SEQ ID NO: 662201 - RNA, 15 nt, Escherichia coli CFT073
aauccagaacaccau

SEQ ID NO: 662202 - RNA, 22 nt, Escherichia coli CFT073
aauccagccccaccagcaaaaa

SEQ ID NO: 662203 - RNA, 12 nt, Escherichia coli CFT073
aauccauucauc

SEQ ID NO: 662204 - RNA, 20 nt, Escherichia coli CFT073
aauccaucccgcucuguaag

SEQ ID NO: 662205 - RNA, 14 nt, Escherichia coli CFT073
aaucccaggaagcc

SEQ ID NO: 662206 - RNA, 20 nt, Escherichia coli CFT073
aaucccaguacuguacaaca

SEQ ID NO: 662207 - RNA, 17 nt, Escherichia coli CFT073
aauccagcgaaauaaaa

SEQ ID NO: 662208 - RNA, 18 nt, Escherichia coli CFT073
aaucgagcaauaaacacu

SEQ ID NO: 662209 - RNA, 22 nt, Escherichia coli CFT073
aaucgagcaauaaacacugcua

SEQ ID NO: 662210 - RNA, 20 nt, Escherichia coli CFT073
aaucgaucacguaauaaaau

SEQ ID NO: 662211 - RNA, 23 nt, Escherichia coli CFT073
aaucgaucaucaccugcgcuggc

SEQ ID NO: 662212 - RNA, 15 nt, Escherichia coli CFT073
aauccuuauauaaaa

SEQ ID NO: 662213 - RNA, 18 nt, Escherichia coli CFT073
aauccuuauauaaaacac

SEQ ID NO: 662214 - RNA, 14 nt, Escherichia coli CFT073
aauccuucaucuuu

SEQ ID NO: 662215 - RNA, 22 nt, Escherichia coli CFT073
aauccguuagcgaguugaucac

SEQ ID NO: 662216 - RNA, 21 nt, Escherichia coli CFT073
aauccguggcaaauugcccaa

SEQ ID NO: 662217 - RNA, 20 nt, Escherichia coli CFT073
aauccguauuccugaaucag

SEQ ID NO: 662218 - RNA, 18 nt, Escherichia coli CFT073
aauccgucgcgccaggcg

SEQ ID NO: 662219 - RNA, 15 nt, Escherichia coli CFT073
aauccgucucaaugg

SEQ ID NO: 662220 - RNA, 18 nt, Escherichia coli CFT073
aauccggcgcucaucagg

SEQ ID NO: 662221 - RNA, 18 nt, Escherichia coli CFT073
aauccgggcuaucaugcc

SEQ ID NO: 662222 - RNA, 23 nt, Escherichia coli CFT073
aauccggucccuucugccaccag

SEQ ID NO: 662223 - RNA, 14 nt, Escherichia coli CFT073
aauccguaaucgcu

SEQ ID NO: 662224 - RNA, 21 nt, Escherichia coli CFT073
aauccguacgcuuuuccacuc

SEQ ID NO: 662225 - RNA, 17 nt, Escherichia coli CFT073
aauccgcccuaacaucg

SEQ ID NO: 662226 - RNA, 17 nt, Escherichia coli CFT073
aauccgccgcuguggca

SEQ ID NO: 662227 - RNA, 15 nt, Escherichia coli CFT073
aauccggcagcgaac

SEQ ID NO: 662228 - RNA, 13 nt, Escherichia coli CFT073
aauccgcaccaac

SEQ ID NO: 662229 - RNA, 14 nt, Escherichia coli CFT073
aaucccguugccac

SEQ ID NO: 662230 - RNA, 23 nt, Escherichia coli CFT073
aaucccguugccacucaggcaaa

SEQ ID NO: 662231 - RNA, 22 nt, Escherichia coli CFT073
aaucccuuccgcuuuuaacauc

SEQ ID NO: 662232 - RNA, 22 nt, Escherichia coli CFT073
aaucccugcgaacugcgcagau

SEQ ID NO: 662233 - RNA, 22 nt, Escherichia coli CFT073
aaucugacuuccugccucuuug

SEQ ID NO: 662234 - RNA, 23 nt, Escherichia coli CFT073
aaucugacuuccugccucuuugc

SEQ ID NO: 662235 - RNA, 12 nt, Escherichia coli CFT073
aaucugagcauu

SEQ ID NO: 662236 - RNA, 17 nt, Escherichia coli CFT073
aaucugcaaaauaccaa

SEQ ID NO: 662237 - RNA, 14 nt, Escherichia coli CFT073
aaucugaaaaccag

SEQ ID NO: 662238 - RNA, 14 nt, Escherichia coli CFT073
aaucucuucaccug

SEQ ID NO: 662239 - RNA, 18 nt, Escherichia coli CFT073
aaucucuuccagcgacac

SEQ ID NO: 662240 - RNA, 21 nt, Escherichia coli CFT073
aaucucuuccagcgucuccag

SEQ ID NO: 662241 - RNA, 23 nt, Escherichia coli CFT073
aaucucuuccgucgccagaaagu

SEQ ID NO: 662242 - RNA, 17 nt, Escherichia coli CFT073
aaucucuuuccauucuu

SEQ ID NO: 662243 - RNA, 20 nt, Escherichia coli CFT073
aaucugcuccauuaacccga

SEQ ID NO: 662244 - RNA, 22 nt, Escherichia coli CFT073
aaucugcuuuucauacaaucgg

SEQ ID NO: 662245 - RNA, 21 nt, Escherichia coli CFT073
aaucuguaacaaggugaauca

SEQ ID NO: 662246 - RNA, 21 nt, Escherichia coli CFT073
aaucuguacaggacgcaaugu

SEQ ID NO: 662247 - RNA, 14 nt, Escherichia coli CFT073
aaucuguccuucca

SEQ ID NO: 662248 - RNA, 23 nt, Escherichia coli CFT073
aaucuguccuuccaguaaccagc

SEQ ID NO: 662249 - RNA, 17 nt, Escherichia coli CFT073
aaucuguucuggaaaaa

SEQ ID NO: 662250 - RNA, 15 nt, Escherichia coli CFT073
aaucuguugaaaaaa

SEQ ID NO: 662251 - RNA, 19 nt, Escherichia coli CFT073
aaucuguugaaauuauugc

SEQ ID NO: 662252 - RNA, 17 nt, Escherichia coli CFT073
aaucuuccagaaugccu

SEQ ID NO: 662253 - RNA, 20 nt, Escherichia coli CFT073
aaucuuccagaucaccgcag

SEQ ID NO: 662254 - RNA, 14 nt, Escherichia coli CFT073
aaucuucauagucu

SEQ ID NO: 662255 - RNA, 12 nt, Escherichia coli CFT073
aaucuuccagaa

SEQ ID NO: 662256 - RNA, 20 nt, Escherichia coli CFT073
aaucuacggaagaguuuuuc

SEQ ID NO: 662257 - RNA, 12 nt, Escherichia coli CFT073
aaucucugcaag

SEQ ID NO: 662258 - RNA, 23 nt, Escherichia coli CFT073
aaucucaccagguucgccaacaa

SEQ ID NO: 662259 - RNA, 21 nt, Escherichia coli CFT073
aaucucacccgguacaucaau

SEQ ID NO: 662260 - RNA, 24 nt, Escherichia coli CFT073
aaucucacccgguacaucaauacc

SEQ ID NO: 662261 - RNA, 13 nt, Escherichia coli CFT073
aaucucaccgcag

SEQ ID NO: 662262 - RNA, 13 nt, Escherichia coli CFT073
aaucucaccaaua

SEQ ID NO: 662263 - RNA, 17 nt, Escherichia coli CFT073
aaucucacuacaacaac

SEQ ID NO: 662264 - RNA, 22 nt, Escherichia coli CFT073
aaucgucaaugccgucaccagc

SEQ ID NO: 662265 - RNA, 19 nt, Escherichia coli CFT073
aaucgucagcaucucugca

SEQ ID NO: 662266 - RNA, 21 nt, Escherichia coli CFT073
aaucgucaguagcgcaauaac

SEQ ID NO: 662267 - RNA, 16 nt, Escherichia coli CFT073
aaucgucaucgacagc

SEQ ID NO: 662268 - RNA, 17 nt, Escherichia coli CFT073
aaucgucgauuguuaua

SEQ ID NO: 662269 - RNA, 21 nt, Escherichia coli CFT073
aaucgucgguguccacuuccg

SEQ ID NO: 662270 - RNA, 12 nt, Escherichia coli CFT073
aaucgccagacu

SEQ ID NO: 662271 - RNA, 19 nt, Escherichia coli CFT073
aaucgccagacucaccagc

SEQ ID NO: 662272 - RNA, 21 nt, Escherichia coli CFT073
aaucgccagcaaaaucaccau

SEQ ID NO: 662273 - RNA, 15 nt, Escherichia coli CFT073
aaucgccaagauuag

SEQ ID NO: 662274 - RNA, 19 nt, Escherichia coli CFT073
aaucgccacaacuucaacg

SEQ ID NO: 662275 - RNA, 16 nt, Escherichia coli CFT073
aaucgcagucucuuua

SEQ ID NO: 662276 - RNA, 13 nt, Escherichia coli CFT073
aaucgauuuagaa

SEQ ID NO: 662277 - RNA, 16 nt, Escherichia coli CFT073
aaucgauuugaaucgu

SEQ ID NO: 662278 - RNA, 23 nt, Escherichia coli CFT073
aaucgcacgauagcuaacugccu

SEQ ID NO: 662279 - RNA, 15 nt, Escherichia coli CFT073
aauauucagccacug

SEQ ID NO: 662280 - RNA, 22 nt, Escherichia coli CFT073
aauauucagccacuguuucaau

SEQ ID NO: 662281 - RNA, 18 nt, Escherichia coli CFT073
aauauucacgacaugugc

SEQ ID NO: 662282 - RNA, 22 nt, Escherichia coli CFT073
aauauucacccgaauaccuuuc

SEQ ID NO: 662283 - RNA, 16 nt, Escherichia coli CFT073
aauauucuuccggcuu

SEQ ID NO: 662284 - RNA, 19 nt, Escherichia coli CFT073
aauauuccagucagcacca

SEQ ID NO: 662285 - RNA, 21 nt, Escherichia coli CFT073
aauauugagcaggaugacaua

SEQ ID NO: 662286 - RNA, 12 nt, Escherichia coli CFT073
aauauugcugcu

SEQ ID NO: 662287 - RNA, 17 nt, Escherichia coli CFT073
aauauugcuguaaagua

SEQ ID NO: 662288 - RNA, 16 nt, Escherichia coli CFT073
aauauugaugcacacc

SEQ ID NO: 662289 - RNA, 17 nt, Escherichia coli CFT073
aauauuuuucgucaguu

SEQ ID NO: 662290 - RNA, 16 nt, Escherichia coli CFT073
aauauuuuuuagcaca

SEQ ID NO: 662291 - RNA, 22 nt, Escherichia coli CFT073
aauauuucauucuccauuucaa

SEQ ID NO: 662292 - RNA, 22 nt, Escherichia coli CFT073
aauauuucuuuaucaccaauga

SEQ ID NO: 662293 - RNA, 23 nt, Escherichia coli CFT073
aauauuucuuuaugggcauuucu

SEQ ID NO: 662294 - RNA, 18 nt, Escherichia coli CFT073
aauauuauggcugucaug

SEQ ID NO: 662295 - RNA, 13 nt, Escherichia coli CFT073
aauauuaaaccac

SEQ ID NO: 662296 - RNA, 19 nt, Escherichia coli CFT073
aauauguugauaaucaaca

SEQ ID NO: 662297 - RNA, 14 nt, Escherichia coli CFT073
aauaugucaguggu

SEQ ID NO: 662298 - RNA, 17 nt, Escherichia coli CFT073
aauaugguuauuaccaa

SEQ ID NO: 662299 - RNA, 20 nt, Escherichia coli CFT073
aauaugguuauuaccaaaaa

SEQ ID NO: 662300 - RNA, 14 nt, Escherichia coli CFT073
aauaugcagcaguc

SEQ ID NO: 662301 - RNA, 21 nt, Escherichia coli CFT073
aauagcccgauggcaucacca

SEQ ID NO: 662302 - RNA, 21 nt, Escherichia coli CFT073
aauagccagcagagcaaaaau

SEQ ID NO: 662303 - RNA, 20 nt, Escherichia coli CFT073
aauagccagcagagcaaaaa

SEQ ID NO: 662304 - RNA, 21 nt, Escherichia coli CFT073
aauagaguuacuauccacagc

SEQ ID NO: 662305 - RNA, 16 nt, Escherichia coli CFT073
aauagauaauuuugaa

SEQ ID NO: 662306 - RNA, 23 nt, Escherichia coli CFT073
aauagauaauuuugaaauaaaau

SEQ ID NO: 662307 - RNA, 15 nt, Escherichia coli CFT073
aaucaaccauuaaac

SEQ ID NO: 662308 - RNA, 19 nt, Escherichia coli CFT073
aaucaacgcgccgacgaau

SEQ ID NO: 662309 - RNA, 19 nt, Escherichia coli CFT073
aaucaacgguugcaaugca

SEQ ID NO: 662310 - RNA, 21 nt, Escherichia coli CFT073
aaucaacagauaaauggcaca

SEQ ID NO: 662311 - RNA, 18 nt, Escherichia coli CFT073
aaucaacagccacucuua

SEQ ID NO: 662312 - RNA, 13 nt, Escherichia coli CFT073
aaucaacaggaac

SEQ ID NO: 662313 - RNA, 14 nt, Escherichia coli CFT073
aaucaacaggaaca

SEQ ID NO: 662314 - RNA, 15 nt, Escherichia coli CFT073
aaucaacaaaagugg

SEQ ID NO: 662315 - RNA, 20 nt, Escherichia coli CFT073
aaucaacacaccgcccugcu

SEQ ID NO: 662316 - RNA, 14 nt, Escherichia coli CFT073
aaucaaagucagau

SEQ ID NO: 662317 - RNA, 17 nt, Escherichia coli CFT073
aaucaaaguuaguaaaa

SEQ ID NO: 662318 - RNA, 14 nt, Escherichia coli CFT073
aaucaagguaauug

SEQ ID NO: 662319 - RNA, 22 nt, Escherichia coli CFT073
aaucaagcgccgaguaaaaaaa

SEQ ID NO: 662320 - RNA, 17 nt, Escherichia coli CFT073
aaucaagaccucaucgu

SEQ ID NO: 662321 - RNA, 20 nt, Escherichia coli CFT073
aaucaauuuuuugauauguu

SEQ ID NO: 662322 - RNA, 14 nt, Escherichia coli CFT073
aaucaaugccagga

SEQ ID NO: 662323 - RNA, 15 nt, Escherichia coli CFT073
aaucaauccggcaau

SEQ ID NO: 662324 - RNA, 17 nt, Escherichia coli CFT073
aaucaauccggcaauca

SEQ ID NO: 662325 - RNA, 22 nt, Escherichia coli CFT073
aaucaauccggcaaucaacauc

SEQ ID NO: 662326 - RNA, 15 nt, Escherichia coli CFT073
aaucaauggcccauu

SEQ ID NO: 662327 - RNA, 16 nt, Escherichia coli CFT073
aaucaauaugcauaaa

SEQ ID NO: 662328 - RNA, 17 nt, Escherichia coli CFT073
aaucacaucaccauaaa

SEQ ID NO: 662329 - RNA, 17 nt, Escherichia coli CFT073
aaucaccaaaccaacaa

SEQ ID NO: 662330 - RNA, 18 nt, Escherichia coli CFT073
aaucaccaaaccaacaag

SEQ ID NO: 662331 - RNA, 19 nt, Escherichia coli CFT073
aaucaccaaacugcucgua

SEQ ID NO: 662332 - RNA, 16 nt, Escherichia coli CFT073
aaucaccagaggaugc

SEQ ID NO: 662333 - RNA, 21 nt, Escherichia coli CFT073
aaucaccaccagcggaauauc

SEQ ID NO: 662334 - RNA, 23 nt, Escherichia coli CFT073
aaucaccaccagcggaauaucag

SEQ ID NO: 662335 - RNA, 20 nt, Escherichia coli CFT073
aaucacaacacgaauaccaa

SEQ ID NO: 662336 - RNA, 18 nt, Escherichia coli CFT073
aaucaccaucagcagcaa

SEQ ID NO: 662337 - RNA, 20 nt, Escherichia coli CFT073
aaucaccccgagcgaauaaa

SEQ ID NO: 662338 - RNA, 22 nt, Escherichia coli CFT073
aaucaccccgagcgaauaaacc

SEQ ID NO: 662339 - RNA, 20 nt, Escherichia coli CFT073
aaucacccgagagaacugcu

SEQ ID NO: 662340 - RNA, 19 nt, Escherichia coli CFT073
aaucaccgaugacagaauc

SEQ ID NO: 662341 - RNA, 19 nt, Escherichia coli CFT073
aaucaccgccaccagcguc

SEQ ID NO: 662342 - RNA, 22 nt, Escherichia coli CFT073
aaucaccgcuucacucccugcc

SEQ ID NO: 662343 - RNA, 20 nt, Escherichia coli CFT073
aaucacgauggcgggccugg

SEQ ID NO: 662344 - RNA, 17 nt, Escherichia coli CFT073
aaucaccucaucaccac

SEQ ID NO: 662345 - RNA, 19 nt, Escherichia coli CFT073
aaucaccucaucaccacag

SEQ ID NO: 662346 - RNA, 15 nt, Escherichia coli CFT073
aaucaccucuuugua

SEQ ID NO: 662347 - RNA, 15 nt, Escherichia coli CFT073
aaucacucuuccccg

SEQ ID NO: 662348 - RNA, 22 nt, Escherichia coli CFT073
aaucacuauuaaagaaaguaau

SEQ ID NO: 662349 - RNA, 23 nt, Escherichia coli CFT073
aaucacgcucaacuuccugaauc

SEQ ID NO: 662350 - RNA, 13 nt, Escherichia coli CFT073
aaucagaaaggcg

SEQ ID NO: 662351 - RNA, 14 nt, Escherichia coli CFT073
aaucacuucaucgc

SEQ ID NO: 662352 - RNA, 15 nt, Escherichia coli CFT073
aaucacugccaccag

SEQ ID NO: 662353 - RNA, 14 nt, Escherichia coli CFT073
aaucacugccagaa

SEQ ID NO: 662354 - RNA, 22 nt, Escherichia coli CFT073
aauuaucggagaaauucugcau

SEQ ID NO: 662355 - RNA, 13 nt, Escherichia coli CFT073
aauuaucauuuuu

SEQ ID NO: 662356 - RNA, 15 nt, Escherichia coli CFT073
aauuauccauauuca

SEQ ID NO: 662357 - RNA, 17 nt, Escherichia coli CFT073
aauuaagaucagaagca

SEQ ID NO: 662358 - RNA, 13 nt, Escherichia coli CFT073
aauuaacuccagu

SEQ ID NO: 662359 - RNA, 13 nt, Escherichia coli CFT073
aauuaagcggcaa

SEQ ID NO: 662360 - RNA, 23 nt, Escherichia coli CFT073
aauuauugccuugaugaaaaaac

SEQ ID NO: 662361 - RNA, 24 nt, Escherichia coli CFT073
aauuaucuauuaaagaguuguaau

SEQ ID NO: 662362 - RNA, 13 nt, Escherichia coli CFT073
aauuauucagagu

SEQ ID NO: 662363 - RNA, 22 nt, Escherichia coli CFT073
aauuauucccgcgcuaccacuu

SEQ ID NO: 662364 - RNA, 19 nt, Escherichia coli CFT073
aauucacguaucagcaugg

SEQ ID NO: 662365 - RNA, 18 nt, Escherichia coli CFT073
aauucacgccccagauug

SEQ ID NO: 662366 - RNA, 12 nt, Escherichia coli CFT073
aauucaggaggc

SEQ ID NO: 662367 - RNA, 21 nt, Escherichia coli CFT073
aauucagcguggcgaaucgcu

SEQ ID NO: 662368 - RNA, 14 nt, Escherichia coli CFT073
aauucgaagcugua

SEQ ID NO: 662369 - RNA, 16 nt, Escherichia coli CFT073
aauucgacuuucucug

SEQ ID NO: 662370 - RNA, 18 nt, Escherichia coli CFT073
aauucgacuuucucuggc

SEQ ID NO: 662371 - RNA, 15 nt, Escherichia coli CFT073
aauuccauuuucacc

SEQ ID NO: 662372 - RNA, 22 nt, Escherichia coli CFT073
aauuccccugccagaagcagaa

SEQ ID NO: 662373 - RNA, 14 nt, Escherichia coli CFT073
aauuccccacccca

SEQ ID NO: 662374 - RNA, 22 nt, Escherichia coli CFT073
aauucaucguaaucucuuucca

SEQ ID NO: 662375 - RNA, 20 nt, Escherichia coli CFT073
aauucauccaguagaauaau

SEQ ID NO: 662376 - RNA, 20 nt, Escherichia coli CFT073
aauucaucuuucaucuguuu

SEQ ID NO: 662377 - RNA, 20 nt, Escherichia coli CFT073
aauucauuacgaaguuuaau

SEQ ID NO: 662378 - RNA, 17 nt, Escherichia coli CFT073
aauucauugaauuuaau

SEQ ID NO: 662379 - RNA, 12 nt, Escherichia coli CFT073
aauuguuucauc

SEQ ID NO: 662380 - RNA, 19 nt, Escherichia coli CFT073
aauuguuucaucgucagcu

SEQ ID NO: 662381 - RNA, 15 nt, Escherichia coli CFT073
aauuuaaaauugaua

SEQ ID NO: 662382 - RNA, 20 nt, Escherichia coli CFT073
aauuuaaaauugauaaccaa

SEQ ID NO: 662383 - RNA, 22 nt, Escherichia coli CFT073
aauuguaguguugcaguaaauu

SEQ ID NO: 662384 - RNA, 14 nt, Escherichia coli CFT073
aauuguauccaugc

SEQ ID NO: 662385 - RNA, 21 nt, Escherichia coli CFT073
aauugaaagagccgauaaaca

SEQ ID NO: 662386 - RNA, 17 nt, Escherichia coli CFT073
aauucuuuuucugaaga

SEQ ID NO: 662387 - RNA, 15 nt, Escherichia coli CFT073
aaaacaagcagcugc

SEQ ID NO: 662388 - RNA, 22 nt, Escherichia coli CFT073
aauugcaucuacgcucucuuca

SEQ ID NO: 662389 - RNA, 11 nt, Escherichia coli CFT073
aauugcagggu

SEQ ID NO: 662390 - RNA, 21 nt, Escherichia coli CFT073
aauugcaguacgauaauggcu

SEQ ID NO: 662391 - RNA, 23 nt, Escherichia coli CFT073
aauugcaguacgauaauggcuuc

SEQ ID NO: 662392 - RNA, 14 nt, Escherichia coli CFT073
aauugccagacaac

SEQ ID NO: 662393 - RNA, 16 nt, Escherichia coli CFT073
aauugccauaaaaacg

SEQ ID NO: 662394 - RNA, 18 nt, Escherichia coli CFT073
aauugccauauaugccau

SEQ ID NO: 662395 - RNA, 18 nt, Escherichia coli CFT073
aauugccauuacuacaaa

SEQ ID NO: 662396 - RNA, 16 nt, Escherichia coli CFT073
aauugcccaaagccaa

SEQ ID NO: 662397 - RNA, 18 nt, Escherichia coli CFT073
aauugcccaaagccaauc

SEQ ID NO: 662398 - RNA, 21 nt, Escherichia coli CFT073
aauugccgcaccaaccaucag

SEQ ID NO: 662399 - RNA, 16 nt, Escherichia coli CFT073
aauugccugaugcgcu

SEQ ID NO: 662400 - RNA, 18 nt, Escherichia coli CFT073
aauugccuguucaaccuc

SEQ ID NO: 662401 - RNA, 17 nt, Escherichia coli CFT073
aauguugcgccucaaga

SEQ ID NO: 662402 - RNA, 21 nt, Escherichia coli CFT073
aauguugcgcgguuagaaaau

SEQ ID NO: 662403 - RNA, 18 nt, Escherichia coli CFT073
aauguugucgcagacgac

SEQ ID NO: 662404 - RNA, 23 nt, Escherichia coli CFT073
aauguuggcgcgcgcuuuuacug

SEQ ID NO: 662405 - RNA, 15 nt, Escherichia coli CFT073
aauuaaccagaaaua

SEQ ID NO: 662406 - RNA, 17 nt, Escherichia coli CFT073
aauuaaccagaaauaga

SEQ ID NO: 662407 - RNA, 22 nt, Escherichia coli CFT073
aauuaaauuguucauauuaacc

SEQ ID NO: 662408 - RNA, 14 nt, Escherichia coli CFT073
aauuaaacagcccu

SEQ ID NO: 662409 - RNA, 18 nt, Escherichia coli CFT073
aauuaaacagcccuuuga

SEQ ID NO: 662410 - RNA, 14 nt, Escherichia coli CFT073
aauuaaacacgggg

SEQ ID NO: 662411 - RNA, 15 nt, Escherichia coli CFT073
aaugucagaaagaaa

SEQ ID NO: 662412 - RNA, 14 nt, Escherichia coli CFT073
aaugucagguauug

SEQ ID NO: 662413 - RNA, 21 nt, Escherichia coli CFT073
aaugucaccuaauuuaaaauu

SEQ ID NO: 662414 - RNA, 22 nt, Escherichia coli CFT073
aaugucaccuaauuuaaaauug

SEQ ID NO: 662415 - RNA, 21 nt, Escherichia coli CFT073
aaugucaucucuggcacgaga

SEQ ID NO: 662416 - RNA, 16 nt, Escherichia coli CFT073
aaugucauggcagucu

SEQ ID NO: 662417 - RNA, 17 nt, Escherichia coli CFT073
aauguccauauauaaaa

SEQ ID NO: 662418 - RNA, 13 nt, Escherichia coli CFT073
aauguuacgaccu

SEQ ID NO: 662419 - RNA, 14 nt, Escherichia coli CFT073
aauguuauccauau

SEQ ID NO: 662420 - RNA, 13 nt, Escherichia coli CFT073
aauguggaaagcc

SEQ ID NO: 662421 - RNA, 16 nt, Escherichia coli CFT073
aaugugguuagagaac

SEQ ID NO: 662422 - RNA, 22 nt, Escherichia coli CFT073
aaugugcuuucaccaauguugu

SEQ ID NO: 662423 - RNA, 16 nt, Escherichia coli CFT073
aauguggcaucagguu

SEQ ID NO: 662424 - RNA, 19 nt, Escherichia coli CFT073
aauguguuuauaagccaua

SEQ ID NO: 662425 - RNA, 23 nt, Escherichia coli CFT073
aauggcgaccacugaccgcccgg

SEQ ID NO: 662426 - RNA, 14 nt, Escherichia coli CFT073
aauggcgcgaaaac

SEQ ID NO: 662427 - RNA, 17 nt, Escherichia coli CFT073
aauggcgcgaaaacaac

SEQ ID NO: 662428 - RNA, 16 nt, Escherichia coli CFT073
aaugguuucgcuuugc

SEQ ID NO: 662429 - RNA, 18 nt, Escherichia coli CFT073
aauguaaaaguugcaguc

SEQ ID NO: 662430 - RNA, 12 nt, Escherichia coli CFT073
aauguaaccaca

SEQ ID NO: 662431 - RNA, 14 nt, Escherichia coli CFT073
aauggcaucugaua

SEQ ID NO: 662432 - RNA, 17 nt, Escherichia coli CFT073
aauggauaagaaagaua

SEQ ID NO: 662433 - RNA, 16 nt, Escherichia coli CFT073
aauggagagaaccagc

SEQ ID NO: 662434 - RNA, 24 nt, Escherichia coli CFT073
aauggccugaugcgcuuaucagac

SEQ ID NO: 662435 - RNA, 20 nt, Escherichia coli CFT073
aauggcaucugauaagccca

SEQ ID NO: 662436 - RNA, 19 nt, Escherichia coli CFT073
aaugcgccuauaaggcucu

SEQ ID NO: 662437 - RNA, 14 nt, Escherichia coli CFT073
aaugcgccugcaua

SEQ ID NO: 662438 - RNA, 17 nt, Escherichia coli CFT073
aaugcgcgcuaugauga

SEQ ID NO: 662439 - RNA, 18 nt, Escherichia coli CFT073
aaugcgcgcgaaaacauc

SEQ ID NO: 662440 - RNA, 20 nt, Escherichia coli CFT073
aaugcgcuuccggcagcuuc

SEQ ID NO: 662441 - RNA, 18 nt, Escherichia coli CFT073
aaugcggaugagauacau

SEQ ID NO: 662442 - RNA, 20 nt, Escherichia coli CFT073
aaugcggagauuccgcuugc

SEQ ID NO: 662443 - RNA, 20 nt, Escherichia coli CFT073
aaugcuuaacgccagacagc

SEQ ID NO: 662444 - RNA, 14 nt, Escherichia coli CFT073
aaugcuugacgcgu

SEQ ID NO: 662445 - RNA, 13 nt, Escherichia coli CFT073
aaugcuucuaccg

SEQ ID NO: 662446 - RNA, 15 nt, Escherichia coli CFT073
aaugcuuucaguacu

SEQ ID NO: 662447 - RNA, 17 nt, Escherichia coli CFT073
aauggaaacagcaccau

SEQ ID NO: 662448 - RNA, 14 nt, Escherichia coli CFT073
aaucuucuucuuua

SEQ ID NO: 662449 - RNA, 15 nt, Escherichia coli CFT073
aaugcaauuacauau

SEQ ID NO: 662450 - RNA, 15 nt, Escherichia coli CFT073
aaugcagcaaccaga

SEQ ID NO: 662451 - RNA, 19 nt, Escherichia coli CFT073
aaugccaaauauuucuuua

SEQ ID NO: 662452 - RNA, 17 nt, Escherichia coli CFT073
aaugccacugaauaaag

SEQ ID NO: 662453 - RNA, 15 nt, Escherichia coli CFT073
aaugccaccacacca

SEQ ID NO: 662454 - RNA, 14 nt, Escherichia coli CFT073
aaugccaccagugc

SEQ ID NO: 662455 - RNA, 12 nt, Escherichia coli CFT073
aaugccauauaa

SEQ ID NO: 662456 - RNA, 14 nt, Escherichia coli CFT073
aaugccaucaccaa

SEQ ID NO: 662457 - RNA, 15 nt, Escherichia coli CFT073
aaugccaucaccaac

SEQ ID NO: 662458 - RNA, 19 nt, Escherichia coli CFT073
aaugccauucacaaaaaca

SEQ ID NO: 662459 - RNA, 21 nt, Escherichia coli CFT073
aaugccauucacaaaaacagu

SEQ ID NO: 662460 - RNA, 17 nt, Escherichia coli CFT073
aaugccauccuugauca

SEQ ID NO: 662461 - RNA, 15 nt, Escherichia coli CFT073
aaugccaggcuccag

SEQ ID NO: 662462 - RNA, 14 nt, Escherichia coli CFT073
aaugcgauggugaa

SEQ ID NO: 662463 - RNA, 21 nt, Escherichia coli CFT073
aaugcgaaaacgauguuugcu

SEQ ID NO: 662464 - RNA, 18 nt, Escherichia coli CFT073
aaugcgaaugaaagauga

SEQ ID NO: 662465 - RNA, 19 nt, Escherichia coli CFT073
aaugccuugauauguauua

SEQ ID NO: 662466 - RNA, 21 nt, Escherichia coli CFT073
aaugccuuugaaaucgaacag

SEQ ID NO: 662467 - RNA, 22 nt, Escherichia coli CFT073
acaaaaaacggccccagaaggg

SEQ ID NO: 662468 - RNA, 22 nt, Escherichia coli CFT073
acaaaaaauugaaaauucaaua

SEQ ID NO: 662469 - RNA, 23 nt, Escherichia coli CFT073
acaaaaauaccauuagucacauu

SEQ ID NO: 662470 - RNA, 18 nt, Escherichia coli CFT073
acaaaacauacuuucuca

SEQ ID NO: 662471 - RNA, 14 nt, Escherichia coli CFT073
acaaaauccugcca

SEQ ID NO: 662472 - RNA, 21 nt, Escherichia coli CFT073
acaaaauccugccagcgugag

SEQ ID NO: 662473 - RNA, 14 nt, Escherichia coli CFT073
acaaaauaccgaug

SEQ ID NO: 662474 - RNA, 13 nt, Escherichia coli CFT073
acaaaaucaauau

SEQ ID NO: 662475 - RNA, 20 nt, Escherichia coli CFT073
acaaaaucaauauaaacagc

SEQ ID NO: 662476 - RNA, 13 nt, Escherichia coli CFT073
acaaaaugccagc

SEQ ID NO: 662477 - RNA, 23 nt, Escherichia coli CFT073
acaaaauggggacaucaaagaaa

SEQ ID NO: 662478 - RNA, 12 nt, Escherichia coli CFT073
acaaaaccugcc

SEQ ID NO: 662479 - RNA, 12 nt, Escherichia coli CFT073
acaaaagcaccg

SEQ ID NO: 662480 - RNA, 21 nt, Escherichia coli CFT073
acaaaagaauggcuguagggu

SEQ ID NO: 662481 - RNA, 17 nt, Escherichia coli CFT073
acaaaagcggugauaaa

SEQ ID NO: 662482 - RNA, 22 nt, Escherichia coli CFT073
acaaaagcggugauaaacccaa

SEQ ID NO: 662483 - RNA, 18 nt, Escherichia coli CFT073
acaaaaguggacauguuu

SEQ ID NO: 662484 - RNA, 15 nt, Escherichia coli CFT073
acaaagccaacagca

SEQ ID NO: 662485 - RNA, 21 nt, Escherichia coli CFT073
acaaagcaaauaauguccaua

SEQ ID NO: 662486 - RNA, 17 nt, Escherichia coli CFT073
acaaagcaauauuaugg

SEQ ID NO: 662487 - RNA, 18 nt, Escherichia coli CFT073
acaaacguucauacgcaa

SEQ ID NO: 662488 - RNA, 20 nt, Escherichia coli CFT073
acaaacuuccagaauauguu

SEQ ID NO: 662489 - RNA, 18 nt, Escherichia coli CFT073
acaaagacgucaaacccu

SEQ ID NO: 662490 - RNA, 15 nt, Escherichia coli CFT073
acaaaauuuuugcca

SEQ ID NO: 662491 - RNA, 15 nt, Escherichia coli CFT073
acaaaauuuauccag

SEQ ID NO: 662492 - RNA, 16 nt, Escherichia coli CFT073
acaaacauaaagccug

SEQ ID NO: 662493 - RNA, 11 nt, Escherichia coli CFT073
acaaacagaau

SEQ ID NO: 662494 - RNA, 20 nt, Escherichia coli CFT073
acaaacaaugccagaaacau

SEQ ID NO: 662495 - RNA, 14 nt, Escherichia coli CFT073
acaaaccagcccga

SEQ ID NO: 662496 - RNA, 14 nt, Escherichia coli CFT073
acaaacgcaaucca

SEQ ID NO: 662497 - RNA, 18 nt, Escherichia coli CFT073
acaaacgcaauccagugg

SEQ ID NO: 662498 - RNA, 19 nt, Escherichia coli CFT073
acaaacggugagacgccag

SEQ ID NO: 662499 - RNA, 13 nt, Escherichia coli CFT073
acaaacucauuaa

SEQ ID NO: 662500 - RNA, 21 nt, Escherichia coli CFT073
acaaacuccccgcaaaccaga

SEQ ID NO: 662501 - RNA, 19 nt, Escherichia coli CFT073
acaaacgccggauggcaca

SEQ ID NO: 662502 - RNA, 19 nt, Escherichia coli CFT073
acaaacgcuguaauuacca

SEQ ID NO: 662503 - RNA, 21 nt, Escherichia coli CFT073
acaaacgcuuuacucaacucc

SEQ ID NO: 662504 - RNA, 20 nt, Escherichia coli CFT073
acaaagucuaaaaaugugcc

SEQ ID NO: 662505 - RNA, 21 nt, Escherichia coli CFT073
acaaaguaauucccaguuacu

SEQ ID NO: 662506 - RNA, 15 nt, Escherichia coli CFT073
acaaagguuuguaac

SEQ ID NO: 662507 - RNA, 18 nt, Escherichia coli CFT073
acaaaggguaaagcacca

SEQ ID NO: 662508 - RNA, 19 nt, Escherichia coli CFT073
acaaauaucuuucuaccau

SEQ ID NO: 662509 - RNA, 19 nt, Escherichia coli CFT073
acaaauagccaauucccag

SEQ ID NO: 662510 - RNA, 16 nt, Escherichia coli CFT073
acaaauagccagcaga

SEQ ID NO: 662511 - RNA, 17 nt, Escherichia coli CFT073
acaaauagccagcagag

SEQ ID NO: 662512 - RNA, 19 nt, Escherichia coli CFT073
acaaauguggcaucagguu

SEQ ID NO: 662513 - RNA, 20 nt, Escherichia coli CFT073
acaaaugaaagcagcagcug

SEQ ID NO: 662514 - RNA, 15 nt, Escherichia coli CFT073
acaaaucucccuugc

SEQ ID NO: 662515 - RNA, 17 nt, Escherichia coli CFT073
acaacccagacaaauaa

SEQ ID NO: 662516 - RNA, 20 nt, Escherichia coli CFT073
acaacccagacaaauaacga

SEQ ID NO: 662517 - RNA, 16 nt, Escherichia coli CFT073
acaaccguucacgcau

SEQ ID NO: 662518 - RNA, 21 nt, Escherichia coli CFT073
acaaccguucacgcauuugca

SEQ ID NO: 662519 - RNA, 18 nt, Escherichia coli CFT073
acaaccguuucaugccau

SEQ ID NO: 662520 - RNA, 18 nt, Escherichia coli CFT073
acaaccgccauccaggua

SEQ ID NO: 662521 - RNA, 20 nt, Escherichia coli CFT073
acaacaucacaccugcucag

SEQ ID NO: 662522 - RNA, 18 nt, Escherichia coli CFT073
acaacaugagaacaguuc

SEQ ID NO: 662523 - RNA, 23 nt, Escherichia coli CFT073
acaacaugcuauuacgccagccu

SEQ ID NO: 662524 - RNA, 17 nt, Escherichia coli CFT073
acaacauugauaagcaa

SEQ ID NO: 662525 - RNA, 19 nt, Escherichia coli CFT073
acaacauugauaagcaagu

SEQ ID NO: 662526 - RNA, 14 nt, Escherichia coli CFT073
acaacaacaucaca

SEQ ID NO: 662527 - RNA, 16 nt, Escherichia coli CFT073
acaacacucucugcag

SEQ ID NO: 662528 - RNA, 20 nt, Escherichia coli CFT073
acaccucaacccgguugcuu

SEQ ID NO: 662529 - RNA, 22 nt, Escherichia coli CFT073
acaccgugaucgacccauaaug

SEQ ID NO: 662530 - RNA, 16 nt, Escherichia coli CFT073
acaccggugaccauca

SEQ ID NO: 662531 - RNA, 23 nt, Escherichia coli CFT073
acaccggugauuauugucgugcc

SEQ ID NO: 662532 - RNA, 15 nt, Escherichia coli CFT073
acaccguaauugcca

SEQ ID NO: 662533 - RNA, 18 nt, Escherichia coli CFT073
acaccguaauugccagac

SEQ ID NO: 662534 - RNA, 21 nt, Escherichia coli CFT073
acaccgcuguugccagcagca

SEQ ID NO: 662535 - RNA, 16 nt, Escherichia coli CFT073
acaccggcaauaauua

SEQ ID NO: 662536 - RNA, 14 nt, Escherichia coli CFT073
acaccggcagagau

SEQ ID NO: 662537 - RNA, 15 nt, Escherichia coli CFT073
acaccugacaauccg

SEQ ID NO: 662538 - RNA, 17 nt, Escherichia coli CFT073
acaccugccaccagcac

SEQ ID NO: 662539 - RNA, 16 nt, Escherichia coli CFT073
acaccucauccgaugg

SEQ ID NO: 662540 - RNA, 15 nt, Escherichia coli CFT073
acaccucguauucca

SEQ ID NO: 662541 - RNA, 13 nt, Escherichia coli CFT073
acaccuuaaggcu

SEQ ID NO: 662542 - RNA, 24 nt, Escherichia coli CFT073
acaccuucuccggccuacaaaaca

SEQ ID NO: 662543 - RNA, 19 nt, Escherichia coli CFT073
acaccuucagcgaagccca

SEQ ID NO: 662544 - RNA, 21 nt, Escherichia coli CFT073
acacgauucguauaauuuauu

SEQ ID NO: 662545 - RNA, 14 nt, Escherichia coli CFT073
acacgcagaccaac

SEQ ID NO: 662546 - RNA, 13 nt, Escherichia coli CFT073
acacgacaugacc

SEQ ID NO: 662547 - RNA, 13 nt, Escherichia coli CFT073
acacgacgccagc

SEQ ID NO: 662548 - RNA, 14 nt, Escherichia coli CFT073
acacgacgccagcc

SEQ ID NO: 662549 - RNA, 19 nt, Escherichia coli CFT073
acacgacgcgccagcagcg

SEQ ID NO: 662550 - RNA, 14 nt, Escherichia coli CFT073
acacgcucuggcag

SEQ ID NO: 662551 - RNA, 21 nt, Escherichia coli CFT073
acacgcugaagaucuucaguc

SEQ ID NO: 662552 - RNA, 14 nt, Escherichia coli CFT073
acacgcgcccagcc

SEQ ID NO: 662553 - RNA, 15 nt, Escherichia coli CFT073
acacgcguguaagca

SEQ ID NO: 662554 - RNA, 23 nt, Escherichia coli CFT073
acacggcucgccuuuucgcccgu

SEQ ID NO: 662555 - RNA, 17 nt, Escherichia coli CFT073
acacgggaaaccaacuc

SEQ ID NO: 662556 - RNA, 15 nt, Escherichia coli CFT073
acaccaacaucacgu

SEQ ID NO: 662557 - RNA, 14 nt, Escherichia coli CFT073
acaccaacgccccg

SEQ ID NO: 662558 - RNA, 17 nt, Escherichia coli CFT073
acaccaaggaacugugc

SEQ ID NO: 662559 - RNA, 18 nt, Escherichia coli CFT073
acaccaaucuucaacacu

SEQ ID NO: 662560 - RNA, 16 nt, Escherichia coli CFT073
acaccaauugugguac

SEQ ID NO: 662561 - RNA, 15 nt, Escherichia coli CFT073
acaccaccagcgcca

SEQ ID NO: 662562 - RNA, 12 nt, Escherichia coli CFT073
acacccacauca

SEQ ID NO: 662563 - RNA, 21 nt, Escherichia coli CFT073
acaccccgcgccgcugagaaa

SEQ ID NO: 662564 - RNA, 22 nt, Escherichia coli CFT073
acaccccgcgccgcugagaaaa

SEQ ID NO: 662565 - RNA, 22 nt, Escherichia coli CFT073
acaccccgguaaagcgcaugau

SEQ ID NO: 662566 - RNA, 17 nt, Escherichia coli CFT073
acaccgccguugauuuc

SEQ ID NO: 662567 - RNA, 20 nt, Escherichia coli CFT073
acaccgccguugauuucaca

SEQ ID NO: 662568 - RNA, 18 nt, Escherichia coli CFT073
acaccgccuaccgccagu

SEQ ID NO: 662569 - RNA, 13 nt, Escherichia coli CFT073
acacaacaauacc

SEQ ID NO: 662570 - RNA, 22 nt, Escherichia coli CFT073
acacaagguauccagacggcgc

SEQ ID NO: 662571 - RNA, 20 nt, Escherichia coli CFT073
acacauugugaaugaucagc

SEQ ID NO: 662572 - RNA, 13 nt, Escherichia coli CFT073
acaccaacaucac

SEQ ID NO: 662573 - RNA, 14 nt, Escherichia coli CFT073
acaccaacaucacg

SEQ ID NO: 662574 - RNA, 17 nt, Escherichia coli CFT073
acacauguguucccugu

SEQ ID NO: 662575 - RNA, 14 nt, Escherichia coli CFT073
acacaugcugacua

SEQ ID NO: 662576 - RNA, 15 nt, Escherichia coli CFT073
acaagcucucuucau

SEQ ID NO: 662577 - RNA, 18 nt, Escherichia coli CFT073
acaagcucauuucccaac

SEQ ID NO: 662578 - RNA, 13 nt, Escherichia coli CFT073
acaagcuaccagc

SEQ ID NO: 662579 - RNA, 15 nt, Escherichia coli CFT073
acaagcugaacgcag

SEQ ID NO: 662580 - RNA, 17 nt, Escherichia coli CFT073
acaaggcgggagaaaug

SEQ ID NO: 662581 - RNA, 17 nt, Escherichia coli CFT073
acaaggcuauccucuaa

SEQ ID NO: 662582 - RNA, 13 nt, Escherichia coli CFT073
acaaguucuucga

SEQ ID NO: 662583 - RNA, 19 nt, Escherichia coli CFT073
acaaguucgaaccaacaau

SEQ ID NO: 662584 - RNA, 17 nt, Escherichia coli CFT073
acaaguucgcuccagcc

SEQ ID NO: 662585 - RNA, 13 nt, Escherichia coli CFT073
acaauaccaaucg

SEQ ID NO: 662586 - RNA, 16 nt, Escherichia coli CFT073
acaauacugaucauca

SEQ ID NO: 662587 - RNA, 20 nt, Escherichia coli CFT073
acaauacgcccgguggcggu

SEQ ID NO: 662588 - RNA, 20 nt, Escherichia coli CFT073
acaauauugaugcucgcugc

SEQ ID NO: 662589 - RNA, 21 nt, Escherichia coli CFT073
acaaucaucgcauccagcgug

SEQ ID NO: 662590 - RNA, 14 nt, Escherichia coli CFT073
acaauccagucagc

SEQ ID NO: 662591 - RNA, 13 nt, Escherichia coli CFT073
acaaucagccaga

SEQ ID NO: 662592 - RNA, 20 nt, Escherichia coli CFT073
acaaucaccaggucaccaga

SEQ ID NO: 662593 - RNA, 16 nt, Escherichia coli CFT073
acaauccgcucuuuca

SEQ ID NO: 662594 - RNA, 12 nt, Escherichia coli CFT073
acaauccuuccc

SEQ ID NO: 662595 - RNA, 21 nt, Escherichia coli CFT073
acaaucccuuaguaacgccag

SEQ ID NO: 662596 - RNA, 15 nt, Escherichia coli CFT073
acaauccgccaggac

SEQ ID NO: 662597 - RNA, 17 nt, Escherichia coli CFT073
acaaucgucagcucgcu

SEQ ID NO: 662598 - RNA, 16 nt, Escherichia coli CFT073
acaaucgggaaaaucu

SEQ ID NO: 662599 - RNA, 23 nt, Escherichia coli CFT073
acaaucgggaaaaucugcgggaa

SEQ ID NO: 662600 - RNA, 16 nt, Escherichia coli CFT073
acaaucgcaaauaugu

SEQ ID NO: 662601 - RNA, 15 nt, Escherichia coli CFT073
acaaucccuuccacc

SEQ ID NO: 662602 - RNA, 23 nt, Escherichia coli CFT073
acaaucgcucacaacaauaucaa

SEQ ID NO: 662603 - RNA, 23 nt, Escherichia coli CFT073
acaaucgcuucaucgcccacauc

SEQ ID NO: 662604 - RNA, 18 nt, Escherichia coli CFT073
acaauugcgggccaaaga

SEQ ID NO: 662605 - RNA, 17 nt, Escherichia coli CFT073
acaaugcaaacggcgcg

SEQ ID NO: 662606 - RNA, 20 nt, Escherichia coli CFT073
acaaugccucgcuaaucucu

SEQ ID NO: 662607 - RNA, 22 nt, Escherichia coli CFT073
acaaugcggugugcggguuuuc

SEQ ID NO: 662608 - RNA, 17 nt, Escherichia coli CFT073
acaaugccguaaccagc

SEQ ID NO: 662609 - RNA, 18 nt, Escherichia coli CFT073
acaaugccgaauagaaca

SEQ ID NO: 662610 - RNA, 19 nt, Escherichia coli CFT073
acaaugcaauauuuugaau

SEQ ID NO: 662611 - RNA, 17 nt, Escherichia coli CFT073
acagccaaaucaucagu

SEQ ID NO: 662612 - RNA, 17 nt, Escherichia coli CFT073
acagccagaaucaaggu

SEQ ID NO: 662613 - RNA, 23 nt, Escherichia coli CFT073
acagccagaaugaggcaucauua

SEQ ID NO: 662614 - RNA, 13 nt, Escherichia coli CFT073
acagcaggaaaau

SEQ ID NO: 662615 - RNA, 19 nt, Escherichia coli CFT073
acagcaggcagauccaguu

SEQ ID NO: 662616 - RNA, 22 nt, Escherichia coli CFT073
acagcgaaaacgacgagccacc

SEQ ID NO: 662617 - RNA, 18 nt, Escherichia coli CFT073
acagccuuauugucuuua

SEQ ID NO: 662618 - RNA, 23 nt, Escherichia coli CFT073
acagccuucggacguuugccaug

SEQ ID NO: 662619 - RNA, 14 nt, Escherichia coli CFT073
acagccuuaacaag

SEQ ID NO: 662620 - RNA, 21 nt, Escherichia coli CFT073
acagccagccgcuaacuuccu

SEQ ID NO: 662621 - RNA, 21 nt, Escherichia coli CFT073
acagccgccagacaauugccg

SEQ ID NO: 662622 - RNA, 19 nt, Escherichia coli CFT073
acacggcucaaccuucuuc

SEQ ID NO: 662623 - RNA, 12 nt, Escherichia coli CFT073
acagcaaaacgc

SEQ ID NO: 662624 - RNA, 15 nt, Escherichia coli CFT073
acagcaauaauaaua

SEQ ID NO: 662625 - RNA, 21 nt, Escherichia coli CFT073
acagcaagcagccgauaauau

SEQ ID NO: 662626 - RNA, 19 nt, Escherichia coli CFT073
acagcagccacaccaauca

SEQ ID NO: 662627 - RNA, 13 nt, Escherichia coli CFT073
acaggcugcugcc

SEQ ID NO: 662628 - RNA, 20 nt, Escherichia coli CFT073
acaggcuggcgucacgccga

SEQ ID NO: 662629 - RNA, 18 nt, Escherichia coli CFT073
acaggcgaaaccagcagc

SEQ ID NO: 662630 - RNA, 13 nt, Escherichia coli CFT073
acaggcgauuuca

SEQ ID NO: 662631 - RNA, 17 nt, Escherichia coli CFT073
acaggaaacagcuugcu

SEQ ID NO: 662632 - RNA, 18 nt, Escherichia coli CFT073
acaggaaauaagaagcca

SEQ ID NO: 662633 - RNA, 13 nt, Escherichia coli CFT073
acaggaaccaaau

SEQ ID NO: 662634 - RNA, 15 nt, Escherichia coli CFT073
acaggaaccaaaugc

SEQ ID NO: 662635 - RNA, 14 nt, Escherichia coli CFT073
acagcuuuuuccug

SEQ ID NO: 662636 - RNA, 16 nt, Escherichia coli CFT073
acagcuuuuuccugcg

SEQ ID NO: 662637 - RNA, 15 nt, Escherichia coli CFT073
acagcgcaauacgaa

SEQ ID NO: 662638 - RNA, 14 nt, Escherichia coli CFT073
acagcgaccgcaga

SEQ ID NO: 662639 - RNA, 17 nt, Escherichia coli CFT073
acagcgccagacacugg

SEQ ID NO: 662640 - RNA, 16 nt, Escherichia coli CFT073
acagcguuuugccauc

SEQ ID NO: 662641 - RNA, 15 nt, Escherichia coli CFT073
acagcguuucuucga

SEQ ID NO: 662642 - RNA, 16 nt, Escherichia coli CFT073
acagcuauaccgccag

SEQ ID NO: 662643 - RNA, 18 nt, Escherichia coli CFT073
acaguugcaguuauuaua

SEQ ID NO: 662644 - RNA, 22 nt, Escherichia coli CFT073
acaguugcugcgugaccgccag

SEQ ID NO: 662645 - RNA, 17 nt, Escherichia coli CFT073
acaguucuucaaaaaua

SEQ ID NO: 662646 - RNA, 19 nt, Escherichia coli CFT073
acaguucuucaaaaauaau

SEQ ID NO: 662647 - RNA, 16 nt, Escherichia coli CFT073
acaguucuucaaaaau

SEQ ID NO: 662648 - RNA, 12 nt, Escherichia coli CFT073
acaguucaaucu

SEQ ID NO: 662649 - RNA, 14 nt, Escherichia coli CFT073
acagugcaggaugc

SEQ ID NO: 662650 - RNA, 18 nt, Escherichia coli CFT073
acagugaccaucuuccag

SEQ ID NO: 662651 - RNA, 22 nt, Escherichia coli CFT073
acagugaccaucuuccagcauc

SEQ ID NO: 662652 - RNA, 13 nt, Escherichia coli CFT073
acagugaaauaca

SEQ ID NO: 662653 - RNA, 14 nt, Escherichia coli CFT073
acagugaaucucuu

SEQ ID NO: 662654 - RNA, 21 nt, Escherichia coli CFT073
acaguggcgacaagcauaaca

SEQ ID NO: 662655 - RNA, 15 nt, Escherichia coli CFT073
acauaaaaaacgcga

SEQ ID NO: 662656 - RNA, 23 nt, Escherichia coli CFT073
acauaaaaaagccgggguaauuc

SEQ ID NO: 662657 - RNA, 13 nt, Escherichia coli CFT073
acauaacagccau

SEQ ID NO: 662658 - RNA, 15 nt, Escherichia coli CFT073
acauaaccaaucauc

SEQ ID NO: 662659 - RNA, 13 nt, Escherichia coli CFT073
acaguaacccagc

SEQ ID NO: 662660 - RNA, 17 nt, Escherichia coli CFT073
acaguaacccagcacca

SEQ ID NO: 662661 - RNA, 16 nt, Escherichia coli CFT073
acaguaagcccaccac

SEQ ID NO: 662662 - RNA, 21 nt, Escherichia coli CFT073
acaguaagccgguaaucacca

SEQ ID NO: 662663 - RNA, 15 nt, Escherichia coli CFT073
acaguacugccggga

SEQ ID NO: 662664 - RNA, 15 nt, Escherichia coli CFT073
acaguacugggauuc

SEQ ID NO: 662665 - RNA, 12 nt, Escherichia coli CFT073
acaguaccagca

SEQ ID NO: 662666 - RNA, 13 nt, Escherichia coli CFT073
acaguaucaccaa

SEQ ID NO: 662667 - RNA, 16 nt, Escherichia coli CFT073
acaguauccgggcauc

SEQ ID NO: 662668 - RNA, 20 nt, Escherichia coli CFT073
acagucacccgcugcgaaca

SEQ ID NO: 662669 - RNA, 22 nt, Escherichia coli CFT073
acagucaguuuguaagucagaa

SEQ ID NO: 662670 - RNA, 22 nt, Escherichia coli CFT073
acagucgaugcagccccacggc

SEQ ID NO: 662671 - RNA, 22 nt, Escherichia coli CFT073
acagucgcccgaccaucgccag

SEQ ID NO: 662672 - RNA, 19 nt, Escherichia coli CFT073
acagguggcguuugccacc

SEQ ID NO: 662673 - RNA, 16 nt, Escherichia coli CFT073
acagguugaagaucau

SEQ ID NO: 662674 - RNA, 19 nt, Escherichia coli CFT073
acaggggaugcuaugaaca

SEQ ID NO: 662675 - RNA, 15 nt, Escherichia coli CFT073
acaggggagccgcac

SEQ ID NO: 662676 - RNA, 13 nt, Escherichia coli CFT073
acagggcaacggc

SEQ ID NO: 662677 - RNA, 14 nt, Escherichia coli CFT073
acagguaagcacac

SEQ ID NO: 662678 - RNA, 20 nt, Escherichia coli CFT073
acaucguugauauuuguuuu

SEQ ID NO: 662679 - RNA, 14 nt, Escherichia coli CFT073
acaucgucgcaaau

SEQ ID NO: 662680 - RNA, 15 nt, Escherichia coli CFT073
acaucucaauauccg

SEQ ID NO: 662681 - RNA, 23 nt, Escherichia coli CFT073
acaucuagccugaugcgaugcug

SEQ ID NO: 662682 - RNA, 12 nt, Escherichia coli CFT073
acaucucuuccc

SEQ ID NO: 662683 - RNA, 16 nt, Escherichia coli CFT073
acaucugacaaaauca

SEQ ID NO: 662684 - RNA, 17 nt, Escherichia coli CFT073
acaucugguaauugacg

SEQ ID NO: 662685 - RNA, 19 nt, Escherichia coli CFT073
acaucugucugauaaaaaa

SEQ ID NO: 662686 - RNA, 22 nt, Escherichia coli CFT073
acaucuggucgaggaucucugc

SEQ ID NO: 662687 - RNA, 20 nt, Escherichia coli CFT073
acaucugucugauaaaaaac

SEQ ID NO: 662688 - RNA, 18 nt, Escherichia coli CFT073
acaugccgaauccgggaa

SEQ ID NO: 662689 - RNA, 21 nt, Escherichia coli CFT073
acaugcgaacuuuacugccuc

SEQ ID NO: 662690 - RNA, 16 nt, Escherichia coli CFT073
acaugccgucaaucca

SEQ ID NO: 662691 - RNA, 14 nt, Escherichia coli CFT073
acaugcugacuacu

SEQ ID NO: 662692 - RNA, 17 nt, Escherichia coli CFT073
acaugcuauuacgccag

SEQ ID NO: 662693 - RNA, 18 nt, Escherichia coli CFT073
acaugcggcgugccuuca

SEQ ID NO: 662694 - RNA, 16 nt, Escherichia coli CFT073
acaugcgggucuuacu

SEQ ID NO: 662695 - RNA, 15 nt, Escherichia coli CFT073
acauguauaaaaaga

SEQ ID NO: 662696 - RNA, 21 nt, Escherichia coli CFT073
acauguccgagcuuaaugaaa

SEQ ID NO: 662697 - RNA, 22 nt, Escherichia coli CFT073
acauguccgagcuuaaugaaaa

SEQ ID NO: 662698 - RNA, 17 nt, Escherichia coli CFT073
acauaaugccgacauca

SEQ ID NO: 662699 - RNA, 18 nt, Escherichia coli CFT073
acauaaugccgacaucaa

SEQ ID NO: 662700 - RNA, 20 nt, Escherichia coli CFT073
acauaaugccgacaucaaac

SEQ ID NO: 662701 - RNA, 23 nt, Escherichia coli CFT073
acauaaugccgacaucaaacagg

SEQ ID NO: 662702 - RNA, 13 nt, Escherichia coli CFT073
acauaaucgaaaa

SEQ ID NO: 662703 - RNA, 16 nt, Escherichia coli CFT073
acaucaauuacaccau

SEQ ID NO: 662704 - RNA, 12 nt, Escherichia coli CFT073
acaucacaccau

SEQ ID NO: 662705 - RNA, 13 nt, Escherichia coli CFT073
acaucacaugcug

SEQ ID NO: 662706 - RNA, 13 nt, Escherichia coli CFT073
acaucaccaacac

SEQ ID NO: 662707 - RNA, 17 nt, Escherichia coli CFT073
acaucaccaacugcccg

SEQ ID NO: 662708 - RNA, 15 nt, Escherichia coli CFT073
acaucaccaaugaca

SEQ ID NO: 662709 - RNA, 21 nt, Escherichia coli CFT073
acaucaccaaugacagcccca

SEQ ID NO: 662710 - RNA, 14 nt, Escherichia coli CFT073
acaucacgcagcug

SEQ ID NO: 662711 - RNA, 18 nt, Escherichia coli CFT073
acaucacgccuucaauau

SEQ ID NO: 662712 - RNA, 22 nt, Escherichia coli CFT073
acaucacgguugagagcaaaca

SEQ ID NO: 662713 - RNA, 13 nt, Escherichia coli CFT073
acaucauccccau

SEQ ID NO: 662714 - RNA, 21 nt, Escherichia coli CFT073
acauccugccaguaagcaguc

SEQ ID NO: 662715 - RNA, 19 nt, Escherichia coli CFT073
acaucgcgccaacaaaagc

SEQ ID NO: 662716 - RNA, 14 nt, Escherichia coli CFT073
acaucgcuuuccag

SEQ ID NO: 662717 - RNA, 21 nt, Escherichia coli CFT073
acaucgguauagauaaagucu

SEQ ID NO: 662718 - RNA, 13 nt, Escherichia coli CFT073
acaucgcugugcu

SEQ ID NO: 662719 - RNA, 14 nt, Escherichia coli CFT073
acaucgcuuaguua

SEQ ID NO: 662720 - RNA, 13 nt, Escherichia coli CFT073
acaucgcuuucca

SEQ ID NO: 662721 - RNA, 23 nt, Escherichia coli CFT073
acaucauccccacaccugacaau

SEQ ID NO: 662722 - RNA, 21 nt, Escherichia coli CFT073
acaucaugccggccagcgcca

SEQ ID NO: 662723 - RNA, 21 nt, Escherichia coli CFT073
acaucauuaacgccucaagua

SEQ ID NO: 662724 - RNA, 22 nt, Escherichia coli CFT073
acaucauugagacguuugagac

SEQ ID NO: 662725 - RNA, 22 nt, Escherichia coli CFT073
acauccugaguuaaucgccgca

SEQ ID NO: 662726 - RNA, 20 nt, Escherichia coli CFT073
acauccgggcaugaagaaag

SEQ ID NO: 662727 - RNA, 23 nt, Escherichia coli CFT073
acauccgggcgagcuuauauacu

SEQ ID NO: 662728 - RNA, 18 nt, Escherichia coli CFT073
acauccgguuucaucagc

SEQ ID NO: 662729 - RNA, 20 nt, Escherichia coli CFT073
acauccggcaauauccauua

SEQ ID NO: 662730 - RNA, 14 nt, Escherichia coli CFT073
acauuguuuuccag

SEQ ID NO: 662731 - RNA, 19 nt, Escherichia coli CFT073
acauugaugaaaagauuaa

SEQ ID NO: 662732 - RNA, 22 nt, Escherichia coli CFT073
acauuguuaaagcccugcucgc

SEQ ID NO: 662733 - RNA, 16 nt, Escherichia coli CFT073
acauugagcaaagacg

SEQ ID NO: 662734 - RNA, 16 nt, Escherichia coli CFT073
acauuacuaaacauuu

SEQ ID NO: 662735 - RNA, 16 nt, Escherichia coli CFT073
acauuacuaauuaaua

SEQ ID NO: 662736 - RNA, 21 nt, Escherichia coli CFT073
acauuacuaauuaauaauaua

SEQ ID NO: 662737 - RNA, 13 nt, Escherichia coli CFT073
acauuaauuuuca

SEQ ID NO: 662738 - RNA, 14 nt, Escherichia coli CFT073
acauuaauuuucaa

SEQ ID NO: 662739 - RNA, 17 nt, Escherichia coli CFT073
acauuacaaaauacaaa

SEQ ID NO: 662740 - RNA, 17 nt, Escherichia coli CFT073
acauuuagcguuaaaau

SEQ ID NO: 662741 - RNA, 14 nt, Escherichia coli CFT073
acauuucuucuuuc

SEQ ID NO: 662742 - RNA, 19 nt, Escherichia coli CFT073
acauuuaacccuucaagaa

SEQ ID NO: 662743 - RNA, 11 nt, Escherichia coli CFT073
acauuuuccau

SEQ ID NO: 662744 - RNA, 21 nt, Escherichia coli CFT073
acauuuuaaacaucaggcaaa

SEQ ID NO: 662745 - RNA, 15 nt, Escherichia coli CFT073
accaaaucgaaauga

SEQ ID NO: 662746 - RNA, 20 nt, Escherichia coli CFT073
accaaaucgaaaugauguuu

SEQ ID NO: 662747 - RNA, 14 nt, Escherichia coli CFT073
accaaaucugauua

SEQ ID NO: 662748 - RNA, 21 nt, Escherichia coli CFT073
accaaaucugauuaauauuga

SEQ ID NO: 662749 - RNA, 18 nt, Escherichia coli CFT073
accaaagccacccacacc

SEQ ID NO: 662750 - RNA, 13 nt, Escherichia coli CFT073
accaaaguagaua

SEQ ID NO: 662751 - RNA, 14 nt, Escherichia coli CFT073
accaaaugcagcaa

SEQ ID NO: 662752 - RNA, 11 nt, Escherichia coli CFT073
accaaaugccg

SEQ ID NO: 662753 - RNA, 12 nt, Escherichia coli CFT073
accaaaugacuc

SEQ ID NO: 662754 - RNA, 16 nt, Escherichia coli CFT073
accaaauugguaaaau

SEQ ID NO: 662755 - RNA, 14 nt, Escherichia coli CFT073
accaacaagcaccg

SEQ ID NO: 662756 - RNA, 15 nt, Escherichia coli CFT073
accaacaauacaaaa

SEQ ID NO: 662757 - RNA, 16 nt, Escherichia coli CFT073
accaacaauacaaaau

SEQ ID NO: 662758 - RNA, 17 nt, Escherichia coli CFT073
accaaagaaguucucca

SEQ ID NO: 662759 - RNA, 17 nt, Escherichia coli CFT073
accaaagaauccgcccu

SEQ ID NO: 662760 - RNA, 18 nt, Escherichia coli CFT073
accaaaaucuaccagcgg

SEQ ID NO: 662761 - RNA, 19 nt, Escherichia coli CFT073
accaaaccagccgccaacu

SEQ ID NO: 662762 - RNA, 13 nt, Escherichia coli CFT073
accaaaccaucac

SEQ ID NO: 662763 - RNA, 19 nt, Escherichia coli CFT073
accaaaauaacgaucauca

SEQ ID NO: 662764 - RNA, 12 nt, Escherichia coli CFT073
accaaaauacca

SEQ ID NO: 662765 - RNA, 12 nt, Escherichia coli CFT073
accaaaaucauc

SEQ ID NO: 662766 - RNA, 20 nt, Escherichia coli CFT073
accaaaacgugcagcugccu

SEQ ID NO: 662767 - RNA, 15 nt, Escherichia coli CFT073
accaaaaccggcucu

SEQ ID NO: 662768 - RNA, 14 nt, Escherichia coli CFT073
acuuggguaacagc

SEQ ID NO: 662769 - RNA, 13 nt, Escherichia coli CFT073
acuugguuacgca

SEQ ID NO: 662770 - RNA, 19 nt, Escherichia coli CFT073
acuuguaaaaucuucgcca

SEQ ID NO: 662771 - RNA, 21 nt, Escherichia coli CFT073
acuuguaaaaucuucgccacu

SEQ ID NO: 662772 - RNA, 21 nt, Escherichia coli CFT073
acuuguaaccuguaaaguaca

SEQ ID NO: 662773 - RNA, 22 nt, Escherichia coli CFT073
acuuagugcacuucuucacauc

SEQ ID NO: 662774 - RNA, 18 nt, Escherichia coli CFT073
acuuauaagucucagaaa

SEQ ID NO: 662775 - RNA, 17 nt, Escherichia coli CFT073
acuugcaggaacaaugc

SEQ ID NO: 662776 - RNA, 14 nt, Escherichia coli CFT073
acuuaucaagaaag

SEQ ID NO: 662777 - RNA, 11 nt, Escherichia coli CFT073
acuuaucauca

SEQ ID NO: 662778 - RNA, 14 nt, Escherichia coli CFT073
acuugcugcucuga

SEQ ID NO: 662779 - RNA, 17 nt, Escherichia coli CFT073
acuuuaaauucagcauu

SEQ ID NO: 662780 - RNA, 20 nt, Escherichia coli CFT073
acuuuaaaaucuuugaaaua

SEQ ID NO: 662781 - RNA, 19 nt, Escherichia coli CFT073
acuuuaauaaucucgccuu

SEQ ID NO: 662782 - RNA, 19 nt, Escherichia coli CFT073
acuuuaauuuugugcagca

SEQ ID NO: 662783 - RNA, 20 nt, Escherichia coli CFT073
acuuuacccguguuuugcau

SEQ ID NO: 662784 - RNA, 20 nt, Escherichia coli CFT073
acuuuaccgguuucaaucca

SEQ ID NO: 662785 - RNA, 21 nt, Escherichia coli CFT073
acuuuacuaaaaagugauaaa

SEQ ID NO: 662786 - RNA, 17 nt, Escherichia coli CFT073
acuuuagcacaaucgca

SEQ ID NO: 662787 - RNA, 18 nt, Escherichia coli CFT073
acuuuagcgaaaucuucc

SEQ ID NO: 662788 - RNA, 18 nt, Escherichia coli CFT073
acuuuaugauccagcuug

SEQ ID NO: 662789 - RNA, 16 nt, Escherichia coli CFT073
acuuuaucugauuuaa

SEQ ID NO: 662790 - RNA, 17 nt, Escherichia coli CFT073
acuuucacgccgccaaa

SEQ ID NO: 662791 - RNA, 18 nt, Escherichia coli CFT073
acuuucaccgguguuccc

SEQ ID NO: 662792 - RNA, 17 nt, Escherichia coli CFT073
acuuuguuguuuaccaa

SEQ ID NO: 662793 - RNA, 18 nt, Escherichia coli CFT073
acuuuguuccugaauuaa

SEQ ID NO: 662794 - RNA, 19 nt, Escherichia coli CFT073
acuuugugucagugucaga

SEQ ID NO: 662795 - RNA, 15 nt, Escherichia coli CFT073
acuuuguaggccuga

SEQ ID NO: 662796 - RNA, 21 nt, Escherichia coli CFT073
acuuuguaggccugauaagac

SEQ ID NO: 662797 - RNA, 16 nt, Escherichia coli CFT073
acuuugucaucaguca

SEQ ID NO: 662798 - RNA, 17 nt, Escherichia coli CFT073
acuuuuaaauugaagag

SEQ ID NO: 662799 - RNA, 13 nt, Escherichia coli CFT073
acuuugauuuaua

SEQ ID NO: 662800 - RNA, 22 nt, Escherichia coli CFT073
acuuuggugaaugccugaucaa

SEQ ID NO: 662801 - RNA, 19 nt, Escherichia coli CFT073
acuuuguaaggaguuuugu

SEQ ID NO: 662802 - RNA, 16 nt, Escherichia coli CFT073
acuuucgccaguucuu

SEQ ID NO: 662803 - RNA, 19 nt, Escherichia coli CFT073
acuuucggcaaccucgccc

SEQ ID NO: 662804 - RNA, 14 nt, Escherichia coli CFT073
acuuuccaguucaa

SEQ ID NO: 662805 - RNA, 16 nt, Escherichia coli CFT073
acuuuccaucuuuccu

SEQ ID NO: 662806 - RNA, 20 nt, Escherichia coli CFT073
acuuuccaugccaucugcca

SEQ ID NO: 662807 - RNA, 9 nt, Escherichia coli CFT073
acuuugaga

SEQ ID NO: 662808 - RNA, 18 nt, Escherichia coli CFT073
acuuugaaggauaagacg

SEQ ID NO: 662809 - RNA, 14 nt, Escherichia coli CFT073
acuuucuuuucccu

SEQ ID NO: 662810 - RNA, 22 nt, Escherichia coli CFT073
acuuucuuuuuguugcgcugaa

SEQ ID NO: 662811 - RNA, 12 nt, Escherichia coli CFT073
acuuucuucagg

SEQ ID NO: 662812 - RNA, 15 nt, Escherichia coli CFT073
acuuucugcaaacaa

SEQ ID NO: 662813 - RNA, 23 nt, Escherichia coli CFT073
acuuucugaaggauuagacgaau

SEQ ID NO: 662814 - RNA, 20 nt, Escherichia coli CFT073
acuuucucucgaaaaaccug

SEQ ID NO: 662815 - RNA, 18 nt, Escherichia coli CFT073
acuuucucacaagcccag

SEQ ID NO: 662816 - RNA, 14 nt, Escherichia coli CFT073
acuuuuauuucacc

SEQ ID NO: 662817 - RNA, 19 nt, Escherichia coli CFT073
acuuuugagccaaaaugcu

SEQ ID NO: 662818 - RNA, 20 nt, Escherichia coli CFT073
acuuuugagccaaaaugcuu

SEQ ID NO: 662819 - RNA, 22 nt, Escherichia coli CFT073
agaaaauacucagcaccccgag

SEQ ID NO: 662820 - RNA, 17 nt, Escherichia coli CFT073
acuuuuuucauccagcu

SEQ ID NO: 662821 - RNA, 12 nt, Escherichia coli CFT073
acuuuuuuuccg

SEQ ID NO: 662822 - RNA, 11 nt, Escherichia coli CFT073
agaaaaucaca

SEQ ID NO: 662823 - RNA, 11 nt, Escherichia coli CFT073
agaaaauccag

SEQ ID NO: 662824 - RNA, 17 nt, Escherichia coli CFT073
agaaaauccagcagaau

SEQ ID NO: 662825 - RNA, 16 nt, Escherichia coli CFT073
agaaaauccaucccaa

SEQ ID NO: 662826 - RNA, 16 nt, Escherichia coli CFT073
agaaaaucgugccaga

SEQ ID NO: 662827 - RNA, 21 nt, Escherichia coli CFT073
agaaaaucguuggucugcaga

SEQ ID NO: 662828 - RNA, 19 nt, Escherichia coli CFT073
agaaaauguauuucaucau

SEQ ID NO: 662829 - RNA, 19 nt, Escherichia coli CFT073
agaaaauuuuagggaagua

SEQ ID NO: 662830 - RNA, 17 nt, Escherichia coli CFT073
agaagcaucguggauga

SEQ ID NO: 662831 - RNA, 12 nt, Escherichia coli CFT073
agaagaggagag

SEQ ID NO: 662832 - RNA, 23 nt, Escherichia coli CFT073
agaagccaccgcaccacgaccua

SEQ ID NO: 662833 - RNA, 22 nt, Escherichia coli CFT073
agaagccauuaaacaccaguac

SEQ ID NO: 662834 - RNA, 21 nt, Escherichia coli CFT073
agaagcccaucaguguccaga

SEQ ID NO: 662835 - RNA, 22 nt, Escherichia coli CFT073
agaagccgcuccggcagcagca

SEQ ID NO: 662836 - RNA, 16 nt, Escherichia coli CFT073
agaaguugugaaacga

SEQ ID NO: 662837 - RNA, 15 nt, Escherichia coli CFT073
agaauaaagcuuuaa

SEQ ID NO: 662838 - RNA, 14 nt, Escherichia coli CFT073
agaauaaaacaagc

SEQ ID NO: 662839 - RNA, 23 nt, Escherichia coli CFT073
agaauaaaacaagcagcugccag

SEQ ID NO: 662840 - RNA, 12 nt, Escherichia coli CFT073
agaauaaaacaa

SEQ ID NO: 662841 - RNA, 22 nt, Escherichia coli CFT073
agaauaccuugcugcuccagcg

SEQ ID NO: 662842 - RNA, 17 nt, Escherichia coli CFT073
agaauacgccccagaau

SEQ ID NO: 662843 - RNA, 13 nt, Escherichia coli CFT073
agaauacccagca

SEQ ID NO: 662844 - RNA, 15 nt, Escherichia coli CFT073
agaauacccagcaau

SEQ ID NO: 662845 - RNA, 22 nt, Escherichia coli CFT073
agaauacccagcaaugccaggc

SEQ ID NO: 662846 - RNA, 18 nt, Escherichia coli CFT073
agaauacccgaagcgcca

SEQ ID NO: 662847 - RNA, 14 nt, Escherichia coli CFT073
agaauuaauugcua

SEQ ID NO: 662848 - RNA, 21 nt, Escherichia coli CFT073
agaaugguuucauuccaguaa

SEQ ID NO: 662849 - RNA, 19 nt, Escherichia coli CFT073
agaaugguaacaccagagu

SEQ ID NO: 662850 - RNA, 13 nt, Escherichia coli CFT073
agaauggugccga

SEQ ID NO: 662851 - RNA, 17 nt, Escherichia coli CFT073
agaaugguuucauucca

SEQ ID NO: 662852 - RNA, 16 nt, Escherichia coli CFT073
agaauuaucauuuuua

SEQ ID NO: 662853 - RNA, 19 nt, Escherichia coli CFT073
agaaucucuuuuguuuccc

SEQ ID NO: 662854 - RNA, 11 nt, Escherichia coli CFT073
agaaugcccca

SEQ ID NO: 662855 - RNA, 16 nt, Escherichia coli CFT073
agaaugcgcucaauau

SEQ ID NO: 662856 - RNA, 19 nt, Escherichia coli CFT073
agaaugcucgcuggcaggc

SEQ ID NO: 662857 - RNA, 19 nt, Escherichia coli CFT073
agaaugcgcaacaccguaa

SEQ ID NO: 662858 - RNA, 13 nt, Escherichia coli CFT073
agaaucaugucag

SEQ ID NO: 662859 - RNA, 17 nt, Escherichia coli CFT073
agaaucacuucaucgcc

SEQ ID NO: 662860 - RNA, 13 nt, Escherichia coli CFT073
agaaucauccagg

SEQ ID NO: 662861 - RNA, 17 nt, Escherichia coli CFT073
agaaucguaaagaucug

SEQ ID NO: 662862 - RNA, 15 nt, Escherichia coli CFT073
agaauauugugcuca

SEQ ID NO: 662863 - RNA, 15 nt, Escherichia coli CFT073
agaaucaaucucagc

SEQ ID NO: 662864 - RNA, 13 nt, Escherichia coli CFT073
agaaucaacacac

SEQ ID NO: 662865 - RNA, 22 nt, Escherichia coli CFT073
agaauaucugcggccuccaaca

SEQ ID NO: 662866 - RNA, 15 nt, Escherichia coli CFT073
agaauaucuucuguu

SEQ ID NO: 662867 - RNA, 17 nt, Escherichia coli CFT073
agaaacgccagcagcag

SEQ ID NO: 662868 - RNA, 16 nt, Escherichia coli CFT073
agaaacgccaucugaa

SEQ ID NO: 662869 - RNA, 20 nt, Escherichia coli CFT073
agaaacgcucauaaauugca

SEQ ID NO: 662870 - RNA, 23 nt, Escherichia coli CFT073
agaaacgcgcggcaaugggguuu

SEQ ID NO: 662871 - RNA, 20 nt, Escherichia coli CFT073
agaaacgcuggugaaaucag

SEQ ID NO: 662872 - RNA, 15 nt, Escherichia coli CFT073
agaaacaccagaaug

SEQ ID NO: 662873 - RNA, 16 nt, Escherichia coli CFT073
aaaacacgacaugacc

SEQ ID NO: 662874 - RNA, 10 nt, Escherichia coli CFT073
aaaacaccgc

SEQ ID NO: 662875 - RNA, 23 nt, Escherichia coli CFT073
aaaacaccgcuguugccagcagc

SEQ ID NO: 662876 - RNA, 15 nt, Escherichia coli CFT073
agaaaucaacaaauu

SEQ ID NO: 662877 - RNA, 15 nt, Escherichia coli CFT073
aaaacacucuucaac

SEQ ID NO: 662878 - RNA, 22 nt, Escherichia coli CFT073
agaaaucagauaaaacaggcgg

SEQ ID NO: 662879 - RNA, 9 nt, Escherichia coli CFT073
agaaaucag

SEQ ID NO: 662880 - RNA, 18 nt, Escherichia coli CFT073
agaaaucucuuccagcga

SEQ ID NO: 662881 - RNA, 20 nt, Escherichia coli CFT073
agaaauccggggcaauuuca

SEQ ID NO: 662882 - RNA, 14 nt, Escherichia coli CFT073
agaaaugccaguaa

SEQ ID NO: 662883 - RNA, 16 nt, Escherichia coli CFT073
agaaaugccaguaacu

SEQ ID NO: 662884 - RNA, 15 nt, Escherichia coli CFT073
agaaauggcuggcag

SEQ ID NO: 662885 - RNA, 17 nt, Escherichia coli CFT073
agaagaaccgccaccuc

SEQ ID NO: 662886 - RNA, 11 nt, Escherichia coli CFT073
agaagaaaaaa

SEQ ID NO: 662887 - RNA, 14 nt, Escherichia coli CFT073
agaagaaagccgga

SEQ ID NO: 662888 - RNA, 13 nt, Escherichia coli CFT073
agaagacugugau

SEQ ID NO: 662889 - RNA, 14 nt, Escherichia coli CFT073
agaagacugugauu

SEQ ID NO: 662890 - RNA, 15 nt, Escherichia coli CFT073
agaagagacuaacau

SEQ ID NO: 662891 - RNA, 15 nt, Escherichia coli CFT073
agaacgucgcaggga

SEQ ID NO: 662892 - RNA, 20 nt, Escherichia coli CFT073
agaacggcagagaaaccaca

SEQ ID NO: 662893 - RNA, 22 nt, Escherichia coli CFT073
agaacggcgcaccagaauaccu

SEQ ID NO: 662894 - RNA, 23 nt, Escherichia coli CFT073
agaacgcugcaauuuauugaauu

SEQ ID NO: 662895 - RNA, 16 nt, Escherichia coli CFT073
agaacggaucaggcag

SEQ ID NO: 662896 - RNA, 16 nt, Escherichia coli CFT073
agaaccagcgcacaga

SEQ ID NO: 662897 - RNA, 18 nt, Escherichia coli CFT073
agaaccagcgcacagagc

SEQ ID NO: 662898 - RNA, 19 nt, Escherichia coli CFT073
agaaccagcgcacagagca

SEQ ID NO: 662899 - RNA, 13 nt, Escherichia coli CFT073
agaaccagcugcc

SEQ ID NO: 662900 - RNA, 11 nt, Escherichia coli CFT073
agaaccaugca

SEQ ID NO: 662901 - RNA, 19 nt, Escherichia coli CFT073
agaacgccaugccaaagaa

SEQ ID NO: 662902 - RNA, 20 nt, Escherichia coli CFT073
agaacgcgccuuaaaaacca

SEQ ID NO: 662903 - RNA, 17 nt, Escherichia coli CFT073
agauaauggcuguuaaa

SEQ ID NO: 662904 - RNA, 15 nt, Escherichia coli CFT073
agauaauuuugaaau

SEQ ID NO: 662905 - RNA, 20 nt, Escherichia coli CFT073
agauaauuuugaaauaaaau

SEQ ID NO: 662906 - RNA, 21 nt, Escherichia coli CFT073
agauaauuuugaaauaaaauc

SEQ ID NO: 662907 - RNA, 19 nt, Escherichia coli CFT073
agauaauuuugcaguccca

SEQ ID NO: 662908 - RNA, 21 nt, Escherichia coli CFT073
agauaauuuugcagucccauc

SEQ ID NO: 662909 - RNA, 22 nt, Escherichia coli CFT073
agauaauuaugccgaucaucau

SEQ ID NO: 662910 - RNA, 20 nt, Escherichia coli CFT073
agauaaucgcgguuacucug

SEQ ID NO: 662911 - RNA, 17 nt, Escherichia coli CFT073
agauaaucaaauacacc

SEQ ID NO: 662912 - RNA, 13 nt, Escherichia coli CFT073
agauaaucacaca

SEQ ID NO: 662913 - RNA, 14 nt, Escherichia coli CFT073
agauaaugacuucc

SEQ ID NO: 662914 - RNA, 13 nt, Escherichia coli CFT073
agauaaugccagc

SEQ ID NO: 662915 - RNA, 14 nt, Escherichia coli CFT073
agauaauggcuguu

SEQ ID NO: 662916 - RNA, 20 nt, Escherichia coli CFT073
agauaaugugccgaauccaa

SEQ ID NO: 662917 - RNA, 13 nt, Escherichia coli CFT073
agauaccaccagc

SEQ ID NO: 662918 - RNA, 23 nt, Escherichia coli CFT073
agauaccaccagcgccauuaaca

SEQ ID NO: 662919 - RNA, 15 nt, Escherichia coli CFT073
agauaccccagcgca

SEQ ID NO: 662920 - RNA, 20 nt, Escherichia coli CFT073
agauacccgacagauaaauc

SEQ ID NO: 662921 - RNA, 21 nt, Escherichia coli CFT073
agauagcguucuuuaacugcc

SEQ ID NO: 662922 - RNA, 15 nt, Escherichia coli CFT073
agaucaacagcauau

SEQ ID NO: 662923 - RNA, 16 nt, Escherichia coli CFT073
agaucaaaccucaccu

SEQ ID NO: 662924 - RNA, 15 nt, Escherichia coli CFT073
agaucaccaauauca

SEQ ID NO: 662925 - RNA, 15 nt, Escherichia coli CFT073
agaucaccacauacu

SEQ ID NO: 662926 - RNA, 18 nt, Escherichia coli CFT073
agaucaccacauacugcu

SEQ ID NO: 662927 - RNA, 23 nt, Escherichia coli CFT073
agauauuuuguucaaaggcagaa

SEQ ID NO: 662928 - RNA, 15 nt, Escherichia coli CFT073
agauaggcaucagca

SEQ ID NO: 662929 - RNA, 15 nt, Escherichia coli CFT073
agauaggucaccaga

SEQ ID NO: 662930 - RNA, 16 nt, Escherichia coli CFT073
agauaggucaccagag

SEQ ID NO: 662931 - RNA, 14 nt, Escherichia coli CFT073
agagucagcaaugc

SEQ ID NO: 662932 - RNA, 20 nt, Escherichia coli CFT073
agagucaucucugccuugag

SEQ ID NO: 662933 - RNA, 20 nt, Escherichia coli CFT073
agaguaugcgcgucagagau

SEQ ID NO: 662934 - RNA, 22 nt, Escherichia coli CFT073
aaaaccacacuucuucagccag

SEQ ID NO: 662935 - RNA, 21 nt, Escherichia coli CFT073
aaaaccaccgaccacggccag

SEQ ID NO: 662936 - RNA, 21 nt, Escherichia coli CFT073
aaaaccagaaagggaagaaca

SEQ ID NO: 662937 - RNA, 19 nt, Escherichia coli CFT073
aaaaccacuaauuccugca

SEQ ID NO: 662938 - RNA, 22 nt, Escherichia coli CFT073
aaaaccagaaagggaagaacau

SEQ ID NO: 662939 - RNA, 13 nt, Escherichia coli CFT073
aaaaccagagaau

SEQ ID NO: 662940 - RNA, 13 nt, Escherichia coli CFT073
agagugccaggcc

SEQ ID NO: 662941 - RNA, 21 nt, Escherichia coli CFT073
agagugcccacguugcaucac

SEQ ID NO: 662942 - RNA, 17 nt, Escherichia coli CFT073
agagugcgccagucaca

SEQ ID NO: 662943 - RNA, 16 nt, Escherichia coli CFT073
agaguuuccaggcugg

SEQ ID NO: 662944 - RNA, 17 nt, Escherichia coli CFT073
agaguuuuaaaaccauu

SEQ ID NO: 662945 - RNA, 16 nt, Escherichia coli CFT073
agaguuuuaaacgcag

SEQ ID NO: 662946 - RNA, 18 nt, Escherichia coli CFT073
agauaaaacaucucuucc

SEQ ID NO: 662947 - RNA, 21 nt, Escherichia coli CFT073
agauaacgccuggcaguggug

SEQ ID NO: 662948 - RNA, 13 nt, Escherichia coli CFT073
agauaaccagagc

SEQ ID NO: 662949 - RNA, 16 nt, Escherichia coli CFT073
agauaacguaaugucu

SEQ ID NO: 662950 - RNA, 20 nt, Escherichia coli CFT073
agauaacuggcaaaaacaag

SEQ ID NO: 662951 - RNA, 14 nt, Escherichia coli CFT073
agauaagaauaaua

SEQ ID NO: 662952 - RNA, 15 nt, Escherichia coli CFT073
agauaagaccaaucc

SEQ ID NO: 662953 - RNA, 12 nt, Escherichia coli CFT073
agauaauaggua

SEQ ID NO: 662954 - RNA, 13 nt, Escherichia coli CFT073
agauaauagucag

SEQ ID NO: 662955 - RNA, 17 nt, Escherichia coli CFT073
agauggcuuugcccuuu

SEQ ID NO: 662956 - RNA, 20 nt, Escherichia coli CFT073
agauggcuuugcccuuucug

SEQ ID NO: 662957 - RNA, 15 nt, Escherichia coli CFT073
agaugcucuucaaaa

SEQ ID NO: 662958 - RNA, 17 nt, Escherichia coli CFT073
agaugcugcaaggugau

SEQ ID NO: 662959 - RNA, 22 nt, Escherichia coli CFT073
agaugcugugccuccugcggcu

SEQ ID NO: 662960 - RNA, 22 nt, Escherichia coli CFT073
agauguuuugccugaaaaauga

SEQ ID NO: 662961 - RNA, 16 nt, Escherichia coli CFT073
agauuaaaauauaagg

SEQ ID NO: 662962 - RNA, 15 nt, Escherichia coli CFT073
agauguaaagugaaa

SEQ ID NO: 662963 - RNA, 22 nt, Escherichia coli CFT073
agauggucuguaccaccagaau

SEQ ID NO: 662964 - RNA, 14 nt, Escherichia coli CFT073
agaugguuuugcuu

SEQ ID NO: 662965 - RNA, 22 nt, Escherichia coli CFT073
agaugcggugcgccacaccgca

SEQ ID NO: 662966 - RNA, 16 nt, Escherichia coli CFT073
agaugcagcauagaag

SEQ ID NO: 662967 - RNA, 12 nt, Escherichia coli CFT073
agaugcguucac

SEQ ID NO: 662968 - RNA, 21 nt, Escherichia coli CFT073
agaugaucaacgaccagaaag

SEQ ID NO: 662969 - RNA, 20 nt, Escherichia coli CFT073
agaugaaauaccacucagcu

SEQ ID NO: 662970 - RNA, 19 nt, Escherichia coli CFT073
agaugaaauacuaaauaug

SEQ ID NO: 662971 - RNA, 18 nt, Escherichia coli CFT073
agaucguucgcaccaaau

SEQ ID NO: 662972 - RNA, 19 nt, Escherichia coli CFT073
agaucgugcagcaccgccg

SEQ ID NO: 662973 - RNA, 15 nt, Escherichia coli CFT073
agaucgguugccaua

SEQ ID NO: 662974 - RNA, 16 nt, Escherichia coli CFT073
agaucgguugccauaa

SEQ ID NO: 662975 - RNA, 18 nt, Escherichia coli CFT073
agaucguacagguaagca

SEQ ID NO: 662976 - RNA, 18 nt, Escherichia coli CFT073
agaucuucaggaguagaa

SEQ ID NO: 662977 - RNA, 18 nt, Escherichia coli CFT073
agaucugaccuauuucau

SEQ ID NO: 662978 - RNA, 19 nt, Escherichia coli CFT073
agaucugaccuauuucauu

SEQ ID NO: 662979 - RNA, 18 nt, Escherichia coli CFT073
agaucugacgauuauuuu

SEQ ID NO: 662980 - RNA, 19 nt, Escherichia coli CFT073
agaucccccgcacacucca

SEQ ID NO: 662981 - RNA, 14 nt, Escherichia coli CFT073
agauccauuaugau

SEQ ID NO: 662982 - RNA, 19 nt, Escherichia coli CFT073
agauccaugaagcaaugau

SEQ ID NO: 662983 - RNA, 21 nt, Escherichia coli CFT073
agauccagugcucauccuuca

SEQ ID NO: 662984 - RNA, 16 nt, Escherichia coli CFT073
agauccgcacucaacu

SEQ ID NO: 662985 - RNA, 12 nt, Escherichia coli CFT073
agauccgccagu

SEQ ID NO: 662986 - RNA, 15 nt, Escherichia coli CFT073
agauccgccaugcug

SEQ ID NO: 662987 - RNA, 15 nt, Escherichia coli CFT073
agaucgcacauguca

SEQ ID NO: 662988 - RNA, 21 nt, Escherichia coli CFT073
agaucgcgaccgccuucaguc

SEQ ID NO: 662989 - RNA, 17 nt, Escherichia coli CFT073
agaucgccccggcaaga

SEQ ID NO: 662990 - RNA, 18 nt, Escherichia coli CFT073
agagccagccccacagca

SEQ ID NO: 662991 - RNA, 24 nt, Escherichia coli CFT073
agagccagcaccgcuggcucacca

SEQ ID NO: 662992 - RNA, 13 nt, Escherichia coli CFT073
agagccagcccca

SEQ ID NO: 662993 - RNA, 13 nt, Escherichia coli CFT073
agagcaaauaaaa

SEQ ID NO: 662994 - RNA, 16 nt, Escherichia coli CFT073
agagcaaccagcaaug

SEQ ID NO: 662995 - RNA, 20 nt, Escherichia coli CFT073
agagcaaccagcaaugccag

SEQ ID NO: 662996 - RNA, 23 nt, Escherichia coli CFT073
agagcaacgagacucaauggcau

SEQ ID NO: 662997 - RNA, 13 nt, Escherichia coli CFT073
agagcuaugaaua

SEQ ID NO: 662998 - RNA, 22 nt, Escherichia coli CFT073
agagcuaugaauagucgccagc

SEQ ID NO: 662999 - RNA, 19 nt, Escherichia coli CFT073
agagcgggcagacaaaaca

SEQ ID NO: 663000 - RNA, 13 nt, Escherichia coli CFT073
agagaucaaaguc

SEQ ID NO: 663001 - RNA, 13 nt, Escherichia coli CFT073
agagaucaaagug

SEQ ID NO: 663002 - RNA, 17 nt, Escherichia coli CFT073
agagauuugcuccagcg

SEQ ID NO: 663003 - RNA, 22 nt, Escherichia coli CFT073
agagcaaaaaucgacagcagga

SEQ ID NO: 663004 - RNA, 14 nt, Escherichia coli CFT073
agagcaaaccgccg

SEQ ID NO: 663005 - RNA, 14 nt, Escherichia coli CFT073
agagcaaacaccgc

SEQ ID NO: 663006 - RNA, 12 nt, Escherichia coli CFT073
agagcaaauaaa

SEQ ID NO: 663007 - RNA, 13 nt, Escherichia coli CFT073
agagagcagucca

SEQ ID NO: 663008 - RNA, 17 nt, Escherichia coli CFT073
agagagcuuuuuuguuc

SEQ ID NO: 663009 - RNA, 22 nt, Escherichia coli CFT073
agagauaacuggcaaaaacaag

SEQ ID NO: 663010 - RNA, 20 nt, Escherichia coli CFT073
agagagguuuucaacucauc

SEQ ID NO: 663011 - RNA, 17 nt, Escherichia coli CFT073
agacuuugucaucaguc

SEQ ID NO: 663012 - RNA, 12 nt, Escherichia coli CFT073
agacuuuuccuu

SEQ ID NO: 663013 - RNA, 16 nt, Escherichia coli CFT073
agacuuugaauaaagc

SEQ ID NO: 663014 - RNA, 17 nt, Escherichia coli CFT073
agacuuuacuaauagca

SEQ ID NO: 663015 - RNA, 12 nt, Escherichia coli CFT073
agagaaaauaau

SEQ ID NO: 663016 - RNA, 13 nt, Escherichia coli CFT073
agagaaagagugc

SEQ ID NO: 663017 - RNA, 15 nt, Escherichia coli CFT073
agagaaagcaaaaau

SEQ ID NO: 663018 - RNA, 21 nt, Escherichia coli CFT073
agagaaccagcgcacagagca

SEQ ID NO: 663019 - RNA, 20 nt, Escherichia coli CFT073
agagaacaucaauccaaaca

SEQ ID NO: 663020 - RNA, 13 nt, Escherichia coli CFT073
agagaagccaggu

SEQ ID NO: 663021 - RNA, 13 nt, Escherichia coli CFT073
agagaacugcugc

SEQ ID NO: 663022 - RNA, 14 nt, Escherichia coli CFT073
agagaagaaagaag

SEQ ID NO: 663023 - RNA, 18 nt, Escherichia coli CFT073
agagaaucaugucagagc

SEQ ID NO: 663024 - RNA, 12 nt, Escherichia coli CFT073
agagacuaacau

SEQ ID NO: 663025 - RNA, 17 nt, Escherichia coli CFT073
agagacuaacauccgaa

SEQ ID NO: 663026 - RNA, 16 nt, Escherichia coli CFT073
agagaauuaaccagaa

SEQ ID NO: 663027 - RNA, 12 nt, Escherichia coli CFT073
agaauuucucag

SEQ ID NO: 663028 - RNA, 16 nt, Escherichia coli CFT073
agaauuuccagaaagu

SEQ ID NO: 663029 - RNA, 14 nt, Escherichia coli CFT073
agacccagcuucag

SEQ ID NO: 663030 - RNA, 12 nt, Escherichia coli CFT073
agacccaguuuu

SEQ ID NO: 663031 - RNA, 13 nt, Escherichia coli CFT073
agaccccaguuuu

SEQ ID NO: 663032 - RNA, 15 nt, Escherichia coli CFT073
agaccccaguuuuua

SEQ ID NO: 663033 - RNA, 20 nt, Escherichia coli CFT073
agaccgucggaauccaacaa

SEQ ID NO: 663034 - RNA, 17 nt, Escherichia coli CFT073
agaccguggucggaaaa

SEQ ID NO: 663035 - RNA, 21 nt, Escherichia coli CFT073
agaccguauucggaaauaugc

SEQ ID NO: 663036 - RNA, 17 nt, Escherichia coli CFT073
agaccguugcucagaau

SEQ ID NO: 663037 - RNA, 16 nt, Escherichia coli CFT073
agacgcgucagugucu

SEQ ID NO: 663038 - RNA, 21 nt, Escherichia coli CFT073
agacgcgguaaaagcccauca

SEQ ID NO: 663039 - RNA, 19 nt, Escherichia coli CFT073
agacgcguuaauaccugau

SEQ ID NO: 663040 - RNA, 18 nt, Escherichia coli CFT073
agacgcguuuacagagcc

SEQ ID NO: 663041 - RNA, 23 nt, Escherichia coli CFT073
agacgcgcggugaucgggucacc

SEQ ID NO: 663042 - RNA, 15 nt, Escherichia coli CFT073
agacgaucgcgcagg

SEQ ID NO: 663043 - RNA, 22 nt, Escherichia coli CFT073
agacgaucgcgcagguuuucca

SEQ ID NO: 663044 - RNA, 19 nt, Escherichia coli CFT073
agacgaaaguuugaaagau

SEQ ID NO: 663045 - RNA, 19 nt, Escherichia coli CFT073
agacgauagaaccuuccac

SEQ ID NO: 663046 - RNA, 17 nt, Escherichia coli CFT073
agaccuacggauucaau

SEQ ID NO: 663047 - RNA, 21 nt, Escherichia coli CFT073
agaccuacggauucaaugcaa

SEQ ID NO: 663048 - RNA, 18 nt, Escherichia coli CFT073
agaccuccguuuuucugu

SEQ ID NO: 663049 - RNA, 13 nt, Escherichia coli CFT073
agacuaauaucgc

SEQ ID NO: 663050 - RNA, 23 nt, Escherichia coli CFT073
agacggcugucauccagcagugg

SEQ ID NO: 663051 - RNA, 21 nt, Escherichia coli CFT073
agacggccaucccagugaauu

SEQ ID NO: 663052 - RNA, 21 nt, Escherichia coli CFT073
agacucaauggcauccgccac

SEQ ID NO: 663053 - RNA, 14 nt, Escherichia coli CFT073
agacucaaaccaau

SEQ ID NO: 663054 - RNA, 22 nt, Escherichia coli CFT073
agacuauucauuguaaauaauu

SEQ ID NO: 663055 - RNA, 13 nt, Escherichia coli CFT073
agacucauuguau

SEQ ID NO: 663056 - RNA, 20 nt, Escherichia coli CFT073
agacucauuuuuaacagugu

SEQ ID NO: 663057 - RNA, 12 nt, Escherichia coli CFT073
agacuccagcag

SEQ ID NO: 663058 - RNA, 23 nt, Escherichia coli CFT073
agacuccagcagugcugcauccu

SEQ ID NO: 663059 - RNA, 12 nt, Escherichia coli CFT073
agacuccagcgc

SEQ ID NO: 663060 - RNA, 15 nt, Escherichia coli CFT073
agacuuaagccuguu

SEQ ID NO: 663061 - RNA, 16 nt, Escherichia coli CFT073
agacuggagcacugcg

SEQ ID NO: 663062 - RNA, 14 nt, Escherichia coli CFT073
agacugacaaucau

SEQ ID NO: 663063 - RNA, 17 nt, Escherichia coli CFT073
agacugacagagaacau

SEQ ID NO: 663064 - RNA, 10 nt, Escherichia coli CFT073
agacugcgca

SEQ ID NO: 663065 - RNA, 14 nt, Escherichia coli CFT073
agacugcgcauuaa

SEQ ID NO: 663066 - RNA, 16 nt, Escherichia coli CFT073
agacugaucaauauca

SEQ ID NO: 663067 - RNA, 15 nt, Escherichia coli CFT073
agacugaucaucgcc

SEQ ID NO: 663068 - RNA, 22 nt, Escherichia coli CFT073
agcgccgggaaugccacgcaaa

SEQ ID NO: 663069 - RNA, 17 nt, Escherichia coli CFT073
agcgccguccaguaaug

SEQ ID NO: 663070 - RNA, 20 nt, Escherichia coli CFT073
agcgccgcgcuauuuuccug

SEQ ID NO: 663071 - RNA, 15 nt, Escherichia coli CFT073
agcgccgccucagcc

SEQ ID NO: 663072 - RNA, 21 nt, Escherichia coli CFT073
agcgccgccucagccagaaua

SEQ ID NO: 663073 - RNA, 19 nt, Escherichia coli CFT073
agcgcguaguucaggauaa

SEQ ID NO: 663074 - RNA, 19 nt, Escherichia coli CFT073
agcgcguaguuugucuuca

SEQ ID NO: 663075 - RNA, 19 nt, Escherichia coli CFT073
agcgcggggaucacuggca

SEQ ID NO: 663076 - RNA, 17 nt, Escherichia coli CFT073
agcgcggggaguucuga

SEQ ID NO: 663077 - RNA, 16 nt, Escherichia coli CFT073
agcgcggggaucacug

SEQ ID NO: 663078 - RNA, 17 nt, Escherichia coli CFT073
agcgcgcguuacgcagc

SEQ ID NO: 663079 - RNA, 14 nt, Escherichia coli CFT073
agcgccaccacaaa

SEQ ID NO: 663080 - RNA, 20 nt, Escherichia coli CFT073
agcgccaccacaaaagcggu

SEQ ID NO: 663081 - RNA, 14 nt, Escherichia coli CFT073
agcgccaccgguuu

SEQ ID NO: 663082 - RNA, 16 nt, Escherichia coli CFT073
agcgcccguaaaccaa

SEQ ID NO: 663083 - RNA, 17 nt, Escherichia coli CFT073
agcgcccguaaaccaag

SEQ ID NO: 663084 - RNA, 20 nt, Escherichia coli CFT073
agcgcccauaaagauguaau

SEQ ID NO: 663085 - RNA, 20 nt, Escherichia coli CFT073
agcgcacuuuauuaacaagc

SEQ ID NO: 663086 - RNA, 22 nt, Escherichia coli CFT073
agcgcaccauaguccggcacca

SEQ ID NO: 663087 - RNA, 23 nt, Escherichia coli CFT073
agcgcaccauaguccggcaccag

SEQ ID NO: 663088 - RNA, 17 nt, Escherichia coli CFT073
agcgaccauuggugcug

SEQ ID NO: 663089 - RNA, 20 nt, Escherichia coli CFT073
agcgcaggggcaaucagcac

SEQ ID NO: 663090 - RNA, 17 nt, Escherichia coli CFT073
agcgcagcgcaucaggc

SEQ ID NO: 663091 - RNA, 15 nt, Escherichia coli CFT073
agcgcagcagauaaa

SEQ ID NO: 663092 - RNA, 16 nt, Escherichia coli CFT073
agcgcagcagauaaaa

SEQ ID NO: 663093 - RNA, 15 nt, Escherichia coli CFT073
agcgcacuuugcugg

SEQ ID NO: 663094 - RNA, 14 nt, Escherichia coli CFT073
agcgcagacaccag

SEQ ID NO: 663095 - RNA, 16 nt, Escherichia coli CFT073
agcgcagcaacaucac

SEQ ID NO: 663096 - RNA, 17 nt, Escherichia coli CFT073
agcggccaaagggagca

SEQ ID NO: 663097 - RNA, 19 nt, Escherichia coli CFT073
agcggccaaagggagcaga

SEQ ID NO: 663098 - RNA, 17 nt, Escherichia coli CFT073
agcgguauugagcuucu

SEQ ID NO: 663099 - RNA, 20 nt, Escherichia coli CFT073
agcgguguuucgggcagccu

SEQ ID NO: 663100 - RNA, 21 nt, Escherichia coli CFT073
agcgguggguuaacaucaugu

SEQ ID NO: 663101 - RNA, 20 nt, Escherichia coli CFT073
agcgguggugaaaagagcgg

SEQ ID NO: 663102 - RNA, 20 nt, Escherichia coli CFT073
agcggucggagguucgaauc

SEQ ID NO: 663103 - RNA, 13 nt, Escherichia coli CFT073
agcguauccauca

SEQ ID NO: 663104 - RNA, 15 nt, Escherichia coli CFT073
agcgucaaacuuuua

SEQ ID NO: 663105 - RNA, 17 nt, Escherichia coli CFT073
agcguaccgccaauuac

SEQ ID NO: 663106 - RNA, 16 nt, Escherichia coli CFT073
agcguagcgcaucagg

SEQ ID NO: 663107 - RNA, 16 nt, Escherichia coli CFT073
agcguaggucaugccu

SEQ ID NO: 663108 - RNA, 15 nt, Escherichia coli CFT073
agcgcuuccagaaug

SEQ ID NO: 663109 - RNA, 13 nt, Escherichia coli CFT073
agcgcuuauacac

SEQ ID NO: 663110 - RNA, 16 nt, Escherichia coli CFT073
agcgcugcggccugcu

SEQ ID NO: 663111 - RNA, 22 nt, Escherichia coli CFT073
agcgcugcggccugcugcacag

SEQ ID NO: 663112 - RNA, 21 nt, Escherichia coli CFT073
agcggacaaacggaccgcaug

SEQ ID NO: 663113 - RNA, 17 nt, Escherichia coli CFT073
agcggaaaucuccagau

SEQ ID NO: 663114 - RNA, 14 nt, Escherichia coli CFT073
agcggaaaugcaga

SEQ ID NO: 663115 - RNA, 20 nt, Escherichia coli CFT073
agcggaaaugcagaggcaua

SEQ ID NO: 663116 - RNA, 16 nt, Escherichia coli CFT073
agcggaaaaucgggcg

SEQ ID NO: 663117 - RNA, 22 nt, Escherichia coli CFT073
agcgcuuuuggcgcguucccuu

SEQ ID NO: 663118 - RNA, 20 nt, Escherichia coli CFT073
agcgcuuuugcuacuuuuuu

SEQ ID NO: 663119 - RNA, 23 nt, Escherichia coli CFT073
agcggcaggccguggaucacauc

SEQ ID NO: 663120 - RNA, 20 nt, Escherichia coli CFT073
agcggcaaaacggugcaggc

SEQ ID NO: 663121 - RNA, 20 nt, Escherichia coli CFT073
agcggcaaugcguuccagca

SEQ ID NO: 663122 - RNA, 14 nt, Escherichia coli CFT073
agcggcaacaucau

SEQ ID NO: 663123 - RNA, 18 nt, Escherichia coli CFT073
agcggcaaccagcagcau

SEQ ID NO: 663124 - RNA, 20 nt, Escherichia coli CFT073
agcggcaaccagcagcauca

SEQ ID NO: 663125 - RNA, 14 nt, Escherichia coli CFT073
agcggagguaauaa

SEQ ID NO: 663126 - RNA, 12 nt, Escherichia coli CFT073
agcggacucacc

SEQ ID NO: 663127 - RNA, 21 nt, Escherichia coli CFT073
agcggacucaccgagcagcac

SEQ ID NO: 663128 - RNA, 16 nt, Escherichia coli CFT073
agccgugaaucacucc

SEQ ID NO: 663129 - RNA, 22 nt, Escherichia coli CFT073
agccgugaaaacagcaaccucc

SEQ ID NO: 663130 - RNA, 16 nt, Escherichia coli CFT073
agccuaacacagcaau

SEQ ID NO: 663131 - RNA, 18 nt, Escherichia coli CFT073
agccuaagccauuuaacu

SEQ ID NO: 663132 - RNA, 16 nt, Escherichia coli CFT073
agccguuuaauugccu

SEQ ID NO: 663133 - RNA, 15 nt, Escherichia coli CFT073
agccuacagaacgcu

SEQ ID NO: 663134 - RNA, 17 nt, Escherichia coli CFT073
agccuacagaacgcugc

SEQ ID NO: 663135 - RNA, 16 nt, Escherichia coli CFT073
agccuaccggcauagu

SEQ ID NO: 663136 - RNA, 13 nt, Escherichia coli CFT073
agccuaccagacc

SEQ ID NO: 663137 - RNA, 14 nt, Escherichia coli CFT073
agcgaaauaaaagu

SEQ ID NO: 663138 - RNA, 17 nt, Escherichia coli CFT073
agcgacagauucagcgc

SEQ ID NO: 663139 - RNA, 20 nt, Escherichia coli CFT073
agcgaaccguucauuucacg

SEQ ID NO: 663140 - RNA, 15 nt, Escherichia coli CFT073
agcgaagccagcucc

SEQ ID NO: 663141 - RNA, 17 nt, Escherichia coli CFT073
agcgaagcccacaccgc

SEQ ID NO: 663142 - RNA, 21 nt, Escherichia coli CFT073
agccuucgccuuucaguucaa

SEQ ID NO: 663143 - RNA, 18 nt, Escherichia coli CFT073
agccucugcguuauuuuc

SEQ ID NO: 663144 - RNA, 15 nt, Escherichia coli CFT073
agccugaaaacgaaa

SEQ ID NO: 663145 - RNA, 14 nt, Escherichia coli CFT073
agccuaugcagguu

SEQ ID NO: 663146 - RNA, 15 nt, Escherichia coli CFT073
agccucaaauuccuu

SEQ ID NO: 663147 - RNA, 21 nt, Escherichia coli CFT073
agccucaagcacccaaugcca

SEQ ID NO: 663148 - RNA, 14 nt, Escherichia coli CFT073
agccucaaugcuga

SEQ ID NO: 663149 - RNA, 17 nt, Escherichia coli CFT073
agccucccgcaacauau

SEQ ID NO: 663150 - RNA, 15 nt, Escherichia coli CFT073
agccuccggccacga

SEQ ID NO: 663151 - RNA, 14 nt, Escherichia coli CFT073
agccgaucagcggc

SEQ ID NO: 663152 - RNA, 17 nt, Escherichia coli CFT073
agccgauuaaucuucca

SEQ ID NO: 663153 - RNA, 16 nt, Escherichia coli CFT073
agccgcaaacuccgug

SEQ ID NO: 663154 - RNA, 15 nt, Escherichia coli CFT073
agccgaccagcaccg

SEQ ID NO: 663155 - RNA, 13 nt, Escherichia coli CFT073
agcccuauaauca

SEQ ID NO: 663156 - RNA, 13 nt, Escherichia coli CFT073
agccgaaacacac

SEQ ID NO: 663157 - RNA, 14 nt, Escherichia coli CFT073
agccgaacagucgc

SEQ ID NO: 663158 - RNA, 19 nt, Escherichia coli CFT073
agcccugaucgcgcgccuu

SEQ ID NO: 663159 - RNA, 22 nt, Escherichia coli CFT073
agcccuuugauuugucugccau

SEQ ID NO: 663160 - RNA, 15 nt, Escherichia coli CFT073
agcccuacaaaccau

SEQ ID NO: 663161 - RNA, 19 nt, Escherichia coli CFT073
agcccucaagccacuuccu

SEQ ID NO: 663162 - RNA, 19 nt, Escherichia coli CFT073
agcccucaccgaagcgagg

SEQ ID NO: 663163 - RNA, 18 nt, Escherichia coli CFT073
agcccgcuucaaacgcug

SEQ ID NO: 663164 - RNA, 19 nt, Escherichia coli CFT073
agccagguuuaccagcagc

SEQ ID NO: 663165 - RNA, 19 nt, Escherichia coli CFT073
agccaguaaaccaaucaau

SEQ ID NO: 663166 - RNA, 14 nt, Escherichia coli CFT073
agcccgcugguugu

SEQ ID NO: 663167 - RNA, 17 nt, Escherichia coli CFT073
agccaggcuuuaccuuc

SEQ ID NO: 663168 - RNA, 18 nt, Escherichia coli CFT073
agccagggauaagccaga

SEQ ID NO: 663169 - RNA, 12 nt, Escherichia coli CFT073
agccagguagau

SEQ ID NO: 663170 - RNA, 23 nt, Escherichia coli CFT073
agccagccucauccaugcggcag

SEQ ID NO: 663171 - RNA, 17 nt, Escherichia coli CFT073
agccgccauuccagcca

SEQ ID NO: 663172 - RNA, 17 nt, Escherichia coli CFT073
agccgccuuuacgcaaa

SEQ ID NO: 663173 - RNA, 19 nt, Escherichia coli CFT073
agccgccugcgaguuuuac

SEQ ID NO: 663174 - RNA, 14 nt, Escherichia coli CFT073
agccgcggcguugc

SEQ ID NO: 663175 - RNA, 21 nt, Escherichia coli CFT073
agccggaauauucuuccggcu

SEQ ID NO: 663176 - RNA, 17 nt, Escherichia coli CFT073
agccgcuucugcagcuu

SEQ ID NO: 663177 - RNA, 19 nt, Escherichia coli CFT073
agccacaguuuuccgccau

SEQ ID NO: 663178 - RNA, 23 nt, Escherichia coli CFT073
agccaccacgcgggguaaaaccc

SEQ ID NO: 663179 - RNA, 18 nt, Escherichia coli CFT073
agccacggcuccagcaau

SEQ ID NO: 663180 - RNA, 15 nt, Escherichia coli CFT073
agccacguuaauacu

SEQ ID NO: 663181 - RNA, 19 nt, Escherichia coli CFT073
agccacggcuccagcaaug

SEQ ID NO: 663182 - RNA, 20 nt, Escherichia coli CFT073
agccacgguccgccauuucc

SEQ ID NO: 663183 - RNA, 16 nt, Escherichia coli CFT073
agccacugcgcaucuu

SEQ ID NO: 663184 - RNA, 13 nt, Escherichia coli CFT073
agccaccaucccg

SEQ ID NO: 663185 - RNA, 15 nt, Escherichia coli CFT073
agccacgucugccac

SEQ ID NO: 663186 - RNA, 18 nt, Escherichia coli CFT073
agccacuuccuuuagaag

SEQ ID NO: 663187 - RNA, 12 nt, Escherichia coli CFT073
agccagccaagc

SEQ ID NO: 663188 - RNA, 18 nt, Escherichia coli CFT073
agccagccaagcauguca

SEQ ID NO: 663189 - RNA, 12 nt, Escherichia coli CFT073
agccaaucugug

SEQ ID NO: 663190 - RNA, 13 nt, Escherichia coli CFT073
agccaaugcaggc

SEQ ID NO: 663191 - RNA, 18 nt, Escherichia coli CFT073
agccaaugcauuauugau

SEQ ID NO: 663192 - RNA, 20 nt, Escherichia coli CFT073
agccaaucccggaagccacc

SEQ ID NO: 663193 - RNA, 13 nt, Escherichia coli CFT073
agccaaucggccc

SEQ ID NO: 663194 - RNA, 17 nt, Escherichia coli CFT073
agccaaucggcccgccc

SEQ ID NO: 663195 - RNA, 12 nt, Escherichia coli CFT073
agccacaacaaa

SEQ ID NO: 663196 - RNA, 17 nt, Escherichia coli CFT073
agccaauuugcgccgcc

SEQ ID NO: 663197 - RNA, 18 nt, Escherichia coli CFT073
agccacaaucgcagcgca

SEQ ID NO: 663198 - RNA, 16 nt, Escherichia coli CFT073
agccaaagaauuggcu

SEQ ID NO: 663199 - RNA, 14 nt, Escherichia coli CFT073
agccaaauaaaauc

SEQ ID NO: 663200 - RNA, 18 nt, Escherichia coli CFT073
agccaaagcgacacaauc

SEQ ID NO: 663201 - RNA, 20 nt, Escherichia coli CFT073
agccaaacgcccagcuaauc

SEQ ID NO: 663202 - RNA, 18 nt, Escherichia coli CFT073
agccaaauccagcaccac

SEQ ID NO: 663203 - RNA, 20 nt, Escherichia coli CFT073
agccaaaucgccccgcagcc

SEQ ID NO: 663204 - RNA, 13 nt, Escherichia coli CFT073
agccaacagcagc

SEQ ID NO: 663205 - RNA, 13 nt, Escherichia coli CFT073
agcauguuccauu

SEQ ID NO: 663206 - RNA, 16 nt, Escherichia coli CFT073
agcauuauuuuugcua

SEQ ID NO: 663207 - RNA, 14 nt, Escherichia coli CFT073
agcauuaccuucaa

SEQ ID NO: 663208 - RNA, 19 nt, Escherichia coli CFT073
agcauuacuuucggugacu

SEQ ID NO: 663209 - RNA, 22 nt, Escherichia coli CFT073
agcauuaacuccccuuuaaauu

SEQ ID NO: 663210 - RNA, 17 nt, Escherichia coli CFT073
agcaucugcaaaauuuc

SEQ ID NO: 663211 - RNA, 16 nt, Escherichia coli CFT073
agcaucucauccauca

SEQ ID NO: 663212 - RNA, 22 nt, Escherichia coli CFT073
agcaucuguucuuucaacacau

SEQ ID NO: 663213 - RNA, 23 nt, Escherichia coli CFT073
agcaucuuaccgaugagcugcaa

SEQ ID NO: 663214 - RNA, 17 nt, Escherichia coli CFT073
agcauggguaaagccca

SEQ ID NO: 663215 - RNA, 23 nt, Escherichia coli CFT073
agcauggcuucuuccccggauga

SEQ ID NO: 663216 - RNA, 15 nt, Escherichia coli CFT073
agcauucaucacaaa

SEQ ID NO: 663217 - RNA, 20 nt, Escherichia coli CFT073
agcauucagacacgccgcca

SEQ ID NO: 663218 - RNA, 23 nt, Escherichia coli CFT073
agcauuucaaaacggucacggcu

SEQ ID NO: 663219 - RNA, 17 nt, Escherichia coli CFT073
agcauuggcaugcacgu

SEQ ID NO: 663220 - RNA, 17 nt, Escherichia coli CFT073
agcauuuggccuggccc

SEQ ID NO: 663221 - RNA, 18 nt, Escherichia coli CFT073
agcauuucuuccagcguu

SEQ ID NO: 663222 - RNA, 20 nt, Escherichia coli CFT073
agcaguuugaucgcuuccau

SEQ ID NO: 663223 - RNA, 17 nt, Escherichia coli CFT073
agcaguuucgucaacuu

SEQ ID NO: 663224 - RNA, 15 nt, Escherichia coli CFT073
agcaguuucaccagc

SEQ ID NO: 663225 - RNA, 18 nt, Escherichia coli CFT073
agcaguuuauaaaauucu

SEQ ID NO: 663226 - RNA, 22 nt, Escherichia coli CFT073
agcaguucuuaaggcauauaug

SEQ ID NO: 663227 - RNA, 13 nt, Escherichia coli CFT073
agcaguugcaggc

SEQ ID NO: 663228 - RNA, 14 nt, Escherichia coli CFT073
agcaguugcaggcu

SEQ ID NO: 663229 - RNA, 20 nt, Escherichia coli CFT073
agcaguuuuuccccugccag

SEQ ID NO: 663230 - RNA, 22 nt, Escherichia coli CFT073
agcaguuuuuccccugccagau

SEQ ID NO: 663231 - RNA, 17 nt, Escherichia coli CFT073
agcauaacaaaaugccg

SEQ ID NO: 663232 - RNA, 16 nt, Escherichia coli CFT073
agcagguugaggugcu

SEQ ID NO: 663233 - RNA, 14 nt, Escherichia coli CFT073
agcaguuccagcau

SEQ ID NO: 663234 - RNA, 18 nt, Escherichia coli CFT073
agcaguucgccgccgagg

SEQ ID NO: 663235 - RNA, 16 nt, Escherichia coli CFT073
agcagguguaguucac

SEQ ID NO: 663236 - RNA, 21 nt, Escherichia coli CFT073
agcaucaacccgcucauaaua

SEQ ID NO: 663237 - RNA, 16 nt, Escherichia coli CFT073
agcaucccaccugaaa

SEQ ID NO: 663238 - RNA, 22 nt, Escherichia coli CFT073
agcauccccggcaaccacaccc

SEQ ID NO: 663239 - RNA, 14 nt, Escherichia coli CFT073
agcauccugcacuu

SEQ ID NO: 663240 - RNA, 16 nt, Escherichia coli CFT073
agcauccugcacuuca

SEQ ID NO: 663241 - RNA, 14 nt, Escherichia coli CFT073
agcaucccaggcau

SEQ ID NO: 663242 - RNA, 16 nt, Escherichia coli CFT073
agcauaauaagcuuuu

SEQ ID NO: 663243 - RNA, 18 nt, Escherichia coli CFT073
agcauaaucaccaucagc

SEQ ID NO: 663244 - RNA, 21 nt, Escherichia coli CFT073
agcauaaucaccaucagcagc

SEQ ID NO: 663245 - RNA, 21 nt, Escherichia coli CFT073
agcauauuuggcgcuggcuuc

SEQ ID NO: 663246 - RNA, 17 nt, Escherichia coli CFT073
agcauaugcacacgcag

SEQ ID NO: 663247 - RNA, 15 nt, Escherichia coli CFT073
agcauaugcuucuuc

SEQ ID NO: 663248 - RNA, 17 nt, Escherichia coli CFT073
agcaucaaacuuuuaaa

SEQ ID NO: 663249 - RNA, 15 nt, Escherichia coli CFT073
agcaucaaacuuuua

SEQ ID NO: 663250 - RNA, 21 nt, Escherichia coli CFT073
agcaucaacaacaauuucacg

SEQ ID NO: 663251 - RNA, 18 nt, Escherichia coli CFT073
agcaggaaauauaaucgg

SEQ ID NO: 663252 - RNA, 17 nt, Escherichia coli CFT073
agcagcuuaagcgacca

SEQ ID NO: 663253 - RNA, 19 nt, Escherichia coli CFT073
agcagcugcucccagcgca

SEQ ID NO: 663254 - RNA, 19 nt, Escherichia coli CFT073
agcagcgauaucugccgag

SEQ ID NO: 663255 - RNA, 14 nt, Escherichia coli CFT073
agcagggcaaacag

SEQ ID NO: 663256 - RNA, 22 nt, Escherichia coli CFT073
agcaggguuucaucgguggugu

SEQ ID NO: 663257 - RNA, 15 nt, Escherichia coli CFT073
aaaaccuaauacucu

SEQ ID NO: 663258 - RNA, 14 nt, Escherichia coli CFT073
agcagcgaauaauu

SEQ ID NO: 663259 - RNA, 19 nt, Escherichia coli CFT073
agcagcgaaucagcccagc

SEQ ID NO: 663260 - RNA, 12 nt, Escherichia coli CFT073
agcagcccugcc

SEQ ID NO: 663261 - RNA, 23 nt, Escherichia coli CFT073
agcagacgcuccauugcccgccc

SEQ ID NO: 663262 - RNA, 19 nt, Escherichia coli CFT073
agcagacgcaucgcccagc

SEQ ID NO: 663263 - RNA, 19 nt, Escherichia coli CFT073
agcagacguuugcaauuug

SEQ ID NO: 663264 - RNA, 21 nt, Escherichia coli CFT073
agcacuuccugaaucacaauc

SEQ ID NO: 663265 - RNA, 18 nt, Escherichia coli CFT073
agcacuggcggcagcagg

SEQ ID NO: 663266 - RNA, 18 nt, Escherichia coli CFT073
agcacugcgcccgccagc

SEQ ID NO: 663267 - RNA, 20 nt, Escherichia coli CFT073
agcagaaucauccaggcuuu

SEQ ID NO: 663268 - RNA, 13 nt, Escherichia coli CFT073
agcagaccagcaa

SEQ ID NO: 663269 - RNA, 18 nt, Escherichia coli CFT073
aaaaccgguuuugguuaa

SEQ ID NO: 663270 - RNA, 22 nt, Escherichia coli CFT073
agcagaaugaaugauacagaaa

SEQ ID NO: 663271 - RNA, 23 nt, Escherichia coli CFT073
agcagaagggccuuuggcaccgu

SEQ ID NO: 663272 - RNA, 13 nt, Escherichia coli CFT073
agcacgccagaca

SEQ ID NO: 663273 - RNA, 15 nt, Escherichia coli CFT073
agcacggcaucaaug

SEQ ID NO: 663274 - RNA, 18 nt, Escherichia coli CFT073
agcaccgcgaauuuuuuc

SEQ ID NO: 663275 - RNA, 23 nt, Escherichia coli CFT073
agcaccgcuuuaaaauuauccag

SEQ ID NO: 663276 - RNA, 14 nt, Escherichia coli CFT073
agcaccgccagcag

SEQ ID NO: 663277 - RNA, 15 nt, Escherichia coli CFT073
agcaccgccagcagc

SEQ ID NO: 663278 - RNA, 22 nt, Escherichia coli CFT073
agcaccgccagcagcagcgaau

SEQ ID NO: 663279 - RNA, 17 nt, Escherichia coli CFT073
agcaccgccgccagggu

SEQ ID NO: 663280 - RNA, 15 nt, Escherichia coli CFT073
agcaccauaaacacc

SEQ ID NO: 663281 - RNA, 21 nt, Escherichia coli CFT073
agcaccacgguacgccagagu

SEQ ID NO: 663282 - RNA, 13 nt, Escherichia coli CFT073
agcaccagauaau

SEQ ID NO: 663283 - RNA, 22 nt, Escherichia coli CFT073
agcaccagaucguguuuugcaa

SEQ ID NO: 663284 - RNA, 14 nt, Escherichia coli CFT073
agcaccagcaacaa

SEQ ID NO: 663285 - RNA, 13 nt, Escherichia coli CFT073
agcaccagcaacg

SEQ ID NO: 663286 - RNA, 19 nt, Escherichia coli CFT073
agcacccagaacgccgaau

SEQ ID NO: 663287 - RNA, 12 nt, Escherichia coli CFT073
agcacccagcaa

SEQ ID NO: 663288 - RNA, 21 nt, Escherichia coli CFT073
agcacccuguuugucuauucc

SEQ ID NO: 663289 - RNA, 21 nt, Escherichia coli CFT073
agcacagcggacaucuggucg

SEQ ID NO: 663290 - RNA, 21 nt, Escherichia coli CFT073
agcacaucacucauaaugaug

SEQ ID NO: 663291 - RNA, 14 nt, Escherichia coli CFT073
agcacaucagcgcc

SEQ ID NO: 663292 - RNA, 14 nt, Escherichia coli CFT073
agcacaucaucaaa

SEQ ID NO: 663293 - RNA, 18 nt, Escherichia coli CFT073
agcacaucaucaaagcca

SEQ ID NO: 663294 - RNA, 20 nt, Escherichia coli CFT073
agcacacgauuccaacgaaa

SEQ ID NO: 663295 - RNA, 20 nt, Escherichia coli CFT073
agcacaccugcaacggcauc

SEQ ID NO: 663296 - RNA, 23 nt, Escherichia coli CFT073
agcaccacauaagaucaucggcc

SEQ ID NO: 663297 - RNA, 22 nt, Escherichia coli CFT073
agcacauugccugaugcgacgc

SEQ ID NO: 663298 - RNA, 17 nt, Escherichia coli CFT073
agcacaugcaacuugaa

SEQ ID NO: 663299 - RNA, 16 nt, Escherichia coli CFT073
agcacaucucaaaucu

SEQ ID NO: 663300 - RNA, 12 nt, Escherichia coli CFT073
agcacaucuccc

SEQ ID NO: 663301 - RNA, 20 nt, Escherichia coli CFT073
agcacaauaaucagcccaac

SEQ ID NO: 663302 - RNA, 14 nt, Escherichia coli CFT073
agcacaauccgcca

SEQ ID NO: 663303 - RNA, 19 nt, Escherichia coli CFT073
agcacaaucacgucauauu

SEQ ID NO: 663304 - RNA, 18 nt, Escherichia coli CFT073
agcacaaacgcaauccag

SEQ ID NO: 663305 - RNA, 13 nt, Escherichia coli CFT073
agcacaaagcaau

SEQ ID NO: 663306 - RNA, 21 nt, Escherichia coli CFT073
agcacaaaguggcggcuaccc

SEQ ID NO: 663307 - RNA, 16 nt, Escherichia coli CFT073
agcaauuuuaauaucc

SEQ ID NO: 663308 - RNA, 17 nt, Escherichia coli CFT073
agcaauuuuaauaucca

SEQ ID NO: 663309 - RNA, 20 nt, Escherichia coli CFT073
agcaauuuuacccgugcauc

SEQ ID NO: 663310 - RNA, 22 nt, Escherichia coli CFT073
agcaauuuuccuugaaaaagag

SEQ ID NO: 663311 - RNA, 17 nt, Escherichia coli CFT073
agcaauguagucuccaa

SEQ ID NO: 663312 - RNA, 23 nt, Escherichia coli CFT073
agcaauguauuuguccacgccgc

SEQ ID NO: 663313 - RNA, 17 nt, Escherichia coli CFT073
agcaauguaaggugcau

SEQ ID NO: 663314 - RNA, 17 nt, Escherichia coli CFT073
agcaauguuauccggcu

SEQ ID NO: 663315 - RNA, 16 nt, Escherichia coli CFT073
agcaauggcacugucg

SEQ ID NO: 663316 - RNA, 22 nt, Escherichia coli CFT073
agcaauuacaggugaaucuuac

SEQ ID NO: 663317 - RNA, 13 nt, Escherichia coli CFT073
agcaauuuaucuu

SEQ ID NO: 663318 - RNA, 14 nt, Escherichia coli CFT073
agcaauuucuccgc

SEQ ID NO: 663319 - RNA, 15 nt, Escherichia coli CFT073
agcaauuucuccgcc

SEQ ID NO: 663320 - RNA, 21 nt, Escherichia coli CFT073
agcaauauguugcaguacucg

SEQ ID NO: 663321 - RNA, 17 nt, Escherichia coli CFT073
agcaauagccgccauac

SEQ ID NO: 663322 - RNA, 11 nt, Escherichia coli CFT073
agcaauacaaa

SEQ ID NO: 663323 - RNA, 22 nt, Escherichia coli CFT073
agcaauacaaaugaguuaucac

SEQ ID NO: 663324 - RNA, 14 nt, Escherichia coli CFT073
agcaauaaugccag

SEQ ID NO: 663325 - RNA, 22 nt, Escherichia coli CFT073
agcaauaaaaaaaugaguauua

SEQ ID NO: 663326 - RNA, 17 nt, Escherichia coli CFT073
agcaauaaucagugccg

SEQ ID NO: 663327 - RNA, 19 nt, Escherichia coli CFT073
agcaauaagccaguccaga

SEQ ID NO: 663328 - RNA, 18 nt, Escherichia coli CFT073
agcaaugcagguaccugu

SEQ ID NO: 663329 - RNA, 22 nt, Escherichia coli CFT073
agcaaugccagcguauaacaca

SEQ ID NO: 663330 - RNA, 17 nt, Escherichia coli CFT073
agcaaugccaucaccaa

SEQ ID NO: 663331 - RNA, 14 nt, Escherichia coli CFT073
agcaaugagcuaug

SEQ ID NO: 663332 - RNA, 22 nt, Escherichia coli CFT073
agcaaugauaaguccgaugccg

SEQ ID NO: 663333 - RNA, 15 nt, Escherichia coli CFT073
agcaaugaucucaau

SEQ ID NO: 663334 - RNA, 18 nt, Escherichia coli CFT073
agcaauccauaccagcac

SEQ ID NO: 663335 - RNA, 16 nt, Escherichia coli CFT073
agcaauccugcaugua

SEQ ID NO: 663336 - RNA, 18 nt, Escherichia coli CFT073
agcaagccuuacuucaca

SEQ ID NO: 663337 - RNA, 20 nt, Escherichia coli CFT073
agcaagcgcaucggaagacu

SEQ ID NO: 663338 - RNA, 19 nt, Escherichia coli CFT073
agcaagaaccaugcaauca

SEQ ID NO: 663339 - RNA, 14 nt, Escherichia coli CFT073
agcaagaccaacac

SEQ ID NO: 663340 - RNA, 23 nt, Escherichia coli CFT073
agcaagagcaaauaaaacaucac

SEQ ID NO: 663341 - RNA, 15 nt, Escherichia coli CFT073
agcaaggcaaucugc

SEQ ID NO: 663342 - RNA, 23 nt, Escherichia coli CFT073
agcaaggcuuucacgucaggguc

SEQ ID NO: 663343 - RNA, 17 nt, Escherichia coli CFT073
agcaaggcuuuccagac

SEQ ID NO: 663344 - RNA, 21 nt, Escherichia coli CFT073
agcaaggccagguuuucuuuc

SEQ ID NO: 663345 - RNA, 22 nt, Escherichia coli CFT073
agcaagugcggcgcaccagcag

SEQ ID NO: 663346 - RNA, 18 nt, Escherichia coli CFT073
agcaacggaaaagcaaca

SEQ ID NO: 663347 - RNA, 13 nt, Escherichia coli CFT073
agcaacgccaaau

SEQ ID NO: 663348 - RNA, 12 nt, Escherichia coli CFT073
agauucaaagac

SEQ ID NO: 663349 - RNA, 17 nt, Escherichia coli CFT073
agauuauucaaaaacag

SEQ ID NO: 663350 - RNA, 22 nt, Escherichia coli CFT073
agauuauucaaaaacagauugc

SEQ ID NO: 663351 - RNA, 16 nt, Escherichia coli CFT073
agcaacuuaaucauca

SEQ ID NO: 663352 - RNA, 11 nt, Escherichia coli CFT073
agcaacuguaa

SEQ ID NO: 663353 - RNA, 21 nt, Escherichia coli CFT073
agcaacuggcuugccagcagg

SEQ ID NO: 663354 - RNA, 13 nt, Escherichia coli CFT073
agcaacugacugg

SEQ ID NO: 663355 - RNA, 16 nt, Escherichia coli CFT073
agcaacuccaucaagc

SEQ ID NO: 663356 - RNA, 14 nt, Escherichia coli CFT073
agcaacguugaacg

SEQ ID NO: 663357 - RNA, 21 nt, Escherichia coli CFT073
acuuaagcacguuacccaauc

SEQ ID NO: 663358 - RNA, 12 nt, Escherichia coli CFT073
acuuaagucucc

SEQ ID NO: 663359 - RNA, 18 nt, Escherichia coli CFT073
acuuaagcgccugauaca

SEQ ID NO: 663360 - RNA, 21 nt, Escherichia coli CFT073
acuuaauauugccguccggca

SEQ ID NO: 663361 - RNA, 22 nt, Escherichia coli CFT073
acuuaaugguucugcacagcuu

SEQ ID NO: 663362 - RNA, 21 nt, Escherichia coli CFT073
acuuaaucgccaguucaguca

SEQ ID NO: 663363 - RNA, 16 nt, Escherichia coli CFT073
acuuaacgucacagaa

SEQ ID NO: 663364 - RNA, 15 nt, Escherichia coli CFT073
acuguuuuuccagcu

SEQ ID NO: 663365 - RNA, 12 nt, Escherichia coli CFT073
acuguuacucau

SEQ ID NO: 663366 - RNA, 20 nt, Escherichia coli CFT073
acuguuucgcggcaaacugc

SEQ ID NO: 663367 - RNA, 11 nt, Escherichia coli CFT073
acuguacaaua

SEQ ID NO: 663368 - RNA, 21 nt, Escherichia coli CFT073
acuguauacgggcuuuuuaau

SEQ ID NO: 663369 - RNA, 16 nt, Escherichia coli CFT073
acugucaccuuuuacc

SEQ ID NO: 663370 - RNA, 15 nt, Escherichia coli CFT073
acugucaucgacaaa

SEQ ID NO: 663371 - RNA, 23 nt, Escherichia coli CFT073
acuguccgcauccccuacucucu

SEQ ID NO: 663372 - RNA, 18 nt, Escherichia coli CFT073
acugugccgcgaccaccu

SEQ ID NO: 663373 - RNA, 22 nt, Escherichia coli CFT073
acuguguuggguucacuuuccc

SEQ ID NO: 663374 - RNA, 18 nt, Escherichia coli CFT073
acuguggucgacaaccag

SEQ ID NO: 663375 - RNA, 17 nt, Escherichia coli CFT073
acugcuuuuaaaugccc

SEQ ID NO: 663376 - RNA, 17 nt, Escherichia coli CFT073
acugcuucgcacaggca

SEQ ID NO: 663377 - RNA, 15 nt, Escherichia coli CFT073
acuggccagcggcga

SEQ ID NO: 663378 - RNA, 18 nt, Escherichia coli CFT073
acuggcuuaauaauuccc

SEQ ID NO: 663379 - RNA, 14 nt, Escherichia coli CFT073
acuggcugccguug

SEQ ID NO: 663380 - RNA, 14 nt, Escherichia coli CFT073
acuggcucuuuuuc

SEQ ID NO: 663381 - RNA, 15 nt, Escherichia coli CFT073
acuggcugaugcugg

SEQ ID NO: 663382 - RNA, 16 nt, Escherichia coli CFT073
acuggcgauaucaaua

SEQ ID NO: 663383 - RNA, 19 nt, Escherichia coli CFT073
acugguucccaacaacagc

SEQ ID NO: 663384 - RNA, 19 nt, Escherichia coli CFT073
acugguuaccugcggacgu

SEQ ID NO: 663385 - RNA, 17 nt, Escherichia coli CFT073
acugguugauuuuaaag

SEQ ID NO: 663386 - RNA, 22 nt, Escherichia coli CFT073
acugguuucagcaucccaggca

SEQ ID NO: 663387 - RNA, 21 nt, Escherichia coli CFT073
acuggugacuuuugcccggca

SEQ ID NO: 663388 - RNA, 23 nt, Escherichia coli CFT073
acuggugacuuuugcccggcaug

SEQ ID NO: 663389 - RNA, 23 nt, Escherichia coli CFT073
acuggugauccacgguucuccac

SEQ ID NO: 663390 - RNA, 13 nt, Escherichia coli CFT073
acuggugccauga

SEQ ID NO: 663391 - RNA, 16 nt, Escherichia coli CFT073
acuggggcuggcggca

SEQ ID NO: 663392 - RNA, 18 nt, Escherichia coli CFT073
acugguagcgcauuucau

SEQ ID NO: 663393 - RNA, 18 nt, Escherichia coli CFT073
acuggggcauuuuuucca

SEQ ID NO: 663394 - RNA, 14 nt, Escherichia coli CFT073
acugaagcgcgccu

SEQ ID NO: 663395 - RNA, 20 nt, Escherichia coli CFT073
acugaagacucaacuuuaaa

SEQ ID NO: 663396 - RNA, 14 nt, Escherichia coli CFT073
acugaagucggcuu

SEQ ID NO: 663397 - RNA, 15 nt, Escherichia coli CFT073
acugaaguucuggug

SEQ ID NO: 663398 - RNA, 14 nt, Escherichia coli CFT073
acugaauaaacagc

SEQ ID NO: 663399 - RNA, 17 nt, Escherichia coli CFT073
acugaauaaacagcaga

SEQ ID NO: 663400 - RNA, 20 nt, Escherichia coli CFT073
acugaauaccguaaaacuca

SEQ ID NO: 663401 - RNA, 16 nt, Escherichia coli CFT073
acucgucgcugauauu

SEQ ID NO: 663402 - RNA, 13 nt, Escherichia coli CFT073
acucuacucccug

SEQ ID NO: 663403 - RNA, 23 nt, Escherichia coli CFT073
acucuacugaaggcgcauugcug

SEQ ID NO: 663404 - RNA, 21 nt, Escherichia coli CFT073
acucgugcgucgcauccggca

SEQ ID NO: 663405 - RNA, 13 nt, Escherichia coli CFT073
acucuacuucuuc

SEQ ID NO: 663406 - RNA, 17 nt, Escherichia coli CFT073
acugaccuuaccaaugc

SEQ ID NO: 663407 - RNA, 14 nt, Escherichia coli CFT073
acugacagacugcu

SEQ ID NO: 663408 - RNA, 22 nt, Escherichia coli CFT073
acugacaucacgccacucacua

SEQ ID NO: 663409 - RNA, 14 nt, Escherichia coli CFT073
acugaccaccacca

SEQ ID NO: 663410 - RNA, 18 nt, Escherichia coli CFT073
acugaauggcauuuccac

SEQ ID NO: 663411 - RNA, 20 nt, Escherichia coli CFT073
acugaauggcgacguaccag

SEQ ID NO: 663412 - RNA, 18 nt, Escherichia coli CFT073
acugaauugugaugguuu

SEQ ID NO: 663413 - RNA, 14 nt, Escherichia coli CFT073
acugacaaaaccga

SEQ ID NO: 663414 - RNA, 19 nt, Escherichia coli CFT073
acugacacaggcagcaauc

SEQ ID NO: 663415 - RNA, 13 nt, Escherichia coli CFT073
acugacauacaaa

SEQ ID NO: 663416 - RNA, 15 nt, Escherichia coli CFT073
acugaugccaaacgc

SEQ ID NO: 663417 - RNA, 15 nt, Escherichia coli CFT073
acugaugacaaacgc

SEQ ID NO: 663418 - RNA, 21 nt, Escherichia coli CFT073
acugaucuuuaucaagcacca

SEQ ID NO: 663419 - RNA, 14 nt, Escherichia coli CFT073
acugacgcagcaga

SEQ ID NO: 663420 - RNA, 18 nt, Escherichia coli CFT073
acugacgcgcuuuucacc

SEQ ID NO: 663421 - RNA, 14 nt, Escherichia coli CFT073
acugacgcucugcu

SEQ ID NO: 663422 - RNA, 20 nt, Escherichia coli CFT073
acugacgucacgcaccaacu

SEQ ID NO: 663423 - RNA, 23 nt, Escherichia coli CFT073
acugacguuaagaucaaaccuca

SEQ ID NO: 663424 - RNA, 18 nt, Escherichia coli CFT073
acugacguugcggauuaa

SEQ ID NO: 663425 - RNA, 20 nt, Escherichia coli CFT073
acugacguugcggauuaaau

SEQ ID NO: 663426 - RNA, 18 nt, Escherichia coli CFT073
acugacuauccacuggaa

SEQ ID NO: 663427 - RNA, 13 nt, Escherichia coli CFT073
acugacuauccug

SEQ ID NO: 663428 - RNA, 16 nt, Escherichia coli CFT073
acugaugcccugcgga

SEQ ID NO: 663429 - RNA, 22 nt, Escherichia coli CFT073
acugauggaauuucaucaucac

SEQ ID NO: 663430 - RNA, 17 nt, Escherichia coli CFT073
acugcaagccaugacgc

SEQ ID NO: 663431 - RNA, 20 nt, Escherichia coli CFT073
acugcacaguguuuguugaa

SEQ ID NO: 663432 - RNA, 15 nt, Escherichia coli CFT073
acugcacgcccauac

SEQ ID NO: 663433 - RNA, 21 nt, Escherichia coli CFT073
acugccagccacacugcggcc

SEQ ID NO: 663434 - RNA, 24 nt, Escherichia coli CFT073
acugccagccacaggccggucauc

SEQ ID NO: 663435 - RNA, 23 nt, Escherichia coli CFT073
acugccagugucggaugcggcuc

SEQ ID NO: 663436 - RNA, 15 nt, Escherichia coli CFT073
acugccagcaaaaaa

SEQ ID NO: 663437 - RNA, 14 nt, Escherichia coli CFT073
acugcuccagggca

SEQ ID NO: 663438 - RNA, 18 nt, Escherichia coli CFT073
acugcuccugcagaaaau

SEQ ID NO: 663439 - RNA, 13 nt, Escherichia coli CFT073
acugcgugugaca

SEQ ID NO: 663440 - RNA, 14 nt, Escherichia coli CFT073
acugcgugugacaa

SEQ ID NO: 663441 - RNA, 19 nt, Escherichia coli CFT073
acugcgugucguaagccac

SEQ ID NO: 663442 - RNA, 21 nt, Escherichia coli CFT073
acugcgugucguaagccaccg

SEQ ID NO: 663443 - RNA, 17 nt, Escherichia coli CFT073
acugccgucgagaauca

SEQ ID NO: 663444 - RNA, 23 nt, Escherichia coli CFT073
acugccgucgagaaucaacacac

SEQ ID NO: 663445 - RNA, 18 nt, Escherichia coli CFT073
acugccuccugcaaaugc

SEQ ID NO: 663446 - RNA, 15 nt, Escherichia coli CFT073
acugccguacaggca

SEQ ID NO: 663447 - RNA, 21 nt, Escherichia coli CFT073
acugccggggaaguaaacccg

SEQ ID NO: 663448 - RNA, 14 nt, Escherichia coli CFT073
acugcccaggcaaa

SEQ ID NO: 663449 - RNA, 20 nt, Escherichia coli CFT073
acuccugcgucggaacaucg

SEQ ID NO: 663450 - RNA, 22 nt, Escherichia coli CFT073
acuccgcuuaccauccacacca

SEQ ID NO: 663451 - RNA, 19 nt, Escherichia coli CFT073
acuccugacuugccaggua

SEQ ID NO: 663452 - RNA, 16 nt, Escherichia coli CFT073
acuccugacagguaug

SEQ ID NO: 663453 - RNA, 20 nt, Escherichia coli CFT073
acucgccgcaaaacccaggc

SEQ ID NO: 663454 - RNA, 16 nt, Escherichia coli CFT073
acucgauuaacucaua

SEQ ID NO: 663455 - RNA, 16 nt, Escherichia coli CFT073
acucggggcuuuucuc

SEQ ID NO: 663456 - RNA, 16 nt, Escherichia coli CFT073
acuccagucccaguuc

SEQ ID NO: 663457 - RNA, 17 nt, Escherichia coli CFT073
acuccagucuuuuaacc

SEQ ID NO: 663458 - RNA, 18 nt, Escherichia coli CFT073
acuccagucuuuuaaccg

SEQ ID NO: 663459 - RNA, 19 nt, Escherichia coli CFT073
acucccuuucugccacgcc

SEQ ID NO: 663460 - RNA, 16 nt, Escherichia coli CFT073
acuccgccccggcaau

SEQ ID NO: 663461 - RNA, 19 nt, Escherichia coli CFT073
acuccgcgaccacacucaa

SEQ ID NO: 663462 - RNA, 16 nt, Escherichia coli CFT073
acuccauugucuuuuc

SEQ ID NO: 663463 - RNA, 17 nt, Escherichia coli CFT073
acuccauugucuuuucg

SEQ ID NO: 663464 - RNA, 13 nt, Escherichia coli CFT073
acucccugcugau

SEQ ID NO: 663465 - RNA, 13 nt, Escherichia coli CFT073
acucccuugccug

SEQ ID NO: 663466 - RNA, 20 nt, Escherichia coli CFT073
acucccuugccugcaggaaa

SEQ ID NO: 663467 - RNA, 22 nt, Escherichia coli CFT073
acucaguguuggauggcggcuu

SEQ ID NO: 663468 - RNA, 16 nt, Escherichia coli CFT073
acucagguggcgguau

SEQ ID NO: 663469 - RNA, 22 nt, Escherichia coli CFT073
acucauaauccgccuuuuuaau

SEQ ID NO: 663470 - RNA, 23 nt, Escherichia coli CFT073
acucauccaccacaaaagcaaag

SEQ ID NO: 663471 - RNA, 20 nt, Escherichia coli CFT073
acucaucagagaaacauccg

SEQ ID NO: 663472 - RNA, 13 nt, Escherichia coli CFT073
acucaucaaaaaa

SEQ ID NO: 663473 - RNA, 15 nt, Escherichia coli CFT073
acucaggaacaucag

SEQ ID NO: 663474 - RNA, 21 nt, Escherichia coli CFT073
acucagcgugccaucaaaguu

SEQ ID NO: 663475 - RNA, 18 nt, Escherichia coli CFT073
acucagcacaaccaccug

SEQ ID NO: 663476 - RNA, 12 nt, Escherichia coli CFT073
acuccagaauac

SEQ ID NO: 663477 - RNA, 14 nt, Escherichia coli CFT073
acuccacugcgcau

SEQ ID NO: 663478 - RNA, 18 nt, Escherichia coli CFT073
acucauuuuuaacagugu

SEQ ID NO: 663479 - RNA, 13 nt, Escherichia coli CFT073
acucaucgucaaa

SEQ ID NO: 663480 - RNA, 12 nt, Escherichia coli CFT073
acucauccccug

SEQ ID NO: 663481 - RNA, 21 nt, Escherichia coli CFT073
acucauccaucucgguuuuca

SEQ ID NO: 663482 - RNA, 22 nt, Escherichia coli CFT073
acucauuaaucaauuuuuugau

SEQ ID NO: 663483 - RNA, 17 nt, Escherichia coli CFT073
acucauugauuuucaaa

SEQ ID NO: 663484 - RNA, 19 nt, Escherichia coli CFT073
acucauugauuuucaaauc

SEQ ID NO: 663485 - RNA, 12 nt, Escherichia coli CFT073
acucaucuucca

SEQ ID NO: 663486 - RNA, 15 nt, Escherichia coli CFT073
acucauuguuaucag

SEQ ID NO: 663487 - RNA, 22 nt, Escherichia coli CFT073
acucauuguuaucagcaauaaa

SEQ ID NO: 663488 - RNA, 12 nt, Escherichia coli CFT073
acucacagggcu

SEQ ID NO: 663489 - RNA, 22 nt, Escherichia coli CFT073
acucacauccagcggcgagcuu

SEQ ID NO: 663490 - RNA, 16 nt, Escherichia coli CFT073
acucacccgccagcgc

SEQ ID NO: 663491 - RNA, 18 nt, Escherichia coli CFT073
acucaaugccagcgacug

SEQ ID NO: 663492 - RNA, 17 nt, Escherichia coli CFT073
acucaccgcucaccuga

SEQ ID NO: 663493 - RNA, 17 nt, Escherichia coli CFT073
acucaccgagcagcaca

SEQ ID NO: 663494 - RNA, 16 nt, Escherichia coli CFT073
acucacgaaucgccuc

SEQ ID NO: 663495 - RNA, 20 nt, Escherichia coli CFT073
acucaccuuuuuucuuauua

SEQ ID NO: 663496 - RNA, 16 nt, Escherichia coli CFT073
acucacgauuguuaau

SEQ ID NO: 663497 - RNA, 22 nt, Escherichia coli CFT073
acucacgcagauacuggaaaau

SEQ ID NO: 663498 - RNA, 13 nt, Escherichia coli CFT073
acucacuaccagu

SEQ ID NO: 663499 - RNA, 20 nt, Escherichia coli CFT073
acucacuaccagugccagaa

SEQ ID NO: 663500 - RNA, 20 nt, Escherichia coli CFT073
acucaagcuaaaccaauaaa

SEQ ID NO: 663501 - RNA, 15 nt, Escherichia coli CFT073
acucaacguggacau

SEQ ID NO: 663502 - RNA, 13 nt, Escherichia coli CFT073
acucaaaaugccg

SEQ ID NO: 663503 - RNA, 16 nt, Escherichia coli CFT073
acuauuaaagaaagua

SEQ ID NO: 663504 - RNA, 15 nt, Escherichia coli CFT073
acuagucccuccgca

SEQ ID NO: 663505 - RNA, 16 nt, Escherichia coli CFT073
acuaucugaaaaugaa

SEQ ID NO: 663506 - RNA, 13 nt, Escherichia coli CFT073
acuaucugauaau

SEQ ID NO: 663507 - RNA, 18 nt, Escherichia coli CFT073
acuaucgccgagauacuc

SEQ ID NO: 663508 - RNA, 20 nt, Escherichia coli CFT073
acuaucacucccucauuuuc

SEQ ID NO: 663509 - RNA, 22 nt, Escherichia coli CFT073
acuaucacucccucauuuucaa

SEQ ID NO: 663510 - RNA, 15 nt, Escherichia coli CFT073
acuaucaggucuuuc

SEQ ID NO: 663511 - RNA, 21 nt, Escherichia coli CFT073
acuauccugaaagcugagaaa

SEQ ID NO: 663512 - RNA, 17 nt, Escherichia coli CFT073
acuauccuggacuuuaa

SEQ ID NO: 663513 - RNA, 16 nt, Escherichia coli CFT073
acguucgugaauaugu

SEQ ID NO: 663514 - RNA, 24 nt, Escherichia coli CFT073
acguucucugauacucaacucaca

SEQ ID NO: 663515 - RNA, 19 nt, Escherichia coli CFT073
acguucucuuucaggccgc

SEQ ID NO: 663516 - RNA, 22 nt, Escherichia coli CFT073
acuaccguuuuacucaaaaugc

SEQ ID NO: 663517 - RNA, 20 nt, Escherichia coli CFT073
acguucggcaaagcgcugaa

SEQ ID NO: 663518 - RNA, 22 nt, Escherichia coli CFT073
acguucggcaaagcgcugaaga

SEQ ID NO: 663519 - RNA, 20 nt, Escherichia coli CFT073
acguucauggcgugacaugg

SEQ ID NO: 663520 - RNA, 13 nt, Escherichia coli CFT073
acguucaguucac

SEQ ID NO: 663521 - RNA, 20 nt, Escherichia coli CFT073
acuacugccagauucuccag

SEQ ID NO: 663522 - RNA, 22 nt, Escherichia coli CFT073
acuacuggagacagauuuauaa

SEQ ID NO: 663523 - RNA, 16 nt, Escherichia coli CFT073
acuacggagauuaaac

SEQ ID NO: 663524 - RNA, 13 nt, Escherichia coli CFT073
acuacggcucagc

SEQ ID NO: 663525 - RNA, 15 nt, Escherichia coli CFT073
acuacggcuuuuuuc

SEQ ID NO: 663526 - RNA, 22 nt, Escherichia coli CFT073
acuacggcuuuuuucauuuccc

SEQ ID NO: 663527 - RNA, 17 nt, Escherichia coli CFT073
acuacguagucuuuacc

SEQ ID NO: 663528 - RNA, 17 nt, Escherichia coli CFT073
acggcacggaaagcagc

SEQ ID NO: 663529 - RNA, 18 nt, Escherichia coli CFT073
acggcacggaaagcagca

SEQ ID NO: 663530 - RNA, 16 nt, Escherichia coli CFT073
acggcauaagccgucc

SEQ ID NO: 663531 - RNA, 16 nt, Escherichia coli CFT073
acggcauaaauuucag

SEQ ID NO: 663532 - RNA, 11 nt, Escherichia coli CFT073
acggcaggaga

SEQ ID NO: 663533 - RNA, 20 nt, Escherichia coli CFT073
acggcauuaucgagcugccu

SEQ ID NO: 663534 - RNA, 22 nt, Escherichia coli CFT073
acggcauucgccacugccagca

SEQ ID NO: 663535 - RNA, 18 nt, Escherichia coli CFT073
acggcauuuugcugaugc

SEQ ID NO: 663536 - RNA, 17 nt, Escherichia coli CFT073
acggccacgaugcacag

SEQ ID NO: 663537 - RNA, 23 nt, Escherichia coli CFT073
acggccacgaugcacagcucuga

SEQ ID NO: 663538 - RNA, 16 nt, Escherichia coli CFT073
acggcccauaacccac

SEQ ID NO: 663539 - RNA, 14 nt, Escherichia coli CFT073
acggcgagccagcg

SEQ ID NO: 663540 - RNA, 15 nt, Escherichia coli CFT073
acggcgacagcaaaa

SEQ ID NO: 663541 - RNA, 20 nt, Escherichia coli CFT073
acggcgcagacggucuggug

SEQ ID NO: 663542 - RNA, 14 nt, Escherichia coli CFT073
acgggcaaucucau

SEQ ID NO: 663543 - RNA, 15 nt, Escherichia coli CFT073
acgggcaagccagca

SEQ ID NO: 663544 - RNA, 19 nt, Escherichia coli CFT073
acgggucaucaaaaucauc

SEQ ID NO: 663545 - RNA, 15 nt, Escherichia coli CFT073
acggguaaggcgcga

SEQ ID NO: 663546 - RNA, 23 nt, Escherichia coli CFT073
acgggguugugauuacaggaugc

SEQ ID NO: 663547 - RNA, 16 nt, Escherichia coli CFT073
acggggaguggugaug

SEQ ID NO: 663548 - RNA, 19 nt, Escherichia coli CFT073
acggggcugccagcucuca

SEQ ID NO: 663549 - RNA, 16 nt, Escherichia coli CFT073
acgguaguugaacucg

SEQ ID NO: 663550 - RNA, 15 nt, Escherichia coli CFT073
acgguauuaacucgg

SEQ ID NO: 663551 - RNA, 21 nt, Escherichia coli CFT073
acggucgaggcaaccagcacg

SEQ ID NO: 663552 - RNA, 15 nt, Escherichia coli CFT073
acggucagcgcacca

SEQ ID NO: 663553 - RNA, 19 nt, Escherichia coli CFT073
acggucagcgcaccacaca

SEQ ID NO: 663554 - RNA, 14 nt, Escherichia coli CFT073
acgucgcuuuauag

SEQ ID NO: 663555 - RNA, 23 nt, Escherichia coli CFT073
acgucgcaagacgaaaaaugaau

SEQ ID NO: 663556 - RNA, 18 nt, Escherichia coli CFT073
acgucucaaucaccacca

SEQ ID NO: 663557 - RNA, 19 nt, Escherichia coli CFT073
acgucucaaucaccaccag

SEQ ID NO: 663558 - RNA, 14 nt, Escherichia coli CFT073
acgugagagaaaau

SEQ ID NO: 663559 - RNA, 14 nt, Escherichia coli CFT073
acgucuacaguacg

SEQ ID NO: 663560 - RNA, 19 nt, Escherichia coli CFT073
acgucggguauauaaagcc

SEQ ID NO: 663561 - RNA, 19 nt, Escherichia coli CFT073
acgugcaguagcagcagga

SEQ ID NO: 663562 - RNA, 19 nt, Escherichia coli CFT073
acgugauuccagacggguc

SEQ ID NO: 663563 - RNA, 20 nt, Escherichia coli CFT073
acgugcaaaaucaaacagaa

SEQ ID NO: 663564 - RNA, 23 nt, Escherichia coli CFT073
acgugcaaaaucaaacagaauau

SEQ ID NO: 663565 - RNA, 13 nt, Escherichia coli CFT073
acguguuucagaa

SEQ ID NO: 663566 - RNA, 18 nt, Escherichia coli CFT073
acguguggucuuuucaac

SEQ ID NO: 663567 - RNA, 16 nt, Escherichia coli CFT073
acguguugcugcaugu

SEQ ID NO: 663568 - RNA, 13 nt, Escherichia coli CFT073
acguuaagaaaac

SEQ ID NO: 663569 - RNA, 16 nt, Escherichia coli CFT073
acguuaauacucacga

SEQ ID NO: 663570 - RNA, 14 nt, Escherichia coli CFT073
acguuaauccugau

SEQ ID NO: 663571 - RNA, 15 nt, Escherichia coli CFT073
acguuacaaccacau

SEQ ID NO: 663572 - RNA, 16 nt, Escherichia coli CFT073
acguuacaaccacaua

SEQ ID NO: 663573 - RNA, 17 nt, Escherichia coli CFT073
acguguaggccugauaa

SEQ ID NO: 663574 - RNA, 19 nt, Escherichia coli CFT073
acguaucaacaucacacca

SEQ ID NO: 663575 - RNA, 15 nt, Escherichia coli CFT073
acguauaacucgccu

SEQ ID NO: 663576 - RNA, 17 nt, Escherichia coli CFT073
acgguugaugccguucc

SEQ ID NO: 663577 - RNA, 21 nt, Escherichia coli CFT073
acgguuaaaaacagccagcag

SEQ ID NO: 663578 - RNA, 21 nt, Escherichia coli CFT073
acgguguuaccguaccaggca

SEQ ID NO: 663579 - RNA, 16 nt, Escherichia coli CFT073
acgguuagcauauacg

SEQ ID NO: 663580 - RNA, 22 nt, Escherichia coli CFT073
acgguucauuggguucaucuga

SEQ ID NO: 663581 - RNA, 20 nt, Escherichia coli CFT073
acgguugaucucaucuucca

SEQ ID NO: 663582 - RNA, 17 nt, Escherichia coli CFT073
acguccaccaaugccaa

SEQ ID NO: 663583 - RNA, 16 nt, Escherichia coli CFT073
acgucacucuuuauga

SEQ ID NO: 663584 - RNA, 18 nt, Escherichia coli CFT073
acgucagugacugcuuuu

SEQ ID NO: 663585 - RNA, 16 nt, Escherichia coli CFT073
acguccgugacuucau

SEQ ID NO: 663586 - RNA, 13 nt, Escherichia coli CFT073
acguccggucggg

SEQ ID NO: 663587 - RNA, 22 nt, Escherichia coli CFT073
acguccauguagcucaucugac

SEQ ID NO: 663588 - RNA, 11 nt, Escherichia coli CFT073
acgucccacag

SEQ ID NO: 663589 - RNA, 15 nt, Escherichia coli CFT073
acgucccaugaugcg

SEQ ID NO: 663590 - RNA, 13 nt, Escherichia coli CFT073
acguccagccggg

SEQ ID NO: 663591 - RNA, 19 nt, Escherichia coli CFT073
acgcgccgacgaauuucau

SEQ ID NO: 663592 - RNA, 22 nt, Escherichia coli CFT073
acgcgccaggaucagaaugcgc

SEQ ID NO: 663593 - RNA, 16 nt, Escherichia coli CFT073
acgcgccgccagccac

SEQ ID NO: 663594 - RNA, 14 nt, Escherichia coli CFT073
acgcgccagcagcg

SEQ ID NO: 663595 - RNA, 19 nt, Escherichia coli CFT073
acgcgauucccagucgcgc

SEQ ID NO: 663596 - RNA, 14 nt, Escherichia coli CFT073
acgcgcaacugucc

SEQ ID NO: 663597 - RNA, 16 nt, Escherichia coli CFT073
acgcgaagcacacaua

SEQ ID NO: 663598 - RNA, 20 nt, Escherichia coli CFT073
acgcgauaaaaaaccccgac

SEQ ID NO: 663599 - RNA, 23 nt, Escherichia coli CFT073
acgcgauaaaaaaccccgacauc

SEQ ID NO: 663600 - RNA, 17 nt, Escherichia coli CFT073
acgcgcuuuucaccgac

SEQ ID NO: 663601 - RNA, 22 nt, Escherichia coli CFT073
acgcggaaacuuaaucgccagu

SEQ ID NO: 663602 - RNA, 14 nt, Escherichia coli CFT073
acgcgcguuuucaa

SEQ ID NO: 663603 - RNA, 17 nt, Escherichia coli CFT073
acgcgcuguaauuucac

SEQ ID NO: 663604 - RNA, 18 nt, Escherichia coli CFT073
acgcggcaacggcuucgc

SEQ ID NO: 663605 - RNA, 24 nt, Escherichia coli CFT073
acgcggcaagcgucgcaucaggca

SEQ ID NO: 663606 - RNA, 17 nt, Escherichia coli CFT073
acgcggccugcacugag

SEQ ID NO: 663607 - RNA, 21 nt, Escherichia coli CFT073
acgcggcagcgucgcauccga

SEQ ID NO: 663608 - RNA, 13 nt, Escherichia coli CFT073
acgcggcaggaga

SEQ ID NO: 663609 - RNA, 14 nt, Escherichia coli CFT073
acgcggcagguaac

SEQ ID NO: 663610 - RNA, 14 nt, Escherichia coli CFT073
acgcgggaauagcu

SEQ ID NO: 663611 - RNA, 23 nt, Escherichia coli CFT073
acgcuggacgccgaugcgcuggc

SEQ ID NO: 663612 - RNA, 14 nt, Escherichia coli CFT073
acgcugcucaaugg

SEQ ID NO: 663613 - RNA, 14 nt, Escherichia coli CFT073
acgcuggcagauuu

SEQ ID NO: 663614 - RNA, 19 nt, Escherichia coli CFT073
acgcuggcagcagaaccag

SEQ ID NO: 663615 - RNA, 16 nt, Escherichia coli CFT073
acgcuggcaucaaucg

SEQ ID NO: 663616 - RNA, 16 nt, Escherichia coli CFT073
acgcuggugaaaucag

SEQ ID NO: 663617 - RNA, 21 nt, Escherichia coli CFT073
acgcuggcuuuacccuggcgc

SEQ ID NO: 663618 - RNA, 18 nt, Escherichia coli CFT073
acgcuggggaaugccaug

SEQ ID NO: 663619 - RNA, 13 nt, Escherichia coli CFT073
acgcucgcugcaa

SEQ ID NO: 663620 - RNA, 14 nt, Escherichia coli CFT073
acgcuccaugcugc

SEQ ID NO: 663621 - RNA, 14 nt, Escherichia coli CFT073
acgcucccagcagu

SEQ ID NO: 663622 - RNA, 12 nt, Escherichia coli CFT073
acgcuccggguu

SEQ ID NO: 663623 - RNA, 15 nt, Escherichia coli CFT073
acgcuccggguuuuc

SEQ ID NO: 663624 - RNA, 14 nt, Escherichia coli CFT073
acgcugccgucuuc

SEQ ID NO: 663625 - RNA, 17 nt, Escherichia coli CFT073
acgcguuaagcccaguu

SEQ ID NO: 663626 - RNA, 17 nt, Escherichia coli CFT073
acgcguuaauaccugau

SEQ ID NO: 663627 - RNA, 14 nt, Escherichia coli CFT073
acgcuccaccaccg

SEQ ID NO: 663628 - RNA, 15 nt, Escherichia coli CFT073
acgcguaaguacagu

SEQ ID NO: 663629 - RNA, 20 nt, Escherichia coli CFT073
acgcgucacaccuuguggaa

SEQ ID NO: 663630 - RNA, 12 nt, Escherichia coli CFT073
acgcgucuuauc

SEQ ID NO: 663631 - RNA, 19 nt, Escherichia coli CFT073
acgcgguuacgcaccgguu

SEQ ID NO: 663632 - RNA, 16 nt, Escherichia coli CFT073
acgcgguuaucccaaa

SEQ ID NO: 663633 - RNA, 22 nt, Escherichia coli CFT073
acgccuuugucgggcaggcuuc

SEQ ID NO: 663634 - RNA, 20 nt, Escherichia coli CFT073
acgccuuccagacucaucuu

SEQ ID NO: 663635 - RNA, 17 nt, Escherichia coli CFT073
acgccuuccgucagcaa

SEQ ID NO: 663636 - RNA, 14 nt, Escherichia coli CFT073
acgccuucuccggc

SEQ ID NO: 663637 - RNA, 13 nt, Escherichia coli CFT073
acgccugcggcug

SEQ ID NO: 663638 - RNA, 13 nt, Escherichia coli CFT073
acgccucacagag

SEQ ID NO: 663639 - RNA, 23 nt, Escherichia coli CFT073
acgccguuuuuacccagcagcag

SEQ ID NO: 663640 - RNA, 23 nt, Escherichia coli CFT073
acgccucgggaaggucagguuug

SEQ ID NO: 663641 - RNA, 20 nt, Escherichia coli CFT073
acgccgcugucuaccagcac

SEQ ID NO: 663642 - RNA, 22 nt, Escherichia coli CFT073
acgccgcuggugauucagggca

SEQ ID NO: 663643 - RNA, 21 nt, Escherichia coli CFT073
acgccgcugucuaccagcacc

SEQ ID NO: 663644 - RNA, 14 nt, Escherichia coli CFT073
acgccgcuauacgc

SEQ ID NO: 663645 - RNA, 17 nt, Escherichia coli CFT073
acgccgcgauagagagc

SEQ ID NO: 663646 - RNA, 18 nt, Escherichia coli CFT073
acgccgcgauagagagca

SEQ ID NO: 663647 - RNA, 15 nt, Escherichia coli CFT073
acgaucaacagaaug

SEQ ID NO: 663648 - RNA, 16 nt, Escherichia coli CFT073
acgaucaacagaauga

SEQ ID NO: 663649 - RNA, 23 nt, Escherichia coli CFT073
acgcccaaugcccagaaaccagu

SEQ ID NO: 663650 - RNA, 22 nt, Escherichia coli CFT073
acgcccagcgaccacaaauacc

SEQ ID NO: 663651 - RNA, 22 nt, Escherichia coli CFT073
acgcccagcgcaggaaagauaa

SEQ ID NO: 663652 - RNA, 16 nt, Escherichia coli CFT073
acgcccauacucaucu

SEQ ID NO: 663653 - RNA, 19 nt, Escherichia coli CFT073
acgcccugcaacugcugca

SEQ ID NO: 663654 - RNA, 22 nt, Escherichia coli CFT073
acgcccugaccgucaaacaugc

SEQ ID NO: 663655 - RNA, 22 nt, Escherichia coli CFT073
acgcccgcgcgguguacgcugc

SEQ ID NO: 663656 - RNA, 18 nt, Escherichia coli CFT073
acgccccucuaaacgcuc

SEQ ID NO: 663657 - RNA, 23 nt, Escherichia coli CFT073
acgcccgcaaucaacauaaugcc

SEQ ID NO: 663658 - RNA, 17 nt, Escherichia coli CFT073
acgccgagcgccagcca

SEQ ID NO: 663659 - RNA, 19 nt, Escherichia coli CFT073
acgccgaauaacgcgcagc

SEQ ID NO: 663660 - RNA, 14 nt, Escherichia coli CFT073
acgaccacccaccg

SEQ ID NO: 663661 - RNA, 21 nt, Escherichia coli CFT073
acgacaguaucgugacaauaa

SEQ ID NO: 663662 - RNA, 20 nt, Escherichia coli CFT073
acgacagucaauauucaauu

SEQ ID NO: 663663 - RNA, 15 nt, Escherichia coli CFT073
acgacaggcuuacgu

SEQ ID NO: 663664 - RNA, 12 nt, Escherichia coli CFT073
acgacaggcaag

SEQ ID NO: 663665 - RNA, 17 nt, Escherichia coli CFT073
acgacacugcucgcaga

SEQ ID NO: 663666 - RNA, 15 nt, Escherichia coli CFT073
acgacacaaugccau

SEQ ID NO: 663667 - RNA, 21 nt, Escherichia coli CFT073
acgaauugcuuccaguaacac

SEQ ID NO: 663668 - RNA, 15 nt, Escherichia coli CFT073
acgaauuuuuuguuc

SEQ ID NO: 663669 - RNA, 21 nt, Escherichia coli CFT073
acgacaaaaauaccaccaaug

SEQ ID NO: 663670 - RNA, 15 nt, Escherichia coli CFT073
acgaauuucaucgcu

SEQ ID NO: 663671 - RNA, 17 nt, Escherichia coli CFT073
acgaaugguuucacgcu

SEQ ID NO: 663672 - RNA, 19 nt, Escherichia coli CFT073
acgaaugguuucacgcugg

SEQ ID NO: 663673 - RNA, 16 nt, Escherichia coli CFT073
accuuugcuguugccg

SEQ ID NO: 663674 - RNA, 14 nt, Escherichia coli CFT073
accuuuuccagugg

SEQ ID NO: 663675 - RNA, 18 nt, Escherichia coli CFT073
accuuuuccaguggcuga

SEQ ID NO: 663676 - RNA, 15 nt, Escherichia coli CFT073
accuuuuccauugcc

SEQ ID NO: 663677 - RNA, 16 nt, Escherichia coli CFT073
accuuuguauuuuucc

SEQ ID NO: 663678 - RNA, 22 nt, Escherichia coli CFT073
accuuuucgguggcguuuuuau

SEQ ID NO: 663679 - RNA, 16 nt, Escherichia coli CFT073
accuuuugcugucuca

SEQ ID NO: 663680 - RNA, 12 nt, Escherichia coli CFT073
acgaaaccacuc

SEQ ID NO: 663681 - RNA, 21 nt, Escherichia coli CFT073
acgaaacccgaaccacgcagg

SEQ ID NO: 663682 - RNA, 14 nt, Escherichia coli CFT073
acgaaucaggcggc

SEQ ID NO: 663683 - RNA, 15 nt, Escherichia coli CFT073
acgaauagucaguuc

SEQ ID NO: 663684 - RNA, 20 nt, Escherichia coli CFT073
acgaauauguuuuugaauua

SEQ ID NO: 663685 - RNA, 13 nt, Escherichia coli CFT073
acgaaucacagcu

SEQ ID NO: 663686 - RNA, 14 nt, Escherichia coli CFT073
acgagccauaaaau

SEQ ID NO: 663687 - RNA, 19 nt, Escherichia coli CFT073
acgacugaugcgacgcagg

SEQ ID NO: 663688 - RNA, 12 nt, Escherichia coli CFT073
acgagaucguca

SEQ ID NO: 663689 - RNA, 18 nt, Escherichia coli CFT073
acgaguggcggacgggug

SEQ ID NO: 663690 - RNA, 18 nt, Escherichia coli CFT073
acgaguuagcauggcuga

SEQ ID NO: 663691 - RNA, 16 nt, Escherichia coli CFT073
acgauaaaagugcaga

SEQ ID NO: 663692 - RNA, 15 nt, Escherichia coli CFT073
acgacgacaggcaag

SEQ ID NO: 663693 - RNA, 20 nt, Escherichia coli CFT073
acgacgguuaaauugaggcu

SEQ ID NO: 663694 - RNA, 20 nt, Escherichia coli CFT073
acgaccuugccaaggucggg

SEQ ID NO: 663695 - RNA, 18 nt, Escherichia coli CFT073
acgaccgccgcucaccug

SEQ ID NO: 663696 - RNA, 14 nt, Escherichia coli CFT073
acgaccggguuuuc

SEQ ID NO: 663697 - RNA, 16 nt, Escherichia coli CFT073
acgaccggguuuucaa

SEQ ID NO: 663698 - RNA, 16 nt, Escherichia coli CFT073
acgaccagaaagacug

SEQ ID NO: 663699 - RNA, 18 nt, Escherichia coli CFT073
acgacaugguagauaacc

SEQ ID NO: 663700 - RNA, 19 nt, Escherichia coli CFT073
acgaccagcggcaacauca

SEQ ID NO: 663701 - RNA, 21 nt, Escherichia coli CFT073
accugcuguguaauuugcguu

SEQ ID NO: 663702 - RNA, 14 nt, Escherichia coli CFT073
accuggauugccug

SEQ ID NO: 663703 - RNA, 18 nt, Escherichia coli CFT073
accuggccccuggcuggu

SEQ ID NO: 663704 - RNA, 21 nt, Escherichia coli CFT073
accuggccccuggcuggucag

SEQ ID NO: 663705 - RNA, 21 nt, Escherichia coli CFT073
accugcucaaucgcauggcug

SEQ ID NO: 663706 - RNA, 11 nt, Escherichia coli CFT073
accugcucagc

SEQ ID NO: 663707 - RNA, 19 nt, Escherichia coli CFT073
accugcucagcacgccacu

SEQ ID NO: 663708 - RNA, 17 nt, Escherichia coli CFT073
accugcguugcucaugc

SEQ ID NO: 663709 - RNA, 19 nt, Escherichia coli CFT073
accugcuauagccuccucu

SEQ ID NO: 663710 - RNA, 20 nt, Escherichia coli CFT073
accugcuauucccgcaaaau

SEQ ID NO: 663711 - RNA, 16 nt, Escherichia coli CFT073
accugcggugcagccg

SEQ ID NO: 663712 - RNA, 16 nt, Escherichia coli CFT073
accugcgucugaugaa

SEQ ID NO: 663713 - RNA, 23 nt, Escherichia coli CFT073
accugcguucagcaguucugcca

SEQ ID NO: 663714 - RNA, 15 nt, Escherichia coli CFT073
accugccugcagcug

SEQ ID NO: 663715 - RNA, 17 nt, Escherichia coli CFT073
accugccugcagcugcu

SEQ ID NO: 663716 - RNA, 21 nt, Escherichia coli CFT073
accugcaacguuuuaagcaaa

SEQ ID NO: 663717 - RNA, 18 nt, Escherichia coli CFT073
accuccacgcccagcgca

SEQ ID NO: 663718 - RNA, 14 nt, Escherichia coli CFT073
accugcaguucauc

SEQ ID NO: 663719 - RNA, 17 nt, Escherichia coli CFT073
accugcacaggcauuca

SEQ ID NO: 663720 - RNA, 19 nt, Escherichia coli CFT073
accugccagcaucuccaua

SEQ ID NO: 663721 - RNA, 19 nt, Escherichia coli CFT073
accugcccgguauccauca

SEQ ID NO: 663722 - RNA, 14 nt, Escherichia coli CFT073
accugcccuccggu

SEQ ID NO: 663723 - RNA, 16 nt, Escherichia coli CFT073
accugccgccaccaug

SEQ ID NO: 663724 - RNA, 12 nt, Escherichia coli CFT073
accuuugaaaau

SEQ ID NO: 663725 - RNA, 20 nt, Escherichia coli CFT073
accuugcuucuuacuauaua

SEQ ID NO: 663726 - RNA, 13 nt, Escherichia coli CFT073
accuucuuccugc

SEQ ID NO: 663727 - RNA, 15 nt, Escherichia coli CFT073
accuucuguuauaua

SEQ ID NO: 663728 - RNA, 19 nt, Escherichia coli CFT073
accuucuguuauauauuac

SEQ ID NO: 663729 - RNA, 15 nt, Escherichia coli CFT073
accuuccagaaaaag

SEQ ID NO: 663730 - RNA, 19 nt, Escherichia coli CFT073
accuggcggcguguuaucc

SEQ ID NO: 663731 - RNA, 21 nt, Escherichia coli CFT073
accuguacaagcaacuugcaa

SEQ ID NO: 663732 - RNA, 12 nt, Escherichia coli CFT073
accuguccagac

SEQ ID NO: 663733 - RNA, 16 nt, Escherichia coli CFT073
accugugacagcagcg

SEQ ID NO: 663734 - RNA, 14 nt, Escherichia coli CFT073
accugucucuuaua

SEQ ID NO: 663735 - RNA, 21 nt, Escherichia coli CFT073
accuucacaaaaugccagcaa

SEQ ID NO: 663736 - RNA, 13 nt, Escherichia coli CFT073
accuucagcaaga

SEQ ID NO: 663737 - RNA, 16 nt, Escherichia coli CFT073
accguugaccauauca

SEQ ID NO: 663738 - RNA, 23 nt, Escherichia coli CFT073
accguuggcgcguguuccagaga

SEQ ID NO: 663739 - RNA, 22 nt, Escherichia coli CFT073
accguucgccaggucagagagc

SEQ ID NO: 663740 - RNA, 16 nt, Escherichia coli CFT073
accguucgccccauac

SEQ ID NO: 663741 - RNA, 20 nt, Escherichia coli CFT073
accguucauuaacgccccaa

SEQ ID NO: 663742 - RNA, 14 nt, Escherichia coli CFT073
accguucagcuugc

SEQ ID NO: 663743 - RNA, 22 nt, Escherichia coli CFT073
accgugcugacucggcugcugc

SEQ ID NO: 663744 - RNA, 13 nt, Escherichia coli CFT073
accguggcaaaau

SEQ ID NO: 663745 - RNA, 17 nt, Escherichia coli CFT073
accguguauuucugguc

SEQ ID NO: 663746 - RNA, 19 nt, Escherichia coli CFT073
accgugcagcacggagaga

SEQ ID NO: 663747 - RNA, 14 nt, Escherichia coli CFT073
accgugagcaaugc

SEQ ID NO: 663748 - RNA, 17 nt, Escherichia coli CFT073
accgucuuuauccagca

SEQ ID NO: 663749 - RNA, 23 nt, Escherichia coli CFT073
accgucgagcagagaaacgccag

SEQ ID NO: 663750 - RNA, 20 nt, Escherichia coli CFT073
accgucguuuugcggcguga

SEQ ID NO: 663751 - RNA, 22 nt, Escherichia coli CFT073
accgucugaagggaugcugugc

SEQ ID NO: 663752 - RNA, 12 nt, Escherichia coli CFT073
accgucuguaac

SEQ ID NO: 663753 - RNA, 23 nt, Escherichia coli CFT073
accgucuguguaccugucgggac

SEQ ID NO: 663754 - RNA, 16 nt, Escherichia coli CFT073
accgucuucccgcagc

SEQ ID NO: 663755 - RNA, 20 nt, Escherichia coli CFT073
accgucuucccgcagccacg

SEQ ID NO: 663756 - RNA, 19 nt, Escherichia coli CFT073
accguccagcguucccacg

SEQ ID NO: 663757 - RNA, 14 nt, Escherichia coli CFT073
accguccauccaca

SEQ ID NO: 663758 - RNA, 16 nt, Escherichia coli CFT073
accgucaucacgcagc

SEQ ID NO: 663759 - RNA, 17 nt, Escherichia coli CFT073
accguccgcauucuucu

SEQ ID NO: 663760 - RNA, 23 nt, Escherichia coli CFT073
accguccucacuuaaagcaacac

SEQ ID NO: 663761 - RNA, 22 nt, Escherichia coli CFT073
accgucgccucgccgagcagcu

SEQ ID NO: 663762 - RNA, 16 nt, Escherichia coli CFT073
accuacagccacaccu

SEQ ID NO: 663763 - RNA, 19 nt, Escherichia coli CFT073
accuaccugcaguucauca

SEQ ID NO: 663764 - RNA, 15 nt, Escherichia coli CFT073
accuacgcccgccag

SEQ ID NO: 663765 - RNA, 13 nt, Escherichia coli CFT073
accucaaaaccaa

SEQ ID NO: 663766 - RNA, 19 nt, Escherichia coli CFT073
accucaacccgguugcuuu

SEQ ID NO: 663767 - RNA, 18 nt, Escherichia coli CFT073
accucauccgaugguuua

SEQ ID NO: 663768 - RNA, 12 nt, Escherichia coli CFT073
accuaauuuuuu

SEQ ID NO: 663769 - RNA, 13 nt, Escherichia coli CFT073
accuaagccgcgu

SEQ ID NO: 663770 - RNA, 19 nt, Escherichia coli CFT073
accuaaagccuguaaugcc

SEQ ID NO: 663771 - RNA, 16 nt, Escherichia coli CFT073
accguuugauauaaac

SEQ ID NO: 663772 - RNA, 17 nt, Escherichia coli CFT073
accguuuguuuuuuaag

SEQ ID NO: 663773 - RNA, 20 nt, Escherichia coli CFT073
accguuuucgacaauaaaca

SEQ ID NO: 663774 - RNA, 13 nt, Escherichia coli CFT073
accgcucgcgcuu

SEQ ID NO: 663775 - RNA, 17 nt, Escherichia coli CFT073
accgcuccgccaucuuc

SEQ ID NO: 663776 - RNA, 15 nt, Escherichia coli CFT073
accgcuaccgcccug

SEQ ID NO: 663777 - RNA, 16 nt, Escherichia coli CFT073
accgcuaccgcccuga

SEQ ID NO: 663778 - RNA, 22 nt, Escherichia coli CFT073
accgcuacuggcaauccugcuu

SEQ ID NO: 663779 - RNA, 20 nt, Escherichia coli CFT073
accgcuauagccgcaacugc

SEQ ID NO: 663780 - RNA, 18 nt, Escherichia coli CFT073
accgcguuggcgcagcaa

SEQ ID NO: 663781 - RNA, 13 nt, Escherichia coli CFT073
accgcguuuucca

SEQ ID NO: 663782 - RNA, 14 nt, Escherichia coli CFT073
accgauucuuugac

SEQ ID NO: 663783 - RNA, 21 nt, Escherichia coli CFT073
accgcaaacugcuguugcugc

SEQ ID NO: 663784 - RNA, 19 nt, Escherichia coli CFT073
accgcaaagucggcaccag

SEQ ID NO: 663785 - RNA, 15 nt, Escherichia coli CFT073
accgcguaugcccag

SEQ ID NO: 663786 - RNA, 22 nt, Escherichia coli CFT073
accgcuguuaugcacacgcgga

SEQ ID NO: 663787 - RNA, 16 nt, Escherichia coli CFT073
accgcuucaucugcac

SEQ ID NO: 663788 - RNA, 20 nt, Escherichia coli CFT073
accgcucugcaucccggcag

SEQ ID NO: 663789 - RNA, 21 nt, Escherichia coli CFT073
accgcucugcaucccggcagg

SEQ ID NO: 663790 - RNA, 17 nt, Escherichia coli CFT073
accgcuucgcguaaaau

SEQ ID NO: 663791 - RNA, 23 nt, Escherichia coli CFT073
accgcuuuaaaauuauccagcgc

SEQ ID NO: 663792 - RNA, 14 nt, Escherichia coli CFT073
accgcuuuccucau

SEQ ID NO: 663793 - RNA, 17 nt, Escherichia coli CFT073
accggaaauugcugccg

SEQ ID NO: 663794 - RNA, 14 nt, Escherichia coli CFT073
accggaaagaauau

SEQ ID NO: 663795 - RNA, 17 nt, Escherichia coli CFT073
accgcuuuuccggcaug

SEQ ID NO: 663796 - RNA, 19 nt, Escherichia coli CFT073
accgcuuuuugauaaguac

SEQ ID NO: 663797 - RNA, 14 nt, Escherichia coli CFT073
accggaacuuucac

SEQ ID NO: 663798 - RNA, 12 nt, Escherichia coli CFT073
accggaaccagc

SEQ ID NO: 663799 - RNA, 13 nt, Escherichia coli CFT073
accggaaccagcg

SEQ ID NO: 663800 - RNA, 13 nt, Escherichia coli CFT073
accggcacccaau

SEQ ID NO: 663801 - RNA, 12 nt, Escherichia coli CFT073
accggaauuuac

SEQ ID NO: 663802 - RNA, 19 nt, Escherichia coli CFT073
accggacaguuugaucagu

SEQ ID NO: 663803 - RNA, 19 nt, Escherichia coli CFT073
accggcuuucgcuucaacc

SEQ ID NO: 663804 - RNA, 13 nt, Escherichia coli CFT073
accgggagaucca

SEQ ID NO: 663805 - RNA, 17 nt, Escherichia coli CFT073
accgguacaaacaucau

SEQ ID NO: 663806 - RNA, 16 nt, Escherichia coli CFT073
accgguagcagagcca

SEQ ID NO: 663807 - RNA, 18 nt, Escherichia coli CFT073
accgguaucugccagcac

SEQ ID NO: 663808 - RNA, 14 nt, Escherichia coli CFT073
accguaaaaauagc

SEQ ID NO: 663809 - RNA, 13 nt, Escherichia coli CFT073
accguaaacagau

SEQ ID NO: 663810 - RNA, 18 nt, Escherichia coli CFT073
accgguugucgugguugg

SEQ ID NO: 663811 - RNA, 18 nt, Escherichia coli CFT073
accgguccacuuccugcg

SEQ ID NO: 663812 - RNA, 20 nt, Escherichia coli CFT073
accgguccacuuccugcgcc

SEQ ID NO: 663813 - RNA, 21 nt, Escherichia coli CFT073
accgguccacuuccugcgcca

SEQ ID NO: 663814 - RNA, 23 nt, Escherichia coli CFT073
accguaacaggugauaauccaga

SEQ ID NO: 663815 - RNA, 18 nt, Escherichia coli CFT073
accguacagauacauuuc

SEQ ID NO: 663816 - RNA, 13 nt, Escherichia coli CFT073
accguagaaggcg

SEQ ID NO: 663817 - RNA, 13 nt, Escherichia coli CFT073
accguaccaggca

SEQ ID NO: 663818 - RNA, 14 nt, Escherichia coli CFT073
accgucacuucuuc

SEQ ID NO: 663819 - RNA, 19 nt, Escherichia coli CFT073
accgucacuguugcuguag

SEQ ID NO: 663820 - RNA, 15 nt, Escherichia coli CFT073
accgucagccagcac

SEQ ID NO: 663821 - RNA, 18 nt, Escherichia coli CFT073
accgucacaucaauuaca

SEQ ID NO: 663822 - RNA, 18 nt, Escherichia coli CFT073
accgucaauaaaaacggc

SEQ ID NO: 663823 - RNA, 19 nt, Escherichia coli CFT073
accguaggucggauaagac

SEQ ID NO: 663824 - RNA, 16 nt, Escherichia coli CFT073
accguaucuaccacug

SEQ ID NO: 663825 - RNA, 16 nt, Escherichia coli CFT073
acccgacgugcagcau

SEQ ID NO: 663826 - RNA, 17 nt, Escherichia coli CFT073
acccgacacggcucgcc

SEQ ID NO: 663827 - RNA, 22 nt, Escherichia coli CFT073
accccuacggcgacagcaaaau

SEQ ID NO: 663828 - RNA, 14 nt, Escherichia coli CFT073
acccgaugcgcuuu

SEQ ID NO: 663829 - RNA, 13 nt, Escherichia coli CFT073
acccgcaaauaau

SEQ ID NO: 663830 - RNA, 15 nt, Escherichia coli CFT073
acccgauacuccacg

SEQ ID NO: 663831 - RNA, 18 nt, Escherichia coli CFT073
acccgauccacugaaaca

SEQ ID NO: 663832 - RNA, 18 nt, Escherichia coli CFT073
acccgaugaucaaaaaaa

SEQ ID NO: 663833 - RNA, 12 nt, Escherichia coli CFT073
acccgcaacagc

SEQ ID NO: 663834 - RNA, 19 nt, Escherichia coli CFT073
acccgcaacgcccugcaac

SEQ ID NO: 663835 - RNA, 13 nt, Escherichia coli CFT073
acccgcaaucauc

SEQ ID NO: 663836 - RNA, 22 nt, Escherichia coli CFT073
acccgcacaaauagccagcaga

SEQ ID NO: 663837 - RNA, 15 nt, Escherichia coli CFT073
acccgcagccagcac

SEQ ID NO: 663838 - RNA, 22 nt, Escherichia coli CFT073
accccgguuguuacugauuaac

SEQ ID NO: 663839 - RNA, 23 nt, Escherichia coli CFT073
acccccguguuuuugugccagag

SEQ ID NO: 663840 - RNA, 19 nt, Escherichia coli CFT073
accccaaguuuaugcaaua

SEQ ID NO: 663841 - RNA, 18 nt, Escherichia coli CFT073
accccaauaauucuuccu

SEQ ID NO: 663842 - RNA, 14 nt, Escherichia coli CFT073
accccaauguuuuu

SEQ ID NO: 663843 - RNA, 22 nt, Escherichia coli CFT073
acccagguuugacgccugcagc

SEQ ID NO: 663844 - RNA, 14 nt, Escherichia coli CFT073
acccagucccacca

SEQ ID NO: 663845 - RNA, 11 nt, Escherichia coli CFT073
acccagcagca

SEQ ID NO: 663846 - RNA, 20 nt, Escherichia coli CFT073
acccagcgguaaaaugguca

SEQ ID NO: 663847 - RNA, 21 nt, Escherichia coli CFT073
acccagcggauaaagcagggc

SEQ ID NO: 663848 - RNA, 20 nt, Escherichia coli CFT073
acccagcguguugaggaagc

SEQ ID NO: 663849 - RNA, 13 nt, Escherichia coli CFT073
acccagcuucagc

SEQ ID NO: 663850 - RNA, 14 nt, Escherichia coli CFT073
acccacgaaaucuu

SEQ ID NO: 663851 - RNA, 17 nt, Escherichia coli CFT073
acccacgaaaucuucca

SEQ ID NO: 663852 - RNA, 17 nt, Escherichia coli CFT073
accaucugauucuuccc

SEQ ID NO: 663853 - RNA, 18 nt, Escherichia coli CFT073
accaucugauucuuccca

SEQ ID NO: 663854 - RNA, 23 nt, Escherichia coli CFT073
accaucugauucuucccauaccc

SEQ ID NO: 663855 - RNA, 16 nt, Escherichia coli CFT073
accaucuuccagcugc

SEQ ID NO: 663856 - RNA, 20 nt, Escherichia coli CFT073
accaucguccagcagcaaug

SEQ ID NO: 663857 - RNA, 20 nt, Escherichia coli CFT073
acccacgguacucaucacgu

SEQ ID NO: 663858 - RNA, 16 nt, Escherichia coli CFT073
acccagacaaaauuca

SEQ ID NO: 663859 - RNA, 15 nt, Escherichia coli CFT073
acccagcaaugccag

SEQ ID NO: 663860 - RNA, 20 nt, Escherichia coli CFT073
acccagaaccauugagcuuu

SEQ ID NO: 663861 - RNA, 15 nt, Escherichia coli CFT073
acccgccaccgggaa

SEQ ID NO: 663862 - RNA, 20 nt, Escherichia coli CFT073
acccgccagaaaaggugcca

SEQ ID NO: 663863 - RNA, 15 nt, Escherichia coli CFT073
acccgccagaauccc

SEQ ID NO: 663864 - RNA, 21 nt, Escherichia coli CFT073
acccgccagaauccccggcag

SEQ ID NO: 663865 - RNA, 17 nt, Escherichia coli CFT073
acccgccaucgcccgca

SEQ ID NO: 663866 - RNA, 15 nt, Escherichia coli CFT073
acccuauuuaaagca

SEQ ID NO: 663867 - RNA, 18 nt, Escherichia coli CFT073
acccuauuuaaagcacaa

SEQ ID NO: 663868 - RNA, 14 nt, Escherichia coli CFT073
acccuaacaucauc

SEQ ID NO: 663869 - RNA, 18 nt, Escherichia coli CFT073
acccguaaaaaucggcaa

SEQ ID NO: 663870 - RNA, 15 nt, Escherichia coli CFT073
acccugguuagcaac

SEQ ID NO: 663871 - RNA, 22 nt, Escherichia coli CFT073
acccuggucgguuucagccagg

SEQ ID NO: 663872 - RNA, 17 nt, Escherichia coli CFT073
acccuguggaucuuccc

SEQ ID NO: 663873 - RNA, 18 nt, Escherichia coli CFT073
acccuguggaucuucccc

SEQ ID NO: 663874 - RNA, 20 nt, Escherichia coli CFT073
acccuguggaucuuccccuu

SEQ ID NO: 663875 - RNA, 20 nt, Escherichia coli CFT073
acccugugggacaaaguaau

SEQ ID NO: 663876 - RNA, 17 nt, Escherichia coli CFT073
acccuucauauuccuga

SEQ ID NO: 663877 - RNA, 14 nt, Escherichia coli CFT073
acccuuguggauaa

SEQ ID NO: 663878 - RNA, 20 nt, Escherichia coli CFT073
acccuugacccguuuuaaau

SEQ ID NO: 663879 - RNA, 21 nt, Escherichia coli CFT073
acccucaaaauuucucuuuca

SEQ ID NO: 663880 - RNA, 19 nt, Escherichia coli CFT073
acccucaaacgccagcaug

SEQ ID NO: 663881 - RNA, 14 nt, Escherichia coli CFT073
acccucaauaauca

SEQ ID NO: 663882 - RNA, 21 nt, Escherichia coli CFT073
acccucacgcauucucuuuuc

SEQ ID NO: 663883 - RNA, 21 nt, Escherichia coli CFT073
acccugaguuuucaguaccgc

SEQ ID NO: 663884 - RNA, 12 nt, Escherichia coli CFT073
acccugcgcaug

SEQ ID NO: 663885 - RNA, 19 nt, Escherichia coli CFT073
acccugaugcccaaaaaaa

SEQ ID NO: 663886 - RNA, 14 nt, Escherichia coli CFT073
acccugauggcuga

SEQ ID NO: 663887 - RNA, 14 nt, Escherichia coli CFT073
accgacaauccagu

SEQ ID NO: 663888 - RNA, 22 nt, Escherichia coli CFT073
accgacaauccaguugguucaa

SEQ ID NO: 663889 - RNA, 15 nt, Escherichia coli CFT073
accgaauccuuugga

SEQ ID NO: 663890 - RNA, 23 nt, Escherichia coli CFT073
accgaaguggacgaacagcucaa

SEQ ID NO: 663891 - RNA, 15 nt, Escherichia coli CFT073
accgaauccagcaag

SEQ ID NO: 663892 - RNA, 16 nt, Escherichia coli CFT073
accgaauccagcaagc

SEQ ID NO: 663893 - RNA, 20 nt, Escherichia coli CFT073
accgaagggaucuuccaguu

SEQ ID NO: 663894 - RNA, 19 nt, Escherichia coli CFT073
acccuuuuugauucaccac

SEQ ID NO: 663895 - RNA, 13 nt, Escherichia coli CFT073
acccuuucugcug

SEQ ID NO: 663896 - RNA, 13 nt, Escherichia coli CFT073
accgaaagcacug

SEQ ID NO: 663897 - RNA, 15 nt, Escherichia coli CFT073
accgaacaaaacagc

SEQ ID NO: 663898 - RNA, 15 nt, Escherichia coli CFT073
accgaaauccuggug

SEQ ID NO: 663899 - RNA, 13 nt, Escherichia coli CFT073
accgaaaucgcca

SEQ ID NO: 663900 - RNA, 15 nt, Escherichia coli CFT073
accgaggaagaccuc

SEQ ID NO: 663901 - RNA, 14 nt, Escherichia coli CFT073
accgaggagcaaca

SEQ ID NO: 663902 - RNA, 19 nt, Escherichia coli CFT073
accgaggccaaaaccacag

SEQ ID NO: 663903 - RNA, 16 nt, Escherichia coli CFT073
accgagggaagcaaua

SEQ ID NO: 663904 - RNA, 20 nt, Escherichia coli CFT073
accgagucgccuuuuuccau

SEQ ID NO: 663905 - RNA, 13 nt, Escherichia coli CFT073
accgacguucagg

SEQ ID NO: 663906 - RNA, 17 nt, Escherichia coli CFT073
accgacugacgcucugc

SEQ ID NO: 663907 - RNA, 14 nt, Escherichia coli CFT073
accgacgaucaaca

SEQ ID NO: 663908 - RNA, 16 nt, Escherichia coli CFT073
accgacgaucaacaga

SEQ ID NO: 663909 - RNA, 22 nt, Escherichia coli CFT073
accgacgaucgggaacagccac

SEQ ID NO: 663910 - RNA, 14 nt, Escherichia coli CFT073
accagugacgcagc

SEQ ID NO: 663911 - RNA, 20 nt, Escherichia coli CFT073
accagugcagauaccaccag

SEQ ID NO: 663912 - RNA, 23 nt, Escherichia coli CFT073
accagugcagaugcacaagcggc

SEQ ID NO: 663913 - RNA, 20 nt, Escherichia coli CFT073
accagugcaggcaccagccc

SEQ ID NO: 663914 - RNA, 20 nt, Escherichia coli CFT073
accaguccuacacacgccag

SEQ ID NO: 663915 - RNA, 23 nt, Escherichia coli CFT073
accagucagcgaacaccagcagu

SEQ ID NO: 663916 - RNA, 13 nt, Escherichia coli CFT073
accagucagaaug

SEQ ID NO: 663917 - RNA, 22 nt, Escherichia coli CFT073
accagucagcgaacaccagcag

SEQ ID NO: 663918 - RNA, 22 nt, Escherichia coli CFT073
accauaaaacgcgcuacugaau

SEQ ID NO: 663919 - RNA, 16 nt, Escherichia coli CFT073
accaguuuuaguggau

SEQ ID NO: 663920 - RNA, 22 nt, Escherichia coli CFT073
accaguugguagguccagccgc

SEQ ID NO: 663921 - RNA, 17 nt, Escherichia coli CFT073
accaguucgcuuugaau

SEQ ID NO: 663922 - RNA, 20 nt, Escherichia coli CFT073
accagugccagaacagaaau

SEQ ID NO: 663923 - RNA, 19 nt, Escherichia coli CFT073
accaguuaaagcucuucuu

SEQ ID NO: 663924 - RNA, 15 nt, Escherichia coli CFT073
accaguucacaccga

SEQ ID NO: 663925 - RNA, 16 nt, Escherichia coli CFT073
accaguucaccaccug

SEQ ID NO: 663926 - RNA, 23 nt, Escherichia coli CFT073
accauaguccggcaccagcgcug

SEQ ID NO: 663927 - RNA, 16 nt, Escherichia coli CFT073
accauauagcgcacau

SEQ ID NO: 663928 - RNA, 21 nt, Escherichia coli CFT073
accauauagcgcacaugcagc

SEQ ID NO: 663929 - RNA, 22 nt, Escherichia coli CFT073
accauauaucagcgccacauca

SEQ ID NO: 663930 - RNA, 11 nt, Escherichia coli CFT073
accauauuaac

SEQ ID NO: 663931 - RNA, 17 nt, Escherichia coli CFT073
accauauucagcagcag

SEQ ID NO: 663932 - RNA, 14 nt, Escherichia coli CFT073
accauaaaucagau

SEQ ID NO: 663933 - RNA, 19 nt, Escherichia coli CFT073
accaucgcaaacagcacau

SEQ ID NO: 663934 - RNA, 14 nt, Escherichia coli CFT073
accaucgccagccc

SEQ ID NO: 663935 - RNA, 16 nt, Escherichia coli CFT073
accaucgccauuuaac

SEQ ID NO: 663936 - RNA, 22 nt, Escherichia coli CFT073
accaucgcccacaccacgccac

SEQ ID NO: 663937 - RNA, 23 nt, Escherichia coli CFT073
accaucgcccacaccacgccacu

SEQ ID NO: 663938 - RNA, 23 nt, Escherichia coli CFT073
accaucggcacgaccaggaacgc

SEQ ID NO: 663939 - RNA, 16 nt, Escherichia coli CFT073
accaucggcagcgcca

SEQ ID NO: 663940 - RNA, 11 nt, Escherichia coli CFT073
accauauuuau

SEQ ID NO: 663941 - RNA, 15 nt, Escherichia coli CFT073
accaucgaaauuagc

SEQ ID NO: 663942 - RNA, 14 nt, Escherichia coli CFT073
accaucgacaccau

SEQ ID NO: 663943 - RNA, 17 nt, Escherichia coli CFT073
accauccugaucgccau

SEQ ID NO: 663944 - RNA, 16 nt, Escherichia coli CFT073
accagguaaagaccau

SEQ ID NO: 663945 - RNA, 19 nt, Escherichia coli CFT073
accaggguggcaaaugcau

SEQ ID NO: 663946 - RNA, 22 nt, Escherichia coli CFT073
accagggaaauaaucgggaaua

SEQ ID NO: 663947 - RNA, 18 nt, Escherichia coli CFT073
accaggcuuacacuuccu

SEQ ID NO: 663948 - RNA, 18 nt, Escherichia coli CFT073
accaggcgaccguuuuca

SEQ ID NO: 663949 - RNA, 14 nt, Escherichia coli CFT073
accaguaaaccaau

SEQ ID NO: 663950 - RNA, 13 nt, Escherichia coli CFT073
accaguaaccaga

SEQ ID NO: 663951 - RNA, 16 nt, Escherichia coli CFT073
accaguaacuuccccu

SEQ ID NO: 663952 - RNA, 15 nt, Escherichia coli CFT073
accaguaaggcaucu

SEQ ID NO: 663953 - RNA, 17 nt, Escherichia coli CFT073
accaguaccauuuucgc

SEQ ID NO: 663954 - RNA, 14 nt, Escherichia coli CFT073
accaguaccgccac

SEQ ID NO: 663955 - RNA, 16 nt, Escherichia coli CFT073
accaguaccgccacca

SEQ ID NO: 663956 - RNA, 13 nt, Escherichia coli CFT073
accaguaccgccg

SEQ ID NO: 663957 - RNA, 22 nt, Escherichia coli CFT073
accaguaccgccgccauaaaca

SEQ ID NO: 663958 - RNA, 15 nt, Escherichia coli CFT073
accagguucaacagc

SEQ ID NO: 663959 - RNA, 19 nt, Escherichia coli CFT073
accaggcaauaaacauccu

SEQ ID NO: 663960 - RNA, 23 nt, Escherichia coli CFT073
accaggaaacccaacgcaaagag

SEQ ID NO: 663961 - RNA, 13 nt, Escherichia coli CFT073
accagcugaaauc

SEQ ID NO: 663962 - RNA, 23 nt, Escherichia coli CFT073
accagcugaaaucaccgccacca

SEQ ID NO: 663963 - RNA, 16 nt, Escherichia coli CFT073
accagcuccggcacuu

SEQ ID NO: 663964 - RNA, 13 nt, Escherichia coli CFT073
accagcguuucca

SEQ ID NO: 663965 - RNA, 17 nt, Escherichia coli CFT073
accagcguuuccagcac

SEQ ID NO: 663966 - RNA, 18 nt, Escherichia coli CFT073
accagcguuuccagcacc

SEQ ID NO: 663967 - RNA, 19 nt, Escherichia coli CFT073
accagaauagcggcuucau

SEQ ID NO: 663968 - RNA, 13 nt, Escherichia coli CFT073
accagaaucgcca

SEQ ID NO: 663969 - RNA, 14 nt, Escherichia coli CFT073
accagaaucgccag

SEQ ID NO: 663970 - RNA, 20 nt, Escherichia coli CFT073
accagaauugaccaguaaua

SEQ ID NO: 663971 - RNA, 20 nt, Escherichia coli CFT073
accagaauuuccagaaagug

SEQ ID NO: 663972 - RNA, 13 nt, Escherichia coli CFT073
accagacaacagu

SEQ ID NO: 663973 - RNA, 15 nt, Escherichia coli CFT073
accagacaacaguca

SEQ ID NO: 663974 - RNA, 23 nt, Escherichia coli CFT073
accagacaacagucaaccgccug

SEQ ID NO: 663975 - RNA, 18 nt, Escherichia coli CFT073
accagacgcgcugaguca

SEQ ID NO: 663976 - RNA, 17 nt, Escherichia coli CFT073
accagaccaauggcuuu

SEQ ID NO: 663977 - RNA, 20 nt, Escherichia coli CFT073
accagaccagcaauaaaaaa

SEQ ID NO: 663978 - RNA, 21 nt, Escherichia coli CFT073
accagacccgguuuauuuauu

SEQ ID NO: 663979 - RNA, 23 nt, Escherichia coli CFT073
accagaccggcaaucgcgccaga

SEQ ID NO: 663980 - RNA, 18 nt, Escherichia coli CFT073
accaacugauccugacaa

SEQ ID NO: 663981 - RNA, 22 nt, Escherichia coli CFT073
accaacugugccgcgaccaccu

SEQ ID NO: 663982 - RNA, 15 nt, Escherichia coli CFT073
accaacaucgacaua

SEQ ID NO: 663983 - RNA, 14 nt, Escherichia coli CFT073
accaaccaucaucc

SEQ ID NO: 663984 - RNA, 15 nt, Escherichia coli CFT073
accaaccaccgccac

SEQ ID NO: 663985 - RNA, 23 nt, Escherichia coli CFT073
accaaccagcguguuaggaucac

SEQ ID NO: 663986 - RNA, 22 nt, Escherichia coli CFT073
accaagcacggcgcgacucagc

SEQ ID NO: 663987 - RNA, 14 nt, Escherichia coli CFT073
accaagaccaaucc

SEQ ID NO: 663988 - RNA, 21 nt, Escherichia coli CFT073
accagagauagcgaaccgcag

SEQ ID NO: 663989 - RNA, 18 nt, Escherichia coli CFT073
accagauggcuuuccacc

SEQ ID NO: 663990 - RNA, 14 nt, Escherichia coli CFT073
accagcaaagugcg

SEQ ID NO: 663991 - RNA, 16 nt, Escherichia coli CFT073
accagcacaccgucag

SEQ ID NO: 663992 - RNA, 22 nt, Escherichia coli CFT073
accagcacaucaucaaagccaa

SEQ ID NO: 663993 - RNA, 12 nt, Escherichia coli CFT073
accagcacaucu

SEQ ID NO: 663994 - RNA, 15 nt, Escherichia coli CFT073
accagcagcccugcc

SEQ ID NO: 663995 - RNA, 17 nt, Escherichia coli CFT073
accagcagcaucaccac

SEQ ID NO: 663996 - RNA, 16 nt, Escherichia coli CFT073
accagcaccgccagca

SEQ ID NO: 663997 - RNA, 17 nt, Escherichia coli CFT073
accagcaggaaucccau

SEQ ID NO: 663998 - RNA, 11 nt, Escherichia coli CFT073
accagcaucgc

SEQ ID NO: 663999 - RNA, 20 nt, Escherichia coli CFT073
accagccacggcgcaugacc

SEQ ID NO: 664000 - RNA, 14 nt, Escherichia coli CFT073
accagccagacuca

SEQ ID NO: 664001 - RNA, 16 nt, Escherichia coli CFT073
accagccagacucagc

SEQ ID NO: 664002 - RNA, 19 nt, Escherichia coli CFT073
accagcagcgucagcacuu

SEQ ID NO: 664003 - RNA, 13 nt, Escherichia coli CFT073
accagcagcugcu

SEQ ID NO: 664004 - RNA, 17 nt, Escherichia coli CFT073
accagcagucgaccaaa

SEQ ID NO: 664005 - RNA, 13 nt, Escherichia coli CFT073
accagcaucaaca

SEQ ID NO: 664006 - RNA, 15 nt, Escherichia coli CFT073
accagcaucaacaac

SEQ ID NO: 664007 - RNA, 17 nt, Escherichia coli CFT073
accagcaucaacaacaa

SEQ ID NO: 664008 - RNA, 12 nt, Escherichia coli CFT073
accagcaucacc

SEQ ID NO: 664009 - RNA, 16 nt, Escherichia coli CFT073
accagccaggccgcca

SEQ ID NO: 664010 - RNA, 17 nt, Escherichia coli CFT073
accagccauuaaccagc

SEQ ID NO: 664011 - RNA, 21 nt, Escherichia coli CFT073
accagccauuaaccagccacu

SEQ ID NO: 664012 - RNA, 20 nt, Escherichia coli CFT073
accagcggcaacaucaucac

SEQ ID NO: 664013 - RNA, 13 nt, Escherichia coli CFT073
accagcgccucuu

SEQ ID NO: 664014 - RNA, 17 nt, Escherichia coli CFT073
accagcgucgcaucagg

SEQ ID NO: 664015 - RNA, 16 nt, Escherichia coli CFT073
accagcgucagaaaca

SEQ ID NO: 664016 - RNA, 23 nt, Escherichia coli CFT073
accagcggccagacgcgccgcca

SEQ ID NO: 664017 - RNA, 22 nt, Escherichia coli CFT073
accagcgccaccacccagaaca

SEQ ID NO: 664018 - RNA, 17 nt, Escherichia coli CFT073
accagcgcaauauguuu

SEQ ID NO: 664019 - RNA, 23 nt, Escherichia coli CFT073
accagccgugcggugguuucucc

SEQ ID NO: 664020 - RNA, 23 nt, Escherichia coli CFT073
accagccguugucagucaucacu

SEQ ID NO: 664021 - RNA, 22 nt, Escherichia coli CFT073
accagcgaaaaaugguuugccc

SEQ ID NO: 664022 - RNA, 15 nt, Escherichia coli CFT073
accagcgaaaccuga

SEQ ID NO: 664023 - RNA, 15 nt, Escherichia coli CFT073
aguaauuaaacugau

SEQ ID NO: 664024 - RNA, 16 nt, Escherichia coli CFT073
aguaauuaaacugaug

SEQ ID NO: 664025 - RNA, 21 nt, Escherichia coli CFT073
aguacacgcugaagaucuuca

SEQ ID NO: 664026 - RNA, 16 nt, Escherichia coli CFT073
aguaaugcgcccaugc

SEQ ID NO: 664027 - RNA, 14 nt, Escherichia coli CFT073
aguaagcguuuucu

SEQ ID NO: 664028 - RNA, 14 nt, Escherichia coli CFT073
aguaaugaaaccga

SEQ ID NO: 664029 - RNA, 13 nt, Escherichia coli CFT073
aguacguucacuu

SEQ ID NO: 664030 - RNA, 15 nt, Escherichia coli CFT073
aguacguucacuuuu

SEQ ID NO: 664031 - RNA, 18 nt, Escherichia coli CFT073
aguacguucacuuuucuu

SEQ ID NO: 664032 - RNA, 20 nt, Escherichia coli CFT073
aguacggcuauauacagcgc

SEQ ID NO: 664033 - RNA, 17 nt, Escherichia coli CFT073
aguacgcaguugcugac

SEQ ID NO: 664034 - RNA, 19 nt, Escherichia coli CFT073
aguacgccaaucugcaaaa

SEQ ID NO: 664035 - RNA, 18 nt, Escherichia coli CFT073
aguacgcggacacuuucc

SEQ ID NO: 664036 - RNA, 20 nt, Escherichia coli CFT073
aguacgcgggaauagcucag

SEQ ID NO: 664037 - RNA, 15 nt, Escherichia coli CFT073
aguacgcgguuuuug

SEQ ID NO: 664038 - RNA, 15 nt, Escherichia coli CFT073
aguacgcuuucccuu

SEQ ID NO: 664039 - RNA, 17 nt, Escherichia coli CFT073
aguacggcaaagauauu

SEQ ID NO: 664040 - RNA, 13 nt, Escherichia coli CFT073
aguacggcagcaa

SEQ ID NO: 664041 - RNA, 15 nt, Escherichia coli CFT073
aguacgauacaaaag

SEQ ID NO: 664042 - RNA, 23 nt, Escherichia coli CFT073
aguacgaccggaaguaagaggag

SEQ ID NO: 664043 - RNA, 14 nt, Escherichia coli CFT073
aguaccuugcugag

SEQ ID NO: 664044 - RNA, 15 nt, Escherichia coli CFT073
aguaccugcaaaccg

SEQ ID NO: 664045 - RNA, 19 nt, Escherichia coli CFT073
aguaccgaacggagucggg

SEQ ID NO: 664046 - RNA, 15 nt, Escherichia coli CFT073
aguaaaugcuggcgc

SEQ ID NO: 664047 - RNA, 22 nt, Escherichia coli CFT073
aguaaccuuuaucacgcagcag

SEQ ID NO: 664048 - RNA, 19 nt, Escherichia coli CFT073
aguaaccugcgaaaaucag

SEQ ID NO: 664049 - RNA, 20 nt, Escherichia coli CFT073
aguaaccuuugaacagccag

SEQ ID NO: 664050 - RNA, 15 nt, Escherichia coli CFT073
aguaaauaagaaaau

SEQ ID NO: 664051 - RNA, 14 nt, Escherichia coli CFT073
aguaaauauugucg

SEQ ID NO: 664052 - RNA, 14 nt, Escherichia coli CFT073
aguaaauaaaaaau

SEQ ID NO: 664053 - RNA, 19 nt, Escherichia coli CFT073
aguaacucauugccagccc

SEQ ID NO: 664054 - RNA, 22 nt, Escherichia coli CFT073
aguaacucauugccagcccuaa

SEQ ID NO: 664055 - RNA, 18 nt, Escherichia coli CFT073
aguaacguuguaccacug

SEQ ID NO: 664056 - RNA, 22 nt, Escherichia coli CFT073
aguaacguuugauuaacgccag

SEQ ID NO: 664057 - RNA, 17 nt, Escherichia coli CFT073
aguaacgcggcaauaaa

SEQ ID NO: 664058 - RNA, 15 nt, Escherichia coli CFT073
aguaagcccaccaca

SEQ ID NO: 664059 - RNA, 12 nt, Escherichia coli CFT073
aguaagcccagg

SEQ ID NO: 664060 - RNA, 15 nt, Escherichia coli CFT073
aguaagccgguaauc

SEQ ID NO: 664061 - RNA, 17 nt, Escherichia coli CFT073
agguuccaauauugguc

SEQ ID NO: 664062 - RNA, 21 nt, Escherichia coli CFT073
agguuccacggaauauuucac

SEQ ID NO: 664063 - RNA, 21 nt, Escherichia coli CFT073
agguuuuagcaugcaggcugg

SEQ ID NO: 664064 - RNA, 19 nt, Escherichia coli CFT073
agguuuucuuucaccucuu

SEQ ID NO: 664065 - RNA, 12 nt, Escherichia coli CFT073
agguuuuuuccu

SEQ ID NO: 664066 - RNA, 12 nt, Escherichia coli CFT073
aguaaaaaaaca

SEQ ID NO: 664067 - RNA, 19 nt, Escherichia coli CFT073
aggugcgugcgcccaucau

SEQ ID NO: 664068 - RNA, 17 nt, Escherichia coli CFT073
agguguaaauaucagga

SEQ ID NO: 664069 - RNA, 14 nt, Escherichia coli CFT073
aggugucaauccuu

SEQ ID NO: 664070 - RNA, 14 nt, Escherichia coli CFT073
aggugcauugaagg

SEQ ID NO: 664071 - RNA, 18 nt, Escherichia coli CFT073
aggugcauugaaggcaau

SEQ ID NO: 664072 - RNA, 18 nt, Escherichia coli CFT073
aggugacguccagaaccg

SEQ ID NO: 664073 - RNA, 15 nt, Escherichia coli CFT073
agguuagugacauag

SEQ ID NO: 664074 - RNA, 16 nt, Escherichia coli CFT073
agguuaacccacagcg

SEQ ID NO: 664075 - RNA, 14 nt, Escherichia coli CFT073
agguuaagccucac

SEQ ID NO: 664076 - RNA, 16 nt, Escherichia coli CFT073
agguguugaaaugaga

SEQ ID NO: 664077 - RNA, 17 nt, Escherichia coli CFT073
agguauuugcguagccg

SEQ ID NO: 664078 - RNA, 13 nt, Escherichia coli CFT073
agguauuuuguca

SEQ ID NO: 664079 - RNA, 15 nt, Escherichia coli CFT073
aggucaaagaaucaa

SEQ ID NO: 664080 - RNA, 13 nt, Escherichia coli CFT073
agguaaaucagac

SEQ ID NO: 664081 - RNA, 19 nt, Escherichia coli CFT073
aggucaagaaggauauaaa

SEQ ID NO: 664082 - RNA, 15 nt, Escherichia coli CFT073
aggucaaucccagga

SEQ ID NO: 664083 - RNA, 20 nt, Escherichia coli CFT073
aggucuuugacgucgaaacu

SEQ ID NO: 664084 - RNA, 15 nt, Escherichia coli CFT073
aggugaaaaauaaaa

SEQ ID NO: 664085 - RNA, 15 nt, Escherichia coli CFT073
aggugaccaaagaag

SEQ ID NO: 664086 - RNA, 21 nt, Escherichia coli CFT073
aggucgacaguagccccgcgg

SEQ ID NO: 664087 - RNA, 19 nt, Escherichia coli CFT073
agguccuguaaguuuggaa

SEQ ID NO: 664088 - RNA, 16 nt, Escherichia coli CFT073
aggucagguucucuga

SEQ ID NO: 664089 - RNA, 13 nt, Escherichia coli CFT073
agguaaaacaagu

SEQ ID NO: 664090 - RNA, 19 nt, Escherichia coli CFT073
aggguuucgacggcaccaa

SEQ ID NO: 664091 - RNA, 23 nt, Escherichia coli CFT073
aggguuucgacggcaccaaaaau

SEQ ID NO: 664092 - RNA, 22 nt, Escherichia coli CFT073
aggguuauuuguucagcaaaug

SEQ ID NO: 664093 - RNA, 17 nt, Escherichia coli CFT073
aggguggggaaaaaaca

SEQ ID NO: 664094 - RNA, 18 nt, Escherichia coli CFT073
aggguggcgucaaaaagc

SEQ ID NO: 664095 - RNA, 20 nt, Escherichia coli CFT073
aggguggcgucaaaaagcuc

SEQ ID NO: 664096 - RNA, 21 nt, Escherichia coli CFT073
agggcggacugauaacuuuuu

SEQ ID NO: 664097 - RNA, 18 nt, Escherichia coli CFT073
agggcuuuuuuauuucau

SEQ ID NO: 664098 - RNA, 16 nt, Escherichia coli CFT073
agggcgcagcugugcc

SEQ ID NO: 664099 - RNA, 22 nt, Escherichia coli CFT073
aggcuuccuggcuugccagcca

SEQ ID NO: 664100 - RNA, 16 nt, Escherichia coli CFT073
aggcuucuauggaagu

SEQ ID NO: 664101 - RNA, 13 nt, Escherichia coli CFT073
agggauauuucac

SEQ ID NO: 664102 - RNA, 17 nt, Escherichia coli CFT073
aggcuuacacuuccuuu

SEQ ID NO: 664103 - RNA, 21 nt, Escherichia coli CFT073
aggcuuaauugcgcagcggag

SEQ ID NO: 664104 - RNA, 15 nt, Escherichia coli CFT073
aggcuguuaccccug

SEQ ID NO: 664105 - RNA, 17 nt, Escherichia coli CFT073
aggcugucgcaaauucg

SEQ ID NO: 664106 - RNA, 20 nt, Escherichia coli CFT073
agggcgaaaccauauuaaau

SEQ ID NO: 664107 - RNA, 14 nt, Escherichia coli CFT073
agggccuccugcag

SEQ ID NO: 664108 - RNA, 22 nt, Escherichia coli CFT073
agggcgaauuuccgcgaccuga

SEQ ID NO: 664109 - RNA, 13 nt, Escherichia coli CFT073
agggcaucaagaa

SEQ ID NO: 664110 - RNA, 15 nt, Escherichia coli CFT073
agggauuaugcaggc

SEQ ID NO: 664111 - RNA, 14 nt, Escherichia coli CFT073
agggaugcugugcu

SEQ ID NO: 664112 - RNA, 15 nt, Escherichia coli CFT073
agggcagcaggauca

SEQ ID NO: 664113 - RNA, 17 nt, Escherichia coli CFT073
agggcagcaggaucaga

SEQ ID NO: 664114 - RNA, 16 nt, Escherichia coli CFT073
agggcagacgccccug

SEQ ID NO: 664115 - RNA, 21 nt, Escherichia coli CFT073
aggcgggaauaauuucccgcc

SEQ ID NO: 664116 - RNA, 22 nt, Escherichia coli CFT073
aggcggguacguuucgccugca

SEQ ID NO: 664117 - RNA, 19 nt, Escherichia coli CFT073
aggcggucauaaaaucaau

SEQ ID NO: 664118 - RNA, 15 nt, Escherichia coli CFT073
aggcggugguggcuu

SEQ ID NO: 664119 - RNA, 18 nt, Escherichia coli CFT073
aggcggucuguauuuggc

SEQ ID NO: 664120 - RNA, 23 nt, Escherichia coli CFT073
aggcguuuacgccgcauccgaca

SEQ ID NO: 664121 - RNA, 23 nt, Escherichia coli CFT073
aggcguuuacgccgcauccggca

SEQ ID NO: 664122 - RNA, 13 nt, Escherichia coli CFT073
aggcguuucacuu

SEQ ID NO: 664123 - RNA, 16 nt, Escherichia coli CFT073
aggcguuguccuugcc

SEQ ID NO: 664124 - RNA, 19 nt, Escherichia coli CFT073
aggcguugauuggcgcagg

SEQ ID NO: 664125 - RNA, 16 nt, Escherichia coli CFT073
aggcguucaagcugca

SEQ ID NO: 664126 - RNA, 21 nt, Escherichia coli CFT073
aggcguucaagcugcaucugg

SEQ ID NO: 664127 - RNA, 15 nt, Escherichia coli CFT073
aggcguucacgccgc

SEQ ID NO: 664128 - RNA, 23 nt, Escherichia coli CFT073
aggcguucacgccgcauccggca

SEQ ID NO: 664129 - RNA, 18 nt, Escherichia coli CFT073
aggcguggauacaggcgg

SEQ ID NO: 664130 - RNA, 16 nt, Escherichia coli CFT073
aggcguggcgccccac

SEQ ID NO: 664131 - RNA, 23 nt, Escherichia coli CFT073
aggcuggcaacgacgguaaacca

SEQ ID NO: 664132 - RNA, 22 nt, Escherichia coli CFT073
aggcugucaguagcaaacacug

SEQ ID NO: 664133 - RNA, 19 nt, Escherichia coli CFT073
aggcugauguugauaaaga

SEQ ID NO: 664134 - RNA, 17 nt, Escherichia coli CFT073
aggcugccagagucagc

SEQ ID NO: 664135 - RNA, 21 nt, Escherichia coli CFT073
aggcugcauuauccacgccgg

SEQ ID NO: 664136 - RNA, 16 nt, Escherichia coli CFT073
aggcucauuaauuuuc

SEQ ID NO: 664137 - RNA, 14 nt, Escherichia coli CFT073
aggcuccagauaac

SEQ ID NO: 664138 - RNA, 17 nt, Escherichia coli CFT073
aggcucaggcuggcuga

SEQ ID NO: 664139 - RNA, 21 nt, Escherichia coli CFT073
aggcaaucuguuuauuugaca

SEQ ID NO: 664140 - RNA, 13 nt, Escherichia coli CFT073
aggcaauuaaaaa

SEQ ID NO: 664141 - RNA, 15 nt, Escherichia coli CFT073
aggcacaaaaccugc

SEQ ID NO: 664142 - RNA, 14 nt, Escherichia coli CFT073
aggcagauaaaaug

SEQ ID NO: 664143 - RNA, 16 nt, Escherichia coli CFT073
aggcagagccaaauaa

SEQ ID NO: 664144 - RNA, 14 nt, Escherichia coli CFT073
aggcacaacugcga

SEQ ID NO: 664145 - RNA, 15 nt, Escherichia coli CFT073
aggcagauacaacca

SEQ ID NO: 664146 - RNA, 14 nt, Escherichia coli CFT073
aggcaggauuuucu

SEQ ID NO: 664147 - RNA, 16 nt, Escherichia coli CFT073
aggcaggcaucaucag

SEQ ID NO: 664148 - RNA, 18 nt, Escherichia coli CFT073
aggcagucugcgcccugg

SEQ ID NO: 664149 - RNA, 21 nt, Escherichia coli CFT073
aggaugcucgcgaaaagaaac

SEQ ID NO: 664150 - RNA, 18 nt, Escherichia coli CFT073
aggaugccguuaauaaua

SEQ ID NO: 664151 - RNA, 18 nt, Escherichia coli CFT073
aggauguugaucagguga

SEQ ID NO: 664152 - RNA, 19 nt, Escherichia coli CFT073
aggaugugagcuggcggac

SEQ ID NO: 664153 - RNA, 20 nt, Escherichia coli CFT073
aggauguuacaaccuccucc

SEQ ID NO: 664154 - RNA, 17 nt, Escherichia coli CFT073
aggaugcccaugccaau

SEQ ID NO: 664155 - RNA, 20 nt, Escherichia coli CFT073
aggcaaacuucucaccauca

SEQ ID NO: 664156 - RNA, 22 nt, Escherichia coli CFT073
aggcaaacuucucaccaucaaa

SEQ ID NO: 664157 - RNA, 19 nt, Escherichia coli CFT073
aggcaaacagaauuaucau

SEQ ID NO: 664158 - RNA, 20 nt, Escherichia coli CFT073
aggcaaacagaauuaucauu

SEQ ID NO: 664159 - RNA, 13 nt, Escherichia coli CFT073
aggcaacaaaaaa

SEQ ID NO: 664160 - RNA, 14 nt, Escherichia coli CFT073
aggcaauaaacauc

SEQ ID NO: 664161 - RNA, 21 nt, Escherichia coli CFT073
aggcaaauucuguuucauuaa

SEQ ID NO: 664162 - RNA, 14 nt, Escherichia coli CFT073
aggcaaaguacaca

SEQ ID NO: 664163 - RNA, 20 nt, Escherichia coli CFT073
aggcaucacuuuaccgguuu

SEQ ID NO: 664164 - RNA, 13 nt, Escherichia coli CFT073
aggcauauaugaa

SEQ ID NO: 664165 - RNA, 14 nt, Escherichia coli CFT073
aggcauauaugaau

SEQ ID NO: 664166 - RNA, 23 nt, Escherichia coli CFT073
aggcauauaugaauauugcugaa

SEQ ID NO: 664167 - RNA, 16 nt, Escherichia coli CFT073
aggcauagaaaaagaa

SEQ ID NO: 664168 - RNA, 14 nt, Escherichia coli CFT073
aggcaucagcaauu

SEQ ID NO: 664169 - RNA, 19 nt, Escherichia coli CFT073
aggcaguuuauccagccac

SEQ ID NO: 664170 - RNA, 14 nt, Escherichia coli CFT073
aggcauagaaaaag

SEQ ID NO: 664171 - RNA, 13 nt, Escherichia coli CFT073
aggccagccugau

SEQ ID NO: 664172 - RNA, 16 nt, Escherichia coli CFT073
aggcaucggcaacgaa

SEQ ID NO: 664173 - RNA, 18 nt, Escherichia coli CFT073
aggcaucgggaauggcau

SEQ ID NO: 664174 - RNA, 15 nt, Escherichia coli CFT073
aggccaguauuucau

SEQ ID NO: 664175 - RNA, 17 nt, Escherichia coli CFT073
aggccaggguaaaaacc

SEQ ID NO: 664176 - RNA, 20 nt, Escherichia coli CFT073
aggccggaaccggcaacggc

SEQ ID NO: 664177 - RNA, 20 nt, Escherichia coli CFT073
aggccggacaaggcgcucgc

SEQ ID NO: 664178 - RNA, 18 nt, Escherichia coli CFT073
aggccgccguaggagugc

SEQ ID NO: 664179 - RNA, 22 nt, Escherichia coli CFT073
aggccgccgucaucacgcaggc

SEQ ID NO: 664180 - RNA, 16 nt, Escherichia coli CFT073
aggcccgucacgcagu

SEQ ID NO: 664181 - RNA, 15 nt, Escherichia coli CFT073
aggaugacauaaccu

SEQ ID NO: 664182 - RNA, 18 nt, Escherichia coli CFT073
aggaugagaaaagagaug

SEQ ID NO: 664183 - RNA, 17 nt, Escherichia coli CFT073
aggaucuggauaaauau

SEQ ID NO: 664184 - RNA, 17 nt, Escherichia coli CFT073
aggaucgcgacaaaaua

SEQ ID NO: 664185 - RNA, 16 nt, Escherichia coli CFT073
aggaucagcaaaaugg

SEQ ID NO: 664186 - RNA, 21 nt, Escherichia coli CFT073
aggaucaccaauaccagcauc

SEQ ID NO: 664187 - RNA, 23 nt, Escherichia coli CFT073
aggaucaccaauaccagcaucag

SEQ ID NO: 664188 - RNA, 13 nt, Escherichia coli CFT073
aggauagaaaacg

SEQ ID NO: 664189 - RNA, 12 nt, Escherichia coli CFT073
aggauauucugc

SEQ ID NO: 664190 - RNA, 20 nt, Escherichia coli CFT073
aggauauucugcggcuucag

SEQ ID NO: 664191 - RNA, 19 nt, Escherichia coli CFT073
aggagggauuaauuaccag

SEQ ID NO: 664192 - RNA, 22 nt, Escherichia coli CFT073
aggaggucgcacugcucuuuuu

SEQ ID NO: 664193 - RNA, 18 nt, Escherichia coli CFT073
aggagucuuucagacuga

SEQ ID NO: 664194 - RNA, 12 nt, Escherichia coli CFT073
aggauaaaaaag

SEQ ID NO: 664195 - RNA, 16 nt, Escherichia coli CFT073
aggaauuaaucccuua

SEQ ID NO: 664196 - RNA, 12 nt, Escherichia coli CFT073
aggaaugaaaua

SEQ ID NO: 664197 - RNA, 19 nt, Escherichia coli CFT073
aggaccccauuaauaccgc

SEQ ID NO: 664198 - RNA, 18 nt, Escherichia coli CFT073
aggaccgguuucaaaacu

SEQ ID NO: 664199 - RNA, 22 nt, Escherichia coli CFT073
aggaauccagcacgaagaggcc

SEQ ID NO: 664200 - RNA, 16 nt, Escherichia coli CFT073
aggaccugcgucugau

SEQ ID NO: 664201 - RNA, 17 nt, Escherichia coli CFT073
aggacgauuccggcaaa

SEQ ID NO: 664202 - RNA, 18 nt, Escherichia coli CFT073
aggaaaauacagcaaugg

SEQ ID NO: 664203 - RNA, 13 nt, Escherichia coli CFT073
aggaaaauaggug

SEQ ID NO: 664204 - RNA, 23 nt, Escherichia coli CFT073
aggaaaauagguguaaauaucag

SEQ ID NO: 664205 - RNA, 12 nt, Escherichia coli CFT073
aggaaaaucagc

SEQ ID NO: 664206 - RNA, 13 nt, Escherichia coli CFT073
aggaaaauacagc

SEQ ID NO: 664207 - RNA, 13 nt, Escherichia coli CFT073
agcuuuaaacacg

SEQ ID NO: 664208 - RNA, 17 nt, Escherichia coli CFT073
agcuugcuuuccagcuu

SEQ ID NO: 664209 - RNA, 13 nt, Escherichia coli CFT073
agcuuggcagagc

SEQ ID NO: 664210 - RNA, 14 nt, Escherichia coli CFT073
agcuuuauccugcc

SEQ ID NO: 664211 - RNA, 16 nt, Escherichia coli CFT073
agcuuuuuauuacucu

SEQ ID NO: 664212 - RNA, 19 nt, Escherichia coli CFT073
agcuuuuuuggcagcgugc

SEQ ID NO: 664213 - RNA, 16 nt, Escherichia coli CFT073
agcuuaacuacugcuu

SEQ ID NO: 664214 - RNA, 14 nt, Escherichia coli CFT073
agcuuaagaauuac

SEQ ID NO: 664215 - RNA, 13 nt, Escherichia coli CFT073
agcuuauuguaca

SEQ ID NO: 664216 - RNA, 17 nt, Escherichia coli CFT073
agcuucaauaucaucau

SEQ ID NO: 664217 - RNA, 21 nt, Escherichia coli CFT073
agcuucacaaaggcuugcugc

SEQ ID NO: 664218 - RNA, 14 nt, Escherichia coli CFT073
agcuucacuuucca

SEQ ID NO: 664219 - RNA, 20 nt, Escherichia coli CFT073
agcuucagauuagccgcagg

SEQ ID NO: 664220 - RNA, 12 nt, Escherichia coli CFT073
agcuugaaauca

SEQ ID NO: 664221 - RNA, 21 nt, Escherichia coli CFT073
agcuugccuucacaggccgcc

SEQ ID NO: 664222 - RNA, 19 nt, Escherichia coli CFT073
agcuugcgacauacggcau

SEQ ID NO: 664223 - RNA, 21 nt, Escherichia coli CFT073
agcuucuucaaaaaagucaga

SEQ ID NO: 664224 - RNA, 14 nt, Escherichia coli CFT073
agcugauaucaccu

SEQ ID NO: 664225 - RNA, 19 nt, Escherichia coli CFT073
agcugauaucaccugcuuc

SEQ ID NO: 664226 - RNA, 20 nt, Escherichia coli CFT073
agcuggaggaacgcgccucu

SEQ ID NO: 664227 - RNA, 22 nt, Escherichia coli CFT073
agcuggaggaacgcgccucuuc

SEQ ID NO: 664228 - RNA, 17 nt, Escherichia coli CFT073
agcugcgcguuaucuac

SEQ ID NO: 664229 - RNA, 22 nt, Escherichia coli CFT073
agcugcggauccugagcaaaca

SEQ ID NO: 664230 - RNA, 22 nt, Escherichia coli CFT073
agcuguuucaguguuuccccac

SEQ ID NO: 664231 - RNA, 15 nt, Escherichia coli CFT073
agcuggcgaacaagu

SEQ ID NO: 664232 - RNA, 22 nt, Escherichia coli CFT073
agcuggcgcuggcgaucgucca

SEQ ID NO: 664233 - RNA, 14 nt, Escherichia coli CFT073
agcuggcgccaggc

SEQ ID NO: 664234 - RNA, 15 nt, Escherichia coli CFT073
agcuggcgccaggcu

SEQ ID NO: 664235 - RNA, 16 nt, Escherichia coli CFT073
agcugaaaaucagauc

SEQ ID NO: 664236 - RNA, 17 nt, Escherichia coli CFT073
agcucuuccgacuugcu

SEQ ID NO: 664237 - RNA, 22 nt, Escherichia coli CFT073
agcucuuccucgcucucgccgc

SEQ ID NO: 664238 - RNA, 17 nt, Escherichia coli CFT073
agcucuuauacgugaaa

SEQ ID NO: 664239 - RNA, 14 nt, Escherichia coli CFT073
agcucuucuacauu

SEQ ID NO: 664240 - RNA, 11 nt, Escherichia coli CFT073
agcugaaauca

SEQ ID NO: 664241 - RNA, 22 nt, Escherichia coli CFT073
agcugaauaucacgggcgcgga

SEQ ID NO: 664242 - RNA, 18 nt, Escherichia coli CFT073
agcugacuugcucaaucu

SEQ ID NO: 664243 - RNA, 13 nt, Escherichia coli CFT073
agcugagugcgaa

SEQ ID NO: 664244 - RNA, 21 nt, Escherichia coli CFT073
agcugagugcgaaaaucaaua

SEQ ID NO: 664245 - RNA, 16 nt, Escherichia coli CFT073
agcugauaacgccacg

SEQ ID NO: 664246 - RNA, 20 nt, Escherichia coli CFT073
agcugauaacgccacgccac

SEQ ID NO: 664247 - RNA, 23 nt, Escherichia coli CFT073
agcugauacgggaggucaucagc

SEQ ID NO: 664248 - RNA, 13 nt, Escherichia coli CFT073
agcucggcgcacc

SEQ ID NO: 664249 - RNA, 11 nt, Escherichia coli CFT073
agcucugccac

SEQ ID NO: 664250 - RNA, 16 nt, Escherichia coli CFT073
agcucugcgcccugca

SEQ ID NO: 664251 - RNA, 17 nt, Escherichia coli CFT073
agcucugcuaauaaugu

SEQ ID NO: 664252 - RNA, 18 nt, Escherichia coli CFT073
agcucugguguggagugc

SEQ ID NO: 664253 - RNA, 21 nt, Escherichia coli CFT073
agcucuguagcaacgauaaca

SEQ ID NO: 664254 - RNA, 20 nt, Escherichia coli CFT073
agcucgcacgccacgccgaa

SEQ ID NO: 664255 - RNA, 17 nt, Escherichia coli CFT073
agcucgcguucugucag

SEQ ID NO: 664256 - RNA, 16 nt, Escherichia coli CFT073
agcucgacaccaaaca

SEQ ID NO: 664257 - RNA, 19 nt, Escherichia coli CFT073
agcuccguccagccaccgc

SEQ ID NO: 664258 - RNA, 14 nt, Escherichia coli CFT073
agcuccggcucuaa

SEQ ID NO: 664259 - RNA, 19 nt, Escherichia coli CFT073
agcuccgccgguugccccg

SEQ ID NO: 664260 - RNA, 18 nt, Escherichia coli CFT073
agcgucuuaucagcauac

SEQ ID NO: 664261 - RNA, 19 nt, Escherichia coli CFT073
agcgucucacuaucgccga

SEQ ID NO: 664262 - RNA, 22 nt, Escherichia coli CFT073
agcgucgguguagccuuugccu

SEQ ID NO: 664263 - RNA, 18 nt, Escherichia coli CFT073
agcgucaaggucaacagu

SEQ ID NO: 664264 - RNA, 14 nt, Escherichia coli CFT073
agcgucgccagcag

SEQ ID NO: 664265 - RNA, 19 nt, Escherichia coli CFT073
auaagacagcgucacauca

SEQ ID NO: 664266 - RNA, 18 nt, Escherichia coli CFT073
auaagaaacacacuuucc

SEQ ID NO: 664267 - RNA, 14 nt, Escherichia coli CFT073
auaacuuuuaguaa

SEQ ID NO: 664268 - RNA, 12 nt, Escherichia coli CFT073
auaagaccaauc

SEQ ID NO: 664269 - RNA, 16 nt, Escherichia coli CFT073
auaagaccgugagcaa

SEQ ID NO: 664270 - RNA, 19 nt, Escherichia coli CFT073
auaagaccgugagcaaugc

SEQ ID NO: 664271 - RNA, 20 nt, Escherichia coli CFT073
auaagaguaaugguuuguuu

SEQ ID NO: 664272 - RNA, 14 nt, Escherichia coli CFT073
auaagagaugaauu

SEQ ID NO: 664273 - RNA, 15 nt, Escherichia coli CFT073
auaacuugccaggcc

SEQ ID NO: 664274 - RNA, 16 nt, Escherichia coli CFT073
auaaauuucaggcaac

SEQ ID NO: 664275 - RNA, 21 nt, Escherichia coli CFT073
auaaauugcgauauguugugu

SEQ ID NO: 664276 - RNA, 15 nt, Escherichia coli CFT073
auaacgagcgagaau

SEQ ID NO: 664277 - RNA, 22 nt, Escherichia coli CFT073
auaacgccaauucauuccuuga

SEQ ID NO: 664278 - RNA, 19 nt, Escherichia coli CFT073
auaacuaaucacuucauca

SEQ ID NO: 664279 - RNA, 19 nt, Escherichia coli CFT073
auaacuaauuccgcugacg

SEQ ID NO: 664280 - RNA, 17 nt, Escherichia coli CFT073
auaacgccuggcagugg

SEQ ID NO: 664281 - RNA, 15 nt, Escherichia coli CFT073
auaaggguugcugac

SEQ ID NO: 664282 - RNA, 22 nt, Escherichia coli CFT073
auaaggguugcugaccaaaucu

SEQ ID NO: 664283 - RNA, 20 nt, Escherichia coli CFT073
auaagguaucgcgaaaaaaa

SEQ ID NO: 664284 - RNA, 22 nt, Escherichia coli CFT073
auaaggucacgcccccugggga

SEQ ID NO: 664285 - RNA, 13 nt, Escherichia coli CFT073
auaagcgcaugaa

SEQ ID NO: 664286 - RNA, 22 nt, Escherichia coli CFT073
auaagcgcccagcucuuuaccu

SEQ ID NO: 664287 - RNA, 22 nt, Escherichia coli CFT073
auaagcaucgcuagauauauau

SEQ ID NO: 664288 - RNA, 17 nt, Escherichia coli CFT073
auaagccaguccagaaa

SEQ ID NO: 664289 - RNA, 17 nt, Escherichia coli CFT073
auaagcaacaaacucau

SEQ ID NO: 664290 - RNA, 16 nt, Escherichia coli CFT073
auaagcacaaagcaau

SEQ ID NO: 664291 - RNA, 11 nt, Escherichia coli CFT073
auaauaucuuu

SEQ ID NO: 664292 - RNA, 18 nt, Escherichia coli CFT073
auaauauuaaucccugcu

SEQ ID NO: 664293 - RNA, 22 nt, Escherichia coli CFT073
auaauauuuguacugucuaaug

SEQ ID NO: 664294 - RNA, 15 nt, Escherichia coli CFT073
auaaucaacccccac

SEQ ID NO: 664295 - RNA, 20 nt, Escherichia coli CFT073
auaaucaaucuuuacacaca

SEQ ID NO: 664296 - RNA, 14 nt, Escherichia coli CFT073
auaaucaaugccag

SEQ ID NO: 664297 - RNA, 15 nt, Escherichia coli CFT073
auaaucaaugccagg

SEQ ID NO: 664298 - RNA, 17 nt, Escherichia coli CFT073
auaaucaacaggaacau

SEQ ID NO: 664299 - RNA, 12 nt, Escherichia coli CFT073
auaauccagcag

SEQ ID NO: 664300 - RNA, 21 nt, Escherichia coli CFT073
auaauccccacaucaggccca

SEQ ID NO: 664301 - RNA, 19 nt, Escherichia coli CFT073
auaauacgcgcguuuucaa

SEQ ID NO: 664302 - RNA, 17 nt, Escherichia coli CFT073
auaauacgcuaaauaaa

SEQ ID NO: 664303 - RNA, 21 nt, Escherichia coli CFT073
auaauacgcuaaauaaacaau

SEQ ID NO: 664304 - RNA, 16 nt, Escherichia coli CFT073
auaaguacguuuucuu

SEQ ID NO: 664305 - RNA, 20 nt, Escherichia coli CFT073
auaaguacguuuucuucucu

SEQ ID NO: 664306 - RNA, 16 nt, Escherichia coli CFT073
auaaguacuaaauaau

SEQ ID NO: 664307 - RNA, 16 nt, Escherichia coli CFT073
auaaguaaacaaacau

SEQ ID NO: 664308 - RNA, 20 nt, Escherichia coli CFT073
auaaguaaacaaacaugaau

SEQ ID NO: 664309 - RNA, 16 nt, Escherichia coli CFT073
auaaguaaggcagagc

SEQ ID NO: 664310 - RNA, 19 nt, Escherichia coli CFT073
auaauaucccaacgcaaaa

SEQ ID NO: 664311 - RNA, 16 nt, Escherichia coli CFT073
auaauacugacaaaac

SEQ ID NO: 664312 - RNA, 23 nt, Escherichia coli CFT073
auaauuagugagacucaccaauc

SEQ ID NO: 664313 - RNA, 17 nt, Escherichia coli CFT073
auaaugugccgaaucca

SEQ ID NO: 664314 - RNA, 15 nt, Escherichia coli CFT073
auaaugccuuuaaug

SEQ ID NO: 664315 - RNA, 15 nt, Escherichia coli CFT073
auaaucccggcacca

SEQ ID NO: 664316 - RNA, 17 nt, Escherichia coli CFT073
auaauccggaaaagccu

SEQ ID NO: 664317 - RNA, 23 nt, Escherichia coli CFT073
auaauccgccuuuuuaauuugcc

SEQ ID NO: 664318 - RNA, 17 nt, Escherichia coli CFT073
auaauccgcuguaauug

SEQ ID NO: 664319 - RNA, 13 nt, Escherichia coli CFT073
auaaucgccguau

SEQ ID NO: 664320 - RNA, 19 nt, Escherichia coli CFT073
auaaucggucgacugcgcu

SEQ ID NO: 664321 - RNA, 12 nt, Escherichia coli CFT073
auaaugauuuug

SEQ ID NO: 664322 - RNA, 13 nt, Escherichia coli CFT073
auaaucuacuaau

SEQ ID NO: 664323 - RNA, 14 nt, Escherichia coli CFT073
auaaaacugccaga

SEQ ID NO: 664324 - RNA, 20 nt, Escherichia coli CFT073
auaaaacgagcgauccaacu

SEQ ID NO: 664325 - RNA, 19 nt, Escherichia coli CFT073
auaaaaggcaccuggaaau

SEQ ID NO: 664326 - RNA, 17 nt, Escherichia coli CFT073
auaaaagggcagcagga

SEQ ID NO: 664327 - RNA, 15 nt, Escherichia coli CFT073
auaaaagcaauagcc

SEQ ID NO: 664328 - RNA, 21 nt, Escherichia coli CFT073
auaaaagcaauaucuuuaucu

SEQ ID NO: 664329 - RNA, 18 nt, Escherichia coli CFT073
auaaaagccugaucaauc

SEQ ID NO: 664330 - RNA, 21 nt, Escherichia coli CFT073
auaaaaagaagaucaucacca

SEQ ID NO: 664331 - RNA, 16 nt, Escherichia coli CFT073
auaaaaauaacaguga

SEQ ID NO: 664332 - RNA, 15 nt, Escherichia coli CFT073
auaaaaaucagauau

SEQ ID NO: 664333 - RNA, 16 nt, Escherichia coli CFT073
auaaaaauugcggccu

SEQ ID NO: 664334 - RNA, 18 nt, Escherichia coli CFT073
auaaaacaagcagcugcc

SEQ ID NO: 664335 - RNA, 23 nt, Escherichia coli CFT073
auaaaacacugagguaacucuca

SEQ ID NO: 664336 - RNA, 15 nt, Escherichia coli CFT073
auaaaacaucaccaa

SEQ ID NO: 664337 - RNA, 22 nt, Escherichia coli CFT073
aguuuuuccuuucugauagaac

SEQ ID NO: 664338 - RNA, 15 nt, Escherichia coli CFT073
aguuuuuccccugcc

SEQ ID NO: 664339 - RNA, 22 nt, Escherichia coli CFT073
aguuuuucaaagcugguggcaa

SEQ ID NO: 664340 - RNA, 12 nt, Escherichia coli CFT073
aguuuuucaaca

SEQ ID NO: 664341 - RNA, 13 nt, Escherichia coli CFT073
aguuuuugcuucu

SEQ ID NO: 664342 - RNA, 22 nt, Escherichia coli CFT073
aguuuuuucgcuugaucuuccu

SEQ ID NO: 664343 - RNA, 21 nt, Escherichia coli CFT073
auaaaaaaagcgggccaguaa

SEQ ID NO: 664344 - RNA, 12 nt, Escherichia coli CFT073
auaaaaaauacg

SEQ ID NO: 664345 - RNA, 20 nt, Escherichia coli CFT073
auaaaaaagccgaugucugc

SEQ ID NO: 664346 - RNA, 16 nt, Escherichia coli CFT073
auaaaaaagaaaagaa

SEQ ID NO: 664347 - RNA, 14 nt, Escherichia coli CFT073
aguuuucuuugcca

SEQ ID NO: 664348 - RNA, 15 nt, Escherichia coli CFT073
aguuuucgcccccag

SEQ ID NO: 664349 - RNA, 16 nt, Escherichia coli CFT073
aguuggcguucacugc

SEQ ID NO: 664350 - RNA, 24 nt, Escherichia coli CFT073
aguuggucagcaagaaacugauca

SEQ ID NO: 664351 - RNA, 15 nt, Escherichia coli CFT073
auaaauauuauuguu

SEQ ID NO: 664352 - RNA, 15 nt, Escherichia coli CFT073
auaaaguugaagcug

SEQ ID NO: 664353 - RNA, 16 nt, Escherichia coli CFT073
auaaagcuuuuuauua

SEQ ID NO: 664354 - RNA, 22 nt, Escherichia coli CFT073
auaaagguaccgacgaucaaca

SEQ ID NO: 664355 - RNA, 22 nt, Escherichia coli CFT073
auaaauuauagaugcagcauag

SEQ ID NO: 664356 - RNA, 14 nt, Escherichia coli CFT073
auaaauuaccacca

SEQ ID NO: 664357 - RNA, 13 nt, Escherichia coli CFT073
auaaauuccgcuc

SEQ ID NO: 664358 - RNA, 20 nt, Escherichia coli CFT073
auaaauggguuuuuuguugc

SEQ ID NO: 664359 - RNA, 19 nt, Escherichia coli CFT073
auaaaugacucacguuacu

SEQ ID NO: 664360 - RNA, 20 nt, Escherichia coli CFT073
auaaaggaguaacagauugu

SEQ ID NO: 664361 - RNA, 20 nt, Escherichia coli CFT073
auaaagcugucaccucugca

SEQ ID NO: 664362 - RNA, 21 nt, Escherichia coli CFT073
auaaagacgguggcacauaau

SEQ ID NO: 664363 - RNA, 14 nt, Escherichia coli CFT073
auaaagaaaucacc

SEQ ID NO: 664364 - RNA, 21 nt, Escherichia coli CFT073
auaaacuuacugacaucaaac

SEQ ID NO: 664365 - RNA, 16 nt, Escherichia coli CFT073
auaaacucaugggucu

SEQ ID NO: 664366 - RNA, 18 nt, Escherichia coli CFT073
auaaacgguuucagcagu

SEQ ID NO: 664367 - RNA, 20 nt, Escherichia coli CFT073
auaaacgguuucagcagugg

SEQ ID NO: 664368 - RNA, 13 nt, Escherichia coli CFT073
auaaacauuacuu

SEQ ID NO: 664369 - RNA, 15 nt, Escherichia coli CFT073
auaaaccaaagcccc

SEQ ID NO: 664370 - RNA, 22 nt, Escherichia coli CFT073
auaaacgccauauucugaucgu

SEQ ID NO: 664371 - RNA, 15 nt, Escherichia coli CFT073
auaaacggaacauac

SEQ ID NO: 664372 - RNA, 14 nt, Escherichia coli CFT073
auaaacauaucacu

SEQ ID NO: 664373 - RNA, 23 nt, Escherichia coli CFT073
auaaacauccuuuucaccuucaa

SEQ ID NO: 664374 - RNA, 19 nt, Escherichia coli CFT073
auaaacaucgucaggaaga

SEQ ID NO: 664375 - RNA, 12 nt, Escherichia coli CFT073
auaaacagcagg

SEQ ID NO: 664376 - RNA, 22 nt, Escherichia coli CFT073
auaaacaguuccgcaaagccca

SEQ ID NO: 664377 - RNA, 20 nt, Escherichia coli CFT073
auaaaaguguaggaaaucag

SEQ ID NO: 664378 - RNA, 16 nt, Escherichia coli CFT073
auaaacaccagcagca

SEQ ID NO: 664379 - RNA, 13 nt, Escherichia coli CFT073
auaaacacucaca

SEQ ID NO: 664380 - RNA, 11 nt, Escherichia coli CFT073
auaaacagcag

SEQ ID NO: 664381 - RNA, 19 nt, Escherichia coli CFT073
auaaacagcagauggcagc

SEQ ID NO: 664382 - RNA, 16 nt, Escherichia coli CFT073
aguuauuggcacugcg

SEQ ID NO: 664383 - RNA, 21 nt, Escherichia coli CFT073
aguuauacagacucaaaccaa

SEQ ID NO: 664384 - RNA, 13 nt, Escherichia coli CFT073
aguucaaguaaaa

SEQ ID NO: 664385 - RNA, 22 nt, Escherichia coli CFT073
aguucaaacggcguuuuuucau

SEQ ID NO: 664386 - RNA, 17 nt, Escherichia coli CFT073
aguucaaccucaagcac

SEQ ID NO: 664387 - RNA, 17 nt, Escherichia coli CFT073
aguucaacggugucgau

SEQ ID NO: 664388 - RNA, 13 nt, Escherichia coli CFT073
aguucaaggaugu

SEQ ID NO: 664389 - RNA, 15 nt, Escherichia coli CFT073
aguuagucgcuuuca

SEQ ID NO: 664390 - RNA, 13 nt, Escherichia coli CFT073
aguuaaucagcgc

SEQ ID NO: 664391 - RNA, 15 nt, Escherichia coli CFT073
aguuaaucaguuuau

SEQ ID NO: 664392 - RNA, 16 nt, Escherichia coli CFT073
aguuagcuuuucuccu

SEQ ID NO: 664393 - RNA, 20 nt, Escherichia coli CFT073
aguuaauaaucggugaggau

SEQ ID NO: 664394 - RNA, 20 nt, Escherichia coli CFT073
aguucauccagacggguaaa

SEQ ID NO: 664395 - RNA, 16 nt, Escherichia coli CFT073
aguucauccccucuuc

SEQ ID NO: 664396 - RNA, 17 nt, Escherichia coli CFT073
aguucauccccucuucc

SEQ ID NO: 664397 - RNA, 21 nt, Escherichia coli CFT073
aguucaguaaaaccauuacca

SEQ ID NO: 664398 - RNA, 14 nt, Escherichia coli CFT073
aguuccggguuuuc

SEQ ID NO: 664399 - RNA, 14 nt, Escherichia coli CFT073
aguuccugcaauuu

SEQ ID NO: 664400 - RNA, 15 nt, Escherichia coli CFT073
aguucccuacucucg

SEQ ID NO: 664401 - RNA, 19 nt, Escherichia coli CFT073
aguuccgggaucaccagac

SEQ ID NO: 664402 - RNA, 19 nt, Escherichia coli CFT073
aguucccccgauugccaug

SEQ ID NO: 664403 - RNA, 13 nt, Escherichia coli CFT073
aguucccccugcc

SEQ ID NO: 664404 - RNA, 17 nt, Escherichia coli CFT073
aguugaguaucagagaa

SEQ ID NO: 664405 - RNA, 13 nt, Escherichia coli CFT073
aguugcggcagga

SEQ ID NO: 664406 - RNA, 15 nt, Escherichia coli CFT073
aguuggcagaauuug

SEQ ID NO: 664407 - RNA, 21 nt, Escherichia coli CFT073
aguuggcagagauucuucaua

SEQ ID NO: 664408 - RNA, 22 nt, Escherichia coli CFT073
aguugcucccauaaugccccag

SEQ ID NO: 664409 - RNA, 14 nt, Escherichia coli CFT073
aguugcuccacugc

SEQ ID NO: 664410 - RNA, 15 nt, Escherichia coli CFT073
aguugcugacuuucc

SEQ ID NO: 664411 - RNA, 16 nt, Escherichia coli CFT073
aguucgcgaaaguuac

SEQ ID NO: 664412 - RNA, 19 nt, Escherichia coli CFT073
aguucgccuuccagcagcu

SEQ ID NO: 664413 - RNA, 14 nt, Escherichia coli CFT073
aguucgaugcucug

SEQ ID NO: 664414 - RNA, 14 nt, Escherichia coli CFT073
aguucgcuuuccgu

SEQ ID NO: 664415 - RNA, 19 nt, Escherichia coli CFT073
aguucuuuuguuuuguccg

SEQ ID NO: 664416 - RNA, 12 nt, Escherichia coli CFT073
aguugaaaucac

SEQ ID NO: 664417 - RNA, 20 nt, Escherichia coli CFT073
agugugauuacagccaggcg

SEQ ID NO: 664418 - RNA, 23 nt, Escherichia coli CFT073
agugugauuacagccaggcgcug

SEQ ID NO: 664419 - RNA, 19 nt, Escherichia coli CFT073
agugugaauauucagaaua

SEQ ID NO: 664420 - RNA, 19 nt, Escherichia coli CFT073
aguguaggaaaucagcaca

SEQ ID NO: 664421 - RNA, 13 nt, Escherichia coli CFT073
aguguacgaacac

SEQ ID NO: 664422 - RNA, 14 nt, Escherichia coli CFT073
aguguaaaugcaaa

SEQ ID NO: 664423 - RNA, 17 nt, Escherichia coli CFT073
aguguaaucagccccgg

SEQ ID NO: 664424 - RNA, 15 nt, Escherichia coli CFT073
aguguaauccugcca

SEQ ID NO: 664425 - RNA, 20 nt, Escherichia coli CFT073
aguuaaaaaaugcagcaaag

SEQ ID NO: 664426 - RNA, 19 nt, Escherichia coli CFT073
aguguuucgacaauaauca

SEQ ID NO: 664427 - RNA, 15 nt, Escherichia coli CFT073
aguguuggcgucaga

SEQ ID NO: 664428 - RNA, 22 nt, Escherichia coli CFT073
aguguugcguuuuuaucuucac

SEQ ID NO: 664429 - RNA, 13 nt, Escherichia coli CFT073
aguuaaccuucuc

SEQ ID NO: 664430 - RNA, 16 nt, Escherichia coli CFT073
aguuaagauucagccc

SEQ ID NO: 664431 - RNA, 19 nt, Escherichia coli CFT073
aguuaaacuuucauaaaca

SEQ ID NO: 664432 - RNA, 15 nt, Escherichia coli CFT073
aguggggcggugaug

SEQ ID NO: 664433 - RNA, 19 nt, Escherichia coli CFT073
aguggcgggacagaaagug

SEQ ID NO: 664434 - RNA, 18 nt, Escherichia coli CFT073
aguggcuccaugugaguc

SEQ ID NO: 664435 - RNA, 17 nt, Escherichia coli CFT073
agugcuuuaaucagcac

SEQ ID NO: 664436 - RNA, 18 nt, Escherichia coli CFT073
agugcuuucagcgaaaaa

SEQ ID NO: 664437 - RNA, 23 nt, Escherichia coli CFT073
agugcuuuuugugggccugauaa

SEQ ID NO: 664438 - RNA, 14 nt, Escherichia coli CFT073
aguggaaaucccca

SEQ ID NO: 664439 - RNA, 14 nt, Escherichia coli CFT073
aguggcgcgccugu

SEQ ID NO: 664440 - RNA, 23 nt, Escherichia coli CFT073
aguggaauaucccauuucuccac

SEQ ID NO: 664441 - RNA, 18 nt, Escherichia coli CFT073
aguggauauccuggucaa

SEQ ID NO: 664442 - RNA, 13 nt, Escherichia coli CFT073
agugcguuacaca

SEQ ID NO: 664443 - RNA, 16 nt, Escherichia coli CFT073
agugcguaagcgcgga

SEQ ID NO: 664444 - RNA, 23 nt, Escherichia coli CFT073
agugauaaaagucgcguuauuuu

SEQ ID NO: 664445 - RNA, 21 nt, Escherichia coli CFT073
agugagcgauugcuggccuag

SEQ ID NO: 664446 - RNA, 21 nt, Escherichia coli CFT073
agugaacccccugaaagcgac

SEQ ID NO: 664447 - RNA, 14 nt, Escherichia coli CFT073
agugaacuuucucu

SEQ ID NO: 664448 - RNA, 14 nt, Escherichia coli CFT073
agugacaccgguga

SEQ ID NO: 664449 - RNA, 22 nt, Escherichia coli CFT073
agugaccgaaccuguuuucacc

SEQ ID NO: 664450 - RNA, 21 nt, Escherichia coli CFT073
agugaccgcuguuaugcacac

SEQ ID NO: 664451 - RNA, 18 nt, Escherichia coli CFT073
agugacgaccuuuuccau

SEQ ID NO: 664452 - RNA, 21 nt, Escherichia coli CFT073
agugaccaucuuccagcauca

SEQ ID NO: 664453 - RNA, 20 nt, Escherichia coli CFT073
agugacccgcagccagcacu

SEQ ID NO: 664454 - RNA, 18 nt, Escherichia coli CFT073
agucuuauuuaauguaaa

SEQ ID NO: 664455 - RNA, 18 nt, Escherichia coli CFT073
agucuucacgggaaauau

SEQ ID NO: 664456 - RNA, 24 nt, Escherichia coli CFT073
agucuugcgcgauuugcccaucag

SEQ ID NO: 664457 - RNA, 17 nt, Escherichia coli CFT073
agugaaacacaugguuu

SEQ ID NO: 664458 - RNA, 21 nt, Escherichia coli CFT073
agugaaagaggcggagguuuu

SEQ ID NO: 664459 - RNA, 21 nt, Escherichia coli CFT073
agucuucauuguguaucaggu

SEQ ID NO: 664460 - RNA, 16 nt, Escherichia coli CFT073
agucgugcccaacugc

SEQ ID NO: 664461 - RNA, 18 nt, Escherichia coli CFT073
agucguauccucagaaau

SEQ ID NO: 664462 - RNA, 15 nt, Escherichia coli CFT073
agucgccugcuuuau

SEQ ID NO: 664463 - RNA, 17 nt, Escherichia coli CFT073
agucguaaugaaucagc

SEQ ID NO: 664464 - RNA, 17 nt, Escherichia coli CFT073
agucccugaaucgccac

SEQ ID NO: 664465 - RNA, 14 nt, Escherichia coli CFT073
agucccuuucaggu

SEQ ID NO: 664466 - RNA, 18 nt, Escherichia coli CFT073
agucauaacguucagcac

SEQ ID NO: 664467 - RNA, 16 nt, Escherichia coli CFT073
agucagggucuggugc

SEQ ID NO: 664468 - RNA, 17 nt, Escherichia coli CFT073
agucaguauuuucccug

SEQ ID NO: 664469 - RNA, 18 nt, Escherichia coli CFT073
agucagucacaggggagg

SEQ ID NO: 664470 - RNA, 21 nt, Escherichia coli CFT073
agucagguauuuugucagccc

SEQ ID NO: 664471 - RNA, 15 nt, Escherichia coli CFT073
agucaggggcuucca

SEQ ID NO: 664472 - RNA, 21 nt, Escherichia coli CFT073
agucaggcaauucuuuccguu

SEQ ID NO: 664473 - RNA, 16 nt, Escherichia coli CFT073
agucaucacuuucaga

SEQ ID NO: 664474 - RNA, 13 nt, Escherichia coli CFT073
agucauccggcgu

SEQ ID NO: 664475 - RNA, 16 nt, Escherichia coli CFT073
aguccaccuggccugc

SEQ ID NO: 664476 - RNA, 14 nt, Escherichia coli CFT073
aguccagcgccuga

SEQ ID NO: 664477 - RNA, 14 nt, Escherichia coli CFT073
aguccagguuuuag

SEQ ID NO: 664478 - RNA, 17 nt, Escherichia coli CFT073
aguccaggccugauuaa

SEQ ID NO: 664479 - RNA, 11 nt, Escherichia coli CFT073
agucccaacug

SEQ ID NO: 664480 - RNA, 16 nt, Escherichia coli CFT073
agucauuaugcuggaa

SEQ ID NO: 664481 - RNA, 15 nt, Escherichia coli CFT073
agucauuccugcccc

SEQ ID NO: 664482 - RNA, 22 nt, Escherichia coli CFT073
agucagaugccucguuggucag

SEQ ID NO: 664483 - RNA, 21 nt, Escherichia coli CFT073
agucagcaaugccagagugau

SEQ ID NO: 664484 - RNA, 21 nt, Escherichia coli CFT073
agucagcaguguccaguaaug

SEQ ID NO: 664485 - RNA, 15 nt, Escherichia coli CFT073
agucacuuuuuuucc

SEQ ID NO: 664486 - RNA, 16 nt, Escherichia coli CFT073
agucacuuuuuuuccg

SEQ ID NO: 664487 - RNA, 19 nt, Escherichia coli CFT073
agucaccuuucagccacuu

SEQ ID NO: 664488 - RNA, 14 nt, Escherichia coli CFT073
agucaccugcccuc

SEQ ID NO: 664489 - RNA, 16 nt, Escherichia coli CFT073
agucaccugcggugca

SEQ ID NO: 664490 - RNA, 15 nt, Escherichia coli CFT073
agucacgcagcaggg

SEQ ID NO: 664491 - RNA, 17 nt, Escherichia coli CFT073
agucacgcgguuauccc

SEQ ID NO: 664492 - RNA, 20 nt, Escherichia coli CFT073
agucacggaaucccguaauc

SEQ ID NO: 664493 - RNA, 16 nt, Escherichia coli CFT073
agucacgggcgguuga

SEQ ID NO: 664494 - RNA, 20 nt, Escherichia coli CFT073
agucacgguuaaucagauaa

SEQ ID NO: 664495 - RNA, 16 nt, Escherichia coli CFT073
agucaccaaagaagcg

SEQ ID NO: 664496 - RNA, 17 nt, Escherichia coli CFT073
agucacaaaauaaguau

SEQ ID NO: 664497 - RNA, 16 nt, Escherichia coli CFT073
agucaacauauuaaaa

SEQ ID NO: 664498 - RNA, 16 nt, Escherichia coli CFT073
agucaaggaaugaaau

SEQ ID NO: 664499 - RNA, 20 nt, Escherichia coli CFT073
agucaaggaaugaaauauua

SEQ ID NO: 664500 - RNA, 15 nt, Escherichia coli CFT073
agucaauaauauccg

SEQ ID NO: 664501 - RNA, 14 nt, Escherichia coli CFT073
agucaauauucaau

SEQ ID NO: 664502 - RNA, 20 nt, Escherichia coli CFT073
aguagaacaauuaauacaau

SEQ ID NO: 664503 - RNA, 23 nt, Escherichia coli CFT073
aguacuuuccauuuuggaauagu

SEQ ID NO: 664504 - RNA, 18 nt, Escherichia coli CFT073
aguacuggaagaaaacau

SEQ ID NO: 664505 - RNA, 16 nt, Escherichia coli CFT073
aguacugccgggaaga

SEQ ID NO: 664506 - RNA, 13 nt, Escherichia coli CFT073
auaguacauuucu

SEQ ID NO: 664507 - RNA, 22 nt, Escherichia coli CFT073
auaguaggagaagcauccugca

SEQ ID NO: 664508 - RNA, 17 nt, Escherichia coli CFT073
auaguaguugauauaca

SEQ ID NO: 664509 - RNA, 15 nt, Escherichia coli CFT073
auagucaaauacgcc

SEQ ID NO: 664510 - RNA, 18 nt, Escherichia coli CFT073
auagucacaaaauaagua

SEQ ID NO: 664511 - RNA, 19 nt, Escherichia coli CFT073
auagucacgcagcagggca

SEQ ID NO: 664512 - RNA, 14 nt, Escherichia coli CFT073
auagucaggugggg

SEQ ID NO: 664513 - RNA, 13 nt, Escherichia coli CFT073
auagucaguucac

SEQ ID NO: 664514 - RNA, 15 nt, Escherichia coli CFT073
auagucaucacuugc

SEQ ID NO: 664515 - RNA, 16 nt, Escherichia coli CFT073
auagucaugaugacgc

SEQ ID NO: 664516 - RNA, 18 nt, Escherichia coli CFT073
auaggugcccgcauagcc

SEQ ID NO: 664517 - RNA, 21 nt, Escherichia coli CFT073
auaggcaggcaucaucagauu

SEQ ID NO: 664518 - RNA, 22 nt, Escherichia coli CFT073
auagggaguuggaguaaaacgg

SEQ ID NO: 664519 - RNA, 16 nt, Escherichia coli CFT073
auagcgcacaugcagc

SEQ ID NO: 664520 - RNA, 20 nt, Escherichia coli CFT073
auagcgcaccaaccacugcu

SEQ ID NO: 664521 - RNA, 16 nt, Escherichia coli CFT073
auagcgcauugcggca

SEQ ID NO: 664522 - RNA, 14 nt, Escherichia coli CFT073
auagcgauuuuuca

SEQ ID NO: 664523 - RNA, 22 nt, Escherichia coli CFT073
auagcgauuuuucaucacugcc

SEQ ID NO: 664524 - RNA, 17 nt, Escherichia coli CFT073
auagcccggcaauggug

SEQ ID NO: 664525 - RNA, 23 nt, Escherichia coli CFT073
auagcuuuucgcgucaaucacac

SEQ ID NO: 664526 - RNA, 17 nt, Escherichia coli CFT073
auagcuuauucuuauua

SEQ ID NO: 664527 - RNA, 14 nt, Escherichia coli CFT073
auaggcaccgccaa

SEQ ID NO: 664528 - RNA, 18 nt, Escherichia coli CFT073
auaggcaaaaaaaugccc

SEQ ID NO: 664529 - RNA, 16 nt, Escherichia coli CFT073
auaucaccuuccagaa

SEQ ID NO: 664530 - RNA, 20 nt, Escherichia coli CFT073
auaucacgcgcgguauuuuc

SEQ ID NO: 664531 - RNA, 21 nt, Escherichia coli CFT073
auaucacucggggcuuuucuc

SEQ ID NO: 664532 - RNA, 16 nt, Escherichia coli CFT073
auaucacuuuuauaua

SEQ ID NO: 664533 - RNA, 22 nt, Escherichia coli CFT073
auaucagcaaugguucgugcaa

SEQ ID NO: 664534 - RNA, 23 nt, Escherichia coli CFT073
auauccagccaacgccuuuacca

SEQ ID NO: 664535 - RNA, 15 nt, Escherichia coli CFT073
auauccagcgccaga

SEQ ID NO: 664536 - RNA, 19 nt, Escherichia coli CFT073
auauccgucgcguuucucc

SEQ ID NO: 664537 - RNA, 15 nt, Escherichia coli CFT073
auauauaaaaucaua

SEQ ID NO: 664538 - RNA, 18 nt, Escherichia coli CFT073
auauauaaagauacacag

SEQ ID NO: 664539 - RNA, 15 nt, Escherichia coli CFT073
auauauaacagaagg

SEQ ID NO: 664540 - RNA, 15 nt, Escherichia coli CFT073
auauauuacccuuua

SEQ ID NO: 664541 - RNA, 14 nt, Escherichia coli CFT073
auaucaacaaaacc

SEQ ID NO: 664542 - RNA, 11 nt, Escherichia coli CFT073
auaucaaccag

SEQ ID NO: 664543 - RNA, 17 nt, Escherichia coli CFT073
auaucaaccaguugugc

SEQ ID NO: 664544 - RNA, 19 nt, Escherichia coli CFT073
auaucaacgcuauuugcug

SEQ ID NO: 664545 - RNA, 21 nt, Escherichia coli CFT073
auaucaacgcuauuugcugaa

SEQ ID NO: 664546 - RNA, 23 nt, Escherichia coli CFT073
auaucaacgcuauuugcugaauu

SEQ ID NO: 664547 - RNA, 15 nt, Escherichia coli CFT073
auauauucauauuuu

SEQ ID NO: 664548 - RNA, 23 nt, Escherichia coli CFT073
auauauuccccggucagcagcac

SEQ ID NO: 664549 - RNA, 14 nt, Escherichia coli CFT073
auauauuccuauau

SEQ ID NO: 664550 - RNA, 19 nt, Escherichia coli CFT073
auaucaaguuuaucaacgu

SEQ ID NO: 664551 - RNA, 16 nt, Escherichia coli CFT073
auaucaauaacauacc

SEQ ID NO: 664552 - RNA, 11 nt, Escherichia coli CFT073
auaucaauaug

SEQ ID NO: 664553 - RNA, 16 nt, Escherichia coli CFT073
auaguccgccagaaua

SEQ ID NO: 664554 - RNA, 18 nt, Escherichia coli CFT073
auauacacgaaaugaaua

SEQ ID NO: 664555 - RNA, 18 nt, Escherichia coli CFT073
auauacagcgccucuuuu

SEQ ID NO: 664556 - RNA, 14 nt, Escherichia coli CFT073
auauaggugauaaa

SEQ ID NO: 664557 - RNA, 14 nt, Escherichia coli CFT073
auauagccagccuc

SEQ ID NO: 664558 - RNA, 19 nt, Escherichia coli CFT073
auacguuucuuccacacca

SEQ ID NO: 664559 - RNA, 13 nt, Escherichia coli CFT073
auacguuauaucu

SEQ ID NO: 664560 - RNA, 21 nt, Escherichia coli CFT073
auacucuuugguauucaaccg

SEQ ID NO: 664561 - RNA, 22 nt, Escherichia coli CFT073
auacugacgauuacguaauuca

SEQ ID NO: 664562 - RNA, 17 nt, Escherichia coli CFT073
auacugagcaaggcaua

SEQ ID NO: 664563 - RNA, 23 nt, Escherichia coli CFT073
auacugauaauaaauaacagugc

SEQ ID NO: 664564 - RNA, 13 nt, Escherichia coli CFT073
auacuacaauccu

SEQ ID NO: 664565 - RNA, 23 nt, Escherichia coli CFT073
auacuacaauccugugcuccagu

SEQ ID NO: 664566 - RNA, 23 nt, Escherichia coli CFT073
auacuacgcagacggcuuucuuc

SEQ ID NO: 664567 - RNA, 17 nt, Escherichia coli CFT073
auacucuucgcggcugu

SEQ ID NO: 664568 - RNA, 17 nt, Escherichia coli CFT073
auacgggucgcaaacaa

SEQ ID NO: 664569 - RNA, 21 nt, Escherichia coli CFT073
auacgucggcaucaggcaaca

SEQ ID NO: 664570 - RNA, 20 nt, Escherichia coli CFT073
auacgguuuuuugaacagac

SEQ ID NO: 664571 - RNA, 23 nt, Escherichia coli CFT073
auaccgucugcaccgagagaaau

SEQ ID NO: 664572 - RNA, 23 nt, Escherichia coli CFT073
auaccgugguuuugguaaagcaa

SEQ ID NO: 664573 - RNA, 23 nt, Escherichia coli CFT073
auaccgacgaucgggaacagcca

SEQ ID NO: 664574 - RNA, 20 nt, Escherichia coli CFT073
auaccgucagcgaucagcau

SEQ ID NO: 664575 - RNA, 23 nt, Escherichia coli CFT073
auacugauuguacuguuacucau

SEQ ID NO: 664576 - RNA, 18 nt, Escherichia coli CFT073
auacuguaaauaguauua

SEQ ID NO: 664577 - RNA, 21 nt, Escherichia coli CFT073
auacuuaaccccagaccaauc

SEQ ID NO: 664578 - RNA, 22 nt, Escherichia coli CFT073
auagaaccuuccacguugguau

SEQ ID NO: 664579 - RNA, 15 nt, Escherichia coli CFT073
auagaaagugacugc

SEQ ID NO: 664580 - RNA, 18 nt, Escherichia coli CFT073
auagaaauuuaguauuuu

SEQ ID NO: 664581 - RNA, 16 nt, Escherichia coli CFT073
auagaaccaaaguuug

SEQ ID NO: 664582 - RNA, 14 nt, Escherichia coli CFT073
auagaaccacgcaa

SEQ ID NO: 664583 - RNA, 12 nt, Escherichia coli CFT073
auagaccauugc

SEQ ID NO: 664584 - RNA, 17 nt, Escherichia coli CFT073
auagaccggagaaaaga

SEQ ID NO: 664585 - RNA, 17 nt, Escherichia coli CFT073
auagacacugccgccgu

SEQ ID NO: 664586 - RNA, 13 nt, Escherichia coli CFT073
auagaauggcauu

SEQ ID NO: 664587 - RNA, 11 nt, Escherichia coli CFT073
auagaauagcc

SEQ ID NO: 664588 - RNA, 13 nt, Escherichia coli CFT073
auagaaucaccgc

SEQ ID NO: 664589 - RNA, 22 nt, Escherichia coli CFT073
auaccauccggcauaaacgcua

SEQ ID NO: 664590 - RNA, 13 nt, Escherichia coli CFT073
auaccaucggcag

SEQ ID NO: 664591 - RNA, 13 nt, Escherichia coli CFT073
auaccauaagaga

SEQ ID NO: 664592 - RNA, 21 nt, Escherichia coli CFT073
auaccauauuguuucaacaca

SEQ ID NO: 664593 - RNA, 12 nt, Escherichia coli CFT073
auacccaaaaaa

SEQ ID NO: 664594 - RNA, 13 nt, Escherichia coli CFT073
auacccaaaaaau

SEQ ID NO: 664595 - RNA, 20 nt, Escherichia coli CFT073
auacccaaaaaauagcaaag

SEQ ID NO: 664596 - RNA, 17 nt, Escherichia coli CFT073
auacccaccgguccuaa

SEQ ID NO: 664597 - RNA, 21 nt, Escherichia coli CFT073
auacccagaaucucuuuuguu

SEQ ID NO: 664598 - RNA, 20 nt, Escherichia coli CFT073
auacccagacuuuucagauu

SEQ ID NO: 664599 - RNA, 16 nt, Escherichia coli CFT073
auacccagcaacgaaa

SEQ ID NO: 664600 - RNA, 22 nt, Escherichia coli CFT073
auacccgaagcgccaauaccaa

SEQ ID NO: 664601 - RNA, 16 nt, Escherichia coli CFT073
auacccgacagauaaa

SEQ ID NO: 664602 - RNA, 19 nt, Escherichia coli CFT073
auacccgacagauaaauca

SEQ ID NO: 664603 - RNA, 13 nt, Escherichia coli CFT073
auaccccagcgca

SEQ ID NO: 664604 - RNA, 16 nt, Escherichia coli CFT073
auaccccgccagcaga

SEQ ID NO: 664605 - RNA, 12 nt, Escherichia coli CFT073
auacccugccag

SEQ ID NO: 664606 - RNA, 23 nt, Escherichia coli CFT073
auacccgcacaaauagccagcag

SEQ ID NO: 664607 - RNA, 17 nt, Escherichia coli CFT073
auacccggcacacaaau

SEQ ID NO: 664608 - RNA, 19 nt, Escherichia coli CFT073
auaccacaaacgccgugca

SEQ ID NO: 664609 - RNA, 17 nt, Escherichia coli CFT073
auaccaaaaucuaccag

SEQ ID NO: 664610 - RNA, 20 nt, Escherichia coli CFT073
auaccaagcccgaugaucau

SEQ ID NO: 664611 - RNA, 23 nt, Escherichia coli CFT073
  misc_feature (14)..(14): n is a, c, g or u
auaccaagucucangagugaaca

SEQ ID NO: 664612 - RNA, 18 nt, Escherichia coli CFT073
auaccaaaaucaucaauu

SEQ ID NO: 664613 - RNA, 14 nt, Escherichia coli CFT073
auaccagcacauaa

SEQ ID NO: 664614 - RNA, 17 nt, Escherichia coli CFT073
auaccagcagcaucacg

SEQ ID NO: 664615 - RNA, 16 nt, Escherichia coli CFT073
auaccagcaucaggau

SEQ ID NO: 664616 - RNA, 11 nt, Escherichia coli CFT073
auaccagccuu

SEQ ID NO: 664617 - RNA, 17 nt, Escherichia coli CFT073
auaccagccuucuucau

SEQ ID NO: 664618 - RNA, 15 nt, Escherichia coli CFT073
auaccaccacagcac

SEQ ID NO: 664619 - RNA, 17 nt, Escherichia coli CFT073
auaccacgccaucaacg

SEQ ID NO: 664620 - RNA, 17 nt, Escherichia coli CFT073
auacauguauaaaaaga

SEQ ID NO: 664621 - RNA, 18 nt, Escherichia coli CFT073
auacauguauaaaaagaa

SEQ ID NO: 664622 - RNA, 20 nt, Escherichia coli CFT073
auacauguauaaaaagaaga

SEQ ID NO: 664623 - RNA, 13 nt, Escherichia coli CFT073
auacauugccgca

SEQ ID NO: 664624 - RNA, 19 nt, Escherichia coli CFT073
auacaucugcaaauccugu

SEQ ID NO: 664625 - RNA, 22 nt, Escherichia coli CFT073
auacaucgcgcuuaucgccagc

SEQ ID NO: 664626 - RNA, 14 nt, Escherichia coli CFT073
auacauaccagcag

SEQ ID NO: 664627 - RNA, 18 nt, Escherichia coli CFT073
auacauaccagcaggaau

SEQ ID NO: 664628 - RNA, 23 nt, Escherichia coli CFT073
auacauaagcaccgaacaagaaa

SEQ ID NO: 664629 - RNA, 23 nt, Escherichia coli CFT073
auaauuccccggcacugucaaca

SEQ ID NO: 664630 - RNA, 14 nt, Escherichia coli CFT073
auacaggggccagc

SEQ ID NO: 664631 - RNA, 15 nt, Escherichia coli CFT073
auaauucaucuuuca

SEQ ID NO: 664632 - RNA, 13 nt, Escherichia coli CFT073
auaauuauuuuac

SEQ ID NO: 664633 - RNA, 13 nt, Escherichia coli CFT073
aucaauugcaauc

SEQ ID NO: 664634 - RNA, 15 nt, Escherichia coli CFT073
aucaauugcaggaag

SEQ ID NO: 664635 - RNA, 20 nt, Escherichia coli CFT073
aucaauugcguucugucgau

SEQ ID NO: 664636 - RNA, 19 nt, Escherichia coli CFT073
aucaauugcuucaauaauc

SEQ ID NO: 664637 - RNA, 23 nt, Escherichia coli CFT073
aucaauuuccggcuuaccaaaua

SEQ ID NO: 664638 - RNA, 21 nt, Escherichia coli CFT073
aucaauuuucccuucugagau

SEQ ID NO: 664639 - RNA, 21 nt, Escherichia coli CFT073
aucacaauuccgguacgccag

SEQ ID NO: 664640 - RNA, 18 nt, Escherichia coli CFT073
aucacaaucggcuuucac

SEQ ID NO: 664641 - RNA, 16 nt, Escherichia coli CFT073
aucacaaaauagaaau

SEQ ID NO: 664642 - RNA, 17 nt, Escherichia coli CFT073
aucacaaaauuuaucca

SEQ ID NO: 664643 - RNA, 19 nt, Escherichia coli CFT073
aucacaaaauuuauccagc

SEQ ID NO: 664644 - RNA, 21 nt, Escherichia coli CFT073
aucacaaaauuuauccagcgc

SEQ ID NO: 664645 - RNA, 22 nt, Escherichia coli CFT073
aucacaaaauuuauccagcgca

SEQ ID NO: 664646 - RNA, 19 nt, Escherichia coli CFT073
aucaauuuuuugauauguu

SEQ ID NO: 664647 - RNA, 12 nt, Escherichia coli CFT073
aucacauccagc

SEQ ID NO: 664648 - RNA, 13 nt, Escherichia coli CFT073
aucacaucccagc

SEQ ID NO: 664649 - RNA, 20 nt, Escherichia coli CFT073
aucacaucaucuaccagcau

SEQ ID NO: 664650 - RNA, 15 nt, Escherichia coli CFT073
aucacauccaccagc

SEQ ID NO: 664651 - RNA, 14 nt, Escherichia coli CFT073
aucacaucauaaau

SEQ ID NO: 664652 - RNA, 13 nt, Escherichia coli CFT073
aucacaucaccau

SEQ ID NO: 664653 - RNA, 18 nt, Escherichia coli CFT073
aucacauaaucgaaaaca

SEQ ID NO: 664654 - RNA, 23 nt, Escherichia coli CFT073
aucaccaaaauaccacugcgcca

SEQ ID NO: 664655 - RNA, 16 nt, Escherichia coli CFT073
aucacaucccagcaga

SEQ ID NO: 664656 - RNA, 20 nt, Escherichia coli CFT073
aucacaccauauccagcgca

SEQ ID NO: 664657 - RNA, 18 nt, Escherichia coli CFT073
aucacaccauccagcaac

SEQ ID NO: 664658 - RNA, 13 nt, Escherichia coli CFT073
aucacagaaaaaa

SEQ ID NO: 664659 - RNA, 13 nt, Escherichia coli CFT073
aucacaguauuua

SEQ ID NO: 664660 - RNA, 14 nt, Escherichia coli CFT073
aucaccuuacugga

SEQ ID NO: 664661 - RNA, 16 nt, Escherichia coli CFT073
aucacgaauagcuucg

SEQ ID NO: 664662 - RNA, 19 nt, Escherichia coli CFT073
aucacgacauaauuuuucu

SEQ ID NO: 664663 - RNA, 17 nt, Escherichia coli CFT073
aucacgaccgcuucagg

SEQ ID NO: 664664 - RNA, 14 nt, Escherichia coli CFT073
aucacguuuuccuu

SEQ ID NO: 664665 - RNA, 15 nt, Escherichia coli CFT073
aucacuauaaauaua

SEQ ID NO: 664666 - RNA, 19 nt, Escherichia coli CFT073
aucacuauaaauauacaua

SEQ ID NO: 664667 - RNA, 14 nt, Escherichia coli CFT073
aucacuauucagau

SEQ ID NO: 664668 - RNA, 21 nt, Escherichia coli CFT073
aucacuauacuccugauggcc

SEQ ID NO: 664669 - RNA, 13 nt, Escherichia coli CFT073
aucacucacccgc

SEQ ID NO: 664670 - RNA, 22 nt, Escherichia coli CFT073
aucacugauuaacaggcggcua

SEQ ID NO: 664671 - RNA, 14 nt, Escherichia coli CFT073
aucacugccgacca

SEQ ID NO: 664672 - RNA, 18 nt, Escherichia coli CFT073
aucacugaugaucuccau

SEQ ID NO: 664673 - RNA, 22 nt, Escherichia coli CFT073
aucacucccuuucugccacgcc

SEQ ID NO: 664674 - RNA, 22 nt, Escherichia coli CFT073
aucaccgcaccaguaauacggc

SEQ ID NO: 664675 - RNA, 22 nt, Escherichia coli CFT073
aucacccgagagaacugcugca

SEQ ID NO: 664676 - RNA, 16 nt, Escherichia coli CFT073
aucacccgccuucacu

SEQ ID NO: 664677 - RNA, 20 nt, Escherichia coli CFT073
aucacccugcgauugugaca

SEQ ID NO: 664678 - RNA, 17 nt, Escherichia coli CFT073
aucacccagcgaagcaa

SEQ ID NO: 664679 - RNA, 16 nt, Escherichia coli CFT073
aucacccacaucaacg

SEQ ID NO: 664680 - RNA, 18 nt, Escherichia coli CFT073
aucaccauauucagcagc

SEQ ID NO: 664681 - RNA, 18 nt, Escherichia coli CFT073
aucaccaauaccagcauc

SEQ ID NO: 664682 - RNA, 19 nt, Escherichia coli CFT073
aucaccaauaccagcauca

SEQ ID NO: 664683 - RNA, 22 nt, Escherichia coli CFT073
aucaccaccgucaucacgcagc

SEQ ID NO: 664684 - RNA, 16 nt, Escherichia coli CFT073
aucaccaggccauaga

SEQ ID NO: 664685 - RNA, 14 nt, Escherichia coli CFT073
aucaccagcaacac

SEQ ID NO: 664686 - RNA, 12 nt, Escherichia coli CFT073
aucaccagucca

SEQ ID NO: 664687 - RNA, 16 nt, Escherichia coli CFT073
aucaccauaaaucaga

SEQ ID NO: 664688 - RNA, 17 nt, Escherichia coli CFT073
aaaacguagcuuauugu

SEQ ID NO: 664689 - RNA, 19 nt, Escherichia coli CFT073
aaaacguagcuuauuguac

SEQ ID NO: 664690 - RNA, 19 nt, Escherichia coli CFT073
aaaacguccggcaauauag

SEQ ID NO: 664691 - RNA, 17 nt, Escherichia coli CFT073
aaaacgucgccagcgcc

SEQ ID NO: 664692 - RNA, 15 nt, Escherichia coli CFT073
aaaacggguacgaug

SEQ ID NO: 664693 - RNA, 20 nt, Escherichia coli CFT073
aaaacgguggccacagcaag

SEQ ID NO: 664694 - RNA, 16 nt, Escherichia coli CFT073
aaaacggaaagcagau

SEQ ID NO: 664695 - RNA, 22 nt, Escherichia coli CFT073
aaaacggauugcuuguucgaug

SEQ ID NO: 664696 - RNA, 13 nt, Escherichia coli CFT073
aucaguuuaucaa

SEQ ID NO: 664697 - RNA, 13 nt, Escherichia coli CFT073
aucaguuucagag

SEQ ID NO: 664698 - RNA, 12 nt, Escherichia coli CFT073
aucaguuucauu

SEQ ID NO: 664699 - RNA, 19 nt, Escherichia coli CFT073
aaaacggaagcucagacgg

SEQ ID NO: 664700 - RNA, 17 nt, Escherichia coli CFT073
aaaacgaccaccuucaa

SEQ ID NO: 664701 - RNA, 21 nt, Escherichia coli CFT073
aaaacgaccaccuucaacguu

SEQ ID NO: 664702 - RNA, 13 nt, Escherichia coli CFT073
aucagucccugaa

SEQ ID NO: 664703 - RNA, 20 nt, Escherichia coli CFT073
aucagguugaggaacuucca

SEQ ID NO: 664704 - RNA, 13 nt, Escherichia coli CFT073
aucaguaccaaag

SEQ ID NO: 664705 - RNA, 18 nt, Escherichia coli CFT073
aucaguacgcacaaugcc

SEQ ID NO: 664706 - RNA, 19 nt, Escherichia coli CFT073
aucagguguaauaaaguca

SEQ ID NO: 664707 - RNA, 14 nt, Escherichia coli CFT073
aucaggucuuucag

SEQ ID NO: 664708 - RNA, 16 nt, Escherichia coli CFT073
aucaggucgaaaauaa

SEQ ID NO: 664709 - RNA, 20 nt, Escherichia coli CFT073
aucagguaagcgauaaaaau

SEQ ID NO: 664710 - RNA, 20 nt, Escherichia coli CFT073
aucagguaguugccagcagc

SEQ ID NO: 664711 - RNA, 15 nt, Escherichia coli CFT073
aucagguauaccgaa

SEQ ID NO: 664712 - RNA, 13 nt, Escherichia coli CFT073
aucaggcugcugg

SEQ ID NO: 664713 - RNA, 17 nt, Escherichia coli CFT073
aucagggcgaaacagag

SEQ ID NO: 664714 - RNA, 18 nt, Escherichia coli CFT073
aucagggaagggucuuuu

SEQ ID NO: 664715 - RNA, 15 nt, Escherichia coli CFT073
aucaggguguaggca

SEQ ID NO: 664716 - RNA, 22 nt, Escherichia coli CFT073
aucaggcaagacgcauaaucca

SEQ ID NO: 664717 - RNA, 22 nt, Escherichia coli CFT073
aucaggcagauacaaccaaucg

SEQ ID NO: 664718 - RNA, 14 nt, Escherichia coli CFT073
aucaggcuaucuuc

SEQ ID NO: 664719 - RNA, 21 nt, Escherichia coli CFT073
aucaggcugaaaaucuucucu

SEQ ID NO: 664720 - RNA, 14 nt, Escherichia coli CFT073
aucagccguuucac

SEQ ID NO: 664721 - RNA, 17 nt, Escherichia coli CFT073
aucagcggcguagggca

SEQ ID NO: 664722 - RNA, 18 nt, Escherichia coli CFT073
aucagcggcguagggcag

SEQ ID NO: 664723 - RNA, 21 nt, Escherichia coli CFT073
aucagcaguuuuuccccugcc

SEQ ID NO: 664724 - RNA, 17 nt, Escherichia coli CFT073
aucaggacgaauacaag

SEQ ID NO: 664725 - RNA, 19 nt, Escherichia coli CFT073
aucagcuccgggcuaacac

SEQ ID NO: 664726 - RNA, 14 nt, Escherichia coli CFT073
aucaggcaacccgc

SEQ ID NO: 664727 - RNA, 18 nt, Escherichia coli CFT073
aucaggcaacccgcacaa

SEQ ID NO: 664728 - RNA, 19 nt, Escherichia coli CFT073
aucaggcaacccgcacaag

SEQ ID NO: 664729 - RNA, 12 nt, Escherichia coli CFT073
aucagcgucagu

SEQ ID NO: 664730 - RNA, 16 nt, Escherichia coli CFT073
aucagcguaacggguc

SEQ ID NO: 664731 - RNA, 19 nt, Escherichia coli CFT073
aucagcguccagcccuccu

SEQ ID NO: 664732 - RNA, 21 nt, Escherichia coli CFT073
aucagcgucgcguuuuucucu

SEQ ID NO: 664733 - RNA, 22 nt, Escherichia coli CFT073
aucagcguuugcgacaguaagc

SEQ ID NO: 664734 - RNA, 18 nt, Escherichia coli CFT073
aucagcuacaccgaucac

SEQ ID NO: 664735 - RNA, 14 nt, Escherichia coli CFT073
aucacuuccagcag

SEQ ID NO: 664736 - RNA, 19 nt, Escherichia coli CFT073
aucacuuccagcaguucgc

SEQ ID NO: 664737 - RNA, 18 nt, Escherichia coli CFT073
aucacuuacgauuuuaau

SEQ ID NO: 664738 - RNA, 19 nt, Escherichia coli CFT073
aucacuggugaaagagcca

SEQ ID NO: 664739 - RNA, 16 nt, Escherichia coli CFT073
aucacuguuuuuucau

SEQ ID NO: 664740 - RNA, 22 nt, Escherichia coli CFT073
aucagaagauuaagagaaccag

SEQ ID NO: 664741 - RNA, 15 nt, Escherichia coli CFT073
aucagcagcaacaaa

SEQ ID NO: 664742 - RNA, 22 nt, Escherichia coli CFT073
aucagcagauaccaacccuggu

SEQ ID NO: 664743 - RNA, 13 nt, Escherichia coli CFT073
aucagcagaucca

SEQ ID NO: 664744 - RNA, 14 nt, Escherichia coli CFT073
aucagcagcggcac

SEQ ID NO: 664745 - RNA, 19 nt, Escherichia coli CFT073
aucagcagcguucccagcc

SEQ ID NO: 664746 - RNA, 13 nt, Escherichia coli CFT073
aucagcaguucac

SEQ ID NO: 664747 - RNA, 16 nt, Escherichia coli CFT073
aucagcauaaucacca

SEQ ID NO: 664748 - RNA, 16 nt, Escherichia coli CFT073
aucagcaauaaaaaaa

SEQ ID NO: 664749 - RNA, 18 nt, Escherichia coli CFT073
aucagcacacauaacagc

SEQ ID NO: 664750 - RNA, 14 nt, Escherichia coli CFT073
auauuuuucccuga

SEQ ID NO: 664751 - RNA, 21 nt, Escherichia coli CFT073
aucaaaaacaaauuuugaaca

SEQ ID NO: 664752 - RNA, 16 nt, Escherichia coli CFT073
auauuuuuugaaaaau

SEQ ID NO: 664753 - RNA, 16 nt, Escherichia coli CFT073
auauuuauucuguugg

SEQ ID NO: 664754 - RNA, 22 nt, Escherichia coli CFT073
auauuucugcggcauucccagc

SEQ ID NO: 664755 - RNA, 22 nt, Escherichia coli CFT073
auauuuaguucauauaauuauu

SEQ ID NO: 664756 - RNA, 13 nt, Escherichia coli CFT073
auauucuuuugca

SEQ ID NO: 664757 - RNA, 16 nt, Escherichia coli CFT073
auauucuguucaugca

SEQ ID NO: 664758 - RNA, 14 nt, Escherichia coli CFT073
aucaaagaaaagca

SEQ ID NO: 664759 - RNA, 13 nt, Escherichia coli CFT073
aucaaaucugccg

SEQ ID NO: 664760 - RNA, 23 nt, Escherichia coli CFT073
aucaaaucaacaaccugcauuug

SEQ ID NO: 664761 - RNA, 22 nt, Escherichia coli CFT073
aucaaaucaccauauucagcag

SEQ ID NO: 664762 - RNA, 22 nt, Escherichia coli CFT073
aucaaauagccugccaguggag

SEQ ID NO: 664763 - RNA, 17 nt, Escherichia coli CFT073
aucaaauaagguuccag

SEQ ID NO: 664764 - RNA, 22 nt, Escherichia coli CFT073
aucaaauacagcuuaaucacca

SEQ ID NO: 664765 - RNA, 13 nt, Escherichia coli CFT073
aucaaagucucug

SEQ ID NO: 664766 - RNA, 19 nt, Escherichia coli CFT073
aucaaaguuaguaaaacua

SEQ ID NO: 664767 - RNA, 18 nt, Escherichia coli CFT073
aucaacauucagaucggu

SEQ ID NO: 664768 - RNA, 18 nt, Escherichia coli CFT073
aucaacauguuccugcca

SEQ ID NO: 664769 - RNA, 14 nt, Escherichia coli CFT073
aucaaauucaagau

SEQ ID NO: 664770 - RNA, 18 nt, Escherichia coli CFT073
aucaaaugcguuaucggc

SEQ ID NO: 664771 - RNA, 16 nt, Escherichia coli CFT073
aucaaauuauuaccau

SEQ ID NO: 664772 - RNA, 21 nt, Escherichia coli CFT073
aucaacauaaugccgacauca

SEQ ID NO: 664773 - RNA, 15 nt, Escherichia coli CFT073
aucaacggcaacaau

SEQ ID NO: 664774 - RNA, 13 nt, Escherichia coli CFT073
aucaacccgagcg

SEQ ID NO: 664775 - RNA, 20 nt, Escherichia coli CFT073
aucaacccugcccuucaggg

SEQ ID NO: 664776 - RNA, 22 nt, Escherichia coli CFT073
aucaaccaguugugcaccacca

SEQ ID NO: 664777 - RNA, 19 nt, Escherichia coli CFT073
aucaaccaugguuucaaac

SEQ ID NO: 664778 - RNA, 20 nt, Escherichia coli CFT073
aucaaccagcaccuuuucca

SEQ ID NO: 664779 - RNA, 18 nt, Escherichia coli CFT073
aucaacucaggaacauca

SEQ ID NO: 664780 - RNA, 19 nt, Escherichia coli CFT073
aucaacucaggaacaucag

SEQ ID NO: 664781 - RNA, 18 nt, Escherichia coli CFT073
aucaacuccgccagcaac

SEQ ID NO: 664782 - RNA, 15 nt, Escherichia coli CFT073
auauucguccauuga

SEQ ID NO: 664783 - RNA, 19 nt, Escherichia coli CFT073
auauucguccauugaagac

SEQ ID NO: 664784 - RNA, 16 nt, Escherichia coli CFT073
auauucgccaucagcc

SEQ ID NO: 664785 - RNA, 17 nt, Escherichia coli CFT073
auauucgccgcccugca

SEQ ID NO: 664786 - RNA, 20 nt, Escherichia coli CFT073
auauuccugaauggugaccu

SEQ ID NO: 664787 - RNA, 18 nt, Escherichia coli CFT073
auauuccugacccagcac

SEQ ID NO: 664788 - RNA, 21 nt, Escherichia coli CFT073
auauuccggugucauuauauc

SEQ ID NO: 664789 - RNA, 18 nt, Escherichia coli CFT073
auauuccuauauauuuag

SEQ ID NO: 664790 - RNA, 14 nt, Escherichia coli CFT073
auauuauuauuccu

SEQ ID NO: 664791 - RNA, 18 nt, Escherichia coli CFT073
auauuauguuaaauugcc

SEQ ID NO: 664792 - RNA, 20 nt, Escherichia coli CFT073
auauuaauuacuucucuuuc

SEQ ID NO: 664793 - RNA, 19 nt, Escherichia coli CFT073
auauuacauaccagcagca

SEQ ID NO: 664794 - RNA, 15 nt, Escherichia coli CFT073
auauuaccuuuaugc

SEQ ID NO: 664795 - RNA, 19 nt, Escherichia coli CFT073
auauuacgggucacaaaca

SEQ ID NO: 664796 - RNA, 20 nt, Escherichia coli CFT073
auauuacgugccgcguuaau

SEQ ID NO: 664797 - RNA, 14 nt, Escherichia coli CFT073
auauuacugacgcc

SEQ ID NO: 664798 - RNA, 14 nt, Escherichia coli CFT073
auauuaacgcagca

SEQ ID NO: 664799 - RNA, 18 nt, Escherichia coli CFT073
auauuaacgcagcaaaag

SEQ ID NO: 664800 - RNA, 19 nt, Escherichia coli CFT073
auauguuuuuuuuaucacu

SEQ ID NO: 664801 - RNA, 16 nt, Escherichia coli CFT073
auauguucccgcgccu

SEQ ID NO: 664802 - RNA, 19 nt, Escherichia coli CFT073
auauguucgcuuaacucac

SEQ ID NO: 664803 - RNA, 23 nt, Escherichia coli CFT073
auauguuuacgcguuuuucagaa

SEQ ID NO: 664804 - RNA, 18 nt, Escherichia coli CFT073
auaugugaucgaauauau

SEQ ID NO: 664805 - RNA, 19 nt, Escherichia coli CFT073
auauggcuugaagcaauag

SEQ ID NO: 664806 - RNA, 21 nt, Escherichia coli CFT073
auaugggcaaacaaaaaaccu

SEQ ID NO: 664807 - RNA, 22 nt, Escherichia coli CFT073
auaugggcaaacaaaaaaccua

SEQ ID NO: 664808 - RNA, 16 nt, Escherichia coli CFT073
auauggcccaucaucu

SEQ ID NO: 664809 - RNA, 14 nt, Escherichia coli CFT073
auauggccuucuuc

SEQ ID NO: 664810 - RNA, 23 nt, Escherichia coli CFT073
auauggcgcgccgauaaaggucg

SEQ ID NO: 664811 - RNA, 22 nt, Escherichia coli CFT073
auauggaacggaugcagcauca

SEQ ID NO: 664812 - RNA, 19 nt, Escherichia coli CFT073
auaugcgcugucauucauu

SEQ ID NO: 664813 - RNA, 20 nt, Escherichia coli CFT073
auauccucauuucauugucc

SEQ ID NO: 664814 - RNA, 13 nt, Escherichia coli CFT073
auauccuccggca

SEQ ID NO: 664815 - RNA, 18 nt, Escherichia coli CFT073
auauccgggcaaaaauua

SEQ ID NO: 664816 - RNA, 14 nt, Escherichia coli CFT073
auaugcauaaaccg

SEQ ID NO: 664817 - RNA, 13 nt, Escherichia coli CFT073
auaugccaggcuu

SEQ ID NO: 664818 - RNA, 12 nt, Escherichia coli CFT073
auaugcccaccg

SEQ ID NO: 664819 - RNA, 20 nt, Escherichia coli CFT073
auaugccgccccaaagggcg

SEQ ID NO: 664820 - RNA, 14 nt, Escherichia coli CFT073
augagauaaucaaa

SEQ ID NO: 664821 - RNA, 15 nt, Escherichia coli CFT073
augagauacauuggu

SEQ ID NO: 664822 - RNA, 19 nt, Escherichia coli CFT073
augagauccgcuucacuga

SEQ ID NO: 664823 - RNA, 18 nt, Escherichia coli CFT073
augagaaucuacaaaggg

SEQ ID NO: 664824 - RNA, 11 nt, Escherichia coli CFT073
augagaaugcg

SEQ ID NO: 664825 - RNA, 17 nt, Escherichia coli CFT073
augagaacuccuggcga

SEQ ID NO: 664826 - RNA, 17 nt, Escherichia coli CFT073
augagaaaacuaucuga

SEQ ID NO: 664827 - RNA, 19 nt, Escherichia coli CFT073
augacgaguauauucugua

SEQ ID NO: 664828 - RNA, 13 nt, Escherichia coli CFT073
augacacacucug

SEQ ID NO: 664829 - RNA, 23 nt, Escherichia coli CFT073
augacaauguggccuuaauuggc

SEQ ID NO: 664830 - RNA, 23 nt, Escherichia coli CFT073
augacaccaacgcuaaauacuga

SEQ ID NO: 664831 - RNA, 16 nt, Escherichia coli CFT073
augaccauaaaaggca

SEQ ID NO: 664832 - RNA, 16 nt, Escherichia coli CFT073
augaccagugcagaua

SEQ ID NO: 664833 - RNA, 17 nt, Escherichia coli CFT073
augaccagugcagauac

SEQ ID NO: 664834 - RNA, 17 nt, Escherichia coli CFT073
augaccagugaggaugc

SEQ ID NO: 664835 - RNA, 14 nt, Escherichia coli CFT073
augaccagaucggg

SEQ ID NO: 664836 - RNA, 18 nt, Escherichia coli CFT073
augacagaaucagcagcg

SEQ ID NO: 664837 - RNA, 16 nt, Escherichia coli CFT073
augaccaccaaauaaa

SEQ ID NO: 664838 - RNA, 21 nt, Escherichia coli CFT073
augaccaccaaauaaaaaaac

SEQ ID NO: 664839 - RNA, 22 nt, Escherichia coli CFT073
augaccgcuaauagcgcagcgg

SEQ ID NO: 664840 - RNA, 16 nt, Escherichia coli CFT073
augaccguuugccccg

SEQ ID NO: 664841 - RNA, 22 nt, Escherichia coli CFT073
augaaaaaaccagaaagggaag

SEQ ID NO: 664842 - RNA, 20 nt, Escherichia coli CFT073
augaaacucaagcuaaacca

SEQ ID NO: 664843 - RNA, 21 nt, Escherichia coli CFT073
augaaacucaagcuaaaccaa

SEQ ID NO: 664844 - RNA, 18 nt, Escherichia coli CFT073
augaaacgcaaauacuga

SEQ ID NO: 664845 - RNA, 15 nt, Escherichia coli CFT073
augaaagcaugucag

SEQ ID NO: 664846 - RNA, 21 nt, Escherichia coli CFT073
augacaacaccaucgaaauua

SEQ ID NO: 664847 - RNA, 20 nt, Escherichia coli CFT073
augacaaacguauaauugcc

SEQ ID NO: 664848 - RNA, 19 nt, Escherichia coli CFT073
augacaaacgcaaaacugc

SEQ ID NO: 664849 - RNA, 18 nt, Escherichia coli CFT073
augaauaaguuucagcau

SEQ ID NO: 664850 - RNA, 19 nt, Escherichia coli CFT073
augaauaaucugaaaacca

SEQ ID NO: 664851 - RNA, 23 nt, Escherichia coli CFT073
augaauaccaagucucaagagug

SEQ ID NO: 664852 - RNA, 12 nt, Escherichia coli CFT073
augaagcaauga

SEQ ID NO: 664853 - RNA, 22 nt, Escherichia coli CFT073
augaauaucauaggucaggaau

SEQ ID NO: 664854 - RNA, 19 nt, Escherichia coli CFT073
augaauauugcugaaaagg

SEQ ID NO: 664855 - RNA, 19 nt, Escherichia coli CFT073
augaauacgcgauuuuucu

SEQ ID NO: 664856 - RNA, 20 nt, Escherichia coli CFT073
augaauagucgccagcucug

SEQ ID NO: 664857 - RNA, 16 nt, Escherichia coli CFT073
aucuuguucauagugc

SEQ ID NO: 664858 - RNA, 20 nt, Escherichia coli CFT073
aucuuuaacugcuccgccgc

SEQ ID NO: 664859 - RNA, 12 nt, Escherichia coli CFT073
aucuuugaaaua

SEQ ID NO: 664860 - RNA, 16 nt, Escherichia coli CFT073
aucuuugacugaaauu

SEQ ID NO: 664861 - RNA, 18 nt, Escherichia coli CFT073
aucuuugacugaaauuua

SEQ ID NO: 664862 - RNA, 14 nt, Escherichia coli CFT073
aucuuuaucaagca

SEQ ID NO: 664863 - RNA, 17 nt, Escherichia coli CFT073
aucuuugauugaagaaa

SEQ ID NO: 664864 - RNA, 21 nt, Escherichia coli CFT073
aucuucugccaauuuuucgcu

SEQ ID NO: 664865 - RNA, 21 nt, Escherichia coli CFT073
aucuucugaccgggauuuuca

SEQ ID NO: 664866 - RNA, 14 nt, Escherichia coli CFT073
aucuucucuucccc

SEQ ID NO: 664867 - RNA, 16 nt, Escherichia coli CFT073
aucuucucucauccgc

SEQ ID NO: 664868 - RNA, 13 nt, Escherichia coli CFT073
aucuucucuuaua

SEQ ID NO: 664869 - RNA, 18 nt, Escherichia coli CFT073
aucuucucuuauauuuca

SEQ ID NO: 664870 - RNA, 14 nt, Escherichia coli CFT073
aucuucuccacgcc

SEQ ID NO: 664871 - RNA, 14 nt, Escherichia coli CFT073
aucuguucuuuuau

SEQ ID NO: 664872 - RNA, 19 nt, Escherichia coli CFT073
aucuguugaaaaaaggcuu

SEQ ID NO: 664873 - RNA, 17 nt, Escherichia coli CFT073
aucuguugaaauuauug

SEQ ID NO: 664874 - RNA, 21 nt, Escherichia coli CFT073
aucuguugauuuaacagcaaa

SEQ ID NO: 664875 - RNA, 20 nt, Escherichia coli CFT073
aucugugggcaugcuucacu

SEQ ID NO: 664876 - RNA, 22 nt, Escherichia coli CFT073
aucugugggcaugcuucacuga

SEQ ID NO: 664877 - RNA, 23 nt, Escherichia coli CFT073
aucugugggcaugcuucacugaa

SEQ ID NO: 664878 - RNA, 13 nt, Escherichia coli CFT073
aucuguuaucuca

SEQ ID NO: 664879 - RNA, 14 nt, Escherichia coli CFT073
aucuguaacagguc

SEQ ID NO: 664880 - RNA, 16 nt, Escherichia coli CFT073
aucuguccuuccagua

SEQ ID NO: 664881 - RNA, 17 nt, Escherichia coli CFT073
aucugguuuuugguuuc

SEQ ID NO: 664882 - RNA, 14 nt, Escherichia coli CFT073
aucuucuucuaugc

SEQ ID NO: 664883 - RNA, 20 nt, Escherichia coli CFT073
aucuucuugcagcuuaauca

SEQ ID NO: 664884 - RNA, 16 nt, Escherichia coli CFT073
aucuucuguugcaggg

SEQ ID NO: 664885 - RNA, 18 nt, Escherichia coli CFT073
aucugaugauauuuuucc

SEQ ID NO: 664886 - RNA, 14 nt, Escherichia coli CFT073
aucugauagaacug

SEQ ID NO: 664887 - RNA, 14 nt, Escherichia coli CFT073
aucucuucuucgcu

SEQ ID NO: 664888 - RNA, 18 nt, Escherichia coli CFT073
aucugacuuuccggggaa

SEQ ID NO: 664889 - RNA, 22 nt, Escherichia coli CFT073
aucugacuuuccggggaaaugc

SEQ ID NO: 664890 - RNA, 14 nt, Escherichia coli CFT073
aucugauucuuccc

SEQ ID NO: 664891 - RNA, 17 nt, Escherichia coli CFT073
aucugcaaaauaccaau

SEQ ID NO: 664892 - RNA, 16 nt, Escherichia coli CFT073
aucugccagccaguca

SEQ ID NO: 664893 - RNA, 22 nt, Escherichia coli CFT073
aucugcccaaaauugacuaucu

SEQ ID NO: 664894 - RNA, 19 nt, Escherichia coli CFT073
aucugcccguacccaacac

SEQ ID NO: 664895 - RNA, 23 nt, Escherichia coli CFT073
aucugcuugcgauguucuucacc

SEQ ID NO: 664896 - RNA, 19 nt, Escherichia coli CFT073
aucugcuguaaagucugga

SEQ ID NO: 664897 - RNA, 21 nt, Escherichia coli CFT073
aucugcuggaaaggccgcgaa

SEQ ID NO: 664898 - RNA, 14 nt, Escherichia coli CFT073
aucuggaggugacg

SEQ ID NO: 664899 - RNA, 16 nt, Escherichia coli CFT073
aucuggucaguuaaca

SEQ ID NO: 664900 - RNA, 17 nt, Escherichia coli CFT073
aucuggucaguuaacaa

SEQ ID NO: 664901 - RNA, 20 nt, Escherichia coli CFT073
aucuggugccagcgccagca

SEQ ID NO: 664902 - RNA, 22 nt, Escherichia coli CFT073
aucugcuugcggcguucgguuu

SEQ ID NO: 664903 - RNA, 18 nt, Escherichia coli CFT073
aucuggaauggaaacagc

SEQ ID NO: 664904 - RNA, 16 nt, Escherichia coli CFT073
aucuccaguuccccgc

SEQ ID NO: 664905 - RNA, 22 nt, Escherichia coli CFT073
aucucaauuccuuugcugcucu

SEQ ID NO: 664906 - RNA, 17 nt, Escherichia coli CFT073
aucuccagauaauuaug

SEQ ID NO: 664907 - RNA, 21 nt, Escherichia coli CFT073
aucucaaaucuucucacugcc

SEQ ID NO: 664908 - RNA, 15 nt, Escherichia coli CFT073
aucucaacaaacgca

SEQ ID NO: 664909 - RNA, 17 nt, Escherichia coli CFT073
aucucaagcgguaaacc

SEQ ID NO: 664910 - RNA, 13 nt, Escherichia coli CFT073
aucucaaucaaaa

SEQ ID NO: 664911 - RNA, 15 nt, Escherichia coli CFT073
aucucaaucaaaaga

SEQ ID NO: 664912 - RNA, 18 nt, Escherichia coli CFT073
aucucguugaucacccac

SEQ ID NO: 664913 - RNA, 17 nt, Escherichia coli CFT073
aucucuaacgguucuuu

SEQ ID NO: 664914 - RNA, 22 nt, Escherichia coli CFT073
aucucgguggaaaauagcauaa

SEQ ID NO: 664915 - RNA, 20 nt, Escherichia coli CFT073
aucucggauaaggcuuccua

SEQ ID NO: 664916 - RNA, 16 nt, Escherichia coli CFT073
aucucgguggaaaaua

SEQ ID NO: 664917 - RNA, 17 nt, Escherichia coli CFT073
aucucgguggaaaauag

SEQ ID NO: 664918 - RNA, 14 nt, Escherichia coli CFT073
aucucuucaauaug

SEQ ID NO: 664919 - RNA, 21 nt, Escherichia coli CFT073
aucucuucaauaugggcacgc

SEQ ID NO: 664920 - RNA, 18 nt, Escherichia coli CFT073
aucucuucaccugccugc

SEQ ID NO: 664921 - RNA, 14 nt, Escherichia coli CFT073
aucucuuccacuuc

SEQ ID NO: 664922 - RNA, 12 nt, Escherichia coli CFT073
aucucuucccac

SEQ ID NO: 664923 - RNA, 18 nt, Escherichia coli CFT073
aucuacuacuggagacag

SEQ ID NO: 664924 - RNA, 21 nt, Escherichia coli CFT073
aucuaccaguuccagcgccug

SEQ ID NO: 664925 - RNA, 20 nt, Escherichia coli CFT073
aucuaagaucccugccauuu

SEQ ID NO: 664926 - RNA, 15 nt, Escherichia coli CFT073
aucguucgccagcuc

SEQ ID NO: 664927 - RNA, 17 nt, Escherichia coli CFT073
aucuaaaugccacugaa

SEQ ID NO: 664928 - RNA, 22 nt, Escherichia coli CFT073
aucuaaaaugucaccuaauuua

SEQ ID NO: 664929 - RNA, 12 nt, Escherichia coli CFT073
aucuaaaagcaa

SEQ ID NO: 664930 - RNA, 16 nt, Escherichia coli CFT073
aucuaaaagcaaacug

SEQ ID NO: 664931 - RNA, 16 nt, Escherichia coli CFT073
aucguggccaugacca

SEQ ID NO: 664932 - RNA, 22 nt, Escherichia coli CFT073
aucgugcuggauuugugucaga

SEQ ID NO: 664933 - RNA, 23 nt, Escherichia coli CFT073
aucgugacaauaauucccagcac

SEQ ID NO: 664934 - RNA, 14 nt, Escherichia coli CFT073
aucgugacagcaua

SEQ ID NO: 664935 - RNA, 14 nt, Escherichia coli CFT073
aucguuaaugaucu

SEQ ID NO: 664936 - RNA, 17 nt, Escherichia coli CFT073
aucguuacucuuaucaa

SEQ ID NO: 664937 - RNA, 21 nt, Escherichia coli CFT073
aucguuaaaaagauuaagaac

SEQ ID NO: 664938 - RNA, 14 nt, Escherichia coli CFT073
aucgcugugcugcu

SEQ ID NO: 664939 - RNA, 19 nt, Escherichia coli CFT073
aucgcuguuguucuuuuuc

SEQ ID NO: 664940 - RNA, 18 nt, Escherichia coli CFT073
aucggaucaauccccaga

SEQ ID NO: 664941 - RNA, 20 nt, Escherichia coli CFT073
aucggagaacaggaauaaau

SEQ ID NO: 664942 - RNA, 18 nt, Escherichia coli CFT073
aucggauuuaguaccgaa

SEQ ID NO: 664943 - RNA, 23 nt, Escherichia coli CFT073
aucggcaaaaauaaucucaccau

SEQ ID NO: 664944 - RNA, 23 nt, Escherichia coli CFT073
aucggcaacgaaauagccaggca

SEQ ID NO: 664945 - RNA, 16 nt, Escherichia coli CFT073
aucgucgccagaccaa

SEQ ID NO: 664946 - RNA, 16 nt, Escherichia coli CFT073
aucguccagcgucagg

SEQ ID NO: 664947 - RNA, 15 nt, Escherichia coli CFT073
aucguccagcugccu

SEQ ID NO: 664948 - RNA, 16 nt, Escherichia coli CFT073
aucguccagcagcaau

SEQ ID NO: 664949 - RNA, 16 nt, Escherichia coli CFT073
aucgccucccgcagua

SEQ ID NO: 664950 - RNA, 15 nt, Escherichia coli CFT073
aucgccuccagcgcu

SEQ ID NO: 664951 - RNA, 20 nt, Escherichia coli CFT073
aucgccugcgccaccacaac

SEQ ID NO: 664952 - RNA, 15 nt, Escherichia coli CFT073
aucgccugcuggaca

SEQ ID NO: 664953 - RNA, 21 nt, Escherichia coli CFT073
aucgccugaacaccagaacca

SEQ ID NO: 664954 - RNA, 21 nt, Escherichia coli CFT073
aucgcccccaucaccggcaca

SEQ ID NO: 664955 - RNA, 21 nt, Escherichia coli CFT073
aucgcccccggagagggggcg

SEQ ID NO: 664956 - RNA, 16 nt, Escherichia coli CFT073
aucgcccgcaaucagc

SEQ ID NO: 664957 - RNA, 17 nt, Escherichia coli CFT073
aucgccccggucaucaa

SEQ ID NO: 664958 - RNA, 19 nt, Escherichia coli CFT073
aucgccggaauaucaccac

SEQ ID NO: 664959 - RNA, 23 nt, Escherichia coli CFT073
aucgccgggauauaugucaccag

SEQ ID NO: 664960 - RNA, 17 nt, Escherichia coli CFT073
aucgccggggcgggcau

SEQ ID NO: 664961 - RNA, 21 nt, Escherichia coli CFT073
aucgccggggcgggcauuuuu

SEQ ID NO: 664962 - RNA, 20 nt, Escherichia coli CFT073
aucgccggaugcggcaggcg

SEQ ID NO: 664963 - RNA, 13 nt, Escherichia coli CFT073
aucgcguuuuaca

SEQ ID NO: 664964 - RNA, 20 nt, Escherichia coli CFT073
aucgcugaacgggccaucca

SEQ ID NO: 664965 - RNA, 15 nt, Escherichia coli CFT073
aucgcugcuaauuua

SEQ ID NO: 664966 - RNA, 23 nt, Escherichia coli CFT073
aucgcuguacucaccaacgcaga

SEQ ID NO: 664967 - RNA, 22 nt, Escherichia coli CFT073
aucgcugggcgauaaaaucaga

SEQ ID NO: 664968 - RNA, 23 nt, Escherichia coli CFT073
aucgcgucgucgguguuaacaau

SEQ ID NO: 664969 - RNA, 13 nt, Escherichia coli CFT073
aucgcguaaggcu

SEQ ID NO: 664970 - RNA, 14 nt, Escherichia coli CFT073
aucgcguugucaua

SEQ ID NO: 664971 - RNA, 21 nt, Escherichia coli CFT073
aucgccuucgcaaaaaaccau

SEQ ID NO: 664972 - RNA, 18 nt, Escherichia coli CFT073
aucgcgacaaaauacagg

SEQ ID NO: 664973 - RNA, 21 nt, Escherichia coli CFT073
aucgcgauagcgcaccaacca

SEQ ID NO: 664974 - RNA, 12 nt, Escherichia coli CFT073
aucgcgaccaau

SEQ ID NO: 664975 - RNA, 15 nt, Escherichia coli CFT073
aucgcgcaaccacaa

SEQ ID NO: 664976 - RNA, 13 nt, Escherichia coli CFT073
aucgcgggaaaaa

SEQ ID NO: 664977 - RNA, 17 nt, Escherichia coli CFT073
aucgcgguaacagauga

SEQ ID NO: 664978 - RNA, 22 nt, Escherichia coli CFT073
aucgcgguaacagaugaaugaa

SEQ ID NO: 664979 - RNA, 15 nt, Escherichia coli CFT073
aucgcaauucuucau

SEQ ID NO: 664980 - RNA, 14 nt, Escherichia coli CFT073
aucgcaccauucac

SEQ ID NO: 664981 - RNA, 17 nt, Escherichia coli CFT073
aucgcacguugccagca

SEQ ID NO: 664982 - RNA, 18 nt, Escherichia coli CFT073
aucgcacguugccagcaa

SEQ ID NO: 664983 - RNA, 19 nt, Escherichia coli CFT073
aucgcacguugccagcaac

SEQ ID NO: 664984 - RNA, 21 nt, Escherichia coli CFT073
aucgcacguugccagcaacug

SEQ ID NO: 664985 - RNA, 22 nt, Escherichia coli CFT073
aucgcaaucauuuuuuccccuu

SEQ ID NO: 664986 - RNA, 17 nt, Escherichia coli CFT073
aucgauuuucaaaauau

SEQ ID NO: 664987 - RNA, 17 nt, Escherichia coli CFT073
aucgcaaauaugugauc

SEQ ID NO: 664988 - RNA, 16 nt, Escherichia coli CFT073
aucgcaacgcaucuuu

SEQ ID NO: 664989 - RNA, 19 nt, Escherichia coli CFT073
aucgcaacgcaucuuuuuc

SEQ ID NO: 664990 - RNA, 18 nt, Escherichia coli CFT073
aucgcaucaaucuuuuuc

SEQ ID NO: 664991 - RNA, 14 nt, Escherichia coli CFT073
aucgccauccuuuc

SEQ ID NO: 664992 - RNA, 20 nt, Escherichia coli CFT073
aucgccaugaugagcgccau

SEQ ID NO: 664993 - RNA, 15 nt, Escherichia coli CFT073
aucgccagguguuug

SEQ ID NO: 664994 - RNA, 15 nt, Escherichia coli CFT073
aucgccaucacaccc

SEQ ID NO: 664995 - RNA, 19 nt, Escherichia coli CFT073
aucgagcguugcuucgcca

SEQ ID NO: 664996 - RNA, 20 nt, Escherichia coli CFT073
aucgagcgcagcaacaucac

SEQ ID NO: 664997 - RNA, 17 nt, Escherichia coli CFT073
aucgagcagcuccugcu

SEQ ID NO: 664998 - RNA, 14 nt, Escherichia coli CFT073
aucgagccgauuaa

SEQ ID NO: 664999 - RNA, 16 nt, Escherichia coli CFT073
aucgagccgauuaaaa

SEQ ID NO: 665000 - RNA, 18 nt, Escherichia coli CFT073
aucgauggugaaguggcu

SEQ ID NO: 665001 - RNA, 14 nt, Escherichia coli CFT073
aucgaugugauaaa

SEQ ID NO: 665002 - RNA, 21 nt, Escherichia coli CFT073
aucgauugcacauucccugca

SEQ ID NO: 665003 - RNA, 22 nt, Escherichia coli CFT073
aucgagcugccugcggaugcgc

SEQ ID NO: 665004 - RNA, 16 nt, Escherichia coli CFT073
aucgauccccugcccg

SEQ ID NO: 665005 - RNA, 14 nt, Escherichia coli CFT073
auccuguucauuuu

SEQ ID NO: 665006 - RNA, 15 nt, Escherichia coli CFT073
auccugcaaauucaa

SEQ ID NO: 665007 - RNA, 18 nt, Escherichia coli CFT073
auccugcaacaacaccag

SEQ ID NO: 665008 - RNA, 21 nt, Escherichia coli CFT073
auccugcaccacaacaccuuu

SEQ ID NO: 665009 - RNA, 21 nt, Escherichia coli CFT073
auccugacaaggugcgaaaaa

SEQ ID NO: 665010 - RNA, 14 nt, Escherichia coli CFT073
auccugaguuaauc

SEQ ID NO: 665011 - RNA, 13 nt, Escherichia coli CFT073
auccugcaaauaa

SEQ ID NO: 665012 - RNA, 21 nt, Escherichia coli CFT073
auccugcaaauaacgcuucag

SEQ ID NO: 665013 - RNA, 22 nt, Escherichia coli CFT073
auccugaugcuucagauaccaa

SEQ ID NO: 665014 - RNA, 11 nt, Escherichia coli CFT073
auccuuuccuu

SEQ ID NO: 665015 - RNA, 20 nt, Escherichia coli CFT073
auccuuuccuuaagccagcg

SEQ ID NO: 665016 - RNA, 13 nt, Escherichia coli CFT073
auccuuccagcuc

SEQ ID NO: 665017 - RNA, 13 nt, Escherichia coli CFT073
auccuucccccac

SEQ ID NO: 665018 - RNA, 14 nt, Escherichia coli CFT073
auccucuaaacccc

SEQ ID NO: 665019 - RNA, 14 nt, Escherichia coli CFT073
auccugaauauccu

SEQ ID NO: 665020 - RNA, 14 nt, Escherichia coli CFT073
auccugaaucaccu

SEQ ID NO: 665021 - RNA, 14 nt, Escherichia coli CFT073
auccugaaagcuga

SEQ ID NO: 665022 - RNA, 22 nt, Escherichia coli CFT073
auccugaaagcugagaaaaugu

SEQ ID NO: 665023 - RNA, 12 nt, Escherichia coli CFT073
auccucuucagc

SEQ ID NO: 665024 - RNA, 23 nt, Escherichia coli CFT073
auccucagaaaucagauaaaaca

SEQ ID NO: 665025 - RNA, 19 nt, Escherichia coli CFT073
auccucaaucggaaaacaa

SEQ ID NO: 665026 - RNA, 16 nt, Escherichia coli CFT073
auccucauaaauugcu

SEQ ID NO: 665027 - RNA, 16 nt, Escherichia coli CFT073
auccucauaacguaaa

SEQ ID NO: 665028 - RNA, 22 nt, Escherichia coli CFT073
auccuaauccuggccauaccau

SEQ ID NO: 665029 - RNA, 14 nt, Escherichia coli CFT073
auccuacauccagu

SEQ ID NO: 665030 - RNA, 14 nt, Escherichia coli CFT073
auccuaaaggcaaa

SEQ ID NO: 665031 - RNA, 21 nt, Escherichia coli CFT073
auccguuagcgaguugaucac

SEQ ID NO: 665032 - RNA, 16 nt, Escherichia coli CFT073
auccguuauagggaaa

SEQ ID NO: 665033 - RNA, 18 nt, Escherichia coli CFT073
auccguucuggacuuccc

SEQ ID NO: 665034 - RNA, 14 nt, Escherichia coli CFT073
auccgguuaucaga

SEQ ID NO: 665035 - RNA, 16 nt, Escherichia coli CFT073
auccgguuuuccagaa

SEQ ID NO: 665036 - RNA, 13 nt, Escherichia coli CFT073
auccgguuuucug

SEQ ID NO: 665037 - RNA, 13 nt, Escherichia coli CFT073
auccgguguggca

SEQ ID NO: 665038 - RNA, 16 nt, Escherichia coli CFT073
auccggugauugcugc

SEQ ID NO: 665039 - RNA, 18 nt, Escherichia coli CFT073
auccggugauugcugccg

SEQ ID NO: 665040 - RNA, 22 nt, Escherichia coli CFT073
auccggucuaccgauccggcac

SEQ ID NO: 665041 - RNA, 21 nt, Escherichia coli CFT073
auccggucccuucugccacca

SEQ ID NO: 665042 - RNA, 22 nt, Escherichia coli CFT073
auccguauuccugaaucagcca

SEQ ID NO: 665043 - RNA, 18 nt, Escherichia coli CFT073
auccgucccaauucuucc

SEQ ID NO: 665044 - RNA, 20 nt, Escherichia coli CFT073
auccgucgccguaauuaaca

SEQ ID NO: 665045 - RNA, 20 nt, Escherichia coli CFT073
auccccuucauuaagaauca

SEQ ID NO: 665046 - RNA, 21 nt, Escherichia coli CFT073
auccccugcccgauaaaagca

SEQ ID NO: 665047 - RNA, 22 nt, Escherichia coli CFT073
auccccugcccgauaaaagcaa

SEQ ID NO: 665048 - RNA, 19 nt, Escherichia coli CFT073
auccggcuauauugcagga

SEQ ID NO: 665049 - RNA, 19 nt, Escherichia coli CFT073
auccggcugauaaggcggc

SEQ ID NO: 665050 - RNA, 23 nt, Escherichia coli CFT073
auccggcuucuuuugcugccuuc

SEQ ID NO: 665051 - RNA, 15 nt, Escherichia coli CFT073
auccggcuuucacuu

SEQ ID NO: 665052 - RNA, 12 nt, Escherichia coli CFT073
auccgggcuauc

SEQ ID NO: 665053 - RNA, 16 nt, Escherichia coli CFT073
auccggccaucaguau

SEQ ID NO: 665054 - RNA, 16 nt, Escherichia coli CFT073
auccggccauuuucau

SEQ ID NO: 665055 - RNA, 17 nt, Escherichia coli CFT073
auccggccuaccgcauc

SEQ ID NO: 665056 - RNA, 16 nt, Escherichia coli CFT073
auccggcaugaacaaa

SEQ ID NO: 665057 - RNA, 15 nt, Escherichia coli CFT073
auccggcauuaucac

SEQ ID NO: 665058 - RNA, 19 nt, Escherichia coli CFT073
auccggcauuuauuccgca

SEQ ID NO: 665059 - RNA, 20 nt, Escherichia coli CFT073
auccggcauuugagcaggau

SEQ ID NO: 665060 - RNA, 19 nt, Escherichia coli CFT073
auccggcaauaacucccag

SEQ ID NO: 665061 - RNA, 19 nt, Escherichia coli CFT073
auccggcaauuuugcgccg

SEQ ID NO: 665062 - RNA, 16 nt, Escherichia coli CFT073
auccggcaucuuguuc

SEQ ID NO: 665063 - RNA, 18 nt, Escherichia coli CFT073
auccggcaucuuguucau

SEQ ID NO: 665064 - RNA, 13 nt, Escherichia coli CFT073
aucccacucauca

SEQ ID NO: 665065 - RNA, 22 nt, Escherichia coli CFT073
aucccacauccgaccaaagaau

SEQ ID NO: 665066 - RNA, 11 nt, Escherichia coli CFT073
aucccacacug

SEQ ID NO: 665067 - RNA, 12 nt, Escherichia coli CFT073
aucccacacugu

SEQ ID NO: 665068 - RNA, 12 nt, Escherichia coli CFT073
auccccacaaac

SEQ ID NO: 665069 - RNA, 19 nt, Escherichia coli CFT073
auccccaccaaaacagcga

SEQ ID NO: 665070 - RNA, 14 nt, Escherichia coli CFT073
auccccagaaugcc

SEQ ID NO: 665071 - RNA, 16 nt, Escherichia coli CFT073
aucccauuucuccacu

SEQ ID NO: 665072 - RNA, 21 nt, Escherichia coli CFT073
aucccauuucuccacugggag

SEQ ID NO: 665073 - RNA, 13 nt, Escherichia coli CFT073
auccaugaagcaa

SEQ ID NO: 665074 - RNA, 16 nt, Escherichia coli CFT073
auccaugaagcaauga

SEQ ID NO: 665075 - RNA, 18 nt, Escherichia coli CFT073
auccaugacaucuccagc

SEQ ID NO: 665076 - RNA, 18 nt, Escherichia coli CFT073
auccaucucgguuuucag

SEQ ID NO: 665077 - RNA, 18 nt, Escherichia coli CFT073
auccaugcgcauaagacc

SEQ ID NO: 665078 - RNA, 18 nt, Escherichia coli CFT073
auccaucguugaauacau

SEQ ID NO: 665079 - RNA, 21 nt, Escherichia coli CFT073
auccaucguugaauacauuca

SEQ ID NO: 665080 - RNA, 15 nt, Escherichia coli CFT073
auccauaccagcaca

SEQ ID NO: 665081 - RNA, 16 nt, Escherichia coli CFT073
auccauaccagcacau

SEQ ID NO: 665082 - RNA, 15 nt, Escherichia coli CFT073
auccauacucuuucc

SEQ ID NO: 665083 - RNA, 22 nt, Escherichia coli CFT073
auccauaguguguuccucugcu

SEQ ID NO: 665084 - RNA, 20 nt, Escherichia coli CFT073
auccauaucgccauugcugg

SEQ ID NO: 665085 - RNA, 13 nt, Escherichia coli CFT073
auccaucaaaggu

SEQ ID NO: 665086 - RNA, 18 nt, Escherichia coli CFT073
auccauaucgauuucuac

SEQ ID NO: 665087 - RNA, 14 nt, Escherichia coli CFT073
auccaguaccugau

SEQ ID NO: 665088 - RNA, 22 nt, Escherichia coli CFT073
auccaguauauugcugauuuuc

SEQ ID NO: 665089 - RNA, 20 nt, Escherichia coli CFT073
auccagcuuuuagaucacuc

SEQ ID NO: 665090 - RNA, 20 nt, Escherichia coli CFT073
auccagugcucauccuucag

SEQ ID NO: 665091 - RNA, 16 nt, Escherichia coli CFT073
auccaguuccacaccu

SEQ ID NO: 665092 - RNA, 22 nt, Escherichia coli CFT073
auccaguuccacaccuacgccc

SEQ ID NO: 665093 - RNA, 13 nt, Escherichia coli CFT073
auccaguuccagu

SEQ ID NO: 665094 - RNA, 14 nt, Escherichia coli CFT073
auccaguuccaguu

SEQ ID NO: 665095 - RNA, 15 nt, Escherichia coli CFT073
auccaguuccuucaa

SEQ ID NO: 665096 - RNA, 19 nt, Escherichia coli CFT073
auccaacuccacgaucuuu

SEQ ID NO: 665097 - RNA, 20 nt, Escherichia coli CFT073
aucauugccgguuggcgacu

SEQ ID NO: 665098 - RNA, 20 nt, Escherichia coli CFT073
aucauugcgccgaacaacag

SEQ ID NO: 665099 - RNA, 23 nt, Escherichia coli CFT073
aucauugcuguuuuacagcugcu

SEQ ID NO: 665100 - RNA, 15 nt, Escherichia coli CFT073
auccaaacauggcac

SEQ ID NO: 665101 - RNA, 19 nt, Escherichia coli CFT073
auccaaaccgacugccugc

SEQ ID NO: 665102 - RNA, 17 nt, Escherichia coli CFT073
auccaaacuuacccuuc

SEQ ID NO: 665103 - RNA, 13 nt, Escherichia coli CFT073
auccacagcaaug

SEQ ID NO: 665104 - RNA, 19 nt, Escherichia coli CFT073
auccacacugguucccaga

SEQ ID NO: 665105 - RNA, 20 nt, Escherichia coli CFT073
auccaacugauuuucaucuu

SEQ ID NO: 665106 - RNA, 13 nt, Escherichia coli CFT073
auccacgaccaga

SEQ ID NO: 665107 - RNA, 21 nt, Escherichia coli CFT073
auccacauuagucauuacuca

SEQ ID NO: 665108 - RNA, 18 nt, Escherichia coli CFT073
auccagauccaauaccgc

SEQ ID NO: 665109 - RNA, 15 nt, Escherichia coli CFT073
auccacugaaacaug

SEQ ID NO: 665110 - RNA, 21 nt, Escherichia coli CFT073
auccacugaaacaugaacauc

SEQ ID NO: 665111 - RNA, 18 nt, Escherichia coli CFT073
auccacgccuuuuuucac

SEQ ID NO: 665112 - RNA, 19 nt, Escherichia coli CFT073
auccacgcauuaauaaggu

SEQ ID NO: 665113 - RNA, 20 nt, Escherichia coli CFT073
auccacgcuguaaugcuaua

SEQ ID NO: 665114 - RNA, 18 nt, Escherichia coli CFT073
auccacguuucuucuaau

SEQ ID NO: 665115 - RNA, 23 nt, Escherichia coli CFT073
auccagcaccacuacagcggaac

SEQ ID NO: 665116 - RNA, 14 nt, Escherichia coli CFT073
auccagcaccgcuu

SEQ ID NO: 665117 - RNA, 10 nt, Escherichia coli CFT073
auccagcaac

SEQ ID NO: 665118 - RNA, 21 nt, Escherichia coli CFT073
auccagcagagauacaggcca

SEQ ID NO: 665119 - RNA, 18 nt, Escherichia coli CFT073
auccagcucaagugccag

SEQ ID NO: 665120 - RNA, 20 nt, Escherichia coli CFT073
auccagcucaagugccagau

SEQ ID NO: 665121 - RNA, 12 nt, Escherichia coli CFT073
auccagcggcag

SEQ ID NO: 665122 - RNA, 17 nt, Escherichia coli CFT073
aucauucugcaaggcaa

SEQ ID NO: 665123 - RNA, 15 nt, Escherichia coli CFT073
aucauucgcagcugc

SEQ ID NO: 665124 - RNA, 19 nt, Escherichia coli CFT073
aucauucgcccgccgagaa

SEQ ID NO: 665125 - RNA, 22 nt, Escherichia coli CFT073
aaaagaaugacccauuuguuau

SEQ ID NO: 665126 - RNA, 17 nt, Escherichia coli CFT073
aaaacuguuuacgcagc

SEQ ID NO: 665127 - RNA, 13 nt, Escherichia coli CFT073
aucauguggcugg

SEQ ID NO: 665128 - RNA, 14 nt, Escherichia coli CFT073
aucauguggcugga

SEQ ID NO: 665129 - RNA, 20 nt, Escherichia coli CFT073
aaaagaaauaucccugaaua

SEQ ID NO: 665130 - RNA, 16 nt, Escherichia coli CFT073
aucauguaguaaugcu

SEQ ID NO: 665131 - RNA, 22 nt, Escherichia coli CFT073
aucauguaaaucaauuaaucca

SEQ ID NO: 665132 - RNA, 21 nt, Escherichia coli CFT073
aaaacugaagcgcgccuggcg

SEQ ID NO: 665133 - RNA, 22 nt, Escherichia coli CFT073
aaaacucgucugauuucuuauu

SEQ ID NO: 665134 - RNA, 14 nt, Escherichia coli CFT073
aucauggcucagau

SEQ ID NO: 665135 - RNA, 20 nt, Escherichia coli CFT073
aucaugguagcgugauggcc

SEQ ID NO: 665136 - RNA, 20 nt, Escherichia coli CFT073
aucaugcuccuguaauggcu

SEQ ID NO: 665137 - RNA, 17 nt, Escherichia coli CFT073
aucaugcggauuaauaa

SEQ ID NO: 665138 - RNA, 20 nt, Escherichia coli CFT073
aucaugcuuaaauauuuuuu

SEQ ID NO: 665139 - RNA, 20 nt, Escherichia coli CFT073
aaaacguggccuccaaaaaa

SEQ ID NO: 665140 - RNA, 13 nt, Escherichia coli CFT073
aaaacgugcagcu

SEQ ID NO: 665141 - RNA, 19 nt, Escherichia coli CFT073
aaaacguggccuccaaaaa

SEQ ID NO: 665142 - RNA, 15 nt, Escherichia coli CFT073
aucauaauuauaaua

SEQ ID NO: 665143 - RNA, 18 nt, Escherichia coli CFT073
aaaacuaucugaaaauga

SEQ ID NO: 665144 - RNA, 16 nt, Escherichia coli CFT073
aaaacucaaaaaaaau

SEQ ID NO: 665145 - RNA, 18 nt, Escherichia coli CFT073
aucaucgcggcacacagc

SEQ ID NO: 665146 - RNA, 15 nt, Escherichia coli CFT073
aucaucgcuuucaaa

SEQ ID NO: 665147 - RNA, 21 nt, Escherichia coli CFT073
aucaucggcaccgccagcagg

SEQ ID NO: 665148 - RNA, 20 nt, Escherichia coli CFT073
aucaucucggguuguugcau

SEQ ID NO: 665149 - RNA, 22 nt, Escherichia coli CFT073
aucaucggucaguuugccccau

SEQ ID NO: 665150 - RNA, 22 nt, Escherichia coli CFT073
aucaucgucguuucuuuuuuau

SEQ ID NO: 665151 - RNA, 16 nt, Escherichia coli CFT073
aucaugaugaugccaa

SEQ ID NO: 665152 - RNA, 17 nt, Escherichia coli CFT073
aucaugaugaugccaaa

SEQ ID NO: 665153 - RNA, 18 nt, Escherichia coli CFT073
aucaugcaguaccagaua

SEQ ID NO: 665154 - RNA, 17 nt, Escherichia coli CFT073
aucaugccaaaaauaau

SEQ ID NO: 665155 - RNA, 17 nt, Escherichia coli CFT073
aucaugaaacuggguau

SEQ ID NO: 665156 - RNA, 18 nt, Escherichia coli CFT073
caaaagacguuaacguuc

SEQ ID NO: 665157 - RNA, 19 nt, Escherichia coli CFT073
caaaagagaggauaugcau

SEQ ID NO: 665158 - RNA, 18 nt, Escherichia coli CFT073
caaaagcaauaauuucaa

SEQ ID NO: 665159 - RNA, 22 nt, Escherichia coli CFT073
caaaagcaauauuggcacuggg

SEQ ID NO: 665160 - RNA, 21 nt, Escherichia coli CFT073
caaaagcaggcaccgcgccca

SEQ ID NO: 665161 - RNA, 18 nt, Escherichia coli CFT073
caaaagauuauugcuuga

SEQ ID NO: 665162 - RNA, 16 nt, Escherichia coli CFT073
caaaacuguaucccag

SEQ ID NO: 665163 - RNA, 17 nt, Escherichia coli CFT073
caaaacuguaucccagc

SEQ ID NO: 665164 - RNA, 17 nt, Escherichia coli CFT073
caaaacguuauuuugcu

SEQ ID NO: 665165 - RNA, 18 nt, Escherichia coli CFT073
caaaacgugcagcugccu

SEQ ID NO: 665166 - RNA, 20 nt, Escherichia coli CFT073
caaaacguggccuccaaaaa

SEQ ID NO: 665167 - RNA, 19 nt, Escherichia coli CFT073
caaaacgcgugacaccauc

SEQ ID NO: 665168 - RNA, 14 nt, Escherichia coli CFT073
caaaaccuuucacc

SEQ ID NO: 665169 - RNA, 16 nt, Escherichia coli CFT073
caaaaagaaacucuau

SEQ ID NO: 665170 - RNA, 19 nt, Escherichia coli CFT073
caaaaccuggacaguuuca

SEQ ID NO: 665171 - RNA, 18 nt, Escherichia coli CFT073
caaaauucauaaagcuau

SEQ ID NO: 665172 - RNA, 12 nt, Escherichia coli CFT073
caaaauuuuugc

SEQ ID NO: 665173 - RNA, 16 nt, Escherichia coli CFT073
caaaauuuuugccaau

SEQ ID NO: 665174 - RNA, 15 nt, Escherichia coli CFT073
caaaauguugcgccu

SEQ ID NO: 665175 - RNA, 14 nt, Escherichia coli CFT073
caaaauuaccuuua

SEQ ID NO: 665176 - RNA, 20 nt, Escherichia coli CFT073
caaaaucuucguuaucccag

SEQ ID NO: 665177 - RNA, 13 nt, Escherichia coli CFT073
caaaauccccuuc

SEQ ID NO: 665178 - RNA, 14 nt, Escherichia coli CFT073
caaaauccccuuca

SEQ ID NO: 665179 - RNA, 15 nt, Escherichia coli CFT073
caaaauccgccaccg

SEQ ID NO: 665180 - RNA, 19 nt, Escherichia coli CFT073
caaaaucggcguaauguug

SEQ ID NO: 665181 - RNA, 17 nt, Escherichia coli CFT073
caaaauagaaauuuagu

SEQ ID NO: 665182 - RNA, 18 nt, Escherichia coli CFT073
caaaauagguaucguaau

SEQ ID NO: 665183 - RNA, 13 nt, Escherichia coli CFT073
caaaauaccaaua

SEQ ID NO: 665184 - RNA, 15 nt, Escherichia coli CFT073
caaaauacaggaaau

SEQ ID NO: 665185 - RNA, 21 nt, Escherichia coli CFT073
caaaagugcgccgaggaaaca

SEQ ID NO: 665186 - RNA, 17 nt, Escherichia coli CFT073
caaaauacggcauugac

SEQ ID NO: 665187 - RNA, 21 nt, Escherichia coli CFT073
caaaauacguuuucaccucug

SEQ ID NO: 665188 - RNA, 18 nt, Escherichia coli CFT073
caaaaggcaauucaauua

SEQ ID NO: 665189 - RNA, 17 nt, Escherichia coli CFT073
caaagccgcgugcgcug

SEQ ID NO: 665190 - RNA, 13 nt, Escherichia coli CFT073
caaagcaaauaau

SEQ ID NO: 665191 - RNA, 17 nt, Escherichia coli CFT073
caaaggcgacaauaaau

SEQ ID NO: 665192 - RNA, 14 nt, Escherichia coli CFT073
caaaggccagccag

SEQ ID NO: 665193 - RNA, 13 nt, Escherichia coli CFT073
caaagcgcugaau

SEQ ID NO: 665194 - RNA, 17 nt, Escherichia coli CFT073
caaagcgacgugcagua

SEQ ID NO: 665195 - RNA, 19 nt, Escherichia coli CFT073
caaagcgauucgucacuuu

SEQ ID NO: 665196 - RNA, 15 nt, Escherichia coli CFT073
caaagcgcacuuuau

SEQ ID NO: 665197 - RNA, 22 nt, Escherichia coli CFT073
caaagacaucgcuggaggcauc

SEQ ID NO: 665198 - RNA, 19 nt, Escherichia coli CFT073
caaagaaacggaagcccca

SEQ ID NO: 665199 - RNA, 16 nt, Escherichia coli CFT073
caaacgcuuuacucaa

SEQ ID NO: 665200 - RNA, 23 nt, Escherichia coli CFT073
caaacgcuuuacucaacuccccg

SEQ ID NO: 665201 - RNA, 19 nt, Escherichia coli CFT073
caaacgguaucuuuccagc

SEQ ID NO: 665202 - RNA, 18 nt, Escherichia coli CFT073
caaacgucagcugccagu

SEQ ID NO: 665203 - RNA, 15 nt, Escherichia coli CFT073
caaacugugcaccgc

SEQ ID NO: 665204 - RNA, 22 nt, Escherichia coli CFT073
caaacugguugaaauaaaccag

SEQ ID NO: 665205 - RNA, 23 nt, Escherichia coli CFT073
caaacugguugaaauaaaccagu

SEQ ID NO: 665206 - RNA, 16 nt, Escherichia coli CFT073
caaacguggugccauu

SEQ ID NO: 665207 - RNA, 16 nt, Escherichia coli CFT073
caaacuucgccacagc

SEQ ID NO: 665208 - RNA, 13 nt, Escherichia coli CFT073
caaacuucuucag

SEQ ID NO: 665209 - RNA, 12 nt, Escherichia coli CFT073
caaacuuaugca

SEQ ID NO: 665210 - RNA, 22 nt, Escherichia coli CFT073
caaacuugcguaucgaccagaa

SEQ ID NO: 665211 - RNA, 13 nt, Escherichia coli CFT073
caaacuuuuaaau

SEQ ID NO: 665212 - RNA, 14 nt, Escherichia coli CFT073
caaaccguaaagca

SEQ ID NO: 665213 - RNA, 21 nt, Escherichia coli CFT073
caaaccauagaauacgccacg

SEQ ID NO: 665214 - RNA, 18 nt, Escherichia coli CFT073
caaaccaugauuccccag

SEQ ID NO: 665215 - RNA, 22 nt, Escherichia coli CFT073
caaaccaucugauucuucccau

SEQ ID NO: 665216 - RNA, 14 nt, Escherichia coli CFT073
caaaccgcccagca

SEQ ID NO: 665217 - RNA, 23 nt, Escherichia coli CFT073
caaaccagguaucguuacgccag

SEQ ID NO: 665218 - RNA, 18 nt, Escherichia coli CFT073
caaaccagcccgacugga

SEQ ID NO: 665219 - RNA, 18 nt, Escherichia coli CFT073
caaacaacgccacacgca

SEQ ID NO: 665220 - RNA, 14 nt, Escherichia coli CFT073
caaaccaacaagca

SEQ ID NO: 665221 - RNA, 22 nt, Escherichia coli CFT073
caacagugccggucagacagcg

SEQ ID NO: 665222 - RNA, 13 nt, Escherichia coli CFT073
caacaguucaugg

SEQ ID NO: 665223 - RNA, 19 nt, Escherichia coli CFT073
caacaguaaggccugguuc

SEQ ID NO: 665224 - RNA, 15 nt, Escherichia coli CFT073
caacaguaauaaugc

SEQ ID NO: 665225 - RNA, 13 nt, Escherichia coli CFT073
caacagcgcgccc

SEQ ID NO: 665226 - RNA, 22 nt, Escherichia coli CFT073
caacagcgugaacugggccugc

SEQ ID NO: 665227 - RNA, 17 nt, Escherichia coli CFT073
caacaucauuaacgccu

SEQ ID NO: 665228 - RNA, 21 nt, Escherichia coli CFT073
caacaucaucacgcagagcau

SEQ ID NO: 665229 - RNA, 15 nt, Escherichia coli CFT073
caacaucgacauaau

SEQ ID NO: 665230 - RNA, 15 nt, Escherichia coli CFT073
caacaucgguacaca

SEQ ID NO: 665231 - RNA, 20 nt, Escherichia coli CFT073
caacaucgguacacaaaaau

SEQ ID NO: 665232 - RNA, 19 nt, Escherichia coli CFT073
caacaaagccgcuuaauaa

SEQ ID NO: 665233 - RNA, 18 nt, Escherichia coli CFT073
caacaaaccaaaaccgcu

SEQ ID NO: 665234 - RNA, 15 nt, Escherichia coli CFT073
caacaaacuuaugcu

SEQ ID NO: 665235 - RNA, 22 nt, Escherichia coli CFT073
caacagauuucgaaucuucuga

SEQ ID NO: 665236 - RNA, 19 nt, Escherichia coli CFT073
caacagauuuugcaggccu

SEQ ID NO: 665237 - RNA, 20 nt, Escherichia coli CFT073
caacagcaaagagagcagcg

SEQ ID NO: 665238 - RNA, 16 nt, Escherichia coli CFT073
caacagcagccacacc

SEQ ID NO: 665239 - RNA, 14 nt, Escherichia coli CFT073
caacaccagcaguc

SEQ ID NO: 665240 - RNA, 18 nt, Escherichia coli CFT073
caacaccaucgaaauuag

SEQ ID NO: 665241 - RNA, 13 nt, Escherichia coli CFT073
caacauuuccagc

SEQ ID NO: 665242 - RNA, 11 nt, Escherichia coli CFT073
caaccagcagg

SEQ ID NO: 665243 - RNA, 18 nt, Escherichia coli CFT073
caaccagcauaacguggc

SEQ ID NO: 665244 - RNA, 20 nt, Escherichia coli CFT073
caaccagcaccuuuuccagu

SEQ ID NO: 665245 - RNA, 22 nt, Escherichia coli CFT073
caaccagcgucgcaucaggcgu

SEQ ID NO: 665246 - RNA, 23 nt, Escherichia coli CFT073
caaccaggccuuccggguuuucu

SEQ ID NO: 665247 - RNA, 20 nt, Escherichia coli CFT073
caacaugcggugauuuugcc

SEQ ID NO: 665248 - RNA, 20 nt, Escherichia coli CFT073
caacaugccgaauccgggaa

SEQ ID NO: 665249 - RNA, 21 nt, Escherichia coli CFT073
caacauggcgcggcacaccag

SEQ ID NO: 665250 - RNA, 13 nt, Escherichia coli CFT073
caacaucuucacc

SEQ ID NO: 665251 - RNA, 19 nt, Escherichia coli CFT073
caacauggucaucaucauu

SEQ ID NO: 665252 - RNA, 17 nt, Escherichia coli CFT073
caacccaaacgguaucu

SEQ ID NO: 665253 - RNA, 17 nt, Escherichia coli CFT073
caaccaugguuucaaac

SEQ ID NO: 665254 - RNA, 22 nt, Escherichia coli CFT073
caacccacaaaaacaccgcugu

SEQ ID NO: 665255 - RNA, 16 nt, Escherichia coli CFT073
caacccagaaacaggc

SEQ ID NO: 665256 - RNA, 18 nt, Escherichia coli CFT073
caaccagugcaccagcuu

SEQ ID NO: 665257 - RNA, 22 nt, Escherichia coli CFT073
caaccauaucgcauaccaucca

SEQ ID NO: 665258 - RNA, 14 nt, Escherichia coli CFT073
caaccaucaguacc

SEQ ID NO: 665259 - RNA, 17 nt, Escherichia coli CFT073
caaccaucaucccuaau

SEQ ID NO: 665260 - RNA, 16 nt, Escherichia coli CFT073
caaccauccccaaaaa

SEQ ID NO: 665261 - RNA, 20 nt, Escherichia coli CFT073
caacccgugagucuccuuua

SEQ ID NO: 665262 - RNA, 18 nt, Escherichia coli CFT073
caaccggaaccagcgccu

SEQ ID NO: 665263 - RNA, 13 nt, Escherichia coli CFT073
caaauaguaagaa

SEQ ID NO: 665264 - RNA, 19 nt, Escherichia coli CFT073
caaauaguaagaaccacag

SEQ ID NO: 665265 - RNA, 21 nt, Escherichia coli CFT073
caaauaguaagaaccacagcc

SEQ ID NO: 665266 - RNA, 22 nt, Escherichia coli CFT073
caaaguaggccguacagcccag

SEQ ID NO: 665267 - RNA, 18 nt, Escherichia coli CFT073
caaagucaauaaaaagcg

SEQ ID NO: 665268 - RNA, 10 nt, Escherichia coli CFT073
caaagggagc

SEQ ID NO: 665269 - RNA, 19 nt, Escherichia coli CFT073
caaaggcugugaaaguugg

SEQ ID NO: 665270 - RNA, 20 nt, Escherichia coli CFT073
caaaguaccaucguccagca

SEQ ID NO: 665271 - RNA, 17 nt, Escherichia coli CFT073
caaauauguugcuuuaa

SEQ ID NO: 665272 - RNA, 15 nt, Escherichia coli CFT073
caaauauuucuuuau

SEQ ID NO: 665273 - RNA, 22 nt, Escherichia coli CFT073
caaaucgccgagaucaacagca

SEQ ID NO: 665274 - RNA, 15 nt, Escherichia coli CFT073
caaaucgcggcagug

SEQ ID NO: 665275 - RNA, 18 nt, Escherichia coli CFT073
caaaucgcucccucucca

SEQ ID NO: 665276 - RNA, 14 nt, Escherichia coli CFT073
caaaucgaaaucaa

SEQ ID NO: 665277 - RNA, 20 nt, Escherichia coli CFT073
caaauccccacaggcgaugc

SEQ ID NO: 665278 - RNA, 17 nt, Escherichia coli CFT073
caaauccccaguugugc

SEQ ID NO: 665279 - RNA, 18 nt, Escherichia coli CFT073
caaauccggcaaauaacg

SEQ ID NO: 665280 - RNA, 13 nt, Escherichia coli CFT073
caaaucacuauua

SEQ ID NO: 665281 - RNA, 20 nt, Escherichia coli CFT073
caaaucacuauuaaagaaag

SEQ ID NO: 665282 - RNA, 17 nt, Escherichia coli CFT073
caaaucacagcaccuua

SEQ ID NO: 665283 - RNA, 11 nt, Escherichia coli CFT073
caaaucaccaa

SEQ ID NO: 665284 - RNA, 12 nt, Escherichia coli CFT073
caaauccagcac

SEQ ID NO: 665285 - RNA, 15 nt, Escherichia coli CFT073
caaauccagccagcg

SEQ ID NO: 665286 - RNA, 15 nt, Escherichia coli CFT073
caaauccagucuuuc

SEQ ID NO: 665287 - RNA, 18 nt, Escherichia coli CFT073
caaauccaucagaccuuc

SEQ ID NO: 665288 - RNA, 17 nt, Escherichia coli CFT073
caaauccauuuucgaca

SEQ ID NO: 665289 - RNA, 21 nt, Escherichia coli CFT073
caaaugaaagcagcagcuguu

SEQ ID NO: 665290 - RNA, 16 nt, Escherichia coli CFT073
caaaugucagaaagaa

SEQ ID NO: 665291 - RNA, 22 nt, Escherichia coli CFT073
caaauguguucagcgacagauu

SEQ ID NO: 665292 - RNA, 15 nt, Escherichia coli CFT073
caaaugucaccagcc

SEQ ID NO: 665293 - RNA, 17 nt, Escherichia coli CFT073
caaaucugccguaacug

SEQ ID NO: 665294 - RNA, 17 nt, Escherichia coli CFT073
caaaucgugcaucuccu

SEQ ID NO: 665295 - RNA, 23 nt, Escherichia coli CFT073
caaaucgucgguguccacuuccg

SEQ ID NO: 665296 - RNA, 18 nt, Escherichia coli CFT073
caaauguugcaucgccug

SEQ ID NO: 665297 - RNA, 19 nt, Escherichia coli CFT073
caaauucauugcguaacau

SEQ ID NO: 665298 - RNA, 12 nt, Escherichia coli CFT073
caaauuccacac

SEQ ID NO: 665299 - RNA, 15 nt, Escherichia coli CFT073
caaauucgcuguaau

SEQ ID NO: 665300 - RNA, 20 nt, Escherichia coli CFT073
caaauucgggcgcugauucu

SEQ ID NO: 665301 - RNA, 16 nt, Escherichia coli CFT073
caaauugcugguauuu

SEQ ID NO: 665302 - RNA, 15 nt, Escherichia coli CFT073
caacggauauuguuu

SEQ ID NO: 665303 - RNA, 17 nt, Escherichia coli CFT073
caacggcacggaaagca

SEQ ID NO: 665304 - RNA, 18 nt, Escherichia coli CFT073
caacggcgucagccacaa

SEQ ID NO: 665305 - RNA, 21 nt, Escherichia coli CFT073
caacggcgucagccacaacaa

SEQ ID NO: 665306 - RNA, 16 nt, Escherichia coli CFT073
caacgggcaccgccgc

SEQ ID NO: 665307 - RNA, 22 nt, Escherichia coli CFT073
caacgguacgcguucaauaaua

SEQ ID NO: 665308 - RNA, 20 nt, Escherichia coli CFT073
caacggaaaagcaacaacca

SEQ ID NO: 665309 - RNA, 20 nt, Escherichia coli CFT073
caacggaccaauaaacgcca

SEQ ID NO: 665310 - RNA, 17 nt, Escherichia coli CFT073
caacgcugaauggcgau

SEQ ID NO: 665311 - RNA, 20 nt, Escherichia coli CFT073
caacgcgguuucgccgccag

SEQ ID NO: 665312 - RNA, 15 nt, Escherichia coli CFT073
caacgcuagcagcag

SEQ ID NO: 665313 - RNA, 14 nt, Escherichia coli CFT073
caacgccuucuucg

SEQ ID NO: 665314 - RNA, 20 nt, Escherichia coli CFT073
caaccucuggugugcguugc

SEQ ID NO: 665315 - RNA, 16 nt, Escherichia coli CFT073
caaccucaaaaagaaa

SEQ ID NO: 665316 - RNA, 19 nt, Escherichia coli CFT073
caaccuccuccggcaucuu

SEQ ID NO: 665317 - RNA, 20 nt, Escherichia coli CFT073
caaccuccuccggcaucuuu

SEQ ID NO: 665318 - RNA, 17 nt, Escherichia coli CFT073
caacgcgccgacgaauu

SEQ ID NO: 665319 - RNA, 22 nt, Escherichia coli CFT073
caacgcgccgcaacaauaaccc

SEQ ID NO: 665320 - RNA, 15 nt, Escherichia coli CFT073
caacgcggcaaaacc

SEQ ID NO: 665321 - RNA, 18 nt, Escherichia coli CFT073
caacgcggcccaacauaa

SEQ ID NO: 665322 - RNA, 16 nt, Escherichia coli CFT073
caaccguuucuuuuuc

SEQ ID NO: 665323 - RNA, 19 nt, Escherichia coli CFT073
caaccguucgggaaaauau

SEQ ID NO: 665324 - RNA, 23 nt, Escherichia coli CFT073
caaccggugcgcgaucuuccucu

SEQ ID NO: 665325 - RNA, 18 nt, Escherichia coli CFT073
caaccgggccgcagagau

SEQ ID NO: 665326 - RNA, 17 nt, Escherichia coli CFT073
caacguaggcacauucg

SEQ ID NO: 665327 - RNA, 21 nt, Escherichia coli CFT073
caacgugaccaguaccaccgc

SEQ ID NO: 665328 - RNA, 22 nt, Escherichia coli CFT073
caacguccucgucgagcagaau

SEQ ID NO: 665329 - RNA, 15 nt, Escherichia coli CFT073
caacguccuggcgcu

SEQ ID NO: 665330 - RNA, 14 nt, Escherichia coli CFT073
caacgguucugcug

SEQ ID NO: 665331 - RNA, 16 nt, Escherichia coli CFT073
caacgguucugcugcc

SEQ ID NO: 665332 - RNA, 17 nt, Escherichia coli CFT073
caacguacucugccacu

SEQ ID NO: 665333 - RNA, 17 nt, Escherichia coli CFT073
caacguagccugccauu

SEQ ID NO: 665334 - RNA, 18 nt, Escherichia coli CFT073
caacguguugcugcaugu

SEQ ID NO: 665335 - RNA, 18 nt, Escherichia coli CFT073
caacguuaccaagaaaga

SEQ ID NO: 665336 - RNA, 13 nt, Escherichia coli CFT073
caacguuccagca

SEQ ID NO: 665337 - RNA, 17 nt, Escherichia coli CFT073
caacguucguacugccc

SEQ ID NO: 665338 - RNA, 20 nt, Escherichia coli CFT073
caacucaccauucugggcuc

SEQ ID NO: 665339 - RNA, 24 nt, Escherichia coli CFT073
caacucacgauuguuaaucacauc

SEQ ID NO: 665340 - RNA, 13 nt, Escherichia coli CFT073
caacucaggaaca

SEQ ID NO: 665341 - RNA, 13 nt, Escherichia coli CFT073
caacugcccaggc

SEQ ID NO: 665342 - RNA, 18 nt, Escherichia coli CFT073
caacucuuuaauagauaa

SEQ ID NO: 665343 - RNA, 22 nt, Escherichia coli CFT073
caacucucgucgguucagagca

SEQ ID NO: 665344 - RNA, 14 nt, Escherichia coli CFT073
caacuccaccaaua

SEQ ID NO: 665345 - RNA, 20 nt, Escherichia coli CFT073
caacuuaaucaucaaugcca

SEQ ID NO: 665346 - RNA, 15 nt, Escherichia coli CFT073
caacugcuggacgau

SEQ ID NO: 665347 - RNA, 14 nt, Escherichia coli CFT073
caagcgcgcuguca

SEQ ID NO: 665348 - RNA, 13 nt, Escherichia coli CFT073
caagcgccgccag

SEQ ID NO: 665349 - RNA, 17 nt, Escherichia coli CFT073
caagccuuacuucacau

SEQ ID NO: 665350 - RNA, 17 nt, Escherichia coli CFT073
caagccuugcagccaga

SEQ ID NO: 665351 - RNA, 13 nt, Escherichia coli CFT073
caagcucauuucc

SEQ ID NO: 665352 - RNA, 20 nt, Escherichia coli CFT073
caagcguuucaucuucaguc

SEQ ID NO: 665353 - RNA, 14 nt, Escherichia coli CFT073
caagcuaaaccaau

SEQ ID NO: 665354 - RNA, 17 nt, Escherichia coli CFT073
caagcuaaaccaauaaa

SEQ ID NO: 665355 - RNA, 19 nt, Escherichia coli CFT073
caagcuaacgaacgcagug

SEQ ID NO: 665356 - RNA, 16 nt, Escherichia coli CFT073
caagcucucuucaucg

SEQ ID NO: 665357 - RNA, 15 nt, Escherichia coli CFT073
caagcucgcagagau

SEQ ID NO: 665358 - RNA, 15 nt, Escherichia coli CFT073
caagccaaucugcug

SEQ ID NO: 665359 - RNA, 20 nt, Escherichia coli CFT073
caagcauuuucucacuggcg

SEQ ID NO: 665360 - RNA, 14 nt, Escherichia coli CFT073
caagccguuaccua

SEQ ID NO: 665361 - RNA, 17 nt, Escherichia coli CFT073
caagauuagccaucauu

SEQ ID NO: 665362 - RNA, 15 nt, Escherichia coli CFT073
caagauuaaaauaua

SEQ ID NO: 665363 - RNA, 16 nt, Escherichia coli CFT073
caagauuaaaauauaa

SEQ ID NO: 665364 - RNA, 12 nt, Escherichia coli CFT073
caagauggggaa

SEQ ID NO: 665365 - RNA, 19 nt, Escherichia coli CFT073
caagauggggaauaagcug

SEQ ID NO: 665366 - RNA, 16 nt, Escherichia coli CFT073
caagacugacaaucaa

SEQ ID NO: 665367 - RNA, 22 nt, Escherichia coli CFT073
caagacugaguuuuauucuuuu

SEQ ID NO: 665368 - RNA, 12 nt, Escherichia coli CFT073
caagacuuugua

SEQ ID NO: 665369 - RNA, 14 nt, Escherichia coli CFT073
caagaguuuuaaaa

SEQ ID NO: 665370 - RNA, 14 nt, Escherichia coli CFT073
caagaucauacuga

SEQ ID NO: 665371 - RNA, 21 nt, Escherichia coli CFT073
caagaucggagccaaaaucaa

SEQ ID NO: 665372 - RNA, 16 nt, Escherichia coli CFT073
caagaucgcccugagg

SEQ ID NO: 665373 - RNA, 15 nt, Escherichia coli CFT073
caagaauuaaaauau

SEQ ID NO: 665374 - RNA, 17 nt, Escherichia coli CFT073
caagaauuaaaauauca

SEQ ID NO: 665375 - RNA, 17 nt, Escherichia coli CFT073
caagaauuacuucuuga

SEQ ID NO: 665376 - RNA, 19 nt, Escherichia coli CFT073
caagaauccuuauuuuuau

SEQ ID NO: 665377 - RNA, 21 nt, Escherichia coli CFT073
caagaauccuuauuuuuauaa

SEQ ID NO: 665378 - RNA, 22 nt, Escherichia coli CFT073
caagaaucgagcaauaaacacu

SEQ ID NO: 665379 - RNA, 23 nt, Escherichia coli CFT073
caagaaucgagcaauaaacacug

SEQ ID NO: 665380 - RNA, 19 nt, Escherichia coli CFT073
caagaaucaugccaaaaau

SEQ ID NO: 665381 - RNA, 20 nt, Escherichia coli CFT073
caagaaucaugccaaaaaua

SEQ ID NO: 665382 - RNA, 17 nt, Escherichia coli CFT073
caagaaugaccgccugc

SEQ ID NO: 665383 - RNA, 22 nt, Escherichia coli CFT073
caagaccaacacccacagccau

SEQ ID NO: 665384 - RNA, 17 nt, Escherichia coli CFT073
caagaauaguuuccagu

SEQ ID NO: 665385 - RNA, 13 nt, Escherichia coli CFT073
caagaaucaugcc

SEQ ID NO: 665386 - RNA, 12 nt, Escherichia coli CFT073
caacuucgcuua

SEQ ID NO: 665387 - RNA, 18 nt, Escherichia coli CFT073
caagaaggauauaaaaau

SEQ ID NO: 665388 - RNA, 19 nt, Escherichia coli CFT073
caagaaggauauaaaaaua

SEQ ID NO: 665389 - RNA, 14 nt, Escherichia coli CFT073
caacuucagcuucg

SEQ ID NO: 665390 - RNA, 12 nt, Escherichia coli CFT073
caacuucaguuu

SEQ ID NO: 665391 - RNA, 20 nt, Escherichia coli CFT073
caacuucauguauucuggcu

SEQ ID NO: 665392 - RNA, 16 nt, Escherichia coli CFT073
caacuucaacaguggc

SEQ ID NO: 665393 - RNA, 19 nt, Escherichia coli CFT073
caacuucaaggucaacauu

SEQ ID NO: 665394 - RNA, 16 nt, Escherichia coli CFT073
caacuucagcagcagc

SEQ ID NO: 665395 - RNA, 19 nt, Escherichia coli CFT073
caaucaguuuuuguugaua

SEQ ID NO: 665396 - RNA, 13 nt, Escherichia coli CFT073
caauccaguccac

SEQ ID NO: 665397 - RNA, 23 nt, Escherichia coli CFT073
caauccagggguuguuauuuccg

SEQ ID NO: 665398 - RNA, 16 nt, Escherichia coli CFT073
caauccacaagcacag

SEQ ID NO: 665399 - RNA, 21 nt, Escherichia coli CFT073
caauccacgcggguuuaccac

SEQ ID NO: 665400 - RNA, 17 nt, Escherichia coli CFT073
caaucacugccagaaua

SEQ ID NO: 665401 - RNA, 21 nt, Escherichia coli CFT073
caaucacuuucugcgccagcg

SEQ ID NO: 665402 - RNA, 21 nt, Escherichia coli CFT073
caaucacuuugcgcucgcuga

SEQ ID NO: 665403 - RNA, 12 nt, Escherichia coli CFT073
caaucagaugug

SEQ ID NO: 665404 - RNA, 15 nt, Escherichia coli CFT073
caaucagcacacaua

SEQ ID NO: 665405 - RNA, 12 nt, Escherichia coli CFT073
caaucagcaccg

SEQ ID NO: 665406 - RNA, 14 nt, Escherichia coli CFT073
caaucagcaccgcg

SEQ ID NO: 665407 - RNA, 20 nt, Escherichia coli CFT073
caaucagccgagcuucaaua

SEQ ID NO: 665408 - RNA, 19 nt, Escherichia coli CFT073
caaucagcgcagcacccag

SEQ ID NO: 665409 - RNA, 19 nt, Escherichia coli CFT073
caaucagcggcguaucuuc

SEQ ID NO: 665410 - RNA, 21 nt, Escherichia coli CFT073
caaucagcguuugcgacagua

SEQ ID NO: 665411 - RNA, 23 nt, Escherichia coli CFT073
caaucagguaagcgauaaaaaua

SEQ ID NO: 665412 - RNA, 19 nt, Escherichia coli CFT073
caaucgcauauuucaacga

SEQ ID NO: 665413 - RNA, 13 nt, Escherichia coli CFT073
caaucgccagauc

SEQ ID NO: 665414 - RNA, 18 nt, Escherichia coli CFT073
caaucgacucugaaugcc

SEQ ID NO: 665415 - RNA, 22 nt, Escherichia coli CFT073
caaucccgucuucgucuggcug

SEQ ID NO: 665416 - RNA, 19 nt, Escherichia coli CFT073
caaucccggaagccaccac

SEQ ID NO: 665417 - RNA, 21 nt, Escherichia coli CFT073
caaucgcccccaucaccggca

SEQ ID NO: 665418 - RNA, 18 nt, Escherichia coli CFT073
caaucgucugguuuuccu

SEQ ID NO: 665419 - RNA, 14 nt, Escherichia coli CFT073
caaucuacaaaaga

SEQ ID NO: 665420 - RNA, 20 nt, Escherichia coli CFT073
caaucugcucuggcagcacc

SEQ ID NO: 665421 - RNA, 13 nt, Escherichia coli CFT073
caaucugcuucuu

SEQ ID NO: 665422 - RNA, 22 nt, Escherichia coli CFT073
caaucugauagaacugcggcag

SEQ ID NO: 665423 - RNA, 15 nt, Escherichia coli CFT073
caaucugaugacuga

SEQ ID NO: 665424 - RNA, 19 nt, Escherichia coli CFT073
caauacguuucuuccacac

SEQ ID NO: 665425 - RNA, 14 nt, Escherichia coli CFT073
caauacgauuaacg

SEQ ID NO: 665426 - RNA, 16 nt, Escherichia coli CFT073
caauaucuaaaauguc

SEQ ID NO: 665427 - RNA, 14 nt, Escherichia coli CFT073
caauauccagcagg

SEQ ID NO: 665428 - RNA, 13 nt, Escherichia coli CFT073
caauauccagcgc

SEQ ID NO: 665429 - RNA, 17 nt, Escherichia coli CFT073
caauaucauuacgccag

SEQ ID NO: 665430 - RNA, 19 nt, Escherichia coli CFT073
caauauccauguaccagac

SEQ ID NO: 665431 - RNA, 20 nt, Escherichia coli CFT073
caauauagcgcguugcgcca

SEQ ID NO: 665432 - RNA, 11 nt, Escherichia coli CFT073
caauauauuug

SEQ ID NO: 665433 - RNA, 14 nt, Escherichia coli CFT073
caauaucaucaucc

SEQ ID NO: 665434 - RNA, 18 nt, Escherichia coli CFT073
caaucaaaagaacacaac

SEQ ID NO: 665435 - RNA, 16 nt, Escherichia coli CFT073
caaucaacgccaccau

SEQ ID NO: 665436 - RNA, 17 nt, Escherichia coli CFT073
caaucaaaugacugguu

SEQ ID NO: 665437 - RNA, 16 nt, Escherichia coli CFT073
caaucaaauuugccag

SEQ ID NO: 665438 - RNA, 19 nt, Escherichia coli CFT073
caaucacuacuacaucugc

SEQ ID NO: 665439 - RNA, 23 nt, Escherichia coli CFT073
caaucaccgggccgaugcggcug

SEQ ID NO: 665440 - RNA, 16 nt, Escherichia coli CFT073
caaucaccgccagcgg

SEQ ID NO: 665441 - RNA, 17 nt, Escherichia coli CFT073
caaucaccgccagcggc

SEQ ID NO: 665442 - RNA, 12 nt, Escherichia coli CFT073
caaucaccacca

SEQ ID NO: 665443 - RNA, 15 nt, Escherichia coli CFT073
caaucaccaccagcg

SEQ ID NO: 665444 - RNA, 17 nt, Escherichia coli CFT073
caaucacaaaaccgucg

SEQ ID NO: 665445 - RNA, 18 nt, Escherichia coli CFT073
caaucacacaaccaugca

SEQ ID NO: 665446 - RNA, 16 nt, Escherichia coli CFT073
caaucacaucaccaua

SEQ ID NO: 665447 - RNA, 15 nt, Escherichia coli CFT073
caagugccagaucag

SEQ ID NO: 665448 - RNA, 15 nt, Escherichia coli CFT073
caagugaacuuucuc

SEQ ID NO: 665449 - RNA, 21 nt, Escherichia coli CFT073
caagugcacuuugucagcaaa

SEQ ID NO: 665450 - RNA, 13 nt, Escherichia coli CFT073
caaguccugccag

SEQ ID NO: 665451 - RNA, 14 nt, Escherichia coli CFT073
caaguccugccaga

SEQ ID NO: 665452 - RNA, 14 nt, Escherichia coli CFT073
caaguccagcaccg

SEQ ID NO: 665453 - RNA, 20 nt, Escherichia coli CFT073
caaguauucacucugcugua

SEQ ID NO: 665454 - RNA, 15 nt, Escherichia coli CFT073
caagugagucggcuu

SEQ ID NO: 665455 - RNA, 20 nt, Escherichia coli CFT073
caagugagucggcuuuuuug

SEQ ID NO: 665456 - RNA, 12 nt, Escherichia coli CFT073
caagucagcaac

SEQ ID NO: 665457 - RNA, 22 nt, Escherichia coli CFT073
caagucagcaacgaugggugau

SEQ ID NO: 665458 - RNA, 14 nt, Escherichia coli CFT073
caagcugcugacau

SEQ ID NO: 665459 - RNA, 23 nt, Escherichia coli CFT073
caaggcaaaauacguuuucaccu

SEQ ID NO: 665460 - RNA, 18 nt, Escherichia coli CFT073
caaggaugcguuuuucgg

SEQ ID NO: 665461 - RNA, 15 nt, Escherichia coli CFT073
caaggauaucgucga

SEQ ID NO: 665462 - RNA, 17 nt, Escherichia coli CFT073
caaguucgaacgccgcc

SEQ ID NO: 665463 - RNA, 23 nt, Escherichia coli CFT073
caauaaacgccgucgccuucaua

SEQ ID NO: 665464 - RNA, 12 nt, Escherichia coli CFT073
caauaaacuggc

SEQ ID NO: 665465 - RNA, 11 nt, Escherichia coli CFT073
caauaaacauc

SEQ ID NO: 665466 - RNA, 16 nt, Escherichia coli CFT073
caauaaaccauaauau

SEQ ID NO: 665467 - RNA, 13 nt, Escherichia coli CFT073
caauaaaauaucu

SEQ ID NO: 665468 - RNA, 14 nt, Escherichia coli CFT073
caauaaaaaagccg

SEQ ID NO: 665469 - RNA, 17 nt, Escherichia coli CFT073
caauaagccaguccaga

SEQ ID NO: 665470 - RNA, 16 nt, Escherichia coli CFT073
caauaagcuguucaga

SEQ ID NO: 665471 - RNA, 22 nt, Escherichia coli CFT073
caauaaguacgauacaaaagca

SEQ ID NO: 665472 - RNA, 14 nt, Escherichia coli CFT073
caauaauuucucag

SEQ ID NO: 665473 - RNA, 14 nt, Escherichia coli CFT073
caauaauuucaaca

SEQ ID NO: 665474 - RNA, 22 nt, Escherichia coli CFT073
caauacagccagccagcaccag

SEQ ID NO: 665475 - RNA, 19 nt, Escherichia coli CFT073
caauacagcgaauagugga

SEQ ID NO: 665476 - RNA, 16 nt, Escherichia coli CFT073
caauacauaagcaccg

SEQ ID NO: 665477 - RNA, 17 nt, Escherichia coli CFT073
caauaccuucugcgccc

SEQ ID NO: 665478 - RNA, 22 nt, Escherichia coli CFT073
caauaccuucugcgcccgcccg

SEQ ID NO: 665479 - RNA, 23 nt, Escherichia coli CFT073
caauaccuucugcgcccgcccgc

SEQ ID NO: 665480 - RNA, 21 nt, Escherichia coli CFT073
cacgggcaauaucgacgccag

SEQ ID NO: 665481 - RNA, 13 nt, Escherichia coli CFT073
cacggcagcaacu

SEQ ID NO: 665482 - RNA, 14 nt, Escherichia coli CFT073
cacgcucccagcag

SEQ ID NO: 665483 - RNA, 16 nt, Escherichia coli CFT073
cacggauaaacguggu

SEQ ID NO: 665484 - RNA, 16 nt, Escherichia coli CFT073
cacgcucacucaucac

SEQ ID NO: 665485 - RNA, 22 nt, Escherichia coli CFT073
cacgcucacucaucacuccccg

SEQ ID NO: 665486 - RNA, 13 nt, Escherichia coli CFT073
cacgcucccagca

SEQ ID NO: 665487 - RNA, 14 nt, Escherichia coli CFT073
cacggacuuaugag

SEQ ID NO: 665488 - RNA, 22 nt, Escherichia coli CFT073
cacggacuuaugaguucgcggc

SEQ ID NO: 665489 - RNA, 15 nt, Escherichia coli CFT073
cacgcuacucgccug

SEQ ID NO: 665490 - RNA, 12 nt, Escherichia coli CFT073
cacgcucaccca

SEQ ID NO: 665491 - RNA, 13 nt, Escherichia coli CFT073
cacgcucacccau

SEQ ID NO: 665492 - RNA, 13 nt, Escherichia coli CFT073
cacgauuuuguag

SEQ ID NO: 665493 - RNA, 19 nt, Escherichia coli CFT073
cacgauuugcguaaaaccu

SEQ ID NO: 665494 - RNA, 19 nt, Escherichia coli CFT073
cacgcaagguuucaguaac

SEQ ID NO: 665495 - RNA, 13 nt, Escherichia coli CFT073
cacgcaaacuucg

SEQ ID NO: 665496 - RNA, 17 nt, Escherichia coli CFT073
cacgcaaacuucgguua

SEQ ID NO: 665497 - RNA, 21 nt, Escherichia coli CFT073
cacgcaaagcacgccaggugg

SEQ ID NO: 665498 - RNA, 23 nt, Escherichia coli CFT073
cacgccguuuuuacccagcagca

SEQ ID NO: 665499 - RNA, 21 nt, Escherichia coli CFT073
cacgccgcauccggcaaucaa

SEQ ID NO: 665500 - RNA, 22 nt, Escherichia coli CFT073
cacgccgguaugcgugcuucau

SEQ ID NO: 665501 - RNA, 17 nt, Escherichia coli CFT073
cacgccgguucccagac

SEQ ID NO: 665502 - RNA, 20 nt, Escherichia coli CFT073
cacgccgaagugcgcacagc

SEQ ID NO: 665503 - RNA, 19 nt, Escherichia coli CFT073
cacgccgaccagaccggca

SEQ ID NO: 665504 - RNA, 23 nt, Escherichia coli CFT073
cacgccgauaaucaacgcgccgc

SEQ ID NO: 665505 - RNA, 12 nt, Escherichia coli CFT073
cacgccuucuuc

SEQ ID NO: 665506 - RNA, 18 nt, Escherichia coli CFT073
cacgcgauggcuuuccac

SEQ ID NO: 665507 - RNA, 20 nt, Escherichia coli CFT073
cacgcgauggcuuuccaccu

SEQ ID NO: 665508 - RNA, 16 nt, Escherichia coli CFT073
cacgcgccagcuucac

SEQ ID NO: 665509 - RNA, 15 nt, Escherichia coli CFT073
cacgcgccacgcacg

SEQ ID NO: 665510 - RNA, 20 nt, Escherichia coli CFT073
cacgcgcuguaauuucacac

SEQ ID NO: 665511 - RNA, 13 nt, Escherichia coli CFT073
aaaauagcauaau

SEQ ID NO: 665512 - RNA, 18 nt, Escherichia coli CFT073
cacgacaaaugcgccgcc

SEQ ID NO: 665513 - RNA, 15 nt, Escherichia coli CFT073
cacgaaucgccucac

SEQ ID NO: 665514 - RNA, 12 nt, Escherichia coli CFT073
aaaauagaaauu

SEQ ID NO: 665515 - RNA, 22 nt, Escherichia coli CFT073
caccuucauucaggccaaagcc

SEQ ID NO: 665516 - RNA, 22 nt, Escherichia coli CFT073
caccuucagcgaagcccacacc

SEQ ID NO: 665517 - RNA, 17 nt, Escherichia coli CFT073
cacgaaacgaaacccaa

SEQ ID NO: 665518 - RNA, 13 nt, Escherichia coli CFT073
cacgaaacugcug

SEQ ID NO: 665519 - RNA, 14 nt, Escherichia coli CFT073
cacgaaaucccaca

SEQ ID NO: 665520 - RNA, 19 nt, Escherichia coli CFT073
cacgaaaucccacauccga

SEQ ID NO: 665521 - RNA, 13 nt, Escherichia coli CFT073
cacgaaaugaaua

SEQ ID NO: 665522 - RNA, 17 nt, Escherichia coli CFT073
cacgaccaggaacgcca

SEQ ID NO: 665523 - RNA, 22 nt, Escherichia coli CFT073
cacgacucauucccauaccuuu

SEQ ID NO: 665524 - RNA, 20 nt, Escherichia coli CFT073
cacgacuuguaccuucagcg

SEQ ID NO: 665525 - RNA, 18 nt, Escherichia coli CFT073
cacgagauuguaucccuu

SEQ ID NO: 665526 - RNA, 18 nt, Escherichia coli CFT073
cacgaugccucaucacaa

SEQ ID NO: 665527 - RNA, 22 nt, Escherichia coli CFT073
cacgaggugccaccagugcagg

SEQ ID NO: 665528 - RNA, 20 nt, Escherichia coli CFT073
cacgagucauuccugccccg

SEQ ID NO: 665529 - RNA, 13 nt, Escherichia coli CFT073
caccugcucagca

SEQ ID NO: 665530 - RNA, 23 nt, Escherichia coli CFT073
caccucauccugacaggcccccc

SEQ ID NO: 665531 - RNA, 21 nt, Escherichia coli CFT073
caccucaucaccacagacaaa

SEQ ID NO: 665532 - RNA, 20 nt, Escherichia coli CFT073
caccucaucaccacagacaa

SEQ ID NO: 665533 - RNA, 18 nt, Escherichia coli CFT073
aaaauaaucuguugauuu

SEQ ID NO: 665534 - RNA, 19 nt, Escherichia coli CFT073
caccuguaaaaaaggcagc

SEQ ID NO: 665535 - RNA, 16 nt, Escherichia coli CFT073
caccuguaaagucaca

SEQ ID NO: 665536 - RNA, 16 nt, Escherichia coli CFT073
caccuguguuguucug

SEQ ID NO: 665537 - RNA, 12 nt, Escherichia coli CFT073
aaaauacaugac

SEQ ID NO: 665538 - RNA, 19 nt, Escherichia coli CFT073
cacccugacuguuuuucca

SEQ ID NO: 665539 - RNA, 18 nt, Escherichia coli CFT073
cacccugaugcccaaaaa

SEQ ID NO: 665540 - RNA, 20 nt, Escherichia coli CFT073
caccgagagaaauagagaaa

SEQ ID NO: 665541 - RNA, 16 nt, Escherichia coli CFT073
caccgagcagcacaau

SEQ ID NO: 665542 - RNA, 20 nt, Escherichia coli CFT073
caccccgcgccgcugagaaa

SEQ ID NO: 665543 - RNA, 23 nt, Escherichia coli CFT073
caccccgguaaagcgcaugaugu

SEQ ID NO: 665544 - RNA, 16 nt, Escherichia coli CFT073
cacccgcagcaagcgu

SEQ ID NO: 665545 - RNA, 15 nt, Escherichia coli CFT073
cacccgucguugcaa

SEQ ID NO: 665546 - RNA, 15 nt, Escherichia coli CFT073
cacccgugcagguuc

SEQ ID NO: 665547 - RNA, 17 nt, Escherichia coli CFT073
cacccgguaaacaaaaa

SEQ ID NO: 665548 - RNA, 15 nt, Escherichia coli CFT073
cacccggucagccau

SEQ ID NO: 665549 - RNA, 20 nt, Escherichia coli CFT073
caccaguaacgcucccugga

SEQ ID NO: 665550 - RNA, 14 nt, Escherichia coli CFT073
caccaguccaucgg

SEQ ID NO: 665551 - RNA, 19 nt, Escherichia coli CFT073
cacccagcguuugcugcuu

SEQ ID NO: 665552 - RNA, 23 nt, Escherichia coli CFT073
cacccagcgaagcaaaccaggcc

SEQ ID NO: 665553 - RNA, 12 nt, Escherichia coli CFT073
cacccagcaauc

SEQ ID NO: 665554 - RNA, 15 nt, Escherichia coli CFT073
cacccagacuaauau

SEQ ID NO: 665555 - RNA, 13 nt, Escherichia coli CFT073
cacccagccccgg

SEQ ID NO: 665556 - RNA, 17 nt, Escherichia coli CFT073
caccccccauugggcca

SEQ ID NO: 665557 - RNA, 16 nt, Escherichia coli CFT073
caccccauagccagcg

SEQ ID NO: 665558 - RNA, 12 nt, Escherichia coli CFT073
cacccaggccau

SEQ ID NO: 665559 - RNA, 16 nt, Escherichia coli CFT073
cacccagucccaccau

SEQ ID NO: 665560 - RNA, 22 nt, Escherichia coli CFT073
cacccagucccaccaucagacc

SEQ ID NO: 665561 - RNA, 12 nt, Escherichia coli CFT073
cacccagugcgg

SEQ ID NO: 665562 - RNA, 19 nt, Escherichia coli CFT073
cacccaucgccguaccuuu

SEQ ID NO: 665563 - RNA, 22 nt, Escherichia coli CFT073
cacccauuuauccagcggcagc

SEQ ID NO: 665564 - RNA, 19 nt, Escherichia coli CFT073
cacccauuuauccagcggc

SEQ ID NO: 665565 - RNA, 17 nt, Escherichia coli CFT073
aaaauaaaucaaaguca

SEQ ID NO: 665566 - RNA, 17 nt, Escherichia coli CFT073
aaaauaaaggguaauau

SEQ ID NO: 665567 - RNA, 18 nt, Escherichia coli CFT073
caccggcauuuuuugcug

SEQ ID NO: 665568 - RNA, 12 nt, Escherichia coli CFT073
caccggcaucaa

SEQ ID NO: 665569 - RNA, 16 nt, Escherichia coli CFT073
caccgucacuucuucg

SEQ ID NO: 665570 - RNA, 15 nt, Escherichia coli CFT073
caccgucaaauccag

SEQ ID NO: 665571 - RNA, 21 nt, Escherichia coli CFT073
caccgggagauccagcauucc

SEQ ID NO: 665572 - RNA, 15 nt, Escherichia coli CFT073
caccguugagguuga

SEQ ID NO: 665573 - RNA, 18 nt, Escherichia coli CFT073
caccguugugaaaauaac

SEQ ID NO: 665574 - RNA, 15 nt, Escherichia coli CFT073
caccguccagaucau

SEQ ID NO: 665575 - RNA, 13 nt, Escherichia coli CFT073
caccguccagcgu

SEQ ID NO: 665576 - RNA, 12 nt, Escherichia coli CFT073
caccuacagcca

SEQ ID NO: 665577 - RNA, 15 nt, Escherichia coli CFT073
caccuacgcccgcca

SEQ ID NO: 665578 - RNA, 15 nt, Escherichia coli CFT073
caccucagccagcgg

SEQ ID NO: 665579 - RNA, 19 nt, Escherichia coli CFT073
caccucaggaaaagcaaaa

SEQ ID NO: 665580 - RNA, 18 nt, Escherichia coli CFT073
caccgcgaagcagcucca

SEQ ID NO: 665581 - RNA, 21 nt, Escherichia coli CFT073
caccgcgacaaucagguaagc

SEQ ID NO: 665582 - RNA, 23 nt, Escherichia coli CFT073
caccgcgauauuggucugcagau

SEQ ID NO: 665583 - RNA, 17 nt, Escherichia coli CFT073
caccgcgcggcugguaa

SEQ ID NO: 665584 - RNA, 21 nt, Escherichia coli CFT073
caccgccugcugauaagacgc

SEQ ID NO: 665585 - RNA, 16 nt, Escherichia coli CFT073
caccgccuaccgccag

SEQ ID NO: 665586 - RNA, 14 nt, Escherichia coli CFT073
caccgccuccagcg

SEQ ID NO: 665587 - RNA, 22 nt, Escherichia coli CFT073
caccgcauccggcaucaguaac

SEQ ID NO: 665588 - RNA, 17 nt, Escherichia coli CFT073
caccgccaaagauaaaa

SEQ ID NO: 665589 - RNA, 16 nt, Escherichia coli CFT073
caccgcagauaagacc

SEQ ID NO: 665590 - RNA, 17 nt, Escherichia coli CFT073
caccgaggccaaaacca

SEQ ID NO: 665591 - RNA, 12 nt, Escherichia coli CFT073
caccgcagaagc

SEQ ID NO: 665592 - RNA, 19 nt, Escherichia coli CFT073
caccgcgugaaucaacacc

SEQ ID NO: 665593 - RNA, 19 nt, Escherichia coli CFT073
caccgcgcuaaggccgcca

SEQ ID NO: 665594 - RNA, 17 nt, Escherichia coli CFT073
caccgcuaacugcugcg

SEQ ID NO: 665595 - RNA, 19 nt, Escherichia coli CFT073
caccgcuuuuuucaucucu

SEQ ID NO: 665596 - RNA, 23 nt, Escherichia coli CFT073
caccggaaauugcugccgcucca

SEQ ID NO: 665597 - RNA, 21 nt, Escherichia coli CFT073
caccgcuguugccagcagcaa

SEQ ID NO: 665598 - RNA, 22 nt, Escherichia coli CFT073
caccgcuguugcuuccaccauc

SEQ ID NO: 665599 - RNA, 13 nt, Escherichia coli CFT073
caccgcugcuucu

SEQ ID NO: 665600 - RNA, 18 nt, Escherichia coli CFT073
caccgcuucaacagcggc

SEQ ID NO: 665601 - RNA, 20 nt, Escherichia coli CFT073
caccgcuucacucccugccc

SEQ ID NO: 665602 - RNA, 12 nt, Escherichia coli CFT073
caccacuccuca

SEQ ID NO: 665603 - RNA, 19 nt, Escherichia coli CFT073
caccacugaauaacauuau

SEQ ID NO: 665604 - RNA, 13 nt, Escherichia coli CFT073
caccacugacaau

SEQ ID NO: 665605 - RNA, 20 nt, Escherichia coli CFT073
caccacuggcgauauugccg

SEQ ID NO: 665606 - RNA, 12 nt, Escherichia coli CFT073
caccacuuaauc

SEQ ID NO: 665607 - RNA, 16 nt, Escherichia coli CFT073
caccacuuccugcucg

SEQ ID NO: 665608 - RNA, 13 nt, Escherichia coli CFT073
caccacguagcau

SEQ ID NO: 665609 - RNA, 21 nt, Escherichia coli CFT073
caccacguagcaucugguaac

SEQ ID NO: 665610 - RNA, 16 nt, Escherichia coli CFT073
caccagaucuuccagc

SEQ ID NO: 665611 - RNA, 17 nt, Escherichia coli CFT073
caccagaucuuccagcg

SEQ ID NO: 665612 - RNA, 14 nt, Escherichia coli CFT073
caccagauccagca

SEQ ID NO: 665613 - RNA, 17 nt, Escherichia coli CFT073
caccagauccugccauu

SEQ ID NO: 665614 - RNA, 14 nt, Escherichia coli CFT073
caccagauggcuuu

SEQ ID NO: 665615 - RNA, 17 nt, Escherichia coli CFT073
caccagauggcuuucca

SEQ ID NO: 665616 - RNA, 17 nt, Escherichia coli CFT073
caccagaugguuaguau

SEQ ID NO: 665617 - RNA, 13 nt, Escherichia coli CFT073
caccagcaaauau

SEQ ID NO: 665618 - RNA, 18 nt, Escherichia coli CFT073
caccagcaauaaugccag

SEQ ID NO: 665619 - RNA, 22 nt, Escherichia coli CFT073
caccagcaauaaugccaguccc

SEQ ID NO: 665620 - RNA, 22 nt, Escherichia coli CFT073
caccaccuuacauauauuacuc

SEQ ID NO: 665621 - RNA, 14 nt, Escherichia coli CFT073
caccaccagcgccu

SEQ ID NO: 665622 - RNA, 16 nt, Escherichia coli CFT073
caccaccagcgccugg

SEQ ID NO: 665623 - RNA, 17 nt, Escherichia coli CFT073
caccaccagcgccuggu

SEQ ID NO: 665624 - RNA, 14 nt, Escherichia coli CFT073
caccaccagcagcu

SEQ ID NO: 665625 - RNA, 21 nt, Escherichia coli CFT073
caccaccagcgccaccacgcc

SEQ ID NO: 665626 - RNA, 16 nt, Escherichia coli CFT073
caccacgccacuaagc

SEQ ID NO: 665627 - RNA, 21 nt, Escherichia coli CFT073
caccacgaggaucgauaucac

SEQ ID NO: 665628 - RNA, 20 nt, Escherichia coli CFT073
caccacgccgauggcagaaa

SEQ ID NO: 665629 - RNA, 22 nt, Escherichia coli CFT073
caccacgcgccugcagcggcca

SEQ ID NO: 665630 - RNA, 23 nt, Escherichia coli CFT073
caccagccauuaaccagccacug

SEQ ID NO: 665631 - RNA, 19 nt, Escherichia coli CFT073
aaaagugcuguaaagcaca

SEQ ID NO: 665632 - RNA, 16 nt, Escherichia coli CFT073
caccaguaaaacgggc

SEQ ID NO: 665633 - RNA, 16 nt, Escherichia coli CFT073
caccagggaaauaauc

SEQ ID NO: 665634 - RNA, 14 nt, Escherichia coli CFT073
caccagcgucaguu

SEQ ID NO: 665635 - RNA, 22 nt, Escherichia coli CFT073
caccagcgucaucaauccugca

SEQ ID NO: 665636 - RNA, 21 nt, Escherichia coli CFT073
caccagcggaauuccggcuuc

SEQ ID NO: 665637 - RNA, 22 nt, Escherichia coli CFT073
caccagcgcugcggccugcugc

SEQ ID NO: 665638 - RNA, 14 nt, Escherichia coli CFT073
cacauuuuccauca

SEQ ID NO: 665639 - RNA, 18 nt, Escherichia coli CFT073
cacauucccuaugcugau

SEQ ID NO: 665640 - RNA, 14 nt, Escherichia coli CFT073
cacauuccagaugc

SEQ ID NO: 665641 - RNA, 15 nt, Escherichia coli CFT073
cacauuccagaugcg

SEQ ID NO: 665642 - RNA, 20 nt, Escherichia coli CFT073
cacauuccagaugcgccagu

SEQ ID NO: 665643 - RNA, 14 nt, Escherichia coli CFT073
caccaaaauaccac

SEQ ID NO: 665644 - RNA, 17 nt, Escherichia coli CFT073
caccaaaccaacaagca

SEQ ID NO: 665645 - RNA, 11 nt, Escherichia coli CFT073
cacauuuuuaa

SEQ ID NO: 665646 - RNA, 13 nt, Escherichia coli CFT073
cacauuuuuuacu

SEQ ID NO: 665647 - RNA, 12 nt, Escherichia coli CFT073
cacauuaaaaug

SEQ ID NO: 665648 - RNA, 15 nt, Escherichia coli CFT073
cacauguugcagggc

SEQ ID NO: 665649 - RNA, 14 nt, Escherichia coli CFT073
cacauuaucaaacg

SEQ ID NO: 665650 - RNA, 17 nt, Escherichia coli CFT073
cacaucgauguuugaca

SEQ ID NO: 665651 - RNA, 13 nt, Escherichia coli CFT073
caccacaacaccu

SEQ ID NO: 665652 - RNA, 15 nt, Escherichia coli CFT073
caccacaccagacca

SEQ ID NO: 665653 - RNA, 20 nt, Escherichia coli CFT073
caccacaccugccaccagca

SEQ ID NO: 665654 - RNA, 17 nt, Escherichia coli CFT073
caccacaaaccagcccg

SEQ ID NO: 665655 - RNA, 16 nt, Escherichia coli CFT073
caccaacugccucguc

SEQ ID NO: 665656 - RNA, 17 nt, Escherichia coli CFT073
caccacauucugcauug

SEQ ID NO: 665657 - RNA, 23 nt, Escherichia coli CFT073
caccacauugccaaaccacggcc

SEQ ID NO: 665658 - RNA, 19 nt, Escherichia coli CFT073
caccaccaaagguuaacug

SEQ ID NO: 665659 - RNA, 17 nt, Escherichia coli CFT073
caccacacgacgcgcca

SEQ ID NO: 665660 - RNA, 23 nt, Escherichia coli CFT073
caccacacgacgcgccagcagcg

SEQ ID NO: 665661 - RNA, 21 nt, Escherichia coli CFT073
caccacagacaaacagcucga

SEQ ID NO: 665662 - RNA, 22 nt, Escherichia coli CFT073
caccacauaagaucaucggcca

SEQ ID NO: 665663 - RNA, 13 nt, Escherichia coli CFT073
caccaaaugcagc

SEQ ID NO: 665664 - RNA, 18 nt, Escherichia coli CFT073
caccaaacugauuuagca

SEQ ID NO: 665665 - RNA, 14 nt, Escherichia coli CFT073
caccaaacugcucg

SEQ ID NO: 665666 - RNA, 23 nt, Escherichia coli CFT073
caccaaagaugucaccauuggca

SEQ ID NO: 665667 - RNA, 12 nt, Escherichia coli CFT073
caccaaaggcac

SEQ ID NO: 665668 - RNA, 16 nt, Escherichia coli CFT073
caccaacgauuuuuuc

SEQ ID NO: 665669 - RNA, 18 nt, Escherichia coli CFT073
caccaaccaucaggcaga

SEQ ID NO: 665670 - RNA, 19 nt, Escherichia coli CFT073
caccaacccaacuuauugu

SEQ ID NO: 665671 - RNA, 20 nt, Escherichia coli CFT073
cacauagcgugacaccagca

SEQ ID NO: 665672 - RNA, 18 nt, Escherichia coli CFT073
cacauacauaauaaucua

SEQ ID NO: 665673 - RNA, 15 nt, Escherichia coli CFT073
cacauacauguauaa

SEQ ID NO: 665674 - RNA, 16 nt, Escherichia coli CFT073
cacauacauguauaaa

SEQ ID NO: 665675 - RNA, 21 nt, Escherichia coli CFT073
cacauacugcuugccauucac

SEQ ID NO: 665676 - RNA, 17 nt, Escherichia coli CFT073
cacagcuauaccgccag

SEQ ID NO: 665677 - RNA, 12 nt, Escherichia coli CFT073
cacagcucugcu

SEQ ID NO: 665678 - RNA, 13 nt, Escherichia coli CFT073
cacagcucugcug

SEQ ID NO: 665679 - RNA, 16 nt, Escherichia coli CFT073
cacagcgugcauagca

SEQ ID NO: 665680 - RNA, 22 nt, Escherichia coli CFT073
cacagcgggguaaucgccagca

SEQ ID NO: 665681 - RNA, 18 nt, Escherichia coli CFT073
cacagccauggcauccaa

SEQ ID NO: 665682 - RNA, 23 nt, Escherichia coli CFT073
cacagccauggcauccaagcugg

SEQ ID NO: 665683 - RNA, 12 nt, Escherichia coli CFT073
cacauauucauu

SEQ ID NO: 665684 - RNA, 17 nt, Escherichia coli CFT073
cacauauucauuacuua

SEQ ID NO: 665685 - RNA, 21 nt, Escherichia coli CFT073
cacauauugcaccagaucuuc

SEQ ID NO: 665686 - RNA, 23 nt, Escherichia coli CFT073
cacauauugcaccagaucuucca

SEQ ID NO: 665687 - RNA, 15 nt, Escherichia coli CFT073
cacauauugcagcuu

SEQ ID NO: 665688 - RNA, 14 nt, Escherichia coli CFT073
cacaucaauauucc

SEQ ID NO: 665689 - RNA, 13 nt, Escherichia coli CFT073
cacaucaccauaa

SEQ ID NO: 665690 - RNA, 15 nt, Escherichia coli CFT073
cacaucaaaucccca

SEQ ID NO: 665691 - RNA, 22 nt, Escherichia coli CFT073
cacaucaacaccgacuucaaua

SEQ ID NO: 665692 - RNA, 13 nt, Escherichia coli CFT073
cacaucagcaacg

SEQ ID NO: 665693 - RNA, 12 nt, Escherichia coli CFT073
cacaucagcgcc

SEQ ID NO: 665694 - RNA, 15 nt, Escherichia coli CFT073
cacaucagcgcccuc

SEQ ID NO: 665695 - RNA, 15 nt, Escherichia coli CFT073
cacaucaggcugaga

SEQ ID NO: 665696 - RNA, 15 nt, Escherichia coli CFT073
cacaucagugauaca

SEQ ID NO: 665697 - RNA, 14 nt, Escherichia coli CFT073
cacauccaguacgc

SEQ ID NO: 665698 - RNA, 16 nt, Escherichia coli CFT073
cacauccaccagcgcc

SEQ ID NO: 665699 - RNA, 13 nt, Escherichia coli CFT073
cacauccugccag

SEQ ID NO: 665700 - RNA, 21 nt, Escherichia coli CFT073
cacauccugccaguaagcagu

SEQ ID NO: 665701 - RNA, 19 nt, Escherichia coli CFT073
cacauccaucgccaguuca

SEQ ID NO: 665702 - RNA, 14 nt, Escherichia coli CFT073
cacaucccagcaga

SEQ ID NO: 665703 - RNA, 21 nt, Escherichia coli CFT073
caauuugcagccguuuguucu

SEQ ID NO: 665704 - RNA, 12 nt, Escherichia coli CFT073
caauuugccauc

SEQ ID NO: 665705 - RNA, 16 nt, Escherichia coli CFT073
cacaaccgccagaugc

SEQ ID NO: 665706 - RNA, 21 nt, Escherichia coli CFT073
cacaaccgccagaugcggcgu

SEQ ID NO: 665707 - RNA, 16 nt, Escherichia coli CFT073
caauuugcuucuggcu

SEQ ID NO: 665708 - RNA, 14 nt, Escherichia coli CFT073
cacaacauugauaa

SEQ ID NO: 665709 - RNA, 17 nt, Escherichia coli CFT073
cacaacauugcgccuca

SEQ ID NO: 665710 - RNA, 21 nt, Escherichia coli CFT073
cacaacauucccaucaguagc

SEQ ID NO: 665711 - RNA, 18 nt, Escherichia coli CFT073
cacaacccagacaaauaa

SEQ ID NO: 665712 - RNA, 17 nt, Escherichia coli CFT073
cacaacgauaauccagc

SEQ ID NO: 665713 - RNA, 14 nt, Escherichia coli CFT073
cacaacgcuuucaa

SEQ ID NO: 665714 - RNA, 16 nt, Escherichia coli CFT073
cacaacgcuuucaaca

SEQ ID NO: 665715 - RNA, 22 nt, Escherichia coli CFT073
cacaacugcgaccguacaacca

SEQ ID NO: 665716 - RNA, 23 nt, Escherichia coli CFT073
cacaacugcgaccguacaaccaa

SEQ ID NO: 665717 - RNA, 19 nt, Escherichia coli CFT073
cacaacguacaccgcagcc

SEQ ID NO: 665718 - RNA, 18 nt, Escherichia coli CFT073
cacaauacauagaagcuc

SEQ ID NO: 665719 - RNA, 11 nt, Escherichia coli CFT073
cacaauaccuu

SEQ ID NO: 665720 - RNA, 15 nt, Escherichia coli CFT073
cacaaucaaauccug

SEQ ID NO: 665721 - RNA, 19 nt, Escherichia coli CFT073
cacaaucaaauccugcauc

SEQ ID NO: 665722 - RNA, 20 nt, Escherichia coli CFT073
cacaauccgccaggacauca

SEQ ID NO: 665723 - RNA, 22 nt, Escherichia coli CFT073
cacaauccgcgagcgucuggcu

SEQ ID NO: 665724 - RNA, 18 nt, Escherichia coli CFT073
cacaaucaacgccaccau

SEQ ID NO: 665725 - RNA, 22 nt, Escherichia coli CFT073
cacaaucaacgccaccaucacu

SEQ ID NO: 665726 - RNA, 22 nt, Escherichia coli CFT073
cacaagcgucauauccgacacu

SEQ ID NO: 665727 - RNA, 16 nt, Escherichia coli CFT073
cacaagcuaccagccc

SEQ ID NO: 665728 - RNA, 14 nt, Escherichia coli CFT073
cacaagcauaugga

SEQ ID NO: 665729 - RNA, 16 nt, Escherichia coli CFT073
cacaagcgaacccgca

SEQ ID NO: 665730 - RNA, 15 nt, Escherichia coli CFT073
cacaagcacagggca

SEQ ID NO: 665731 - RNA, 15 nt, Escherichia coli CFT073
cacacggauauugcu

SEQ ID NO: 665732 - RNA, 13 nt, Escherichia coli CFT073
cacacgcgcugag

SEQ ID NO: 665733 - RNA, 21 nt, Escherichia coli CFT073
cacaaucggcuuucaccgccu

SEQ ID NO: 665734 - RNA, 14 nt, Escherichia coli CFT073
cacaaucugauaga

SEQ ID NO: 665735 - RNA, 18 nt, Escherichia coli CFT073
cacaaugcccggaaugua

SEQ ID NO: 665736 - RNA, 19 nt, Escherichia coli CFT073
cacaaugccgccaauaaug

SEQ ID NO: 665737 - RNA, 10 nt, Escherichia coli CFT073
cacacaccag

SEQ ID NO: 665738 - RNA, 13 nt, Escherichia coli CFT073
cacacacacgccc

SEQ ID NO: 665739 - RNA, 15 nt, Escherichia coli CFT073
cacagcagccuucgc

SEQ ID NO: 665740 - RNA, 14 nt, Escherichia coli CFT073
cacagcaagcagcc

SEQ ID NO: 665741 - RNA, 14 nt, Escherichia coli CFT073
cacagauaaaucaa

SEQ ID NO: 665742 - RNA, 22 nt, Escherichia coli CFT073
cacagauaauaauguguucaac

SEQ ID NO: 665743 - RNA, 12 nt, Escherichia coli CFT073
cacagcacccca

SEQ ID NO: 665744 - RNA, 21 nt, Escherichia coli CFT073
cacagcaccccauagccagcg

SEQ ID NO: 665745 - RNA, 13 nt, Escherichia coli CFT073
cacagaacaaaau

SEQ ID NO: 665746 - RNA, 16 nt, Escherichia coli CFT073
cacacuucuucagcca

SEQ ID NO: 665747 - RNA, 14 nt, Escherichia coli CFT073
cacacuuucaucaa

SEQ ID NO: 665748 - RNA, 20 nt, Escherichia coli CFT073
cacacuucaauauuaaugcu

SEQ ID NO: 665749 - RNA, 15 nt, Escherichia coli CFT073
cacagaaaagcagag

SEQ ID NO: 665750 - RNA, 14 nt, Escherichia coli CFT073
cacagaaacgccau

SEQ ID NO: 665751 - RNA, 17 nt, Escherichia coli CFT073
caaugguguccaaaugc

SEQ ID NO: 665752 - RNA, 13 nt, Escherichia coli CFT073
caaugguuucccu

SEQ ID NO: 665753 - RNA, 16 nt, Escherichia coli CFT073
caauggucgugguaau

SEQ ID NO: 665754 - RNA, 23 nt, Escherichia coli CFT073
caauggucagcgccaggcuuucc

SEQ ID NO: 665755 - RNA, 17 nt, Escherichia coli CFT073
caauggucccuugcugg

SEQ ID NO: 665756 - RNA, 19 nt, Escherichia coli CFT073
caaugguggcaaucugaau

SEQ ID NO: 665757 - RNA, 18 nt, Escherichia coli CFT073
caauguaucuuucaucau

SEQ ID NO: 665758 - RNA, 15 nt, Escherichia coli CFT073
caaugucaagugaau

SEQ ID NO: 665759 - RNA, 18 nt, Escherichia coli CFT073
caauguacggaauaagua

SEQ ID NO: 665760 - RNA, 17 nt, Escherichia coli CFT073
caauguaccagucaaua

SEQ ID NO: 665761 - RNA, 19 nt, Escherichia coli CFT073
caaugggcuuaaugagaua

SEQ ID NO: 665762 - RNA, 23 nt, Escherichia coli CFT073
caauggcuccgggugugacaaca

SEQ ID NO: 665763 - RNA, 21 nt, Escherichia coli CFT073
caauggagcuaaacagagcug

SEQ ID NO: 665764 - RNA, 14 nt, Escherichia coli CFT073
caauggaccagaac

SEQ ID NO: 665765 - RNA, 23 nt, Escherichia coli CFT073
caauggacgauuaucaaaggucu

SEQ ID NO: 665766 - RNA, 19 nt, Escherichia coli CFT073
caauggagcacauugccug

SEQ ID NO: 665767 - RNA, 12 nt, Escherichia coli CFT073
caauggcacugu

SEQ ID NO: 665768 - RNA, 14 nt, Escherichia coli CFT073
caauggcauauucc

SEQ ID NO: 665769 - RNA, 15 nt, Escherichia coli CFT073
caaugacgucuucca

SEQ ID NO: 665770 - RNA, 23 nt, Escherichia coli CFT073
caaugacgucuuccaccggcugu

SEQ ID NO: 665771 - RNA, 17 nt, Escherichia coli CFT073
caaugcuucagaaaauu

SEQ ID NO: 665772 - RNA, 20 nt, Escherichia coli CFT073
caaugaccgcgccauccaua

SEQ ID NO: 665773 - RNA, 20 nt, Escherichia coli CFT073
caaugacagccccaccagca

SEQ ID NO: 665774 - RNA, 19 nt, Escherichia coli CFT073
caaugacaguaucaccaac

SEQ ID NO: 665775 - RNA, 12 nt, Escherichia coli CFT073
caaugacauaca

SEQ ID NO: 665776 - RNA, 21 nt, Escherichia coli CFT073
caaugaaugcuucgcucucuu

SEQ ID NO: 665777 - RNA, 21 nt, Escherichia coli CFT073
caaucuguuuauuugacagcc

SEQ ID NO: 665778 - RNA, 15 nt, Escherichia coli CFT073
caaucuucucuuccc

SEQ ID NO: 665779 - RNA, 13 nt, Escherichia coli CFT073
caauugcuucaau

SEQ ID NO: 665780 - RNA, 23 nt, Escherichia coli CFT073
caauugcgcaccagcuugcgaca

SEQ ID NO: 665781 - RNA, 12 nt, Escherichia coli CFT073
caauugcauuug

SEQ ID NO: 665782 - RNA, 16 nt, Escherichia coli CFT073
caauuucgccucgcuu

SEQ ID NO: 665783 - RNA, 21 nt, Escherichia coli CFT073
caauuuccgcagcuccagccc

SEQ ID NO: 665784 - RNA, 19 nt, Escherichia coli CFT073
caauuucuucaggauuggu

SEQ ID NO: 665785 - RNA, 17 nt, Escherichia coli CFT073
caauuucacgcucaccc

SEQ ID NO: 665786 - RNA, 21 nt, Escherichia coli CFT073
caauucgugugguaaaaccuu

SEQ ID NO: 665787 - RNA, 23 nt, Escherichia coli CFT073
caauucuuccuggguacgcaugu

SEQ ID NO: 665788 - RNA, 22 nt, Escherichia coli CFT073
caauucgcgucggcgucagcgc

SEQ ID NO: 665789 - RNA, 17 nt, Escherichia coli CFT073
caauucgagcaucaucu

SEQ ID NO: 665790 - RNA, 14 nt, Escherichia coli CFT073
caauuccugcgcga

SEQ ID NO: 665791 - RNA, 12 nt, Escherichia coli CFT073
caauuccuucug

SEQ ID NO: 665792 - RNA, 20 nt, Escherichia coli CFT073
caauguguugauaaucguuu

SEQ ID NO: 665793 - RNA, 20 nt, Escherichia coli CFT073
caauguuaacuguuuaucgu

SEQ ID NO: 665794 - RNA, 15 nt, Escherichia coli CFT073
caaugugaaaacccu

SEQ ID NO: 665795 - RNA, 22 nt, Escherichia coli CFT073
caaugugaaaacccugcgcaug

SEQ ID NO: 665796 - RNA, 18 nt, Escherichia coli CFT073
caauguggagagcaacau

SEQ ID NO: 665797 - RNA, 17 nt, Escherichia coli CFT073
caauguggccuuaauug

SEQ ID NO: 665798 - RNA, 19 nt, Escherichia coli CFT073
auuuugggcgggaucucca

SEQ ID NO: 665799 - RNA, 18 nt, Escherichia coli CFT073
auuuugcugcuuccauug

SEQ ID NO: 665800 - RNA, 18 nt, Escherichia coli CFT073
auuuugcugugcuuuaca

SEQ ID NO: 665801 - RNA, 21 nt, Escherichia coli CFT073
auuuugcuuauuuaaacugaa

SEQ ID NO: 665802 - RNA, 22 nt, Escherichia coli CFT073
auuuugcuuauuuaaacugaag

SEQ ID NO: 665803 - RNA, 15 nt, Escherichia coli CFT073
auuuugcuuccggca

SEQ ID NO: 665804 - RNA, 18 nt, Escherichia coli CFT073
auuuucgccaucucaaaa

SEQ ID NO: 665805 - RNA, 13 nt, Escherichia coli CFT073
auuuuucauaauc

SEQ ID NO: 665806 - RNA, 13 nt, Escherichia coli CFT073
auuuuucaucacu

SEQ ID NO: 665807 - RNA, 19 nt, Escherichia coli CFT073
auuuuuccacuggauaaag

SEQ ID NO: 665808 - RNA, 17 nt, Escherichia coli CFT073
auuuuucagcgccauaa

SEQ ID NO: 665809 - RNA, 13 nt, Escherichia coli CFT073
auuuuucagcauc

SEQ ID NO: 665810 - RNA, 15 nt, Escherichia coli CFT073
auuuuuaacaguguu

SEQ ID NO: 665811 - RNA, 23 nt, Escherichia coli CFT073
auuuuuaacuucgcguucugugg

SEQ ID NO: 665812 - RNA, 14 nt, Escherichia coli CFT073
auuuugugauuuau

SEQ ID NO: 665813 - RNA, 16 nt, Escherichia coli CFT073
caaaaaaaucuucacu

SEQ ID NO: 665814 - RNA, 22 nt, Escherichia coli CFT073
caaaaaaagccacggaauaaac

SEQ ID NO: 665815 - RNA, 18 nt, Escherichia coli CFT073
caaaaaauugaaaauuca

SEQ ID NO: 665816 - RNA, 20 nt, Escherichia coli CFT073
auuuuuucgauaaucaaaug

SEQ ID NO: 665817 - RNA, 18 nt, Escherichia coli CFT073
auuuuuucagauaaaagc

SEQ ID NO: 665818 - RNA, 16 nt, Escherichia coli CFT073
auuuuauuucaaaauu

SEQ ID NO: 665819 - RNA, 17 nt, Escherichia coli CFT073
auuuuauuucaaaauua

SEQ ID NO: 665820 - RNA, 13 nt, Escherichia coli CFT073
auuuucaucuuuu

SEQ ID NO: 665821 - RNA, 15 nt, Escherichia coli CFT073
auuuucaccagcauc

SEQ ID NO: 665822 - RNA, 19 nt, Escherichia coli CFT073
auuuucauaguaggucaua

SEQ ID NO: 665823 - RNA, 21 nt, Escherichia coli CFT073
auuuucauaguaggucauauc

SEQ ID NO: 665824 - RNA, 14 nt, Escherichia coli CFT073
auuuucaauaacug

SEQ ID NO: 665825 - RNA, 15 nt, Escherichia coli CFT073
auuuuauaaucaaca

SEQ ID NO: 665826 - RNA, 19 nt, Escherichia coli CFT073
auuuuauauuacgccucag

SEQ ID NO: 665827 - RNA, 16 nt, Escherichia coli CFT073
auuuuauccauauuuu

SEQ ID NO: 665828 - RNA, 19 nt, Escherichia coli CFT073
auuuuauccgcaaagauuu

SEQ ID NO: 665829 - RNA, 23 nt, Escherichia coli CFT073
auuuuaggaugcugcaauaaaau

SEQ ID NO: 665830 - RNA, 15 nt, Escherichia coli CFT073
auuugagcuugcugc

SEQ ID NO: 665831 - RNA, 15 nt, Escherichia coli CFT073
auuugaguucacugc

SEQ ID NO: 665832 - RNA, 16 nt, Escherichia coli CFT073
auuugaguucacugcc

SEQ ID NO: 665833 - RNA, 21 nt, Escherichia coli CFT073
auuugaucaagcucaucaaug

SEQ ID NO: 665834 - RNA, 22 nt, Escherichia coli CFT073
auuuguuuuucaggaaauaaau

SEQ ID NO: 665835 - RNA, 13 nt, Escherichia coli CFT073
auuuuaaaaccac

SEQ ID NO: 665836 - RNA, 21 nt, Escherichia coli CFT073
auuuuaaauuuccucuuguca

SEQ ID NO: 665837 - RNA, 19 nt, Escherichia coli CFT073
auuuuacccgugcauccca

SEQ ID NO: 665838 - RNA, 13 nt, Escherichia coli CFT073
auuuuacuuccca

SEQ ID NO: 665839 - RNA, 16 nt, Escherichia coli CFT073
auuuuacuucccaguc

SEQ ID NO: 665840 - RNA, 13 nt, Escherichia coli CFT073
auuucaccaucuu

SEQ ID NO: 665841 - RNA, 20 nt, Escherichia coli CFT073
auuucacccagcguuugcug

SEQ ID NO: 665842 - RNA, 16 nt, Escherichia coli CFT073
auuucacaccaucaac

SEQ ID NO: 665843 - RNA, 18 nt, Escherichia coli CFT073
auuucacaccaucaacaa

SEQ ID NO: 665844 - RNA, 15 nt, Escherichia coli CFT073
auuucaccacugccu

SEQ ID NO: 665845 - RNA, 18 nt, Escherichia coli CFT073
auuucaggcaacaaaaaa

SEQ ID NO: 665846 - RNA, 18 nt, Escherichia coli CFT073
auuucagggguaggaaaa

SEQ ID NO: 665847 - RNA, 21 nt, Escherichia coli CFT073
auuucagguucugaccagcca

SEQ ID NO: 665848 - RNA, 24 nt, Escherichia coli CFT073
auuucagguucugaccagccagca

SEQ ID NO: 665849 - RNA, 14 nt, Escherichia coli CFT073
auuucagugcugac

SEQ ID NO: 665850 - RNA, 13 nt, Escherichia coli CFT073
auuuccaucucca

SEQ ID NO: 665851 - RNA, 16 nt, Escherichia coli CFT073
auuuccaucuccagcu

SEQ ID NO: 665852 - RNA, 23 nt, Escherichia coli CFT073
auuuccggauacgguuuuuugaa

SEQ ID NO: 665853 - RNA, 15 nt, Escherichia coli CFT073
auuucgcuaaaagua

SEQ ID NO: 665854 - RNA, 17 nt, Escherichia coli CFT073
auuucccaacaguuugu

SEQ ID NO: 665855 - RNA, 14 nt, Escherichia coli CFT073
auuuccccauuccg

SEQ ID NO: 665856 - RNA, 15 nt, Escherichia coli CFT073
auuuccccauuccga

SEQ ID NO: 665857 - RNA, 20 nt, Escherichia coli CFT073
auuucccgggcgagcaaugu

SEQ ID NO: 665858 - RNA, 22 nt, Escherichia coli CFT073
auuucccgauaaccuucuucau

SEQ ID NO: 665859 - RNA, 21 nt, Escherichia coli CFT073
auuuccccccggcagcugcca

SEQ ID NO: 665860 - RNA, 15 nt, Escherichia coli CFT073
auuucccggccacgc

SEQ ID NO: 665861 - RNA, 19 nt, Escherichia coli CFT073
auuuccgcagcuccagccc

SEQ ID NO: 665862 - RNA, 18 nt, Escherichia coli CFT073
auuucguuagcaaacgac

SEQ ID NO: 665863 - RNA, 19 nt, Escherichia coli CFT073
auuucguuagcaaacgaca

SEQ ID NO: 665864 - RNA, 23 nt, Escherichia coli CFT073
auuucgucgcaucacagaccaaa

SEQ ID NO: 665865 - RNA, 18 nt, Escherichia coli CFT073
auuucgucuugcaggaag

SEQ ID NO: 665866 - RNA, 20 nt, Escherichia coli CFT073
auuucguccagcgaaccuuc

SEQ ID NO: 665867 - RNA, 22 nt, Escherichia coli CFT073
auuucguccauguuggagauaa

SEQ ID NO: 665868 - RNA, 23 nt, Escherichia coli CFT073
auuucugcgcggauagccagcau

SEQ ID NO: 665869 - RNA, 17 nt, Escherichia coli CFT073
auuucucuggagaaaua

SEQ ID NO: 665870 - RNA, 19 nt, Escherichia coli CFT073
auuucugacgaugguguuu

SEQ ID NO: 665871 - RNA, 14 nt, Escherichia coli CFT073
auuucugacuuccc

SEQ ID NO: 665872 - RNA, 17 nt, Escherichia coli CFT073
auuucugacuucccucc

SEQ ID NO: 665873 - RNA, 20 nt, Escherichia coli CFT073
auuucugcaaucgucugcug

SEQ ID NO: 665874 - RNA, 22 nt, Escherichia coli CFT073
auuucugcaaucgucugcugaa

SEQ ID NO: 665875 - RNA, 14 nt, Escherichia coli CFT073
auuucuuuuuuuca

SEQ ID NO: 665876 - RNA, 16 nt, Escherichia coli CFT073
auuucuuuuuuucauu

SEQ ID NO: 665877 - RNA, 12 nt, Escherichia coli CFT073
auuugaaaugac

SEQ ID NO: 665878 - RNA, 15 nt, Escherichia coli CFT073
auuugaaaccgucuu

SEQ ID NO: 665879 - RNA, 15 nt, Escherichia coli CFT073
auuucuucagccaca

SEQ ID NO: 665880 - RNA, 20 nt, Escherichia coli CFT073
auuucuucagccacauuuuu

SEQ ID NO: 665881 - RNA, 21 nt, Escherichia coli CFT073
auuucuuauugaguaaauuca

SEQ ID NO: 665882 - RNA, 22 nt, Escherichia coli CFT073
auuucuucaucgguauaaccaa

SEQ ID NO: 665883 - RNA, 22 nt, Escherichia coli CFT073
auuucuucauugguuucaccca

SEQ ID NO: 665884 - RNA, 13 nt, Escherichia coli CFT073
auuucuguuugcg

SEQ ID NO: 665885 - RNA, 22 nt, Escherichia coli CFT073
auuuauuuuuacucuucuuuaa

SEQ ID NO: 665886 - RNA, 11 nt, Escherichia coli CFT073
auuuauuucuc

SEQ ID NO: 665887 - RNA, 20 nt, Escherichia coli CFT073
auuucaauaucgccuuuugc

SEQ ID NO: 665888 - RNA, 22 nt, Escherichia coli CFT073
auuucaauaucgccuuuugccc

SEQ ID NO: 665889 - RNA, 23 nt, Escherichia coli CFT073
auuuaugcagcagguccaucacu

SEQ ID NO: 665890 - RNA, 21 nt, Escherichia coli CFT073
auuuaucuuugauugaagaaa

SEQ ID NO: 665891 - RNA, 15 nt, Escherichia coli CFT073
auuuaacagcaaaac

SEQ ID NO: 665892 - RNA, 12 nt, Escherichia coli CFT073
auuuaacaucau

SEQ ID NO: 665893 - RNA, 14 nt, Escherichia coli CFT073
auuuaucagauuuu

SEQ ID NO: 665894 - RNA, 21 nt, Escherichia coli CFT073
auuuaucgcagguaagauaau

SEQ ID NO: 665895 - RNA, 22 nt, Escherichia coli CFT073
auuuaucggauaggccauaauc

SEQ ID NO: 665896 - RNA, 19 nt, Escherichia coli CFT073
aaaaguagggcgcugccag

SEQ ID NO: 665897 - RNA, 20 nt, Escherichia coli CFT073
aaaaguaguuccagcaugau

SEQ ID NO: 665898 - RNA, 15 nt, Escherichia coli CFT073
auuuaucuucccagc

SEQ ID NO: 665899 - RNA, 17 nt, Escherichia coli CFT073
auuuaucuucaccaaau

SEQ ID NO: 665900 - RNA, 18 nt, Escherichia coli CFT073
auuuaucuucaccaaaug

SEQ ID NO: 665901 - RNA, 12 nt, Escherichia coli CFT073
auuuaucuuccc

SEQ ID NO: 665902 - RNA, 18 nt, Escherichia coli CFT073
auuuaucucgucacuuuu

SEQ ID NO: 665903 - RNA, 16 nt, Escherichia coli CFT073
aaaagucccuucccag

SEQ ID NO: 665904 - RNA, 21 nt, Escherichia coli CFT073
aaaaguauggacgugcucugg

SEQ ID NO: 665905 - RNA, 19 nt, Escherichia coli CFT073
auuuaaacccuuucugcug

SEQ ID NO: 665906 - RNA, 21 nt, Escherichia coli CFT073
auuuaaacccuuucugcugcu

SEQ ID NO: 665907 - RNA, 11 nt, Escherichia coli CFT073
auuuaaacucg

SEQ ID NO: 665908 - RNA, 15 nt, Escherichia coli CFT073
auuuaaacucgcugc

SEQ ID NO: 665909 - RNA, 16 nt, Escherichia coli CFT073
auuuaaagcacaaaaa

SEQ ID NO: 665910 - RNA, 20 nt, Escherichia coli CFT073
auugucgagguuauaaaccc

SEQ ID NO: 665911 - RNA, 19 nt, Escherichia coli CFT073
auugucugaacguucugcu

SEQ ID NO: 665912 - RNA, 14 nt, Escherichia coli CFT073
auuguguaauuaau

SEQ ID NO: 665913 - RNA, 23 nt, Escherichia coli CFT073
auugugucgacauagccaucccu

SEQ ID NO: 665914 - RNA, 18 nt, Escherichia coli CFT073
auugugugacacuucuuc

SEQ ID NO: 665915 - RNA, 12 nt, Escherichia coli CFT073
auuguugauucg

SEQ ID NO: 665916 - RNA, 13 nt, Escherichia coli CFT073
auuguuagcaacg

SEQ ID NO: 665917 - RNA, 14 nt, Escherichia coli CFT073
auuguuaucagcaa

SEQ ID NO: 665918 - RNA, 17 nt, Escherichia coli CFT073
auugguuucacccaguc

SEQ ID NO: 665919 - RNA, 15 nt, Escherichia coli CFT073
aaaagggugcaggag

SEQ ID NO: 665920 - RNA, 19 nt, Escherichia coli CFT073
aaaagguaaggauaaaaaa

SEQ ID NO: 665921 - RNA, 14 nt, Escherichia coli CFT073
auugguugcagcac

SEQ ID NO: 665922 - RNA, 23 nt, Escherichia coli CFT073
auugguugcagcacgcuggacgu

SEQ ID NO: 665923 - RNA, 13 nt, Escherichia coli CFT073
auuguacauuucc

SEQ ID NO: 665924 - RNA, 18 nt, Escherichia coli CFT073
auuguacuuuaaaauaag

SEQ ID NO: 665925 - RNA, 19 nt, Escherichia coli CFT073
auuguacuuuccagccaca

SEQ ID NO: 665926 - RNA, 14 nt, Escherichia coli CFT073
auuguagaaaaucu

SEQ ID NO: 665927 - RNA, 17 nt, Escherichia coli CFT073
auugggauguugauuaa

SEQ ID NO: 665928 - RNA, 15 nt, Escherichia coli CFT073
auugggaagauaaaa

SEQ ID NO: 665929 - RNA, 15 nt, Escherichia coli CFT073
auugggcgaucuccc

SEQ ID NO: 665930 - RNA, 13 nt, Escherichia coli CFT073
aaaaggggaaaaa

SEQ ID NO: 665931 - RNA, 13 nt, Escherichia coli CFT073
auugguggugugu

SEQ ID NO: 665932 - RNA, 14 nt, Escherichia coli CFT073
auugcuguuuuaca

SEQ ID NO: 665933 - RNA, 19 nt, Escherichia coli CFT073
auugcuggccuagaugaau

SEQ ID NO: 665934 - RNA, 16 nt, Escherichia coli CFT073
auugcugcugccgcgc

SEQ ID NO: 665935 - RNA, 14 nt, Escherichia coli CFT073
auuggcugggguac

SEQ ID NO: 665936 - RNA, 18 nt, Escherichia coli CFT073
auugccgaagaccagauu

SEQ ID NO: 665937 - RNA, 19 nt, Escherichia coli CFT073
auugccggaugugaugcau

SEQ ID NO: 665938 - RNA, 14 nt, Escherichia coli CFT073
auugccgcguucgc

SEQ ID NO: 665939 - RNA, 16 nt, Escherichia coli CFT073
auugccgcuaguucuc

SEQ ID NO: 665940 - RNA, 21 nt, Escherichia coli CFT073
auugccggaagcgccaccagc

SEQ ID NO: 665941 - RNA, 18 nt, Escherichia coli CFT073
auugccgggcgcaucaga

SEQ ID NO: 665942 - RNA, 20 nt, Escherichia coli CFT073
auugccgggcuaacuucuuu

SEQ ID NO: 665943 - RNA, 19 nt, Escherichia coli CFT073
auugccagcaucagaguau

SEQ ID NO: 665944 - RNA, 18 nt, Escherichia coli CFT073
auugccaaguccugccag

SEQ ID NO: 665945 - RNA, 16 nt, Escherichia coli CFT073
auugcccaaagccaau

SEQ ID NO: 665946 - RNA, 21 nt, Escherichia coli CFT073
auugccauguugaucccugca

SEQ ID NO: 665947 - RNA, 20 nt, Escherichia coli CFT073
auugccauguuuuccuuuuc

SEQ ID NO: 665948 - RNA, 15 nt, Escherichia coli CFT073
auugccauaaaaacg

SEQ ID NO: 665949 - RNA, 18 nt, Escherichia coli CFT073
auugcugcacauccggua

SEQ ID NO: 665950 - RNA, 16 nt, Escherichia coli CFT073
auugcugcaccagcag

SEQ ID NO: 665951 - RNA, 18 nt, Escherichia coli CFT073
auugcugccgcuccagau

SEQ ID NO: 665952 - RNA, 17 nt, Escherichia coli CFT073
auugcuaaaggcaacau

SEQ ID NO: 665953 - RNA, 14 nt, Escherichia coli CFT073
auugcguucugucg

SEQ ID NO: 665954 - RNA, 22 nt, Escherichia coli CFT073
auugcgguggauuuaaugccaa

SEQ ID NO: 665955 - RNA, 15 nt, Escherichia coli CFT073
auugcgggccaggaa

SEQ ID NO: 665956 - RNA, 18 nt, Escherichia coli CFT073
auugcguaaucuuuucau

SEQ ID NO: 665957 - RNA, 21 nt, Escherichia coli CFT073
auugcgacaagcucauuuccc

SEQ ID NO: 665958 - RNA, 19 nt, Escherichia coli CFT073
auugccuugaugaaaaaac

SEQ ID NO: 665959 - RNA, 16 nt, Escherichia coli CFT073
auugccuguuaaaagc

SEQ ID NO: 665960 - RNA, 15 nt, Escherichia coli CFT073
auugccugcgugcau

SEQ ID NO: 665961 - RNA, 15 nt, Escherichia coli CFT073
auugccugugaaggu

SEQ ID NO: 665962 - RNA, 22 nt, Escherichia coli CFT073
auugccucacgcaaauucuucg

SEQ ID NO: 665963 - RNA, 17 nt, Escherichia coli CFT073
auugccuggcugcccau

SEQ ID NO: 665964 - RNA, 14 nt, Escherichia coli CFT073
auugcauaucaauu

SEQ ID NO: 665965 - RNA, 16 nt, Escherichia coli CFT073
auugcauaucaauuag

SEQ ID NO: 665966 - RNA, 13 nt, Escherichia coli CFT073
auugcauuaaaaa

SEQ ID NO: 665967 - RNA, 19 nt, Escherichia coli CFT073
auugcauccgauuguuccu

SEQ ID NO: 665968 - RNA, 19 nt, Escherichia coli CFT073
auugcagauaccacaucaa

SEQ ID NO: 665969 - RNA, 16 nt, Escherichia coli CFT073
auugcagauaccacau

SEQ ID NO: 665970 - RNA, 14 nt, Escherichia coli CFT073
auugcacuggcacc

SEQ ID NO: 665971 - RNA, 12 nt, Escherichia coli CFT073
auugcagcucug

SEQ ID NO: 665972 - RNA, 15 nt, Escherichia coli CFT073
auugcaggagcggug

SEQ ID NO: 665973 - RNA, 21 nt, Escherichia coli CFT073
auugcaggggcuuauauaggu

SEQ ID NO: 665974 - RNA, 19 nt, Escherichia coli CFT073
auugcacauucccugcagu

SEQ ID NO: 665975 - RNA, 21 nt, Escherichia coli CFT073
auugcaccacaucgguuugcg

SEQ ID NO: 665976 - RNA, 14 nt, Escherichia coli CFT073
auugcaccaucccc

SEQ ID NO: 665977 - RNA, 18 nt, Escherichia coli CFT073
auugcacgcgaccgucuu

SEQ ID NO: 665978 - RNA, 19 nt, Escherichia coli CFT073
auugcacguccaguggcau

SEQ ID NO: 665979 - RNA, 16 nt, Escherichia coli CFT073
auucuuuuuugauucc

SEQ ID NO: 665980 - RNA, 20 nt, Escherichia coli CFT073
auucuuuuuugauuccagua

SEQ ID NO: 665981 - RNA, 18 nt, Escherichia coli CFT073
auugaucucguugaucac

SEQ ID NO: 665982 - RNA, 16 nt, Escherichia coli CFT073
auucuugacuaucacu

SEQ ID NO: 665983 - RNA, 23 nt, Escherichia coli CFT073
auucuugacuaucacucccucau

SEQ ID NO: 665984 - RNA, 18 nt, Escherichia coli CFT073
auucuugaauuguugaug

SEQ ID NO: 665985 - RNA, 22 nt, Escherichia coli CFT073
auucuguaacucgaauuauuca

SEQ ID NO: 665986 - RNA, 23 nt, Escherichia coli CFT073
auucucuuuucacgcaauaccug

SEQ ID NO: 665987 - RNA, 19 nt, Escherichia coli CFT073
auucugacacugccacuuu

SEQ ID NO: 665988 - RNA, 17 nt, Escherichia coli CFT073
auucugacgccaccauu

SEQ ID NO: 665989 - RNA, 22 nt, Escherichia coli CFT073
auucugcaaggcaaaauacguu

SEQ ID NO: 665990 - RNA, 21 nt, Escherichia coli CFT073
auucguacaaacgcuuuacuc

SEQ ID NO: 665991 - RNA, 15 nt, Escherichia coli CFT073
auucguauuuaaaac

SEQ ID NO: 665992 - RNA, 22 nt, Escherichia coli CFT073
auucguaagcgagaacugccuu

SEQ ID NO: 665993 - RNA, 19 nt, Escherichia coli CFT073
auucgcuugcaaaagcagg

SEQ ID NO: 665994 - RNA, 22 nt, Escherichia coli CFT073
auucgcuguaauucuucaagug

SEQ ID NO: 665995 - RNA, 22 nt, Escherichia coli CFT073
auucuauuuugccaggcuaacc

SEQ ID NO: 665996 - RNA, 16 nt, Escherichia coli CFT073
auucguuaacggcauu

SEQ ID NO: 665997 - RNA, 14 nt, Escherichia coli CFT073
auuccaucaauagc

SEQ ID NO: 665998 - RNA, 14 nt, Escherichia coli CFT073
auuccacucaucgc

SEQ ID NO: 665999 - RNA, 22 nt, Escherichia coli CFT073
auucauuuuucgcuaccagcaa

SEQ ID NO: 666000 - RNA, 16 nt, Escherichia coli CFT073
auucccggaaauugcc

SEQ ID NO: 666001 - RNA, 23 nt, Escherichia coli CFT073
auucccgcgcuaccacuucccaa

SEQ ID NO: 666002 - RNA, 21 nt, Escherichia coli CFT073
auuccccugccagaagcagaa

SEQ ID NO: 666003 - RNA, 19 nt, Escherichia coli CFT073
auucccuacgccuaccacc

SEQ ID NO: 666004 - RNA, 12 nt, Escherichia coli CFT073
auucccugccug

SEQ ID NO: 666005 - RNA, 16 nt, Escherichia coli CFT073
auucccggcuuugcaa

SEQ ID NO: 666006 - RNA, 16 nt, Escherichia coli CFT073
auucccguggccugca

SEQ ID NO: 666007 - RNA, 15 nt, Escherichia coli CFT073
auuccgugccagcac

SEQ ID NO: 666008 - RNA, 16 nt, Escherichia coli CFT073
auuccgugccagcacc

SEQ ID NO: 666009 - RNA, 18 nt, Escherichia coli CFT073
auuccguucaguaaucaa

SEQ ID NO: 666010 - RNA, 15 nt, Escherichia coli CFT073
auuccuuaugcugcu

SEQ ID NO: 666011 - RNA, 21 nt, Escherichia coli CFT073
auuccucaaacgugcggcagg

SEQ ID NO: 666012 - RNA, 14 nt, Escherichia coli CFT073
auuccuauuuuguu

SEQ ID NO: 666013 - RNA, 20 nt, Escherichia coli CFT073
auucaucacgcacugcaaua

SEQ ID NO: 666014 - RNA, 15 nt, Escherichia coli CFT073
auucaucacgccaau

SEQ ID NO: 666015 - RNA, 16 nt, Escherichia coli CFT073
auucauauuuuuuccc

SEQ ID NO: 666016 - RNA, 12 nt, Escherichia coli CFT073
auucaucaccac

SEQ ID NO: 666017 - RNA, 23 nt, Escherichia coli CFT073
auucaucgcucucaugcugcugg

SEQ ID NO: 666018 - RNA, 17 nt, Escherichia coli CFT073
aaaaggaguuuuuccuu

SEQ ID NO: 666019 - RNA, 14 nt, Escherichia coli CFT073
auucauguucggua

SEQ ID NO: 666020 - RNA, 23 nt, Escherichia coli CFT073
auucauuacuuaucuaauaaaca

SEQ ID NO: 666021 - RNA, 13 nt, Escherichia coli CFT073
auucauuccuuga

SEQ ID NO: 666022 - RNA, 20 nt, Escherichia coli CFT073
auucauugcuauuucccccu

SEQ ID NO: 666023 - RNA, 17 nt, Escherichia coli CFT073
auucauuguucucccau

SEQ ID NO: 666024 - RNA, 21 nt, Escherichia coli CFT073
auucauuuggcguaguugcug

SEQ ID NO: 666025 - RNA, 13 nt, Escherichia coli CFT073
auucauuuugcug

SEQ ID NO: 666026 - RNA, 21 nt, Escherichia coli CFT073
auucauuuugcuggaaaagua

SEQ ID NO: 666027 - RNA, 14 nt, Escherichia coli CFT073
auuaauacaucaac

SEQ ID NO: 666028 - RNA, 19 nt, Escherichia coli CFT073
auuaauaaggaugcaacac

SEQ ID NO: 666029 - RNA, 20 nt, Escherichia coli CFT073
auuaagcgcaaaggccagca

SEQ ID NO: 666030 - RNA, 22 nt, Escherichia coli CFT073
auuaagcgcaaaggccagcaau

SEQ ID NO: 666031 - RNA, 21 nt, Escherichia coli CFT073
auuaagccgaucguugaggcu

SEQ ID NO: 666032 - RNA, 21 nt, Escherichia coli CFT073
auuaagcgccggaauauauuc

SEQ ID NO: 666033 - RNA, 19 nt, Escherichia coli CFT073
auuaagacgcagauuuuua

SEQ ID NO: 666034 - RNA, 12 nt, Escherichia coli CFT073
auuaagaaucac

SEQ ID NO: 666035 - RNA, 14 nt, Escherichia coli CFT073
auuaagaaucacug

SEQ ID NO: 666036 - RNA, 17 nt, Escherichia coli CFT073
auuaagaaucacuguuu

SEQ ID NO: 666037 - RNA, 14 nt, Escherichia coli CFT073
auuaagaucagaag

SEQ ID NO: 666038 - RNA, 16 nt, Escherichia coli CFT073
auuaagaucagaagca

SEQ ID NO: 666039 - RNA, 14 nt, Escherichia coli CFT073
auuaacgccccaau

SEQ ID NO: 666040 - RNA, 22 nt, Escherichia coli CFT073
auuaacgcgaaauaaucaaaug

SEQ ID NO: 666041 - RNA, 15 nt, Escherichia coli CFT073
auuaacgcagcaaaa

SEQ ID NO: 666042 - RNA, 18 nt, Escherichia coli CFT073
auuaacgcagcaaaagca

SEQ ID NO: 666043 - RNA, 23 nt, Escherichia coli CFT073
auuaacgcagcaaaagcaggcac

SEQ ID NO: 666044 - RNA, 16 nt, Escherichia coli CFT073
auuaacccguuuacau

SEQ ID NO: 666045 - RNA, 14 nt, Escherichia coli CFT073
auuaaccguugguu

SEQ ID NO: 666046 - RNA, 21 nt, Escherichia coli CFT073
auuaaaugcugguuuugaaaa

SEQ ID NO: 666047 - RNA, 17 nt, Escherichia coli CFT073
auuaacggccacgaugc

SEQ ID NO: 666048 - RNA, 21 nt, Escherichia coli CFT073
auuaacggccacgaugcacag

SEQ ID NO: 666049 - RNA, 18 nt, Escherichia coli CFT073
auuaacgucaaccacuca

SEQ ID NO: 666050 - RNA, 13 nt, Escherichia coli CFT073
auuaacucacugg

SEQ ID NO: 666051 - RNA, 15 nt, Escherichia coli CFT073
auuaacucacuggcg

SEQ ID NO: 666052 - RNA, 19 nt, Escherichia coli CFT073
auuaacuugcgacagccau

SEQ ID NO: 666053 - RNA, 13 nt, Escherichia coli CFT073
auuaacugugguu

SEQ ID NO: 666054 - RNA, 20 nt, Escherichia coli CFT073
auuaaagccgcgaaacugcg

SEQ ID NO: 666055 - RNA, 22 nt, Escherichia coli CFT073
auuaaagccgcgaaacugcgug

SEQ ID NO: 666056 - RNA, 18 nt, Escherichia coli CFT073
auuaaagccggaugcuuu

SEQ ID NO: 666057 - RNA, 22 nt, Escherichia coli CFT073
auguucgccagauuguuaucca

SEQ ID NO: 666058 - RNA, 20 nt, Escherichia coli CFT073
auguucggcgucuuguugaa

SEQ ID NO: 666059 - RNA, 15 nt, Escherichia coli CFT073
auguucguugcauuc

SEQ ID NO: 666060 - RNA, 21 nt, Escherichia coli CFT073
auguuugucaucagucuuaag

SEQ ID NO: 666061 - RNA, 14 nt, Escherichia coli CFT073
auguuuuccagcac

SEQ ID NO: 666062 - RNA, 22 nt, Escherichia coli CFT073
auguugaucaggugauggcagc

SEQ ID NO: 666063 - RNA, 15 nt, Escherichia coli CFT073
auguugaucccugca

SEQ ID NO: 666064 - RNA, 14 nt, Escherichia coli CFT073
auguugauaaaaag

SEQ ID NO: 666065 - RNA, 13 nt, Escherichia coli CFT073
auguugauaauca

SEQ ID NO: 666066 - RNA, 20 nt, Escherichia coli CFT073
auguugauaaucaacaggaa

SEQ ID NO: 666067 - RNA, 14 nt, Escherichia coli CFT073
auguuauugcagac

SEQ ID NO: 666068 - RNA, 12 nt, Escherichia coli CFT073
auguuauucaug

SEQ ID NO: 666069 - RNA, 22 nt, Escherichia coli CFT073
auguuccggguuugccacaucg

SEQ ID NO: 666070 - RNA, 19 nt, Escherichia coli CFT073
auguuccggcgacacaucu

SEQ ID NO: 666071 - RNA, 14 nt, Escherichia coli CFT073
auguuaauuauuuu

SEQ ID NO: 666072 - RNA, 18 nt, Escherichia coli CFT073
auguuacgaccuuccuga

SEQ ID NO: 666073 - RNA, 20 nt, Escherichia coli CFT073
auguuaaauugccugugaag

SEQ ID NO: 666074 - RNA, 17 nt, Escherichia coli CFT073
auguguuggcaccaucc

SEQ ID NO: 666075 - RNA, 19 nt, Escherichia coli CFT073
auguguuggcaccaucccu

SEQ ID NO: 666076 - RNA, 17 nt, Escherichia coli CFT073
auguguuuauaagccau

SEQ ID NO: 666077 - RNA, 19 nt, Escherichia coli CFT073
augugugacugcacuguuu

SEQ ID NO: 666078 - RNA, 20 nt, Escherichia coli CFT073
augugguuagcuggagaguu

SEQ ID NO: 666079 - RNA, 18 nt, Escherichia coli CFT073
auguguaagaaaggcaga

SEQ ID NO: 666080 - RNA, 19 nt, Escherichia coli CFT073
augugcccccugcaauaaa

SEQ ID NO: 666081 - RNA, 18 nt, Escherichia coli CFT073
augugccggaugcaucac

SEQ ID NO: 666082 - RNA, 17 nt, Escherichia coli CFT073
augucgugguacugccg

SEQ ID NO: 666083 - RNA, 17 nt, Escherichia coli CFT073
augucgucccuuucugg

SEQ ID NO: 666084 - RNA, 16 nt, Escherichia coli CFT073
augucgcugcacuuuc

SEQ ID NO: 666085 - RNA, 20 nt, Escherichia coli CFT073
augucgaauuucucguaaau

SEQ ID NO: 666086 - RNA, 18 nt, Escherichia coli CFT073
augucgauaucaggcaaa

SEQ ID NO: 666087 - RNA, 17 nt, Escherichia coli CFT073
auguaccagucaauaau

SEQ ID NO: 666088 - RNA, 22 nt, Escherichia coli CFT073
augucucgguagagaaaaccac

SEQ ID NO: 666089 - RNA, 16 nt, Escherichia coli CFT073
augucucucagagaau

SEQ ID NO: 666090 - RNA, 24 nt, Escherichia coli CFT073
augucucucagagaaucaugucag

SEQ ID NO: 666091 - RNA, 16 nt, Escherichia coli CFT073
augucuucacaaccgc

SEQ ID NO: 666092 - RNA, 17 nt, Escherichia coli CFT073
augucuucacaaccgcc

SEQ ID NO: 666093 - RNA, 16 nt, Escherichia coli CFT073
augucuguucuggugu

SEQ ID NO: 666094 - RNA, 20 nt, Escherichia coli CFT073
augucuggcgagcuccaggg

SEQ ID NO: 666095 - RNA, 21 nt, Escherichia coli CFT073
augucuggcugagcaaacagu

SEQ ID NO: 666096 - RNA, 18 nt, Escherichia coli CFT073
augucuugccucccugca

SEQ ID NO: 666097 - RNA, 21 nt, Escherichia coli CFT073
augucuucccggcucaguaaa

SEQ ID NO: 666098 - RNA, 14 nt, Escherichia coli CFT073
augugcagcagugc

SEQ ID NO: 666099 - RNA, 18 nt, Escherichia coli CFT073
augugacuggaaaucaaa

SEQ ID NO: 666100 - RNA, 17 nt, Escherichia coli CFT073
augugaucgaauauauc

SEQ ID NO: 666101 - RNA, 16 nt, Escherichia coli CFT073
auuagcacgauuuugu

SEQ ID NO: 666102 - RNA, 22 nt, Escherichia coli CFT073
aaaagcgggcaguguuuagugg

SEQ ID NO: 666103 - RNA, 17 nt, Escherichia coli CFT073
aaaagccuaagaaguca

SEQ ID NO: 666104 - RNA, 18 nt, Escherichia coli CFT073
auuagcaucaagaaaaau

SEQ ID NO: 666105 - RNA, 21 nt, Escherichia coli CFT073
auuagcaucaagaaaaauacu

SEQ ID NO: 666106 - RNA, 22 nt, Escherichia coli CFT073
auuagcaucaagaaaaauacug

SEQ ID NO: 666107 - RNA, 12 nt, Escherichia coli CFT073
auuagccaggca

SEQ ID NO: 666108 - RNA, 21 nt, Escherichia coli CFT073
auuacuuucggugacuucaaa

SEQ ID NO: 666109 - RNA, 21 nt, Escherichia coli CFT073
auuagaauuauuagcaacgau

SEQ ID NO: 666110 - RNA, 18 nt, Escherichia coli CFT073
auuacuuuaagccuuccg

SEQ ID NO: 666111 - RNA, 21 nt, Escherichia coli CFT073
auuacuucuugaugcggauaa

SEQ ID NO: 666112 - RNA, 17 nt, Escherichia coli CFT073
auuacugccagcucacc

SEQ ID NO: 666113 - RNA, 19 nt, Escherichia coli CFT073
auuacugccagcucaccuc

SEQ ID NO: 666114 - RNA, 21 nt, Escherichia coli CFT073
auuacugccagcucaccucac

SEQ ID NO: 666115 - RNA, 16 nt, Escherichia coli CFT073
auuacugcgaauuucc

SEQ ID NO: 666116 - RNA, 16 nt, Escherichia coli CFT073
auuacuggauaaccug

SEQ ID NO: 666117 - RNA, 17 nt, Escherichia coli CFT073
auuacuggcuguauaua

SEQ ID NO: 666118 - RNA, 19 nt, Escherichia coli CFT073
auuacuguaggccaguauu

SEQ ID NO: 666119 - RNA, 22 nt, Escherichia coli CFT073
auuaauaccgccaacaugcgca

SEQ ID NO: 666120 - RNA, 13 nt, Escherichia coli CFT073
auuaauauauauu

SEQ ID NO: 666121 - RNA, 15 nt, Escherichia coli CFT073
auuaauauauauuau

SEQ ID NO: 666122 - RNA, 17 nt, Escherichia coli CFT073
auuacauaccagcagca

SEQ ID NO: 666123 - RNA, 21 nt, Escherichia coli CFT073
auuacauaccagcagcaucac

SEQ ID NO: 666124 - RNA, 21 nt, Escherichia coli CFT073
auuacaggaacugcaaggaga

SEQ ID NO: 666125 - RNA, 16 nt, Escherichia coli CFT073
auuaccaaaaacgguc

SEQ ID NO: 666126 - RNA, 20 nt, Escherichia coli CFT073
auuaccgaagggaucuucca

SEQ ID NO: 666127 - RNA, 21 nt, Escherichia coli CFT073
auuaccgcaccaccagcagcu

SEQ ID NO: 666128 - RNA, 24 nt, Escherichia coli CFT073
auuacguucgacugcgccuuccag

SEQ ID NO: 666129 - RNA, 17 nt, Escherichia coli CFT073
auuacuauggauauaau

SEQ ID NO: 666130 - RNA, 16 nt, Escherichia coli CFT073
auuacucauuaaucaa

SEQ ID NO: 666131 - RNA, 18 nt, Escherichia coli CFT073
auuacucauuaaucaauu

SEQ ID NO: 666132 - RNA, 16 nt, Escherichia coli CFT073
auuacuccacuuccug

SEQ ID NO: 666133 - RNA, 17 nt, Escherichia coli CFT073
auuaccuucaauacugg

SEQ ID NO: 666134 - RNA, 18 nt, Escherichia coli CFT073
auuaccuucaauacuggc

SEQ ID NO: 666135 - RNA, 21 nt, Escherichia coli CFT073
auuacgggcgaaguucgccau

SEQ ID NO: 666136 - RNA, 19 nt, Escherichia coli CFT073
auuacgguaaggauauuca

SEQ ID NO: 666137 - RNA, 13 nt, Escherichia coli CFT073
auuacguaccaga

SEQ ID NO: 666138 - RNA, 16 nt, Escherichia coli CFT073
auuacguacugcaacg

SEQ ID NO: 666139 - RNA, 23 nt, Escherichia coli CFT073
auuaccugucgcgucaaucacuu

SEQ ID NO: 666140 - RNA, 21 nt, Escherichia coli CFT073
auuaccguugcggcuccagac

SEQ ID NO: 666141 - RNA, 16 nt, Escherichia coli CFT073
auuaccgugaaucgga

SEQ ID NO: 666142 - RNA, 15 nt, Escherichia coli CFT073
auuaccggugucuuu

SEQ ID NO: 666143 - RNA, 15 nt, Escherichia coli CFT073
auuaccggagcugca

SEQ ID NO: 666144 - RNA, 19 nt, Escherichia coli CFT073
auucaagauaacgccuggc

SEQ ID NO: 666145 - RNA, 13 nt, Escherichia coli CFT073
auucaagcauuau

SEQ ID NO: 666146 - RNA, 15 nt, Escherichia coli CFT073
auucaaaauccgcca

SEQ ID NO: 666147 - RNA, 17 nt, Escherichia coli CFT073
auucaaaaacagauugc

SEQ ID NO: 666148 - RNA, 19 nt, Escherichia coli CFT073
auuauuuuugugaagaaua

SEQ ID NO: 666149 - RNA, 22 nt, Escherichia coli CFT073
auuauuuuugugaagaauaaau

SEQ ID NO: 666150 - RNA, 12 nt, Escherichia coli CFT073
auuauuuuaaau

SEQ ID NO: 666151 - RNA, 19 nt, Escherichia coli CFT073
auuauugccuugaugaaaa

SEQ ID NO: 666152 - RNA, 20 nt, Escherichia coli CFT073
auuauugccuugaugaaaaa

SEQ ID NO: 666153 - RNA, 13 nt, Escherichia coli CFT073
auuauuuauucag

SEQ ID NO: 666154 - RNA, 13 nt, Escherichia coli CFT073
auuaucgagcugc

SEQ ID NO: 666155 - RNA, 15 nt, Escherichia coli CFT073
auuaugccugauuac

SEQ ID NO: 666156 - RNA, 16 nt, Escherichia coli CFT073
auuauuaaaccaggaa

SEQ ID NO: 666157 - RNA, 23 nt, Escherichia coli CFT073
auuauuaaaccaggaacagugaa

SEQ ID NO: 666158 - RNA, 21 nt, Escherichia coli CFT073
auuauggaucaauuucguuga

SEQ ID NO: 666159 - RNA, 16 nt, Escherichia coli CFT073
augguucccuuuuuca

SEQ ID NO: 666160 - RNA, 15 nt, Escherichia coli CFT073
augguucugcacagc

SEQ ID NO: 666161 - RNA, 11 nt, Escherichia coli CFT073
auguaaauauu

SEQ ID NO: 666162 - RNA, 15 nt, Escherichia coli CFT073
auguaaauauuggug

SEQ ID NO: 666163 - RNA, 13 nt, Escherichia coli CFT073
auguaaaucaauu

SEQ ID NO: 666164 - RNA, 17 nt, Escherichia coli CFT073
auguaaacaagacauca

SEQ ID NO: 666165 - RNA, 14 nt, Escherichia coli CFT073
augguguucacuca

SEQ ID NO: 666166 - RNA, 21 nt, Escherichia coli CFT073
auggugucuucguugugaaua

SEQ ID NO: 666167 - RNA, 15 nt, Escherichia coli CFT073
auggugcuaauugca

SEQ ID NO: 666168 - RNA, 21 nt, Escherichia coli CFT073
auggugcuaauugcaccaucc

SEQ ID NO: 666169 - RNA, 19 nt, Escherichia coli CFT073
augguggaguggcccaggu

SEQ ID NO: 666170 - RNA, 18 nt, Escherichia coli CFT073
augguacuggcgacugcc

SEQ ID NO: 666171 - RNA, 23 nt, Escherichia coli CFT073
augguagaaacgcugaaugcugc

SEQ ID NO: 666172 - RNA, 23 nt, Escherichia coli CFT073
auggugaaguuauuaaugacaau

SEQ ID NO: 666173 - RNA, 21 nt, Escherichia coli CFT073
augggcgugauaaugcguucg

SEQ ID NO: 666174 - RNA, 22 nt, Escherichia coli CFT073
augggcgugauaaugcguucgc

SEQ ID NO: 666175 - RNA, 19 nt, Escherichia coli CFT073
augggcuucgauacugccu

SEQ ID NO: 666176 - RNA, 17 nt, Escherichia coli CFT073
augggcuccacaaaaug

SEQ ID NO: 666177 - RNA, 23 nt, Escherichia coli CFT073
augggcggucccacaacagguau

SEQ ID NO: 666178 - RNA, 20 nt, Escherichia coli CFT073
augguaaagcaccugauuag

SEQ ID NO: 666179 - RNA, 17 nt, Escherichia coli CFT073
auggcuggaaucaucaa

SEQ ID NO: 666180 - RNA, 18 nt, Escherichia coli CFT073
auggcuggaaucaucaag

SEQ ID NO: 666181 - RNA, 23 nt, Escherichia coli CFT073
auggcugccuuuuuuacaggugu

SEQ ID NO: 666182 - RNA, 21 nt, Escherichia coli CFT073
auggcuguuuucagcaccaga

SEQ ID NO: 666183 - RNA, 20 nt, Escherichia coli CFT073
auggcuguaggguggggaaa

SEQ ID NO: 666184 - RNA, 22 nt, Escherichia coli CFT073
auggcugaaagcgccgggaaug

SEQ ID NO: 666185 - RNA, 22 nt, Escherichia coli CFT073
auggcguuuccuuccagaaaca

SEQ ID NO: 666186 - RNA, 20 nt, Escherichia coli CFT073
auggcuaaaguacguaaaac

SEQ ID NO: 666187 - RNA, 14 nt, Escherichia coli CFT073
auggcuaucaagau

SEQ ID NO: 666188 - RNA, 16 nt, Escherichia coli CFT073
auggcgugaaagaaaa

SEQ ID NO: 666189 - RNA, 17 nt, Escherichia coli CFT073
auggccgcuccaagguc

SEQ ID NO: 666190 - RNA, 14 nt, Escherichia coli CFT073
auggcccauucagc

SEQ ID NO: 666191 - RNA, 22 nt, Escherichia coli CFT073
auggcagccauuuguuggcgcu

SEQ ID NO: 666192 - RNA, 12 nt, Escherichia coli CFT073
auggcauaaccg

SEQ ID NO: 666193 - RNA, 15 nt, Escherichia coli CFT073
auggcaucaccaucg

SEQ ID NO: 666194 - RNA, 13 nt, Escherichia coli CFT073
auggcauccagcg

SEQ ID NO: 666195 - RNA, 13 nt, Escherichia coli CFT073
auggcauccuguu

SEQ ID NO: 666196 - RNA, 15 nt, Escherichia coli CFT073
auggcacuucaagau

SEQ ID NO: 666197 - RNA, 20 nt, Escherichia coli CFT073
auggcagaccaaacggugag

SEQ ID NO: 666198 - RNA, 22 nt, Escherichia coli CFT073
auggacguuaauccgcucugcc

SEQ ID NO: 666199 - RNA, 14 nt, Escherichia coli CFT073
auggacgauuauca

SEQ ID NO: 666200 - RNA, 13 nt, Escherichia coli CFT073
auggacgcagacc

SEQ ID NO: 666201 - RNA, 13 nt, Escherichia coli CFT073
auggaaaaacagc

SEQ ID NO: 666202 - RNA, 18 nt, Escherichia coli CFT073
auggaaacagcaccaucc

SEQ ID NO: 666203 - RNA, 14 nt, Escherichia coli CFT073
augcuuuuuuaaaa

SEQ ID NO: 666204 - RNA, 19 nt, Escherichia coli CFT073
augcuuuuuuaaaaacaga

SEQ ID NO: 666205 - RNA, 18 nt, Escherichia coli CFT073
auggaaaucacccagcga

SEQ ID NO: 666206 - RNA, 14 nt, Escherichia coli CFT073
auggacaaaagccc

SEQ ID NO: 666207 - RNA, 19 nt, Escherichia coli CFT073
auggaacucuuucugacga

SEQ ID NO: 666208 - RNA, 20 nt, Escherichia coli CFT073
augcugcgccaguugcuuau

SEQ ID NO: 666209 - RNA, 20 nt, Escherichia coli CFT073
augcugccuucggugggaaa

SEQ ID NO: 666210 - RNA, 22 nt, Escherichia coli CFT073
augcugcuccagcguaccugcc

SEQ ID NO: 666211 - RNA, 18 nt, Escherichia coli CFT073
augcugcuguuuuugaaa

SEQ ID NO: 666212 - RNA, 23 nt, Escherichia coli CFT073
augcucucuucgccaaugaccgc

SEQ ID NO: 666213 - RNA, 14 nt, Escherichia coli CFT073
augcucugccagcg

SEQ ID NO: 666214 - RNA, 23 nt, Escherichia coli CFT073
augcuccccuuucuuauuuuucu

SEQ ID NO: 666215 - RNA, 22 nt, Escherichia coli CFT073
augcuccugauuggcagguggc

SEQ ID NO: 666216 - RNA, 24 nt, Escherichia coli CFT073
augcucgcgaaaagaaacugugau

SEQ ID NO: 666217 - RNA, 16 nt, Escherichia coli CFT073
augcucgcuggcaggc

SEQ ID NO: 666218 - RNA, 13 nt, Escherichia coli CFT073
augcuucagauac

SEQ ID NO: 666219 - RNA, 16 nt, Escherichia coli CFT073
augcuucagauaccaa

SEQ ID NO: 666220 - RNA, 19 nt, Escherichia coli CFT073
augcuucaucgugacaauc

SEQ ID NO: 666221 - RNA, 13 nt, Escherichia coli CFT073
augcuuacuugcc

SEQ ID NO: 666222 - RNA, 18 nt, Escherichia coli CFT073
augcuuaaauauuuuuua

SEQ ID NO: 666223 - RNA, 21 nt, Escherichia coli CFT073
augcugcuuuaucagaucacg

SEQ ID NO: 666224 - RNA, 17 nt, Escherichia coli CFT073
augcuuuacguuccuga

SEQ ID NO: 666225 - RNA, 12 nt, Escherichia coli CFT073
augcuuucagua

SEQ ID NO: 666226 - RNA, 18 nt, Escherichia coli CFT073
augcuucuucugugaagc

SEQ ID NO: 666227 - RNA, 23 nt, Escherichia coli CFT073
augcuucuucugugaagcaugag

SEQ ID NO: 666228 - RNA, 13 nt, Escherichia coli CFT073
augcagccuucau

SEQ ID NO: 666229 - RNA, 20 nt, Escherichia coli CFT073
augcagcauagucagguauu

SEQ ID NO: 666230 - RNA, 14 nt, Escherichia coli CFT073
augcagcgcaugac

SEQ ID NO: 666231 - RNA, 15 nt, Escherichia coli CFT073
augccaaucuucaca

SEQ ID NO: 666232 - RNA, 22 nt, Escherichia coli CFT073
augccaaucuucacaucaucau

SEQ ID NO: 666233 - RNA, 20 nt, Escherichia coli CFT073
augccaauaaauccuuugua

SEQ ID NO: 666234 - RNA, 17 nt, Escherichia coli CFT073
augccaaucggcggcac

SEQ ID NO: 666235 - RNA, 19 nt, Escherichia coli CFT073
augccaccacaccagacca

SEQ ID NO: 666236 - RNA, 21 nt, Escherichia coli CFT073
augccaccacaccagaccaga

SEQ ID NO: 666237 - RNA, 19 nt, Escherichia coli CFT073
augccaccagaaacagagu

SEQ ID NO: 666238 - RNA, 16 nt, Escherichia coli CFT073
augcagcaaccagagc

SEQ ID NO: 666239 - RNA, 16 nt, Escherichia coli CFT073
augcagcauagaagaa

SEQ ID NO: 666240 - RNA, 15 nt, Escherichia coli CFT073
augcagcagcaaacg

SEQ ID NO: 666241 - RNA, 16 nt, Escherichia coli CFT073
augcagacucauugua

SEQ ID NO: 666242 - RNA, 20 nt, Escherichia coli CFT073
augcacccgcaaaugaucau

SEQ ID NO: 666243 - RNA, 20 nt, Escherichia coli CFT073
augcacacgcggagccaguu

SEQ ID NO: 666244 - RNA, 20 nt, Escherichia coli CFT073
augcacaggagacaccagcg

SEQ ID NO: 666245 - RNA, 13 nt, Escherichia coli CFT073
augccauccgcau

SEQ ID NO: 666246 - RNA, 16 nt, Escherichia coli CFT073
augccaucgccagcag

SEQ ID NO: 666247 - RNA, 13 nt, Escherichia coli CFT073
augccgcccagca

SEQ ID NO: 666248 - RNA, 14 nt, Escherichia coli CFT073
augccgcagcaccc

SEQ ID NO: 666249 - RNA, 18 nt, Escherichia coli CFT073
augccgccgacaguuauc

SEQ ID NO: 666250 - RNA, 16 nt, Escherichia coli CFT073
augcgcgaggaauaug

SEQ ID NO: 666251 - RNA, 17 nt, Escherichia coli CFT073
augcgcccaugccgccu

SEQ ID NO: 666252 - RNA, 23 nt, Escherichia coli CFT073
augcgccagguaacgaagauggc

SEQ ID NO: 666253 - RNA, 15 nt, Escherichia coli CFT073
augcgacgccgauaa

SEQ ID NO: 666254 - RNA, 18 nt, Escherichia coli CFT073
augcgacgcuugacgcgu

SEQ ID NO: 666255 - RNA, 15 nt, Escherichia coli CFT073
augcgacgcuugccg

SEQ ID NO: 666256 - RNA, 22 nt, Escherichia coli CFT073
augcgacauagaucuaaaugcc

SEQ ID NO: 666257 - RNA, 13 nt, Escherichia coli CFT073
augccucgcugau

SEQ ID NO: 666258 - RNA, 17 nt, Escherichia coli CFT073
augccucguuggucagc

SEQ ID NO: 666259 - RNA, 13 nt, Escherichia coli CFT073
augccucuccugu

SEQ ID NO: 666260 - RNA, 21 nt, Escherichia coli CFT073
augccucucgcgaggagaggc

SEQ ID NO: 666261 - RNA, 18 nt, Escherichia coli CFT073
augccucuuucauccgau

SEQ ID NO: 666262 - RNA, 22 nt, Escherichia coli CFT073
augccugaucaaagaccgguuu

SEQ ID NO: 666263 - RNA, 15 nt, Escherichia coli CFT073
augccuguccucuuc

SEQ ID NO: 666264 - RNA, 22 nt, Escherichia coli CFT073
augccuguauugguuucgagga

SEQ ID NO: 666265 - RNA, 22 nt, Escherichia coli CFT073
augccugugcgauuuccuucag

SEQ ID NO: 666266 - RNA, 22 nt, Escherichia coli CFT073
augccuugugggccugaaagcu

SEQ ID NO: 666267 - RNA, 20 nt, Escherichia coli CFT073
augccuuucuuuguucuucu

SEQ ID NO: 666268 - RNA, 20 nt, Escherichia coli CFT073
augaugacuugccuccagcg

SEQ ID NO: 666269 - RNA, 23 nt, Escherichia coli CFT073
augaugcaccaccugauugcugc

SEQ ID NO: 666270 - RNA, 16 nt, Escherichia coli CFT073
augaugccgacggcgc

SEQ ID NO: 666271 - RNA, 15 nt, Escherichia coli CFT073
augaugauugaccau

SEQ ID NO: 666272 - RNA, 20 nt, Escherichia coli CFT073
augaucugcgcccaauaucc

SEQ ID NO: 666273 - RNA, 22 nt, Escherichia coli CFT073
augaucugcgcccaauauccug

SEQ ID NO: 666274 - RNA, 18 nt, Escherichia coli CFT073
augagcacaacauacuga

SEQ ID NO: 666275 - RNA, 16 nt, Escherichia coli CFT073
augauguucaacuuuc

SEQ ID NO: 666276 - RNA, 22 nt, Escherichia coli CFT073
augaugcuacagcaacagggga

SEQ ID NO: 666277 - RNA, 15 nt, Escherichia coli CFT073
augaugcugauggcu

SEQ ID NO: 666278 - RNA, 18 nt, Escherichia coli CFT073
augauggcgugaaagaaa

SEQ ID NO: 666279 - RNA, 17 nt, Escherichia coli CFT073
augauggcuaucaagau

SEQ ID NO: 666280 - RNA, 23 nt, Escherichia coli CFT073
augauggugaaagcaaaaaagaa

SEQ ID NO: 666281 - RNA, 14 nt, Escherichia coli CFT073
augauuaccagcau

SEQ ID NO: 666282 - RNA, 15 nt, Escherichia coli CFT073
augauuaccagcauc

SEQ ID NO: 666283 - RNA, 16 nt, Escherichia coli CFT073
augauuaccagcauca

SEQ ID NO: 666284 - RNA, 19 nt, Escherichia coli CFT073
augauuaccggagcugcag

SEQ ID NO: 666285 - RNA, 21 nt, Escherichia coli CFT073
augauuaccggagcugcagcc

SEQ ID NO: 666286 - RNA, 21 nt, Escherichia coli CFT073
augauuacucccuugccugca

SEQ ID NO: 666287 - RNA, 18 nt, Escherichia coli CFT073
augauuaucaugcccuuu

SEQ ID NO: 666288 - RNA, 18 nt, Escherichia coli CFT073
augauugaccauauuaac

SEQ ID NO: 666289 - RNA, 14 nt, Escherichia coli CFT073
augauugccacaag

SEQ ID NO: 666290 - RNA, 21 nt, Escherichia coli CFT073
augauuccgcagauauucguu

SEQ ID NO: 666291 - RNA, 15 nt, Escherichia coli CFT073
augauuuccaggaug

SEQ ID NO: 666292 - RNA, 20 nt, Escherichia coli CFT073
augauuucaucaucaggcau

SEQ ID NO: 666293 - RNA, 21 nt, Escherichia coli CFT073
augauuuucaucuuuugcgau

SEQ ID NO: 666294 - RNA, 12 nt, Escherichia coli CFT073
augauuuuccug

SEQ ID NO: 666295 - RNA, 23 nt, Escherichia coli CFT073
augcaaacgauuaucaacacauu

SEQ ID NO: 666296 - RNA, 12 nt, Escherichia coli CFT073
augcaacgugau

SEQ ID NO: 666297 - RNA, 17 nt, Escherichia coli CFT073
augcaacugcccaggca

SEQ ID NO: 666298 - RNA, 20 nt, Escherichia coli CFT073
augcaacuguuuuaccaaau

SEQ ID NO: 666299 - RNA, 15 nt, Escherichia coli CFT073
augcaacuguuuuac

SEQ ID NO: 666300 - RNA, 14 nt, Escherichia coli CFT073
augcaaaugagaau

SEQ ID NO: 666301 - RNA, 12 nt, Escherichia coli CFT073
augcaaauuucc

SEQ ID NO: 666302 - RNA, 14 nt, Escherichia coli CFT073
augcaaucacugcc

SEQ ID NO: 666303 - RNA, 15 nt, Escherichia coli CFT073
augcaauucacacag

SEQ ID NO: 666304 - RNA, 22 nt, Escherichia coli CFT073
augcaauagcgccugcugcugu

SEQ ID NO: 666305 - RNA, 17 nt, Escherichia coli CFT073
augcaauaaaaaagccg

SEQ ID NO: 666306 - RNA, 22 nt, Escherichia coli CFT073
augcaagaggguuauuuguuca

SEQ ID NO: 666307 - RNA, 15 nt, Escherichia coli CFT073
cagcguugaugcuca

SEQ ID NO: 666308 - RNA, 18 nt, Escherichia coli CFT073
cagcguugcagagaguca

SEQ ID NO: 666309 - RNA, 15 nt, Escherichia coli CFT073
cagcguucccuuccc

SEQ ID NO: 666310 - RNA, 15 nt, Escherichia coli CFT073
cagcguuccccagaa

SEQ ID NO: 666311 - RNA, 23 nt, Escherichia coli CFT073
cagcguguuaggaucacgccccu

SEQ ID NO: 666312 - RNA, 17 nt, Escherichia coli CFT073
cagcguggugacgagga

SEQ ID NO: 666313 - RNA, 18 nt, Escherichia coli CFT073
cagcgucgcguuuuucuc

SEQ ID NO: 666314 - RNA, 12 nt, Escherichia coli CFT073
cagcgucgggua

SEQ ID NO: 666315 - RNA, 22 nt, Escherichia coli CFT073
cagcgucgccaauggaauagcg

SEQ ID NO: 666316 - RNA, 22 nt, Escherichia coli CFT073
cagcgucauuuccagacgccau

SEQ ID NO: 666317 - RNA, 22 nt, Escherichia coli CFT073
cagcgggaucggcguacuggca

SEQ ID NO: 666318 - RNA, 21 nt, Escherichia coli CFT073
cagcgggauucuccugagaau

SEQ ID NO: 666319 - RNA, 15 nt, Escherichia coli CFT073
aaaauuacgaauucc

SEQ ID NO: 666320 - RNA, 22 nt, Escherichia coli CFT073
aaaauuacucucgugccagagc

SEQ ID NO: 666321 - RNA, 15 nt, Escherichia coli CFT073
aaaauuauuuuaaau

SEQ ID NO: 666322 - RNA, 18 nt, Escherichia coli CFT073
aaaauucauaaagcuauu

SEQ ID NO: 666323 - RNA, 14 nt, Escherichia coli CFT073
cagcgggcuccaug

SEQ ID NO: 666324 - RNA, 12 nt, Escherichia coli CFT073
cagcggggcgaa

SEQ ID NO: 666325 - RNA, 21 nt, Escherichia coli CFT073
cagcgggguucuccugagaac

SEQ ID NO: 666326 - RNA, 15 nt, Escherichia coli CFT073
cagcgguugagagaa

SEQ ID NO: 666327 - RNA, 17 nt, Escherichia coli CFT073
cagcgguuuacccugcu

SEQ ID NO: 666328 - RNA, 23 nt, Escherichia coli CFT073
cagcggguuuucuacuuuuucuu

SEQ ID NO: 666329 - RNA, 12 nt, Escherichia coli CFT073
cagcggguuaau

SEQ ID NO: 666330 - RNA, 20 nt, Escherichia coli CFT073
cagcguagugauaccccgca

SEQ ID NO: 666331 - RNA, 13 nt, Escherichia coli CFT073
cagcguaccauga

SEQ ID NO: 666332 - RNA, 14 nt, Escherichia coli CFT073
cagcgucagaaaca

SEQ ID NO: 666333 - RNA, 16 nt, Escherichia coli CFT073
cagcgucagcacuuca

SEQ ID NO: 666334 - RNA, 14 nt, Escherichia coli CFT073
cagcgucagcagca

SEQ ID NO: 666335 - RNA, 15 nt, Escherichia coli CFT073
cagcguauuccaccg

SEQ ID NO: 666336 - RNA, 18 nt, Escherichia coli CFT073
cagcguaaaaaaacaaaa

SEQ ID NO: 666337 - RNA, 21 nt, Escherichia coli CFT073
cagcguaaauccugacgcugg

SEQ ID NO: 666338 - RNA, 16 nt, Escherichia coli CFT073
cagcguaacgcccacg

SEQ ID NO: 666339 - RNA, 21 nt, Escherichia coli CFT073
cagcguaacgcccacgcuacu

SEQ ID NO: 666340 - RNA, 19 nt, Escherichia coli CFT073
cagcguaauaggcgcgaca

SEQ ID NO: 666341 - RNA, 18 nt, Escherichia coli CFT073
cagcggcaaccagcagca

SEQ ID NO: 666342 - RNA, 19 nt, Escherichia coli CFT073
cagcggcaacggcacauau

SEQ ID NO: 666343 - RNA, 18 nt, Escherichia coli CFT073
cagcggcauuacgcgccu

SEQ ID NO: 666344 - RNA, 22 nt, Escherichia coli CFT073
cagcggccagacgcgccgccac

SEQ ID NO: 666345 - RNA, 19 nt, Escherichia coli CFT073
cagcggcuuccccaacaca

SEQ ID NO: 666346 - RNA, 14 nt, Escherichia coli CFT073
cagcggcuuuuuac

SEQ ID NO: 666347 - RNA, 16 nt, Escherichia coli CFT073
cagcggcuuuuuacgc

SEQ ID NO: 666348 - RNA, 17 nt, Escherichia coli CFT073
cagcggcguuuuaucac

SEQ ID NO: 666349 - RNA, 20 nt, Escherichia coli CFT073
cagcggcugcuucgcgccca

SEQ ID NO: 666350 - RNA, 17 nt, Escherichia coli CFT073
cagcggcuguuccggca

SEQ ID NO: 666351 - RNA, 14 nt, Escherichia coli CFT073
cagcggaugaccca

SEQ ID NO: 666352 - RNA, 20 nt, Escherichia coli CFT073
cagcggauaaagcagggcag

SEQ ID NO: 666353 - RNA, 23 nt, Escherichia coli CFT073
cagcggaaugcagucacgccagu

SEQ ID NO: 666354 - RNA, 20 nt, Escherichia coli CFT073
cagcgcuaccagagccgcgc

SEQ ID NO: 666355 - RNA, 17 nt, Escherichia coli CFT073
cagcgcggcgagagccu

SEQ ID NO: 666356 - RNA, 21 nt, Escherichia coli CFT073
cagcgcggcgauaauacccag

SEQ ID NO: 666357 - RNA, 22 nt, Escherichia coli CFT073
cagcgcaucguagauuucaucc

SEQ ID NO: 666358 - RNA, 14 nt, Escherichia coli CFT073
cagcgcauccuggc

SEQ ID NO: 666359 - RNA, 20 nt, Escherichia coli CFT073
cagcgcaugacccagugcau

SEQ ID NO: 666360 - RNA, 21 nt, Escherichia coli CFT073
cagcgcauggcggcagcgugc

SEQ ID NO: 666361 - RNA, 12 nt, Escherichia coli CFT073
cagcgcauugac

SEQ ID NO: 666362 - RNA, 20 nt, Escherichia coli CFT073
cagcgccugcagcugcagau

SEQ ID NO: 666363 - RNA, 19 nt, Escherichia coli CFT073
cagcgcggcagcggcuuca

SEQ ID NO: 666364 - RNA, 14 nt, Escherichia coli CFT073
cagcgcgcucgcca

SEQ ID NO: 666365 - RNA, 16 nt, Escherichia coli CFT073
cagcgcggagaacuua

SEQ ID NO: 666366 - RNA, 22 nt, Escherichia coli CFT073
cagcgcgcguauccugcaugga

SEQ ID NO: 666367 - RNA, 22 nt, Escherichia coli CFT073
cagcgccuggcagcaugcugcc

SEQ ID NO: 666368 - RNA, 14 nt, Escherichia coli CFT073
cagccacaaaccau

SEQ ID NO: 666369 - RNA, 15 nt, Escherichia coli CFT073
cagccacaccaauca

SEQ ID NO: 666370 - RNA, 18 nt, Escherichia coli CFT073
cagccaaauaaaaucccg

SEQ ID NO: 666371 - RNA, 21 nt, Escherichia coli CFT073
cagccaaaucccgugaugcgg

SEQ ID NO: 666372 - RNA, 15 nt, Escherichia coli CFT073
cagccaacgaucugg

SEQ ID NO: 666373 - RNA, 23 nt, Escherichia coli CFT073
cagcagcgacucacgaaucgccu

SEQ ID NO: 666374 - RNA, 22 nt, Escherichia coli CFT073
cagcagccgcgcuuucuucuuc

SEQ ID NO: 666375 - RNA, 19 nt, Escherichia coli CFT073
cagcagcgaaucagcccag

SEQ ID NO: 666376 - RNA, 14 nt, Escherichia coli CFT073
cagcagcccgagca

SEQ ID NO: 666377 - RNA, 23 nt, Escherichia coli CFT073
cagcagccacaccaaucaacaau

SEQ ID NO: 666378 - RNA, 19 nt, Escherichia coli CFT073
cagcagccgcgcuuucuuc

SEQ ID NO: 666379 - RNA, 15 nt, Escherichia coli CFT073
cagccagcaccaggc

SEQ ID NO: 666380 - RNA, 15 nt, Escherichia coli CFT073
cagccagcacugccg

SEQ ID NO: 666381 - RNA, 15 nt, Escherichia coli CFT073
cagccagcagcgaau

SEQ ID NO: 666382 - RNA, 18 nt, Escherichia coli CFT073
cagccagccaagcauguc

SEQ ID NO: 666383 - RNA, 18 nt, Escherichia coli CFT073
cagccagguuuugcucug

SEQ ID NO: 666384 - RNA, 16 nt, Escherichia coli CFT073
cagccaguaaaccaau

SEQ ID NO: 666385 - RNA, 14 nt, Escherichia coli CFT073
cagccaguagcacc

SEQ ID NO: 666386 - RNA, 16 nt, Escherichia coli CFT073
cagccagucagucucu

SEQ ID NO: 666387 - RNA, 19 nt, Escherichia coli CFT073
cagccaguucgagaaaaau

SEQ ID NO: 666388 - RNA, 21 nt, Escherichia coli CFT073
cagccaguuuuucagcgccag

SEQ ID NO: 666389 - RNA, 22 nt, Escherichia coli CFT073
cagccauaaagaaaucaccugc

SEQ ID NO: 666390 - RNA, 23 nt, Escherichia coli CFT073
cagccauaaagaaaucaccugcc

SEQ ID NO: 666391 - RNA, 21 nt, Escherichia coli CFT073
cagccauaaucacucuucccc

SEQ ID NO: 666392 - RNA, 19 nt, Escherichia coli CFT073
cagccagaaaucaccaccg

SEQ ID NO: 666393 - RNA, 16 nt, Escherichia coli CFT073
cagccagaauaucccc

SEQ ID NO: 666394 - RNA, 16 nt, Escherichia coli CFT073
cagccacugcgcgccu

SEQ ID NO: 666395 - RNA, 12 nt, Escherichia coli CFT073
cagccacugcgg

SEQ ID NO: 666396 - RNA, 16 nt, Escherichia coli CFT073
cagccacugcgccauu

SEQ ID NO: 666397 - RNA, 12 nt, Escherichia coli CFT073
cagccacuuccu

SEQ ID NO: 666398 - RNA, 15 nt, Escherichia coli CFT073
cagccagacucagca

SEQ ID NO: 666399 - RNA, 22 nt, Escherichia coli CFT073
cagccagagaauaccguugacc

SEQ ID NO: 666400 - RNA, 17 nt, Escherichia coli CFT073
cagcccaaagagcaaga

SEQ ID NO: 666401 - RNA, 18 nt, Escherichia coli CFT073
cagccauacguugcauaa

SEQ ID NO: 666402 - RNA, 15 nt, Escherichia coli CFT073
cagcccagaucagac

SEQ ID NO: 666403 - RNA, 19 nt, Escherichia coli CFT073
cagcccaggaagcccgccc

SEQ ID NO: 666404 - RNA, 22 nt, Escherichia coli CFT073
cagcccaggaagcccgcccagc

SEQ ID NO: 666405 - RNA, 14 nt, Escherichia coli CFT073
cagccccaguuccu

SEQ ID NO: 666406 - RNA, 16 nt, Escherichia coli CFT073
cagccccaucagcgcc

SEQ ID NO: 666407 - RNA, 17 nt, Escherichia coli CFT073
cagccccaucagcgcca

SEQ ID NO: 666408 - RNA, 22 nt, Escherichia coli CFT073
cagccccagacguuucgccagc

SEQ ID NO: 666409 - RNA, 21 nt, Escherichia coli CFT073
cagcccauaccgugguuuugg

SEQ ID NO: 666410 - RNA, 13 nt, Escherichia coli CFT073
cagccccucagcg

SEQ ID NO: 666411 - RNA, 14 nt, Escherichia coli CFT073
cagccccucagcgg

SEQ ID NO: 666412 - RNA, 12 nt, Escherichia coli CFT073
cagccccuccgg

SEQ ID NO: 666413 - RNA, 13 nt, Escherichia coli CFT073
cagccccuccgga

SEQ ID NO: 666414 - RNA, 15 nt, Escherichia coli CFT073
cagcccgagguuauu

SEQ ID NO: 666415 - RNA, 13 nt, Escherichia coli CFT073
cagcccgccgaga

SEQ ID NO: 666416 - RNA, 14 nt, Escherichia coli CFT073
cagcccgccgagaa

SEQ ID NO: 666417 - RNA, 16 nt, Escherichia coli CFT073
cagcccgccaaugccg

SEQ ID NO: 666418 - RNA, 13 nt, Escherichia coli CFT073
cagcccgccacaa

SEQ ID NO: 666419 - RNA, 21 nt, Escherichia coli CFT073
cagcccggcaagugucgccug

SEQ ID NO: 666420 - RNA, 12 nt, Escherichia coli CFT073
cagcgcaaagau

SEQ ID NO: 666421 - RNA, 12 nt, Escherichia coli CFT073
cagcgcaacuug

SEQ ID NO: 666422 - RNA, 22 nt, Escherichia coli CFT073
cagcgcaacuugugcucgcguu

SEQ ID NO: 666423 - RNA, 19 nt, Escherichia coli CFT073
cagcgaguuuuucaguccg

SEQ ID NO: 666424 - RNA, 14 nt, Escherichia coli CFT073
cagcgauaccggcu

SEQ ID NO: 666425 - RNA, 20 nt, Escherichia coli CFT073
cagcgagggcuaugcgcauc

SEQ ID NO: 666426 - RNA, 16 nt, Escherichia coli CFT073
cagccuuucacaucag

SEQ ID NO: 666427 - RNA, 14 nt, Escherichia coli CFT073
cagccuucuugcug

SEQ ID NO: 666428 - RNA, 22 nt, Escherichia coli CFT073
cagcgacauacucagcgccugc

SEQ ID NO: 666429 - RNA, 17 nt, Escherichia coli CFT073
cagccugugccugagcc

SEQ ID NO: 666430 - RNA, 19 nt, Escherichia coli CFT073
cagccuugaggccauccgc

SEQ ID NO: 666431 - RNA, 20 nt, Escherichia coli CFT073
cagcgacgacuggcgcggca

SEQ ID NO: 666432 - RNA, 22 nt, Escherichia coli CFT073
cagcgacgacuggcgcggcagg

SEQ ID NO: 666433 - RNA, 15 nt, Escherichia coli CFT073
cagccuaugcagguu

SEQ ID NO: 666434 - RNA, 17 nt, Escherichia coli CFT073
cagccguuuaauugccu

SEQ ID NO: 666435 - RNA, 18 nt, Escherichia coli CFT073
cagccguuuaauugccuc

SEQ ID NO: 666436 - RNA, 22 nt, Escherichia coli CFT073
cagccuaagccauuuaacucac

SEQ ID NO: 666437 - RNA, 22 nt, Escherichia coli CFT073
cagccguugucagucaucacuu

SEQ ID NO: 666438 - RNA, 22 nt, Escherichia coli CFT073
cagccggguaaucagcuuaucc

SEQ ID NO: 666439 - RNA, 19 nt, Escherichia coli CFT073
cagccgucgcccacagucu

SEQ ID NO: 666440 - RNA, 15 nt, Escherichia coli CFT073
cagccgcuaacuucc

SEQ ID NO: 666441 - RNA, 22 nt, Escherichia coli CFT073
cagccgcuaacuuccugcuggc

SEQ ID NO: 666442 - RNA, 21 nt, Escherichia coli CFT073
cagcccggguuugccgcuggc

SEQ ID NO: 666443 - RNA, 17 nt, Escherichia coli CFT073
cagggccucuccuuuac

SEQ ID NO: 666444 - RNA, 16 nt, Escherichia coli CFT073
cagggauggcuccggg

SEQ ID NO: 666445 - RNA, 22 nt, Escherichia coli CFT073
cagggauaaagcuuuuuauuac

SEQ ID NO: 666446 - RNA, 17 nt, Escherichia coli CFT073
cagggaucauccacccg

SEQ ID NO: 666447 - RNA, 18 nt, Escherichia coli CFT073
caggggcaaucagcacua

SEQ ID NO: 666448 - RNA, 22 nt, Escherichia coli CFT073
cagggcuuucgcaauaaucauc

SEQ ID NO: 666449 - RNA, 22 nt, Escherichia coli CFT073
cagggcuuuuuaaugcaauaaa

SEQ ID NO: 666450 - RNA, 21 nt, Escherichia coli CFT073
cagggcuuuuuuauuucaucu

SEQ ID NO: 666451 - RNA, 18 nt, Escherichia coli CFT073
caggguaucgguugcugg

SEQ ID NO: 666452 - RNA, 18 nt, Escherichia coli CFT073
cagggguuguuauuuccg

SEQ ID NO: 666453 - RNA, 20 nt, Escherichia coli CFT073
caggguucccggccaaagcg

SEQ ID NO: 666454 - RNA, 15 nt, Escherichia coli CFT073
caggguugcagaccc

SEQ ID NO: 666455 - RNA, 22 nt, Escherichia coli CFT073
caggguuauuuguaacugucgg

SEQ ID NO: 666456 - RNA, 15 nt, Escherichia coli CFT073
caggguguaggcaaa

SEQ ID NO: 666457 - RNA, 22 nt, Escherichia coli CFT073
cagggugacaaauuugugcucu

SEQ ID NO: 666458 - RNA, 18 nt, Escherichia coli CFT073
cagguaagcgauaaaaau

SEQ ID NO: 666459 - RNA, 21 nt, Escherichia coli CFT073
cagguaagaguuucaacauca

SEQ ID NO: 666460 - RNA, 18 nt, Escherichia coli CFT073
cagguagcguuucaccuc

SEQ ID NO: 666461 - RNA, 21 nt, Escherichia coli CFT073
cagguagcguuucaccucuuu

SEQ ID NO: 666462 - RNA, 15 nt, Escherichia coli CFT073
cagguagcagcagcg

SEQ ID NO: 666463 - RNA, 18 nt, Escherichia coli CFT073
cagguagcagcagcgcca

SEQ ID NO: 666464 - RNA, 22 nt, Escherichia coli CFT073
cagguagccggaggauguuaca

SEQ ID NO: 666465 - RNA, 16 nt, Escherichia coli CFT073
cagguacucaccguug

SEQ ID NO: 666466 - RNA, 19 nt, Escherichia coli CFT073
cagguacucaugcccacgc

SEQ ID NO: 666467 - RNA, 17 nt, Escherichia coli CFT073
caggcuaccgcagugaa

SEQ ID NO: 666468 - RNA, 13 nt, Escherichia coli CFT073
caggcguuucacu

SEQ ID NO: 666469 - RNA, 15 nt, Escherichia coli CFT073
caggcguuucuucac

SEQ ID NO: 666470 - RNA, 17 nt, Escherichia coli CFT073
caggcguuucuucaccc

SEQ ID NO: 666471 - RNA, 23 nt, Escherichia coli CFT073
caggcggguaucguuaaagagau

SEQ ID NO: 666472 - RNA, 15 nt, Escherichia coli CFT073
caggcgcugcuggag

SEQ ID NO: 666473 - RNA, 16 nt, Escherichia coli CFT073
caggcgcugcuggagc

SEQ ID NO: 666474 - RNA, 16 nt, Escherichia coli CFT073
caggcggcuaugcugg

SEQ ID NO: 666475 - RNA, 20 nt, Escherichia coli CFT073
caggcuuuauucugacgcca

SEQ ID NO: 666476 - RNA, 15 nt, Escherichia coli CFT073
caggcucugacugau

SEQ ID NO: 666477 - RNA, 15 nt, Escherichia coli CFT073
caggcuacucccagu

SEQ ID NO: 666478 - RNA, 16 nt, Escherichia coli CFT073
caggcuacucccagua

SEQ ID NO: 666479 - RNA, 17 nt, Escherichia coli CFT073
caggcuaucgaacaugc

SEQ ID NO: 666480 - RNA, 12 nt, Escherichia coli CFT073
caggcugaugga

SEQ ID NO: 666481 - RNA, 23 nt, Escherichia coli CFT073
caggcugaacaacaguuuuaucu

SEQ ID NO: 666482 - RNA, 15 nt, Escherichia coli CFT073
caggcugagaaggga

SEQ ID NO: 666483 - RNA, 22 nt, Escherichia coli CFT073
caggcugaggcguuucaacucc

SEQ ID NO: 666484 - RNA, 18 nt, Escherichia coli CFT073
caggccuacggggugugu

SEQ ID NO: 666485 - RNA, 18 nt, Escherichia coli CFT073
caggccuaacaccaucag

SEQ ID NO: 666486 - RNA, 14 nt, Escherichia coli CFT073
caggccguggauca

SEQ ID NO: 666487 - RNA, 16 nt, Escherichia coli CFT073
caggccaauagugcgg

SEQ ID NO: 666488 - RNA, 21 nt, Escherichia coli CFT073
caggcgcgugaaugccugagg

SEQ ID NO: 666489 - RNA, 14 nt, Escherichia coli CFT073
caggcgcgccuggu

SEQ ID NO: 666490 - RNA, 14 nt, Escherichia coli CFT073
caggcgagcugcca

SEQ ID NO: 666491 - RNA, 21 nt, Escherichia coli CFT073
caggcgacucgguugcacaga

SEQ ID NO: 666492 - RNA, 14 nt, Escherichia coli CFT073
caggcagcaaucac

SEQ ID NO: 666493 - RNA, 21 nt, Escherichia coli CFT073
caggcagauacaaccaaucgc

SEQ ID NO: 666494 - RNA, 17 nt, Escherichia coli CFT073
caggcacuugucaccaa

SEQ ID NO: 666495 - RNA, 15 nt, Escherichia coli CFT073
caggcagaacgccau

SEQ ID NO: 666496 - RNA, 20 nt, Escherichia coli CFT073
caggcagaacgccaugccaa

SEQ ID NO: 666497 - RNA, 22 nt, Escherichia coli CFT073
caggcagaagagaagaaagaag

SEQ ID NO: 666498 - RNA, 18 nt, Escherichia coli CFT073
caggcacuacguucucac

SEQ ID NO: 666499 - RNA, 22 nt, Escherichia coli CFT073
caggcaguucgcggauaucuuu

SEQ ID NO: 666500 - RNA, 18 nt, Escherichia coli CFT073
caggcagugaauuucuac

SEQ ID NO: 666501 - RNA, 19 nt, Escherichia coli CFT073
caggauuuccagcucaaag

SEQ ID NO: 666502 - RNA, 19 nt, Escherichia coli CFT073
caggcaaagucacccgaua

SEQ ID NO: 666503 - RNA, 23 nt, Escherichia coli CFT073
caggcaaaucgcucccucuccac

SEQ ID NO: 666504 - RNA, 14 nt, Escherichia coli CFT073
caggcaaaccagua

SEQ ID NO: 666505 - RNA, 22 nt, Escherichia coli CFT073
caggcaaacuucacgcauuuac

SEQ ID NO: 666506 - RNA, 15 nt, Escherichia coli CFT073
caggcacaccgccgc

SEQ ID NO: 666507 - RNA, 14 nt, Escherichia coli CFT073
caggcacaccagca

SEQ ID NO: 666508 - RNA, 15 nt, Escherichia coli CFT073
caggcacaucggcua

SEQ ID NO: 666509 - RNA, 15 nt, Escherichia coli CFT073
caggcaccagccccu

SEQ ID NO: 666510 - RNA, 16 nt, Escherichia coli CFT073
caggcaacaucgccag

SEQ ID NO: 666511 - RNA, 19 nt, Escherichia coli CFT073
caggcaacggugacuggcu

SEQ ID NO: 666512 - RNA, 18 nt, Escherichia coli CFT073
caggcaacuucaagguca

SEQ ID NO: 666513 - RNA, 16 nt, Escherichia coli CFT073
caggcaagcauaugac

SEQ ID NO: 666514 - RNA, 23 nt, Escherichia coli CFT073
caggcaagccuugcagccagaac

SEQ ID NO: 666515 - RNA, 22 nt, Escherichia coli CFT073
caggcaagccgcuaacagcagc

SEQ ID NO: 666516 - RNA, 22 nt, Escherichia coli CFT073
caggcaaucaguaaucgcgcca

SEQ ID NO: 666517 - RNA, 14 nt, Escherichia coli CFT073
caggaauucggcau

SEQ ID NO: 666518 - RNA, 16 nt, Escherichia coli CFT073
caggacaucagcgcac

SEQ ID NO: 666519 - RNA, 20 nt, Escherichia coli CFT073
caggacaucagcgcaccaua

SEQ ID NO: 666520 - RNA, 15 nt, Escherichia coli CFT073
caggaccauucacac

SEQ ID NO: 666521 - RNA, 22 nt, Escherichia coli CFT073
caggaguagcucuggguaacac

SEQ ID NO: 666522 - RNA, 16 nt, Escherichia coli CFT073
caggaguagcucuggg

SEQ ID NO: 666523 - RNA, 23 nt, Escherichia coli CFT073
caggaucaucauuguugguuaaa

SEQ ID NO: 666524 - RNA, 13 nt, Escherichia coli CFT073
caggaucagcucc

SEQ ID NO: 666525 - RNA, 14 nt, Escherichia coli CFT073
caggaucagcaaaa

SEQ ID NO: 666526 - RNA, 15 nt, Escherichia coli CFT073
caggaucagcaaaau

SEQ ID NO: 666527 - RNA, 18 nt, Escherichia coli CFT073
caggauccgcucugcccu

SEQ ID NO: 666528 - RNA, 18 nt, Escherichia coli CFT073
caggauuacgcucaccaa

SEQ ID NO: 666529 - RNA, 20 nt, Escherichia coli CFT073
caggauuacgcucaccaaaa

SEQ ID NO: 666530 - RNA, 18 nt, Escherichia coli CFT073
caggauuacuuaacuucc

SEQ ID NO: 666531 - RNA, 17 nt, Escherichia coli CFT073
caggauguaauccggca

SEQ ID NO: 666532 - RNA, 16 nt, Escherichia coli CFT073
caggaugcggcuaauu

SEQ ID NO: 666533 - RNA, 19 nt, Escherichia coli CFT073
caggaugccguuaauaaua

SEQ ID NO: 666534 - RNA, 20 nt, Escherichia coli CFT073
caggauggcauuugcaacac

SEQ ID NO: 666535 - RNA, 13 nt, Escherichia coli CFT073
caggaugcuucaa

SEQ ID NO: 666536 - RNA, 19 nt, Escherichia coli CFT073
caggaugcuucaacgaaag

SEQ ID NO: 666537 - RNA, 21 nt, Escherichia coli CFT073
caggaaaaucagcaucaaccc

SEQ ID NO: 666538 - RNA, 17 nt, Escherichia coli CFT073
caggaaaucgucgaggg

SEQ ID NO: 666539 - RNA, 17 nt, Escherichia coli CFT073
caggaaaaugagauggu

SEQ ID NO: 666540 - RNA, 13 nt, Escherichia coli CFT073
cagcuuucagaga

SEQ ID NO: 666541 - RNA, 14 nt, Escherichia coli CFT073
caggaacuucguaa

SEQ ID NO: 666542 - RNA, 17 nt, Escherichia coli CFT073
caggaacuguugcaaaa

SEQ ID NO: 666543 - RNA, 15 nt, Escherichia coli CFT073
caggaagccccagcu

SEQ ID NO: 666544 - RNA, 17 nt, Escherichia coli CFT073
cagcuuguuauccauca

SEQ ID NO: 666545 - RNA, 15 nt, Escherichia coli CFT073
cagcuucgucaccug

SEQ ID NO: 666546 - RNA, 23 nt, Escherichia coli CFT073
cagcuucucgugaaauucacgca

SEQ ID NO: 666547 - RNA, 17 nt, Escherichia coli CFT073
cagcuucuucuccagcu

SEQ ID NO: 666548 - RNA, 19 nt, Escherichia coli CFT073
cagcuucuucuccagcugc

SEQ ID NO: 666549 - RNA, 23 nt, Escherichia coli CFT073
cagcugguaauggcgaucgggaa

SEQ ID NO: 666550 - RNA, 18 nt, Escherichia coli CFT073
cagcuggcgccaggcuuc

SEQ ID NO: 666551 - RNA, 19 nt, Escherichia coli CFT073
cagcucuuuauccagcagc

SEQ ID NO: 666552 - RNA, 21 nt, Escherichia coli CFT073
cagcucuuuauccagcagcca

SEQ ID NO: 666553 - RNA, 13 nt, Escherichia coli CFT073
cagcucuuucucg

SEQ ID NO: 666554 - RNA, 16 nt, Escherichia coli CFT073
cagcucgugcagaaca

SEQ ID NO: 666555 - RNA, 20 nt, Escherichia coli CFT073
cagcugaaaucaccgccacc

SEQ ID NO: 666556 - RNA, 16 nt, Escherichia coli CFT073
cagcguuuccagcacc

SEQ ID NO: 666557 - RNA, 21 nt, Escherichia coli CFT073
cagcguuuccagcaccaguuc

SEQ ID NO: 666558 - RNA, 23 nt, Escherichia coli CFT073
cagcguuugcagcuuacgcgcca

SEQ ID NO: 666559 - RNA, 15 nt, Escherichia coli CFT073
cagcguuugcugaaa

SEQ ID NO: 666560 - RNA, 15 nt, Escherichia coli CFT073
cagcugcucccagcg

SEQ ID NO: 666561 - RNA, 20 nt, Escherichia coli CFT073
cagcugcucauagcggcugc

SEQ ID NO: 666562 - RNA, 17 nt, Escherichia coli CFT073
cagcugcucauuacagu

SEQ ID NO: 666563 - RNA, 14 nt, Escherichia coli CFT073
cagcugccugccag

SEQ ID NO: 666564 - RNA, 15 nt, Escherichia coli CFT073
cagcugccugccagu

SEQ ID NO: 666565 - RNA, 16 nt, Escherichia coli CFT073
cagcugccugccagua

SEQ ID NO: 666566 - RNA, 18 nt, Escherichia coli CFT073
cagcugccgaaccacuga

SEQ ID NO: 666567 - RNA, 20 nt, Escherichia coli CFT073
cagcugccgaaccacugaug

SEQ ID NO: 666568 - RNA, 17 nt, Escherichia coli CFT073
aaaaugauaaauugccu

SEQ ID NO: 666569 - RNA, 15 nt, Escherichia coli CFT073
cagcaacaucaccaa

SEQ ID NO: 666570 - RNA, 17 nt, Escherichia coli CFT073
cagcaacaucacgcuga

SEQ ID NO: 666571 - RNA, 21 nt, Escherichia coli CFT073
aaaaugauguagcccugauac

SEQ ID NO: 666572 - RNA, 17 nt, Escherichia coli CFT073
aaaaugaugauugacca

SEQ ID NO: 666573 - RNA, 23 nt, Escherichia coli CFT073
cagcaaagagagauccagcuucg

SEQ ID NO: 666574 - RNA, 14 nt, Escherichia coli CFT073
cagcaaagcccggg

SEQ ID NO: 666575 - RNA, 20 nt, Escherichia coli CFT073
cagcaaauaauucaucuuuc

SEQ ID NO: 666576 - RNA, 22 nt, Escherichia coli CFT073
cagcaaauaguaagaaccacag

SEQ ID NO: 666577 - RNA, 21 nt, Escherichia coli CFT073
cagcaaaugacccauuuucuc

SEQ ID NO: 666578 - RNA, 19 nt, Escherichia coli CFT073
cagcaaauucgggcgcuga

SEQ ID NO: 666579 - RNA, 14 nt, Escherichia coli CFT073
cagcaacagcaaag

SEQ ID NO: 666580 - RNA, 14 nt, Escherichia coli CFT073
cagcaauaaaaaaa

SEQ ID NO: 666581 - RNA, 16 nt, Escherichia coli CFT073
cagcaauaaaaaaaug

SEQ ID NO: 666582 - RNA, 16 nt, Escherichia coli CFT073
cagcaagagcaaauaa

SEQ ID NO: 666583 - RNA, 16 nt, Escherichia coli CFT073
cagcaagugcggcgca

SEQ ID NO: 666584 - RNA, 12 nt, Escherichia coli CFT073
cagcaagaacca

SEQ ID NO: 666585 - RNA, 17 nt, Escherichia coli CFT073
cagcaagaccgcgacca

SEQ ID NO: 666586 - RNA, 23 nt, Escherichia coli CFT073
cagcaacuggcuugccagcaggg

SEQ ID NO: 666587 - RNA, 16 nt, Escherichia coli CFT073
cagcaacuuaaucauc

SEQ ID NO: 666588 - RNA, 21 nt, Escherichia coli CFT073
cagcaacguuucgcuggaugu

SEQ ID NO: 666589 - RNA, 13 nt, Escherichia coli CFT073
cagcaacuacagc

SEQ ID NO: 666590 - RNA, 16 nt, Escherichia coli CFT073
aaaaugccagcaacug

SEQ ID NO: 666591 - RNA, 14 nt, Escherichia coli CFT073
aaaaugccagccuu

SEQ ID NO: 666592 - RNA, 16 nt, Escherichia coli CFT073
aaaaugcgaaaaaaac

SEQ ID NO: 666593 - RNA, 19 nt, Escherichia coli CFT073
aaaaugccguacagcagaa

SEQ ID NO: 666594 - RNA, 23 nt, Escherichia coli CFT073
aaaaugcgcggucagaaaauuau

SEQ ID NO: 666595 - RNA, 14 nt, Escherichia coli CFT073
aaaaugcgcaugau

SEQ ID NO: 666596 - RNA, 22 nt, Escherichia coli CFT073
cagcaacgcuucguagaagcca

SEQ ID NO: 666597 - RNA, 19 nt, Escherichia coli CFT073
cagcaacggaaaagcaaca

SEQ ID NO: 666598 - RNA, 13 nt, Escherichia coli CFT073
cagauccugccau

SEQ ID NO: 666599 - RNA, 22 nt, Escherichia coli CFT073
cagaucgaaaucuuuuuacugc

SEQ ID NO: 666600 - RNA, 15 nt, Escherichia coli CFT073
aaaaucggcaacauc

SEQ ID NO: 666601 - RNA, 23 nt, Escherichia coli CFT073
aaaaucggcaacaucaaauacag

SEQ ID NO: 666602 - RNA, 15 nt, Escherichia coli CFT073
aaaaucggcuuucaa

SEQ ID NO: 666603 - RNA, 14 nt, Escherichia coli CFT073
cagauucagcagcg

SEQ ID NO: 666604 - RNA, 15 nt, Escherichia coli CFT073
cagauccgcacccgc

SEQ ID NO: 666605 - RNA, 18 nt, Escherichia coli CFT073
cagauccgguucgccaug

SEQ ID NO: 666606 - RNA, 18 nt, Escherichia coli CFT073
cagauccgcugaugaauc

SEQ ID NO: 666607 - RNA, 20 nt, Escherichia coli CFT073
cagauccggcuuacaucuuu

SEQ ID NO: 666608 - RNA, 15 nt, Escherichia coli CFT073
cagauccgggcuaau

SEQ ID NO: 666609 - RNA, 15 nt, Escherichia coli CFT073
cagaucccacauaug

SEQ ID NO: 666610 - RNA, 13 nt, Escherichia coli CFT073
cagaucagggaag

SEQ ID NO: 666611 - RNA, 17 nt, Escherichia coli CFT073
cagaucagccacuuccu

SEQ ID NO: 666612 - RNA, 13 nt, Escherichia coli CFT073
cagauccaccaga

SEQ ID NO: 666613 - RNA, 14 nt, Escherichia coli CFT073
cagaucauccaucg

SEQ ID NO: 666614 - RNA, 14 nt, Escherichia coli CFT073
cagauugcugacaa

SEQ ID NO: 666615 - RNA, 13 nt, Escherichia coli CFT073
cagauugcugcug

SEQ ID NO: 666616 - RNA, 16 nt, Escherichia coli CFT073
cagauugaagauagag

SEQ ID NO: 666617 - RNA, 21 nt, Escherichia coli CFT073
cagauugauguuaccaacacu

SEQ ID NO: 666618 - RNA, 23 nt, Escherichia coli CFT073
cagauugaugcgaguaaucaggc

SEQ ID NO: 666619 - RNA, 14 nt, Escherichia coli CFT073
cagauucuccaccu

SEQ ID NO: 666620 - RNA, 13 nt, Escherichia coli CFT073
cagauugauaaag

SEQ ID NO: 666621 - RNA, 19 nt, Escherichia coli CFT073
cagauucagcgcacuuuca

SEQ ID NO: 666622 - RNA, 22 nt, Escherichia coli CFT073
cagauucagcgucgccagcagc

SEQ ID NO: 666623 - RNA, 23 nt, Escherichia coli CFT073
cagauucucauauaucccuucca

SEQ ID NO: 666624 - RNA, 15 nt, Escherichia coli CFT073
cagcaaaagcaggca

SEQ ID NO: 666625 - RNA, 17 nt, Escherichia coli CFT073
cagcaaaagcaggcacc

SEQ ID NO: 666626 - RNA, 20 nt, Escherichia coli CFT073
cagcaaaagcaggcaccgcg

SEQ ID NO: 666627 - RNA, 16 nt, Escherichia coli CFT073
cagcaaaaucaccauc

SEQ ID NO: 666628 - RNA, 17 nt, Escherichia coli CFT073
cagcaaaaucaccauca

SEQ ID NO: 666629 - RNA, 14 nt, Escherichia coli CFT073
aaaaucuucguuau

SEQ ID NO: 666630 - RNA, 22 nt, Escherichia coli CFT073
aaaaucuguacaggacgcaaug

SEQ ID NO: 666631 - RNA, 18 nt, Escherichia coli CFT073
cagcaauaaucagauggc

SEQ ID NO: 666632 - RNA, 22 nt, Escherichia coli CFT073
cagcaauaaucagauggcggcu

SEQ ID NO: 666633 - RNA, 14 nt, Escherichia coli CFT073
cagcaauaauaaua

SEQ ID NO: 666634 - RNA, 22 nt, Escherichia coli CFT073
cagcaauacaaaugaguuauca

SEQ ID NO: 666635 - RNA, 12 nt, Escherichia coli CFT073
cagcaaucacug

SEQ ID NO: 666636 - RNA, 22 nt, Escherichia coli CFT073
cagcaauauagcgcauggcagc

SEQ ID NO: 666637 - RNA, 16 nt, Escherichia coli CFT073
cagcaaucacugccag

SEQ ID NO: 666638 - RNA, 14 nt, Escherichia coli CFT073
cagcaccaaacugg

SEQ ID NO: 666639 - RNA, 14 nt, Escherichia coli CFT073
cagcaccaccgccc

SEQ ID NO: 666640 - RNA, 16 nt, Escherichia coli CFT073
cagcaccaccgcccgu

SEQ ID NO: 666641 - RNA, 14 nt, Escherichia coli CFT073
cagcaccagcuccg

SEQ ID NO: 666642 - RNA, 12 nt, Escherichia coli CFT073
cagcaccagaga

SEQ ID NO: 666643 - RNA, 17 nt, Escherichia coli CFT073
cagcaccagagaacuga

SEQ ID NO: 666644 - RNA, 12 nt, Escherichia coli CFT073
cagcaccagaua

SEQ ID NO: 666645 - RNA, 23 nt, Escherichia coli CFT073
cagcaccagcaacaacaacacgc

SEQ ID NO: 666646 - RNA, 14 nt, Escherichia coli CFT073
cagcaccagcaacg

SEQ ID NO: 666647 - RNA, 20 nt, Escherichia coli CFT073
cagcacgcugaacacgguag

SEQ ID NO: 666648 - RNA, 14 nt, Escherichia coli CFT073
cagcacgcugaagg

SEQ ID NO: 666649 - RNA, 14 nt, Escherichia coli CFT073
cagcacggagagac

SEQ ID NO: 666650 - RNA, 14 nt, Escherichia coli CFT073
cagcacgaagaggc

SEQ ID NO: 666651 - RNA, 15 nt, Escherichia coli CFT073
cagcaccugcuugaa

SEQ ID NO: 666652 - RNA, 19 nt, Escherichia coli CFT073
cagcaccuuaugcgggcca

SEQ ID NO: 666653 - RNA, 19 nt, Escherichia coli CFT073
cagcaccgcgacaaucagg

SEQ ID NO: 666654 - RNA, 10 nt, Escherichia coli CFT073
cagcaccgcg

SEQ ID NO: 666655 - RNA, 18 nt, Escherichia coli CFT073
cagcaccgcgacaaucag

SEQ ID NO: 666656 - RNA, 14 nt, Escherichia coli CFT073
cagcaccgcagaga

SEQ ID NO: 666657 - RNA, 15 nt, Escherichia coli CFT073
cagcaccgcagagau

SEQ ID NO: 666658 - RNA, 14 nt, Escherichia coli CFT073
cagcacccugaguu

SEQ ID NO: 666659 - RNA, 16 nt, Escherichia coli CFT073
cagcagcaauauguug

SEQ ID NO: 666660 - RNA, 15 nt, Escherichia coli CFT073
cagcagcaccaccgc

SEQ ID NO: 666661 - RNA, 21 nt, Escherichia coli CFT073
cagcagaucgaucuuguugaa

SEQ ID NO: 666662 - RNA, 11 nt, Escherichia coli CFT073
cagcagcagcg

SEQ ID NO: 666663 - RNA, 14 nt, Escherichia coli CFT073
cagcagcagacagc

SEQ ID NO: 666664 - RNA, 16 nt, Escherichia coli CFT073
cagcagcagacagccu

SEQ ID NO: 666665 - RNA, 18 nt, Escherichia coli CFT073
cagcacugauuuuuucca

SEQ ID NO: 666666 - RNA, 20 nt, Escherichia coli CFT073
cagcacugccagccacaggc

SEQ ID NO: 666667 - RNA, 23 nt, Escherichia coli CFT073
aaaaugguacucggcacguuacu

SEQ ID NO: 666668 - RNA, 17 nt, Escherichia coli CFT073
aaaauggggacaucaaa

SEQ ID NO: 666669 - RNA, 22 nt, Escherichia coli CFT073
aaaauggggacaucaaagaaaa

SEQ ID NO: 666670 - RNA, 23 nt, Escherichia coli CFT073
aaaauggggacaucaaagaaaag

SEQ ID NO: 666671 - RNA, 19 nt, Escherichia coli CFT073
aaaaugguuugccagcaga

SEQ ID NO: 666672 - RNA, 20 nt, Escherichia coli CFT073
aaaauguauuucaucaucag

SEQ ID NO: 666673 - RNA, 21 nt, Escherichia coli CFT073
aaaaugucaccuaauuuaaaa

SEQ ID NO: 666674 - RNA, 14 nt, Escherichia coli CFT073
cagcacguuuaaca

SEQ ID NO: 666675 - RNA, 20 nt, Escherichia coli CFT073
cagcacucugugcgucugcu

SEQ ID NO: 666676 - RNA, 21 nt, Escherichia coli CFT073
aaaaucccggcaacaaauuca

SEQ ID NO: 666677 - RNA, 18 nt, Escherichia coli CFT073
aaaaucccggugaccguc

SEQ ID NO: 666678 - RNA, 23 nt, Escherichia coli CFT073
aaaauccucaaucggaaaacaac

SEQ ID NO: 666679 - RNA, 16 nt, Escherichia coli CFT073
aaaaucgacagcagga

SEQ ID NO: 666680 - RNA, 17 nt, Escherichia coli CFT073
aaaaucgacaucugcaa

SEQ ID NO: 666681 - RNA, 13 nt, Escherichia coli CFT073
aaaaucgccugaa

SEQ ID NO: 666682 - RNA, 14 nt, Escherichia coli CFT073
aaaaucgccugaac

SEQ ID NO: 666683 - RNA, 14 nt, Escherichia coli CFT073
cagaucaccaauau

SEQ ID NO: 666684 - RNA, 17 nt, Escherichia coli CFT073
cagaucacgcaucaccc

SEQ ID NO: 666685 - RNA, 22 nt, Escherichia coli CFT073
cagaucagaacgcagcauuucc

SEQ ID NO: 666686 - RNA, 18 nt, Escherichia coli CFT073
cagauauuuaaguugauc

SEQ ID NO: 666687 - RNA, 14 nt, Escherichia coli CFT073
cagauaguuaccgu

SEQ ID NO: 666688 - RNA, 21 nt, Escherichia coli CFT073
cagauaucccgccagcaccag

SEQ ID NO: 666689 - RNA, 14 nt, Escherichia coli CFT073
cagauacugaugaa

SEQ ID NO: 666690 - RNA, 16 nt, Escherichia coli CFT073
cagauaccaacccugg

SEQ ID NO: 666691 - RNA, 14 nt, Escherichia coli CFT073
aaaauccaucccaa

SEQ ID NO: 666692 - RNA, 20 nt, Escherichia coli CFT073
cagauaggcaucagcaauug

SEQ ID NO: 666693 - RNA, 17 nt, Escherichia coli CFT073
cagauaccaauuuauuu

SEQ ID NO: 666694 - RNA, 14 nt, Escherichia coli CFT073
cagauaccacauca

SEQ ID NO: 666695 - RNA, 19 nt, Escherichia coli CFT073
cagauacccgacagauaaa

SEQ ID NO: 666696 - RNA, 15 nt, Escherichia coli CFT073
cagauaccaccagcg

SEQ ID NO: 666697 - RNA, 17 nt, Escherichia coli CFT073
cagauaccaccagcgcc

SEQ ID NO: 666698 - RNA, 15 nt, Escherichia coli CFT073
cagauaaccagagcg

SEQ ID NO: 666699 - RNA, 17 nt, Escherichia coli CFT073
cagauaacccagcagcc

SEQ ID NO: 666700 - RNA, 23 nt, Escherichia coli CFT073
cagauaacccaggggucaguucc

SEQ ID NO: 666701 - RNA, 19 nt, Escherichia coli CFT073
cagagauuugcuccagcga

SEQ ID NO: 666702 - RNA, 17 nt, Escherichia coli CFT073
cagagauuugcuccagc

SEQ ID NO: 666703 - RNA, 12 nt, Escherichia coli CFT073
cagagccugaau

SEQ ID NO: 666704 - RNA, 22 nt, Escherichia coli CFT073
cagagccgcgguauccggcuca

SEQ ID NO: 666705 - RNA, 13 nt, Escherichia coli CFT073
cagagaucuuuca

SEQ ID NO: 666706 - RNA, 19 nt, Escherichia coli CFT073
cagagauagaacugcauug

SEQ ID NO: 666707 - RNA, 18 nt, Escherichia coli CFT073
cagagaucagauaauauu

SEQ ID NO: 666708 - RNA, 22 nt, Escherichia coli CFT073
cagagauacaggccaccgccca

SEQ ID NO: 666709 - RNA, 15 nt, Escherichia coli CFT073
cagagauagaacugc

SEQ ID NO: 666710 - RNA, 15 nt, Escherichia coli CFT073
cagagaaacgccagc

SEQ ID NO: 666711 - RNA, 22 nt, Escherichia coli CFT073
cagacuuuuugcggcagcaaug

SEQ ID NO: 666712 - RNA, 18 nt, Escherichia coli CFT073
cagacuguaaaucugccg

SEQ ID NO: 666713 - RNA, 14 nt, Escherichia coli CFT073
cagacugcuuuucc

SEQ ID NO: 666714 - RNA, 15 nt, Escherichia coli CFT073
cagacuguaaaucug

SEQ ID NO: 666715 - RNA, 14 nt, Escherichia coli CFT073
aaaaucaauguaac

SEQ ID NO: 666716 - RNA, 14 nt, Escherichia coli CFT073
aaaaucaccaucac

SEQ ID NO: 666717 - RNA, 14 nt, Escherichia coli CFT073
cagaggucuuuucu

SEQ ID NO: 666718 - RNA, 12 nt, Escherichia coli CFT073
cagaguagaaau

SEQ ID NO: 666719 - RNA, 14 nt, Escherichia coli CFT073
cagaguagaaauau

SEQ ID NO: 666720 - RNA, 15 nt, Escherichia coli CFT073
cagaguaccgauaga

SEQ ID NO: 666721 - RNA, 17 nt, Escherichia coli CFT073
cagaguauuacccggca

SEQ ID NO: 666722 - RNA, 19 nt, Escherichia coli CFT073
cagaguauuuccagcucaa

SEQ ID NO: 666723 - RNA, 13 nt, Escherichia coli CFT073
cagauaaaacaca

SEQ ID NO: 666724 - RNA, 16 nt, Escherichia coli CFT073
cagauaaaacacauca

SEQ ID NO: 666725 - RNA, 13 nt, Escherichia coli CFT073
cagauaaaacagg

SEQ ID NO: 666726 - RNA, 14 nt, Escherichia coli CFT073
cagauaaacuacag

SEQ ID NO: 666727 - RNA, 15 nt, Escherichia coli CFT073
cagagccugaauaaa

SEQ ID NO: 666728 - RNA, 17 nt, Escherichia coli CFT073
cagagccugacauuucc

SEQ ID NO: 666729 - RNA, 13 nt, Escherichia coli CFT073
cagagccugccaa

SEQ ID NO: 666730 - RNA, 21 nt, Escherichia coli CFT073
cagagcgaauuaagaauuucu

SEQ ID NO: 666731 - RNA, 12 nt, Escherichia coli CFT073
cagagggaaaga

SEQ ID NO: 666732 - RNA, 20 nt, Escherichia coli CFT073
cagagcgggcagacaaaaca

SEQ ID NO: 666733 - RNA, 23 nt, Escherichia coli CFT073
cagaccaaccgucagauccgcca

SEQ ID NO: 666734 - RNA, 15 nt, Escherichia coli CFT073
cagaccaaacgguga

SEQ ID NO: 666735 - RNA, 22 nt, Escherichia coli CFT073
cagaccaauaauccccaauacg

SEQ ID NO: 666736 - RNA, 13 nt, Escherichia coli CFT073
cagaccaauggcu

SEQ ID NO: 666737 - RNA, 18 nt, Escherichia coli CFT073
cagacccagaaccauuga

SEQ ID NO: 666738 - RNA, 21 nt, Escherichia coli CFT073
cagacccagguagacaccaag

SEQ ID NO: 666739 - RNA, 18 nt, Escherichia coli CFT073
cagaccgucggaauccaa

SEQ ID NO: 666740 - RNA, 13 nt, Escherichia coli CFT073
cagaccgugcgca

SEQ ID NO: 666741 - RNA, 16 nt, Escherichia coli CFT073
cagaccuaaaaauucc

SEQ ID NO: 666742 - RNA, 21 nt, Escherichia coli CFT073
cagaccgggaaucgaaaugcc

SEQ ID NO: 666743 - RNA, 11 nt, Escherichia coli CFT073
cagaccgccga

SEQ ID NO: 666744 - RNA, 16 nt, Escherichia coli CFT073
cagaccgcacaccgag

SEQ ID NO: 666745 - RNA, 15 nt, Escherichia coli CFT073
cagaccgccgauaga

SEQ ID NO: 666746 - RNA, 21 nt, Escherichia coli CFT073
cagacugaucaucgcccaguu

SEQ ID NO: 666747 - RNA, 15 nt, Escherichia coli CFT073
cagacguccacgaga

SEQ ID NO: 666748 - RNA, 18 nt, Escherichia coli CFT073
cagacguccggcgcugca

SEQ ID NO: 666749 - RNA, 13 nt, Escherichia coli CFT073
cagacggucuggu

SEQ ID NO: 666750 - RNA, 23 nt, Escherichia coli CFT073
cagacggcugucauccagcagug

SEQ ID NO: 666751 - RNA, 15 nt, Escherichia coli CFT073
cagacgaucgcgcag

SEQ ID NO: 666752 - RNA, 20 nt, Escherichia coli CFT073
cagacggaacaucugcccca

SEQ ID NO: 666753 - RNA, 14 nt, Escherichia coli CFT073
cagacgaaugaagc

SEQ ID NO: 666754 - RNA, 12 nt, Escherichia coli CFT073
cagaccugaauu

SEQ ID NO: 666755 - RNA, 17 nt, Escherichia coli CFT073
cagaccugcguucagca

SEQ ID NO: 666756 - RNA, 23 nt, Escherichia coli CFT073
cagaccuucauagguaaacauca

SEQ ID NO: 666757 - RNA, 21 nt, Escherichia coli CFT073
cagaccuucgcuaucaaacug

SEQ ID NO: 666758 - RNA, 20 nt, Escherichia coli CFT073
cagacgacggggguaaccuc

SEQ ID NO: 666759 - RNA, 16 nt, Escherichia coli CFT073
cagacgacugucuucc

SEQ ID NO: 666760 - RNA, 22 nt, Escherichia coli CFT073
cagacgacugucuuccugcggu

SEQ ID NO: 666761 - RNA, 23 nt, Escherichia coli CFT073
cagacgacuguuggaaucacuca

SEQ ID NO: 666762 - RNA, 20 nt, Escherichia coli CFT073
cagaauuugagcuugcugca

SEQ ID NO: 666763 - RNA, 17 nt, Escherichia coli CFT073
cagaauuugaggaagcu

SEQ ID NO: 666764 - RNA, 14 nt, Escherichia coli CFT073
cagaauuugcacca

SEQ ID NO: 666765 - RNA, 14 nt, Escherichia coli CFT073
cagaauuuggugaa

SEQ ID NO: 666766 - RNA, 19 nt, Escherichia coli CFT073
cagaaugcgcgcgaaaaca

SEQ ID NO: 666767 - RNA, 20 nt, Escherichia coli CFT073
cagaaugcgcgcgaaaacau

SEQ ID NO: 666768 - RNA, 14 nt, Escherichia coli CFT073
cagaaugccucaau

SEQ ID NO: 666769 - RNA, 14 nt, Escherichia coli CFT073
cagacaaaacauac

SEQ ID NO: 666770 - RNA, 20 nt, Escherichia coli CFT073
cagacaaaauccugccagcg

SEQ ID NO: 666771 - RNA, 12 nt, Escherichia coli CFT073
cagacaaauaac

SEQ ID NO: 666772 - RNA, 13 nt, Escherichia coli CFT073
cagacaacaguca

SEQ ID NO: 666773 - RNA, 15 nt, Escherichia coli CFT073
cagacaacaugagaa

SEQ ID NO: 666774 - RNA, 15 nt, Escherichia coli CFT073
cagacaucaccagua

SEQ ID NO: 666775 - RNA, 18 nt, Escherichia coli CFT073
cagaauaccuugcugcuc

SEQ ID NO: 666776 - RNA, 19 nt, Escherichia coli CFT073
cagaauacccagcaaugcc

SEQ ID NO: 666777 - RNA, 18 nt, Escherichia coli CFT073
cagaauaacgcggcagga

SEQ ID NO: 666778 - RNA, 14 nt, Escherichia coli CFT073
cagaauauauaaag

SEQ ID NO: 666779 - RNA, 14 nt, Escherichia coli CFT073
cagaauauccggca

SEQ ID NO: 666780 - RNA, 17 nt, Escherichia coli CFT073
cagaauacuucacauga

SEQ ID NO: 666781 - RNA, 21 nt, Escherichia coli CFT073
cagaauaguguuaaccgguac

SEQ ID NO: 666782 - RNA, 12 nt, Escherichia coli CFT073
cagaauaucugc

SEQ ID NO: 666783 - RNA, 22 nt, Escherichia coli CFT073
cagaauaucugcggccuccaac

SEQ ID NO: 666784 - RNA, 20 nt, Escherichia coli CFT073
cagaauauugccgaagacca

SEQ ID NO: 666785 - RNA, 17 nt, Escherichia coli CFT073
cagaauauacggaauga

SEQ ID NO: 666786 - RNA, 13 nt, Escherichia coli CFT073
cagaaucguaaag

SEQ ID NO: 666787 - RNA, 15 nt, Escherichia coli CFT073
cagaaucgccaacgc

SEQ ID NO: 666788 - RNA, 14 nt, Escherichia coli CFT073
cagaaucgccagca

SEQ ID NO: 666789 - RNA, 15 nt, Escherichia coli CFT073
cagaaucgccagcau

SEQ ID NO: 666790 - RNA, 24 nt, Escherichia coli CFT073
cagaauccggcgcucaucaggcca

SEQ ID NO: 666791 - RNA, 16 nt, Escherichia coli CFT073
cagaauccccacaaac

SEQ ID NO: 666792 - RNA, 19 nt, Escherichia coli CFT073
cagaauccccggcaggaag

SEQ ID NO: 666793 - RNA, 18 nt, Escherichia coli CFT073
cagaauccggugauugcu

SEQ ID NO: 666794 - RNA, 19 nt, Escherichia coli CFT073
cagaauccggugauugcug

SEQ ID NO: 666795 - RNA, 20 nt, Escherichia coli CFT073
cagaauccggugauugcugc

SEQ ID NO: 666796 - RNA, 20 nt, Escherichia coli CFT073
cagaauccguacgcuuuucc

SEQ ID NO: 666797 - RNA, 15 nt, Escherichia coli CFT073
cagaaucaucauauc

SEQ ID NO: 666798 - RNA, 21 nt, Escherichia coli CFT073
cagaaucaccggagcugccag

SEQ ID NO: 666799 - RNA, 15 nt, Escherichia coli CFT073
cagaaucaccucuuu

SEQ ID NO: 666800 - RNA, 22 nt, Escherichia coli CFT073
cagaaucagauugaugcgagua

SEQ ID NO: 666801 - RNA, 16 nt, Escherichia coli CFT073
cagaagacgagccguc

SEQ ID NO: 666802 - RNA, 11 nt, Escherichia coli CFT073
cagaagaaccg

SEQ ID NO: 666803 - RNA, 16 nt, Escherichia coli CFT073
cagaacuucugguaac

SEQ ID NO: 666804 - RNA, 11 nt, Escherichia coli CFT073
cagaagaaaac

SEQ ID NO: 666805 - RNA, 23 nt, Escherichia coli CFT073
cagaagaaaacguuccacgccgc

SEQ ID NO: 666806 - RNA, 19 nt, Escherichia coli CFT073
cagaacugcugcgccagcg

SEQ ID NO: 666807 - RNA, 18 nt, Escherichia coli CFT073
cagaacucaucuucuuuu

SEQ ID NO: 666808 - RNA, 20 nt, Escherichia coli CFT073
cagaacucaucuucuuuuuc

SEQ ID NO: 666809 - RNA, 18 nt, Escherichia coli CFT073
cagaagguuuauauagua

SEQ ID NO: 666810 - RNA, 15 nt, Escherichia coli CFT073
cagaaguugcaccca

SEQ ID NO: 666811 - RNA, 17 nt, Escherichia coli CFT073
cagaaggugacccguuu

SEQ ID NO: 666812 - RNA, 22 nt, Escherichia coli CFT073
cagaaaggcguuguccuugccg

SEQ ID NO: 666813 - RNA, 16 nt, Escherichia coli CFT073
cagaaagggaagaaca

SEQ ID NO: 666814 - RNA, 23 nt, Escherichia coli CFT073
cagaaagggaagaacaucacugc

SEQ ID NO: 666815 - RNA, 18 nt, Escherichia coli CFT073
cagaaaguaauuacgccc

SEQ ID NO: 666816 - RNA, 12 nt, Escherichia coli CFT073
cagaacauccag

SEQ ID NO: 666817 - RNA, 16 nt, Escherichia coli CFT073
cagaaccagcaaccac

SEQ ID NO: 666818 - RNA, 20 nt, Escherichia coli CFT073
cagaaccagggaaaaaagcc

SEQ ID NO: 666819 - RNA, 21 nt, Escherichia coli CFT073
cagaaccgccgcugucugaau

SEQ ID NO: 666820 - RNA, 15 nt, Escherichia coli CFT073
cagaacgacgaccgc

SEQ ID NO: 666821 - RNA, 22 nt, Escherichia coli CFT073
cagaacgccaugccaaagaagg

SEQ ID NO: 666822 - RNA, 17 nt, Escherichia coli CFT073
cagaacgcgauauacgu

SEQ ID NO: 666823 - RNA, 17 nt, Escherichia coli CFT073
cagaaccgcguaacuuu

SEQ ID NO: 666824 - RNA, 23 nt, Escherichia coli CFT073
cagaaccguggguaaugccuuug

SEQ ID NO: 666825 - RNA, 19 nt, Escherichia coli CFT073
cagaaccugaggcaauaaa

SEQ ID NO: 666826 - RNA, 13 nt, Escherichia coli CFT073
cagaacgcugccu

SEQ ID NO: 666827 - RNA, 16 nt, Escherichia coli CFT073
cagaacuaaaaucggu

SEQ ID NO: 666828 - RNA, 16 nt, Escherichia coli CFT073
cagaacuaaacuguga

SEQ ID NO: 666829 - RNA, 17 nt, Escherichia coli CFT073
cagaacucacgcacuuc

SEQ ID NO: 666830 - RNA, 14 nt, Escherichia coli CFT073
cagaacucaucuuc

SEQ ID NO: 666831 - RNA, 15 nt, Escherichia coli CFT073
cagaaaaaucccucu

SEQ ID NO: 666832 - RNA, 14 nt, Escherichia coli CFT073
cacuuuguaggccu

SEQ ID NO: 666833 - RNA, 23 nt, Escherichia coli CFT073
cacuuuuaaaucgccaagauuag

SEQ ID NO: 666834 - RNA, 15 nt, Escherichia coli CFT073
cacuuuuauuucacc

SEQ ID NO: 666835 - RNA, 18 nt, Escherichia coli CFT073
cacuuuaugauccagcuu

SEQ ID NO: 666836 - RNA, 17 nt, Escherichia coli CFT073
cacuuugucugcaaucu

SEQ ID NO: 666837 - RNA, 13 nt, Escherichia coli CFT073
cacuuugugucag

SEQ ID NO: 666838 - RNA, 23 nt, Escherichia coli CFT073
cagaaagacugaauugccagcau

SEQ ID NO: 666839 - RNA, 12 nt, Escherichia coli CFT073
cagaaaaggagu

SEQ ID NO: 666840 - RNA, 13 nt, Escherichia coli CFT073
cagaaaagaacca

SEQ ID NO: 666841 - RNA, 16 nt, Escherichia coli CFT073
cacuuuagacacauca

SEQ ID NO: 666842 - RNA, 13 nt, Escherichia coli CFT073
aaaauaucacucg

SEQ ID NO: 666843 - RNA, 22 nt, Escherichia coli CFT073
aaaauaucguaggccugcucaa

SEQ ID NO: 666844 - RNA, 18 nt, Escherichia coli CFT073
aaaauaugcccuuguggc

SEQ ID NO: 666845 - RNA, 23 nt, Escherichia coli CFT073
cacuuuaucgagaaugcugaagu

SEQ ID NO: 666846 - RNA, 21 nt, Escherichia coli CFT073
cacuuuaucgaucacauccag

SEQ ID NO: 666847 - RNA, 22 nt, Escherichia coli CFT073
cacuuuaucgaucacauccagu

SEQ ID NO: 666848 - RNA, 16 nt, Escherichia coli CFT073
cacuuugaucugcguc

SEQ ID NO: 666849 - RNA, 21 nt, Escherichia coli CFT073
cacuucuuccgggcuauacac

SEQ ID NO: 666850 - RNA, 22 nt, Escherichia coli CFT073
cacuucuuccgggcuauacacc

SEQ ID NO: 666851 - RNA, 13 nt, Escherichia coli CFT073
cacuucuucguag

SEQ ID NO: 666852 - RNA, 14 nt, Escherichia coli CFT073
cacuucuggcggcg

SEQ ID NO: 666853 - RNA, 15 nt, Escherichia coli CFT073
cacuucuucacauca

SEQ ID NO: 666854 - RNA, 14 nt, Escherichia coli CFT073
cacuucuucagcca

SEQ ID NO: 666855 - RNA, 16 nt, Escherichia coli CFT073
cacuucgucagaaaug

SEQ ID NO: 666856 - RNA, 13 nt, Escherichia coli CFT073
cacuugccugcug

SEQ ID NO: 666857 - RNA, 14 nt, Escherichia coli CFT073
cacuugccugcugu

SEQ ID NO: 666858 - RNA, 20 nt, Escherichia coli CFT073
cacuugcugcaccucuuccu

SEQ ID NO: 666859 - RNA, 22 nt, Escherichia coli CFT073
cacuugcugcaccucuuccuga

SEQ ID NO: 666860 - RNA, 14 nt, Escherichia coli CFT073
cacuugcugguugu

SEQ ID NO: 666861 - RNA, 21 nt, Escherichia coli CFT073
cacuuguaguuacauuuuuau

SEQ ID NO: 666862 - RNA, 23 nt, Escherichia coli CFT073
cacuugucaccaaucugaaacca

SEQ ID NO: 666863 - RNA, 21 nt, Escherichia coli CFT073
cacuucaccgcgaauauaagc

SEQ ID NO: 666864 - RNA, 11 nt, Escherichia coli CFT073
cacuucaccuu

SEQ ID NO: 666865 - RNA, 15 nt, Escherichia coli CFT073
cacuucacgcugcca

SEQ ID NO: 666866 - RNA, 19 nt, Escherichia coli CFT073
cacuucagcgaaaucacgc

SEQ ID NO: 666867 - RNA, 17 nt, Escherichia coli CFT073
cacuucauaauccaggu

SEQ ID NO: 666868 - RNA, 21 nt, Escherichia coli CFT073
cacuucauacuccgucugcgc

SEQ ID NO: 666869 - RNA, 16 nt, Escherichia coli CFT073
cacuucauaggucauu

SEQ ID NO: 666870 - RNA, 14 nt, Escherichia coli CFT073
cacuuccaccacuu

SEQ ID NO: 666871 - RNA, 16 nt, Escherichia coli CFT073
cacuuccaccacuucc

SEQ ID NO: 666872 - RNA, 20 nt, Escherichia coli CFT073
cacuuccaccacuuccugcu

SEQ ID NO: 666873 - RNA, 14 nt, Escherichia coli CFT073
cacuuccugcucgg

SEQ ID NO: 666874 - RNA, 14 nt, Escherichia coli CFT073
cacuucgaccaggu

SEQ ID NO: 666875 - RNA, 23 nt, Escherichia coli CFT073
cacuucgcuaccggcgacuuccu

SEQ ID NO: 666876 - RNA, 20 nt, Escherichia coli CFT073
cacuucgcugacauuaccuu

SEQ ID NO: 666877 - RNA, 16 nt, Escherichia coli CFT073
cacuucccagccccgc

SEQ ID NO: 666878 - RNA, 23 nt, Escherichia coli CFT073
cacuuccagcaguucgcccgcuu

SEQ ID NO: 666879 - RNA, 18 nt, Escherichia coli CFT073
cacuuaaagcaacaccau

SEQ ID NO: 666880 - RNA, 14 nt, Escherichia coli CFT073
cacuguucauuaaa

SEQ ID NO: 666881 - RNA, 17 nt, Escherichia coli CFT073
cacuguucgccgcagcc

SEQ ID NO: 666882 - RNA, 22 nt, Escherichia coli CFT073
cacuguucuggcguaucuccag

SEQ ID NO: 666883 - RNA, 20 nt, Escherichia coli CFT073
cacugucccaaaaugucgga

SEQ ID NO: 666884 - RNA, 23 nt, Escherichia coli CFT073
cacuguguuggguucacuuuccc

SEQ ID NO: 666885 - RNA, 20 nt, Escherichia coli CFT073
cacuguuaccgcugcuggcg

SEQ ID NO: 666886 - RNA, 18 nt, Escherichia coli CFT073
cacuucaaauuucauaau

SEQ ID NO: 666887 - RNA, 12 nt, Escherichia coli CFT073
cacuuacagcaa

SEQ ID NO: 666888 - RNA, 14 nt, Escherichia coli CFT073
cacuguaucaggug

SEQ ID NO: 666889 - RNA, 16 nt, Escherichia coli CFT073
cacuguaagccaccga

SEQ ID NO: 666890 - RNA, 20 nt, Escherichia coli CFT073
cacuggucugacgcugaaua

SEQ ID NO: 666891 - RNA, 17 nt, Escherichia coli CFT073
cacuggugaaagagcca

SEQ ID NO: 666892 - RNA, 14 nt, Escherichia coli CFT073
cacugguggcagug

SEQ ID NO: 666893 - RNA, 19 nt, Escherichia coli CFT073
cacugguuaacgcgccaau

SEQ ID NO: 666894 - RNA, 17 nt, Escherichia coli CFT073
cacugguucccaacaac

SEQ ID NO: 666895 - RNA, 14 nt, Escherichia coli CFT073
cacuggccucuucu

SEQ ID NO: 666896 - RNA, 18 nt, Escherichia coli CFT073
cacuggcgauauugccgc

SEQ ID NO: 666897 - RNA, 20 nt, Escherichia coli CFT073
cacuggcaagaaacgcucca

SEQ ID NO: 666898 - RNA, 21 nt, Escherichia coli CFT073
cacuggccuuuucacaacgaa

SEQ ID NO: 666899 - RNA, 22 nt, Escherichia coli CFT073
cacuggccuuuucacaacgaau

SEQ ID NO: 666900 - RNA, 16 nt, Escherichia coli CFT073
cacuggcgaacucuga

SEQ ID NO: 666901 - RNA, 13 nt, Escherichia coli CFT073
cacuggcgacacg

SEQ ID NO: 666902 - RNA, 18 nt, Escherichia coli CFT073
cacuggcgacacgcauca

SEQ ID NO: 666903 - RNA, 18 nt, Escherichia coli CFT073
cacuauaucucaaucaaa

SEQ ID NO: 666904 - RNA, 17 nt, Escherichia coli CFT073
cacuaucaaugaauaag

SEQ ID NO: 666905 - RNA, 21 nt, Escherichia coli CFT073
cacuauuuaccgccaacgcaa

SEQ ID NO: 666906 - RNA, 16 nt, Escherichia coli CFT073
cacuacggucacgcca

SEQ ID NO: 666907 - RNA, 14 nt, Escherichia coli CFT073
cacuacgugaucgu

SEQ ID NO: 666908 - RNA, 16 nt, Escherichia coli CFT073
cacuagucccuccgca

SEQ ID NO: 666909 - RNA, 14 nt, Escherichia coli CFT073
cacucauuuucucu

SEQ ID NO: 666910 - RNA, 13 nt, Escherichia coli CFT073
cacucaucaagca

SEQ ID NO: 666911 - RNA, 16 nt, Escherichia coli CFT073
cacucaacagccagaa

SEQ ID NO: 666912 - RNA, 20 nt, Escherichia coli CFT073
cacucaacuuauugaucauc

SEQ ID NO: 666913 - RNA, 15 nt, Escherichia coli CFT073
cacucacccgccagc

SEQ ID NO: 666914 - RNA, 21 nt, Escherichia coli CFT073
cacucacgauagugacucauu

SEQ ID NO: 666915 - RNA, 21 nt, Escherichia coli CFT073
cacucacgcugcguacagcgc

SEQ ID NO: 666916 - RNA, 20 nt, Escherichia coli CFT073
cacgugcuuauaacugcccg

SEQ ID NO: 666917 - RNA, 12 nt, Escherichia coli CFT073
cacguuacccaa

SEQ ID NO: 666918 - RNA, 20 nt, Escherichia coli CFT073
aaaauauaagguucuuuagc

SEQ ID NO: 666919 - RNA, 15 nt, Escherichia coli CFT073
cacgugccagauguu

SEQ ID NO: 666920 - RNA, 15 nt, Escherichia coli CFT073
cacguuccuugcugc

SEQ ID NO: 666921 - RNA, 14 nt, Escherichia coli CFT073
cacguuuuccuuca

SEQ ID NO: 666922 - RNA, 19 nt, Escherichia coli CFT073
cacguuuuucauccagcgg

SEQ ID NO: 666923 - RNA, 15 nt, Escherichia coli CFT073
cacuaacugcgcgcu

SEQ ID NO: 666924 - RNA, 21 nt, Escherichia coli CFT073
cacuaacugcgcgcuguucca

SEQ ID NO: 666925 - RNA, 16 nt, Escherichia coli CFT073
cacuaauuaagacuga

SEQ ID NO: 666926 - RNA, 18 nt, Escherichia coli CFT073
cacuaauuaagacugaug

SEQ ID NO: 666927 - RNA, 16 nt, Escherichia coli CFT073
cacuaacacuucugcc

SEQ ID NO: 666928 - RNA, 20 nt, Escherichia coli CFT073
cacuacgcagggauauuuca

SEQ ID NO: 666929 - RNA, 14 nt, Escherichia coli CFT073
cacuacgcccgcug

SEQ ID NO: 666930 - RNA, 15 nt, Escherichia coli CFT073
cacuacggcucagca

SEQ ID NO: 666931 - RNA, 15 nt, Escherichia coli CFT073
cacuaccgccgagca

SEQ ID NO: 666932 - RNA, 14 nt, Escherichia coli CFT073
cacuaauuccugca

SEQ ID NO: 666933 - RNA, 16 nt, Escherichia coli CFT073
cacuaauuccugcaaa

SEQ ID NO: 666934 - RNA, 22 nt, Escherichia coli CFT073
cacuacaacaaccuuuguauuu

SEQ ID NO: 666935 - RNA, 19 nt, Escherichia coli CFT073
cacuacaccguacucccga

SEQ ID NO: 666936 - RNA, 22 nt, Escherichia coli CFT073
cacuacaccguacucccgagga

SEQ ID NO: 666937 - RNA, 17 nt, Escherichia coli CFT073
cacuaccaccuuuuuaa

SEQ ID NO: 666938 - RNA, 23 nt, Escherichia coli CFT073
cacuaccagugccagaacagaaa

SEQ ID NO: 666939 - RNA, 15 nt, Escherichia coli CFT073
cacucuuucagcacc

SEQ ID NO: 666940 - RNA, 17 nt, Escherichia coli CFT073
cacucugcgccuuugau

SEQ ID NO: 666941 - RNA, 19 nt, Escherichia coli CFT073
cacucuuaacgccacucgc

SEQ ID NO: 666942 - RNA, 12 nt, Escherichia coli CFT073
cacucuucaaca

SEQ ID NO: 666943 - RNA, 16 nt, Escherichia coli CFT073
cacucuucaacacacu

SEQ ID NO: 666944 - RNA, 22 nt, Escherichia coli CFT073
cacucugccguaccaucgccag

SEQ ID NO: 666945 - RNA, 21 nt, Escherichia coli CFT073
cacucucaaucgucaaacgca

SEQ ID NO: 666946 - RNA, 14 nt, Escherichia coli CFT073
cacucguuucaaau

SEQ ID NO: 666947 - RNA, 13 nt, Escherichia coli CFT073
cacucugaccugu

SEQ ID NO: 666948 - RNA, 19 nt, Escherichia coli CFT073
cacugaauaaaagugugca

SEQ ID NO: 666949 - RNA, 17 nt, Escherichia coli CFT073
cacugaaacagauaaaa

SEQ ID NO: 666950 - RNA, 21 nt, Escherichia coli CFT073
cacugaaacagauaaaaguua

SEQ ID NO: 666951 - RNA, 18 nt, Escherichia coli CFT073
cacugaaaguggaaacac

SEQ ID NO: 666952 - RNA, 12 nt, Escherichia coli CFT073
cacugaaaucuc

SEQ ID NO: 666953 - RNA, 21 nt, Escherichia coli CFT073
cacugaauucccccauugaaa

SEQ ID NO: 666954 - RNA, 16 nt, Escherichia coli CFT073
cacugacaaucgccag

SEQ ID NO: 666955 - RNA, 14 nt, Escherichia coli CFT073
cacugacaccagca

SEQ ID NO: 666956 - RNA, 18 nt, Escherichia coli CFT073
cacugacacggaacaacg

SEQ ID NO: 666957 - RNA, 15 nt, Escherichia coli CFT073
cacugacauccacgu

SEQ ID NO: 666958 - RNA, 17 nt, Escherichia coli CFT073
cacucgacgcagcagac

SEQ ID NO: 666959 - RNA, 18 nt, Escherichia coli CFT073
cacucguccagucgccug

SEQ ID NO: 666960 - RNA, 22 nt, Escherichia coli CFT073
cacuccgcuuaccauccacacc

SEQ ID NO: 666961 - RNA, 21 nt, Escherichia coli CFT073
cacuccgguaauaucgcgcag

SEQ ID NO: 666962 - RNA, 16 nt, Escherichia coli CFT073
cacugaugacaggcua

SEQ ID NO: 666963 - RNA, 19 nt, Escherichia coli CFT073
cacugaugccacuggaugu

SEQ ID NO: 666964 - RNA, 22 nt, Escherichia coli CFT073
cacugauaagcugagcacaaaa

SEQ ID NO: 666965 - RNA, 22 nt, Escherichia coli CFT073
cacugaggcgauagcauccagu

SEQ ID NO: 666966 - RNA, 15 nt, Escherichia coli CFT073
cacugacgggaaacu

SEQ ID NO: 666967 - RNA, 12 nt, Escherichia coli CFT073
cacugacgcgca

SEQ ID NO: 666968 - RNA, 20 nt, Escherichia coli CFT073
cacugacuuuaccugccuga

SEQ ID NO: 666969 - RNA, 13 nt, Escherichia coli CFT073
cacugagcaccac

SEQ ID NO: 666970 - RNA, 16 nt, Escherichia coli CFT073
cacugcaaaucaccac

SEQ ID NO: 666971 - RNA, 19 nt, Escherichia coli CFT073
cacugauggaauuucauca

SEQ ID NO: 666972 - RNA, 15 nt, Escherichia coli CFT073
cacugauuacccuuc

SEQ ID NO: 666973 - RNA, 12 nt, Escherichia coli CFT073
cacugauuuccc

SEQ ID NO: 666974 - RNA, 20 nt, Escherichia coli CFT073
cacugcagaauauccgccgu

SEQ ID NO: 666975 - RNA, 15 nt, Escherichia coli CFT073
cacugcaggcugaug

SEQ ID NO: 666976 - RNA, 16 nt, Escherichia coli CFT073
cacugcauggcggcgu

SEQ ID NO: 666977 - RNA, 14 nt, Escherichia coli CFT073
cacugccacuuuuu

SEQ ID NO: 666978 - RNA, 15 nt, Escherichia coli CFT073
cacugccacuuuuuc

SEQ ID NO: 666979 - RNA, 16 nt, Escherichia coli CFT073
cacugccacuuuuucc

SEQ ID NO: 666980 - RNA, 18 nt, Escherichia coli CFT073
cacugcgagaaaaagccu

SEQ ID NO: 666981 - RNA, 13 nt, Escherichia coli CFT073
cacugcgagaaaa

SEQ ID NO: 666982 - RNA, 19 nt, Escherichia coli CFT073
cacugcgccaacgucugcc

SEQ ID NO: 666983 - RNA, 16 nt, Escherichia coli CFT073
cacugccguacaggca

SEQ ID NO: 666984 - RNA, 16 nt, Escherichia coli CFT073
cacugcgacaccagca

SEQ ID NO: 666985 - RNA, 14 nt, Escherichia coli CFT073
cacugccgccuucc

SEQ ID NO: 666986 - RNA, 19 nt, Escherichia coli CFT073
cacugccgggggcgaccug

SEQ ID NO: 666987 - RNA, 19 nt, Escherichia coli CFT073
cacugcgguguaaaccagc

SEQ ID NO: 666988 - RNA, 14 nt, Escherichia coli CFT073
cacugcgcucuucu

SEQ ID NO: 666989 - RNA, 18 nt, Escherichia coli CFT073
cacugcgcauaauccacu

SEQ ID NO: 666990 - RNA, 17 nt, Escherichia coli CFT073
cacugcgcccgccagca

SEQ ID NO: 666991 - RNA, 16 nt, Escherichia coli CFT073
cacugcgcccgccagc

SEQ ID NO: 666992 - RNA, 12 nt, Escherichia coli CFT073
cacugcgccgcc

SEQ ID NO: 666993 - RNA, 22 nt, Escherichia coli CFT073
cacugcgccgccagugugaaua

SEQ ID NO: 666994 - RNA, 18 nt, Escherichia coli CFT073
cacugcucgcagaaauac

SEQ ID NO: 666995 - RNA, 18 nt, Escherichia coli CFT073
cacugcugauaauccagu

SEQ ID NO: 666996 - RNA, 16 nt, Escherichia coli CFT073
caucuccuuacugccc

SEQ ID NO: 666997 - RNA, 16 nt, Escherichia coli CFT073
caucuccugacacaac

SEQ ID NO: 666998 - RNA, 17 nt, Escherichia coli CFT073
caucucgcgcucuucuu

SEQ ID NO: 666999 - RNA, 12 nt, Escherichia coli CFT073
caucucugcaac

SEQ ID NO: 667000 - RNA, 15 nt, Escherichia coli CFT073
caucucuaccuguuc

SEQ ID NO: 667001 - RNA, 15 nt, Escherichia coli CFT073
caucugauucuuccc

SEQ ID NO: 667002 - RNA, 21 nt, Escherichia coli CFT073
caucugcgccacgaaaacccu

SEQ ID NO: 667003 - RNA, 11 nt, Escherichia coli CFT073
caucugcccca

SEQ ID NO: 667004 - RNA, 12 nt, Escherichia coli CFT073
caucucuuccca

SEQ ID NO: 667005 - RNA, 18 nt, Escherichia coli CFT073
caucucuucccacggauu

SEQ ID NO: 667006 - RNA, 22 nt, Escherichia coli CFT073
caucucuucuucaagccaggcu

SEQ ID NO: 667007 - RNA, 14 nt, Escherichia coli CFT073
caucucuuugcugu

SEQ ID NO: 667008 - RNA, 12 nt, Escherichia coli CFT073
caucucuccuuu

SEQ ID NO: 667009 - RNA, 18 nt, Escherichia coli CFT073
caucugaagccugcuuaa

SEQ ID NO: 667010 - RNA, 15 nt, Escherichia coli CFT073
caucugacaaaauca

SEQ ID NO: 667011 - RNA, 19 nt, Escherichia coli CFT073
caucugacguucagccgcu

SEQ ID NO: 667012 - RNA, 19 nt, Escherichia coli CFT073
caucugguuuuuuauauuc

SEQ ID NO: 667013 - RNA, 17 nt, Escherichia coli CFT073
caucuggugccagcgcc

SEQ ID NO: 667014 - RNA, 12 nt, Escherichia coli CFT073
caucuggucaga

SEQ ID NO: 667015 - RNA, 16 nt, Escherichia coli CFT073
caucuggcgagaacac

SEQ ID NO: 667016 - RNA, 16 nt, Escherichia coli CFT073
caucuggcauuuugcu

SEQ ID NO: 667017 - RNA, 23 nt, Escherichia coli CFT073
caucuggcaucggcgcacaaccg

SEQ ID NO: 667018 - RNA, 15 nt, Escherichia coli CFT073
caucuggcauucaga

SEQ ID NO: 667019 - RNA, 14 nt, Escherichia coli CFT073
caucugcgcccugg

SEQ ID NO: 667020 - RNA, 15 nt, Escherichia coli CFT073
caucugcgcccuggc

SEQ ID NO: 667021 - RNA, 17 nt, Escherichia coli CFT073
caucuuaauagcugcca

SEQ ID NO: 667022 - RNA, 14 nt, Escherichia coli CFT073
caucgucacaccau

SEQ ID NO: 667023 - RNA, 17 nt, Escherichia coli CFT073
caucgucaggaagaagc

SEQ ID NO: 667024 - RNA, 15 nt, Escherichia coli CFT073
caucguccggcuggg

SEQ ID NO: 667025 - RNA, 20 nt, Escherichia coli CFT073
caucgcuacaccaaucguca

SEQ ID NO: 667026 - RNA, 19 nt, Escherichia coli CFT073
caucgcgguuaugccgccg

SEQ ID NO: 667027 - RNA, 20 nt, Escherichia coli CFT073
caucuacuacuggagacaga

SEQ ID NO: 667028 - RNA, 15 nt, Escherichia coli CFT073
caucucauccaucaa

SEQ ID NO: 667029 - RNA, 15 nt, Escherichia coli CFT073
caucucaacaaacgc

SEQ ID NO: 667030 - RNA, 20 nt, Escherichia coli CFT073
caucucaacuuucuuggcac

SEQ ID NO: 667031 - RNA, 13 nt, Escherichia coli CFT073
caucuccagugcg

SEQ ID NO: 667032 - RNA, 19 nt, Escherichia coli CFT073
caucuccaguuucgagaaa

SEQ ID NO: 667033 - RNA, 14 nt, Escherichia coli CFT073
caucuccaucaucu

SEQ ID NO: 667034 - RNA, 15 nt, Escherichia coli CFT073
cauccuguucauuuu

SEQ ID NO: 667035 - RNA, 19 nt, Escherichia coli CFT073
cauccuguaugacaaaaga

SEQ ID NO: 667036 - RNA, 15 nt, Escherichia coli CFT073
caucgacaguaccag

SEQ ID NO: 667037 - RNA, 12 nt, Escherichia coli CFT073
caucgacaccag

SEQ ID NO: 667038 - RNA, 14 nt, Escherichia coli CFT073
caucgacagcaaau

SEQ ID NO: 667039 - RNA, 19 nt, Escherichia coli CFT073
cauccugccaggaccgcug

SEQ ID NO: 667040 - RNA, 23 nt, Escherichia coli CFT073
cauccugccaggaccgcugaaau

SEQ ID NO: 667041 - RNA, 12 nt, Escherichia coli CFT073
cauccugccaug

SEQ ID NO: 667042 - RNA, 19 nt, Escherichia coli CFT073
cauccugcggcagcuccag

SEQ ID NO: 667043 - RNA, 16 nt, Escherichia coli CFT073
caucgacauugaccag

SEQ ID NO: 667044 - RNA, 16 nt, Escherichia coli CFT073
caucgacgccaucauu

SEQ ID NO: 667045 - RNA, 16 nt, Escherichia coli CFT073
caucgauccccugccc

SEQ ID NO: 667046 - RNA, 18 nt, Escherichia coli CFT073
caucgacguccaaucagc

SEQ ID NO: 667047 - RNA, 15 nt, Escherichia coli CFT073
caucgacguggugaa

SEQ ID NO: 667048 - RNA, 23 nt, Escherichia coli CFT073
caucgcaaacagcacaucuccca

SEQ ID NO: 667049 - RNA, 14 nt, Escherichia coli CFT073
caucgcaaaccaga

SEQ ID NO: 667050 - RNA, 23 nt, Escherichia coli CFT073
caucccgguaucaaagcgccaga

SEQ ID NO: 667051 - RNA, 21 nt, Escherichia coli CFT073
caucauugguuaacuccagcg

SEQ ID NO: 667052 - RNA, 22 nt, Escherichia coli CFT073
caucauugguuaacuccagcga

SEQ ID NO: 667053 - RNA, 19 nt, Escherichia coli CFT073
caucccuuucgccugcaaa

SEQ ID NO: 667054 - RNA, 19 nt, Escherichia coli CFT073
cauccgacaaaaugauguc

SEQ ID NO: 667055 - RNA, 22 nt, Escherichia coli CFT073
cauccggaucgagaauauucac

SEQ ID NO: 667056 - RNA, 14 nt, Escherichia coli CFT073
cauccugcaccaca

SEQ ID NO: 667057 - RNA, 20 nt, Escherichia coli CFT073
cauccugaauuaacuuauca

SEQ ID NO: 667058 - RNA, 22 nt, Escherichia coli CFT073
cauccucauaacguaaaccaau

SEQ ID NO: 667059 - RNA, 21 nt, Escherichia coli CFT073
cauccuaaaggcaaaaugcca

SEQ ID NO: 667060 - RNA, 21 nt, Escherichia coli CFT073
cauccgguuucaucagccaau

SEQ ID NO: 667061 - RNA, 18 nt, Escherichia coli CFT073
cauccgguuuucugccug

SEQ ID NO: 667062 - RNA, 18 nt, Escherichia coli CFT073
cauccggauacagcccca

SEQ ID NO: 667063 - RNA, 22 nt, Escherichia coli CFT073
cauccggcaaccgcgccaagcc

SEQ ID NO: 667064 - RNA, 17 nt, Escherichia coli CFT073
cauccggcaauucucac

SEQ ID NO: 667065 - RNA, 20 nt, Escherichia coli CFT073
cauccggcaauugcaccgcg

SEQ ID NO: 667066 - RNA, 23 nt, Escherichia coli CFT073
cauccggcaauugcaccgcgcca

SEQ ID NO: 667067 - RNA, 15 nt, Escherichia coli CFT073
cauccgguaagcgau

SEQ ID NO: 667068 - RNA, 16 nt, Escherichia coli CFT073
cauccgguacuuuccu

SEQ ID NO: 667069 - RNA, 23 nt, Escherichia coli CFT073
caucaugaacugggcuauggcaa

SEQ ID NO: 667070 - RNA, 21 nt, Escherichia coli CFT073
caucaugaaacgcccacgcgc

SEQ ID NO: 667071 - RNA, 23 nt, Escherichia coli CFT073
caucaucgcgaucccccagaaaa

SEQ ID NO: 667072 - RNA, 14 nt, Escherichia coli CFT073
caucaucagaaaug

SEQ ID NO: 667073 - RNA, 19 nt, Escherichia coli CFT073
caucaucagaaaugccagu

SEQ ID NO: 667074 - RNA, 17 nt, Escherichia coli CFT073
caucauccgcggauaaa

SEQ ID NO: 667075 - RNA, 18 nt, Escherichia coli CFT073
caucauccgcggauaaaa

SEQ ID NO: 667076 - RNA, 22 nt, Escherichia coli CFT073
caucaguaaaguaucaaacaga

SEQ ID NO: 667077 - RNA, 14 nt, Escherichia coli CFT073
caucagguugagga

SEQ ID NO: 667078 - RNA, 20 nt, Escherichia coli CFT073
caucagguuggaucaacagg

SEQ ID NO: 667079 - RNA, 17 nt, Escherichia coli CFT073
caucaguaacuuacuua

SEQ ID NO: 667080 - RNA, 20 nt, Escherichia coli CFT073
caucaguagcaguaauuuau

SEQ ID NO: 667081 - RNA, 21 nt, Escherichia coli CFT073
caucaguagcaguaauuuaua

SEQ ID NO: 667082 - RNA, 21 nt, Escherichia coli CFT073
caucaggccaaacagaccaau

SEQ ID NO: 667083 - RNA, 13 nt, Escherichia coli CFT073
caucaggccaggc

SEQ ID NO: 667084 - RNA, 15 nt, Escherichia coli CFT073
caucagugaacccau

SEQ ID NO: 667085 - RNA, 14 nt, Escherichia coli CFT073
caucauaaauaaga

SEQ ID NO: 667086 - RNA, 20 nt, Escherichia coli CFT073
caucaguuucgaucagcaau

SEQ ID NO: 667087 - RNA, 20 nt, Escherichia coli CFT073
caucauaucgucauuaucgc

SEQ ID NO: 667088 - RNA, 22 nt, Escherichia coli CFT073
caucauauucauagcacauccu

SEQ ID NO: 667089 - RNA, 17 nt, Escherichia coli CFT073
caucacgcacugcaaua

SEQ ID NO: 667090 - RNA, 20 nt, Escherichia coli CFT073
caucacgcgguuacgcaccg

SEQ ID NO: 667091 - RNA, 14 nt, Escherichia coli CFT073
caucacgacauaau

SEQ ID NO: 667092 - RNA, 13 nt, Escherichia coli CFT073
caucaaucacuuu

SEQ ID NO: 667093 - RNA, 13 nt, Escherichia coli CFT073
caucaaucccuuc

SEQ ID NO: 667094 - RNA, 21 nt, Escherichia coli CFT073
caucaaucccuucgacuuuca

SEQ ID NO: 667095 - RNA, 16 nt, Escherichia coli CFT073
caucaaugccagcaua

SEQ ID NO: 667096 - RNA, 14 nt, Escherichia coli CFT073
caucaaugaccuga

SEQ ID NO: 667097 - RNA, 18 nt, Escherichia coli CFT073
caucagaacugacgccca

SEQ ID NO: 667098 - RNA, 15 nt, Escherichia coli CFT073
caucagacugcuuuu

SEQ ID NO: 667099 - RNA, 22 nt, Escherichia coli CFT073
caucagacugcuuuucccuuuc

SEQ ID NO: 667100 - RNA, 16 nt, Escherichia coli CFT073
caucagaacagcccca

SEQ ID NO: 667101 - RNA, 22 nt, Escherichia coli CFT073
caucacgguugagagcaaacac

SEQ ID NO: 667102 - RNA, 23 nt, Escherichia coli CFT073
caucacgguugagagcaaacacc

SEQ ID NO: 667103 - RNA, 16 nt, Escherichia coli CFT073
caucacgccgcuggca

SEQ ID NO: 667104 - RNA, 21 nt, Escherichia coli CFT073
caucacggaucaguuuaucca

SEQ ID NO: 667105 - RNA, 16 nt, Escherichia coli CFT073
caucacggcagccuga

SEQ ID NO: 667106 - RNA, 16 nt, Escherichia coli CFT073
caucaggcaaacuuca

SEQ ID NO: 667107 - RNA, 21 nt, Escherichia coli CFT073
caucaggcaacccagaagaaa

SEQ ID NO: 667108 - RNA, 21 nt, Escherichia coli CFT073
caucaggcagauacaaccaau

SEQ ID NO: 667109 - RNA, 14 nt, Escherichia coli CFT073
caucagcuggcaaa

SEQ ID NO: 667110 - RNA, 22 nt, Escherichia coli CFT073
caucagcuggcaaacaugcagc

SEQ ID NO: 667111 - RNA, 21 nt, Escherichia coli CFT073
caucagcuuacgguaggcacg

SEQ ID NO: 667112 - RNA, 19 nt, Escherichia coli CFT073
caucagcggguuuuucccu

SEQ ID NO: 667113 - RNA, 18 nt, Escherichia coli CFT073
caucagcgguacucgcgc

SEQ ID NO: 667114 - RNA, 19 nt, Escherichia coli CFT073
caucagcuccaugggagaa

SEQ ID NO: 667115 - RNA, 22 nt, Escherichia coli CFT073
caucagaucguugaacccggca

SEQ ID NO: 667116 - RNA, 21 nt, Escherichia coli CFT073
caucagcgacgaccguuuuac

SEQ ID NO: 667117 - RNA, 20 nt, Escherichia coli CFT073
caucagcgauucauugagua

SEQ ID NO: 667118 - RNA, 20 nt, Escherichia coli CFT073
caucagcgaacgacauccgc

SEQ ID NO: 667119 - RNA, 13 nt, Escherichia coli CFT073
caucagcgcccuc

SEQ ID NO: 667120 - RNA, 20 nt, Escherichia coli CFT073
caucagcgccugauggacau

SEQ ID NO: 667121 - RNA, 17 nt, Escherichia coli CFT073
caucaaacaacggcacu

SEQ ID NO: 667122 - RNA, 22 nt, Escherichia coli CFT073
caucaaacaacggcacuucaau

SEQ ID NO: 667123 - RNA, 15 nt, Escherichia coli CFT073
cauauuucgucgcau

SEQ ID NO: 667124 - RNA, 21 nt, Escherichia coli CFT073
caucaacgcggcaaaacccug

SEQ ID NO: 667125 - RNA, 16 nt, Escherichia coli CFT073
caucaaccagcacaaa

SEQ ID NO: 667126 - RNA, 13 nt, Escherichia coli CFT073
caucaagcggcgc

SEQ ID NO: 667127 - RNA, 22 nt, Escherichia coli CFT073
caucaagcuaacgaacgcagug

SEQ ID NO: 667128 - RNA, 19 nt, Escherichia coli CFT073
caucaauauuccagucagc

SEQ ID NO: 667129 - RNA, 15 nt, Escherichia coli CFT073
caucaagacccggcg

SEQ ID NO: 667130 - RNA, 23 nt, Escherichia coli CFT073
caucaagacccggcgcacgcggc

SEQ ID NO: 667131 - RNA, 12 nt, Escherichia coli CFT073
caucaagaaacu

SEQ ID NO: 667132 - RNA, 14 nt, Escherichia coli CFT073
caucaagaaacucu

SEQ ID NO: 667133 - RNA, 14 nt, Escherichia coli CFT073
caucaacugacuau

SEQ ID NO: 667134 - RNA, 15 nt, Escherichia coli CFT073
cauauuaacgcagca

SEQ ID NO: 667135 - RNA, 15 nt, Escherichia coli CFT073
cauauguugaaaagc

SEQ ID NO: 667136 - RNA, 13 nt, Escherichia coli CFT073
cauauguuuacgc

SEQ ID NO: 667137 - RNA, 18 nt, Escherichia coli CFT073
cauaugcagccacugcug

SEQ ID NO: 667138 - RNA, 14 nt, Escherichia coli CFT073
cauaugcagcaucc

SEQ ID NO: 667139 - RNA, 13 nt, Escherichia coli CFT073
cauaugccccugu

SEQ ID NO: 667140 - RNA, 21 nt, Escherichia coli CFT073
cauauggauaugaucugcaca

SEQ ID NO: 667141 - RNA, 19 nt, Escherichia coli CFT073
cauauuuaagccugcauca

SEQ ID NO: 667142 - RNA, 14 nt, Escherichia coli CFT073
cauauuuaaaaacg

SEQ ID NO: 667143 - RNA, 18 nt, Escherichia coli CFT073
cauauuguguaugcacac

SEQ ID NO: 667144 - RNA, 18 nt, Escherichia coli CFT073
cauauuggggaugacgaa

SEQ ID NO: 667145 - RNA, 14 nt, Escherichia coli CFT073
cauauuacgaauga

SEQ ID NO: 667146 - RNA, 17 nt, Escherichia coli CFT073
cauaucuuuuucguaag

SEQ ID NO: 667147 - RNA, 17 nt, Escherichia coli CFT073
cauaugauucauauugc

SEQ ID NO: 667148 - RNA, 15 nt, Escherichia coli CFT073
cauaucccaccagcg

SEQ ID NO: 667149 - RNA, 13 nt, Escherichia coli CFT073
cauaucucccagu

SEQ ID NO: 667150 - RNA, 13 nt, Escherichia coli CFT073
cauauccagcgcc

SEQ ID NO: 667151 - RNA, 17 nt, Escherichia coli CFT073
cauauccagugcaccac

SEQ ID NO: 667152 - RNA, 21 nt, Escherichia coli CFT073
cauauccaucguugaauacau

SEQ ID NO: 667153 - RNA, 16 nt, Escherichia coli CFT073
cauaucacuuuuauau

SEQ ID NO: 667154 - RNA, 12 nt, Escherichia coli CFT073
cauaucaucaag

SEQ ID NO: 667155 - RNA, 23 nt, Escherichia coli CFT073
cauaucaucaucggucaguuugc

SEQ ID NO: 667156 - RNA, 19 nt, Escherichia coli CFT073
cauauagccgcgcaguuuc

SEQ ID NO: 667157 - RNA, 13 nt, Escherichia coli CFT073
cauaucaauuaga

SEQ ID NO: 667158 - RNA, 18 nt, Escherichia coli CFT073
cauaucaccguucacugc

SEQ ID NO: 667159 - RNA, 16 nt, Escherichia coli CFT073
cauacucagcgccugc

SEQ ID NO: 667160 - RNA, 13 nt, Escherichia coli CFT073
cauacucaucuuc

SEQ ID NO: 667161 - RNA, 22 nt, Escherichia coli CFT073
cauaguauuuauccauaauuug

SEQ ID NO: 667162 - RNA, 20 nt, Escherichia coli CFT073
cauagucacuaccuguuuaa

SEQ ID NO: 667163 - RNA, 20 nt, Escherichia coli CFT073
cauauaagugcauuaaauuc

SEQ ID NO: 667164 - RNA, 20 nt, Escherichia coli CFT073
cauauaccgcaucagcaucg

SEQ ID NO: 667165 - RNA, 19 nt, Escherichia coli CFT073
cauaguccggcaccagcgc

SEQ ID NO: 667166 - RNA, 16 nt, Escherichia coli CFT073
cauagugaaaacgaag

SEQ ID NO: 667167 - RNA, 23 nt, Escherichia coli CFT073
cauagugaucagccucucucuga

SEQ ID NO: 667168 - RNA, 15 nt, Escherichia coli CFT073
cauagugccugaugc

SEQ ID NO: 667169 - RNA, 19 nt, Escherichia coli CFT073
cauacagcguuuugccauc

SEQ ID NO: 667170 - RNA, 11 nt, Escherichia coli CFT073
cauacagccag

SEQ ID NO: 667171 - RNA, 17 nt, Escherichia coli CFT073
cauacaaugcaauauuu

SEQ ID NO: 667172 - RNA, 12 nt, Escherichia coli CFT073
cauacacagaua

SEQ ID NO: 667173 - RNA, 21 nt, Escherichia coli CFT073
cauaauuuuucuuuaacaucg

SEQ ID NO: 667174 - RNA, 19 nt, Escherichia coli CFT073
cauacagcuuuuacagcca

SEQ ID NO: 667175 - RNA, 15 nt, Escherichia coli CFT073
cauacauaacagaau

SEQ ID NO: 667176 - RNA, 19 nt, Escherichia coli CFT073
cauacauggcauccccugc

SEQ ID NO: 667177 - RNA, 22 nt, Escherichia coli CFT073
cauacaugguuugaucgcuaag

SEQ ID NO: 667178 - RNA, 15 nt, Escherichia coli CFT073
cauacauguauaaaa

SEQ ID NO: 667179 - RNA, 19 nt, Escherichia coli CFT073
cauacauguauaaaaagaa

SEQ ID NO: 667180 - RNA, 14 nt, Escherichia coli CFT073
cauaccaagcccga

SEQ ID NO: 667181 - RNA, 17 nt, Escherichia coli CFT073
cauaccacauacauaau

SEQ ID NO: 667182 - RNA, 11 nt, Escherichia coli CFT073
cauaccagcag

SEQ ID NO: 667183 - RNA, 13 nt, Escherichia coli CFT073
cauaccagcagca

SEQ ID NO: 667184 - RNA, 17 nt, Escherichia coli CFT073
cauaccagcaggaaucc

SEQ ID NO: 667185 - RNA, 23 nt, Escherichia coli CFT073
cauaccagcaggaaucccaucag

SEQ ID NO: 667186 - RNA, 19 nt, Escherichia coli CFT073
cauacgcaaugugcagcag

SEQ ID NO: 667187 - RNA, 20 nt, Escherichia coli CFT073
cauacgcgguauuaaauccg

SEQ ID NO: 667188 - RNA, 21 nt, Escherichia coli CFT073
cauaccuaaaagcacgccaga

SEQ ID NO: 667189 - RNA, 16 nt, Escherichia coli CFT073
cauaccggacuccaga

SEQ ID NO: 667190 - RNA, 23 nt, Escherichia coli CFT073
cauacccgcacaaauagccagca

SEQ ID NO: 667191 - RNA, 24 nt, Escherichia coli CFT073
cauaccauauuguuucaacacagg

SEQ ID NO: 667192 - RNA, 20 nt, Escherichia coli CFT073
cauacccaccaauuaauccc

SEQ ID NO: 667193 - RNA, 14 nt, Escherichia coli CFT073
cauaaucaaauaaa

SEQ ID NO: 667194 - RNA, 23 nt, Escherichia coli CFT073
cauaaucaagguugcacaaccaa

SEQ ID NO: 667195 - RNA, 14 nt, Escherichia coli CFT073
cauaaucaaucgca

SEQ ID NO: 667196 - RNA, 20 nt, Escherichia coli CFT073
cauaauauucauuacaccaa

SEQ ID NO: 667197 - RNA, 16 nt, Escherichia coli CFT073
cauaauauugccggga

SEQ ID NO: 667198 - RNA, 23 nt, Escherichia coli CFT073
cauaauauucauuacaccaauac

SEQ ID NO: 667199 - RNA, 15 nt, Escherichia coli CFT073
cauaauccuguagau

SEQ ID NO: 667200 - RNA, 22 nt, Escherichia coli CFT073
cauaauccagccuucuauaucu

SEQ ID NO: 667201 - RNA, 14 nt, Escherichia coli CFT073
cauaauccaggcau

SEQ ID NO: 667202 - RNA, 16 nt, Escherichia coli CFT073
cauaauccaggcauca

SEQ ID NO: 667203 - RNA, 19 nt, Escherichia coli CFT073
cauaauaagcuuuuucugc

SEQ ID NO: 667204 - RNA, 15 nt, Escherichia coli CFT073
cauaauacugacaaa

SEQ ID NO: 667205 - RNA, 23 nt, Escherichia coli CFT073
cauaauuuuggucgcuaacugga

SEQ ID NO: 667206 - RNA, 17 nt, Escherichia coli CFT073
cauaauuuccagcagug

SEQ ID NO: 667207 - RNA, 15 nt, Escherichia coli CFT073
cauaauugaccagau

SEQ ID NO: 667208 - RNA, 21 nt, Escherichia coli CFT073
cauaauugagcagcaaaaugg

SEQ ID NO: 667209 - RNA, 17 nt, Escherichia coli CFT073
cauaauguguuaauaau

SEQ ID NO: 667210 - RNA, 16 nt, Escherichia coli CFT073
cauaaugcccagcguu

SEQ ID NO: 667211 - RNA, 23 nt, Escherichia coli CFT073
cauaaugccccagcgcacuacgc

SEQ ID NO: 667212 - RNA, 13 nt, Escherichia coli CFT073
cauaaugccgaca

SEQ ID NO: 667213 - RNA, 15 nt, Escherichia coli CFT073
cauaaugaugccgaa

SEQ ID NO: 667214 - RNA, 20 nt, Escherichia coli CFT073
cauaaugauggugaaagcaa

SEQ ID NO: 667215 - RNA, 21 nt, Escherichia coli CFT073
cauaaugauggugaaagcaaa

SEQ ID NO: 667216 - RNA, 18 nt, Escherichia coli CFT073
cauaaugggcgcgggcaa

SEQ ID NO: 667217 - RNA, 22 nt, Escherichia coli CFT073
cauaaugguggaguggcccagg

SEQ ID NO: 667218 - RNA, 16 nt, Escherichia coli CFT073
cauaaaucagaucgac

SEQ ID NO: 667219 - RNA, 21 nt, Escherichia coli CFT073
cauaaauuauagaugcagcau

SEQ ID NO: 667220 - RNA, 11 nt, Escherichia coli CFT073
cauaaauaaca

SEQ ID NO: 667221 - RNA, 14 nt, Escherichia coli CFT073
cauaaauaacaucu

SEQ ID NO: 667222 - RNA, 21 nt, Escherichia coli CFT073
cauaaagucaaaagccuccga

SEQ ID NO: 667223 - RNA, 21 nt, Escherichia coli CFT073
cauaaagcccgcuucaaacgc

SEQ ID NO: 667224 - RNA, 14 nt, Escherichia coli CFT073
cauaaagccugaua

SEQ ID NO: 667225 - RNA, 21 nt, Escherichia coli CFT073
cauaaagcgcaauauuucucu

SEQ ID NO: 667226 - RNA, 19 nt, Escherichia coli CFT073
cauaaacaauacagcgaau

SEQ ID NO: 667227 - RNA, 16 nt, Escherichia coli CFT073
cauaaacaccagcagc

SEQ ID NO: 667228 - RNA, 19 nt, Escherichia coli CFT073
cauaaacacucacauccag

SEQ ID NO: 667229 - RNA, 15 nt, Escherichia coli CFT073
cauaaacaccagcaa

SEQ ID NO: 667230 - RNA, 22 nt, Escherichia coli CFT073
cauaaaagggcagcaggaucag

SEQ ID NO: 667231 - RNA, 21 nt, Escherichia coli CFT073
cauaacacaauaccuucugcg

SEQ ID NO: 667232 - RNA, 15 nt, Escherichia coli CFT073
cauaacaaaaugccg

SEQ ID NO: 667233 - RNA, 13 nt, Escherichia coli CFT073
cauaaccaacaaa

SEQ ID NO: 667234 - RNA, 20 nt, Escherichia coli CFT073
cauaacauucagcaauaacu

SEQ ID NO: 667235 - RNA, 17 nt, Escherichia coli CFT073
cauaacagaauaucugc

SEQ ID NO: 667236 - RNA, 12 nt, Escherichia coli CFT073
cauaacagccau

SEQ ID NO: 667237 - RNA, 22 nt, Escherichia coli CFT073
cauaaccuguuccuuauucugu

SEQ ID NO: 667238 - RNA, 21 nt, Escherichia coli CFT073
cauaaccgaaaaguuucucgc

SEQ ID NO: 667239 - RNA, 12 nt, Escherichia coli CFT073
cauaaccgauac

SEQ ID NO: 667240 - RNA, 19 nt, Escherichia coli CFT073
cauaacgcuggggaaugcc

SEQ ID NO: 667241 - RNA, 13 nt, Escherichia coli CFT073
cauaacucaccau

SEQ ID NO: 667242 - RNA, 18 nt, Escherichia coli CFT073
cauaacucuccuguuuaa

SEQ ID NO: 667243 - RNA, 17 nt, Escherichia coli CFT073
cauaacuggucaucaag

SEQ ID NO: 667244 - RNA, 14 nt, Escherichia coli CFT073
cauaagcaccgaac

SEQ ID NO: 667245 - RNA, 18 nt, Escherichia coli CFT073
cauaagcaccgaacaaga

SEQ ID NO: 667246 - RNA, 15 nt, Escherichia coli CFT073
cauaagccgcggcgu

SEQ ID NO: 667247 - RNA, 13 nt, Escherichia coli CFT073
cauaaguaaguga

SEQ ID NO: 667248 - RNA, 19 nt, Escherichia coli CFT073
caguucgauauccagaccg

SEQ ID NO: 667249 - RNA, 14 nt, Escherichia coli CFT073
caguucccccugcc

SEQ ID NO: 667250 - RNA, 23 nt, Escherichia coli CFT073
caguucuagugcuacccacuucc

SEQ ID NO: 667251 - RNA, 18 nt, Escherichia coli CFT073
caguucggcguucaccag

SEQ ID NO: 667252 - RNA, 22 nt, Escherichia coli CFT073
caguucgcuuugaaugugcggc

SEQ ID NO: 667253 - RNA, 16 nt, Escherichia coli CFT073
caguucggcaucaucg

SEQ ID NO: 667254 - RNA, 15 nt, Escherichia coli CFT073
caguucuucaaaaau

SEQ ID NO: 667255 - RNA, 17 nt, Escherichia coli CFT073
caguucuucaaaaauaa

SEQ ID NO: 667256 - RNA, 17 nt, Escherichia coli CFT073
caguugaugauguucaa

SEQ ID NO: 667257 - RNA, 19 nt, Escherichia coli CFT073
caguugaugauguucaacu

SEQ ID NO: 667258 - RNA, 19 nt, Escherichia coli CFT073
caguugauggaaaauuguu

SEQ ID NO: 667259 - RNA, 22 nt, Escherichia coli CFT073
caguugauacaggaacagccac

SEQ ID NO: 667260 - RNA, 20 nt, Escherichia coli CFT073
caguuggcagagauucuuca

SEQ ID NO: 667261 - RNA, 12 nt, Escherichia coli CFT073
caguugcucuuc

SEQ ID NO: 667262 - RNA, 14 nt, Escherichia coli CFT073
caguugcugcguga

SEQ ID NO: 667263 - RNA, 14 nt, Escherichia coli CFT073
caguugcgcuucac

SEQ ID NO: 667264 - RNA, 22 nt, Escherichia coli CFT073
caguugcagucucaugcgucau

SEQ ID NO: 667265 - RNA, 15 nt, Escherichia coli CFT073
caguugugaugccac

SEQ ID NO: 667266 - RNA, 19 nt, Escherichia coli CFT073
caguuguaugucauaaaaa

SEQ ID NO: 667267 - RNA, 15 nt, Escherichia coli CFT073
caguuguuugcggaa

SEQ ID NO: 667268 - RNA, 23 nt, Escherichia coli CFT073
caguuuaccgagcgccgggagau

SEQ ID NO: 667269 - RNA, 23 nt, Escherichia coli CFT073
caguuggcugugguacugccgac

SEQ ID NO: 667270 - RNA, 15 nt, Escherichia coli CFT073
caguugguagagcac

SEQ ID NO: 667271 - RNA, 23 nt, Escherichia coli CFT073
caguugguuagagcacaucacuc

SEQ ID NO: 667272 - RNA, 17 nt, Escherichia coli CFT073
caguugguagagcacga

SEQ ID NO: 667273 - RNA, 12 nt, Escherichia coli CFT073
caguugguucaa

SEQ ID NO: 667274 - RNA, 14 nt, Escherichia coli CFT073
caguuguaauaaga

SEQ ID NO: 667275 - RNA, 18 nt, Escherichia coli CFT073
caguuguaauaagagguu

SEQ ID NO: 667276 - RNA, 18 nt, Escherichia coli CFT073
caguuguaaucacgcuca

SEQ ID NO: 667277 - RNA, 19 nt, Escherichia coli CFT073
caguuguaaucacgcucaa

SEQ ID NO: 667278 - RNA, 16 nt, Escherichia coli CFT073
caguuuagcucagaau

SEQ ID NO: 667279 - RNA, 20 nt, Escherichia coli CFT073
caguuuauaauuggcagugg

SEQ ID NO: 667280 - RNA, 13 nt, Escherichia coli CFT073
caguuuauacagc

SEQ ID NO: 667281 - RNA, 15 nt, Escherichia coli CFT073
caguuuauccagcca

SEQ ID NO: 667282 - RNA, 23 nt, Escherichia coli CFT073
caguuuacgagugcgcucuucaa

SEQ ID NO: 667283 - RNA, 16 nt, Escherichia coli CFT073
caguuuauccagccac

SEQ ID NO: 667284 - RNA, 15 nt, Escherichia coli CFT073
caguuuaugaaucaa

SEQ ID NO: 667285 - RNA, 15 nt, Escherichia coli CFT073
caguuuauggaacaa

SEQ ID NO: 667286 - RNA, 18 nt, Escherichia coli CFT073
caguuuauucuuuacugc

SEQ ID NO: 667287 - RNA, 20 nt, Escherichia coli CFT073
caguuucgccaguuuuucaa

SEQ ID NO: 667288 - RNA, 16 nt, Escherichia coli CFT073
caguuucgacaucaca

SEQ ID NO: 667289 - RNA, 18 nt, Escherichia coli CFT073
caguuucgaucagcaauu

SEQ ID NO: 667290 - RNA, 14 nt, Escherichia coli CFT073
caguuucaccucuc

SEQ ID NO: 667291 - RNA, 14 nt, Escherichia coli CFT073
caguuucaccagca

SEQ ID NO: 667292 - RNA, 23 nt, Escherichia coli CFT073
caguuucagagcgaauuaagaau

SEQ ID NO: 667293 - RNA, 17 nt, Escherichia coli CFT073
caguuucagccccauca

SEQ ID NO: 667294 - RNA, 22 nt, Escherichia coli CFT073
caguuuggucuggcaaaaauaa

SEQ ID NO: 667295 - RNA, 20 nt, Escherichia coli CFT073
caguuugcgcgugcugggau

SEQ ID NO: 667296 - RNA, 20 nt, Escherichia coli CFT073
caguuuguaagucagaaagc

SEQ ID NO: 667297 - RNA, 17 nt, Escherichia coli CFT073
caguuuuccgccauuca

SEQ ID NO: 667298 - RNA, 20 nt, Escherichia coli CFT073
caguuuuaguggauuaacug

SEQ ID NO: 667299 - RNA, 22 nt, Escherichia coli CFT073
caguuuuaccgccggaacaucc

SEQ ID NO: 667300 - RNA, 20 nt, Escherichia coli CFT073
caguuugcaggccaaacagc

SEQ ID NO: 667301 - RNA, 17 nt, Escherichia coli CFT073
caguuugcgggacaacu

SEQ ID NO: 667302 - RNA, 17 nt, Escherichia coli CFT073
caguuugcucaaaucca

SEQ ID NO: 667303 - RNA, 15 nt, Escherichia coli CFT073
caguuucuuuuaaca

SEQ ID NO: 667304 - RNA, 24 nt, Escherichia coli CFT073
caguuuucgcaccgcguuuagcgu

SEQ ID NO: 667305 - RNA, 22 nt, Escherichia coli CFT073
caguuuugucuucggccauuga

SEQ ID NO: 667306 - RNA, 14 nt, Escherichia coli CFT073
caguuuugucuucg

SEQ ID NO: 667307 - RNA, 12 nt, Escherichia coli CFT073
caguuuuuccag

SEQ ID NO: 667308 - RNA, 18 nt, Escherichia coli CFT073
caguuuuuccccugccag

SEQ ID NO: 667309 - RNA, 18 nt, Escherichia coli CFT073
caguuuuuccuuuuggug

SEQ ID NO: 667310 - RNA, 16 nt, Escherichia coli CFT073
caguuuuucuuuuuca

SEQ ID NO: 667311 - RNA, 22 nt, Escherichia coli CFT073
caguuuuucuuuuucaaacugg

SEQ ID NO: 667312 - RNA, 19 nt, Escherichia coli CFT073
caguguuggcggcagauga

SEQ ID NO: 667313 - RNA, 10 nt, Escherichia coli CFT073
caguguuuag

SEQ ID NO: 667314 - RNA, 20 nt, Escherichia coli CFT073
caguguuuaguggcuuaacu

SEQ ID NO: 667315 - RNA, 14 nt, Escherichia coli CFT073
cagugucauuguca

SEQ ID NO: 667316 - RNA, 22 nt, Escherichia coli CFT073
cagugugaauaauugugcaauu

SEQ ID NO: 667317 - RNA, 13 nt, Escherichia coli CFT073
cagugugccacuu

SEQ ID NO: 667318 - RNA, 14 nt, Escherichia coli CFT073
caguuaccagccgg

SEQ ID NO: 667319 - RNA, 17 nt, Escherichia coli CFT073
caguuaagcccuuagua

SEQ ID NO: 667320 - RNA, 18 nt, Escherichia coli CFT073
caguucauccauuaacag

SEQ ID NO: 667321 - RNA, 12 nt, Escherichia coli CFT073
caguucagcaac

SEQ ID NO: 667322 - RNA, 15 nt, Escherichia coli CFT073
caguucagcaacacu

SEQ ID NO: 667323 - RNA, 21 nt, Escherichia coli CFT073
caguucaucaacgcccauaaa

SEQ ID NO: 667324 - RNA, 15 nt, Escherichia coli CFT073
caguuccacaccuac

SEQ ID NO: 667325 - RNA, 19 nt, Escherichia coli CFT073
caguuccacuucugcacgg

SEQ ID NO: 667326 - RNA, 18 nt, Escherichia coli CFT073
caguuccagcaaaucaau

SEQ ID NO: 667327 - RNA, 15 nt, Escherichia coli CFT073
caguuccagcagcuc

SEQ ID NO: 667328 - RNA, 16 nt, Escherichia coli CFT073
caguuccagcgccugg

SEQ ID NO: 667329 - RNA, 17 nt, Escherichia coli CFT073
caguuaucaggcugcug

SEQ ID NO: 667330 - RNA, 14 nt, Escherichia coli CFT073
caguuauucauugc

SEQ ID NO: 667331 - RNA, 21 nt, Escherichia coli CFT073
caguucaaauucauugucggg

SEQ ID NO: 667332 - RNA, 16 nt, Escherichia coli CFT073
caguucacgaauauuu

SEQ ID NO: 667333 - RNA, 20 nt, Escherichia coli CFT073
cagguauaccgaaaucgcca

SEQ ID NO: 667334 - RNA, 22 nt, Escherichia coli CFT073
cagguaguugccagcagcuccc

SEQ ID NO: 667335 - RNA, 15 nt, Escherichia coli CFT073
cagugccgagauauu

SEQ ID NO: 667336 - RNA, 13 nt, Escherichia coli CFT073
cagugccgaugcc

SEQ ID NO: 667337 - RNA, 14 nt, Escherichia coli CFT073
cagugccaucccag

SEQ ID NO: 667338 - RNA, 23 nt, Escherichia coli CFT073
cagugccccaaaugucggaugcg

SEQ ID NO: 667339 - RNA, 19 nt, Escherichia coli CFT073
cagugcccggcccggagga

SEQ ID NO: 667340 - RNA, 18 nt, Escherichia coli CFT073
cagugccgccguuaaaug

SEQ ID NO: 667341 - RNA, 19 nt, Escherichia coli CFT073
cagugccgccguuaaaugg

SEQ ID NO: 667342 - RNA, 22 nt, Escherichia coli CFT073
cagugccgcgcauagcaccacc

SEQ ID NO: 667343 - RNA, 18 nt, Escherichia coli CFT073
cagugccggaaugggcaa

SEQ ID NO: 667344 - RNA, 19 nt, Escherichia coli CFT073
cagugccggaaugucuucc

SEQ ID NO: 667345 - RNA, 21 nt, Escherichia coli CFT073
cagugccggaaugucuuccuu

SEQ ID NO: 667346 - RNA, 19 nt, Escherichia coli CFT073
cagugccggucagacagcg

SEQ ID NO: 667347 - RNA, 20 nt, Escherichia coli CFT073
cagugccugcgccaccguuu

SEQ ID NO: 667348 - RNA, 19 nt, Escherichia coli CFT073
cagugccuggcauaacgca

SEQ ID NO: 667349 - RNA, 22 nt, Escherichia coli CFT073
cagugcgcgaaccagagacaga

SEQ ID NO: 667350 - RNA, 19 nt, Escherichia coli CFT073
cagugcugacugaugagaa

SEQ ID NO: 667351 - RNA, 14 nt, Escherichia coli CFT073
cagugcguaagcgc

SEQ ID NO: 667352 - RNA, 15 nt, Escherichia coli CFT073
cagugcguacccagc

SEQ ID NO: 667353 - RNA, 14 nt, Escherichia coli CFT073
cagugcguuacaca

SEQ ID NO: 667354 - RNA, 23 nt, Escherichia coli CFT073
caguggaggaacuuaaccugcga

SEQ ID NO: 667355 - RNA, 17 nt, Escherichia coli CFT073
cagugcugcauccugca

SEQ ID NO: 667356 - RNA, 20 nt, Escherichia coli CFT073
cagugcugcauccugcacca

SEQ ID NO: 667357 - RNA, 13 nt, Escherichia coli CFT073
caguggaaucauc

SEQ ID NO: 667358 - RNA, 19 nt, Escherichia coli CFT073
caguggcgugguaucacgu

SEQ ID NO: 667359 - RNA, 16 nt, Escherichia coli CFT073
ccacggauuaccguga

SEQ ID NO: 667360 - RNA, 15 nt, Escherichia coli CFT073
ccacggcaugaaagc

SEQ ID NO: 667361 - RNA, 13 nt, Escherichia coli CFT073
ccacgcucagcaa

SEQ ID NO: 667362 - RNA, 21 nt, Escherichia coli CFT073
ccacgcgguauggucacugag

SEQ ID NO: 667363 - RNA, 19 nt, Escherichia coli CFT073
ccacgcuuugauccgccag

SEQ ID NO: 667364 - RNA, 12 nt, Escherichia coli CFT073
ccacgcuggacg

SEQ ID NO: 667365 - RNA, 18 nt, Escherichia coli CFT073
ccacgcugccgcgcagcg

SEQ ID NO: 667366 - RNA, 15 nt, Escherichia coli CFT073
ccacgcugccgcgca

SEQ ID NO: 667367 - RNA, 18 nt, Escherichia coli CFT073
ccacgccauaaccggccu

SEQ ID NO: 667368 - RNA, 22 nt, Escherichia coli CFT073
ccacgccgaaccaugucaucaa

SEQ ID NO: 667369 - RNA, 24 nt, Escherichia coli CFT073
ccacgccgauaaucaacgcgccgc

SEQ ID NO: 667370 - RNA, 10 nt, Escherichia coli CFT073
ccacgcgcgg

SEQ ID NO: 667371 - RNA, 21 nt, Escherichia coli CFT073
ccacgccgauggcagaaauca

SEQ ID NO: 667372 - RNA, 22 nt, Escherichia coli CFT073
ccacuacuuaauaagcaggcca

SEQ ID NO: 667373 - RNA, 14 nt, Escherichia coli CFT073
ccacucaccgccgu

SEQ ID NO: 667374 - RNA, 18 nt, Escherichia coli CFT073
ccacuaccguaguaaauc

SEQ ID NO: 667375 - RNA, 23 nt, Escherichia coli CFT073
ccacuacgugaucgucuucaacc

SEQ ID NO: 667376 - RNA, 14 nt, Escherichia coli CFT073
ccacgugagugugg

SEQ ID NO: 667377 - RNA, 13 nt, Escherichia coli CFT073
ccacgucugaagu

SEQ ID NO: 667378 - RNA, 14 nt, Escherichia coli CFT073
ccacguugcaucac

SEQ ID NO: 667379 - RNA, 15 nt, Escherichia coli CFT073
ccacguuuaccgccc

SEQ ID NO: 667380 - RNA, 14 nt, Escherichia coli CFT073
ccacguuucuucua

SEQ ID NO: 667381 - RNA, 16 nt, Escherichia coli CFT073
ccacguuccccagaug

SEQ ID NO: 667382 - RNA, 13 nt, Escherichia coli CFT073
ccacggcuccagc

SEQ ID NO: 667383 - RNA, 14 nt, Escherichia coli CFT073
ccacggcuccagca

SEQ ID NO: 667384 - RNA, 19 nt, Escherichia coli CFT073
ccacgagacuuauuaaaga

SEQ ID NO: 667385 - RNA, 13 nt, Escherichia coli CFT073
ccacgcacagccc

SEQ ID NO: 667386 - RNA, 16 nt, Escherichia coli CFT073
ccaccugauugcugcu

SEQ ID NO: 667387 - RNA, 20 nt, Escherichia coli CFT073
ccacgaccagcgcaaacggc

SEQ ID NO: 667388 - RNA, 22 nt, Escherichia coli CFT073
ccaccuccgcuaaauccgccgc

SEQ ID NO: 667389 - RNA, 12 nt, Escherichia coli CFT073
ccaccgcccguu

SEQ ID NO: 667390 - RNA, 16 nt, Escherichia coli CFT073
ccaccgcccagagaau

SEQ ID NO: 667391 - RNA, 16 nt, Escherichia coli CFT073
ccaccgguacaaacau

SEQ ID NO: 667392 - RNA, 15 nt, Escherichia coli CFT073
ccaccgucaaaucca

SEQ ID NO: 667393 - RNA, 14 nt, Escherichia coli CFT073
ccacaggcuggcgu

SEQ ID NO: 667394 - RNA, 14 nt, Escherichia coli CFT073
ccaccaccucuucc

SEQ ID NO: 667395 - RNA, 13 nt, Escherichia coli CFT073
ccaccaccuuaca

SEQ ID NO: 667396 - RNA, 18 nt, Escherichia coli CFT073
ccaccaccgcaaaauagg

SEQ ID NO: 667397 - RNA, 15 nt, Escherichia coli CFT073
ccaccaggccacggc

SEQ ID NO: 667398 - RNA, 19 nt, Escherichia coli CFT073
ccaccagcagcugcuccca

SEQ ID NO: 667399 - RNA, 13 nt, Escherichia coli CFT073
ccaccagauggcu

SEQ ID NO: 667400 - RNA, 17 nt, Escherichia coli CFT073
ccaccagcaaaaacggc

SEQ ID NO: 667401 - RNA, 17 nt, Escherichia coli CFT073
ccaccagaaucgccagc

SEQ ID NO: 667402 - RNA, 15 nt, Escherichia coli CFT073
ccaccagaaccgccg

SEQ ID NO: 667403 - RNA, 16 nt, Escherichia coli CFT073
ccaccagaaccgccgc

SEQ ID NO: 667404 - RNA, 16 nt, Escherichia coli CFT073
ccaccacgccaagaaa

SEQ ID NO: 667405 - RNA, 14 nt, Escherichia coli CFT073
ccaccacgcccagc

SEQ ID NO: 667406 - RNA, 21 nt, Escherichia coli CFT073
ccaccacgcgggguaaaaccc

SEQ ID NO: 667407 - RNA, 12 nt, Escherichia coli CFT073
ccaccagugaau

SEQ ID NO: 667408 - RNA, 12 nt, Escherichia coli CFT073
ccaccagugccg

SEQ ID NO: 667409 - RNA, 17 nt, Escherichia coli CFT073
ccaccauccccaccaaa

SEQ ID NO: 667410 - RNA, 13 nt, Escherichia coli CFT073
ccacagcaagcag

SEQ ID NO: 667411 - RNA, 16 nt, Escherichia coli CFT073
ccacagcaagcagccg

SEQ ID NO: 667412 - RNA, 15 nt, Escherichia coli CFT073
ccacagcaaugcauu

SEQ ID NO: 667413 - RNA, 15 nt, Escherichia coli CFT073
ccacacccacaucaa

SEQ ID NO: 667414 - RNA, 19 nt, Escherichia coli CFT073
ccacaccaguaaagcccau

SEQ ID NO: 667415 - RNA, 14 nt, Escherichia coli CFT073
ccacaccagugacg

SEQ ID NO: 667416 - RNA, 19 nt, Escherichia coli CFT073
ccacaccagugacgcagcg

SEQ ID NO: 667417 - RNA, 21 nt, Escherichia coli CFT073
ccacacaaagugcgaggauca

SEQ ID NO: 667418 - RNA, 13 nt, Escherichia coli CFT073
ccacaccaaaaua

SEQ ID NO: 667419 - RNA, 14 nt, Escherichia coli CFT073
ccacaccaaaauaa

SEQ ID NO: 667420 - RNA, 16 nt, Escherichia coli CFT073
ccacaccaaaauaacg

SEQ ID NO: 667421 - RNA, 16 nt, Escherichia coli CFT073
ccacaccaccaugcua

SEQ ID NO: 667422 - RNA, 15 nt, Escherichia coli CFT073
ccacaccacgccacu

SEQ ID NO: 667423 - RNA, 13 nt, Escherichia coli CFT073
ccacaccagacca

SEQ ID NO: 667424 - RNA, 16 nt, Escherichia coli CFT073
ccacaccagaccagac

SEQ ID NO: 667425 - RNA, 15 nt, Escherichia coli CFT073
ccacagccgagcgcu

SEQ ID NO: 667426 - RNA, 23 nt, Escherichia coli CFT073
ccacagcaguuagcuuuucuccu

SEQ ID NO: 667427 - RNA, 19 nt, Escherichia coli CFT073
ccacagcagccuucgccac

SEQ ID NO: 667428 - RNA, 18 nt, Escherichia coli CFT073
ccacagcagccuucgcca

SEQ ID NO: 667429 - RNA, 13 nt, Escherichia coli CFT073
ccaauuugcgccg

SEQ ID NO: 667430 - RNA, 18 nt, Escherichia coli CFT073
ccaauuuaagugguauug

SEQ ID NO: 667431 - RNA, 23 nt, Escherichia coli CFT073
ccaauuucugugcagccaaaaau

SEQ ID NO: 667432 - RNA, 13 nt, Escherichia coli CFT073
ccaaucucccagc

SEQ ID NO: 667433 - RNA, 16 nt, Escherichia coli CFT073
ccaaucugguugccca

SEQ ID NO: 667434 - RNA, 13 nt, Escherichia coli CFT073
ccaaucugcaaaa

SEQ ID NO: 667435 - RNA, 18 nt, Escherichia coli CFT073
ccaaucuucacaucauca

SEQ ID NO: 667436 - RNA, 22 nt, Escherichia coli CFT073
ccaauguggaaagccccagccc

SEQ ID NO: 667437 - RNA, 18 nt, Escherichia coli CFT073
ccaauggcuuuugccgcc

SEQ ID NO: 667438 - RNA, 13 nt, Escherichia coli CFT073
ccaaucaccacuu

SEQ ID NO: 667439 - RNA, 14 nt, Escherichia coli CFT073
ccaaucagcacaca

SEQ ID NO: 667440 - RNA, 21 nt, Escherichia coli CFT073
ccaaucagcacacauaacagc

SEQ ID NO: 667441 - RNA, 11 nt, Escherichia coli CFT073
ccaauauccug

SEQ ID NO: 667442 - RNA, 13 nt, Escherichia coli CFT073
ccaauauccugag

SEQ ID NO: 667443 - RNA, 15 nt, Escherichia coli CFT073
ccaauauuaaauauc

SEQ ID NO: 667444 - RNA, 20 nt, Escherichia coli CFT073
ccaaucccccacuuuuaaau

SEQ ID NO: 667445 - RNA, 15 nt, Escherichia coli CFT073
ccaaucgcaggcgag

SEQ ID NO: 667446 - RNA, 18 nt, Escherichia coli CFT073
ccaaucgcccgggcuuua

SEQ ID NO: 667447 - RNA, 14 nt, Escherichia coli CFT073
ccaaucauaaacgc

SEQ ID NO: 667448 - RNA, 20 nt, Escherichia coli CFT073
ccaaucaucgacauugacca

SEQ ID NO: 667449 - RNA, 14 nt, Escherichia coli CFT073
ccaauaccaaaaau

SEQ ID NO: 667450 - RNA, 20 nt, Escherichia coli CFT073
ccaauacguuucuuccacac

SEQ ID NO: 667451 - RNA, 22 nt, Escherichia coli CFT073
ccaauacguuucuuccacacca

SEQ ID NO: 667452 - RNA, 15 nt, Escherichia coli CFT073
ccaauagugcggcgu

SEQ ID NO: 667453 - RNA, 16 nt, Escherichia coli CFT073
ccaacgggaauucaac

SEQ ID NO: 667454 - RNA, 17 nt, Escherichia coli CFT073
ccaacggggccagcaca

SEQ ID NO: 667455 - RNA, 13 nt, Escherichia coli CFT073
ccaacggcgagcc

SEQ ID NO: 667456 - RNA, 23 nt, Escherichia coli CFT073
ccaacgaucuggcgucagcggcu

SEQ ID NO: 667457 - RNA, 18 nt, Escherichia coli CFT073
ccaaccuuucaucuguuu

SEQ ID NO: 667458 - RNA, 14 nt, Escherichia coli CFT073
ccaacgaaucuuua

SEQ ID NO: 667459 - RNA, 15 nt, Escherichia coli CFT073
ccaacgcauuuauuu

SEQ ID NO: 667460 - RNA, 13 nt, Escherichia coli CFT073
ccaacgcaccaaa

SEQ ID NO: 667461 - RNA, 17 nt, Escherichia coli CFT073
ccaagcaccauaaacac

SEQ ID NO: 667462 - RNA, 22 nt, Escherichia coli CFT073
ccaagagcaaauuuuccccaga

SEQ ID NO: 667463 - RNA, 14 nt, Escherichia coli CFT073
ccaagauagaacca

SEQ ID NO: 667464 - RNA, 21 nt, Escherichia coli CFT073
ccaacugugugcugagcggcg

SEQ ID NO: 667465 - RNA, 15 nt, Escherichia coli CFT073
ccaacuuauuguuuu

SEQ ID NO: 667466 - RNA, 11 nt, Escherichia coli CFT073
ccaacuucaua

SEQ ID NO: 667467 - RNA, 16 nt, Escherichia coli CFT073
ccaacuucauacauug

SEQ ID NO: 667468 - RNA, 17 nt, Escherichia coli CFT073
ccaaauccggcaaauaa

SEQ ID NO: 667469 - RNA, 14 nt, Escherichia coli CFT073
ccaaauccauuuuc

SEQ ID NO: 667470 - RNA, 15 nt, Escherichia coli CFT073
ccaaaucugauuaau

SEQ ID NO: 667471 - RNA, 20 nt, Escherichia coli CFT073
ccaacaaauaguacacagac

SEQ ID NO: 667472 - RNA, 17 nt, Escherichia coli CFT073
ccaacaacccugcauca

SEQ ID NO: 667473 - RNA, 20 nt, Escherichia coli CFT073
ccaaauuuggugcucaguuu

SEQ ID NO: 667474 - RNA, 23 nt, Escherichia coli CFT073
ccaacaaaacauaucccaccagc

SEQ ID NO: 667475 - RNA, 11 nt, Escherichia coli CFT073
ccaacaaucau

SEQ ID NO: 667476 - RNA, 23 nt, Escherichia coli CFT073
ccaacaagcaccggcaccgaggu

SEQ ID NO: 667477 - RNA, 15 nt, Escherichia coli CFT073
ccaacagcagccaca

SEQ ID NO: 667478 - RNA, 16 nt, Escherichia coli CFT073
ccaacagcagccacac

SEQ ID NO: 667479 - RNA, 12 nt, Escherichia coli CFT073
ccaacagugccg

SEQ ID NO: 667480 - RNA, 15 nt, Escherichia coli CFT073
ccaacagcgacauca

SEQ ID NO: 667481 - RNA, 16 nt, Escherichia coli CFT073
ccaaaucauaaaaauc

SEQ ID NO: 667482 - RNA, 13 nt, Escherichia coli CFT073
ccaaaucaucagu

SEQ ID NO: 667483 - RNA, 17 nt, Escherichia coli CFT073
ccaaauauucagccacu

SEQ ID NO: 667484 - RNA, 14 nt, Escherichia coli CFT073
cauuuucagccagg

SEQ ID NO: 667485 - RNA, 16 nt, Escherichia coli CFT073
cauuuucgacaauaaa

SEQ ID NO: 667486 - RNA, 19 nt, Escherichia coli CFT073
cauuucggcccaugacaaa

SEQ ID NO: 667487 - RNA, 23 nt, Escherichia coli CFT073
cauuucgugcggguaaccagcca

SEQ ID NO: 667488 - RNA, 15 nt, Escherichia coli CFT073
cauuucccagcaaga

SEQ ID NO: 667489 - RNA, 16 nt, Escherichia coli CFT073
cauuucccggaauaau

SEQ ID NO: 667490 - RNA, 17 nt, Escherichia coli CFT073
cauuucccccuuccugc

SEQ ID NO: 667491 - RNA, 12 nt, Escherichia coli CFT073
cauuuccagcgc

SEQ ID NO: 667492 - RNA, 21 nt, Escherichia coli CFT073
cauuucauuuggauggaaaau

SEQ ID NO: 667493 - RNA, 15 nt, Escherichia coli CFT073
cauuuccaagauuaa

SEQ ID NO: 667494 - RNA, 19 nt, Escherichia coli CFT073
cauuucauauucaaaaucc

SEQ ID NO: 667495 - RNA, 15 nt, Escherichia coli CFT073
cauuuauuucaacga

SEQ ID NO: 667496 - RNA, 19 nt, Escherichia coli CFT073
cauuuauuucaacgacaua

SEQ ID NO: 667497 - RNA, 16 nt, Escherichia coli CFT073
cauuucacguucacgu

SEQ ID NO: 667498 - RNA, 18 nt, Escherichia coli CFT073
cauuuagcguuaaaauuu

SEQ ID NO: 667499 - RNA, 17 nt, Escherichia coli CFT073
cauuuaugccauguuca

SEQ ID NO: 667500 - RNA, 12 nt, Escherichia coli CFT073
cauuugucucaa

SEQ ID NO: 667501 - RNA, 15 nt, Escherichia coli CFT073
cauuugugacauuaa

SEQ ID NO: 667502 - RNA, 21 nt, Escherichia coli CFT073
cauuuggcguaguugcugcgu

SEQ ID NO: 667503 - RNA, 16 nt, Escherichia coli CFT073
cauuuggacaccauug

SEQ ID NO: 667504 - RNA, 17 nt, Escherichia coli CFT073
cauuugcguggcgcgcg

SEQ ID NO: 667505 - RNA, 19 nt, Escherichia coli CFT073
cauuugcuguagaugacac

SEQ ID NO: 667506 - RNA, 18 nt, Escherichia coli CFT073
cauuugcucuaccagccc

SEQ ID NO: 667507 - RNA, 20 nt, Escherichia coli CFT073
cauuuuacguguuucagaau

SEQ ID NO: 667508 - RNA, 18 nt, Escherichia coli CFT073
cauuugccagcgucagau

SEQ ID NO: 667509 - RNA, 20 nt, Escherichia coli CFT073
cauuugagcaggaugccuga

SEQ ID NO: 667510 - RNA, 19 nt, Escherichia coli CFT073
cauuguaggccagauaaaa

SEQ ID NO: 667511 - RNA, 18 nt, Escherichia coli CFT073
cauugucaggaucaccaa

SEQ ID NO: 667512 - RNA, 19 nt, Escherichia coli CFT073
cauugucaggaucaccaau

SEQ ID NO: 667513 - RNA, 17 nt, Escherichia coli CFT073
cauuggcucaucaaaca

SEQ ID NO: 667514 - RNA, 13 nt, Escherichia coli CFT073
cauuggcuugcac

SEQ ID NO: 667515 - RNA, 18 nt, Escherichia coli CFT073
cauuggccggaauaccac

SEQ ID NO: 667516 - RNA, 17 nt, Escherichia coli CFT073
cauuuaacccuucaaga

SEQ ID NO: 667517 - RNA, 11 nt, Escherichia coli CFT073
cauuuaagcca

SEQ ID NO: 667518 - RNA, 19 nt, Escherichia coli CFT073
cauuuacccgauccacuga

SEQ ID NO: 667519 - RNA, 19 nt, Escherichia coli CFT073
cauuuaacacgaacuuuau

SEQ ID NO: 667520 - RNA, 17 nt, Escherichia coli CFT073
cauuuaaacucaccgcu

SEQ ID NO: 667521 - RNA, 18 nt, Escherichia coli CFT073
cauuuaaacucaccgcuc

SEQ ID NO: 667522 - RNA, 22 nt, Escherichia coli CFT073
cauugugauguaagcgcauaau

SEQ ID NO: 667523 - RNA, 18 nt, Escherichia coli CFT073
cauuguuccacucuuuca

SEQ ID NO: 667524 - RNA, 12 nt, Escherichia coli CFT073
cauugcugguga

SEQ ID NO: 667525 - RNA, 13 nt, Escherichia coli CFT073
cauugcuuaaagu

SEQ ID NO: 667526 - RNA, 22 nt, Escherichia coli CFT073
cauugcuuaaaguguuccggcu

SEQ ID NO: 667527 - RNA, 14 nt, Escherichia coli CFT073
cauugcuuugguaa

SEQ ID NO: 667528 - RNA, 20 nt, Escherichia coli CFT073
cauugcuuuuuugauuacag

SEQ ID NO: 667529 - RNA, 19 nt, Escherichia coli CFT073
cauugcgggcuggaaacgc

SEQ ID NO: 667530 - RNA, 19 nt, Escherichia coli CFT073
cauugcuaaugcagguacg

SEQ ID NO: 667531 - RNA, 15 nt, Escherichia coli CFT073
cauugcuauuucccc

SEQ ID NO: 667532 - RNA, 18 nt, Escherichia coli CFT073
cauugcucauuccgccgc

SEQ ID NO: 667533 - RNA, 21 nt, Escherichia coli CFT073
cauugcucauuccgccgccca

SEQ ID NO: 667534 - RNA, 22 nt, Escherichia coli CFT073
cauugcucauuccgccgcccag

SEQ ID NO: 667535 - RNA, 18 nt, Escherichia coli CFT073
cauugcugacauggcaau

SEQ ID NO: 667536 - RNA, 21 nt, Escherichia coli CFT073
cauugcugaugcaccuucaac

SEQ ID NO: 667537 - RNA, 21 nt, Escherichia coli CFT073
cauugcugcugaagcaacagu

SEQ ID NO: 667538 - RNA, 20 nt, Escherichia coli CFT073
cauugcgcaaccgcccggcc

SEQ ID NO: 667539 - RNA, 17 nt, Escherichia coli CFT073
cauugcgccgaacaaca

SEQ ID NO: 667540 - RNA, 18 nt, Escherichia coli CFT073
cauugcgccgaacaacag

SEQ ID NO: 667541 - RNA, 20 nt, Escherichia coli CFT073
cauugcgccgaacaacagug

SEQ ID NO: 667542 - RNA, 21 nt, Escherichia coli CFT073
cauugcgccgaacaacagugc

SEQ ID NO: 667543 - RNA, 21 nt, Escherichia coli CFT073
cauugccggaugcgacgcugg

SEQ ID NO: 667544 - RNA, 14 nt, Escherichia coli CFT073
cauugccgccuggg

SEQ ID NO: 667545 - RNA, 22 nt, Escherichia coli CFT073
cauugccugcaacgaaccaauc

SEQ ID NO: 667546 - RNA, 11 nt, Escherichia coli CFT073
cauugccuggc

SEQ ID NO: 667547 - RNA, 22 nt, Escherichia coli CFT073
cauucgcuguguaaacccagcc

SEQ ID NO: 667548 - RNA, 17 nt, Escherichia coli CFT073
cauugauucgccgccgc

SEQ ID NO: 667549 - RNA, 16 nt, Escherichia coli CFT073
cauucguacaaacgcu

SEQ ID NO: 667550 - RNA, 16 nt, Escherichia coli CFT073
cauugauuuucaaauc

SEQ ID NO: 667551 - RNA, 21 nt, Escherichia coli CFT073
cauugccauuguuguagguac

SEQ ID NO: 667552 - RNA, 12 nt, Escherichia coli CFT073
cauugccagcgc

SEQ ID NO: 667553 - RNA, 17 nt, Escherichia coli CFT073
cauugccagaaaccagc

SEQ ID NO: 667554 - RNA, 13 nt, Escherichia coli CFT073
cauuagucacaaa

SEQ ID NO: 667555 - RNA, 18 nt, Escherichia coli CFT073
cauuagucauuacucauc

SEQ ID NO: 667556 - RNA, 13 nt, Escherichia coli CFT073
cauuagcccggca

SEQ ID NO: 667557 - RNA, 18 nt, Escherichia coli CFT073
cauuagcgcuaucaaagu

SEQ ID NO: 667558 - RNA, 16 nt, Escherichia coli CFT073
cauucagggcagugcc

SEQ ID NO: 667559 - RNA, 10 nt, Escherichia coli CFT073
cauucaggcc

SEQ ID NO: 667560 - RNA, 15 nt, Escherichia coli CFT073
cauucaucgccaccg

SEQ ID NO: 667561 - RNA, 22 nt, Escherichia coli CFT073
cauucaucgccaccgcgggcaa

SEQ ID NO: 667562 - RNA, 19 nt, Escherichia coli CFT073
cauucgccguuaccagcac

SEQ ID NO: 667563 - RNA, 14 nt, Escherichia coli CFT073
cauucgcccgccga

SEQ ID NO: 667564 - RNA, 14 nt, Escherichia coli CFT073
cauucgcaauacau

SEQ ID NO: 667565 - RNA, 15 nt, Escherichia coli CFT073
cauuaccgaauccug

SEQ ID NO: 667566 - RNA, 21 nt, Escherichia coli CFT073
cauuaccccugacgcuuaucu

SEQ ID NO: 667567 - RNA, 22 nt, Escherichia coli CFT073
cauuacgaaaucggcaccgccg

SEQ ID NO: 667568 - RNA, 22 nt, Escherichia coli CFT073
cauuacgcaucgguacaauaaa

SEQ ID NO: 667569 - RNA, 18 nt, Escherichia coli CFT073
cauuagcaucaagaaaaa

SEQ ID NO: 667570 - RNA, 16 nt, Escherichia coli CFT073
cauuagcauuaacagu

SEQ ID NO: 667571 - RNA, 19 nt, Escherichia coli CFT073
cauuagcauuaacaguaga

SEQ ID NO: 667572 - RNA, 15 nt, Escherichia coli CFT073
cauuacucauccaug

SEQ ID NO: 667573 - RNA, 14 nt, Escherichia coli CFT073
cauuacucguccuu

SEQ ID NO: 667574 - RNA, 20 nt, Escherichia coli CFT073
cauuacguccaucacaauca

SEQ ID NO: 667575 - RNA, 15 nt, Escherichia coli CFT073
cauuacuaaacauuu

SEQ ID NO: 667576 - RNA, 17 nt, Escherichia coli CFT073
cauuacuauaacccacc

SEQ ID NO: 667577 - RNA, 16 nt, Escherichia coli CFT073
cauuaauacaucaacu

SEQ ID NO: 667578 - RNA, 19 nt, Escherichia coli CFT073
cauuaaguguaaucagccc

SEQ ID NO: 667579 - RNA, 15 nt, Escherichia coli CFT073
cauuaaguaacaaua

SEQ ID NO: 667580 - RNA, 15 nt, Escherichia coli CFT073
cauguuaaccaacca

SEQ ID NO: 667581 - RNA, 18 nt, Escherichia coli CFT073
cauguuaaccaaccaguc

SEQ ID NO: 667582 - RNA, 21 nt, Escherichia coli CFT073
caugugaugccgcauccggcu

SEQ ID NO: 667583 - RNA, 16 nt, Escherichia coli CFT073
caugugcaaucuacaa

SEQ ID NO: 667584 - RNA, 14 nt, Escherichia coli CFT073
cauguguucccugu

SEQ ID NO: 667585 - RNA, 20 nt, Escherichia coli CFT073
cauggucgguauuaucacua

SEQ ID NO: 667586 - RNA, 19 nt, Escherichia coli CFT073
caugguauaaggagcaaua

SEQ ID NO: 667587 - RNA, 19 nt, Escherichia coli CFT073
caugggugccggauacaaa

SEQ ID NO: 667588 - RNA, 15 nt, Escherichia coli CFT073
cauggccgcaagagu

SEQ ID NO: 667589 - RNA, 14 nt, Escherichia coli CFT073
cauggcauccaagc

SEQ ID NO: 667590 - RNA, 17 nt, Escherichia coli CFT073
cauggcauccuguuuuc

SEQ ID NO: 667591 - RNA, 22 nt, Escherichia coli CFT073
cauggcauuaaauucagcaaau

SEQ ID NO: 667592 - RNA, 13 nt, Escherichia coli CFT073
cauggcauuuucu

SEQ ID NO: 667593 - RNA, 15 nt, Escherichia coli CFT073
cauggcgugacaugg

SEQ ID NO: 667594 - RNA, 18 nt, Escherichia coli CFT073
cauguagcaaauuucguc

SEQ ID NO: 667595 - RNA, 14 nt, Escherichia coli CFT073
cauguaacgcugca

SEQ ID NO: 667596 - RNA, 23 nt, Escherichia coli CFT073
cauguaaugcagguccacgacca

SEQ ID NO: 667597 - RNA, 14 nt, Escherichia coli CFT073
cauguaacugccuu

SEQ ID NO: 667598 - RNA, 16 nt, Escherichia coli CFT073
cauguaacugccuuuc

SEQ ID NO: 667599 - RNA, 20 nt, Escherichia coli CFT073
cauguccgagcuuaaugaaa

SEQ ID NO: 667600 - RNA, 20 nt, Escherichia coli CFT073
caucuucggcaauacuucaa

SEQ ID NO: 667601 - RNA, 18 nt, Escherichia coli CFT073
caucuucguaccaaauga

SEQ ID NO: 667602 - RNA, 18 nt, Escherichia coli CFT073
caucuucgucaaagauau

SEQ ID NO: 667603 - RNA, 22 nt, Escherichia coli CFT073
caucuucagucgcaucuucacg

SEQ ID NO: 667604 - RNA, 19 nt, Escherichia coli CFT073
caucuucacuguccgccag

SEQ ID NO: 667605 - RNA, 20 nt, Escherichia coli CFT073
caucuucacuguccgccaga

SEQ ID NO: 667606 - RNA, 17 nt, Escherichia coli CFT073
caucuucaccaauguuc

SEQ ID NO: 667607 - RNA, 19 nt, Escherichia coli CFT073
caucuucccgcgccagcgc

SEQ ID NO: 667608 - RNA, 18 nt, Escherichia coli CFT073
caucuuccgggcaacaau

SEQ ID NO: 667609 - RNA, 14 nt, Escherichia coli CFT073
caucuucaucaucu

SEQ ID NO: 667610 - RNA, 12 nt, Escherichia coli CFT073
caucuuccagca

SEQ ID NO: 667611 - RNA, 18 nt, Escherichia coli CFT073
caucuuccagcaucagca

SEQ ID NO: 667612 - RNA, 20 nt, Escherichia coli CFT073
caucuuccagcugcacgcca

SEQ ID NO: 667613 - RNA, 21 nt, Escherichia coli CFT073
caucuuccagcugcacgccac

SEQ ID NO: 667614 - RNA, 18 nt, Escherichia coli CFT073
caugcuuaaauauuuuuu

SEQ ID NO: 667615 - RNA, 20 nt, Escherichia coli CFT073
caugcuuaccaaaaugcugc

SEQ ID NO: 667616 - RNA, 12 nt, Escherichia coli CFT073
caugcuucugca

SEQ ID NO: 667617 - RNA, 13 nt, Escherichia coli CFT073
caugcuucugcac

SEQ ID NO: 667618 - RNA, 18 nt, Escherichia coli CFT073
caugcuguagugaauugc

SEQ ID NO: 667619 - RNA, 16 nt, Escherichia coli CFT073
caugcuggaaccacag

SEQ ID NO: 667620 - RNA, 19 nt, Escherichia coli CFT073
caugcuggaaccacagcgc

SEQ ID NO: 667621 - RNA, 14 nt, Escherichia coli CFT073
cauggagcuuuaaa

SEQ ID NO: 667622 - RNA, 22 nt, Escherichia coli CFT073
cgaacgggauaaacgaaaugcg

SEQ ID NO: 667623 - RNA, 22 nt, Escherichia coli CFT073
cgaagauggcauacaacgccau

SEQ ID NO: 667624 - RNA, 13 nt, Escherichia coli CFT073
cgaagaucaccac

SEQ ID NO: 667625 - RNA, 20 nt, Escherichia coli CFT073
cgaaggugccugcccagccg

SEQ ID NO: 667626 - RNA, 19 nt, Escherichia coli CFT073
cgaaggugaacgccaccaa

SEQ ID NO: 667627 - RNA, 13 nt, Escherichia coli CFT073
cgaagcggcugcg

SEQ ID NO: 667628 - RNA, 20 nt, Escherichia coli CFT073
cgaaccagaccagcaauaaa

SEQ ID NO: 667629 - RNA, 24 nt, Escherichia coli CFT073
cgaaccagccguugucagucauca

SEQ ID NO: 667630 - RNA, 14 nt, Escherichia coli CFT073
cgaacaugcggguc

SEQ ID NO: 667631 - RNA, 23 nt, Escherichia coli CFT073
cgaaccgccuggcgcugcucagg

SEQ ID NO: 667632 - RNA, 12 nt, Escherichia coli CFT073
cgaacaggucac

SEQ ID NO: 667633 - RNA, 14 nt, Escherichia coli CFT073
cgaacagccaggcu

SEQ ID NO: 667634 - RNA, 21 nt, Escherichia coli CFT073
cgaaaguuugaaagaugcugg

SEQ ID NO: 667635 - RNA, 21 nt, Escherichia coli CFT073
cgaaauagccaggcagauaau

SEQ ID NO: 667636 - RNA, 15 nt, Escherichia coli CFT073
cgaaaguuauuggca

SEQ ID NO: 667637 - RNA, 17 nt, Escherichia coli CFT073
cgaaaugagauauuuca

SEQ ID NO: 667638 - RNA, 21 nt, Escherichia coli CFT073
cgaaauccuggugaaaguugg

SEQ ID NO: 667639 - RNA, 12 nt, Escherichia coli CFT073
cgaaaucgccau

SEQ ID NO: 667640 - RNA, 18 nt, Escherichia coli CFT073
cgaaaucauucgcagcug

SEQ ID NO: 667641 - RNA, 21 nt, Escherichia coli CFT073
cgaaaaugccacugcgccggg

SEQ ID NO: 667642 - RNA, 19 nt, Escherichia coli CFT073
cgaaaaugcucgccuugcu

SEQ ID NO: 667643 - RNA, 17 nt, Escherichia coli CFT073
cgaaaauuacgaaagca

SEQ ID NO: 667644 - RNA, 21 nt, Escherichia coli CFT073
cgaaaauaauccuggcagcau

SEQ ID NO: 667645 - RNA, 17 nt, Escherichia coli CFT073
cgaaaccagcagccauc

SEQ ID NO: 667646 - RNA, 16 nt, Escherichia coli CFT073
cgaaaccauauuaaau

SEQ ID NO: 667647 - RNA, 14 nt, Escherichia coli CFT073
cgaaaauuggcaga

SEQ ID NO: 667648 - RNA, 20 nt, Escherichia coli CFT073
cgaaacugacauacaaaucg

SEQ ID NO: 667649 - RNA, 18 nt, Escherichia coli CFT073
ccuuucuuuguucuucug

SEQ ID NO: 667650 - RNA, 18 nt, Escherichia coli CFT073
ccuuucuggacacagcgu

SEQ ID NO: 667651 - RNA, 21 nt, Escherichia coli CFT073
ccuuucuguuccauaaucgcc

SEQ ID NO: 667652 - RNA, 13 nt, Escherichia coli CFT073
ccuuucugcaucc

SEQ ID NO: 667653 - RNA, 21 nt, Escherichia coli CFT073
ccuuucugcauccguucuucg

SEQ ID NO: 667654 - RNA, 18 nt, Escherichia coli CFT073
ccuuuuccauugccgcag

SEQ ID NO: 667655 - RNA, 18 nt, Escherichia coli CFT073
cgaaaacgcauaucuucu

SEQ ID NO: 667656 - RNA, 15 nt, Escherichia coli CFT073
cgaaaagaaacugug

SEQ ID NO: 667657 - RNA, 14 nt, Escherichia coli CFT073
cgaaaaaaauuacu

SEQ ID NO: 667658 - RNA, 17 nt, Escherichia coli CFT073
cgaaaacccucaauaau

SEQ ID NO: 667659 - RNA, 12 nt, Escherichia coli CFT073
cgaaaaaugaug

SEQ ID NO: 667660 - RNA, 21 nt, Escherichia coli CFT073
ccuuuuuguuguaaugacaac

SEQ ID NO: 667661 - RNA, 13 nt, Escherichia coli CFT073
ccuugcaacuccg

SEQ ID NO: 667662 - RNA, 14 nt, Escherichia coli CFT073
ccuugaugaaaaaa

SEQ ID NO: 667663 - RNA, 21 nt, Escherichia coli CFT073
ccuugcaguuguaaucacgcu

SEQ ID NO: 667664 - RNA, 14 nt, Escherichia coli CFT073
ccuugcccaccagc

SEQ ID NO: 667665 - RNA, 13 nt, Escherichia coli CFT073
ccuucucggcagu

SEQ ID NO: 667666 - RNA, 20 nt, Escherichia coli CFT073
ccuucucuucaaaccacugc

SEQ ID NO: 667667 - RNA, 14 nt, Escherichia coli CFT073
ccuucugagaucaa

SEQ ID NO: 667668 - RNA, 14 nt, Escherichia coli CFT073
ccuucugccaccag

SEQ ID NO: 667669 - RNA, 17 nt, Escherichia coli CFT073
ccuugaguuuuucaucc

SEQ ID NO: 667670 - RNA, 15 nt, Escherichia coli CFT073
ccuugcgcaaugagu

SEQ ID NO: 667671 - RNA, 22 nt, Escherichia coli CFT073
ccuugcgauaucccauuuacug

SEQ ID NO: 667672 - RNA, 22 nt, Escherichia coli CFT073
ccuugcgauuacguucggcaaa

SEQ ID NO: 667673 - RNA, 12 nt, Escherichia coli CFT073
ccuucuccacac

SEQ ID NO: 667674 - RNA, 15 nt, Escherichia coli CFT073
ccuucuccacaccgu

SEQ ID NO: 667675 - RNA, 14 nt, Escherichia coli CFT073
ccuucggucagagu

SEQ ID NO: 667676 - RNA, 21 nt, Escherichia coli CFT073
ccuuccagaaacauccccagc

SEQ ID NO: 667677 - RNA, 18 nt, Escherichia coli CFT073
ccuuccagcgcguucugu

SEQ ID NO: 667678 - RNA, 20 nt, Escherichia coli CFT073
ccuuccauacgaauugccgc

SEQ ID NO: 667679 - RNA, 22 nt, Escherichia coli CFT073
ccuuccauacgaauugccgcgc

SEQ ID NO: 667680 - RNA, 14 nt, Escherichia coli CFT073
ccuuccagcuccag

SEQ ID NO: 667681 - RNA, 16 nt, Escherichia coli CFT073
ccuuccagcuccagcc

SEQ ID NO: 667682 - RNA, 16 nt, Escherichia coli CFT073
ccuuccagcucuuugg

SEQ ID NO: 667683 - RNA, 16 nt, Escherichia coli CFT073
ccuucccagccgggaa

SEQ ID NO: 667684 - RNA, 18 nt, Escherichia coli CFT073
ccuuccauuaucgccagg

SEQ ID NO: 667685 - RNA, 12 nt, Escherichia coli CFT073
ccuucccagccg

SEQ ID NO: 667686 - RNA, 13 nt, Escherichia coli CFT073
ccuucccccacca

SEQ ID NO: 667687 - RNA, 20 nt, Escherichia coli CFT073
ccuuccgcaauacagccagc

SEQ ID NO: 667688 - RNA, 17 nt, Escherichia coli CFT073
ccuucaucuuuauagaa

SEQ ID NO: 667689 - RNA, 15 nt, Escherichia coli CFT073
ccuucauucaccagu

SEQ ID NO: 667690 - RNA, 12 nt, Escherichia coli CFT073
ccuucauucagg

SEQ ID NO: 667691 - RNA, 12 nt, Escherichia coli CFT073
ccuuauccagca

SEQ ID NO: 667692 - RNA, 14 nt, Escherichia coli CFT073
ccuuauccagcaga

SEQ ID NO: 667693 - RNA, 23 nt, Escherichia coli CFT073
ccuucauauuccugacccagcac

SEQ ID NO: 667694 - RNA, 22 nt, Escherichia coli CFT073
ccuucaucacgcagugucagca

SEQ ID NO: 667695 - RNA, 12 nt, Escherichia coli CFT073
ccuuacugcccc

SEQ ID NO: 667696 - RNA, 19 nt, Escherichia coli CFT073
ccuuacuuacacaucauga

SEQ ID NO: 667697 - RNA, 13 nt, Escherichia coli CFT073
ccuguugacggga

SEQ ID NO: 667698 - RNA, 18 nt, Escherichia coli CFT073
ccuguugcccaugcuucu

SEQ ID NO: 667699 - RNA, 15 nt, Escherichia coli CFT073
ccuguugccugcacu

SEQ ID NO: 667700 - RNA, 21 nt, Escherichia coli CFT073
ccuguugcgcuccgcgaccca

SEQ ID NO: 667701 - RNA, 14 nt, Escherichia coli CFT073
ccuguucgccgccg

SEQ ID NO: 667702 - RNA, 18 nt, Escherichia coli CFT073
ccuguuccggcagaaacc

SEQ ID NO: 667703 - RNA, 23 nt, Escherichia coli CFT073
ccuguucaucgauagaacggaua

SEQ ID NO: 667704 - RNA, 16 nt, Escherichia coli CFT073
ccuguuuuuuaauuca

SEQ ID NO: 667705 - RNA, 18 nt, Escherichia coli CFT073
ccuguuuuuuuaaugcgc

SEQ ID NO: 667706 - RNA, 20 nt, Escherichia coli CFT073
ccuguuugguugccagccau

SEQ ID NO: 667707 - RNA, 18 nt, Escherichia coli CFT073
ccuguggacgcagcucau

SEQ ID NO: 667708 - RNA, 21 nt, Escherichia coli CFT073
ccuguggcgcgaccagacgca

SEQ ID NO: 667709 - RNA, 22 nt, Escherichia coli CFT073
ccuguuaagaagggcuggccaa

SEQ ID NO: 667710 - RNA, 22 nt, Escherichia coli CFT073
ccuguucaaacuucgccacagc

SEQ ID NO: 667711 - RNA, 23 nt, Escherichia coli CFT073
ccuguuaaucagcuaauggcugc

SEQ ID NO: 667712 - RNA, 18 nt, Escherichia coli CFT073
ccugugccugagccggag

SEQ ID NO: 667713 - RNA, 13 nt, Escherichia coli CFT073
ccugugcgcccug

SEQ ID NO: 667714 - RNA, 15 nt, Escherichia coli CFT073
ccugucuucccugcu

SEQ ID NO: 667715 - RNA, 15 nt, Escherichia coli CFT073
ccugugacagcagcg

SEQ ID NO: 667716 - RNA, 14 nt, Escherichia coli CFT073
ccugucgaggccaa

SEQ ID NO: 667717 - RNA, 18 nt, Escherichia coli CFT073
ccugucgcuuugacagcu

SEQ ID NO: 667718 - RNA, 20 nt, Escherichia coli CFT073
ccugucaccgggcaaacgcu

SEQ ID NO: 667719 - RNA, 20 nt, Escherichia coli CFT073
ccuguccagacggagcugcc

SEQ ID NO: 667720 - RNA, 14 nt, Escherichia coli CFT073
ccuguaaccaccgu

SEQ ID NO: 667721 - RNA, 15 nt, Escherichia coli CFT073
ccuguaaaaaagaaa

SEQ ID NO: 667722 - RNA, 23 nt, Escherichia coli CFT073
ccugguuguauggccuggugagu

SEQ ID NO: 667723 - RNA, 19 nt, Escherichia coli CFT073
ccugguuucucuccguguc

SEQ ID NO: 667724 - RNA, 22 nt, Escherichia coli CFT073
ccuguaaacggaugacuucgcu

SEQ ID NO: 667725 - RNA, 18 nt, Escherichia coli CFT073
ccugcguuuguccgccag

SEQ ID NO: 667726 - RNA, 15 nt, Escherichia coli CFT073
ccugcguucagcagu

SEQ ID NO: 667727 - RNA, 20 nt, Escherichia coli CFT073
ccugcguucagcaguucugc

SEQ ID NO: 667728 - RNA, 14 nt, Escherichia coli CFT073
ccugcuacaccauu

SEQ ID NO: 667729 - RNA, 17 nt, Escherichia coli CFT073
ccugcucgucauccgcu

SEQ ID NO: 667730 - RNA, 16 nt, Escherichia coli CFT073
ccugcucgucauccgc

SEQ ID NO: 667731 - RNA, 15 nt, Escherichia coli CFT073
ccugcugcacaccau

SEQ ID NO: 667732 - RNA, 22 nt, Escherichia coli CFT073
ccugcucgucggcaaagcgggc

SEQ ID NO: 667733 - RNA, 16 nt, Escherichia coli CFT073
ccugcucuuucagcac

SEQ ID NO: 667734 - RNA, 23 nt, Escherichia coli CFT073
ccugcugaauauugccaauggug

SEQ ID NO: 667735 - RNA, 21 nt, Escherichia coli CFT073
ccugcugaauuuccugcgcuu

SEQ ID NO: 667736 - RNA, 23 nt, Escherichia coli CFT073
ccugcugagaacauaaacaccca

SEQ ID NO: 667737 - RNA, 18 nt, Escherichia coli CFT073
ccugggugaugguccagu

SEQ ID NO: 667738 - RNA, 17 nt, Escherichia coli CFT073
ccugguacucgacugug

SEQ ID NO: 667739 - RNA, 21 nt, Escherichia coli CFT073
ccugguacauugcgaacaggu

SEQ ID NO: 667740 - RNA, 19 nt, Escherichia coli CFT073
ccugcaacggcaucgccaa

SEQ ID NO: 667741 - RNA, 24 nt, Escherichia coli CFT073
ccugcaacguuuuaagcaaauaau

SEQ ID NO: 667742 - RNA, 13 nt, Escherichia coli CFT073
ccugcaacugaug

SEQ ID NO: 667743 - RNA, 13 nt, Escherichia coli CFT073
ccugcaacaacac

SEQ ID NO: 667744 - RNA, 21 nt, Escherichia coli CFT073
ccugcaacgaaccaaucaccc

SEQ ID NO: 667745 - RNA, 22 nt, Escherichia coli CFT073
ccugcaacgaaccaaucacccc

SEQ ID NO: 667746 - RNA, 20 nt, Escherichia coli CFT073
ccugcaaaaucuguugaaau

SEQ ID NO: 667747 - RNA, 14 nt, Escherichia coli CFT073
ccugauugaccgcc

SEQ ID NO: 667748 - RNA, 17 nt, Escherichia coli CFT073
ccugauuuucuucauug

SEQ ID NO: 667749 - RNA, 17 nt, Escherichia coli CFT073
ccugcaauguuaacugu

SEQ ID NO: 667750 - RNA, 17 nt, Escherichia coli CFT073
ccugcaagguggucaga

SEQ ID NO: 667751 - RNA, 17 nt, Escherichia coli CFT073
ccugcaauuuaccuuuc

SEQ ID NO: 667752 - RNA, 15 nt, Escherichia coli CFT073
ccugcacaaagcgcc

SEQ ID NO: 667753 - RNA, 17 nt, Escherichia coli CFT073
ccugcacaaagcgccag

SEQ ID NO: 667754 - RNA, 20 nt, Escherichia coli CFT073
ccugcacaaagcgccagaau

SEQ ID NO: 667755 - RNA, 20 nt, Escherichia coli CFT073
ccugcacaaauuugccgucg

SEQ ID NO: 667756 - RNA, 19 nt, Escherichia coli CFT073
ccugcagaaaauccagcgu

SEQ ID NO: 667757 - RNA, 15 nt, Escherichia coli CFT073
ccugaucaauaagcg

SEQ ID NO: 667758 - RNA, 12 nt, Escherichia coli CFT073
ccugaucaauca

SEQ ID NO: 667759 - RNA, 19 nt, Escherichia coli CFT073
ccugaucaaucaucaggcu

SEQ ID NO: 667760 - RNA, 19 nt, Escherichia coli CFT073
ccugauccagcucuuccuc

SEQ ID NO: 667761 - RNA, 22 nt, Escherichia coli CFT073
ccugauccauugucuccagggc

SEQ ID NO: 667762 - RNA, 22 nt, Escherichia coli CFT073
ccugauagcccgcacaaagcac

SEQ ID NO: 667763 - RNA, 17 nt, Escherichia coli CFT073
ccugauauucucgcucc

SEQ ID NO: 667764 - RNA, 22 nt, Escherichia coli CFT073
ccugaugaaaaaucuccagcgu

SEQ ID NO: 667765 - RNA, 15 nt, Escherichia coli CFT073
ccugauccugcaaca

SEQ ID NO: 667766 - RNA, 12 nt, Escherichia coli CFT073
ccugauguagcg

SEQ ID NO: 667767 - RNA, 20 nt, Escherichia coli CFT073
ccugaucgagcaguaaucca

SEQ ID NO: 667768 - RNA, 19 nt, Escherichia coli CFT073
ccugaugaucuaaaagcaa

SEQ ID NO: 667769 - RNA, 20 nt, Escherichia coli CFT073
ccugaugcgacgcugguugc

SEQ ID NO: 667770 - RNA, 16 nt, Escherichia coli CFT073
ccugaugcgacgcuug

SEQ ID NO: 667771 - RNA, 14 nt, Escherichia coli CFT073
ccugcggugcagcc

SEQ ID NO: 667772 - RNA, 18 nt, Escherichia coli CFT073
ccugcgcuuucugcuucg

SEQ ID NO: 667773 - RNA, 18 nt, Escherichia coli CFT073
ccugcgcuuccaguucca

SEQ ID NO: 667774 - RNA, 15 nt, Escherichia coli CFT073
ccugcgcguuacugg

SEQ ID NO: 667775 - RNA, 13 nt, Escherichia coli CFT073
ccugcgcaauaac

SEQ ID NO: 667776 - RNA, 22 nt, Escherichia coli CFT073
ccugcgcaauaaccguaacgca

SEQ ID NO: 667777 - RNA, 21 nt, Escherichia coli CFT073
ccugcgcauuucgcucuucac

SEQ ID NO: 667778 - RNA, 13 nt, Escherichia coli CFT073
ccugcgccaccac

SEQ ID NO: 667779 - RNA, 23 nt, Escherichia coli CFT073
ccugcgccaccacaacauuccca

SEQ ID NO: 667780 - RNA, 19 nt, Escherichia coli CFT073
ccugcauuagcaaugcccu

SEQ ID NO: 667781 - RNA, 14 nt, Escherichia coli CFT073
ccugcauaucggca

SEQ ID NO: 667782 - RNA, 11 nt, Escherichia coli CFT073
ccugcaucaca

SEQ ID NO: 667783 - RNA, 22 nt, Escherichia coli CFT073
ccugcagcugcagauaacuggc

SEQ ID NO: 667784 - RNA, 17 nt, Escherichia coli CFT073
ccugcaggaaagcaaga

SEQ ID NO: 667785 - RNA, 15 nt, Escherichia coli CFT073
ccugcaggaaaucaa

SEQ ID NO: 667786 - RNA, 17 nt, Escherichia coli CFT073
ccugccacaguuuuuca

SEQ ID NO: 667787 - RNA, 17 nt, Escherichia coli CFT073
ccugccgggaauacugc

SEQ ID NO: 667788 - RNA, 17 nt, Escherichia coli CFT073
ccugaaccagaccgccu

SEQ ID NO: 667789 - RNA, 16 nt, Escherichia coli CFT073
ccugaaauuuaucuac

SEQ ID NO: 667790 - RNA, 13 nt, Escherichia coli CFT073
ccugaacaagcaa

SEQ ID NO: 667791 - RNA, 13 nt, Escherichia coli CFT073
ccugaaaaaugag

SEQ ID NO: 667792 - RNA, 19 nt, Escherichia coli CFT073
ccugaaaauucaguucguc

SEQ ID NO: 667793 - RNA, 13 nt, Escherichia coli CFT073
ccucuuugugaca

SEQ ID NO: 667794 - RNA, 18 nt, Escherichia coli CFT073
ccugaaagcgugucaugu

SEQ ID NO: 667795 - RNA, 20 nt, Escherichia coli CFT073
ccugaaacgcggcguaacca

SEQ ID NO: 667796 - RNA, 13 nt, Escherichia coli CFT073
ccugaacuuguuu

SEQ ID NO: 667797 - RNA, 13 nt, Escherichia coli CFT073
ccugaagaucaac

SEQ ID NO: 667798 - RNA, 16 nt, Escherichia coli CFT073
ccugaagcggcagagg

SEQ ID NO: 667799 - RNA, 18 nt, Escherichia coli CFT073
ccugaaucaccugauuga

SEQ ID NO: 667800 - RNA, 12 nt, Escherichia coli CFT073
ccugaauaaacg

SEQ ID NO: 667801 - RNA, 13 nt, Escherichia coli CFT073
ccugaauaaacgc

SEQ ID NO: 667802 - RNA, 13 nt, Escherichia coli CFT073
ccugaauaaucag

SEQ ID NO: 667803 - RNA, 17 nt, Escherichia coli CFT073
ccugaauaaucagauac

SEQ ID NO: 667804 - RNA, 20 nt, Escherichia coli CFT073
ccugaauaaucguaaucagc

SEQ ID NO: 667805 - RNA, 15 nt, Escherichia coli CFT073
ccucuucuuuaaaac

SEQ ID NO: 667806 - RNA, 11 nt, Escherichia coli CFT073
ccucuucuuuu

SEQ ID NO: 667807 - RNA, 12 nt, Escherichia coli CFT073
ccucuuccugag

SEQ ID NO: 667808 - RNA, 15 nt, Escherichia coli CFT073
ccucuuucaccagau

SEQ ID NO: 667809 - RNA, 19 nt, Escherichia coli CFT073
ccucuuugcugccuucgca

SEQ ID NO: 667810 - RNA, 13 nt, Escherichia coli CFT073
ccucuguuacuac

SEQ ID NO: 667811 - RNA, 19 nt, Escherichia coli CFT073
ccucuguucagugauggca

SEQ ID NO: 667812 - RNA, 21 nt, Escherichia coli CFT073
ccucuucaccguccauccaca

SEQ ID NO: 667813 - RNA, 15 nt, Escherichia coli CFT073
ccucuucaauuaaca

SEQ ID NO: 667814 - RNA, 13 nt, Escherichia coli CFT073
ccucuucauuaaa

SEQ ID NO: 667815 - RNA, 19 nt, Escherichia coli CFT073
ccucuuccauuucaucgcc

SEQ ID NO: 667816 - RNA, 21 nt, Escherichia coli CFT073
ccucuuccauuucaucgccag

SEQ ID NO: 667817 - RNA, 23 nt, Escherichia coli CFT073
ccucuuccgacagcguuacgcuu

SEQ ID NO: 667818 - RNA, 21 nt, Escherichia coli CFT073
ccugauacgcgccaaucggca

SEQ ID NO: 667819 - RNA, 15 nt, Escherichia coli CFT073
ccugauacagccaaa

SEQ ID NO: 667820 - RNA, 23 nt, Escherichia coli CFT073
ccugauaagugaagaccgugauu

SEQ ID NO: 667821 - RNA, 15 nt, Escherichia coli CFT073
ccugaguuaauuaaa

SEQ ID NO: 667822 - RNA, 17 nt, Escherichia coli CFT073
ccugauaaaucaccugc

SEQ ID NO: 667823 - RNA, 20 nt, Escherichia coli CFT073
ccugauaacacagcggcagc

SEQ ID NO: 667824 - RNA, 12 nt, Escherichia coli CFT073
ccugauaagaca

SEQ ID NO: 667825 - RNA, 12 nt, Escherichia coli CFT073
ccugacugguua

SEQ ID NO: 667826 - RNA, 17 nt, Escherichia coli CFT073
ccugacuguuccaguac

SEQ ID NO: 667827 - RNA, 23 nt, Escherichia coli CFT073
ccugacuguuuuuccagcuuagc

SEQ ID NO: 667828 - RNA, 17 nt, Escherichia coli CFT073
ccugacuugcgaacuca

SEQ ID NO: 667829 - RNA, 18 nt, Escherichia coli CFT073
ccugagaagcgcagcgca

SEQ ID NO: 667830 - RNA, 14 nt, Escherichia coli CFT073
ccugagacaaacag

SEQ ID NO: 667831 - RNA, 17 nt, Escherichia coli CFT073
ccugagacagacagccu

SEQ ID NO: 667832 - RNA, 13 nt, Escherichia coli CFT073
ccugagaggauga

SEQ ID NO: 667833 - RNA, 18 nt, Escherichia coli CFT073
ccugacgcccguuuucac

SEQ ID NO: 667834 - RNA, 18 nt, Escherichia coli CFT073
ccugacggaaaucaucca

SEQ ID NO: 667835 - RNA, 14 nt, Escherichia coli CFT073
ccugacccagcacc

SEQ ID NO: 667836 - RNA, 23 nt, Escherichia coli CFT073
ccugacccagcaccaguaccauu

SEQ ID NO: 667837 - RNA, 19 nt, Escherichia coli CFT073
ccugaccgucuuuuuuuac

SEQ ID NO: 667838 - RNA, 21 nt, Escherichia coli CFT073
ccugacaaggugcgaaaaaaa

SEQ ID NO: 667839 - RNA, 18 nt, Escherichia coli CFT073
ccugacagaccacucucu

SEQ ID NO: 667840 - RNA, 18 nt, Escherichia coli CFT073
ccugaaucugagcauuua

SEQ ID NO: 667841 - RNA, 13 nt, Escherichia coli CFT073
ccugaaucuggcu

SEQ ID NO: 667842 - RNA, 22 nt, Escherichia coli CFT073
ccugaauccgcgauuaucccau

SEQ ID NO: 667843 - RNA, 17 nt, Escherichia coli CFT073
ccugaauggugaccugc

SEQ ID NO: 667844 - RNA, 21 nt, Escherichia coli CFT073
ccugaauggugaccugcaaug

SEQ ID NO: 667845 - RNA, 19 nt, Escherichia coli CFT073
ccugaauuugcuccagaaa

SEQ ID NO: 667846 - RNA, 20 nt, Escherichia coli CFT073
ccugaauuugcuccagaaac

SEQ ID NO: 667847 - RNA, 14 nt, Escherichia coli CFT073
ccucugcaacgucu

SEQ ID NO: 667848 - RNA, 19 nt, Escherichia coli CFT073
ccucugcaacgucuucccg

SEQ ID NO: 667849 - RNA, 13 nt, Escherichia coli CFT073
ccucugccagcug

SEQ ID NO: 667850 - RNA, 21 nt, Escherichia coli CFT073
ccucuccccagaggggcgagg

SEQ ID NO: 667851 - RNA, 21 nt, Escherichia coli CFT073
ccucguauuccaucucgccau

SEQ ID NO: 667852 - RNA, 16 nt, Escherichia coli CFT073
ccucuaaaauaacgaa

SEQ ID NO: 667853 - RNA, 16 nt, Escherichia coli CFT073
ccucguugauguucgg

SEQ ID NO: 667854 - RNA, 15 nt, Escherichia coli CFT073
ccucguuuugccgcc

SEQ ID NO: 667855 - RNA, 18 nt, Escherichia coli CFT073
ccucguuggucagcucaa

SEQ ID NO: 667856 - RNA, 22 nt, Escherichia coli CFT073
ccucguucugaauacccgccag

SEQ ID NO: 667857 - RNA, 14 nt, Escherichia coli CFT073
ccucgugcaccgcc

SEQ ID NO: 667858 - RNA, 20 nt, Escherichia coli CFT073
ccucgauuggggagaaaaac

SEQ ID NO: 667859 - RNA, 14 nt, Escherichia coli CFT073
ccucgcccgcagaa

SEQ ID NO: 667860 - RNA, 17 nt, Escherichia coli CFT073
ccucgccccuccgggga

SEQ ID NO: 667861 - RNA, 14 nt, Escherichia coli CFT073
ccucgccccuccgg

SEQ ID NO: 667862 - RNA, 15 nt, Escherichia coli CFT073
ccuccuccggcaucu

SEQ ID NO: 667863 - RNA, 19 nt, Escherichia coli CFT073
ccuccgcuaaauccgccgc

SEQ ID NO: 667864 - RNA, 22 nt, Escherichia coli CFT073
ccuccgcuaaauccgccgccac

SEQ ID NO: 667865 - RNA, 22 nt, Escherichia coli CFT073
ccucgcgcguccacggugcgac

SEQ ID NO: 667866 - RNA, 17 nt, Escherichia coli CFT073
ccucgcucucgccgcgc

SEQ ID NO: 667867 - RNA, 15 nt, Escherichia coli CFT073
ccucccguuuuuaga

SEQ ID NO: 667868 - RNA, 23 nt, Escherichia coli CFT073
ccucccggugaauucaguaccag

SEQ ID NO: 667869 - RNA, 23 nt, Escherichia coli CFT073
aaacgccgucgccuucauaccau

SEQ ID NO: 667870 - RNA, 13 nt, Escherichia coli CFT073
aaacgccgcuggu

SEQ ID NO: 667871 - RNA, 19 nt, Escherichia coli CFT073
ccucauuaaucaccaguca

SEQ ID NO: 667872 - RNA, 16 nt, Escherichia coli CFT073
ccucaugcggcgcgcc

SEQ ID NO: 667873 - RNA, 13 nt, Escherichia coli CFT073
ccucauuuaaaau

SEQ ID NO: 667874 - RNA, 15 nt, Escherichia coli CFT073
aaacgcauaucuucu

SEQ ID NO: 667875 - RNA, 18 nt, Escherichia coli CFT073
aaacgccaccuguuucuu

SEQ ID NO: 667876 - RNA, 14 nt, Escherichia coli CFT073
aaacgccagaauca

SEQ ID NO: 667877 - RNA, 16 nt, Escherichia coli CFT073
ccucauaaauugcuga

SEQ ID NO: 667878 - RNA, 14 nt, Escherichia coli CFT073
aaacgcaguuuaau

SEQ ID NO: 667879 - RNA, 15 nt, Escherichia coli CFT073
ccucaacaucuucac

SEQ ID NO: 667880 - RNA, 16 nt, Escherichia coli CFT073
ccucaacaucuucacc

SEQ ID NO: 667881 - RNA, 13 nt, Escherichia coli CFT073
ccucaccuaaaua

SEQ ID NO: 667882 - RNA, 16 nt, Escherichia coli CFT073
ccucaccuaaauaagu

SEQ ID NO: 667883 - RNA, 20 nt, Escherichia coli CFT073
ccucaccucaauggcagcau

SEQ ID NO: 667884 - RNA, 13 nt, Escherichia coli CFT073
ccucaagaaucac

SEQ ID NO: 667885 - RNA, 16 nt, Escherichia coli CFT073
ccucaacgccgcacag

SEQ ID NO: 667886 - RNA, 15 nt, Escherichia coli CFT073
ccucaacggaauaaa

SEQ ID NO: 667887 - RNA, 21 nt, Escherichia coli CFT073
ccucacgguuuugcucggcaa

SEQ ID NO: 667888 - RNA, 17 nt, Escherichia coli CFT073
ccucaccuuccacgcgg

SEQ ID NO: 667889 - RNA, 14 nt, Escherichia coli CFT073
ccucacgcaaauuc

SEQ ID NO: 667890 - RNA, 20 nt, Escherichia coli CFT073
ccucaguacccgcguucugg

SEQ ID NO: 667891 - RNA, 21 nt, Escherichia coli CFT073
ccucagggcggcuaucccaaa

SEQ ID NO: 667892 - RNA, 18 nt, Escherichia coli CFT073
ccucagguucaaccgcag

SEQ ID NO: 667893 - RNA, 20 nt, Escherichia coli CFT073
ccucagguucaaccgcagcu

SEQ ID NO: 667894 - RNA, 15 nt, Escherichia coli CFT073
ccucacuguuggcuu

SEQ ID NO: 667895 - RNA, 21 nt, Escherichia coli CFT073
ccucacuuaaagcaacaccau

SEQ ID NO: 667896 - RNA, 16 nt, Escherichia coli CFT073
ccgugcgauggcaggc

SEQ ID NO: 667897 - RNA, 16 nt, Escherichia coli CFT073
ccgugccgcuguucug

SEQ ID NO: 667898 - RNA, 15 nt, Escherichia coli CFT073
ccgugcggugggcua

SEQ ID NO: 667899 - RNA, 21 nt, Escherichia coli CFT073
ccgucuuuauccagcaccacu

SEQ ID NO: 667900 - RNA, 16 nt, Escherichia coli CFT073
ccgucuucccgcagcc

SEQ ID NO: 667901 - RNA, 17 nt, Escherichia coli CFT073
ccgucuucccgcagcca

SEQ ID NO: 667902 - RNA, 22 nt, Escherichia coli CFT073
ccgucugggcaaaaucaucacu

SEQ ID NO: 667903 - RNA, 23 nt, Escherichia coli CFT073
ccguccggcacucaaucgccaaa

SEQ ID NO: 667904 - RNA, 15 nt, Escherichia coli CFT073
ccguccggcaucgca

SEQ ID NO: 667905 - RNA, 19 nt, Escherichia coli CFT073
ccgucccuaacaugccacu

SEQ ID NO: 667906 - RNA, 22 nt, Escherichia coli CFT073
ccgucccuaacaugccacuggc

SEQ ID NO: 667907 - RNA, 17 nt, Escherichia coli CFT073
ccgucgcccacagucug

SEQ ID NO: 667908 - RNA, 14 nt, Escherichia coli CFT073
ccgucacuucuucg

SEQ ID NO: 667909 - RNA, 19 nt, Escherichia coli CFT073
ccgucagccagcacugaca

SEQ ID NO: 667910 - RNA, 11 nt, Escherichia coli CFT073
ccgucagccgc

SEQ ID NO: 667911 - RNA, 21 nt, Escherichia coli CFT073
ccgucaucgacgucagcagau

SEQ ID NO: 667912 - RNA, 15 nt, Escherichia coli CFT073
ccgucagccgcccgc

SEQ ID NO: 667913 - RNA, 17 nt, Escherichia coli CFT073
aaaccuucguucacaaa

SEQ ID NO: 667914 - RNA, 23 nt, Escherichia coli CFT073
aaaccuucguucacaaacagcgc

SEQ ID NO: 667915 - RNA, 21 nt, Escherichia coli CFT073
aaaccuuguuggaucaugcuc

SEQ ID NO: 667916 - RNA, 22 nt, Escherichia coli CFT073
aaaccuuaaagcgaaacagcgc

SEQ ID NO: 667917 - RNA, 15 nt, Escherichia coli CFT073
ccgucaugccgguaa

SEQ ID NO: 667918 - RNA, 20 nt, Escherichia coli CFT073
ccgucaugucucucagagaa

SEQ ID NO: 667919 - RNA, 12 nt, Escherichia coli CFT073
ccguccaccaga

SEQ ID NO: 667920 - RNA, 19 nt, Escherichia coli CFT073
ccguauguugcacaccagg

SEQ ID NO: 667921 - RNA, 15 nt, Escherichia coli CFT073
ccgucaauaaaaacg

SEQ ID NO: 667922 - RNA, 18 nt, Escherichia coli CFT073
ccguagcguaaaucaucg

SEQ ID NO: 667923 - RNA, 17 nt, Escherichia coli CFT073
ccguagcguuuuuucau

SEQ ID NO: 667924 - RNA, 19 nt, Escherichia coli CFT073
ccguagccauuaccagguc

SEQ ID NO: 667925 - RNA, 13 nt, Escherichia coli CFT073
ccguagcccaauc

SEQ ID NO: 667926 - RNA, 16 nt, Escherichia coli CFT073
ccgguuuugguuuucu

SEQ ID NO: 667927 - RNA, 15 nt, Escherichia coli CFT073
ccgguuucgccgcgg

SEQ ID NO: 667928 - RNA, 21 nt, Escherichia coli CFT073
ccguaagguggauuacucuac

SEQ ID NO: 667929 - RNA, 21 nt, Escherichia coli CFT073
ccguaaguaagauaaaagcaa

SEQ ID NO: 667930 - RNA, 14 nt, Escherichia coli CFT073
ccguacgcuuuucc

SEQ ID NO: 667931 - RNA, 21 nt, Escherichia coli CFT073
ccguacugacggcguucuuua

SEQ ID NO: 667932 - RNA, 21 nt, Escherichia coli CFT073
ccguaauguugcgccaguucc

SEQ ID NO: 667933 - RNA, 15 nt, Escherichia coli CFT073
ccguaauuaacaccu

SEQ ID NO: 667934 - RNA, 19 nt, Escherichia coli CFT073
ccguacaaagugccgccag

SEQ ID NO: 667935 - RNA, 15 nt, Escherichia coli CFT073
ccguaaucgccucca

SEQ ID NO: 667936 - RNA, 21 nt, Escherichia coli CFT073
ccguacagaguauuacccggc

SEQ ID NO: 667937 - RNA, 15 nt, Escherichia coli CFT073
ccguacagcccagga

SEQ ID NO: 667938 - RNA, 16 nt, Escherichia coli CFT073
ccggugccgccgucag

SEQ ID NO: 667939 - RNA, 15 nt, Escherichia coli CFT073
ccggugagcacauca

SEQ ID NO: 667940 - RNA, 19 nt, Escherichia coli CFT073
ccggugucaugcgggcgag

SEQ ID NO: 667941 - RNA, 21 nt, Escherichia coli CFT073
ccgguggcgugaaugcgccaa

SEQ ID NO: 667942 - RNA, 22 nt, Escherichia coli CFT073
ccggucuaccgauccggcacca

SEQ ID NO: 667943 - RNA, 20 nt, Escherichia coli CFT073
ccgggguucgaauccccgcc

SEQ ID NO: 667944 - RNA, 15 nt, Escherichia coli CFT073
ccggguagcgcggca

SEQ ID NO: 667945 - RNA, 14 nt, Escherichia coli CFT073
ccggagucaguccc

SEQ ID NO: 667946 - RNA, 15 nt, Escherichia coli CFT073
ccggagguuuuucaa

SEQ ID NO: 667947 - RNA, 22 nt, Escherichia coli CFT073
ccggauaaggcauuuacgccgc

SEQ ID NO: 667948 - RNA, 17 nt, Escherichia coli CFT073
ccggauacagccccagc

SEQ ID NO: 667949 - RNA, 16 nt, Escherichia coli CFT073
ccggccagcgccacca

SEQ ID NO: 667950 - RNA, 16 nt, Escherichia coli CFT073
ccggccauuuucauuu

SEQ ID NO: 667951 - RNA, 21 nt, Escherichia coli CFT073
ccggccuacgggaacagugcu

SEQ ID NO: 667952 - RNA, 22 nt, Escherichia coli CFT073
ccggccuacguagaucacugaa

SEQ ID NO: 667953 - RNA, 23 nt, Escherichia coli CFT073
ccggccugauauaucaccuucca

SEQ ID NO: 667954 - RNA, 22 nt, Escherichia coli CFT073
ccggccugcacugcaggccgga

SEQ ID NO: 667955 - RNA, 23 nt, Escherichia coli CFT073
ccggcgacaggaaccaaaugccg

SEQ ID NO: 667956 - RNA, 14 nt, Escherichia coli CFT073
ccggcgacuuccug

SEQ ID NO: 667957 - RNA, 20 nt, Escherichia coli CFT073
ccgggauauaugucaccagc

SEQ ID NO: 667958 - RNA, 21 nt, Escherichia coli CFT073
ccgggauauaugucaccagca

SEQ ID NO: 667959 - RNA, 22 nt, Escherichia coli CFT073
ccgggaucaccgaaccagggcg

SEQ ID NO: 667960 - RNA, 16 nt, Escherichia coli CFT073
aaaccugccaacgaac

SEQ ID NO: 667961 - RNA, 19 nt, Escherichia coli CFT073
ccgggcuguuuuccagcac

SEQ ID NO: 667962 - RNA, 18 nt, Escherichia coli CFT073
ccgggggcgaccugugcc

SEQ ID NO: 667963 - RNA, 19 nt, Escherichia coli CFT073
ccggcuuuuuuacaucauc

SEQ ID NO: 667964 - RNA, 19 nt, Escherichia coli CFT073
ccgggaaauccucaaccgg

SEQ ID NO: 667965 - RNA, 22 nt, Escherichia coli CFT073
ccggcuuucaccugaucaauuu

SEQ ID NO: 667966 - RNA, 13 nt, Escherichia coli CFT073
ccggcuuucacuu

SEQ ID NO: 667967 - RNA, 19 nt, Escherichia coli CFT073
ccggcuuacaucuuuacau

SEQ ID NO: 667968 - RNA, 16 nt, Escherichia coli CFT073
ccggcuucuucugccg

SEQ ID NO: 667969 - RNA, 23 nt, Escherichia coli CFT073
ccggcuucuuuugcugccuucac

SEQ ID NO: 667970 - RNA, 18 nt, Escherichia coli CFT073
ccgggaaucgaaaugcca

SEQ ID NO: 667971 - RNA, 21 nt, Escherichia coli CFT073
ccgggaaggaaccuguucaac

SEQ ID NO: 667972 - RNA, 23 nt, Escherichia coli CFT073
aaaccgguuuguaggccggauaa

SEQ ID NO: 667973 - RNA, 18 nt, Escherichia coli CFT073
aaaccgguuuugguuaac

SEQ ID NO: 667974 - RNA, 21 nt, Escherichia coli CFT073
aaaccgguauguucagaaagc

SEQ ID NO: 667975 - RNA, 23 nt, Escherichia coli CFT073
aaaccguaaguaagauaaaagca

SEQ ID NO: 667976 - RNA, 14 nt, Escherichia coli CFT073
aaaccguauucauc

SEQ ID NO: 667977 - RNA, 22 nt, Escherichia coli CFT073
ccgcugcgaacacgccuuugac

SEQ ID NO: 667978 - RNA, 21 nt, Escherichia coli CFT073
ccgcugcuucucuucagccaa

SEQ ID NO: 667979 - RNA, 21 nt, Escherichia coli CFT073
ccgcucucuucguggcccgcc

SEQ ID NO: 667980 - RNA, 11 nt, Escherichia coli CFT073
ccgcucugccc

SEQ ID NO: 667981 - RNA, 16 nt, Escherichia coli CFT073
ccgcucugcccugcca

SEQ ID NO: 667982 - RNA, 17 nt, Escherichia coli CFT073
ccgcucuucaucuucca

SEQ ID NO: 667983 - RNA, 18 nt, Escherichia coli CFT073
ccgcucuucaucuuccag

SEQ ID NO: 667984 - RNA, 21 nt, Escherichia coli CFT073
ccgcucucgaggcucugauug

SEQ ID NO: 667985 - RNA, 11 nt, Escherichia coli CFT073
ccgcugauuca

SEQ ID NO: 667986 - RNA, 14 nt, Escherichia coli CFT073
ccgcugauugcugg

SEQ ID NO: 667987 - RNA, 19 nt, Escherichia coli CFT073
ccgcugcaacacuuccgcu

SEQ ID NO: 667988 - RNA, 23 nt, Escherichia coli CFT073
ccggaaggaagacguagcaagca

SEQ ID NO: 667989 - RNA, 17 nt, Escherichia coli CFT073
ccggaauaauaaugucu

SEQ ID NO: 667990 - RNA, 12 nt, Escherichia coli CFT073
ccggaauaccac

SEQ ID NO: 667991 - RNA, 18 nt, Escherichia coli CFT073
ccggaagaucggaaaggg

SEQ ID NO: 667992 - RNA, 17 nt, Escherichia coli CFT073
ccggaagccaccacgcc

SEQ ID NO: 667993 - RNA, 17 nt, Escherichia coli CFT073
ccggaaccugacggcgc

SEQ ID NO: 667994 - RNA, 20 nt, Escherichia coli CFT073
ccggaauggucaccacaaau

SEQ ID NO: 667995 - RNA, 15 nt, Escherichia coli CFT073
ccggaauagcuuuac

SEQ ID NO: 667996 - RNA, 20 nt, Escherichia coli CFT073
ccggacguuugauuuuuaac

SEQ ID NO: 667997 - RNA, 19 nt, Escherichia coli CFT073
ccggacuuaacgucacaga

SEQ ID NO: 667998 - RNA, 22 nt, Escherichia coli CFT073
ccggagacauuacguccaucac

SEQ ID NO: 667999 - RNA, 20 nt, Escherichia coli CFT073
ccggagagcaauuuccggca

SEQ ID NO: 668000 - RNA, 15 nt, Escherichia coli CFT073
ccgcuucuucuucca

SEQ ID NO: 668001 - RNA, 20 nt, Escherichia coli CFT073
ccgcuguaauaccagccuuc

SEQ ID NO: 668002 - RNA, 22 nt, Escherichia coli CFT073
ccgcugguggauguuugcagua

SEQ ID NO: 668003 - RNA, 20 nt, Escherichia coli CFT073
ccgcuugccuagggcgcagc

SEQ ID NO: 668004 - RNA, 19 nt, Escherichia coli CFT073
ccggaacaaaugaaagcag

SEQ ID NO: 668005 - RNA, 23 nt, Escherichia coli CFT073
ccggaaccaccagauccaacauc

SEQ ID NO: 668006 - RNA, 16 nt, Escherichia coli CFT073
ccggaaccagcgccug

SEQ ID NO: 668007 - RNA, 18 nt, Escherichia coli CFT073
ccgcuaaauccgccgcca

SEQ ID NO: 668008 - RNA, 15 nt, Escherichia coli CFT073
ccgcgugccaccauu

SEQ ID NO: 668009 - RNA, 16 nt, Escherichia coli CFT073
ccgcuauccugcgguu

SEQ ID NO: 668010 - RNA, 19 nt, Escherichia coli CFT073
ccgcuacucugacccagaa

SEQ ID NO: 668011 - RNA, 13 nt, Escherichia coli CFT073
ccgcuacuggcaa

SEQ ID NO: 668012 - RNA, 20 nt, Escherichia coli CFT073
ccgcuaccgcccugagcauc

SEQ ID NO: 668013 - RNA, 15 nt, Escherichia coli CFT073
ccgcuaccugccgcc

SEQ ID NO: 668014 - RNA, 19 nt, Escherichia coli CFT073
ccgcuaccugccgccacca

SEQ ID NO: 668015 - RNA, 19 nt, Escherichia coli CFT073
ccgcuacccgaacaccaau

SEQ ID NO: 668016 - RNA, 19 nt, Escherichia coli CFT073
ccgcuauugaccagcgccg

SEQ ID NO: 668017 - RNA, 19 nt, Escherichia coli CFT073
ccgcucaucaccgcaaagu

SEQ ID NO: 668018 - RNA, 16 nt, Escherichia coli CFT073
ccgcucaucaggccug

SEQ ID NO: 668019 - RNA, 20 nt, Escherichia coli CFT073
ccgcucacgaugccgccgag

SEQ ID NO: 668020 - RNA, 21 nt, Escherichia coli CFT073
ccgcucccggauaccccagcu

SEQ ID NO: 668021 - RNA, 13 nt, Escherichia coli CFT073
ccgcuccggcagc

SEQ ID NO: 668022 - RNA, 18 nt, Escherichia coli CFT073
ccgcuccggcagcagcac

SEQ ID NO: 668023 - RNA, 15 nt, Escherichia coli CFT073
ccgcucgaaguuuuc

SEQ ID NO: 668024 - RNA, 18 nt, Escherichia coli CFT073
ccgcgucauugacgcugg

SEQ ID NO: 668025 - RNA, 15 nt, Escherichia coli CFT073
ccgcguaguugcgcu

SEQ ID NO: 668026 - RNA, 17 nt, Escherichia coli CFT073
ccgcgugaugcggcauc

SEQ ID NO: 668027 - RNA, 20 nt, Escherichia coli CFT073
ccgcgucguugaaaugcggc

SEQ ID NO: 668028 - RNA, 15 nt, Escherichia coli CFT073
ccgcggcugcagcgg

SEQ ID NO: 668029 - RNA, 12 nt, Escherichia coli CFT073
ccgcggcgcagc

SEQ ID NO: 668030 - RNA, 13 nt, Escherichia coli CFT073
ccgccuguugccc

SEQ ID NO: 668031 - RNA, 18 nt, Escherichia coli CFT073
ccgccuuuuuaauuugcc

SEQ ID NO: 668032 - RNA, 19 nt, Escherichia coli CFT073
ccgcgaaccagaccagcaa

SEQ ID NO: 668033 - RNA, 13 nt, Escherichia coli CFT073
ccgcagccaucac

SEQ ID NO: 668034 - RNA, 13 nt, Escherichia coli CFT073
ccgcagccgccac

SEQ ID NO: 668035 - RNA, 18 nt, Escherichia coli CFT073
ccgccugcauaaaggcaa

SEQ ID NO: 668036 - RNA, 20 nt, Escherichia coli CFT073
ccgccugccuucccuucucu

SEQ ID NO: 668037 - RNA, 22 nt, Escherichia coli CFT073
ccgccugcaauucgcagaccgg

SEQ ID NO: 668038 - RNA, 21 nt, Escherichia coli CFT073
ccgcgauagagagcagucagg

SEQ ID NO: 668039 - RNA, 15 nt, Escherichia coli CFT073
ccgcgaucccagacc

SEQ ID NO: 668040 - RNA, 16 nt, Escherichia coli CFT073
ccgcgauaacgcccca

SEQ ID NO: 668041 - RNA, 14 nt, Escherichia coli CFT073
ccgcgagcaaaauc

SEQ ID NO: 668042 - RNA, 16 nt, Escherichia coli CFT073
ccgcgacggaagcuua

SEQ ID NO: 668043 - RNA, 14 nt, Escherichia coli CFT073
ccgcgacugcggua

SEQ ID NO: 668044 - RNA, 21 nt, Escherichia coli CFT073
ccgcgacaaucgcccccauca

SEQ ID NO: 668045 - RNA, 21 nt, Escherichia coli CFT073
ccgcgcacgaggugccaccag

SEQ ID NO: 668046 - RNA, 21 nt, Escherichia coli CFT073
ccgcgcagcgaaacucgcuga

SEQ ID NO: 668047 - RNA, 15 nt, Escherichia coli CFT073
aaacccucaauaauc

SEQ ID NO: 668048 - RNA, 22 nt, Escherichia coli CFT073
aaacccuauuuuuggaggugaa

SEQ ID NO: 668049 - RNA, 19 nt, Escherichia coli CFT073
aaacccugccgucugggca

SEQ ID NO: 668050 - RNA, 13 nt, Escherichia coli CFT073
aaacccugcgcau

SEQ ID NO: 668051 - RNA, 18 nt, Escherichia coli CFT073
aaacccuuucugcugcuu

SEQ ID NO: 668052 - RNA, 20 nt, Escherichia coli CFT073
ccgcgccuucgugcggcugc

SEQ ID NO: 668053 - RNA, 16 nt, Escherichia coli CFT073
ccgcgccgcugagaaa

SEQ ID NO: 668054 - RNA, 14 nt, Escherichia coli CFT073
aaaccgaccaauca

SEQ ID NO: 668055 - RNA, 14 nt, Escherichia coli CFT073
aaaccgacuuaaaa

SEQ ID NO: 668056 - RNA, 16 nt, Escherichia coli CFT073
aaaccgcaucauguaa

SEQ ID NO: 668057 - RNA, 20 nt, Escherichia coli CFT073
aaaccgcaucauguaaauca

SEQ ID NO: 668058 - RNA, 22 nt, Escherichia coli CFT073
aaaccgcaucauguaaaucaau

SEQ ID NO: 668059 - RNA, 19 nt, Escherichia coli CFT073
ccgcgcgugccggaacgcc

SEQ ID NO: 668060 - RNA, 15 nt, Escherichia coli CFT073
ccgcgcuccaucaug

SEQ ID NO: 668061 - RNA, 16 nt, Escherichia coli CFT073
ccgcgcuauuuuccug

SEQ ID NO: 668062 - RNA, 15 nt, Escherichia coli CFT073
ccgcgcuugccgccg

SEQ ID NO: 668063 - RNA, 14 nt, Escherichia coli CFT073
ccgauacgaucauc

SEQ ID NO: 668064 - RNA, 19 nt, Escherichia coli CFT073
ccgauacgaucaucuggcg

SEQ ID NO: 668065 - RNA, 15 nt, Escherichia coli CFT073
ccgaucaguaccagc

SEQ ID NO: 668066 - RNA, 16 nt, Escherichia coli CFT073
ccgauccggcaccaau

SEQ ID NO: 668067 - RNA, 20 nt, Escherichia coli CFT073
ccgauccccggauucauacu

SEQ ID NO: 668068 - RNA, 15 nt, Escherichia coli CFT073
ccgaucccugcaaca

SEQ ID NO: 668069 - RNA, 14 nt, Escherichia coli CFT073
ccgaucaucaucca

SEQ ID NO: 668070 - RNA, 21 nt, Escherichia coli CFT073
ccgaugacagaaucagcagcg

SEQ ID NO: 668071 - RNA, 16 nt, Escherichia coli CFT073
ccgaugagcugcaacu

SEQ ID NO: 668072 - RNA, 15 nt, Escherichia coli CFT073
ccgaugaagucauug

SEQ ID NO: 668073 - RNA, 14 nt, Escherichia coli CFT073
ccgaugauucccag

SEQ ID NO: 668074 - RNA, 20 nt, Escherichia coli CFT073
ccgaugcauaugaaugccag

SEQ ID NO: 668075 - RNA, 18 nt, Escherichia coli CFT073
ccgaugccguuaaggcca

SEQ ID NO: 668076 - RNA, 15 nt, Escherichia coli CFT073
ccgaugccgcggcgc

SEQ ID NO: 668077 - RNA, 13 nt, Escherichia coli CFT073
ccgcaaacugcug

SEQ ID NO: 668078 - RNA, 16 nt, Escherichia coli CFT073
ccgauggugcagcaga

SEQ ID NO: 668079 - RNA, 17 nt, Escherichia coli CFT073
ccgauggugcagcagac

SEQ ID NO: 668080 - RNA, 20 nt, Escherichia coli CFT073
ccgcaacagugaaauacagu

SEQ ID NO: 668081 - RNA, 17 nt, Escherichia coli CFT073
ccgcaacauaucuuuuu

SEQ ID NO: 668082 - RNA, 22 nt, Escherichia coli CFT073
ccgcaacaauaacccccugccc

SEQ ID NO: 668083 - RNA, 15 nt, Escherichia coli CFT073
ccgcaacagcaauac

SEQ ID NO: 668084 - RNA, 14 nt, Escherichia coli CFT073
ccgcaacuaccagc

SEQ ID NO: 668085 - RNA, 18 nt, Escherichia coli CFT073
ccgcaacgcccugcaacu

SEQ ID NO: 668086 - RNA, 20 nt, Escherichia coli CFT073
ccgcaaccgccguugccuuu

SEQ ID NO: 668087 - RNA, 17 nt, Escherichia coli CFT073
ccgcaccgcgguacagc

SEQ ID NO: 668088 - RNA, 15 nt, Escherichia coli CFT073
ccgcaccugccagcg

SEQ ID NO: 668089 - RNA, 18 nt, Escherichia coli CFT073
ccgcaccugccagcgccg

SEQ ID NO: 668090 - RNA, 15 nt, Escherichia coli CFT073
ccgauaaaauaauca

SEQ ID NO: 668091 - RNA, 17 nt, Escherichia coli CFT073
ccgaguagccagcugcc

SEQ ID NO: 668092 - RNA, 19 nt, Escherichia coli CFT073
ccgaguaaaaaaacaucau

SEQ ID NO: 668093 - RNA, 22 nt, Escherichia coli CFT073
ccgagcgaauaaaccacaccgc

SEQ ID NO: 668094 - RNA, 12 nt, Escherichia coli CFT073
ccgagcgcccgc

SEQ ID NO: 668095 - RNA, 14 nt, Escherichia coli CFT073
ccgagcgcccgcca

SEQ ID NO: 668096 - RNA, 15 nt, Escherichia coli CFT073
ccgagcgcuaccauc

SEQ ID NO: 668097 - RNA, 16 nt, Escherichia coli CFT073
ccgagauaaaugccaa

SEQ ID NO: 668098 - RNA, 17 nt, Escherichia coli CFT073
ccgagaucaacagcaua

SEQ ID NO: 668099 - RNA, 19 nt, Escherichia coli CFT073
ccgagaauuuccagaugug

SEQ ID NO: 668100 - RNA, 17 nt, Escherichia coli CFT073
aaaccaccgaagaucac

SEQ ID NO: 668101 - RNA, 18 nt, Escherichia coli CFT073
aaaccacccaccagcgcc

SEQ ID NO: 668102 - RNA, 14 nt, Escherichia coli CFT073
ccgacgcuccugau

SEQ ID NO: 668103 - RNA, 19 nt, Escherichia coli CFT073
ccgacucacuugcagucgg

SEQ ID NO: 668104 - RNA, 15 nt, Escherichia coli CFT073
ccgacugaaguucug

SEQ ID NO: 668105 - RNA, 21 nt, Escherichia coli CFT073
ccgaaugggccuuucaacuau

SEQ ID NO: 668106 - RNA, 19 nt, Escherichia coli CFT073
ccgacaauaaacgcgcagg

SEQ ID NO: 668107 - RNA, 19 nt, Escherichia coli CFT073
ccgacaaucucuucgagaa

SEQ ID NO: 668108 - RNA, 12 nt, Escherichia coli CFT073
ccgacacaaugu

SEQ ID NO: 668109 - RNA, 11 nt, Escherichia coli CFT073
ccgacaccagc

SEQ ID NO: 668110 - RNA, 22 nt, Escherichia coli CFT073
ccgaagcggugagguucagucc

SEQ ID NO: 668111 - RNA, 19 nt, Escherichia coli CFT073
ccgaaguucguacacccgc

SEQ ID NO: 668112 - RNA, 15 nt, Escherichia coli CFT073
aaaccaauaaagaac

SEQ ID NO: 668113 - RNA, 15 nt, Escherichia coli CFT073
aaaccaagcugggca

SEQ ID NO: 668114 - RNA, 18 nt, Escherichia coli CFT073
aaaccaccagucagaaug

SEQ ID NO: 668115 - RNA, 17 nt, Escherichia coli CFT073
aaaccacaucagcgaac

SEQ ID NO: 668116 - RNA, 13 nt, Escherichia coli CFT073
ccgacaccgccug

SEQ ID NO: 668117 - RNA, 17 nt, Escherichia coli CFT073
ccgacaccggcagagau

SEQ ID NO: 668118 - RNA, 20 nt, Escherichia coli CFT073
aaaccaaacuuaugcagcug

SEQ ID NO: 668119 - RNA, 22 nt, Escherichia coli CFT073
aaacagucacuuucgagcaauu

SEQ ID NO: 668120 - RNA, 16 nt, Escherichia coli CFT073
ccgaaccagugcucca

SEQ ID NO: 668121 - RNA, 19 nt, Escherichia coli CFT073
ccgaaccagugcuccaccu

SEQ ID NO: 668122 - RNA, 20 nt, Escherichia coli CFT073
aaacaucggcaguaaugguu

SEQ ID NO: 668123 - RNA, 22 nt, Escherichia coli CFT073
aaacaucggcuuauucauauca

SEQ ID NO: 668124 - RNA, 23 nt, Escherichia coli CFT073
aaacaucggcuuauucauaucaa

SEQ ID NO: 668125 - RNA, 17 nt, Escherichia coli CFT073
aaacaucgggacaugau

SEQ ID NO: 668126 - RNA, 23 nt, Escherichia coli CFT073
aaacaucguugauuucaccaucu

SEQ ID NO: 668127 - RNA, 16 nt, Escherichia coli CFT073
aaacaugcuaaugguu

SEQ ID NO: 668128 - RNA, 20 nt, Escherichia coli CFT073
aaacauggagaguuuucaug

SEQ ID NO: 668129 - RNA, 22 nt, Escherichia coli CFT073
aaacauggcacugcgaucccgg

SEQ ID NO: 668130 - RNA, 14 nt, Escherichia coli CFT073
cccuuucugcauga

SEQ ID NO: 668131 - RNA, 14 nt, Escherichia coli CFT073
cccuuucugcugcu

SEQ ID NO: 668132 - RNA, 20 nt, Escherichia coli CFT073
cccuuugccugccgccuuuu

SEQ ID NO: 668133 - RNA, 18 nt, Escherichia coli CFT073
aaacagaaauagagaaag

SEQ ID NO: 668134 - RNA, 12 nt, Escherichia coli CFT073
aaacagaaauac

SEQ ID NO: 668135 - RNA, 22 nt, Escherichia coli CFT073
ccgaacagugccagacaaacca

SEQ ID NO: 668136 - RNA, 23 nt, Escherichia coli CFT073
ccgaacagugccagacaaaccac

SEQ ID NO: 668137 - RNA, 14 nt, Escherichia coli CFT073
ccgaacaacagugc

SEQ ID NO: 668138 - RNA, 16 nt, Escherichia coli CFT073
ccgaaaucaaggcgga

SEQ ID NO: 668139 - RNA, 23 nt, Escherichia coli CFT073
ccgaaaucgcauugcgccauuga

SEQ ID NO: 668140 - RNA, 13 nt, Escherichia coli CFT073
cccuuucacuuua

SEQ ID NO: 668141 - RNA, 16 nt, Escherichia coli CFT073
cccuuggcgucuaagg

SEQ ID NO: 668142 - RNA, 21 nt, Escherichia coli CFT073
cccuugugcugcgccauauac

SEQ ID NO: 668143 - RNA, 22 nt, Escherichia coli CFT073
cccuucucaaucccuuucucca

SEQ ID NO: 668144 - RNA, 23 nt, Escherichia coli CFT073
cccuguaagaccugucucuuaua

SEQ ID NO: 668145 - RNA, 15 nt, Escherichia coli CFT073
cccuguaauugccug

SEQ ID NO: 668146 - RNA, 23 nt, Escherichia coli CFT073
cccuguuaccgggcuacaacgca

SEQ ID NO: 668147 - RNA, 18 nt, Escherichia coli CFT073
cccugugcgcccuguucu

SEQ ID NO: 668148 - RNA, 16 nt, Escherichia coli CFT073
cccuguggaucuuccc

SEQ ID NO: 668149 - RNA, 23 nt, Escherichia coli CFT073
cccuucccgggucgcgacugcca

SEQ ID NO: 668150 - RNA, 22 nt, Escherichia coli CFT073
cccuuccggugcgaucaguuca

SEQ ID NO: 668151 - RNA, 17 nt, Escherichia coli CFT073
cccuucgagcgggggga

SEQ ID NO: 668152 - RNA, 16 nt, Escherichia coli CFT073
cccuucgauaaaggcc

SEQ ID NO: 668153 - RNA, 19 nt, Escherichia coli CFT073
cccugcaucacugacauca

SEQ ID NO: 668154 - RNA, 14 nt, Escherichia coli CFT073
cccugcagucaccu

SEQ ID NO: 668155 - RNA, 19 nt, Escherichia coli CFT073
cccugcaccggugcaucca

SEQ ID NO: 668156 - RNA, 14 nt, Escherichia coli CFT073
aaacacuugcggca

SEQ ID NO: 668157 - RNA, 20 nt, Escherichia coli CFT073
cccuggaaaaaaugccccag

SEQ ID NO: 668158 - RNA, 19 nt, Escherichia coli CFT073
cccuggcuaucggcaaaaa

SEQ ID NO: 668159 - RNA, 23 nt, Escherichia coli CFT073
cccuggcgcagcacgacucuccc

SEQ ID NO: 668160 - RNA, 11 nt, Escherichia coli CFT073
cccuggaucgu

SEQ ID NO: 668161 - RNA, 20 nt, Escherichia coli CFT073
cccuggcaauagcgcacgcc

SEQ ID NO: 668162 - RNA, 21 nt, Escherichia coli CFT073
cccuggcaugauugagcugcc

SEQ ID NO: 668163 - RNA, 22 nt, Escherichia coli CFT073
cccgcguuucgcugcgucuucc

SEQ ID NO: 668164 - RNA, 12 nt, Escherichia coli CFT073
cccgcguucugg

SEQ ID NO: 668165 - RNA, 18 nt, Escherichia coli CFT073
cccgcgucguucaucgca

SEQ ID NO: 668166 - RNA, 23 nt, Escherichia coli CFT073
cccgcguaagcgggaucagguaa

SEQ ID NO: 668167 - RNA, 20 nt, Escherichia coli CFT073
cccgcgaacggggcugccag

SEQ ID NO: 668168 - RNA, 21 nt, Escherichia coli CFT073
cccgcgacaaucgcccccauc

SEQ ID NO: 668169 - RNA, 13 nt, Escherichia coli CFT073
cccgcgcccaggc

SEQ ID NO: 668170 - RNA, 13 nt, Escherichia coli CFT073
cccgcgauggcug

SEQ ID NO: 668171 - RNA, 21 nt, Escherichia coli CFT073
cccgcuguuuguucaagcgca

SEQ ID NO: 668172 - RNA, 23 nt, Escherichia coli CFT073
cccggaacgggagaaacccggcc

SEQ ID NO: 668173 - RNA, 23 nt, Escherichia coli CFT073
cccgcuuuggcaucuucugccgg

SEQ ID NO: 668174 - RNA, 14 nt, Escherichia coli CFT073
cccgcuucuuccag

SEQ ID NO: 668175 - RNA, 13 nt, Escherichia coli CFT073
cccgcugccagga

SEQ ID NO: 668176 - RNA, 15 nt, Escherichia coli CFT073
cccgcugcaacucuu

SEQ ID NO: 668177 - RNA, 13 nt, Escherichia coli CFT073
cccgcucacgcag

SEQ ID NO: 668178 - RNA, 20 nt, Escherichia coli CFT073
cccggaagccaccacgccaa

SEQ ID NO: 668179 - RNA, 22 nt, Escherichia coli CFT073
cccggauaccccagcuggcgcc

SEQ ID NO: 668180 - RNA, 18 nt, Escherichia coli CFT073
cccggacuagcgcuuuuu

SEQ ID NO: 668181 - RNA, 20 nt, Escherichia coli CFT073
cccggcaacaaauucacgcc

SEQ ID NO: 668182 - RNA, 16 nt, Escherichia coli CFT073
cccggauuacagcuca

SEQ ID NO: 668183 - RNA, 23 nt, Escherichia coli CFT073
cccggauuacgcaucaguuucau

SEQ ID NO: 668184 - RNA, 22 nt, Escherichia coli CFT073
cccggcaacguugccaguacca

SEQ ID NO: 668185 - RNA, 21 nt, Escherichia coli CFT073
cccggcaagaaauaccgaaga

SEQ ID NO: 668186 - RNA, 14 nt, Escherichia coli CFT073
cccggcaccagcac

SEQ ID NO: 668187 - RNA, 15 nt, Escherichia coli CFT073
cccgguuucucuucu

SEQ ID NO: 668188 - RNA, 14 nt, Escherichia coli CFT073
cccguacugaaccc

SEQ ID NO: 668189 - RNA, 15 nt, Escherichia coli CFT073
aaacacgacaugacc

SEQ ID NO: 668190 - RNA, 23 nt, Escherichia coli CFT073
aaacacgauucguauaauuuauu

SEQ ID NO: 668191 - RNA, 23 nt, Escherichia coli CFT073
cccgguccuucaucuucaacggc

SEQ ID NO: 668192 - RNA, 23 nt, Escherichia coli CFT073
cccggugaauucaguaccagcac

SEQ ID NO: 668193 - RNA, 19 nt, Escherichia coli CFT073
cccgguguucccgcgccag

SEQ ID NO: 668194 - RNA, 21 nt, Escherichia coli CFT073
cccggcguggugcagccgcca

SEQ ID NO: 668195 - RNA, 22 nt, Escherichia coli CFT073
cccggcguggugcagccgccau

SEQ ID NO: 668196 - RNA, 15 nt, Escherichia coli CFT073
cccggucaucaaauu

SEQ ID NO: 668197 - RNA, 17 nt, Escherichia coli CFT073
cccggcauucaccucug

SEQ ID NO: 668198 - RNA, 13 nt, Escherichia coli CFT073
cccggcaucauua

SEQ ID NO: 668199 - RNA, 20 nt, Escherichia coli CFT073
cccggcaucauuauuccccc

SEQ ID NO: 668200 - RNA, 21 nt, Escherichia coli CFT073
cccggcaucauuauucccccg

SEQ ID NO: 668201 - RNA, 23 nt, Escherichia coli CFT073
cccggcaucauuauucccccggc

SEQ ID NO: 668202 - RNA, 20 nt, Escherichia coli CFT073
cccggccaguccccucgccc

SEQ ID NO: 668203 - RNA, 17 nt, Escherichia coli CFT073
cccggcgcagcgcgcga

SEQ ID NO: 668204 - RNA, 16 nt, Escherichia coli CFT073
cccggccuggcucguu

SEQ ID NO: 668205 - RNA, 16 nt, Escherichia coli CFT073
cccgcauccgcugaug

SEQ ID NO: 668206 - RNA, 17 nt, Escherichia coli CFT073
cccgcauccgcugaugc

SEQ ID NO: 668207 - RNA, 18 nt, Escherichia coli CFT073
cccgauucggucauggug

SEQ ID NO: 668208 - RNA, 22 nt, Escherichia coli CFT073
cccgauugguucagacgccacu

SEQ ID NO: 668209 - RNA, 13 nt, Escherichia coli CFT073
cccgaucuucuga

SEQ ID NO: 668210 - RNA, 14 nt, Escherichia coli CFT073
cccgauaaccgcaa

SEQ ID NO: 668211 - RNA, 20 nt, Escherichia coli CFT073
cccgaacucgaccugcaacu

SEQ ID NO: 668212 - RNA, 16 nt, Escherichia coli CFT073
ccccuguguugauuuc

SEQ ID NO: 668213 - RNA, 21 nt, Escherichia coli CFT073
ccccuggcuaucggcaaaaau

SEQ ID NO: 668214 - RNA, 15 nt, Escherichia coli CFT073
ccccugggccaccuc

SEQ ID NO: 668215 - RNA, 14 nt, Escherichia coli CFT073
cccgaacagcaacu

SEQ ID NO: 668216 - RNA, 16 nt, Escherichia coli CFT073
ccccuauaucaacgcc

SEQ ID NO: 668217 - RNA, 18 nt, Escherichia coli CFT073
ccccguguuuuugugcca

SEQ ID NO: 668218 - RNA, 23 nt, Escherichia coli CFT073
ccccguguuuuugugccagagca

SEQ ID NO: 668219 - RNA, 13 nt, Escherichia coli CFT073
ccccauucugcgc

SEQ ID NO: 668220 - RNA, 18 nt, Escherichia coli CFT073
cccccauugggccacuca

SEQ ID NO: 668221 - RNA, 15 nt, Escherichia coli CFT073
ccccgccaacagugc

SEQ ID NO: 668222 - RNA, 18 nt, Escherichia coli CFT073
ccccgccagcgccaucgg

SEQ ID NO: 668223 - RNA, 15 nt, Escherichia coli CFT073
ccccaagcgggggga

SEQ ID NO: 668224 - RNA, 15 nt, Escherichia coli CFT073
ccccaacgucuuacg

SEQ ID NO: 668225 - RNA, 20 nt, Escherichia coli CFT073
cccauugccuggcugcccau

SEQ ID NO: 668226 - RNA, 15 nt, Escherichia coli CFT073
ccccaauccacgcgg

SEQ ID NO: 668227 - RNA, 22 nt, Escherichia coli CFT073
cccauuaauaccgccaacaugc

SEQ ID NO: 668228 - RNA, 14 nt, Escherichia coli CFT073
cccauuccagccau

SEQ ID NO: 668229 - RNA, 10 nt, Escherichia coli CFT073
cccauucagc

SEQ ID NO: 668230 - RNA, 18 nt, Escherichia coli CFT073
cccagccauuccugcacc

SEQ ID NO: 668231 - RNA, 21 nt, Escherichia coli CFT073
ccccacaagcccgccagacca

SEQ ID NO: 668232 - RNA, 20 nt, Escherichia coli CFT073
ccccacaaucagccagaaca

SEQ ID NO: 668233 - RNA, 14 nt, Escherichia coli CFT073
ccccacaccaccau

SEQ ID NO: 668234 - RNA, 21 nt, Escherichia coli CFT073
ccccacgcuaccuaagcgcca

SEQ ID NO: 668235 - RNA, 22 nt, Escherichia coli CFT073
ccccacggucauaugcaaacca

SEQ ID NO: 668236 - RNA, 14 nt, Escherichia coli CFT073
ccccacucccgcau

SEQ ID NO: 668237 - RNA, 14 nt, Escherichia coli CFT073
ccccacugcauggc

SEQ ID NO: 668238 - RNA, 18 nt, Escherichia coli CFT073
ccccagaauccccacaaa

SEQ ID NO: 668239 - RNA, 22 nt, Escherichia coli CFT073
ccccagaccaauugccgcacca

SEQ ID NO: 668240 - RNA, 18 nt, Escherichia coli CFT073
ccccagacguuucgccag

SEQ ID NO: 668241 - RNA, 22 nt, Escherichia coli CFT073
ccccagacuccagcagugcugc

SEQ ID NO: 668242 - RNA, 22 nt, Escherichia coli CFT073
ccccagacgacggcugccauca

SEQ ID NO: 668243 - RNA, 16 nt, Escherichia coli CFT073
ccccagcggaaaauau

SEQ ID NO: 668244 - RNA, 15 nt, Escherichia coli CFT073
ccccaggcauagaaa

SEQ ID NO: 668245 - RNA, 17 nt, Escherichia coli CFT073
ccccagucuuccugcgg

SEQ ID NO: 668246 - RNA, 20 nt, Escherichia coli CFT073
ccccaguaaacacaccacag

SEQ ID NO: 668247 - RNA, 21 nt, Escherichia coli CFT073
cccacccggggauuugugaug

SEQ ID NO: 668248 - RNA, 13 nt, Escherichia coli CFT073
cccaccagcgccg

SEQ ID NO: 668249 - RNA, 16 nt, Escherichia coli CFT073
cccaccagcgccgccc

SEQ ID NO: 668250 - RNA, 16 nt, Escherichia coli CFT073
cccacgaaaucuucca

SEQ ID NO: 668251 - RNA, 20 nt, Escherichia coli CFT073
cccaccuugcgggcaggcaa

SEQ ID NO: 668252 - RNA, 17 nt, Escherichia coli CFT073
cccaccugcccggcagc

SEQ ID NO: 668253 - RNA, 12 nt, Escherichia coli CFT073
cccacgaccagu

SEQ ID NO: 668254 - RNA, 14 nt, Escherichia coli CFT073
cccaccugcgguuc

SEQ ID NO: 668255 - RNA, 17 nt, Escherichia coli CFT073
cccaccgccaggcacuu

SEQ ID NO: 668256 - RNA, 21 nt, Escherichia coli CFT073
cccacauguugcgcuucacca

SEQ ID NO: 668257 - RNA, 14 nt, Escherichia coli CFT073
cccaccagcaaaua

SEQ ID NO: 668258 - RNA, 21 nt, Escherichia coli CFT073
cccaccaccgcuaacugcugc

SEQ ID NO: 668259 - RNA, 21 nt, Escherichia coli CFT073
cccacauauguuuaaccggca

SEQ ID NO: 668260 - RNA, 22 nt, Escherichia coli CFT073
cccacauauguuuaaccggcag

SEQ ID NO: 668261 - RNA, 19 nt, Escherichia coli CFT073
cccacaguuucauaucugc

SEQ ID NO: 668262 - RNA, 14 nt, Escherichia coli CFT073
cccacagcgcgucu

SEQ ID NO: 668263 - RNA, 16 nt, Escherichia coli CFT073
cccacaccacgccacu

SEQ ID NO: 668264 - RNA, 22 nt, Escherichia coli CFT073
cccacaccgcccagcgagcugg

SEQ ID NO: 668265 - RNA, 19 nt, Escherichia coli CFT073
cccacaccugacaauccga

SEQ ID NO: 668266 - RNA, 20 nt, Escherichia coli CFT073
cccacagacccagguagaca

SEQ ID NO: 668267 - RNA, 12 nt, Escherichia coli CFT073
cccacagagugg

SEQ ID NO: 668268 - RNA, 12 nt, Escherichia coli CFT073
cccacagcaccg

SEQ ID NO: 668269 - RNA, 14 nt, Escherichia coli CFT073
cccacagcgcacca

SEQ ID NO: 668270 - RNA, 16 nt, Escherichia coli CFT073
cccacagcgcaccaac

SEQ ID NO: 668271 - RNA, 17 nt, Escherichia coli CFT073
cccacagcgcaccaacg

SEQ ID NO: 668272 - RNA, 20 nt, Escherichia coli CFT073
cccacuguuugaucugcugc

SEQ ID NO: 668273 - RNA, 15 nt, Escherichia coli CFT073
cccacucaucaagca

SEQ ID NO: 668274 - RNA, 19 nt, Escherichia coli CFT073
cccacuauuggaugacaaa

SEQ ID NO: 668275 - RNA, 18 nt, Escherichia coli CFT073
cccagaccugcguucagc

SEQ ID NO: 668276 - RNA, 13 nt, Escherichia coli CFT073
cccagaucagacc

SEQ ID NO: 668277 - RNA, 22 nt, Escherichia coli CFT073
cccagcaucacgcccgcuuuuu

SEQ ID NO: 668278 - RNA, 18 nt, Escherichia coli CFT073
cccacgcaaaccaccugg

SEQ ID NO: 668279 - RNA, 18 nt, Escherichia coli CFT073
cccacgcacagaacaaaa

SEQ ID NO: 668280 - RNA, 20 nt, Escherichia coli CFT073
cccacggauagauuuuuaau

SEQ ID NO: 668281 - RNA, 19 nt, Escherichia coli CFT073
cccacggguggucuucaua

SEQ ID NO: 668282 - RNA, 16 nt, Escherichia coli CFT073
cccacgggacgcugca

SEQ ID NO: 668283 - RNA, 21 nt, Escherichia coli CFT073
cccacggcggugucgccagaa

SEQ ID NO: 668284 - RNA, 13 nt, Escherichia coli CFT073
ccauuuaaacuca

SEQ ID NO: 668285 - RNA, 19 nt, Escherichia coli CFT073
ccauuguuggcgaugagau

SEQ ID NO: 668286 - RNA, 13 nt, Escherichia coli CFT073
ccauuguuagcaa

SEQ ID NO: 668287 - RNA, 21 nt, Escherichia coli CFT073
ccauuggugcuguucugccgg

SEQ ID NO: 668288 - RNA, 23 nt, Escherichia coli CFT073
ccauugcacgcgaccgucuuuau

SEQ ID NO: 668289 - RNA, 15 nt, Escherichia coli CFT073
ccauuccaccauaca

SEQ ID NO: 668290 - RNA, 16 nt, Escherichia coli CFT073
ccauucuuucccagca

SEQ ID NO: 668291 - RNA, 12 nt, Escherichia coli CFT073
ccauucacaauu

SEQ ID NO: 668292 - RNA, 22 nt, Escherichia coli CFT073
ccauucacacuccagucccagu

SEQ ID NO: 668293 - RNA, 21 nt, Escherichia coli CFT073
ccauucagauugauguuacca

SEQ ID NO: 668294 - RNA, 21 nt, Escherichia coli CFT073
ccauucaaggacaaaccggcu

SEQ ID NO: 668295 - RNA, 20 nt, Escherichia coli CFT073
ccauuauuuucgucagcucc

SEQ ID NO: 668296 - RNA, 16 nt, Escherichia coli CFT073
ccaugcuguucgcaac

SEQ ID NO: 668297 - RNA, 18 nt, Escherichia coli CFT073
ccaugcuuguuuauuauc

SEQ ID NO: 668298 - RNA, 21 nt, Escherichia coli CFT073
ccaugcgcccaucggaccauu

SEQ ID NO: 668299 - RNA, 13 nt, Escherichia coli CFT073
ccaugcggcaucu

SEQ ID NO: 668300 - RNA, 22 nt, Escherichia coli CFT073
ccaugcgcgccggacgcaccuu

SEQ ID NO: 668301 - RNA, 15 nt, Escherichia coli CFT073
cccaacaacagcgcg

SEQ ID NO: 668302 - RNA, 23 nt, Escherichia coli CFT073
cccaaagaucaacugccgccugg

SEQ ID NO: 668303 - RNA, 12 nt, Escherichia coli CFT073
cccaaaccgccc

SEQ ID NO: 668304 - RNA, 23 nt, Escherichia coli CFT073
cccaaaaugucggaugcgacgcu

SEQ ID NO: 668305 - RNA, 19 nt, Escherichia coli CFT073
ccauuucauugagucgcuu

SEQ ID NO: 668306 - RNA, 13 nt, Escherichia coli CFT073
ccauuucaaugcg

SEQ ID NO: 668307 - RNA, 23 nt, Escherichia coli CFT073
cccaaaaaaucaacgacaaaaau

SEQ ID NO: 668308 - RNA, 13 nt, Escherichia coli CFT073
cccaauaccuuca

SEQ ID NO: 668309 - RNA, 17 nt, Escherichia coli CFT073
cccaauaccuucaucga

SEQ ID NO: 668310 - RNA, 22 nt, Escherichia coli CFT073
cccaauacgauuaacgccagac

SEQ ID NO: 668311 - RNA, 15 nt, Escherichia coli CFT073
cccaauauacaaaua

SEQ ID NO: 668312 - RNA, 12 nt, Escherichia coli CFT073
cccaauccacgc

SEQ ID NO: 668313 - RNA, 18 nt, Escherichia coli CFT073
cccaauucuuccugggua

SEQ ID NO: 668314 - RNA, 15 nt, Escherichia coli CFT073
cccaauucauacaug

SEQ ID NO: 668315 - RNA, 14 nt, Escherichia coli CFT073
cccacaagcccgcc

SEQ ID NO: 668316 - RNA, 15 nt, Escherichia coli CFT073
cccacaagcccgcca

SEQ ID NO: 668317 - RNA, 18 nt, Escherichia coli CFT073
cccacaacauugcgccuc

SEQ ID NO: 668318 - RNA, 24 nt, Escherichia coli CFT073
aaacaagacaucacucacgacaca

SEQ ID NO: 668319 - RNA, 17 nt, Escherichia coli CFT073
ccaucaggcagaacacc

SEQ ID NO: 668320 - RNA, 19 nt, Escherichia coli CFT073
ccaucaggcagaacaccgg

SEQ ID NO: 668321 - RNA, 23 nt, Escherichia coli CFT073
ccaucaggcagauacaaccaauc

SEQ ID NO: 668322 - RNA, 12 nt, Escherichia coli CFT073
ccaucagcagcg

SEQ ID NO: 668323 - RNA, 14 nt, Escherichia coli CFT073
ccaucagcaguacg

SEQ ID NO: 668324 - RNA, 17 nt, Escherichia coli CFT073
ccaucagccagccccau

SEQ ID NO: 668325 - RNA, 20 nt, Escherichia coli CFT073
ccaucagcgccaucgccagg

SEQ ID NO: 668326 - RNA, 14 nt, Escherichia coli CFT073
ccaucagaccagac

SEQ ID NO: 668327 - RNA, 19 nt, Escherichia coli CFT073
ccaucagacuuugcgccau

SEQ ID NO: 668328 - RNA, 14 nt, Escherichia coli CFT073
ccaucaccgccagg

SEQ ID NO: 668329 - RNA, 13 nt, Escherichia coli CFT073
ccaucaccucuuc

SEQ ID NO: 668330 - RNA, 18 nt, Escherichia coli CFT073
ccaucaccugacagcaga

SEQ ID NO: 668331 - RNA, 21 nt, Escherichia coli CFT073
ccaucaccugacagcagagca

SEQ ID NO: 668332 - RNA, 22 nt, Escherichia coli CFT073
aaacaaguucuucgaagcacuc

SEQ ID NO: 668333 - RNA, 11 nt, Escherichia coli CFT073
aaacaauaaua

SEQ ID NO: 668334 - RNA, 16 nt, Escherichia coli CFT073
aaacaauaauauugcu

SEQ ID NO: 668335 - RNA, 13 nt, Escherichia coli CFT073
ccaucauccugau

SEQ ID NO: 668336 - RNA, 15 nt, Escherichia coli CFT073
ccaucaugcgccagg

SEQ ID NO: 668337 - RNA, 19 nt, Escherichia coli CFT073
ccaucauuaugagugaugu

SEQ ID NO: 668338 - RNA, 21 nt, Escherichia coli CFT073
ccauccccaaaaaaucaacga

SEQ ID NO: 668339 - RNA, 12 nt, Escherichia coli CFT073
ccaucuccagcu

SEQ ID NO: 668340 - RNA, 15 nt, Escherichia coli CFT073
ccaucuccaucaucu

SEQ ID NO: 668341 - RNA, 19 nt, Escherichia coli CFT073
ccaucuccuuacugccccc

SEQ ID NO: 668342 - RNA, 21 nt, Escherichia coli CFT073
ccaucguugagcaucugcaaa

SEQ ID NO: 668343 - RNA, 19 nt, Escherichia coli CFT073
ccaucguuaaaaaacagug

SEQ ID NO: 668344 - RNA, 20 nt, Escherichia coli CFT073
ccaucccuuucgccugcaaa

SEQ ID NO: 668345 - RNA, 23 nt, Escherichia coli CFT073
ccauccgagcagcaaugcuuacu

SEQ ID NO: 668346 - RNA, 16 nt, Escherichia coli CFT073
ccauccgcccacacca

SEQ ID NO: 668347 - RNA, 18 nt, Escherichia coli CFT073
ccaucgaaccaucggcuu

SEQ ID NO: 668348 - RNA, 15 nt, Escherichia coli CFT073
ccaucgauacccaga

SEQ ID NO: 668349 - RNA, 17 nt, Escherichia coli CFT073
ccaucgauacccagaca

SEQ ID NO: 668350 - RNA, 13 nt, Escherichia coli CFT073
ccaucgacuucuc

SEQ ID NO: 668351 - RNA, 14 nt, Escherichia coli CFT073
ccaucgacuucucg

SEQ ID NO: 668352 - RNA, 21 nt, Escherichia coli CFT073
ccaucgacgaaauggugugca

SEQ ID NO: 668353 - RNA, 16 nt, Escherichia coli CFT073
ccaucgacaccagcca

SEQ ID NO: 668354 - RNA, 16 nt, Escherichia coli CFT073
ccaucgacgaaauggu

SEQ ID NO: 668355 - RNA, 23 nt, Escherichia coli CFT073
ccaugaucugcaaauucaauaaa

SEQ ID NO: 668356 - RNA, 15 nt, Escherichia coli CFT073
ccaugccuuguuuaa

SEQ ID NO: 668357 - RNA, 20 nt, Escherichia coli CFT073
ccaugccuucauaaugaaug

SEQ ID NO: 668358 - RNA, 23 nt, Escherichia coli CFT073
ccaugauuucguauacugcagcg

SEQ ID NO: 668359 - RNA, 16 nt, Escherichia coli CFT073
ccaucugccagcaagc

SEQ ID NO: 668360 - RNA, 13 nt, Escherichia coli CFT073
ccaucuuccagca

SEQ ID NO: 668361 - RNA, 18 nt, Escherichia coli CFT073
ccaucucuugcggcagaa

SEQ ID NO: 668362 - RNA, 21 nt, Escherichia coli CFT073
ccaucucugcaacgucuuccc

SEQ ID NO: 668363 - RNA, 16 nt, Escherichia coli CFT073
ccaucuggcuccuguu

SEQ ID NO: 668364 - RNA, 16 nt, Escherichia coli CFT073
ccaucugauucuuccc

SEQ ID NO: 668365 - RNA, 18 nt, Escherichia coli CFT073
ccaucugaugauauuuuu

SEQ ID NO: 668366 - RNA, 23 nt, Escherichia coli CFT073
ccaguuuaucaaugacaucugca

SEQ ID NO: 668367 - RNA, 12 nt, Escherichia coli CFT073
ccaguuucacag

SEQ ID NO: 668368 - RNA, 14 nt, Escherichia coli CFT073
ccaguuucacagga

SEQ ID NO: 668369 - RNA, 22 nt, Escherichia coli CFT073
ccaguugagcggauucgcguuu

SEQ ID NO: 668370 - RNA, 14 nt, Escherichia coli CFT073
ccaguucgcuuuga

SEQ ID NO: 668371 - RNA, 20 nt, Escherichia coli CFT073
ccaguucgcuuugaaugugc

SEQ ID NO: 668372 - RNA, 22 nt, Escherichia coli CFT073
ccaguucgauguugugaauauu

SEQ ID NO: 668373 - RNA, 14 nt, Escherichia coli CFT073
ccaguuucuguacc

SEQ ID NO: 668374 - RNA, 19 nt, Escherichia coli CFT073
ccaguuucuucaggccagc

SEQ ID NO: 668375 - RNA, 16 nt, Escherichia coli CFT073
ccaguuuggucuggca

SEQ ID NO: 668376 - RNA, 19 nt, Escherichia coli CFT073
ccauaaaccgcaucaugua

SEQ ID NO: 668377 - RNA, 19 nt, Escherichia coli CFT073
ccauaacccacaccauaau

SEQ ID NO: 668378 - RNA, 14 nt, Escherichia coli CFT073
ccauaacaaauauc

SEQ ID NO: 668379 - RNA, 12 nt, Escherichia coli CFT073
ccagugcuccac

SEQ ID NO: 668380 - RNA, 16 nt, Escherichia coli CFT073
ccagugguacaaaagc

SEQ ID NO: 668381 - RNA, 17 nt, Escherichia coli CFT073
ccagugguacaaaagca

SEQ ID NO: 668382 - RNA, 23 nt, Escherichia coli CFT073
ccaguuccuuaacuucaucggca

SEQ ID NO: 668383 - RNA, 14 nt, Escherichia coli CFT073
ccaguguucuuccg

SEQ ID NO: 668384 - RNA, 14 nt, Escherichia coli CFT073
ccaguguuguauuc

SEQ ID NO: 668385 - RNA, 18 nt, Escherichia coli CFT073
ccauaucgcuggcugcag

SEQ ID NO: 668386 - RNA, 23 nt, Escherichia coli CFT073
ccauauccaccggaauggucagu

SEQ ID NO: 668387 - RNA, 18 nt, Escherichia coli CFT073
ccauaucugguuaaaaaa

SEQ ID NO: 668388 - RNA, 15 nt, Escherichia coli CFT073
ccaucaaaucacuaa

SEQ ID NO: 668389 - RNA, 13 nt, Escherichia coli CFT073
ccaucaaaucugc

SEQ ID NO: 668390 - RNA, 13 nt, Escherichia coli CFT073
ccaucaaaugcgc

SEQ ID NO: 668391 - RNA, 15 nt, Escherichia coli CFT073
ccaucaaccuucaca

SEQ ID NO: 668392 - RNA, 13 nt, Escherichia coli CFT073
ccaucaacgccag

SEQ ID NO: 668393 - RNA, 18 nt, Escherichia coli CFT073
ccauaucgccauugcugg

SEQ ID NO: 668394 - RNA, 13 nt, Escherichia coli CFT073
ccauauagcgcac

SEQ ID NO: 668395 - RNA, 16 nt, Escherichia coli CFT073
ccauauaacguccagu

SEQ ID NO: 668396 - RNA, 14 nt, Escherichia coli CFT073
ccaucaaucccauc

SEQ ID NO: 668397 - RNA, 15 nt, Escherichia coli CFT073
ccaucaaucuucacg

SEQ ID NO: 668398 - RNA, 21 nt, Escherichia coli CFT073
ccaucaaucuucacgcgcaga

SEQ ID NO: 668399 - RNA, 13 nt, Escherichia coli CFT073
ccaucacaauuca

SEQ ID NO: 668400 - RNA, 13 nt, Escherichia coli CFT073
ccaucaauugcuc

SEQ ID NO: 668401 - RNA, 11 nt, Escherichia coli CFT073
ccaucacccaa

SEQ ID NO: 668402 - RNA, 22 nt, Escherichia coli CFT073
ccaucaccaacgauuuuuuccg

SEQ ID NO: 668403 - RNA, 23 nt, Escherichia coli CFT073
ccauauaaacauaucacuuuuau

SEQ ID NO: 668404 - RNA, 22 nt, Escherichia coli CFT073
ccauaguguguuccucugcucc

SEQ ID NO: 668405 - RNA, 18 nt, Escherichia coli CFT073
ccauaauccaugccaacg

SEQ ID NO: 668406 - RNA, 23 nt, Escherichia coli CFT073
ccauacucguugacgaccagucc

SEQ ID NO: 668407 - RNA, 21 nt, Escherichia coli CFT073
ccauaacgacccaacuuuguu

SEQ ID NO: 668408 - RNA, 18 nt, Escherichia coli CFT073
ccauaaccgccagcacag

SEQ ID NO: 668409 - RNA, 12 nt, Escherichia coli CFT073
ccauaacggcug

SEQ ID NO: 668410 - RNA, 16 nt, Escherichia coli CFT073
ccauaauacugacaaa

SEQ ID NO: 668411 - RNA, 16 nt, Escherichia coli CFT073
ccauaaucaaauaaau

SEQ ID NO: 668412 - RNA, 21 nt, Escherichia coli CFT073
ccauaaucacucuuccccgcu

SEQ ID NO: 668413 - RNA, 15 nt, Escherichia coli CFT073
ccacucuuucagcac

SEQ ID NO: 668414 - RNA, 19 nt, Escherichia coli CFT073
ccacucgggagagccccag

SEQ ID NO: 668415 - RNA, 20 nt, Escherichia coli CFT073
ccacucgggagagccccagc

SEQ ID NO: 668416 - RNA, 22 nt, Escherichia coli CFT073
ccacugacgggaaacucugcug

SEQ ID NO: 668417 - RNA, 16 nt, Escherichia coli CFT073
ccagccgguaaggcca

SEQ ID NO: 668418 - RNA, 19 nt, Escherichia coli CFT073
ccagccuacagaacgcugc

SEQ ID NO: 668419 - RNA, 22 nt, Escherichia coli CFT073
ccagccugaacgagaaaagcca

SEQ ID NO: 668420 - RNA, 15 nt, Escherichia coli CFT073
ccagccgugaauggu

SEQ ID NO: 668421 - RNA, 23 nt, Escherichia coli CFT073
ccagccguuauguugauucauuu

SEQ ID NO: 668422 - RNA, 18 nt, Escherichia coli CFT073
ccagcgacagccagccca

SEQ ID NO: 668423 - RNA, 15 nt, Escherichia coli CFT073
ccagcgaaaccugaa

SEQ ID NO: 668424 - RNA, 18 nt, Escherichia coli CFT073
ccagccuuuccagcaauc

SEQ ID NO: 668425 - RNA, 15 nt, Escherichia coli CFT073
ccagcgccaaagcca

SEQ ID NO: 668426 - RNA, 17 nt, Escherichia coli CFT073
ccagcgcacuacgccgc

SEQ ID NO: 668427 - RNA, 16 nt, Escherichia coli CFT073
ccagcgcagacggcgc

SEQ ID NO: 668428 - RNA, 15 nt, Escherichia coli CFT073
ccagcgcacagagca

SEQ ID NO: 668429 - RNA, 15 nt, Escherichia coli CFT073
ccagcgauccgggua

SEQ ID NO: 668430 - RNA, 14 nt, Escherichia coli CFT073
ccagcgccugcgcg

SEQ ID NO: 668431 - RNA, 16 nt, Escherichia coli CFT073
ccagcgcgaccgccau

SEQ ID NO: 668432 - RNA, 22 nt, Escherichia coli CFT073
ccagcgccaucucuucugcgcu

SEQ ID NO: 668433 - RNA, 18 nt, Escherichia coli CFT073
ccagcgccgccagaauca

SEQ ID NO: 668434 - RNA, 12 nt, Escherichia coli CFT073
ccagcgccgccc

SEQ ID NO: 668435 - RNA, 15 nt, Escherichia coli CFT073
ccagcgccaucucuu

SEQ ID NO: 668436 - RNA, 23 nt, Escherichia coli CFT073
ccagcgccccuggcgcagcacga

SEQ ID NO: 668437 - RNA, 14 nt, Escherichia coli CFT073
ccagcgcccgcuuc

SEQ ID NO: 668438 - RNA, 22 nt, Escherichia coli CFT073
ccagcuccgggcugguuuucag

SEQ ID NO: 668439 - RNA, 18 nt, Escherichia coli CFT073
ccagcuccguccagccac

SEQ ID NO: 668440 - RNA, 21 nt, Escherichia coli CFT073
ccagcucaagugccagaucag

SEQ ID NO: 668441 - RNA, 20 nt, Escherichia coli CFT073
ccagcguuauaaaacacauu

SEQ ID NO: 668442 - RNA, 18 nt, Escherichia coli CFT073
ccagcguuuccagcacca

SEQ ID NO: 668443 - RNA, 21 nt, Escherichia coli CFT073
ccagcguuuccagcaccaguu

SEQ ID NO: 668444 - RNA, 12 nt, Escherichia coli CFT073
ccagcuaccaga

SEQ ID NO: 668445 - RNA, 18 nt, Escherichia coli CFT073
ccagcgucgggccacgcu

SEQ ID NO: 668446 - RNA, 21 nt, Escherichia coli CFT073
ccagcgugucgagcauugcca

SEQ ID NO: 668447 - RNA, 15 nt, Escherichia coli CFT073
ccagcguuacccaga

SEQ ID NO: 668448 - RNA, 15 nt, Escherichia coli CFT073
ccagcguuaccggcu

SEQ ID NO: 668449 - RNA, 17 nt, Escherichia coli CFT073
ccagcguggucauggca

SEQ ID NO: 668450 - RNA, 18 nt, Escherichia coli CFT073
ccagcguagugaaggcaa

SEQ ID NO: 668451 - RNA, 17 nt, Escherichia coli CFT073
ccagcggugaaaacggc

SEQ ID NO: 668452 - RNA, 15 nt, Escherichia coli CFT073
ccagcgguuggagca

SEQ ID NO: 668453 - RNA, 18 nt, Escherichia coli CFT073
ccagcggacggcugauau

SEQ ID NO: 668454 - RNA, 20 nt, Escherichia coli CFT073
ccagcggccagacgcgccgc

SEQ ID NO: 668455 - RNA, 16 nt, Escherichia coli CFT073
ccagcggguaaacagc

SEQ ID NO: 668456 - RNA, 13 nt, Escherichia coli CFT073
ccagcggaauaga

SEQ ID NO: 668457 - RNA, 17 nt, Escherichia coli CFT073
ccagcgcuucgcucccc

SEQ ID NO: 668458 - RNA, 17 nt, Escherichia coli CFT073
ccagcgcuuugauggca

SEQ ID NO: 668459 - RNA, 17 nt, Escherichia coli CFT073
ccagcggaaaauaucac

SEQ ID NO: 668460 - RNA, 14 nt, Escherichia coli CFT073
ccagcgcguucugu

SEQ ID NO: 668461 - RNA, 16 nt, Escherichia coli CFT073
ccagcgcugcccacca

SEQ ID NO: 668462 - RNA, 17 nt, Escherichia coli CFT073
ccagcgcugcccaccac

SEQ ID NO: 668463 - RNA, 20 nt, Escherichia coli CFT073
ccagcgcugcggccugcugc

SEQ ID NO: 668464 - RNA, 16 nt, Escherichia coli CFT073
ccagcgcgcggcuggc

SEQ ID NO: 668465 - RNA, 12 nt, Escherichia coli CFT073
ccagcgcgcgca

SEQ ID NO: 668466 - RNA, 18 nt, Escherichia coli CFT073
ccagcgcgauacaggcca

SEQ ID NO: 668467 - RNA, 20 nt, Escherichia coli CFT073
ccagcgcgauacaggccacc

SEQ ID NO: 668468 - RNA, 18 nt, Escherichia coli CFT073
ccagcgcgaacauuucau

SEQ ID NO: 668469 - RNA, 21 nt, Escherichia coli CFT073
ccaggcgcugaacuuccggga

SEQ ID NO: 668470 - RNA, 19 nt, Escherichia coli CFT073
ccaggcgcugcuggagcag

SEQ ID NO: 668471 - RNA, 19 nt, Escherichia coli CFT073
ccaggcgcgagaagaucca

SEQ ID NO: 668472 - RNA, 14 nt, Escherichia coli CFT073
ccaggcgcaccagc

SEQ ID NO: 668473 - RNA, 22 nt, Escherichia coli CFT073
ccaggcgaagacaaaaccaacg

SEQ ID NO: 668474 - RNA, 21 nt, Escherichia coli CFT073
ccaggccgauagacacugccg

SEQ ID NO: 668475 - RNA, 22 nt, Escherichia coli CFT073
ccaggccgauagacacugccgc

SEQ ID NO: 668476 - RNA, 18 nt, Escherichia coli CFT073
ccaggccgguaacgcuuu

SEQ ID NO: 668477 - RNA, 15 nt, Escherichia coli CFT073
ccagggauaaagccc

SEQ ID NO: 668478 - RNA, 14 nt, Escherichia coli CFT073
ccagggaagauguu

SEQ ID NO: 668479 - RNA, 15 nt, Escherichia coli CFT073
ccagggaaauaaucg

SEQ ID NO: 668480 - RNA, 13 nt, Escherichia coli CFT073
ccaggcuucauac

SEQ ID NO: 668481 - RNA, 20 nt, Escherichia coli CFT073
ccaggcuuuaccuucagacu

SEQ ID NO: 668482 - RNA, 16 nt, Escherichia coli CFT073
ccaggcuggucgcgcg

SEQ ID NO: 668483 - RNA, 20 nt, Escherichia coli CFT073
ccaggcuuacacuuccuuua

SEQ ID NO: 668484 - RNA, 23 nt, Escherichia coli CFT073
ccaggcuacgccagauccgccau

SEQ ID NO: 668485 - RNA, 21 nt, Escherichia coli CFT073
ccagguauugagggaagcggg

SEQ ID NO: 668486 - RNA, 13 nt, Escherichia coli CFT073
ccaggucaauccc

SEQ ID NO: 668487 - RNA, 15 nt, Escherichia coli CFT073
ccaggucaaucccag

SEQ ID NO: 668488 - RNA, 19 nt, Escherichia coli CFT073
ccaggucagagagccagcc

SEQ ID NO: 668489 - RNA, 20 nt, Escherichia coli CFT073
ccaggucagagagccagccc

SEQ ID NO: 668490 - RNA, 15 nt, Escherichia coli CFT073
ccaggggcuggugcc

SEQ ID NO: 668491 - RNA, 16 nt, Escherichia coli CFT073
ccagggcuuuauucac

SEQ ID NO: 668492 - RNA, 19 nt, Escherichia coli CFT073
ccagcuuuuuuggcagcgu

SEQ ID NO: 668493 - RNA, 18 nt, Escherichia coli CFT073
ccagcuuuuguugucacc

SEQ ID NO: 668494 - RNA, 20 nt, Escherichia coli CFT073
ccagcuucaucaucgcagau

SEQ ID NO: 668495 - RNA, 13 nt, Escherichia coli CFT073
ccaggaaacccaa

SEQ ID NO: 668496 - RNA, 16 nt, Escherichia coli CFT073
ccaggaacaacgacag

SEQ ID NO: 668497 - RNA, 23 nt, Escherichia coli CFT073
ccaggaaccugugacagcagcgg

SEQ ID NO: 668498 - RNA, 15 nt, Escherichia coli CFT073
ccaggaacagugaaa

SEQ ID NO: 668499 - RNA, 21 nt, Escherichia coli CFT073
ccaggaacgcgccaagauaga

SEQ ID NO: 668500 - RNA, 13 nt, Escherichia coli CFT073
ccaggaacucagc

SEQ ID NO: 668501 - RNA, 12 nt, Escherichia coli CFT073
ccaggaagccuu

SEQ ID NO: 668502 - RNA, 13 nt, Escherichia coli CFT073
ccaggaagccuuc

SEQ ID NO: 668503 - RNA, 18 nt, Escherichia coli CFT073
ccagcucugcgcccugca

SEQ ID NO: 668504 - RNA, 21 nt, Escherichia coli CFT073
ccagcuguccgauuuguucuc

SEQ ID NO: 668505 - RNA, 16 nt, Escherichia coli CFT073
ccagcuguucgcgcac

SEQ ID NO: 668506 - RNA, 22 nt, Escherichia coli CFT073
ccagcuuaauucuguccuccau

SEQ ID NO: 668507 - RNA, 19 nt, Escherichia coli CFT073
ccagcugcggugguaucga

SEQ ID NO: 668508 - RNA, 21 nt, Escherichia coli CFT073
ccagcugccgaaccacugaug

SEQ ID NO: 668509 - RNA, 15 nt, Escherichia coli CFT073
ccaggacgauaaacc

SEQ ID NO: 668510 - RNA, 16 nt, Escherichia coli CFT073
ccaggagguauuauuc

SEQ ID NO: 668511 - RNA, 19 nt, Escherichia coli CFT073
ccaggagucuuucagacug

SEQ ID NO: 668512 - RNA, 23 nt, Escherichia coli CFT073
ccaggagucuuucagacugagau

SEQ ID NO: 668513 - RNA, 19 nt, Escherichia coli CFT073
ccaggaguuacugcaacga

SEQ ID NO: 668514 - RNA, 15 nt, Escherichia coli CFT073
ccaggauagaaaacg

SEQ ID NO: 668515 - RNA, 13 nt, Escherichia coli CFT073
ccaggcaaaccag

SEQ ID NO: 668516 - RNA, 21 nt, Escherichia coli CFT073
ccaggcaagaauccgccccgc

SEQ ID NO: 668517 - RNA, 16 nt, Escherichia coli CFT073
ccaggcaauaaacauc

SEQ ID NO: 668518 - RNA, 17 nt, Escherichia coli CFT073
ccaggcagcgauuaacu

SEQ ID NO: 668519 - RNA, 14 nt, Escherichia coli CFT073
ccaggcacuggccu

SEQ ID NO: 668520 - RNA, 13 nt, Escherichia coli CFT073
ccaggcauccagu

SEQ ID NO: 668521 - RNA, 18 nt, Escherichia coli CFT073
ccaggcauccaguugcau

SEQ ID NO: 668522 - RNA, 11 nt, Escherichia coli CFT073
ccaggcaucca

SEQ ID NO: 668523 - RNA, 13 nt, Escherichia coli CFT073
ccaggcaguuuau

SEQ ID NO: 668524 - RNA, 14 nt, Escherichia coli CFT073
ccaggcauagaaaa

SEQ ID NO: 668525 - RNA, 17 nt, Escherichia coli CFT073
ccaggcauagaaaaaga

SEQ ID NO: 668526 - RNA, 17 nt, Escherichia coli CFT073
ccaggcaucagauuguu

SEQ ID NO: 668527 - RNA, 20 nt, Escherichia coli CFT073
ccaggccacucaugccuuuc

SEQ ID NO: 668528 - RNA, 16 nt, Escherichia coli CFT073
cgaggaauucagcgug

SEQ ID NO: 668529 - RNA, 22 nt, Escherichia coli CFT073
cgaggaggacuauuuacagauu

SEQ ID NO: 668530 - RNA, 16 nt, Escherichia coli CFT073
cgaggcaaugccccag

SEQ ID NO: 668531 - RNA, 16 nt, Escherichia coli CFT073
cgaggcaaccagcacg

SEQ ID NO: 668532 - RNA, 20 nt, Escherichia coli CFT073
cgaggauucgaaccucggaa

SEQ ID NO: 668533 - RNA, 14 nt, Escherichia coli CFT073
cgaggccaauuugg

SEQ ID NO: 668534 - RNA, 20 nt, Escherichia coli CFT073
cgaggccaauuuggcugcca

SEQ ID NO: 668535 - RNA, 18 nt, Escherichia coli CFT073
cgaggccauauuucacau

SEQ ID NO: 668536 - RNA, 18 nt, Escherichia coli CFT073
cgaggcucugauugccuu

SEQ ID NO: 668537 - RNA, 21 nt, Escherichia coli CFT073
cgaggcucugauugccuucca

SEQ ID NO: 668538 - RNA, 13 nt, Escherichia coli CFT073
aaacgcuggaugu

SEQ ID NO: 668539 - RNA, 21 nt, Escherichia coli CFT073
aaacgcuuauaguaacguuug

SEQ ID NO: 668540 - RNA, 17 nt, Escherichia coli CFT073
aaacggaauauccccaa

SEQ ID NO: 668541 - RNA, 14 nt, Escherichia coli CFT073
aaacggaauuuaaa

SEQ ID NO: 668542 - RNA, 17 nt, Escherichia coli CFT073
aaacggaauuuaaauga

SEQ ID NO: 668543 - RNA, 14 nt, Escherichia coli CFT073
aaacgcuucucaag

SEQ ID NO: 668544 - RNA, 14 nt, Escherichia coli CFT073
aaacgcuuuuaacg

SEQ ID NO: 668545 - RNA, 18 nt, Escherichia coli CFT073
aaacggaaagcaacaagu

SEQ ID NO: 668546 - RNA, 22 nt, Escherichia coli CFT073
aaacggaaagcagauaacccag

SEQ ID NO: 668547 - RNA, 15 nt, Escherichia coli CFT073
cgagcuuucuuauuc

SEQ ID NO: 668548 - RNA, 22 nt, Escherichia coli CFT073
cgagcuuauuuguugagcugga

SEQ ID NO: 668549 - RNA, 21 nt, Escherichia coli CFT073
cgagcguugccgcucccggca

SEQ ID NO: 668550 - RNA, 21 nt, Escherichia coli CFT073
cgagcgucauauagccgccuu

SEQ ID NO: 668551 - RNA, 14 nt, Escherichia coli CFT073
cgauaacaaucacc

SEQ ID NO: 668552 - RNA, 21 nt, Escherichia coli CFT073
cgauaacaaucaccaaaccaa

SEQ ID NO: 668553 - RNA, 13 nt, Escherichia coli CFT073
cgauaaagcuggg

SEQ ID NO: 668554 - RNA, 15 nt, Escherichia coli CFT073
cgauaaaagugcaga

SEQ ID NO: 668555 - RNA, 14 nt, Escherichia coli CFT073
cgauaaaauaauca

SEQ ID NO: 668556 - RNA, 14 nt, Escherichia coli CFT073
cgauaaaaucccau

SEQ ID NO: 668557 - RNA, 15 nt, Escherichia coli CFT073
cgaguuuucagcaau

SEQ ID NO: 668558 - RNA, 14 nt, Escherichia coli CFT073
cgauaaccaggcag

SEQ ID NO: 668559 - RNA, 14 nt, Escherichia coli CFT073
cgauaaccccagau

SEQ ID NO: 668560 - RNA, 13 nt, Escherichia coli CFT073
cgauacaccuuca

SEQ ID NO: 668561 - RNA, 22 nt, Escherichia coli CFT073
cgauacaaaaacccgcuucaaa

SEQ ID NO: 668562 - RNA, 13 nt, Escherichia coli CFT073
cgauacaaaagca

SEQ ID NO: 668563 - RNA, 15 nt, Escherichia coli CFT073
cgauacaccuucaca

SEQ ID NO: 668564 - RNA, 21 nt, Escherichia coli CFT073
cgauaauuuacaaucacuuca

SEQ ID NO: 668565 - RNA, 18 nt, Escherichia coli CFT073
cgauaaucaucagacugg

SEQ ID NO: 668566 - RNA, 20 nt, Escherichia coli CFT073
cgauagcgcaccaaccacug

SEQ ID NO: 668567 - RNA, 13 nt, Escherichia coli CFT073
cgauagacacugc

SEQ ID NO: 668568 - RNA, 14 nt, Escherichia coli CFT073
cgauaccaguaaaa

SEQ ID NO: 668569 - RNA, 18 nt, Escherichia coli CFT073
cgauaccaacgcauuuau

SEQ ID NO: 668570 - RNA, 20 nt, Escherichia coli CFT073
cgagguagcgauagaaauca

SEQ ID NO: 668571 - RNA, 13 nt, Escherichia coli CFT073
cgagguuuuccuu

SEQ ID NO: 668572 - RNA, 18 nt, Escherichia coli CFT073
cgaggugucuucgcgcac

SEQ ID NO: 668573 - RNA, 15 nt, Escherichia coli CFT073
cgagguuaauauuuu

SEQ ID NO: 668574 - RNA, 16 nt, Escherichia coli CFT073
cgaguccuuccuggcu

SEQ ID NO: 668575 - RNA, 16 nt, Escherichia coli CFT073
cgaguacaaaaauaag

SEQ ID NO: 668576 - RNA, 19 nt, Escherichia coli CFT073
cgaguaaacaggggcugua

SEQ ID NO: 668577 - RNA, 18 nt, Escherichia coli CFT073
cgagugcauccagugccg

SEQ ID NO: 668578 - RNA, 19 nt, Escherichia coli CFT073
cgagugccagcgagagagc

SEQ ID NO: 668579 - RNA, 17 nt, Escherichia coli CFT073
cgagucgcugagcgugc

SEQ ID NO: 668580 - RNA, 15 nt, Escherichia coli CFT073
cgagucgcugagcgu

SEQ ID NO: 668581 - RNA, 16 nt, Escherichia coli CFT073
cgaguggucuccugga

SEQ ID NO: 668582 - RNA, 18 nt, Escherichia coli CFT073
cgaguguguggaaaacag

SEQ ID NO: 668583 - RNA, 14 nt, Escherichia coli CFT073
aaacgccugcuccu

SEQ ID NO: 668584 - RNA, 20 nt, Escherichia coli CFT073
cgagcgcagcaacaucacgc

SEQ ID NO: 668585 - RNA, 14 nt, Escherichia coli CFT073
cgagcgccagcgaa

SEQ ID NO: 668586 - RNA, 19 nt, Escherichia coli CFT073
aaacgcgucugaccgucuu

SEQ ID NO: 668587 - RNA, 19 nt, Escherichia coli CFT073
aaacgcucauaaauugcag

SEQ ID NO: 668588 - RNA, 21 nt, Escherichia coli CFT073
aaacgcgccagcgucgcaucc

SEQ ID NO: 668589 - RNA, 16 nt, Escherichia coli CFT073
aaacgccuuauccggc

SEQ ID NO: 668590 - RNA, 16 nt, Escherichia coli CFT073
cgagccgguugccuga

SEQ ID NO: 668591 - RNA, 13 nt, Escherichia coli CFT073
cgagcaucaucuu

SEQ ID NO: 668592 - RNA, 17 nt, Escherichia coli CFT073
cgagccaaacgcccagc

SEQ ID NO: 668593 - RNA, 13 nt, Escherichia coli CFT073
cgagccagugccc

SEQ ID NO: 668594 - RNA, 18 nt, Escherichia coli CFT073
cgagaucuuuaauacacg

SEQ ID NO: 668595 - RNA, 23 nt, Escherichia coli CFT073
cgagaucuuuaucaaucaccgcu

SEQ ID NO: 668596 - RNA, 17 nt, Escherichia coli CFT073
cgagauauuuccuuguu

SEQ ID NO: 668597 - RNA, 14 nt, Escherichia coli CFT073
cgagauaaaugcca

SEQ ID NO: 668598 - RNA, 16 nt, Escherichia coli CFT073
cgagauaauggcaaug

SEQ ID NO: 668599 - RNA, 20 nt, Escherichia coli CFT073
cgagauuacuaacaaagugc

SEQ ID NO: 668600 - RNA, 20 nt, Escherichia coli CFT073
cgagauuagacggcgcaaca

SEQ ID NO: 668601 - RNA, 12 nt, Escherichia coli CFT073
cgagauugugaa

SEQ ID NO: 668602 - RNA, 20 nt, Escherichia coli CFT073
cgagcaaaagccuuauccgc

SEQ ID NO: 668603 - RNA, 14 nt, Escherichia coli CFT073
cgagcaacgcagcg

SEQ ID NO: 668604 - RNA, 18 nt, Escherichia coli CFT073
cgagcaauaaacacugcu

SEQ ID NO: 668605 - RNA, 12 nt, Escherichia coli CFT073
cgagcagccacu

SEQ ID NO: 668606 - RNA, 14 nt, Escherichia coli CFT073
cgagcaguacagcc

SEQ ID NO: 668607 - RNA, 23 nt, Escherichia coli CFT073
cgagcaguaauccagcaaacugg

SEQ ID NO: 668608 - RNA, 21 nt, Escherichia coli CFT073
cgagcaggacgcucccucaau

SEQ ID NO: 668609 - RNA, 16 nt, Escherichia coli CFT073
cgacguuuuucaggcu

SEQ ID NO: 668610 - RNA, 17 nt, Escherichia coli CFT073
cgacguuugaugcgucu

SEQ ID NO: 668611 - RNA, 18 nt, Escherichia coli CFT073
cgacguucugccaaacgc

SEQ ID NO: 668612 - RNA, 16 nt, Escherichia coli CFT073
cgacgugcccuuucag

SEQ ID NO: 668613 - RNA, 22 nt, Escherichia coli CFT073
cgaauacgccgauaucgcuggc

SEQ ID NO: 668614 - RNA, 12 nt, Escherichia coli CFT073
cgaauaccccag

SEQ ID NO: 668615 - RNA, 16 nt, Escherichia coli CFT073
cgaauaccuucuuccu

SEQ ID NO: 668616 - RNA, 16 nt, Escherichia coli CFT073
cgaauagaacauaaug

SEQ ID NO: 668617 - RNA, 14 nt, Escherichia coli CFT073
cgacucuguuaugg

SEQ ID NO: 668618 - RNA, 17 nt, Escherichia coli CFT073
cgacugauaucugcccg

SEQ ID NO: 668619 - RNA, 14 nt, Escherichia coli CFT073
cgacugaugaaguc

SEQ ID NO: 668620 - RNA, 23 nt, Escherichia coli CFT073
cgacugcaagccaugacgcacuu

SEQ ID NO: 668621 - RNA, 16 nt, Escherichia coli CFT073
cgacugcgccaauacc

SEQ ID NO: 668622 - RNA, 15 nt, Escherichia coli CFT073
cgacugcgccuucca

SEQ ID NO: 668623 - RNA, 17 nt, Escherichia coli CFT073
cgacucgcgaaucgccg

SEQ ID NO: 668624 - RNA, 15 nt, Escherichia coli CFT073
cgacucguuguguga

SEQ ID NO: 668625 - RNA, 16 nt, Escherichia coli CFT073
cgacguuuuacagcaa

SEQ ID NO: 668626 - RNA, 16 nt, Escherichia coli CFT073
cgacucaaaucacgca

SEQ ID NO: 668627 - RNA, 21 nt, Escherichia coli CFT073
cgagaaaagccaaccugcagg

SEQ ID NO: 668628 - RNA, 20 nt, Escherichia coli CFT073
cgagaaaaucaucugcgccc

SEQ ID NO: 668629 - RNA, 17 nt, Escherichia coli CFT073
cgagaaauugagauaag

SEQ ID NO: 668630 - RNA, 23 nt, Escherichia coli CFT073
cgacuuccugcaaucuuuccugc

SEQ ID NO: 668631 - RNA, 18 nt, Escherichia coli CFT073
cgacuucgauguccgcuc

SEQ ID NO: 668632 - RNA, 14 nt, Escherichia coli CFT073
cgacugucuuccug

SEQ ID NO: 668633 - RNA, 19 nt, Escherichia coli CFT073
cgacuguucgccaaaaggc

SEQ ID NO: 668634 - RNA, 19 nt, Escherichia coli CFT073
cgacuguuuauuguugauu

SEQ ID NO: 668635 - RNA, 23 nt, Escherichia coli CFT073
cgacuuccaccagcggcugaaua

SEQ ID NO: 668636 - RNA, 17 nt, Escherichia coli CFT073
cgagagccuucggcaaa

SEQ ID NO: 668637 - RNA, 22 nt, Escherichia coli CFT073
cgagaaguuuuucgucaccugg

SEQ ID NO: 668638 - RNA, 18 nt, Escherichia coli CFT073
cgagaaugcugaagucga

SEQ ID NO: 668639 - RNA, 15 nt, Escherichia coli CFT073
cgagaaucugccgca

SEQ ID NO: 668640 - RNA, 18 nt, Escherichia coli CFT073
cgagaaugaagucaccaa

SEQ ID NO: 668641 - RNA, 15 nt, Escherichia coli CFT073
cgagacggcggaaag

SEQ ID NO: 668642 - RNA, 22 nt, Escherichia coli CFT073
cgagacgguauuacccggcccc

SEQ ID NO: 668643 - RNA, 22 nt, Escherichia coli CFT073
cgccaauuugucgccaucguua

SEQ ID NO: 668644 - RNA, 12 nt, Escherichia coli CFT073
cgccaaucgcca

SEQ ID NO: 668645 - RNA, 20 nt, Escherichia coli CFT073
cgccaauguacggaauaagu

SEQ ID NO: 668646 - RNA, 13 nt, Escherichia coli CFT073
cgccaccaccagu

SEQ ID NO: 668647 - RNA, 19 nt, Escherichia coli CFT073
cgccaccacaacauuccca

SEQ ID NO: 668648 - RNA, 22 nt, Escherichia coli CFT073
cgcauugagaucuuucgcuuua

SEQ ID NO: 668649 - RNA, 15 nt, Escherichia coli CFT073
cgcauuuacucucau

SEQ ID NO: 668650 - RNA, 13 nt, Escherichia coli CFT073
cgcauugcuggcu

SEQ ID NO: 668651 - RNA, 18 nt, Escherichia coli CFT073
cgcauuaaauaccaagcc

SEQ ID NO: 668652 - RNA, 16 nt, Escherichia coli CFT073
cgcauguuuagucgcc

SEQ ID NO: 668653 - RNA, 23 nt, Escherichia coli CFT073
cgccaaaccgaccaaucacaucg

SEQ ID NO: 668654 - RNA, 14 nt, Escherichia coli CFT073
cgccaaagcggcag

SEQ ID NO: 668655 - RNA, 15 nt, Escherichia coli CFT073
cgccaaagcggcagu

SEQ ID NO: 668656 - RNA, 20 nt, Escherichia coli CFT073
cgccaaauggauaagaaaga

SEQ ID NO: 668657 - RNA, 18 nt, Escherichia coli CFT073
cgccaaauggcaggcaca

SEQ ID NO: 668658 - RNA, 18 nt, Escherichia coli CFT073
cgccaaaaggcaauucaa

SEQ ID NO: 668659 - RNA, 16 nt, Escherichia coli CFT073
cgcauuuucuucauuc

SEQ ID NO: 668660 - RNA, 19 nt, Escherichia coli CFT073
cgccaacucaacgccugcu

SEQ ID NO: 668661 - RNA, 15 nt, Escherichia coli CFT073
cgccaacgucugccu

SEQ ID NO: 668662 - RNA, 19 nt, Escherichia coli CFT073
cgccaacgccugcggcuga

SEQ ID NO: 668663 - RNA, 20 nt, Escherichia coli CFT073
cgccaacaugcgcagaagca

SEQ ID NO: 668664 - RNA, 13 nt, Escherichia coli CFT073
cgccaacagcagc

SEQ ID NO: 668665 - RNA, 13 nt, Escherichia coli CFT073
cgccaaccaggau

SEQ ID NO: 668666 - RNA, 23 nt, Escherichia coli CFT073
cgccaaccaugccgcccagcagc

SEQ ID NO: 668667 - RNA, 16 nt, Escherichia coli CFT073
cgcaucgggcaauggc

SEQ ID NO: 668668 - RNA, 17 nt, Escherichia coli CFT073
cgcaucgcgcaccagcg

SEQ ID NO: 668669 - RNA, 15 nt, Escherichia coli CFT073
cgcaucggucgcguu

SEQ ID NO: 668670 - RNA, 17 nt, Escherichia coli CFT073
cgcaucuuauccggccu

SEQ ID NO: 668671 - RNA, 24 nt, Escherichia coli CFT073
cgcaucuggcauuuugcuuucaau

SEQ ID NO: 668672 - RNA, 17 nt, Escherichia coli CFT073
cgcaucuguaugucagu

SEQ ID NO: 668673 - RNA, 22 nt, Escherichia coli CFT073
cgcaucaggcaaugugcuccau

SEQ ID NO: 668674 - RNA, 21 nt, Escherichia coli CFT073
cgcaucagguaacucagcaca

SEQ ID NO: 668675 - RNA, 16 nt, Escherichia coli CFT073
cgcaucagucacgaca

SEQ ID NO: 668676 - RNA, 16 nt, Escherichia coli CFT073
cgcaucagugaaccca

SEQ ID NO: 668677 - RNA, 18 nt, Escherichia coli CFT073
cgcaucagcagauaccaa

SEQ ID NO: 668678 - RNA, 20 nt, Escherichia coli CFT073
cgcaucagcuuacgcaacuc

SEQ ID NO: 668679 - RNA, 20 nt, Escherichia coli CFT073
cgcaucaugaaacgcccacg

SEQ ID NO: 668680 - RNA, 19 nt, Escherichia coli CFT073
cgcaucgccagacaauggc

SEQ ID NO: 668681 - RNA, 20 nt, Escherichia coli CFT073
cgcaucauuaccggcacugg

SEQ ID NO: 668682 - RNA, 16 nt, Escherichia coli CFT073
cgcaucaccccuuccu

SEQ ID NO: 668683 - RNA, 23 nt, Escherichia coli CFT073
cgcauauuguucugaccaaacaa

SEQ ID NO: 668684 - RNA, 19 nt, Escherichia coli CFT073
aaacgggcugcccggauag

SEQ ID NO: 668685 - RNA, 21 nt, Escherichia coli CFT073
aaacggcaggagagauacccc

SEQ ID NO: 668686 - RNA, 20 nt, Escherichia coli CFT073
aaacggcauaaauuucaggc

SEQ ID NO: 668687 - RNA, 22 nt, Escherichia coli CFT073
aaacggcgucgauugcucaaca

SEQ ID NO: 668688 - RNA, 23 nt, Escherichia coli CFT073
aaacggcguuuuuucaucacugc

SEQ ID NO: 668689 - RNA, 23 nt, Escherichia coli CFT073
cgcagggaucauccacccgcagc

SEQ ID NO: 668690 - RNA, 18 nt, Escherichia coli CFT073
cgcagggcgaauuccuga

SEQ ID NO: 668691 - RNA, 19 nt, Escherichia coli CFT073
cgcagggcgaauuccugac

SEQ ID NO: 668692 - RNA, 14 nt, Escherichia coli CFT073
cgcagaacuucacu

SEQ ID NO: 668693 - RNA, 23 nt, Escherichia coli CFT073
cgcagaaauaccccgccagcaga

SEQ ID NO: 668694 - RNA, 19 nt, Escherichia coli CFT073
cgcagagugcgcagcaucg

SEQ ID NO: 668695 - RNA, 15 nt, Escherichia coli CFT073
cgcagaguuuccagg

SEQ ID NO: 668696 - RNA, 19 nt, Escherichia coli CFT073
cgcagaguuuccaggcugg

SEQ ID NO: 668697 - RNA, 16 nt, Escherichia coli CFT073
cgcagauaagaccaau

SEQ ID NO: 668698 - RNA, 17 nt, Escherichia coli CFT073
cgcagaucccacucauc

SEQ ID NO: 668699 - RNA, 15 nt, Escherichia coli CFT073
cgcagcguccagcgc

SEQ ID NO: 668700 - RNA, 19 nt, Escherichia coli CFT073
cgcagcuuugugcuucagu

SEQ ID NO: 668701 - RNA, 17 nt, Escherichia coli CFT073
cgcagcuccagcccgcg

SEQ ID NO: 668702 - RNA, 22 nt, Escherichia coli CFT073
cgcagcuuugugcuucaguucc

SEQ ID NO: 668703 - RNA, 22 nt, Escherichia coli CFT073
cgcaggcaucuuuuucaaugca

SEQ ID NO: 668704 - RNA, 13 nt, Escherichia coli CFT073
cgcaggccacgaa

SEQ ID NO: 668705 - RNA, 22 nt, Escherichia coli CFT073
cgcaggccacgaaucagcaccg

SEQ ID NO: 668706 - RNA, 12 nt, Escherichia coli CFT073
cgcaggagauug

SEQ ID NO: 668707 - RNA, 20 nt, Escherichia coli CFT073
cgcaggagcgccgaauggau

SEQ ID NO: 668708 - RNA, 14 nt, Escherichia coli CFT073
cgcaggcugauaac

SEQ ID NO: 668709 - RNA, 17 nt, Escherichia coli CFT073
cgcaggcuguuaccccu

SEQ ID NO: 668710 - RNA, 23 nt, Escherichia coli CFT073
cgcaggcuguuaccccugcggcc

SEQ ID NO: 668711 - RNA, 17 nt, Escherichia coli CFT073
cgcaggcuuccuggcuu

SEQ ID NO: 668712 - RNA, 20 nt, Escherichia coli CFT073
cgcaaaucaacuaaaaucaa

SEQ ID NO: 668713 - RNA, 21 nt, Escherichia coli CFT073
cgcaaagggacuuuucaggcu

SEQ ID NO: 668714 - RNA, 17 nt, Escherichia coli CFT073
cgcaaaggccagcaauc

SEQ ID NO: 668715 - RNA, 15 nt, Escherichia coli CFT073
cgcaacagcgcgccc

SEQ ID NO: 668716 - RNA, 13 nt, Escherichia coli CFT073
cgcaacaacacac

SEQ ID NO: 668717 - RNA, 23 nt, Escherichia coli CFT073
cgcaacaauaacccccugcccca

SEQ ID NO: 668718 - RNA, 20 nt, Escherichia coli CFT073
cgcaaccgccaacagcagcc

SEQ ID NO: 668719 - RNA, 18 nt, Escherichia coli CFT073
cgcaagacgaaaaaugaa

SEQ ID NO: 668720 - RNA, 15 nt, Escherichia coli CFT073
cgcaacuuuuucuug

SEQ ID NO: 668721 - RNA, 20 nt, Escherichia coli CFT073
cgcaauuucauuauucauug

SEQ ID NO: 668722 - RNA, 13 nt, Escherichia coli CFT073
cgcaauugcugaa

SEQ ID NO: 668723 - RNA, 14 nt, Escherichia coli CFT073
cgcacaaacgccac

SEQ ID NO: 668724 - RNA, 18 nt, Escherichia coli CFT073
cgcaauuuugacaauaau

SEQ ID NO: 668725 - RNA, 22 nt, Escherichia coli CFT073
cgcacaaccugaguaaaucacc

SEQ ID NO: 668726 - RNA, 19 nt, Escherichia coli CFT073
cgcacguugccagcaacug

SEQ ID NO: 668727 - RNA, 21 nt, Escherichia coli CFT073
cgcacguucugucgcucugcu

SEQ ID NO: 668728 - RNA, 18 nt, Escherichia coli CFT073
cgcacucuacucccugcu

SEQ ID NO: 668729 - RNA, 15 nt, Escherichia coli CFT073
cgcacguuguuaaca

SEQ ID NO: 668730 - RNA, 20 nt, Escherichia coli CFT073
cgcacguuguuaacaaucuu

SEQ ID NO: 668731 - RNA, 23 nt, Escherichia coli CFT073
cgcacuuuucccacuaacugcgc

SEQ ID NO: 668732 - RNA, 13 nt, Escherichia coli CFT073
cgcaccugccagc

SEQ ID NO: 668733 - RNA, 18 nt, Escherichia coli CFT073
cgcaccuacagccaugcg

SEQ ID NO: 668734 - RNA, 13 nt, Escherichia coli CFT073
cgcaccugccagu

SEQ ID NO: 668735 - RNA, 17 nt, Escherichia coli CFT073
cgcaccuucauucaggc

SEQ ID NO: 668736 - RNA, 14 nt, Escherichia coli CFT073
cgcaccaccagcag

SEQ ID NO: 668737 - RNA, 17 nt, Escherichia coli CFT073
cgcaccagaaacaauaa

SEQ ID NO: 668738 - RNA, 12 nt, Escherichia coli CFT073
cgcaccagcagg

SEQ ID NO: 668739 - RNA, 16 nt, Escherichia coli CFT073
cgcaccagcaggccgu

SEQ ID NO: 668740 - RNA, 11 nt, Escherichia coli CFT073
cgcaccaccag

SEQ ID NO: 668741 - RNA, 22 nt, Escherichia coli CFT073
cgcaccaaaguuaaucagcgcc

SEQ ID NO: 668742 - RNA, 13 nt, Escherichia coli CFT073
cgcaccaacgcaa

SEQ ID NO: 668743 - RNA, 20 nt, Escherichia coli CFT073
cgcaccaacuccacuucacc

SEQ ID NO: 668744 - RNA, 16 nt, Escherichia coli CFT073
cgaugggcgucccaga

SEQ ID NO: 668745 - RNA, 20 nt, Escherichia coli CFT073
cgaugggggcaaaaauauau

SEQ ID NO: 668746 - RNA, 16 nt, Escherichia coli CFT073
cgauggcgggccugga

SEQ ID NO: 668747 - RNA, 13 nt, Escherichia coli CFT073
cgauggcuggggu

SEQ ID NO: 668748 - RNA, 19 nt, Escherichia coli CFT073
cgaugcuuugaccucccgc

SEQ ID NO: 668749 - RNA, 15 nt, Escherichia coli CFT073
cgaugcuguuauaca

SEQ ID NO: 668750 - RNA, 23 nt, Escherichia coli CFT073
cgaugcuuuacguauccguucca

SEQ ID NO: 668751 - RNA, 14 nt, Escherichia coli CFT073
cgaucaacagaaug

SEQ ID NO: 668752 - RNA, 15 nt, Escherichia coli CFT073
cgaugaucaaaaaaa

SEQ ID NO: 668753 - RNA, 17 nt, Escherichia coli CFT073
cgaugaucaaaaaaauc

SEQ ID NO: 668754 - RNA, 21 nt, Escherichia coli CFT073
cgauauggccuucuucaucgc

SEQ ID NO: 668755 - RNA, 21 nt, Escherichia coli CFT073
cgauauuacgggucacaaaca

SEQ ID NO: 668756 - RNA, 21 nt, Escherichia coli CFT073
cgauaucguacucgccuauac

SEQ ID NO: 668757 - RNA, 17 nt, Escherichia coli CFT073
cgauaugaccauuggua

SEQ ID NO: 668758 - RNA, 13 nt, Escherichia coli CFT073
cgaugaucgccau

SEQ ID NO: 668759 - RNA, 21 nt, Escherichia coli CFT073
cgaugaugaucggcguaccca

SEQ ID NO: 668760 - RNA, 17 nt, Escherichia coli CFT073
cgaugccugcuuauuaa

SEQ ID NO: 668761 - RNA, 18 nt, Escherichia coli CFT073
cgaugccgcggcgcggcg

SEQ ID NO: 668762 - RNA, 17 nt, Escherichia coli CFT073
cgaugauuuccgccagc

SEQ ID NO: 668763 - RNA, 17 nt, Escherichia coli CFT073
cgaugcaaccgagcgcc

SEQ ID NO: 668764 - RNA, 12 nt, Escherichia coli CFT073
cgauuuucaaaa

SEQ ID NO: 668765 - RNA, 13 nt, Escherichia coli CFT073
cgauuuuuuccag

SEQ ID NO: 668766 - RNA, 16 nt, Escherichia coli CFT073
cgauuuuuuccagcgc

SEQ ID NO: 668767 - RNA, 16 nt, Escherichia coli CFT073
cgcaaaacccgcuucu

SEQ ID NO: 668768 - RNA, 22 nt, Escherichia coli CFT073
cgcaaaacccgcuucuuccagc

SEQ ID NO: 668769 - RNA, 12 nt, Escherichia coli CFT073
cgcaaaacccag

SEQ ID NO: 668770 - RNA, 23 nt, Escherichia coli CFT073
cgcaaacaucggcuuauucauau

SEQ ID NO: 668771 - RNA, 16 nt, Escherichia coli CFT073
cgcaaaauugccugau

SEQ ID NO: 668772 - RNA, 13 nt, Escherichia coli CFT073
cgcaaacaccagc

SEQ ID NO: 668773 - RNA, 17 nt, Escherichia coli CFT073
cgcaaacaccagcugaa

SEQ ID NO: 668774 - RNA, 22 nt, Escherichia coli CFT073
cgcaaaaucucacacugaugau

SEQ ID NO: 668775 - RNA, 22 nt, Escherichia coli CFT073
cgcaaagagagaagccagguag

SEQ ID NO: 668776 - RNA, 20 nt, Escherichia coli CFT073
cgcaaagauaaugacuuccg

SEQ ID NO: 668777 - RNA, 12 nt, Escherichia coli CFT073
cgcaaacugcug

SEQ ID NO: 668778 - RNA, 19 nt, Escherichia coli CFT073
cgcaaacuuugccacaauc

SEQ ID NO: 668779 - RNA, 20 nt, Escherichia coli CFT073
cgcaaaccagacaacaguca

SEQ ID NO: 668780 - RNA, 12 nt, Escherichia coli CFT073
cgauguucaaua

SEQ ID NO: 668781 - RNA, 14 nt, Escherichia coli CFT073
cgauguucaauaaa

SEQ ID NO: 668782 - RNA, 13 nt, Escherichia coli CFT073
cgauugaagcagc

SEQ ID NO: 668783 - RNA, 17 nt, Escherichia coli CFT073
cgauuguacuuuaaaau

SEQ ID NO: 668784 - RNA, 19 nt, Escherichia coli CFT073
cgauuguacuuuaaaauaa

SEQ ID NO: 668785 - RNA, 15 nt, Escherichia coli CFT073
cgccgcggcgcagcu

SEQ ID NO: 668786 - RNA, 15 nt, Escherichia coli CFT073
cgccgcggacaauaa

SEQ ID NO: 668787 - RNA, 22 nt, Escherichia coli CFT073
cgccgcggacaauaauaucuuu

SEQ ID NO: 668788 - RNA, 19 nt, Escherichia coli CFT073
cgccgcguuugcgcagcca

SEQ ID NO: 668789 - RNA, 20 nt, Escherichia coli CFT073
cgccgcguuugcgcagccag

SEQ ID NO: 668790 - RNA, 13 nt, Escherichia coli CFT073
cgccgcuaccggc

SEQ ID NO: 668791 - RNA, 22 nt, Escherichia coli CFT073
cgccgcuaacaugguuaaaauc

SEQ ID NO: 668792 - RNA, 20 nt, Escherichia coli CFT073
cgccgcucggugcgcguggc

SEQ ID NO: 668793 - RNA, 13 nt, Escherichia coli CFT073
cgccgcuuuuucg

SEQ ID NO: 668794 - RNA, 21 nt, Escherichia coli CFT073
cgccggaaagcagcauauaaa

SEQ ID NO: 668795 - RNA, 19 nt, Escherichia coli CFT073
cgccgcuucaucgguuaac

SEQ ID NO: 668796 - RNA, 19 nt, Escherichia coli CFT073
cgccgcugucuaccagcac

SEQ ID NO: 668797 - RNA, 15 nt, Escherichia coli CFT073
cgccgcugguggcga

SEQ ID NO: 668798 - RNA, 19 nt, Escherichia coli CFT073
cgccggauauuccugaaug

SEQ ID NO: 668799 - RNA, 16 nt, Escherichia coli CFT073
cgccggaguacgccau

SEQ ID NO: 668800 - RNA, 15 nt, Escherichia coli CFT073
cgccggcgcaccggu

SEQ ID NO: 668801 - RNA, 12 nt, Escherichia coli CFT073
cgccgguuuugc

SEQ ID NO: 668802 - RNA, 19 nt, Escherichia coli CFT073
cgccguaacugacgggcuu

SEQ ID NO: 668803 - RNA, 22 nt, Escherichia coli CFT073
cgccguagccauuaccaggucg

SEQ ID NO: 668804 - RNA, 13 nt, Escherichia coli CFT073
cgccguaggccau

SEQ ID NO: 668805 - RNA, 23 nt, Escherichia coli CFT073
cgccguaguugcucccauaaugc

SEQ ID NO: 668806 - RNA, 15 nt, Escherichia coli CFT073
cgccgguuggucauu

SEQ ID NO: 668807 - RNA, 19 nt, Escherichia coli CFT073
cgccgggauauaugucacc

SEQ ID NO: 668808 - RNA, 22 nt, Escherichia coli CFT073
cgccgggaugauggcuuuggcg

SEQ ID NO: 668809 - RNA, 21 nt, Escherichia coli CFT073
cgccggcuucaucuuuauuca

SEQ ID NO: 668810 - RNA, 14 nt, Escherichia coli CFT073
cgccgcagccagau

SEQ ID NO: 668811 - RNA, 15 nt, Escherichia coli CFT073
cgccgcagccgcauu

SEQ ID NO: 668812 - RNA, 21 nt, Escherichia coli CFT073
cgccgcagagcgauauccagc

SEQ ID NO: 668813 - RNA, 14 nt, Escherichia coli CFT073
cgccgcacccggca

SEQ ID NO: 668814 - RNA, 16 nt, Escherichia coli CFT073
cgccgcaugugccggg

SEQ ID NO: 668815 - RNA, 22 nt, Escherichia coli CFT073
cgccgcauccgacaucaacgcc

SEQ ID NO: 668816 - RNA, 14 nt, Escherichia coli CFT073
cgccgcauccggcc

SEQ ID NO: 668817 - RNA, 22 nt, Escherichia coli CFT073
cgccgcauccggcgacaggaac

SEQ ID NO: 668818 - RNA, 20 nt, Escherichia coli CFT073
cgccgcaucaggccgccagc

SEQ ID NO: 668819 - RNA, 14 nt, Escherichia coli CFT073
cgccgcccaguccc

SEQ ID NO: 668820 - RNA, 14 nt, Escherichia coli CFT073
cgccgacgcccugc

SEQ ID NO: 668821 - RNA, 22 nt, Escherichia coli CFT073
cgccgaauuaaacaacgccagu

SEQ ID NO: 668822 - RNA, 17 nt, Escherichia coli CFT073
cgccgaauaacgcgcag

SEQ ID NO: 668823 - RNA, 18 nt, Escherichia coli CFT073
cgccgaauaacgcgcagc

SEQ ID NO: 668824 - RNA, 19 nt, Escherichia coli CFT073
cgcccgguggcgguuuugu

SEQ ID NO: 668825 - RNA, 18 nt, Escherichia coli CFT073
cgcccggaaacgggcgcu

SEQ ID NO: 668826 - RNA, 22 nt, Escherichia coli CFT073
cgcccggauauccacccgcagc

SEQ ID NO: 668827 - RNA, 18 nt, Escherichia coli CFT073
cgcccagcgcaggaaaga

SEQ ID NO: 668828 - RNA, 17 nt, Escherichia coli CFT073
cgcccauaacgcgcgcg

SEQ ID NO: 668829 - RNA, 15 nt, Escherichia coli CFT073
cgcccaguagugcgc

SEQ ID NO: 668830 - RNA, 12 nt, Escherichia coli CFT073
cgcccagucacg

SEQ ID NO: 668831 - RNA, 20 nt, Escherichia coli CFT073
cgcccgaccaucgccagcuc

SEQ ID NO: 668832 - RNA, 15 nt, Escherichia coli CFT073
cgccccgcucacgca

SEQ ID NO: 668833 - RNA, 22 nt, Escherichia coli CFT073
cgcccgaugcauaauccgccgc

SEQ ID NO: 668834 - RNA, 21 nt, Escherichia coli CFT073
cgcccgcaaucaacauaaugc

SEQ ID NO: 668835 - RNA, 22 nt, Escherichia coli CFT073
cgcccgcagcggaauaaaaagc

SEQ ID NO: 668836 - RNA, 11 nt, Escherichia coli CFT073
cgcccgccaga

SEQ ID NO: 668837 - RNA, 12 nt, Escherichia coli CFT073
cgcccgccgaga

SEQ ID NO: 668838 - RNA, 13 nt, Escherichia coli CFT073
cgcccgccgagaa

SEQ ID NO: 668839 - RNA, 18 nt, Escherichia coli CFT073
cgccacggaaacauucaa

SEQ ID NO: 668840 - RNA, 23 nt, Escherichia coli CFT073
cgccacggaaacauucaauaagc

SEQ ID NO: 668841 - RNA, 16 nt, Escherichia coli CFT073
cgccacgcugccgcgc

SEQ ID NO: 668842 - RNA, 19 nt, Escherichia coli CFT073
cgccacgcgggaagucacu

SEQ ID NO: 668843 - RNA, 16 nt, Escherichia coli CFT073
cgccaugccaaagaag

SEQ ID NO: 668844 - RNA, 16 nt, Escherichia coli CFT073
cgccaucguugaugca

SEQ ID NO: 668845 - RNA, 23 nt, Escherichia coli CFT073
cgccauggcggauccguugaucg

SEQ ID NO: 668846 - RNA, 13 nt, Escherichia coli CFT073
cgcccagccaucg

SEQ ID NO: 668847 - RNA, 23 nt, Escherichia coli CFT073
cgcccagccugaaugccgcgccc

SEQ ID NO: 668848 - RNA, 15 nt, Escherichia coli CFT073
cgcccagcagcacag

SEQ ID NO: 668849 - RNA, 20 nt, Escherichia coli CFT073
cgcccacgcaccaccagcgc

SEQ ID NO: 668850 - RNA, 17 nt, Escherichia coli CFT073
cgcccacgccagcccgc

SEQ ID NO: 668851 - RNA, 16 nt, Escherichia coli CFT073
cgcgguuucgccgcca

SEQ ID NO: 668852 - RNA, 15 nt, Escherichia coli CFT073
cgcgguuuucuucca

SEQ ID NO: 668853 - RNA, 20 nt, Escherichia coli CFT073
cgcgguuuucuuccagccac

SEQ ID NO: 668854 - RNA, 15 nt, Escherichia coli CFT073
cgcguaaauccagca

SEQ ID NO: 668855 - RNA, 20 nt, Escherichia coli CFT073
cgcguaaauccagcaccgcu

SEQ ID NO: 668856 - RNA, 14 nt, Escherichia coli CFT073
cgcguaacgccaga

SEQ ID NO: 668857 - RNA, 15 nt, Escherichia coli CFT073
cgcguaacuuuugcc

SEQ ID NO: 668858 - RNA, 13 nt, Escherichia coli CFT073
cgcguaccgccga

SEQ ID NO: 668859 - RNA, 16 nt, Escherichia coli CFT073
cgcguacgccgcucga

SEQ ID NO: 668860 - RNA, 15 nt, Escherichia coli CFT073
cgcguagccaggcgg

SEQ ID NO: 668861 - RNA, 22 nt, Escherichia coli CFT073
cgcgucaaguuaagcauuggca

SEQ ID NO: 668862 - RNA, 23 nt, Escherichia coli CFT073
cgcguaguucaggauaauuaucu

SEQ ID NO: 668863 - RNA, 12 nt, Escherichia coli CFT073
cgcguuccugac

SEQ ID NO: 668864 - RNA, 19 nt, Escherichia coli CFT073
cgcguucgauagcgcgcca

SEQ ID NO: 668865 - RNA, 21 nt, Escherichia coli CFT073
cgcguucgauagcgcgccagc

SEQ ID NO: 668866 - RNA, 15 nt, Escherichia coli CFT073
cgcguuucugcgcuu

SEQ ID NO: 668867 - RNA, 21 nt, Escherichia coli CFT073
cgcguuugcguuccggcggca

SEQ ID NO: 668868 - RNA, 23 nt, Escherichia coli CFT073
cgcguuuuggcgaaauagccgaa

SEQ ID NO: 668869 - RNA, 16 nt, Escherichia coli CFT073
cgcguuaaauccugcc

SEQ ID NO: 668870 - RNA, 16 nt, Escherichia coli CFT073
cgcguuaagcccaguu

SEQ ID NO: 668871 - RNA, 19 nt, Escherichia coli CFT073
cgcgucggcgucagcgcca

SEQ ID NO: 668872 - RNA, 17 nt, Escherichia coli CFT073
cgcgguuacgcaccggu

SEQ ID NO: 668873 - RNA, 21 nt, Escherichia coli CFT073
cgcggucgccgucaggcaagc

SEQ ID NO: 668874 - RNA, 18 nt, Escherichia coli CFT073
cgcgguaucucgcgccag

SEQ ID NO: 668875 - RNA, 17 nt, Escherichia coli CFT073
cgcggucagcugcuguu

SEQ ID NO: 668876 - RNA, 17 nt, Escherichia coli CFT073
cgcgguaaagcgcggca

SEQ ID NO: 668877 - RNA, 23 nt, Escherichia coli CFT073
cgcgguaagaguaaagcccgcca

SEQ ID NO: 668878 - RNA, 18 nt, Escherichia coli CFT073
cgcgguaaaagccauucu

SEQ ID NO: 668879 - RNA, 15 nt, Escherichia coli CFT073
cgcgguaaaagccca

SEQ ID NO: 668880 - RNA, 22 nt, Escherichia coli CFT073
cgcgcuucgguguuaaaacgca

SEQ ID NO: 668881 - RNA, 15 nt, Escherichia coli CFT073
cgcgcuuaucgccag

SEQ ID NO: 668882 - RNA, 22 nt, Escherichia coli CFT073
cgcgcuguaauuucacaccauc

SEQ ID NO: 668883 - RNA, 22 nt, Escherichia coli CFT073
cgcgcuucguuuuccgccacau

SEQ ID NO: 668884 - RNA, 18 nt, Escherichia coli CFT073
cgcggauaaaacugccag

SEQ ID NO: 668885 - RNA, 14 nt, Escherichia coli CFT073
cgcggcacaccagc

SEQ ID NO: 668886 - RNA, 23 nt, Escherichia coli CFT073
cgcggcuucaacuuuccgcacuu

SEQ ID NO: 668887 - RNA, 23 nt, Escherichia coli CFT073
cgcggguaaaaccauuuugcugg

SEQ ID NO: 668888 - RNA, 19 nt, Escherichia coli CFT073
cgcgcacgcccaucagcgg

SEQ ID NO: 668889 - RNA, 16 nt, Escherichia coli CFT073
cgcgcaccguccagcg

SEQ ID NO: 668890 - RNA, 14 nt, Escherichia coli CFT073
cgcgcaggagcggc

SEQ ID NO: 668891 - RNA, 23 nt, Escherichia coli CFT073
cgcgcauuaccucaauaauuucu

SEQ ID NO: 668892 - RNA, 15 nt, Escherichia coli CFT073
cgcgcagugccugcc

SEQ ID NO: 668893 - RNA, 14 nt, Escherichia coli CFT073
cgcgcaaacaguga

SEQ ID NO: 668894 - RNA, 23 nt, Escherichia coli CFT073
cgcgauggcuggaaucaucaagc

SEQ ID NO: 668895 - RNA, 20 nt, Escherichia coli CFT073
cgcgauggcuuuccaccugc

SEQ ID NO: 668896 - RNA, 16 nt, Escherichia coli CFT073
cgcgaucucgucagca

SEQ ID NO: 668897 - RNA, 14 nt, Escherichia coli CFT073
cgcgaugaccaaaa

SEQ ID NO: 668898 - RNA, 14 nt, Escherichia coli CFT073
cgcgccaaccagga

SEQ ID NO: 668899 - RNA, 21 nt, Escherichia coli CFT073
cgcgccaaucagcgcagcacc

SEQ ID NO: 668900 - RNA, 22 nt, Escherichia coli CFT073
cgcgccaaucagcgcagcaccc

SEQ ID NO: 668901 - RNA, 18 nt, Escherichia coli CFT073
cgcgccaaucagcgcagc

SEQ ID NO: 668902 - RNA, 14 nt, Escherichia coli CFT073
cgcgcccaaacgua

SEQ ID NO: 668903 - RNA, 18 nt, Escherichia coli CFT073
cgcgcccauacggcucag

SEQ ID NO: 668904 - RNA, 13 nt, Escherichia coli CFT073
cgcgcccagccug

SEQ ID NO: 668905 - RNA, 22 nt, Escherichia coli CFT073
cgcgccccacggaaguuuaauc

SEQ ID NO: 668906 - RNA, 18 nt, Escherichia coli CFT073
cgcgccccacggauugcc

SEQ ID NO: 668907 - RNA, 13 nt, Escherichia coli CFT073
cgcgcccgccgcu

SEQ ID NO: 668908 - RNA, 21 nt, Escherichia coli CFT073
cgcgccgcgcugcuguagcag

SEQ ID NO: 668909 - RNA, 15 nt, Escherichia coli CFT073
cgcgccucaggcacu

SEQ ID NO: 668910 - RNA, 15 nt, Escherichia coli CFT073
cgccuuuuacgcauu

SEQ ID NO: 668911 - RNA, 17 nt, Escherichia coli CFT073
cgccuuugagcaguuuc

SEQ ID NO: 668912 - RNA, 14 nt, Escherichia coli CFT073
cgccuuugaugcca

SEQ ID NO: 668913 - RNA, 23 nt, Escherichia coli CFT073
cgccuugcgugacgccugcucca

SEQ ID NO: 668914 - RNA, 13 nt, Escherichia coli CFT073
cgccuucuugaac

SEQ ID NO: 668915 - RNA, 15 nt, Escherichia coli CFT073
cgccuuauccggccu

SEQ ID NO: 668916 - RNA, 16 nt, Escherichia coli CFT073
cgccugcgucuaucag

SEQ ID NO: 668917 - RNA, 14 nt, Escherichia coli CFT073
cgccugcggccagc

SEQ ID NO: 668918 - RNA, 23 nt, Escherichia coli CFT073
cgccugcuccucggugaucucaa

SEQ ID NO: 668919 - RNA, 15 nt, Escherichia coli CFT073
cgccugcuucuacgc

SEQ ID NO: 668920 - RNA, 22 nt, Escherichia coli CFT073
cgccuggugcaggcguuaauau

SEQ ID NO: 668921 - RNA, 20 nt, Escherichia coli CFT073
cgccugguugaguaaauaac

SEQ ID NO: 668922 - RNA, 22 nt, Escherichia coli CFT073
cgccuguugcgguuucucccgu

SEQ ID NO: 668923 - RNA, 17 nt, Escherichia coli CFT073
cgccugucaccgccucc

SEQ ID NO: 668924 - RNA, 13 nt, Escherichia coli CFT073
cgcgaccggcggc

SEQ ID NO: 668925 - RNA, 13 nt, Escherichia coli CFT073
cgcgaaacugcgu

SEQ ID NO: 668926 - RNA, 19 nt, Escherichia coli CFT073
cgcgaaauaaucaaaugaa

SEQ ID NO: 668927 - RNA, 14 nt, Escherichia coli CFT073
cgcgagccuuuacg

SEQ ID NO: 668928 - RNA, 18 nt, Escherichia coli CFT073
cgcgauccacgcucgcug

SEQ ID NO: 668929 - RNA, 17 nt, Escherichia coli CFT073
cgcgaucccagaccaga

SEQ ID NO: 668930 - RNA, 15 nt, Escherichia coli CFT073
cgcgauagccgcuuu

SEQ ID NO: 668931 - RNA, 15 nt, Escherichia coli CFT073
cgcgauagcgcacca

SEQ ID NO: 668932 - RNA, 22 nt, Escherichia coli CFT073
cgcgauaucgcgguacuucuca

SEQ ID NO: 668933 - RNA, 23 nt, Escherichia coli CFT073
cgcgauauuccgcaacgccgcca

SEQ ID NO: 668934 - RNA, 19 nt, Escherichia coli CFT073
cggauuuuucgcgcgggca

SEQ ID NO: 668935 - RNA, 21 nt, Escherichia coli CFT073
cggauuucaaacgcgcccaaa

SEQ ID NO: 668936 - RNA, 12 nt, Escherichia coli CFT073
cggcaaacacgc

SEQ ID NO: 668937 - RNA, 21 nt, Escherichia coli CFT073
cggcaaaacguuauuuugcua

SEQ ID NO: 668938 - RNA, 14 nt, Escherichia coli CFT073
cggcaaacgcaacc

SEQ ID NO: 668939 - RNA, 14 nt, Escherichia coli CFT073
cggcaaacugcuga

SEQ ID NO: 668940 - RNA, 15 nt, Escherichia coli CFT073
cggcaaaggucugau

SEQ ID NO: 668941 - RNA, 16 nt, Escherichia coli CFT073
cggcaacaucaaauca

SEQ ID NO: 668942 - RNA, 14 nt, Escherichia coli CFT073
cggcaacaaauuca

SEQ ID NO: 668943 - RNA, 19 nt, Escherichia coli CFT073
cggcaacaaauucacgccu

SEQ ID NO: 668944 - RNA, 16 nt, Escherichia coli CFT073
cggcaacaauuuccgc

SEQ ID NO: 668945 - RNA, 14 nt, Escherichia coli CFT073
cggcaaccagcagc

SEQ ID NO: 668946 - RNA, 15 nt, Escherichia coli CFT073
cggcaaccagcaccg

SEQ ID NO: 668947 - RNA, 18 nt, Escherichia coli CFT073
cggcaagauacugcauaa

SEQ ID NO: 668948 - RNA, 17 nt, Escherichia coli CFT073
cggcaacgaccgcgagc

SEQ ID NO: 668949 - RNA, 13 nt, Escherichia coli CFT073
cggcaacgccagc

SEQ ID NO: 668950 - RNA, 22 nt, Escherichia coli CFT073
cggcaaggguugggauuuauuu

SEQ ID NO: 668951 - RNA, 17 nt, Escherichia coli CFT073
cggcaauaaacagcacu

SEQ ID NO: 668952 - RNA, 20 nt, Escherichia coli CFT073
cggcaauaaacagcacugaa

SEQ ID NO: 668953 - RNA, 15 nt, Escherichia coli CFT073
cggcaauaacuccca

SEQ ID NO: 668954 - RNA, 21 nt, Escherichia coli CFT073
cggcaauacuuugcagaucgc

SEQ ID NO: 668955 - RNA, 22 nt, Escherichia coli CFT073
cggcaauauagauaucaugcuc

SEQ ID NO: 668956 - RNA, 18 nt, Escherichia coli CFT073
cggcaaucaacgccugau

SEQ ID NO: 668957 - RNA, 23 nt, Escherichia coli CFT073
cggcaaucgccagauccgcuucg

SEQ ID NO: 668958 - RNA, 14 nt, Escherichia coli CFT073
cggcaaucgcgcca

SEQ ID NO: 668959 - RNA, 20 nt, Escherichia coli CFT073
cggcaccgaggaugaauaac

SEQ ID NO: 668960 - RNA, 18 nt, Escherichia coli CFT073
cggcacguuacugaucac

SEQ ID NO: 668961 - RNA, 23 nt, Escherichia coli CFT073
cggcacguucgauguggcucagc

SEQ ID NO: 668962 - RNA, 15 nt, Escherichia coli CFT073
cggcacuagucccuc

SEQ ID NO: 668963 - RNA, 17 nt, Escherichia coli CFT073
cggcacucaaucgccaa

SEQ ID NO: 668964 - RNA, 20 nt, Escherichia coli CFT073
cggcaccuucgcggcaaaac

SEQ ID NO: 668965 - RNA, 14 nt, Escherichia coli CFT073
cggcaccagcgcug

SEQ ID NO: 668966 - RNA, 17 nt, Escherichia coli CFT073
cggcacccaucgccagc

SEQ ID NO: 668967 - RNA, 14 nt, Escherichia coli CFT073
cggcaccagauauu

SEQ ID NO: 668968 - RNA, 14 nt, Escherichia coli CFT073
cggcaccacggcua

SEQ ID NO: 668969 - RNA, 23 nt, Escherichia coli CFT073
cggcacaaaacuguaucccagcc

SEQ ID NO: 668970 - RNA, 23 nt, Escherichia coli CFT073
cggcaauuucagugcugacugau

SEQ ID NO: 668971 - RNA, 14 nt, Escherichia coli CFT073
cggcaaugcgcccc

SEQ ID NO: 668972 - RNA, 22 nt, Escherichia coli CFT073
cggcacacagcacggcagcaac

SEQ ID NO: 668973 - RNA, 21 nt, Escherichia coli CFT073
cggcacagccagcgcaggcag

SEQ ID NO: 668974 - RNA, 15 nt, Escherichia coli CFT073
cggcacauaaccagu

SEQ ID NO: 668975 - RNA, 14 nt, Escherichia coli CFT073
cggcaccaaucacc

SEQ ID NO: 668976 - RNA, 16 nt, Escherichia coli CFT073
cggauaaucggcaaua

SEQ ID NO: 668977 - RNA, 21 nt, Escherichia coli CFT073
cggauaauggagccagaucug

SEQ ID NO: 668978 - RNA, 21 nt, Escherichia coli CFT073
cggauaaggcguuuaugccgc

SEQ ID NO: 668979 - RNA, 20 nt, Escherichia coli CFT073
cggauaaggcuuuugcucgu

SEQ ID NO: 668980 - RNA, 19 nt, Escherichia coli CFT073
cggauaagaggcgccagca

SEQ ID NO: 668981 - RNA, 18 nt, Escherichia coli CFT073
cggauaagaugcgccagc

SEQ ID NO: 668982 - RNA, 13 nt, Escherichia coli CFT073
cggauaccccagc

SEQ ID NO: 668983 - RNA, 16 nt, Escherichia coli CFT073
cggauaauuccccggc

SEQ ID NO: 668984 - RNA, 13 nt, Escherichia coli CFT073
cggauacggucag

SEQ ID NO: 668985 - RNA, 19 nt, Escherichia coli CFT073
cggauagccgccccagacu

SEQ ID NO: 668986 - RNA, 15 nt, Escherichia coli CFT073
cggaucaauccccag

SEQ ID NO: 668987 - RNA, 18 nt, Escherichia coli CFT073
cggauauuuuccagcaac

SEQ ID NO: 668988 - RNA, 22 nt, Escherichia coli CFT073
cggauauuuuccagcaacgcug

SEQ ID NO: 668989 - RNA, 12 nt, Escherichia coli CFT073
cggaucaggcag

SEQ ID NO: 668990 - RNA, 15 nt, Escherichia coli CFT073
cggauaucggcagcg

SEQ ID NO: 668991 - RNA, 21 nt, Escherichia coli CFT073
cggauaggcaccgccaaagau

SEQ ID NO: 668992 - RNA, 16 nt, Escherichia coli CFT073
cggauaggccauaauc

SEQ ID NO: 668993 - RNA, 23 nt, Escherichia coli CFT073
cggaggccugauaaaacgcgcag

SEQ ID NO: 668994 - RNA, 19 nt, Escherichia coli CFT073
cggagcuucacccgcagca

SEQ ID NO: 668995 - RNA, 15 nt, Escherichia coli CFT073
cggagguuuuuuccu

SEQ ID NO: 668996 - RNA, 16 nt, Escherichia coli CFT073
cggagguuuuuuccuc

SEQ ID NO: 668997 - RNA, 14 nt, Escherichia coli CFT073
cggagucagucccu

SEQ ID NO: 668998 - RNA, 16 nt, Escherichia coli CFT073
cggaguugcagauuug

SEQ ID NO: 668999 - RNA, 17 nt, Escherichia coli CFT073
cggauaaagcagggcag

SEQ ID NO: 669000 - RNA, 18 nt, Escherichia coli CFT073
cggaucugaucagcacga

SEQ ID NO: 669001 - RNA, 13 nt, Escherichia coli CFT073
cggaucggcuggc

SEQ ID NO: 669002 - RNA, 15 nt, Escherichia coli CFT073
cggaugaguacagcg

SEQ ID NO: 669003 - RNA, 22 nt, Escherichia coli CFT073
cggaugagacgcggcacuccgc

SEQ ID NO: 669004 - RNA, 16 nt, Escherichia coli CFT073
cggaugaucauccggc

SEQ ID NO: 669005 - RNA, 15 nt, Escherichia coli CFT073
cggaucaguuuaucc

SEQ ID NO: 669006 - RNA, 13 nt, Escherichia coli CFT073
cggauccagaacu

SEQ ID NO: 669007 - RNA, 21 nt, Escherichia coli CFT073
cggauccagcgguuggagcac

SEQ ID NO: 669008 - RNA, 15 nt, Escherichia coli CFT073
cggaucgaugccaaa

SEQ ID NO: 669009 - RNA, 21 nt, Escherichia coli CFT073
cggauuaauaaggaugcaaca

SEQ ID NO: 669010 - RNA, 20 nt, Escherichia coli CFT073
cggauugaccaacaguugcc

SEQ ID NO: 669011 - RNA, 15 nt, Escherichia coli CFT073
cggaugcgaugcugg

SEQ ID NO: 669012 - RNA, 14 nt, Escherichia coli CFT073
cggaugccgcugcu

SEQ ID NO: 669013 - RNA, 24 nt, Escherichia coli CFT073
cggaugcagcaucaugucgcccac

SEQ ID NO: 669014 - RNA, 18 nt, Escherichia coli CFT073
cggaugaugccacaaacu

SEQ ID NO: 669015 - RNA, 14 nt, Escherichia coli CFT073
cggaugauuauguc

SEQ ID NO: 669016 - RNA, 14 nt, Escherichia coli CFT073
cggaugauucacau

SEQ ID NO: 669017 - RNA, 13 nt, Escherichia coli CFT073
cggaugauuccgc

SEQ ID NO: 669018 - RNA, 15 nt, Escherichia coli CFT073
cggaugcgccgucag

SEQ ID NO: 669019 - RNA, 20 nt, Escherichia coli CFT073
cggauggauccccgcagcaa

SEQ ID NO: 669020 - RNA, 15 nt, Escherichia coli CFT073
cggauggcaacagca

SEQ ID NO: 669021 - RNA, 15 nt, Escherichia coli CFT073
cggacuuuuuauuua

SEQ ID NO: 669022 - RNA, 16 nt, Escherichia coli CFT073
cggagaagagauaaac

SEQ ID NO: 669023 - RNA, 22 nt, Escherichia coli CFT073
cggagaauccagccccaccagc

SEQ ID NO: 669024 - RNA, 16 nt, Escherichia coli CFT073
cggagacaaacagggu

SEQ ID NO: 669025 - RNA, 17 nt, Escherichia coli CFT073
cggagcaaugaucucaa

SEQ ID NO: 669026 - RNA, 15 nt, Escherichia coli CFT073
cggagcaaccugcac

SEQ ID NO: 669027 - RNA, 18 nt, Escherichia coli CFT073
cggagaucaccacauacu

SEQ ID NO: 669028 - RNA, 21 nt, Escherichia coli CFT073
cggagauaaccacguucauuu

SEQ ID NO: 669029 - RNA, 14 nt, Escherichia coli CFT073
cggagcgcgcguca

SEQ ID NO: 669030 - RNA, 16 nt, Escherichia coli CFT073
cggagcccuacaaacc

SEQ ID NO: 669031 - RNA, 13 nt, Escherichia coli CFT073
cggagcugccagc

SEQ ID NO: 669032 - RNA, 19 nt, Escherichia coli CFT073
cggaggaaacuugccuccg

SEQ ID NO: 669033 - RNA, 22 nt, Escherichia coli CFT073
cggaggaaacuugccuccggca

SEQ ID NO: 669034 - RNA, 20 nt, Escherichia coli CFT073
cggacaaauaacccgccaug

SEQ ID NO: 669035 - RNA, 23 nt, Escherichia coli CFT073
cggaauuucuuucagcaguucag

SEQ ID NO: 669036 - RNA, 17 nt, Escherichia coli CFT073
cggacaauaauaucuuu

SEQ ID NO: 669037 - RNA, 22 nt, Escherichia coli CFT073
cggaauauauucauauuuuuuc

SEQ ID NO: 669038 - RNA, 15 nt, Escherichia coli CFT073
cggaauaucagaggc

SEQ ID NO: 669039 - RNA, 23 nt, Escherichia coli CFT073
cggaaucaacggcaacaauuucc

SEQ ID NO: 669040 - RNA, 16 nt, Escherichia coli CFT073
cggaaucaccggcaaa

SEQ ID NO: 669041 - RNA, 20 nt, Escherichia coli CFT073
cggaaugauauuggucacca

SEQ ID NO: 669042 - RNA, 12 nt, Escherichia coli CFT073
cggaauggucag

SEQ ID NO: 669043 - RNA, 17 nt, Escherichia coli CFT073
cggaaugcacagccuga

SEQ ID NO: 669044 - RNA, 24 nt, Escherichia coli CFT073
cggacgaccgugcgccagcaaauc

SEQ ID NO: 669045 - RNA, 18 nt, Escherichia coli CFT073
cggacgaucgcugaugaa

SEQ ID NO: 669046 - RNA, 18 nt, Escherichia coli CFT073
cggacgcaccuugccaaa

SEQ ID NO: 669047 - RNA, 16 nt, Escherichia coli CFT073
cggaccagcgggcgcu

SEQ ID NO: 669048 - RNA, 23 nt, Escherichia coli CFT073
cggaaauuaccgcaccaccagca

SEQ ID NO: 669049 - RNA, 20 nt, Escherichia coli CFT073
cggaaauuaccgcaccacca

SEQ ID NO: 669050 - RNA, 15 nt, Escherichia coli CFT073
cggaacaacggcaaa

SEQ ID NO: 669051 - RNA, 23 nt, Escherichia coli CFT073
cggaacaucugccccauugcuga

SEQ ID NO: 669052 - RNA, 15 nt, Escherichia coli CFT073
cggaacaucugcccc

SEQ ID NO: 669053 - RNA, 15 nt, Escherichia coli CFT073
cggaaccgcaggcug

SEQ ID NO: 669054 - RNA, 21 nt, Escherichia coli CFT073
cggaaccgcaggcugauaacc

SEQ ID NO: 669055 - RNA, 16 nt, Escherichia coli CFT073
cggaaauaacgcugau

SEQ ID NO: 669056 - RNA, 15 nt, Escherichia coli CFT073
cggaaaucaugcucc

SEQ ID NO: 669057 - RNA, 13 nt, Escherichia coli CFT073
cggaaaucuccag

SEQ ID NO: 669058 - RNA, 15 nt, Escherichia coli CFT073
cggaaaucuccagau

SEQ ID NO: 669059 - RNA, 18 nt, Escherichia coli CFT073
cggaaaucuccagauaau

SEQ ID NO: 669060 - RNA, 16 nt, Escherichia coli CFT073
cggaaagcaacaaguu

SEQ ID NO: 669061 - RNA, 17 nt, Escherichia coli CFT073
cggaaacugucaauaaa

SEQ ID NO: 669062 - RNA, 19 nt, Escherichia coli CFT073
cggaacuuuuuucauccag

SEQ ID NO: 669063 - RNA, 17 nt, Escherichia coli CFT073
cggaagagacuauuucu

SEQ ID NO: 669064 - RNA, 16 nt, Escherichia coli CFT073
cggaagaguuuuucag

SEQ ID NO: 669065 - RNA, 15 nt, Escherichia coli CFT073
cggaagaucggaaag

SEQ ID NO: 669066 - RNA, 22 nt, Escherichia coli CFT073
cggaagcaaaauaaccggcaag

SEQ ID NO: 669067 - RNA, 16 nt, Escherichia coli CFT073
cggaagcgccaccagc

SEQ ID NO: 669068 - RNA, 17 nt, Escherichia coli CFT073
cggaagccccaggucaa

SEQ ID NO: 669069 - RNA, 15 nt, Escherichia coli CFT073
cggaaguuuaauccg

SEQ ID NO: 669070 - RNA, 19 nt, Escherichia coli CFT073
cggaaggguaaacacccag

SEQ ID NO: 669071 - RNA, 23 nt, Escherichia coli CFT073
cggaaggguaaacacccaggcca

SEQ ID NO: 669072 - RNA, 16 nt, Escherichia coli CFT073
cggaaguaagaggagg

SEQ ID NO: 669073 - RNA, 14 nt, Escherichia coli CFT073
cgcuuuaugugcuu

SEQ ID NO: 669074 - RNA, 17 nt, Escherichia coli CFT073
cgcuuucgcuuucucuu

SEQ ID NO: 669075 - RNA, 18 nt, Escherichia coli CFT073
cgcuuucucaccaugacc

SEQ ID NO: 669076 - RNA, 17 nt, Escherichia coli CFT073
cgcuuugauccgccaga

SEQ ID NO: 669077 - RNA, 17 nt, Escherichia coli CFT073
cgcuuugaugcguucuu

SEQ ID NO: 669078 - RNA, 13 nt, Escherichia coli CFT073
cgcuuugauggca

SEQ ID NO: 669079 - RNA, 17 nt, Escherichia coli CFT073
cgcuuugcugccuuccu

SEQ ID NO: 669080 - RNA, 16 nt, Escherichia coli CFT073
cgcuuuucaccgccuu

SEQ ID NO: 669081 - RNA, 20 nt, Escherichia coli CFT073
cgcuuuugggaucgccauca

SEQ ID NO: 669082 - RNA, 16 nt, Escherichia coli CFT073
cgcuuuuugauaagua

SEQ ID NO: 669083 - RNA, 20 nt, Escherichia coli CFT073
cgcuuuuuaggggcgcaucu

SEQ ID NO: 669084 - RNA, 19 nt, Escherichia coli CFT073
cggaaaaaucaaaaacucu

SEQ ID NO: 669085 - RNA, 16 nt, Escherichia coli CFT073
cggaaaagcaacaacc

SEQ ID NO: 669086 - RNA, 16 nt, Escherichia coli CFT073
cggaaaacaacaccgg

SEQ ID NO: 669087 - RNA, 14 nt, Escherichia coli CFT073
cgcuuuuucugaaa

SEQ ID NO: 669088 - RNA, 19 nt, Escherichia coli CFT073
cgcuuuuuuagguacaaag

SEQ ID NO: 669089 - RNA, 12 nt, Escherichia coli CFT073
cgcuaagcccga

SEQ ID NO: 669090 - RNA, 16 nt, Escherichia coli CFT073
cgcuaccacuucccaa

SEQ ID NO: 669091 - RNA, 18 nt, Escherichia coli CFT073
cgcuaccagaaagcgacc

SEQ ID NO: 669092 - RNA, 23 nt, Escherichia coli CFT073
cgcuuguugauucugauaugcag

SEQ ID NO: 669093 - RNA, 22 nt, Escherichia coli CFT073
cgcuuuaaucaccaucgcgcca

SEQ ID NO: 669094 - RNA, 20 nt, Escherichia coli CFT073
cgcuuuacccugguuagcaa

SEQ ID NO: 669095 - RNA, 19 nt, Escherichia coli CFT073
cgcuuuacuguacaauccu

SEQ ID NO: 669096 - RNA, 14 nt, Escherichia coli CFT073
cggccuaccgcauc

SEQ ID NO: 669097 - RNA, 22 nt, Escherichia coli CFT073
cggccuacaaaagcaauaauuu

SEQ ID NO: 669098 - RNA, 19 nt, Escherichia coli CFT073
cggccuggggaaugagcga

SEQ ID NO: 669099 - RNA, 12 nt, Escherichia coli CFT073
cggccuggcacg

SEQ ID NO: 669100 - RNA, 20 nt, Escherichia coli CFT073
cggccuugauuauuucccuc

SEQ ID NO: 669101 - RNA, 22 nt, Escherichia coli CFT073
cggccuuuuuauuuagauaaac

SEQ ID NO: 669102 - RNA, 16 nt, Escherichia coli CFT073
cggcgaagagagcgcc

SEQ ID NO: 669103 - RNA, 22 nt, Escherichia coli CFT073
cggcgaccguucgccaggucag

SEQ ID NO: 669104 - RNA, 20 nt, Escherichia coli CFT073
cggcccguacugaacccggg

SEQ ID NO: 669105 - RNA, 15 nt, Escherichia coli CFT073
cggcccggaggaugc

SEQ ID NO: 669106 - RNA, 18 nt, Escherichia coli CFT073
cggcccuucgauauauuu

SEQ ID NO: 669107 - RNA, 16 nt, Escherichia coli CFT073
cggcauuguucauuug

SEQ ID NO: 669108 - RNA, 14 nt, Escherichia coli CFT073
cggccacagcgcca

SEQ ID NO: 669109 - RNA, 14 nt, Escherichia coli CFT073
cggccaaaagcaca

SEQ ID NO: 669110 - RNA, 17 nt, Escherichia coli CFT073
cggccaaaagcacaauc

SEQ ID NO: 669111 - RNA, 20 nt, Escherichia coli CFT073
cggcauuucggcccaugaca

SEQ ID NO: 669112 - RNA, 21 nt, Escherichia coli CFT073
cggcauuuuccagcucuucua

SEQ ID NO: 669113 - RNA, 18 nt, Escherichia coli CFT073
cggcauuuugcugaugca

SEQ ID NO: 669114 - RNA, 20 nt, Escherichia coli CFT073
cggcagcaaucgaccaggcc

SEQ ID NO: 669115 - RNA, 19 nt, Escherichia coli CFT073
cggcagcaaucgaccaggc

SEQ ID NO: 669116 - RNA, 16 nt, Escherichia coli CFT073
cggccacagcgccaga

SEQ ID NO: 669117 - RNA, 23 nt, Escherichia coli CFT073
cggccagacaccggcuuucaccu

SEQ ID NO: 669118 - RNA, 17 nt, Escherichia coli CFT073
cggccauuuucauuuaa

SEQ ID NO: 669119 - RNA, 14 nt, Escherichia coli CFT073
cggccaguccccuc

SEQ ID NO: 669120 - RNA, 15 nt, Escherichia coli CFT073
cggccccuauaucaa

SEQ ID NO: 669121 - RNA, 20 nt, Escherichia coli CFT073
cggccccgucgcccgaugcc

SEQ ID NO: 669122 - RNA, 16 nt, Human
uguuuucccuccuugg

SEQ ID NO: 669123 - RNA, 20 nt, Human
uguugcuaucaauccaagaa

SEQ ID NO: 669124 - RNA, 20 nt, Human
uuaaaaaaaaaccugagccc

SEQ ID NO: 669125 - RNA, 15 nt, Human
uuaaaaaagaaacau

SEQ ID NO: 669126 - RNA, 15 nt, Human
uuacuguaagaaaau

SEQ ID NO: 669127 - RNA, 13 nt, Human
uuauuucacuuua

SEQ ID NO: 669128 - RNA, 12 nt, Human
uucaaaacuuau

SEQ ID NO: 669129 - RNA, 17 nt, Human
uucaaauccuugaagau

SEQ ID NO: 669130 - RNA, 15 nt, Human
uuauauauuguagau

SEQ ID NO: 669131 - RNA, 15 nt, Human
uuauauuuuugugau

SEQ ID NO: 669132 - RNA, 15 nt, Human
gcggaccuucccagc

SEQ ID NO: 669133 - RNA, 15 nt, Human
gccgcuuaagcuuuc

SEQ ID NO: 669134 - RNA, 20 nt, Human
gcuaggggggucagccagcc

SEQ ID NO: 669135 - RNA, 23 nt, Human
gcguugagccaccaagcuggugg

SEQ ID NO: 669136 - RNA, 19 nt, Human
gcucauggaauuggagcuc

SEQ ID NO: 669137 - RNA, 15 nt, Human
gcuaugcuauugaag

SEQ ID NO: 669138 - RNA, 13 nt, Human
guuguaccgcaau

SEQ ID NO: 669139 - RNA, 13 nt, Human
guugauggaaaua

SEQ ID NO: 669140 - RNA, 20 nt, Human
uaacaauaaaagacaaggaa

SEQ ID NO: 669141 - RNA, 18 nt, Human
guuuuauaugcuucuguu

SEQ ID NO: 669142 - RNA, 18 nt, Human
guuucauaagaauucugu

SEQ ID NO: 669143 - RNA, 16 nt, Human
uaaaagacagugaaag

SEQ ID NO: 669144 - RNA, 11 nt, Human
uaaagaaacaa

SEQ ID NO: 669145 - RNA, 21 nt, Human
uauaaauuuaucauuuaguua

SEQ ID NO: 669146 - RNA, 19 nt, Human
uagugagacacugucucua

SEQ ID NO: 669147 - RNA, 15 nt, Human
uaggccugguguguu

SEQ ID NO: 669148 - RNA, 13 nt, Human
uagggugauauua

SEQ ID NO: 669149 - RNA, 17 nt, Human
uagcagcuuauucacaa

SEQ ID NO: 669150 - RNA, 15 nt, Human
uagauagaugaagaa

SEQ ID NO: 669151 - RNA, 22 nt, Human
uauagcuuugccauguggcaga

SEQ ID NO: 669152 - RNA, 17 nt, Human
uauauaacaaugcugua

SEQ ID NO: 669153 - RNA, 14 nt, Human
ugcuauuugcuguu

SEQ ID NO: 669154 - RNA, 23 nt, Human
uguuggagaagaacugaaaucau

SEQ ID NO: 669155 - RNA, 14 nt, Human
uggcuccagcuggc

SEQ ID NO: 669156 - RNA, 12 nt, Human
uggcugccagaa

SEQ ID NO: 669157 - RNA, 17 nt, Human
ugggaaacaaaaggaua

SEQ ID NO: 669158 - RNA, 16 nt, Human
uggcagcuuuccucaa

SEQ ID NO: 669159 - RNA, 15 nt, Human
uggaauuggagcucg

SEQ ID NO: 669160 - RNA, 20 nt, Human
uggacgagaaaacaauaacg

SEQ ID NO: 669161 - RNA, 12 nt, Human
ugauccugcaau

SEQ ID NO: 669162 - RNA, 16 nt, Human
ugauguuuagaaacac

SEQ ID NO: 669163 - RNA, 17 nt, Human
ugauuuuauaugcuauu

SEQ ID NO: 669164 - RNA, 15 nt, Human
ugagccuuuguugcu

SEQ ID NO: 669165 - RNA, 11 nt, Human
ugaggagcugu

SEQ ID NO: 669166 - RNA, 18 nt, Human
ugagugccuguaaucaca

SEQ ID NO: 669167 - RNA, 18 nt, Human
ugagaugggagaaucacu

SEQ ID NO: 669168 - RNA, 14 nt, Human
ugagaugguuucua

SEQ ID NO: 669169 - RNA, 21 nt, Human
ugagcgcccacuagacccacu

SEQ ID NO: 669170 - RNA, 17 nt, Human
ugagcggaccuucccag

SEQ ID NO: 669171 - RNA, 13 nt, Human
ugagcagucagga

SEQ ID NO: 669172 - RNA, 23 nt, Human
ugaaguccaagcauuuagaugua

SEQ ID NO: 669173 - RNA, 19 nt, Human
ugagagacacacugaagaa

SEQ ID NO: 669174 - RNA, 15 nt, Human
ucauucugccugccc

SEQ ID NO: 669175 - RNA, 19 nt, Human
ucaccaaggcugauuaaac

SEQ ID NO: 669176 - RNA, 21 nt, Human
ucacccugaggugagcaucau

SEQ ID NO: 669177 - RNA, 17 nt, Human
ucaccuuuuggucugga

SEQ ID NO: 669178 - RNA, 15 nt, Human
ucagauaaucacaau

SEQ ID NO: 669179 - RNA, 12 nt, Human
uccacagcugcu

SEQ ID NO: 669180 - RNA, 23 nt, Human
uccagugauaagagauguugacu

SEQ ID NO: 669181 - RNA, 21 nt, Human
ugaacuauaugacuggccaca

SEQ ID NO: 669182 - RNA, 21 nt, Human
ugaacuuuuuguuuuguuucu

SEQ ID NO: 669183 - RNA, 21 nt, Human
ugaaggaauaucucuucucag

SEQ ID NO: 669184 - RNA, 19 nt, Human
gaggaucacuuuaggccug

SEQ ID NO: 669185 - RNA, 18 nt, Human
gaggcuccacuuggucug

SEQ ID NO: 669186 - RNA, 21 nt, Human
gagccugaucaccugcccugc

SEQ ID NO: 669187 - RNA, 19 nt, Human
gagcaucuccucaacucug

SEQ ID NO: 669188 - RNA, 18 nt, Human
gagacagaaagcagaaca

SEQ ID NO: 669189 - RNA, 17 nt, Human
gaggggcuucugggcag

SEQ ID NO: 669190 - RNA, 23 nt, Human
gagucaagggugugugcagcauu

SEQ ID NO: 669191 - RNA, 14 nt, Human
gagucucagcuuca

SEQ ID NO: 669192 - RNA, 18 nt, Human
gaugguucccuugaugaa

SEQ ID NO: 669193 - RNA, 21 nt, Human
gauuaugaauuacauuuguau

SEQ ID NO: 669194 - RNA, 14 nt, Human
gauuccucacuuug

SEQ ID NO: 669195 - RNA, 12 nt, Human
gauugugggaua

SEQ ID NO: 669196 - RNA, 22 nt, Human
gauuugauguauguaauacaua

SEQ ID NO: 669197 - RNA, 20 nt, Human
gauggcaggaggcauccaaa

SEQ ID NO: 669198 - RNA, 18 nt, Human
gauccccaagccuggcaa

SEQ ID NO: 669199 - RNA, 11 nt, Human
gaugaacuuuu

SEQ ID NO: 669200 - RNA, 12 nt, Human
gaugaagaaguu

SEQ ID NO: 669201 - RNA, 23 nt, Human
gcccccacuugccauaaaacuua

SEQ ID NO: 669202 - RNA, 20 nt, Human
gccaaauauaaauaaaaaua

SEQ ID NO: 669203 - RNA, 13 nt, Human
gccaugaaucacc

SEQ ID NO: 669204 - RNA, 23 nt, Human
gccaugggacagggaggacgcuc

SEQ ID NO: 669205 - RNA, 17 nt, Human
gccaugugcagccacca

SEQ ID NO: 669206 - RNA, 20 nt, Human
gcagacacaugugcuggcca

SEQ ID NO: 669207 - RNA, 20 nt, Human
gcagcuuuccucaaaacuuc

SEQ ID NO: 669208 - RNA, 23 nt, Human
gcaggaggaucacuuuaggccug

SEQ ID NO: 669209 - RNA, 18 nt, Human
gcagcuuccaggcuggcg

SEQ ID NO: 669210 - RNA, 13 nt, Human
gcagucaggaaag

SEQ ID NO: 669211 - RNA, 22 nt, Human
cuugaggcacagaaacuccugu

SEQ ID NO: 669212 - RNA, 14 nt, Human
cuugaugaagaagu

SEQ ID NO: 669213 - RNA, 21 nt, Human
cuuccuaauuccacagcugcu

SEQ ID NO: 669214 - RNA, 17 nt, Human
cuucucucaaggagagg

SEQ ID NO: 669215 - RNA, 16 nt, Human
cugugagaugcuagaa

SEQ ID NO: 669216 - RNA, 23 nt, Human
cuucagacauagaauuaacacau

SEQ ID NO: 669217 - RNA, 16 nt, Human
cuuccccucugcagcu

SEQ ID NO: 669218 - RNA, 15 nt, Human
cuggccuucggccuc

SEQ ID NO: 669219 - RNA, 15 nt, Human
cuguaauccuugcau

SEQ ID NO: 669220 - RNA, 20 nt, Human
cuggggcuuuaacuccugcu

SEQ ID NO: 669221 - RNA, 16 nt, Human
gaccccugagcuugca

SEQ ID NO: 669222 - RNA, 22 nt, Human
gaccaaccuggaguugaaaauc

SEQ ID NO: 669223 - RNA, 17 nt, Human
gaccaggcacccccaga

SEQ ID NO: 669224 - RNA, 17 nt, Human
gacgcucucuggccuuc

SEQ ID NO: 669225 - RNA, 23 nt, Human
gacagugaaagaaaauaacgaua

SEQ ID NO: 669226 - RNA, 17 nt, Human
gacaugggccccagaua

SEQ ID NO: 669227 - RNA, 20 nt, Human
gacaugggccccagauacca

SEQ ID NO: 669228 - RNA, 18 nt, Human
gacacacugaagaagcac

SEQ ID NO: 669229 - RNA, 15 nt, Human
cuuuuuuugaaucau

SEQ ID NO: 669230 - RNA, 13 nt, Human
gaaaaaaagcuuu

SEQ ID NO: 669231 - RNA, 15 nt, Human
gaaaaguuucccagu

SEQ ID NO: 669232 - RNA, 12 nt, Human
cgauaaaagaca

SEQ ID NO: 669233 - RNA, 14 nt, Human
cgcucucuggccuu

SEQ ID NO: 669234 - RNA, 13 nt, Human
cgcucucuggccu

SEQ ID NO: 669235 - RNA, 23 nt, Human
cggauugagaaggagcucccagg

SEQ ID NO: 669236 - RNA, 15 nt, Human
cggccuccauccuga

SEQ ID NO: 669237 - RNA, 17 nt, Human
cuaaggcaggaggauca

SEQ ID NO: 669238 - RNA, 21 nt, Human
cugaaacugcccacucugcaa

SEQ ID NO: 669239 - RNA, 15 nt, Human
cugacacuaaaacac

SEQ ID NO: 669240 - RNA, 16 nt, Human
cugacucuuaagaaga

SEQ ID NO: 669241 - RNA, 15 nt, Human
cucgagcguugcugg

SEQ ID NO: 669242 - RNA, 21 nt, Human
cuccugccuaagugcagcccc

SEQ ID NO: 669243 - RNA, 13 nt, Human
cuccacauccugu

SEQ ID NO: 669244 - RNA, 20 nt, Human
cucagugucaaugcagcccc

SEQ ID NO: 669245 - RNA, 22 nt, Human
cuauauuuuuuguuaaaugauu

SEQ ID NO: 669246 - RNA, 22 nt, Human
cuaugcuuguaacugucuucua

SEQ ID NO: 669247 - RNA, 21 nt, Human
cuauguagaauauauuuccuu

SEQ ID NO: 669248 - RNA, 17 nt, Human
cuaugucauuugcugga

SEQ ID NO: 669249 - RNA, 17 nt, Human
uucauaagaauucuguu

SEQ ID NO: 669250 - RNA, 13 nt, Human
uucaaacauauau

SEQ ID NO: 669251 - RNA, 15 nt, Human
uuaugcuaagugaaa

SEQ ID NO: 669252 - RNA, 13 nt, Human
uuaaaagaaugau

SEQ ID NO: 669253 - RNA, 22 nt, Human
uuaaaagaaugauuaugaauua

SEQ ID NO: 669254 - RNA, 23 nt, Human
uuagcauggccacaucugagccc

SEQ ID NO: 669255 - RNA, 20 nt, Human
uuaccauuauggauaaagau

SEQ ID NO: 669256 - RNA, 22 nt, Human
uugagcaggauuagauaaggcu

SEQ ID NO: 669257 - RNA, 12 nt, Human
uugaaauuguau

SEQ ID NO: 669258 - RNA, 16 nt, Human
uugaagggaaauuuca

SEQ ID NO: 669259 - RNA, 13 nt, Human
uuccucugagccu

SEQ ID NO: 669260 - RNA, 15 nt, Human
uucuaagaagugaaa

SEQ ID NO: 669261 - RNA, 12 nt, Human
uugaugcuacag

SEQ ID NO: 669262 - RNA, 19 nt, Human
cgagaaaacaauaacgaua

SEQ ID NO: 669263 - RNA, 14 nt, Human
cgagcguugcuggg

SEQ ID NO: 669264 - RNA, 23 nt, Human
ccucugcagcuuccaggcuggcg

SEQ ID NO: 669265 - RNA, 23 nt, Human
ccugcacuccagccugagcgaca

SEQ ID NO: 669266 - RNA, 14 nt, Human
ccugccagcuggcc

SEQ ID NO: 669267 - RNA, 20 nt, Human
ccgauaucuucagaaaaccu

SEQ ID NO: 669268 - RNA, 19 nt, Human
ccuccagggagucucagcu

SEQ ID NO: 669269 - RNA, 19 nt, Human
ccucaaaacuucagacaua

SEQ ID NO: 669270 - RNA, 11 nt, Human
aaauguauucu

SEQ ID NO: 669271 - RNA, 13 nt, Human
aaaugauguuuca

SEQ ID NO: 669272 - RNA, 20 nt, Human
aaauguuuacagauccccaa

SEQ ID NO: 669273 - RNA, 20 nt, Human
aaauugucacaggacagccc

SEQ ID NO: 669274 - RNA, 23 nt, Human
aaaacuuuaugcuaagugaaaua

SEQ ID NO: 669275 - RNA, 17 nt, Human
aaaagaaugauuaugaa

SEQ ID NO: 669276 - RNA, 23 nt, Human
aagccagaucuaugccacaagaa

SEQ ID NO: 669277 - RNA, 15 nt, Human
aagcugaguguuuca

SEQ ID NO: 669278 - RNA, 16 nt, Human
aagggugugugcagca

SEQ ID NO: 669279 - RNA, 17 nt, Human
aagguacuucaaauccu

SEQ ID NO: 669280 - RNA, 18 nt, Human
aaagguauuuuaaucacc

SEQ ID NO: 669281 - RNA, 20 nt, Human
aagacaaggaaaaaauaaca

SEQ ID NO: 669282 - RNA, 20 nt, Human
aacuuguaaaggaauuuaaa

SEQ ID NO: 669283 - RNA, 19 nt, Human
aagcaccaaucaugaauua

SEQ ID NO: 669284 - RNA, 17 nt, Human
aacugaaacaaaauuag

SEQ ID NO: 669285 - RNA, 11 nt, Human
aaaaaaaauua

SEQ ID NO: 669286 - RNA, 15 nt, Human
aacucccuuucaaca

SEQ ID NO: 669287 - RNA, 12 nt, Human
uggaaaacugcu

SEQ ID NO: 669288 - RNA, 23 nt, Human
uggagcucguggaacaguuaccu

SEQ ID NO: 669289 - RNA, 23 nt, Human
uggagcucgugggacagucaccu

SEQ ID NO: 669290 - RNA, 21 nt, Human
uggccuucggccuccauccug

SEQ ID NO: 669291 - RNA, 19 nt, Human
uggccuugugaggagcugg

SEQ ID NO: 669292 - RNA, 14 nt, Human
uggccuucggccuc

SEQ ID NO: 669293 - RNA, 16 nt, Human
uggccuucggccucca

SEQ ID NO: 669294 - RNA, 16 nt, Human
uggaugcucucguuga

SEQ ID NO: 669295 - RNA, 18 nt, Human
ugggcaugguggugugug

SEQ ID NO: 669296 - RNA, 17 nt, Human
ugugagcucaccagucc

SEQ ID NO: 669297 - RNA, 17 nt, Human
ugugcagccaccagucc

SEQ ID NO: 669298 - RNA, 15 nt, Human
ugugccccugcacuc

SEQ ID NO: 669299 - RNA, 15 nt, Human
uguggcagaucuaca

SEQ ID NO: 669300 - RNA, 19 nt, Human
uggugaaaccuggucucua

SEQ ID NO: 669301 - RNA, 11 nt, Human
uguaaaauggu

SEQ ID NO: 669302 - RNA, 13 nt, Human
ugucaaugcagcc

SEQ ID NO: 669303 - RNA, 16 nt, Human
ugucacuuugcuacag

SEQ ID NO: 669304 - RNA, 13 nt, Human
ugucauuugcugg

SEQ ID NO: 669305 - RNA, 20 nt, Human
uguauguacuucaugcuguc

SEQ ID NO: 669306 - RNA, 20 nt, Human
uguauuacaaauccaaugaa

SEQ ID NO: 669307 - RNA, 22 nt, Human
ugaaagaaaauaacaauaaaag

SEQ ID NO: 669308 - RNA, 18 nt, Human
ugaaauaagccagacauc

SEQ ID NO: 669309 - RNA, 13 nt, Human
uccuuggagacag

SEQ ID NO: 669310 - RNA, 12 nt, Human
uccagugauaag

SEQ ID NO: 669311 - RNA, 15 nt, Human
ucccuugaugaagaa

SEQ ID NO: 669312 - RNA, 16 nt, Human
uccugccccugagccc

SEQ ID NO: 669313 - RNA, 16 nt, Human
ugagcagucaggaaag

SEQ ID NO: 669314 - RNA, 22 nt, Human
ugagauuuugcuugagcaggau

SEQ ID NO: 669315 - RNA, 19 nt, Human
ugcuagaacagucucuuga

SEQ ID NO: 669316 - RNA, 19 nt, Human
ugcuauugggguugggggg

SEQ ID NO: 669317 - RNA, 17 nt, Human
ugacacuuaaaaauggu

SEQ ID NO: 669318 - RNA, 14 nt, Human
ugacaaagacaucg

SEQ ID NO: 669319 - RNA, 21 nt, Human
ugagagacacacugaagaagc

SEQ ID NO: 669320 - RNA, 19 nt, Human
guagaaugggggcagcacc

SEQ ID NO: 669321 - RNA, 13 nt, Human
guauggcaaacug

SEQ ID NO: 669322 - RNA, 16 nt, Human
guacucugaaaguuuu

SEQ ID NO: 669323 - RNA, 13 nt, Human
ggaggacgcucuc

SEQ ID NO: 669324 - RNA, 16 nt, Human
ggacgcucucuggccu

SEQ ID NO: 669325 - RNA, 19 nt, Human
guuuauuuguuuuuccagu

SEQ ID NO: 669326 - RNA, 22 nt, Human
guuucauaagaauucuguugau

SEQ ID NO: 669327 - RNA, 18 nt, Human
guauauauaucauagcaa

SEQ ID NO: 669328 - RNA, 17 nt, Human
uccacuggaaaacugcu

SEQ ID NO: 669329 - RNA, 15 nt, Human
uccagauccuggaaa

SEQ ID NO: 669330 - RNA, 17 nt, Human
uccaaguucaaaacuua

SEQ ID NO: 669331 - RNA, 21 nt, Human
uccagauccuggaaaucaggg

SEQ ID NO: 669332 - RNA, 23 nt, Human
uccaggcuggcgugcagcaucag

SEQ ID NO: 669333 - RNA, 15 nt, Human
uccauccugaggcuc

SEQ ID NO: 669334 - RNA, 17 nt, Human
uaacgauaaaagacagu

SEQ ID NO: 669335 - RNA, 15 nt, Human
uaaacaguagugaua

SEQ ID NO: 669336 - RNA, 20 nt, Human
uaaagcuucuguuccgugcu

SEQ ID NO: 669337 - RNA, 11 nt, Human
uauaaaggauu

SEQ ID NO: 669338 - RNA, 15 nt, Human
uaggauguugaaaaa

SEQ ID NO: 669339 - RNA, 23 nt, Human
cuuaaaaaugguuuaaaugguca

SEQ ID NO: 669340 - RNA, 19 nt, Human
cuguauacugugugcuaaa

SEQ ID NO: 669341 - RNA, 16 nt, Human
cuggccaacgggguga

SEQ ID NO: 669342 - RNA, 20 nt, Human
cuggcuaauuagcauggcca

SEQ ID NO: 669343 - RNA, 14 nt, Human
cuggcuccagcugg

SEQ ID NO: 669344 - RNA, 17 nt, Human
cuugaguuuaaauugua

SEQ ID NO: 669345 - RNA, 14 nt, Human
gaaugggggcagca

SEQ ID NO: 669346 - RNA, 20 nt, Human
cuugcccuggugccucaccc

SEQ ID NO: 669347 - RNA, 14 nt, Human
gaaguauaggccag

SEQ ID NO: 669348 - RNA, 15 nt, Human
cuagagcaaagccau

SEQ ID NO: 669349 - RNA, 15 nt, Human
cuagaacucccuuuc

SEQ ID NO: 669350 - RNA, 14 nt, Human
cugccuauauuuuu

SEQ ID NO: 669351 - RNA, 20 nt, Human
cuggaauaauccuaaacaua

SEQ ID NO: 669352 - RNA, 18 nt, Human
cuaccaaaaaaaggaagg

SEQ ID NO: 669353 - RNA, 22 nt, Human
cuacuuguggggcuaaggcagg

SEQ ID NO: 669354 - RNA, 19 nt, Human
cuaagcauuccaacuaucu

SEQ ID NO: 669355 - RNA, 15 nt, Human
ggaaacguauucaaa

SEQ ID NO: 669356 - RNA, 14 nt, Human
ggaauuuaaaaauc

SEQ ID NO: 669357 - RNA, 14 nt, Human
ggacacauaucaaa

SEQ ID NO: 669358 - RNA, 16 nt, Human
ggacaugggccccaga

SEQ ID NO: 669359 - RNA, 11 nt, Human
ggaaaugcucc

SEQ ID NO: 669360 - RNA, 14 nt, Human
ggaacaaggaagga

SEQ ID NO: 669361 - RNA, 13 nt, Human
gcuuuuuuugaau

SEQ ID NO: 669362 - RNA, 16 nt, Human
gcuggcgugcagcauc

SEQ ID NO: 669363 - RNA, 20 nt, Human
gcucuggacaggcacuaucu

SEQ ID NO: 669364 - RNA, 17 nt, Human
gcugccuccccagcucu

SEQ ID NO: 669365 - RNA, 22 nt, Human
gcccuuccccucugcagcuucc

SEQ ID NO: 669366 - RNA, 13 nt, Human
gccuccauccuga

SEQ ID NO: 669367 - RNA, 16 nt, Human
gccuacuaaaugcuca

SEQ ID NO: 669368 - RNA, 19 nt, Human
gauaaggcuguucuuuaaa

SEQ ID NO: 669369 - RNA, 19 nt, Human
gagguacugagagugaaca

SEQ ID NO: 669370 - RNA, 13 nt, Human
gaugaauuaaguu

SEQ ID NO: 669371 - RNA, 21 nt, Human
gccauagucauucugccugcc

SEQ ID NO: 669372 - RNA, 17 nt, Human
gccaugggacagggagg

SEQ ID NO: 669373 - RNA, 14 nt, Human
gacacuuaaaaaug

SEQ ID NO: 669374 - RNA, 14 nt, Human
cgaaccuugaaaac

SEQ ID NO: 669375 - RNA, 24 nt, Human
ccugguuggucacagaaugacuga

SEQ ID NO: 669376 - RNA, 14 nt, Human
ccuuccucugagcc

SEQ ID NO: 669377 - RNA, 17 nt, Human
ccuucucucaaggagag

SEQ ID NO: 669378 - RNA, 18 nt, Human
cgagaaaacaauaacgau

SEQ ID NO: 669379 - RNA, 21 nt, Human
cgagaaaacaauaacgauaaa

SEQ ID NO: 669380 - RNA, 22 nt, Human
cgagacccugucucaauaaaua

SEQ ID NO: 669381 - RNA, 21 nt, Human
cgauaaaagacagugaaagaa

SEQ ID NO: 669382 - RNA, 18 nt, Human
ccguugaacgucacaucu

SEQ ID NO: 669383 - RNA, 16 nt, Human
ccgggcguggugguga

SEQ ID NO: 669384 - RNA, 22 nt, Human
ccugccucaagcuaugugagcu

SEQ ID NO: 669385 - RNA, 20 nt, Human
cccacucugcaagaagaaau

SEQ ID NO: 669386 - RNA, 12 nt, Human
ccauaccccugg

SEQ ID NO: 669387 - RNA, 17 nt, Human
ccaugaacuauaugacu

SEQ ID NO: 669388 - RNA, 18 nt, Human
ccauuuuuagugaaauau

SEQ ID NO: 669389 - RNA, 12 nt, Human
ccagcacagccu

SEQ ID NO: 669390 - RNA, 16 nt, Human
ccaggcacccccagaa

SEQ ID NO: 669391 - RNA, 16 nt, Human
ccagguaccuucucac

SEQ ID NO: 669392 - RNA, 16 nt, Human
cccgugugccugagcg

SEQ ID NO: 669393 - RNA, 20 nt, Human
ccccucuggcuccagcuggc

SEQ ID NO: 669394 - RNA, 17 nt, Human
ccccugagcuugcagag

SEQ ID NO: 669395 - RNA, 18 nt, Human
cccugaaagucccagauc

SEQ ID NO: 669396 - RNA, 21 nt, Human
cccugagcuugcagagaugag

SEQ ID NO: 669397 - RNA, 20 nt, Human
cccugaggugagcaucaucu

SEQ ID NO: 669398 - RNA, 22 nt, Human
cccugcugagucccaggcugag

SEQ ID NO: 669399 - RNA, 17 nt, Human
cccuugguccuggaaca

SEQ ID NO: 669400 - RNA, 12 nt, Human
caugauccugca

SEQ ID NO: 669401 - RNA, 17 nt, Human
caugucuagagaacacu

SEQ ID NO: 669402 - RNA, 17 nt, Human
caugugcuggccaccug

SEQ ID NO: 669403 - RNA, 23 nt, Human
cauggugaaaccuggucucuaca

SEQ ID NO: 669404 - RNA, 23 nt, Human
caucgcagacacaugugcuggcc

SEQ ID NO: 669405 - RNA, 20 nt, Human
cauuguuggcuguuccugca

SEQ ID NO: 669406 - RNA, 17 nt, Human
caggaaguagaggaggc

SEQ ID NO: 669407 - RNA, 14 nt, Human
cauagugagacacu

SEQ ID NO: 669408 - RNA, 20 nt, Human
augggccauaugaaaaggcu

SEQ ID NO: 669409 - RNA, 17 nt, Human
augggcuuuggaugauu

SEQ ID NO: 669410 - RNA, 17 nt, Human
auuacaaauccaaugaa

SEQ ID NO: 669411 - RNA, 11 nt, Human
auuaaaaccuc

SEQ ID NO: 669412 - RNA, 19 nt, Human
caagagccuuuuuuugaaa

SEQ ID NO: 669413 - RNA, 14 nt, Human
caagaaauauuccu

SEQ ID NO: 669414 - RNA, 15 nt, Human
cacaccaaccuucug

SEQ ID NO: 669415 - RNA, 22 nt, Human
caagccagauuuuccugaaaac

SEQ ID NO: 669416 - RNA, 12 nt, Human
cagcagagaagu

SEQ ID NO: 669417 - RNA, 21 nt, Human
agaucacuugagcucaggagg

SEQ ID NO: 669418 - RNA, 14 nt, Human
agaugcuagaacuc

SEQ ID NO: 669419 - RNA, 21 nt, Human
agagccuuuuuuugaaaaaaa

SEQ ID NO: 669420 - RNA, 17 nt, Human
agacaagaaggaaagau

SEQ ID NO: 669421 - RNA, 17 nt, Human
aggcuguggauuuaaug

SEQ ID NO: 669422 - RNA, 13 nt, Human
agggaggacgcuc

SEQ ID NO: 669423 - RNA, 14 nt, Human
agggcaagagagcg

SEQ ID NO: 669424 - RNA, 13 nt, Human
agggcagaugaug

SEQ ID NO: 669425 - RNA, 14 nt, Human
acuuccaagagccu

SEQ ID NO: 669426 - RNA, 18 nt, Human
agaaaacaauaacgauaa

SEQ ID NO: 669427 - RNA, 15 nt, Human
agaaaauaacgauaa

SEQ ID NO: 669428 - RNA, 23 nt, Human
acuuguggggcuaaggcaggagg

SEQ ID NO: 669429 - RNA, 22 nt, Human
agacacugucucuaccaaaaaa

SEQ ID NO: 669430 - RNA, 23 nt, Human
agaaugaccuggccgcagugagg

SEQ ID NO: 669431 - RNA, 21 nt, Human
agaauucuguugauggaaaua

SEQ ID NO: 669432 - RNA, 14 nt, Human
agaaauaggaaaua

SEQ ID NO: 669433 - RNA, 13 nt, Human
agaaagaaaauca

SEQ ID NO: 669434 - RNA, 15 nt, Human
agaagaaaucaugau

SEQ ID NO: 669435 - RNA, 11 nt, Human
agugaaaaucu

SEQ ID NO: 669436 - RNA, 21 nt, Human
aguccuguaauggaagcaucu

SEQ ID NO: 669437 - RNA, 18 nt, Human
aguauauauaucauagca

SEQ ID NO: 669438 - RNA, 15 nt, Human
agucaagggugugug

SEQ ID NO: 669439 - RNA, 13 nt, Human
auauuauuuuaua

SEQ ID NO: 669440 - RNA, 23 nt, Human
auaugacuggccacacaggaucu

SEQ ID NO: 669441 - RNA, 15 nt, Human
agugugaggaaaacc

SEQ ID NO: 669442 - RNA, 17 nt, Human
auauauuuccuuauuca

SEQ ID NO: 669443 - RNA, 13 nt, Human
auaucaaacugaa

SEQ ID NO: 669444 - RNA, 12 nt, Human
aucauuuacuuu

SEQ ID NO: 669445 - RNA, 16 nt, Human
aucaaacuuuacagaa

SEQ ID NO: 669446 - RNA, 14 nt, Human
aucaccaaggagcc

SEQ ID NO: 669447 - RNA, 13 nt, Human
aucagcaucccua

SEQ ID NO: 669448 - RNA, 17 nt, Human
aucaauccaagaacuua

SEQ ID NO: 669449 - RNA, 23 nt, Human
auauuuccuuauucagaauuucu

SEQ ID NO: 669450 - RNA, 11 nt, Human
auauuucuguu

SEQ ID NO: 669451 - RNA, 23 nt, Human
augcugagcccggaaacuccaca

SEQ ID NO: 669452 - RNA, 23 nt, Human
augcuacaggauuugaaauugua

SEQ ID NO: 669453 - RNA, 19 nt, Human
augcuagaacucccuuuca

SEQ ID NO: 669454 - RNA, 13 nt, Human
aacuaaaaauuaa

SEQ ID NO: 669455 - RNA, 21 nt, Human
aagacccaaaaggcagaagca

SEQ ID NO: 669456 - RNA, 22 nt, Human
aagacagugaaagaaaauaaca

SEQ ID NO: 669457 - RNA, 16 nt, Human
aaauuagaaauguaau

SEQ ID NO: 669458 - RNA, 15 nt, Human
aacccagggaagaca

SEQ ID NO: 669459 - RNA, 20 nt, Human
acaaaugggaaacaaaagga

SEQ ID NO: 669460 - RNA, 15 nt, Human
aauuauuucacuuua

SEQ ID NO: 669461 - RNA, 14 nt, Human
aauuggagcucgug

SEQ ID NO: 669462 - RNA, 16 nt, Human
aagccaugugcagcca

SEQ ID NO: 669463 - RNA, 22 nt, Human
aagcaacccaaauguucaucaa

SEQ ID NO: 669464 - RNA, 23 nt, Human
acaaucuaggaugggaacaagga

SEQ ID NO: 669465 - RNA, 13 nt, Human
acacaucaggaaa

SEQ ID NO: 669466 - RNA, 12 nt, Human
acaaggaaggaa

SEQ ID NO: 669467 - RNA, 13 nt, Human
acaauaaaagaca

SEQ ID NO: 669468 - RNA, 12 nt, Human
accucaggcaau

SEQ ID NO: 669469 - RNA, 14 nt, Human
acaccucagcugcc

SEQ ID NO: 669470 - RNA, 16 nt, Human
acacuaaaacaccuca

SEQ ID NO: 669471 - RNA, 20 nt, Human
acacuguuaucuucacuuuu

SEQ ID NO: 669472 - RNA, 17 nt, Human
acuccuguucaugccca

SEQ ID NO: 669473 - RNA, 19 nt, Human
acucugcaagaagaaauca

SEQ ID NO: 669474 - RNA, 22 nt, Human
acugucucuaccaaaaaaagga

SEQ ID NO: 669475 - RNA, 12 nt, Human
acugcagaagac

SEQ ID NO: 669476 - RNA, 11 nt, Human
acuauaaaacu

SEQ ID NO: 669477 - RNA, 16 nt, Human
uuuggucuaucuuuga

SEQ ID NO: 669478 - RNA, 15 nt, Human
uucuucucacauuua

SEQ ID NO: 669479 - RNA, 20 nt, Human
uugcuaagcauuccaacuau

SEQ ID NO: 669480 - RNA, 17 nt, Human
uuguggggcuaaggcag

SEQ ID NO: 669481 - RNA, 14 nt, Human
uuguauuuaaggau

SEQ ID NO: 669482 - RNA, 14 nt, Human
uucagccugaaaga

SEQ ID NO: 669483 - RNA, 18 nt, Human
uuccucacuuugaagagu

SEQ ID NO: 669484 - RNA, 21 nt, Human
uucggccuccauccugaggcu

SEQ ID NO: 669485 - RNA, 23 nt, Human
ucuacauaaaauacaaaaacuua

SEQ ID NO: 669486 - RNA, 16 nt, Human
ucuacuggcugccaga

SEQ ID NO: 669487 - RNA, 13 nt, Human
uccuggaaaucag

SEQ ID NO: 669488 - RNA, 15 nt, Human
ugaaagaaaauaacg

SEQ ID NO: 669489 - RNA, 20 nt, Human
ugggcacaacacaucaggaa

SEQ ID NO: 669490 - RNA, 23 nt, Human
ugguguguucaagaccagccugg

SEQ ID NO: 669491 - RNA, 18 nt, Human
ugucauuugcuggagcuc

SEQ ID NO: 669492 - RNA, 15 nt, Human
guuaucuucacuuuu

SEQ ID NO: 669493 - RNA, 15 nt, Human
gugggaccugggcca

SEQ ID NO: 669494 - RNA, 19 nt, Human
guuaugauuaaguaaugau

SEQ ID NO: 669495 - RNA, 13 nt, Human
uaagaagugaaaa

SEQ ID NO: 669496 - RNA, 13 nt, Human
uaagcaaacuuac

SEQ ID NO: 669497 - RNA, 18 nt, Human
uaauuuuagacauucuuu

SEQ ID NO: 669498 - RNA, 13 nt, Human
uacaaaaacuuag

SEQ ID NO: 669499 - RNA, 18 nt, Human
gugagaccaaauugagcu

SEQ ID NO: 669500 - RNA, 15 nt, Human
guauauuuuauauca

SEQ ID NO: 669501 - RNA, 17 nt, Human
uauuaaguauuuuauua

SEQ ID NO: 669502 - RNA, 18 nt, Human
ucaaacauauauaacaau

SEQ ID NO: 669503 - RNA, 13 nt, Human
ucaauaucuuuuu

SEQ ID NO: 669504 - RNA, 18 nt, Human
ucaauaaaauccauacau

SEQ ID NO: 669505 - RNA, 21 nt, Human
uccaucaaggguacacugccu

SEQ ID NO: 669506 - RNA, 12 nt, Human
cccccucuggcu

SEQ ID NO: 669507 - RNA, 16 nt, Human
gcuggaaaaguauguu

SEQ ID NO: 669508 - RNA, 17 nt, Human
ggaguaccauaauucug

SEQ ID NO: 669509 - RNA, 18 nt, Human
ggaguaccauaauucugg

SEQ ID NO: 669510 - RNA, 15 nt, Human
ggauuccucacuuug

SEQ ID NO: 669511 - RNA, 12 nt, Human
ggauuuuugaag

SEQ ID NO: 669512 - RNA, 13 nt, Human
ggcagauguuccu

SEQ ID NO: 669513 - RNA, 16 nt, Human
ggcaggaggaucacuu

SEQ ID NO: 669514 - RNA, 16 nt, Human
ggccaggcaugguggu

SEQ ID NO: 669515 - RNA, 12 nt, Human
ggaaaugcuccu

SEQ ID NO: 669516 - RNA, 19 nt, Human
ggaagaccucauuuugaag

SEQ ID NO: 669517 - RNA, 13 nt, Human
ggaauuggagcuc

SEQ ID NO: 669518 - RNA, 18 nt, Human
ggaccaggcacccccaga

SEQ ID NO: 669519 - RNA, 20 nt, Human
ggagaggcaaagaaaggaga

SEQ ID NO: 669520 - RNA, 17 nt, Human
ggcuaguaucaaaagaa

SEQ ID NO: 669521 - RNA, 12 nt, Human
ggcgugcagcau

SEQ ID NO: 669522 - RNA, 15 nt, Human
ggcuaaggcaggagg

SEQ ID NO: 669523 - RNA, 20 nt, Human
ggccaugggacagggaggac

SEQ ID NO: 669524 - RNA, 14 nt, Human
ggccuccauccuga

SEQ ID NO: 669525 - RNA, 17 nt, Human
gggaagccuuggggcug

SEQ ID NO: 669526 - RNA, 22 nt, Human
gggaauuucuucaacucccugc

SEQ ID NO: 669527 - RNA, 13 nt, Human
gggacagggagga

SEQ ID NO: 669528 - RNA, 19 nt, Human
gggacagggaggacgcucu

SEQ ID NO: 669529 - RNA, 18 nt, Human
gguccugcugaaacugcc

SEQ ID NO: 669530 - RNA, 13 nt, Human
gggcagaucacuu

SEQ ID NO: 669531 - RNA, 13 nt, Human
guaguuagcuuuc

SEQ ID NO: 669532 - RNA, 15 nt, Human
guagaauauauuucc

SEQ ID NO: 669533 - RNA, 13 nt, Human
guaagucuuuaau

SEQ ID NO: 669534 - RNA, 14 nt, Human
guaaaggcaaacuu

SEQ ID NO: 669535 - RNA, 22 nt, Human
guaaaggggcagcagugccaaa

SEQ ID NO: 669536 - RNA, 23 nt, Human
aaacccugucucuacuaaaaaua

SEQ ID NO: 669537 - RNA, 24 nt, Human
aaacguauucaaacaauuugaaua

SEQ ID NO: 669538 - RNA, 21 nt, Human
aaaauauaugaggcuacagaa

SEQ ID NO: 669539 - RNA, 17 nt, Human
aaacaaggaugaauuaa

SEQ ID NO: 669540 - RNA, 23 nt, Human
aaagcuccauuuuuagugaaaua

SEQ ID NO: 669541 - RNA, 16 nt, Human
aaacuuugauuuuaua

SEQ ID NO: 669542 - RNA, 20 nt, Human
aaagacaaggaaaaaauaac

SEQ ID NO: 669543 - RNA, 20 nt, Human
aaagacagugaaagaaaaua

SEQ ID NO: 669544 - RNA, 18 nt, Human
aaaguguuugaaagcuuu

SEQ ID NO: 669545 - RNA, 14 nt, Human
aaauaaauaaaaac

SEQ ID NO: 669546 - RNA, 20 nt, Human
auuuuagacauucuuuaucu

SEQ ID NO: 669547 - RNA, 14 nt, Human
caaacuuuacagaa

SEQ ID NO: 669548 - RNA, 13 nt, Human
caaaaaucaaacu

SEQ ID NO: 669549 - RNA, 23 nt, Human
auuuuugugauuuugugauugau

SEQ ID NO: 669550 - RNA, 18 nt, Human
auuucugagcauuuaaua

SEQ ID NO: 669551 - RNA, 20 nt, Human
auuucuugagguaaaagcau

SEQ ID NO: 669552 - RNA, 21 nt, Human
auuucuugagguaaaagcauc

SEQ ID NO: 669553 - RNA, 13 nt, Human
auuugaaauauug

SEQ ID NO: 669554 - RNA, 13 nt, Human
auuugaaauugua

SEQ ID NO: 669555 - RNA, 15 nt, Human
auuguuggcuguucc

SEQ ID NO: 669556 - RNA, 18 nt, Human
caaauugagcuagggggg

SEQ ID NO: 669557 - RNA, 16 nt, Human
caaaguugauuaagaa

SEQ ID NO: 669558 - RNA, 16 nt, Human
caaauauaaauaaaaa

SEQ ID NO: 669559 - RNA, 16 nt, Human
cacucugcaagaagaa

SEQ ID NO: 669560 - RNA, 23 nt, Human
cacuaaauugacacuuaaaaaug

SEQ ID NO: 669561 - RNA, 19 nt, Human
cacugccuucucaacucca

SEQ ID NO: 669562 - RNA, 17 nt, Human
cacuggcuguuaaucuu

SEQ ID NO: 669563 - RNA, 15 nt, Human
auuauguuaaaacug

SEQ ID NO: 669564 - RNA, 19 nt, Human
augagagaacagggcugaa

SEQ ID NO: 669565 - RNA, 14 nt, Human
augaggcuacagaa

SEQ ID NO: 669566 - RNA, 12 nt, Human
augagggcugga

SEQ ID NO: 669567 - RNA, 21 nt, Human
auucccagccagcacagccuc

SEQ ID NO: 669568 - RNA, 21 nt, Human
auugugccccugcacuccagc

SEQ ID NO: 669569 - RNA, 23 nt, Human
auccugaggcuccacuuggucug

SEQ ID NO: 669570 - RNA, 23 nt, Human
auacguuaggaggacaaaaggaa

SEQ ID NO: 669571 - RNA, 13 nt, Human
auacuauuuaauu

SEQ ID NO: 669572 - RNA, 14 nt, Human
auaccacaggaacc

SEQ ID NO: 669573 - RNA, 21 nt, Human
auagccagguaccuucucacc

SEQ ID NO: 669574 - RNA, 17 nt, Human
aucccuuaccugggaaa

SEQ ID NO: 669575 - RNA, 14 nt, Human
aucuacacuccagu

SEQ ID NO: 669576 - RNA, 12 nt, Human
auccuugaagau

SEQ ID NO: 669577 - RNA, 12 nt, Human
aucuggcucugg

SEQ ID NO: 669578 - RNA, 14 nt, Human
augaaauauuaugu

SEQ ID NO: 669579 - RNA, 13 nt, Human
aggaaagagagca

SEQ ID NO: 669580 - RNA, 21 nt, Human
aggaaagaugugaauaggcug

SEQ ID NO: 669581 - RNA, 13 nt, Human
agcuuuccucaaa

SEQ ID NO: 669582 - RNA, 13 nt, Human
agcuucacccuga

SEQ ID NO: 669583 - RNA, 13 nt, Human
agcucuaucccaa

SEQ ID NO: 669584 - RNA, 19 nt, Human
agcucgugggacagucacc

SEQ ID NO: 669585 - RNA, 20 nt, Human
agcucuaaaugucaaucagc

SEQ ID NO: 669586 - RNA, 15 nt, Human
agcugguggcucugu

SEQ ID NO: 669587 - RNA, 14 nt, Human
aggauggcaggagg

SEQ ID NO: 669588 - RNA, 20 nt, Human
aggaaugaaguacucauaca

SEQ ID NO: 669589 - RNA, 18 nt, Human
agcuuugaggaaaauggg

SEQ ID NO: 669590 - RNA, 21 nt, Human
aggaaggaaagaugugaauag

SEQ ID NO: 669591 - RNA, 21 nt, Human
aggaaguauaggccaggcaca

SEQ ID NO: 669592 - RNA, 15 nt, Human
aggaauuuaaaaauc

SEQ ID NO: 669593 - RNA, 11 nt, Human
auaacaaugaa

SEQ ID NO: 669594 - RNA, 13 nt, Human
auaagaauucugu

SEQ ID NO: 669595 - RNA, 16 nt, Human
aggcugaggcaggagg

SEQ ID NO: 669596 - RNA, 14 nt, Human
aggcuccacuuggu

SEQ ID NO: 669597 - RNA, 23 nt, Human
acagcacgggggccaaggaugcc

SEQ ID NO: 669598 - RNA, 15 nt, Human
accagucccucccca

SEQ ID NO: 669599 - RNA, 17 nt, Human
agccugggcaacauggu

SEQ ID NO: 669600 - RNA, 15 nt, Human
acuucuuaggguuau

SEQ ID NO: 669601 - RNA, 22 nt, Human
acuuaaugccacuaaauugaca

SEQ ID NO: 669602 - RNA, 17 nt, Human
acuguacuccagccagg

SEQ ID NO: 669603 - RNA, 18 nt, Human
acucuauaauguguucau

SEQ ID NO: 669604 - RNA, 14 nt, Human
acucuuaagaagac

SEQ ID NO: 669605 - RNA, 16 nt, Human
acucuugauuguggga

SEQ ID NO: 669606 - RNA, 14 nt, Human
acugacaaagacau

SEQ ID NO: 669607 - RNA, 23 nt, Human
acuggcaagaccugauuucugag

SEQ ID NO: 669608 - RNA, 21 nt, Human
acuaucuguuuuuauauuucu

SEQ ID NO: 669609 - RNA, 20 nt, Human
acguuaggaggacaaaagga

SEQ ID NO: 669610 - RNA, 13 nt, Human
acuaaaaauuaaa

SEQ ID NO: 669611 - RNA, 19 nt, Human
acuaauuauacccccugca

SEQ ID NO: 669612 - RNA, 13 nt, Human
acgcucucuggcc

SEQ ID NO: 669613 - RNA, 18 nt, Human
acgauaaaagacagugaa

SEQ ID NO: 669614 - RNA, 15 nt, Human
accauuauggauaaa

SEQ ID NO: 669615 - RNA, 13 nt, Human
accauaauucugg

SEQ ID NO: 669616 - RNA, 12 nt, Human
accaaggcugau

SEQ ID NO: 669617 - RNA, 16 nt, Human
accaaucaugaauuag

SEQ ID NO: 669618 - RNA, 16 nt, Human
accagccuggucaaca

SEQ ID NO: 669619 - RNA, 14 nt, Human
accaggcaccccca

SEQ ID NO: 669620 - RNA, 19 nt, Human
agaaaauaacgauaaaaga

SEQ ID NO: 669621 - RNA, 11 nt, Human
acuugccauaa

SEQ ID NO: 669622 - RNA, 16 nt, Human
acuugccauaaaacuu

SEQ ID NO: 669623 - RNA, 22 nt, Human
acuuuauaaaggauuaauguca

SEQ ID NO: 669624 - RNA, 15 nt, Human
acuuugauuuuauau

SEQ ID NO: 669625 - RNA, 14 nt, Human
agaagugaaaaucu

SEQ ID NO: 669626 - RNA, 17 nt, Human
agaaugggggcagcacc

SEQ ID NO: 669627 - RNA, 13 nt, Human
aaguauuuuauua

SEQ ID NO: 669628 - RNA, 15 nt, Human
agacaaggaaaaaau

SEQ ID NO: 669629 - RNA, 18 nt, Human
aaguugauuaagaaagga

SEQ ID NO: 669630 - RNA, 12 nt, Human
aauaaauaaaua

SEQ ID NO: 669631 - RNA, 13 nt, Human
aaugaaguguuua

SEQ ID NO: 669632 - RNA, 13 nt, Human
aaauaacaaugaa

SEQ ID NO: 669633 - RNA, 19 nt, Human
aaaauaacgauaaaagaca

SEQ ID NO: 669634 - RNA, 18 nt, Human
aaaaugguuuaaaugguc

SEQ ID NO: 669635 - RNA, 15 nt, Human
aaagcugaguguuuc

SEQ ID NO: 669636 - RNA, 11 nt, Human
aaaggaaggaa

SEQ ID NO: 669637 - RNA, 20 nt, Human
aaagaaugauuaugaauuac

SEQ ID NO: 669638 - RNA, 12 nt, Human
aaacaauaacga

SEQ ID NO: 669639 - RNA, 19 nt, Human
aaacaauaacgauaaaaga

SEQ ID NO: 669640 - RNA, 13 nt, Human
aauauucauagca

SEQ ID NO: 669641 - RNA, 15 nt, Human
aauauaaauuuauca

SEQ ID NO: 669642 - RNA, 16 nt, Human
aauaucuuaucuuccu

SEQ ID NO: 669643 - RNA, 22 nt, Human
aaagcuccauuuuuagugaaau

SEQ ID NO: 669644 - RNA, 22 nt, Human
aauaacgauaaaagacagugaa

SEQ ID NO: 669645 - RNA, 15 nt, Human
aauaaauaaauaaau

SEQ ID NO: 669646 - RNA, 23 nt, Human
aauacaucccuuaccugggaaag

SEQ ID NO: 669647 - RNA, 15 nt, Human
acaugauccugcaau

SEQ ID NO: 669648 - RNA, 18 nt, Human
acagugaaagaaaauaac

SEQ ID NO: 669649 - RNA, 18 nt, Human
acaucuggaaaguuuucu

SEQ ID NO: 669650 - RNA, 19 nt, Human
acacuguuaucuucacuuu

SEQ ID NO: 669651 - RNA, 14 nt, Human
acaggcacuaucug

SEQ ID NO: 669652 - RNA, 19 nt, Human
acaauaacgauaaaagaca

SEQ ID NO: 669653 - RNA, 15 nt, Human
caguucugaagaaga

SEQ ID NO: 669654 - RNA, 20 nt, Human
cauauauaacaaugcuguau

SEQ ID NO: 669655 - RNA, 17 nt, Human
cauccaaaggcuccuga

SEQ ID NO: 669656 - RNA, 18 nt, Human
cagugucugcuggagaca

SEQ ID NO: 669657 - RNA, 20 nt, Human
cagugaaagaaaauaacgau

SEQ ID NO: 669658 - RNA, 23 nt, Human
cagugaaagaaaauaacgauaaa

SEQ ID NO: 669659 - RNA, 15 nt, Human
caggaaagagagcac

SEQ ID NO: 669660 - RNA, 18 nt, Human
cagcuuccaggcuggcgu

SEQ ID NO: 669661 - RNA, 14 nt, Human
caggaggaucacuu

SEQ ID NO: 669662 - RNA, 18 nt, Human
caggcacaguggcucaca

SEQ ID NO: 669663 - RNA, 15 nt, Human
cagggacuugaaccc

SEQ ID NO: 669664 - RNA, 18 nt, Human
cagggagucucagcuuca

SEQ ID NO: 669665 - RNA, 22 nt, Human
cagguaccuucucaccugugag

SEQ ID NO: 669666 - RNA, 19 nt, Human
caucuccucaacucugagu

SEQ ID NO: 669667 - RNA, 16 nt, Human
caucugaugagaacaa

SEQ ID NO: 669668 - RNA, 18 nt, Human
cauggccacaucugagcc

SEQ ID NO: 669669 - RNA, 14 nt, Human
cauuuuggaaggcu

SEQ ID NO: 669670 - RNA, 15 nt, Human
ccaaguucaaaacuu

SEQ ID NO: 669671 - RNA, 13 nt, Human
cauggugaaaccu

SEQ ID NO: 669672 - RNA, 13 nt, Human
ccaugggacaggg

SEQ ID NO: 669673 - RNA, 19 nt, Human
ccauuauggauaaagauga

SEQ ID NO: 669674 - RNA, 19 nt, Human
cccacuugccauaaaacuu

SEQ ID NO: 669675 - RNA, 22 nt, Human
ccauggaaacgaagcaccauca

SEQ ID NO: 669676 - RNA, 12 nt, Human
caauaaaagaca

SEQ ID NO: 669677 - RNA, 21 nt, Human
caaguaaaaggaaaugcuccu

SEQ ID NO: 669678 - RNA, 20 nt, Human
cacaaucuaggaugggaaca

SEQ ID NO: 669679 - RNA, 13 nt, Human
cacauaucaaacu

SEQ ID NO: 669680 - RNA, 20 nt, Human
caccaaggcugauuaaacca

SEQ ID NO: 669681 - RNA, 22 nt, Human
caccucagcugccuccccagcu

SEQ ID NO: 669682 - RNA, 23 nt, Human
cagaucacuugagcucaggaggu

SEQ ID NO: 669683 - RNA, 22 nt, Human
cacuaaacaaagagugaaggau

SEQ ID NO: 669684 - RNA, 14 nt, Human
caccugcugagccc

SEQ ID NO: 669685 - RNA, 18 nt, Human
caccuuaucuauguagaa

SEQ ID NO: 669686 - RNA, 17 nt, Human
auuuuggaaggcugagg

SEQ ID NO: 669687 - RNA, 23 nt, Human
auuuuggcaagcucuaucaccaa

SEQ ID NO: 669688 - RNA, 15 nt, Human
auuuguaacaagccu

SEQ ID NO: 669689 - RNA, 17 nt, Human
auuuguaacaagccucc

SEQ ID NO: 669690 - RNA, 21 nt, Human
caaacugaaacaaaauuagaa

SEQ ID NO: 669691 - RNA, 17 nt, Human
caaaagaaagaaaauca

SEQ ID NO: 669692 - RNA, 21 nt, Human
auuuuuuuuuucaauaaaacu

SEQ ID NO: 669693 - RNA, 14 nt, Human
caaaaaucaaacuu

SEQ ID NO: 669694 - RNA, 18 nt, Human
caaauauaaauaaaaaua

SEQ ID NO: 669695 - RNA, 15 nt, Human
caaagcccagcuuga

SEQ ID NO: 669696 - RNA, 20 nt, Human
caaccuggaguugaaaaucu

SEQ ID NO: 669697 - RNA, 19 nt, Human
caagacugcacaucaaaau

SEQ ID NO: 669698 - RNA, 18 nt, Human
auuucuaaagccauugua

SEQ ID NO: 669699 - RNA, 14 nt, Human
auuugaauauaaau

SEQ ID NO: 669700 - RNA, 21 nt, Human
auuugaauauaaauuuaucau

SEQ ID NO: 669701 - RNA, 19 nt, Human
auuugcuguuauuuuaucu

SEQ ID NO: 669702 - RNA, 18 nt, Human
auuugggcacaacacauc

SEQ ID NO: 669703 - RNA, 15 nt, Human
auucugaaagcaacc

SEQ ID NO: 669704 - RNA, 18 nt, Human
auucugccugcccugaaa

SEQ ID NO: 669705 - RNA, 14 nt, Human
auugagaaggagcu

SEQ ID NO: 669706 - RNA, 17 nt, Human
auaucuucagaaaaccu

SEQ ID NO: 669707 - RNA, 16 nt, Human
aucaggaaagagagca

SEQ ID NO: 669708 - RNA, 13 nt, Human
aucacuugaaccc

SEQ ID NO: 669709 - RNA, 15 nt, Human
aucaauccaagaacu

SEQ ID NO: 669710 - RNA, 13 nt, Human
aguuuauauagaa

SEQ ID NO: 669711 - RNA, 22 nt, Human
aguuuauauagaaauguauucu

SEQ ID NO: 669712 - RNA, 14 nt, Human
auaaaaacaaaguu

SEQ ID NO: 669713 - RNA, 22 nt, Human
auaacgauaaaagacagugaaa

SEQ ID NO: 669714 - RNA, 20 nt, Human
auaaagcuuaggucaaaguu

SEQ ID NO: 669715 - RNA, 20 nt, Human
auaacaaugaaaguugauaa

SEQ ID NO: 669716 - RNA, 21 nt, Human
auaaguugcauagguuuaaua

SEQ ID NO: 669717 - RNA, 15 nt, Human
auaaucagagauaaa

SEQ ID NO: 669718 - RNA, 14 nt, Human
auaacaauaaaaga

SEQ ID NO: 669719 - RNA, 17 nt, Human
auaauuuugugaagcaa

SEQ ID NO: 669720 - RNA, 23 nt, Human
auacuauuuaauuauuucacuuu

SEQ ID NO: 669721 - RNA, 16 nt, Human
augcugagcccggaaa

SEQ ID NO: 669722 - RNA, 19 nt, Human
augacuggccacacaggau

SEQ ID NO: 669723 - RNA, 13 nt, Human
aucuucagaaaac

SEQ ID NO: 669724 - RNA, 15 nt, Human
aucuuauaauuuaaa

SEQ ID NO: 669725 - RNA, 11 nt, Human
aucucuucugg

SEQ ID NO: 669726 - RNA, 14 nt, Human
auguuucuugggga

SEQ ID NO: 669727 - RNA, 21 nt, Human
auguugacucuaaaguugauu

SEQ ID NO: 669728 - RNA, 24 nt, Human
auggcuugaguuuaaauuguaaua

SEQ ID NO: 669729 - RNA, 15 nt, Human
augucugaaauggaa

SEQ ID NO: 669730 - RNA, 19 nt, Human
augguuucuagagaugguu

SEQ ID NO: 669731 - RNA, 20 nt, Human
agcucaggaggucaagauca

SEQ ID NO: 669732 - RNA, 12 nt, Human
agcuucuguucc

SEQ ID NO: 669733 - RNA, 16 nt, Human
aggaaguauaggccag

SEQ ID NO: 669734 - RNA, 19 nt, Human
aggaauugacccacaagaa

SEQ ID NO: 669735 - RNA, 20 nt, Human
aggcugagaugggagaauca

SEQ ID NO: 669736 - RNA, 18 nt, Human
aggcugaugggcaaaaaa

SEQ ID NO: 669737 - RNA, 14 nt, Human
aggcaggaggauca

SEQ ID NO: 669738 - RNA, 20 nt, Human
aggcacccccagaaugaccu

SEQ ID NO: 669739 - RNA, 15 nt, Human
agugaauaaagucau

SEQ ID NO: 669740 - RNA, 15 nt, Human
aguucugaagaagau

SEQ ID NO: 669741 - RNA, 16 nt, Human
agucuuauauauugua

SEQ ID NO: 669742 - RNA, 15 nt, Human
agucuuucacauuua

SEQ ID NO: 669743 - RNA, 19 nt, Human
uugugugaaagguacuuca

SEQ ID NO: 669744 - RNA, 13 nt, Human
uuuaaauuguaau

SEQ ID NO: 669745 - RNA, 11 nt, Human
uuuaacuccug

SEQ ID NO: 669746 - RNA, 15 nt, Human
ugccauaaaacuuag

SEQ ID NO: 669747 - RNA, 15 nt, Human
ugccauguggcagau

SEQ ID NO: 669748 - RNA, 18 nt, Human
ugcagugucugcuggaga

SEQ ID NO: 669749 - RNA, 13 nt, Human
agcccagcuugaa

SEQ ID NO: 669750 - RNA, 19 nt, Human
agcuacuugggaggcugag

SEQ ID NO: 669751 - RNA, 17 nt, Human
agccuugggaccccuga

SEQ ID NO: 669752 - RNA, 20 nt, Human
agccuaguugaucagcuuau

SEQ ID NO: 669753 - RNA, 17 nt, Human
guuaucuucacuuuuau

SEQ ID NO: 669754 - RNA, 15 nt, Human
guucuaagaagugaa

SEQ ID NO: 669755 - RNA, 22 nt, Human
uacagguccugcugaaacugcc

SEQ ID NO: 669756 - RNA, 13 nt, Human
uagauaauacagu

SEQ ID NO: 669757 - RNA, 14 nt, Human
ucaaacugaaacaa

SEQ ID NO: 669758 - RNA, 15 nt, Human
ucaaagauagggagg

SEQ ID NO: 669759 - RNA, 12 nt, Human
ucaagccugccu

SEQ ID NO: 669760 - RNA, 23 nt, Human
ucaauaucuuuuuuuuaauaaac

SEQ ID NO: 669761 - RNA, 16 nt, Human
ucacauuuaaauaaag

SEQ ID NO: 669762 - RNA, 15 nt, Human
ucacuuuuauaagaa

SEQ ID NO: 669763 - RNA, 12 nt, Human
ucuaaaaguuua

SEQ ID NO: 669764 - RNA, 18 nt, Human
ucuagagcaaagccaucc

SEQ ID NO: 669765 - RNA, 13 nt, Human
ucucagguguguu

SEQ ID NO: 669766 - RNA, 21 nt, Human
ucagcucagcuaaugaagugu

SEQ ID NO: 669767 - RNA, 22 nt, Human
ucuugaggcacagaaacuccug

SEQ ID NO: 669768 - RNA, 16 nt, Human
ugagcgacagugagac

SEQ ID NO: 669769 - RNA, 18 nt, Human
ucuuagaugcaguucuga

SEQ ID NO: 669770 - RNA, 14 nt, Human
ucugcuggagacau

SEQ ID NO: 669771 - RNA, 20 nt, Human
ugauaugggucuugauaaau

SEQ ID NO: 669772 - RNA, 19 nt, Human
ugagucccaggcugagccu

SEQ ID NO: 669773 - RNA, 18 nt, Human
gcggaccuucccagcuag

SEQ ID NO: 669774 - RNA, 15 nt, Human
gccaccaagcuggug

SEQ ID NO: 669775 - RNA, 18 nt, Human
ggccaugggacagggagg

SEQ ID NO: 669776 - RNA, 17 nt, Human
ggcauagaaguaaaaac

SEQ ID NO: 669777 - RNA, 21 nt, Human
ggccacacaggaucuuuugua

SEQ ID NO: 669778 - RNA, 21 nt, Human
gugggauacuauuuaauuauu

SEQ ID NO: 669779 - RNA, 17 nt, Human
gugacuauuauauuucc

SEQ ID NO: 669780 - RNA, 23 nt, Human
gugagcagucaggaaagagaacu

SEQ ID NO: 669781 - RNA, 16 nt, Human
guaaaauagugaauaa

SEQ ID NO: 669782 - RNA, 22 nt, Human
guaaugauaacuggaaacuuca

SEQ ID NO: 669783 - RNA, 19 nt, Human
gguggugagugccuguaau

SEQ ID NO: 669784 - RNA, 14 nt, Human
ggugugugcagcau

SEQ ID NO: 669785 - RNA, 21 nt, Human
ggucucuacauaaaauacaaa

SEQ ID NO: 669786 - RNA, 23 nt, Human
gguauguuuucaggcuagaugua

SEQ ID NO: 669787 - RNA, 15 nt, Human
gcagcaucagcaucc

SEQ ID NO: 669788 - RNA, 21 nt, Human
gcagcauuguuggcuguuccu

SEQ ID NO: 669789 - RNA, 19 nt, Human
gcacgcauggaaaaguuuc

SEQ ID NO: 669790 - RNA, 21 nt, Human
gcagaagcaacccaaauguuc

SEQ ID NO: 669791 - RNA, 17 nt, Human
gcauagaaguaaaaaca

SEQ ID NO: 669792 - RNA, 14 nt, Human
gcaugggaagugac

SEQ ID NO: 669793 - RNA, 14 nt, Human
gagccccgaaucug

SEQ ID NO: 669794 - RNA, 17 nt, Human
gaugcaguucugaagaa

SEQ ID NO: 669795 - RNA, 15 nt, Human
gauggaguuucucua

SEQ ID NO: 669796 - RNA, 16 nt, Human
gagagaaugagagaca

SEQ ID NO: 669797 - RNA, 18 nt, Human
gacucuggucaagaagca

SEQ ID NO: 669798 - RNA, 13 nt, Human
gagacaagcagcc

SEQ ID NO: 669799 - RNA, 16 nt, Human
gauguugaaaaaguuc

SEQ ID NO: 669800 - RNA, 15 nt, Human
gauguauguacuuca

SEQ ID NO: 669801 - RNA, 14 nt, Human
gaaaucauacuucu

SEQ ID NO: 669802 - RNA, 19 nt, Human
gaaagaugugaauaggcug

SEQ ID NO: 669803 - RNA, 18 nt, Human
gaacagauuucaaaaaaa

SEQ ID NO: 669804 - RNA, 22 nt, Human
gaacauuuauguuccuuuuaaa

SEQ ID NO: 669805 - RNA, 15 nt, Human
gacaugggccccaga

SEQ ID NO: 669806 - RNA, 18 nt, Human
gaccccugagcuugcaga

SEQ ID NO: 669807 - RNA, 18 nt, Human
agccaaauguaaaauagu

SEQ ID NO: 669808 - RNA, 14 nt, Human
cuuuuaaagaaaca

SEQ ID NO: 669809 - RNA, 15 nt, Human
cuuuucccaacucca

SEQ ID NO: 669810 - RNA, 20 nt, Human
gaaaacaauaacgauaaaag

SEQ ID NO: 669811 - RNA, 17 nt, Human
gaaaauaacgauaaaag

SEQ ID NO: 669812 - RNA, 17 nt, Human
gaaagaaaauaacaaua

SEQ ID NO: 669813 - RNA, 23 nt, Human
gaaaacuuuaugcuaagugaaau

SEQ ID NO: 669814 - RNA, 17 nt, Human
gaaaauaacaauaaaag

SEQ ID NO: 669815 - RNA, 18 nt, Human
agccagaucuaugccaca

SEQ ID NO: 669816 - RNA, 14 nt, Human
cugcccauccugcc

SEQ ID NO: 669817 - RNA, 15 nt, Human
cugcccauccugccc

SEQ ID NO: 669818 - RNA, 14 nt, Human
cauaaaauacaaaa

SEQ ID NO: 669819 - RNA, 20 nt, Human
cuauguagaauauauuuccu

SEQ ID NO: 669820 - RNA, 18 nt, Human
cuauuuaauuauuucacu

SEQ ID NO: 669821 - RNA, 18 nt, Human
cuauuuauuaaguauuuu

SEQ ID NO: 669822 - RNA, 16 nt, Human
cucagcugccucccca

SEQ ID NO: 669823 - RNA, 19 nt, Human
cagacacaugugcuggcca

SEQ ID NO: 669824 - RNA, 16 nt, Human
cacuguuaucuucacu

SEQ ID NO: 669825 - RNA, 12 nt, Human
cacuuggucugu

SEQ ID NO: 669826 - RNA, 20 nt, Human
cagaaaaccuaagcaaacuu

SEQ ID NO: 669827 - RNA, 22 nt, Human
cagaaacuccuguucaugccca

SEQ ID NO: 669828 - RNA, 22 nt, Human
cagaacuaaaaauuaaaaccuc

SEQ ID NO: 669829 - RNA, 15 nt, Human
cagugaaagaaaaua

SEQ ID NO: 669830 - RNA, 20 nt, Human
cagugaaagaaaauaacaau

SEQ ID NO: 669831 - RNA, 23 nt, Human
cagugaaagaaaauaacaauaaa

SEQ ID NO: 669832 - RNA, 20 nt, Human
agacagugaaagaaaauaac

SEQ ID NO: 669833 - RNA, 19 nt, Human
agacaucaacagauaaaua

SEQ ID NO: 669834 - RNA, 11 nt, Human
cugcagcuucc

SEQ ID NO: 669835 - RNA, 13 nt, Human
cugcagcuuccag

SEQ ID NO: 669836 - RNA, 14 nt, Human
cugccagcuggccu

SEQ ID NO: 669837 - RNA, 16 nt, Human
cucuguagaaggagua

SEQ ID NO: 669838 - RNA, 14 nt, Human
cucuggccuucggc

SEQ ID NO: 669839 - RNA, 16 nt, Human
cucuggccuucggccu

SEQ ID NO: 669840 - RNA, 22 nt, Human
cucuacauaaaauacaaaaacu

SEQ ID NO: 669841 - RNA, 16 nt, Human
cugagagugaacaaau

SEQ ID NO: 669842 - RNA, 18 nt, Human
cugagccuugggaccccu

SEQ ID NO: 669843 - RNA, 18 nt, Human
cugagcggaccuucccag

SEQ ID NO: 669844 - RNA, 20 nt, Human
cugaucaccugcccugcuga

SEQ ID NO: 669845 - RNA, 13 nt, Human
cuccuuggagaca

SEQ ID NO: 669846 - RNA, 14 nt, Human
cucucaaggagagg

SEQ ID NO: 669847 - RNA, 16 nt, Human
cucaugaguaacugau

SEQ ID NO: 669848 - RNA, 17 nt, Human
cucccaacuauaaaacu

SEQ ID NO: 669849 - RNA, 22 nt, Human
cucccuuggggccuaugcagag

SEQ ID NO: 669850 - RNA, 14 nt, Human
aggaaggaaagaug

SEQ ID NO: 669851 - RNA, 22 nt, Human
agcauuguuggcuguuccugca

SEQ ID NO: 669852 - RNA, 14 nt, Human
uauuaaguauuuua

SEQ ID NO: 669853 - RNA, 15 nt, Human
augggacagggagga

SEQ ID NO: 669854 - RNA, 15 nt, Human
aggcagauguuccua

SEQ ID NO: 669855 - RNA, 20 nt, Human
aacaagccuccuuuuaaagu

SEQ ID NO: 669856 - RNA, 14 nt, Human
gcuggagcucugcc

SEQ ID NO: 669857 - RNA, 14 nt, Human
aucuucagaaaacc

SEQ ID NO: 669858 - RNA, 17 nt, Human
uuauauuugaaauauug

SEQ ID NO: 669859 - RNA, 14 nt, Human
ugggcagaucacuu

SEQ ID NO: 669860 - RNA, 17 nt, Human
acaaaugggaaacaaaa

SEQ ID NO: 669861 - RNA, 14 nt, Human
agaaauaggaaaua

SEQ ID NO: 669862 - RNA, 12 nt, Human
aagagcuuaaca

SEQ ID NO: 669863 - RNA, 18 nt, Human
auaauccuaaacauauga

SEQ ID NO: 669864 - RNA, 15 nt, Human
ggcuggcgugcagca

SEQ ID NO: 669865 - RNA, 13 nt, Human
cuacagugagcca

SEQ ID NO: 669866 - RNA, 19 nt, Human
guccaggucuaccaaaaau

SEQ ID NO: 669867 - RNA, 24 nt, Human
uggcagaucuacaugucuagagaa

SEQ ID NO: 669868 - RNA, 12 nt, Human
aaaagaaagaaa

SEQ ID NO: 669869 - RNA, 17 nt, Human
ugaaaaucuuauaauuu

SEQ ID NO: 669870 - RNA, 17 nt, Human
uuaaauggucaauuuug

SEQ ID NO: 669871 - RNA, 20 nt, Human
caccucagcugccuccccag

SEQ ID NO: 669872 - RNA, 21 nt, Human
accaaggagccaaacauccua

SEQ ID NO: 669873 - RNA, 12 nt, Human
agaucaagccug

SEQ ID NO: 669874 - RNA, 13 nt, Human
ggcaggcacugcc

SEQ ID NO: 669875 - RNA, 22 nt, Human
caaacaauuugaauauaaauuu

SEQ ID NO: 669876 - RNA, 22 nt, Human
ggcagcuuuccucaaaacuuca

SEQ ID NO: 669877 - RNA, 14 nt, Human
agcucguggaacag

SEQ ID NO: 669878 - RNA, 15 nt, Human
cuugugaggagcugg

SEQ ID NO: 669879 - RNA, 20 nt, Human
aagcuucacuguaaaauaau

SEQ ID NO: 669880 - RNA, 13 nt, Human
agccucagucucc

SEQ ID NO: 669881 - RNA, 15 nt, Human
uuauagcuacuaauu

SEQ ID NO: 669882 - RNA, 13 nt, Human
uagcauggccaca

SEQ ID NO: 669883 - RNA, 12 nt, Human
gacccugucuca

SEQ ID NO: 669884 - RNA, 18 nt, Human
accaccugccuauauuuu

SEQ ID NO: 669885 - RNA, 21 nt, Human
auuauauuuauuacuguaaga

SEQ ID NO: 669886 - RNA, 16 nt, Human
cacuuaaaaaugguuu

SEQ ID NO: 669887 - RNA, 22 nt, Human
uaauaggcguaacuaauuuuaa

SEQ ID NO: 669888 - RNA, 11 nt, Human
aaaaaaaggaa

SEQ ID NO: 669889 - RNA, 21 nt, Human
cauuucuugagguaaaagcau

SEQ ID NO: 669890 - RNA, 19 nt, Human
cugagccucagucucccuc

SEQ ID NO: 669891 - RNA, 20 nt, Human
acagaacuaaaaauuaaaac

SEQ ID NO: 669892 - RNA, 15 nt, Human
aaugucugaaaugga

SEQ ID NO: 669893 - RNA, 14 nt, Human
ucaaugcagccccc

SEQ ID NO: 669894 - RNA, 19 nt, Human
uaucucauuuccaagcaag

SEQ ID NO: 669895 - RNA, 17 nt, Human
agaacucccuuucaaca

SEQ ID NO: 669896 - RNA, 22 nt, Human
augcugagcccggaaacuccac

SEQ ID NO: 669897 - RNA, 14 nt, Human
aaagaaacaaaaau

SEQ ID NO: 669898 - RNA, 20 nt, Human
uuguaggugacuauuauauu

SEQ ID NO: 669899 - RNA, 13 nt, Human
ugugcuggccacc

SEQ ID NO: 669900 - RNA, 21 nt, Human
auuccuuuuucucuccucucc

SEQ ID NO: 669901 - RNA, 17 nt, Human
uccucugagccuuggga

SEQ ID NO: 669902 - RNA, 16 nt, Human
ucuucaacucccugcc

SEQ ID NO: 669903 - RNA, 21 nt, Human
uugccuaggcauagcccugcc

SEQ ID NO: 669904 - RNA, 16 nt, Human
gccaaggaugccccgu

SEQ ID NO: 669905 - RNA, 16 nt, Human
ggugcugcagccccug

SEQ ID NO: 669906 - RNA, 15 nt, Human
uugacacuuaaaaau

SEQ ID NO: 669907 - RNA, 14 nt, Human
acaaauccaaugaa

SEQ ID NO: 669908 - RNA, 16 nt, Human
cuuagcccuuccccuc

SEQ ID NO: 669909 - RNA, 18 nt, Human
uacuuuauuuucuauaau

SEQ ID NO: 669910 - RNA, 21 nt, Human
acuccagccagggcaagagag

SEQ ID NO: 669911 - RNA, 16 nt, Human
uuagagaauuuccuua

SEQ ID NO: 669912 - RNA, 19 nt, Human
cagagaugaggccgccaug

SEQ ID NO: 669913 - RNA, 19 nt, Human
aagcuuguauuccuuuuuc

SEQ ID NO: 669914 - RNA, 13 nt, Human
ugggcaaaaaacc

SEQ ID NO: 669915 - RNA, 12 nt, Human
uuauuucacuuu

SEQ ID NO: 669916 - RNA, 19 nt, Human
aauguuuacagauccccaa

SEQ ID NO: 669917 - RNA, 18 nt, Human
gauuucaaaaaaaaaccc

SEQ ID NO: 669918 - RNA, 23 nt, Human
gcuggccuugugaggagcuggaa

SEQ ID NO: 669919 - RNA, 18 nt, Human
cuuuccaugaguugcagu

SEQ ID NO: 669920 - RNA, 16 nt, Human
cuuauaauuuaaaaua

SEQ ID NO: 669921 - RNA, 12 nt, Human
uacuaaaugcuc

SEQ ID NO: 669922 - RNA, 15 nt, Human
acaaaugggaaacaa

SEQ ID NO: 669923 - RNA, 14 nt, Human
cacaucaggaaaga

SEQ ID NO: 669924 - RNA, 20 nt, Human
uaacgauaaaagacagugaa

SEQ ID NO: 669925 - RNA, 17 nt, Human
aacaguuaccucugccu

SEQ ID NO: 669926 - RNA, 13 nt, Human
gaaccuaggguga

SEQ ID NO: 669927 - RNA, 22 nt, Human
cuuccuaauuccacagcugcuc

SEQ ID NO: 669928 - RNA, 14 nt, Human
uuuuauaugcuauu

SEQ ID NO: 669929 - RNA, 13 nt, Human
ggcuccugagaca

SEQ ID NO: 669930 - RNA, 17 nt, Human
uauuuguacauuuuuuu

SEQ ID NO: 669931 - RNA, 20 nt, Human
ucuucagcagagaaguuuuc

SEQ ID NO: 669932 - RNA, 13 nt, Human
cugagagugaaca

SEQ ID NO: 669933 - RNA, 15 nt, Human
uaaaacuuuuccaau

SEQ ID NO: 669934 - RNA, 18 nt, Human
caaacuuuacagaaagau

SEQ ID NO: 669935 - RNA, 17 nt, Human
cuggacucaccuccccc

SEQ ID NO: 669936 - RNA, 17 nt, Human
cuaauaucuuaucuucc

SEQ ID NO: 669937 - RNA, 20 nt, Human
uaguuauaaaaauauauagc

SEQ ID NO: 669938 - RNA, 18 nt, Human
ccugaaagaggaaugaag

SEQ ID NO: 669939 - RNA, 19 nt, Human
uacuucuuaggguuaugau

SEQ ID NO: 669940 - RNA, 18 nt, Human
aggcggauugagaaggag

SEQ ID NO: 669941 - RNA, 16 nt, Human
agggagggaaggggga

SEQ ID NO: 669942 - RNA, 23 nt, Human
ucccuagaaagccaugugcagcc

SEQ ID NO: 669943 - RNA, 13 nt, Human
aguguuuagcaua

SEQ ID NO: 669944 - RNA, 13 nt, Human
uaaauauauauuu

SEQ ID NO: 669945 - RNA, 12 nt, Human
cucauggaauug

SEQ ID NO: 669946 - RNA, 17 nt, Human
uaagaaauaggaaauau

SEQ ID NO: 669947 - RNA, 13 nt, Human
uuuuuuuuuucaa

SEQ ID NO: 669948 - RNA, 16 nt, Human
uucaauaaaacuuuuc

SEQ ID NO: 669949 - RNA, 14 nt, Human
acuuuuauaagaaa

SEQ ID NO: 669950 - RNA, 18 nt, Human
cauggaauuggagcucgu

SEQ ID NO: 669951 - RNA, 17 nt, Human
gaaaaucaggcuggcca

SEQ ID NO: 669952 - RNA, 23 nt, Human
auuuuagauagaugaagaagcua

SEQ ID NO: 669953 - RNA, 22 nt, Human
aaacauguuuaucguauuugau

SEQ ID NO: 669954 - RNA, 22 nt, Human
gcagaugaugcuuugagaacau

SEQ ID NO: 669955 - RNA, 11 nt, Human
agugucugcug

SEQ ID NO: 669956 - RNA, 14 nt, Human
ugcagcuuccaggc

SEQ ID NO: 669957 - RNA, 23 nt, Human
gaggcauuuaggccaugggacag

SEQ ID NO: 669958 - RNA, 12 nt, Human
cccccagcccuc

SEQ ID NO: 669959 - RNA, 15 nt, Human
uagagaauuuccuua

SEQ ID NO: 669960 - RNA, 21 nt, Human
caguaguuagcuuucuuccug

SEQ ID NO: 669961 - RNA, 14 nt, Human
auaaauaaauaaau

SEQ ID NO: 669962 - RNA, 14 nt, Human
uaaauaaauaaaua

SEQ ID NO: 669963 - RNA, 18 nt, Human
ccuugggaccccugagcu

SEQ ID NO: 669964 - RNA, 11 nt, Human
acugggacagg

SEQ ID NO: 669965 - RNA, 16 nt, Human
ugcuguauuuuaaaag

SEQ ID NO: 669966 - RNA, 14 nt, Human
agaaaauaacaaua

SEQ ID NO: 669967 - RNA, 14 nt, Human
uauuuauuuuaaua

SEQ ID NO: 669968 - RNA, 15 nt, Human
augucugaaauggaa

SEQ ID NO: 669969 - RNA, 19 nt, Human
gccccccagcccuccuuau

SEQ ID NO: 669970 - RNA, 23 nt, Human
ucuccauguacuggcaagaccug

SEQ ID NO: 669971 - RNA, 14 nt, Human
gggaccugggccau

SEQ ID NO: 669972 - RNA, 19 nt, Human
aggggggucagccagcccu

SEQ ID NO: 669973 - RNA, 18 nt, Human
ccugccuaagugcagccc

SEQ ID NO: 669974 - RNA, 13 nt, Human
caugggccccaga

SEQ ID NO: 669975 - RNA, 17 nt, Human
acaaaaggaauguguaa

SEQ ID NO: 669976 - RNA, 21 nt, Human
ccaaggaugccccgucccccu

SEQ ID NO: 669977 - RNA, 18 nt, Human
gacauuugcucauggaau

SEQ ID NO: 669978 - RNA, 12 nt, Human
gcaaagcccagc

SEQ ID NO: 669979 - RNA, 15 nt, Human
cgggagccugaucac

SEQ ID NO: 669980 - RNA, 14 nt, Human
agcccucuucugac

SEQ ID NO: 669981 - RNA, 16 nt, Human
aggaggaucacuugag

SEQ ID NO: 669982 - RNA, 17 nt, Human
cagggcugaagcugugu

SEQ ID NO: 669983 - RNA, 13 nt, Human
gugagcaucaucu

SEQ ID NO: 669984 - RNA, 19 nt, Human
gccuggucaacauagugag

SEQ ID NO: 669985 - RNA, 16 nt, Human
gaauggcuaagcaaaa

SEQ ID NO: 669986 - RNA, 23 nt, Human
aggagcuguugagguaccuccaa

SEQ ID NO: 669987 - RNA, 20 nt, Human
aaacuuuaugcuaagugaaa

SEQ ID NO: 669988 - RNA, 19 nt, Human
uaggugacuauuauauuuc

SEQ ID NO: 669989 - RNA, 21 nt, Human
gccugaucaccugcccugcug

SEQ ID NO: 669990 - RNA, 14 nt, Human
acagaauuuuaugc

SEQ ID NO: 669991 - RNA, 13 nt, Human
cguugagccacca

SEQ ID NO: 669992 - RNA, 16 nt, Human
uuaauaauuuuuaauu

SEQ ID NO: 669993 - RNA, 15 nt, Human
uguuaucuucacuuu

SEQ ID NO: 669994 - RNA, 22 nt, Human
accuuaucuauguagaauauau

SEQ ID NO: 669995 - RNA, 17 nt, Human
aucaaggguacacugcc

SEQ ID NO: 669996 - RNA, 14 nt, Human
auaaaauaauuuuu

SEQ ID NO: 669997 - RNA, 21 nt, Human
ugaaauggacuuuuguacaua

SEQ ID NO: 669998 - RNA, 13 nt, Human
caguuauuauauu

SEQ ID NO: 669999 - RNA, 15 nt, Human
agagugugaggaaaa

SEQ ID NO: 670000 - RNA, 13 nt, Human
uauuucuaugaaa

SEQ ID NO: 670001 - RNA, 23 nt, Human
acguaaucguguccccuauccua

SEQ ID NO: 670002 - RNA, 22 nt, Human
uugaaaaucuuauaauuuaaaa

SEQ ID NO: 670003 - RNA, 19 nt, Human
gaaaauaacgauaaaagac

SEQ ID NO: 670004 - RNA, 16 nt, Human
auuuuaauaauguuuc

SEQ ID NO: 670005 - RNA, 16 nt, Human
acaugaacuuguaaag

SEQ ID NO: 670006 - RNA, 14 nt, Human
caccaaccuucuga

SEQ ID NO: 670007 - RNA, 23 nt, Human
uagucauucugccugcccugaaa

SEQ ID NO: 670008 - RNA, 17 nt, Human
agcucugcccauccugc

SEQ ID NO: 670009 - RNA, 16 nt, Human
guugauggaaauacac

SEQ ID NO: 670010 - RNA, 17 nt, Human
caaauauaaauaaaaau

SEQ ID NO: 670011 - RNA, 21 nt, Human
caccucagcugccuccccagc

SEQ ID NO: 670012 - RNA, 18 nt, Human
cccacuagacccacugga

SEQ ID NO: 670013 - RNA, 22 nt, Human
uaaaauaauuuuuauauuugaa

SEQ ID NO: 670014 - RNA, 14 nt, Human
cuggagcucugccc

SEQ ID NO: 670015 - RNA, 15 nt, Human
acucaacaaacauaa

SEQ ID NO: 670016 - RNA, 23 nt, Human
uuuguauaaaauaauuuuuauau

SEQ ID NO: 670017 - RNA, 15 nt, Human
ccucuucugacacua

SEQ ID NO: 670018 - RNA, 16 nt, Human
gugaaaccuggucucu

SEQ ID NO: 670019 - RNA, 13 nt, Human
acuauuauauuuc

SEQ ID NO: 670020 - RNA, 23 nt, Human
ggccuccauccugaggcuccacu

SEQ ID NO: 670021 - RNA, 20 nt, Human
agccuuggggcugaugcagu

SEQ ID NO: 670022 - RNA, 16 nt, Human
uaacaauaaaagacaa

SEQ ID NO: 670023 - RNA, 16 nt, Human
agacauugaggcaggc

SEQ ID NO: 670024 - RNA, 14 nt, Human
cacaacacacagau

SEQ ID NO: 670025 - RNA, 13 nt, Human
uuaugcuaaguga

SEQ ID NO: 670026 - RNA, 15 nt, Human
aauucugaaagcaac

SEQ ID NO: 670027 - RNA, 16 nt, Human
uuagauagaugaagaa

SEQ ID NO: 670028 - RNA, 16 nt, Human
uauaaauuuaucauuu

SEQ ID NO: 670029 - RNA, 17 nt, Human
cugagcggaccuuccca

SEQ ID NO: 670030 - RNA, 16 nt, Human
gagaacacugugcucu

SEQ ID NO: 670031 - RNA, 19 nt, Human
uggagccuacuaaaugcuc

SEQ ID NO: 670032 - RNA, 22 nt, Human
agacccacuggacucaccuccc

SEQ ID NO: 670033 - RNA, 18 nt, Human
auuauuucacuuuagaaa

SEQ ID NO: 670034 - RNA, 19 nt, Human
ccauccugccccugagccc

SEQ ID NO: 670035 - RNA, 15 nt, Human
uaguauggcaaacug

SEQ ID NO: 670036 - RNA, 22 nt, Human
aaaguugauuuaaggccaggca

SEQ ID NO: 670037 - RNA, 16 nt, Human
ucugcagauaaacagu

SEQ ID NO: 670038 - RNA, 16 nt, Human
caauaacgauaaaaga

SEQ ID NO: 670039 - RNA, 15 nt, Human
gacucaccuccccca

SEQ ID NO: 670040 - RNA, 17 nt, Human
uaccaaaaaaaggaagg

SEQ ID NO: 670041 - RNA, 16 nt, Human
ccagaucaagccugcc

SEQ ID NO: 670042 - RNA, 21 nt, Human
ucagggcagaugaugcuuuga

SEQ ID NO: 670043 - RNA, 22 nt, Human
aaagagugaaggauuuauguuu

SEQ ID NO: 670044 - RNA, 15 nt, Human
gccccugggaccagg

SEQ ID NO: 670045 - RNA, 16 nt, Human
aggccaugggacaggg

SEQ ID NO: 670046 - RNA, 14 nt, Human
ugaggcuacagaac

SEQ ID NO: 670047 - RNA, 15 nt, Human
aaaauaacaaugaaa

SEQ ID NO: 670048 - RNA, 14 nt, Human
acguuaggaggaca

SEQ ID NO: 670049 - RNA, 19 nt, Human
auguuuacagauccccaag

SEQ ID NO: 670050 - RNA, 14 nt, Human
agugucuugaauug

SEQ ID NO: 670051 - RNA, 14 nt, Human
uaauuauuucacuu

SEQ ID NO: 670052 - RNA, 21 nt, Human
acacuaaaacaccucagcugc

SEQ ID NO: 670053 - RNA, 14 nt, Human
cagagucaagggug

SEQ ID NO: 670054 - RNA, 19 nt, Human
ggucgaggcuacagugagc

SEQ ID NO: 670055 - RNA, 23 nt, Human
uugauuuuauaugcuauuuauua

SEQ ID NO: 670056 - RNA, 13 nt, Human
cccaaaaggcaga

SEQ ID NO: 670057 - RNA, 19 nt, Human
caagcagcccuuagcccuu

SEQ ID NO: 670058 - RNA, 20 nt, Human
cacccccagaaugaccuggc

SEQ ID NO: 670059 - RNA, 13 nt, Human
ccaaauugagcua

SEQ ID NO: 670060 - RNA, 18 nt, Human
cugcagccccugggacca

SEQ ID NO: 670061 - RNA, 19 nt, Human
cccugccccccagcccucc

SEQ ID NO: 670062 - RNA, 17 nt, Human
ccagggaagacaagaag

SEQ ID NO: 670063 - RNA, 23 nt, Human
uuuaaugccgauaucuucagaaa

SEQ ID NO: 670064 - RNA, 23 nt, Human
gccagguaccuucucaccuguga

SEQ ID NO: 670065 - RNA, 17 nt, Human
uccuuggugccuggagc

SEQ ID NO: 670066 - RNA, 19 nt, Human
ugagcgcccacuagaccca

SEQ ID NO: 670067 - RNA, 14 nt, Human
agaucaagccugcc

SEQ ID NO: 670068 - RNA, 23 nt, Human
ccagaucaagccugccucaauca

SEQ ID NO: 670069 - RNA, 19 nt, Human
uagugagcagucaggaaag

SEQ ID NO: 670070 - RNA, 16 nt, Human
acugcuaguuuauaua

SEQ ID NO: 670071 - RNA, 18 nt, Human
gaugcaguucugaagaag

SEQ ID NO: 670072 - RNA, 17 nt, Human
ucuuauaauuuaaaaua

SEQ ID NO: 670073 - RNA, 11 nt, Human
agacacaugug

SEQ ID NO: 670074 - RNA, 16 nt, Human
cugcucucaguucacu

SEQ ID NO: 670075 - RNA, 22 nt, Human
cccagaaugaccuggccgcagu

SEQ ID NO: 670076 - RNA, 17 nt, Human
ccaucaguuccagccuu

SEQ ID NO: 670077 - RNA, 23 nt, Human
aucgcagacacaugugcuggcca

SEQ ID NO: 670078 - RNA, 15 nt, Human
uuuaaggauucugag

SEQ ID NO: 670079 - RNA, 19 nt, Human
ccaccugccuauauuuuuu

SEQ ID NO: 670080 - RNA, 23 nt, Human
agccuugggaccccugagcuugc

SEQ ID NO: 670081 - RNA, 18 nt, Human
ucccaacuauaaaacuag

SEQ ID NO: 670082 - RNA, 20 nt, Human
aauaagccagacaucaacag

SEQ ID NO: 670083 - RNA, 22 nt, Human
cuucagccugaaagaggaauga

SEQ ID NO: 670084 - RNA, 18 nt, Human
agcuagaauucacuccac

SEQ ID NO: 670085 - RNA, 19 nt, Human
uggaacaguuaccucugcc

SEQ ID NO: 670086 - RNA, 16 nt, Human
caaaaaaaggaaggaa

SEQ ID NO: 670087 - RNA, 14 nt, Human
acacugaagaagca

SEQ ID NO: 670088 - RNA, 16 nt, Human
aaggagauacagugga

SEQ ID NO: 670089 - RNA, 18 nt, Human
uaaaauccauacauuugu

SEQ ID NO: 670090 - RNA, 20 nt, Human
ucauucacucaacaaacaua

SEQ ID NO: 670091 - RNA, 16 nt, Human
uguccccuauccuacu

SEQ ID NO: 670092 - RNA, 21 nt, Human
ugaauuguaggugacuauuau

SEQ ID NO: 670093 - RNA, 22 nt, Human
gauaagagauguugacucuaaa

SEQ ID NO: 670094 - RNA, 15 nt, Human
ccgugugccugagcg

SEQ ID NO: 670095 - RNA, 17 nt, Human
ucaauccaagaacuuau

SEQ ID NO: 670096 - RNA, 18 nt, Human
cuuucacauuuaaauaaa

SEQ ID NO: 670097 - RNA, 12 nt, Human
cauguuccccuu

SEQ ID NO: 670098 - RNA, 17 nt, Human
aauucuugccaaauaua

SEQ ID NO: 670099 - RNA, 21 nt, Human
cacuaucuggguuuugggggg

SEQ ID NO: 670100 - RNA, 17 nt, Human
guagaaugggggcagca

SEQ ID NO: 670101 - RNA, 14 nt, Human
ccagcuggccggga

SEQ ID NO: 670102 - RNA, 14 nt, Human
gagcccauggcacu

SEQ ID NO: 670103 - RNA, 16 nt, Human
uuguaaaggaauuuaa

SEQ ID NO: 670104 - RNA, 15 nt, Human
cuugaaaacuuuaug

SEQ ID NO: 670105 - RNA, 15 nt, Human
auaaauaaauaaaua

SEQ ID NO: 670106 - RNA, 15 nt, Human
uaaauaaauaaauaa

SEQ ID NO: 670107 - RNA, 12 nt, Human
ccaggcugagcc

SEQ ID NO: 670108 - RNA, 18 nt, Human
auccugugggaccugggc

SEQ ID NO: 670109 - RNA, 14 nt, Human
ggcuccagcuggcc

SEQ ID NO: 670110 - RNA, 13 nt, Human
uaguuuauauaga

SEQ ID NO: 670111 - RNA, 19 nt, Human
caagagagcgagacccugu

SEQ ID NO: 670112 - RNA, 17 nt, Human
caauaacgauaaaagac

SEQ ID NO: 670113 - RNA, 15 nt, Human
uucccgugugccuga

SEQ ID NO: 670114 - RNA, 21 nt, Human
guacuccagccagggcaagag

SEQ ID NO: 670115 - RNA, 14 nt, Human
aggggcagcagugc

SEQ ID NO: 670116 - RNA, 13 nt, Human
uuaaaaaagaaac

SEQ ID NO: 670117 - RNA, 20 nt, Human
cugcacacagcacgggggcc

SEQ ID NO: 670118 - RNA, 11 nt, Human
caauaaaagac

SEQ ID NO: 670119 - RNA, 16 nt, Human
gaaucacuugaacccg

SEQ ID NO: 670120 - RNA, 15 nt, Human
agcucuaucaccaag

SEQ ID NO: 670121 - RNA, 18 nt, Human
aucagcaucccuagaaag

SEQ ID NO: 670122 - RNA, 14 nt, Human
ugaagauguagagg

SEQ ID NO: 670123 - RNA, 21 nt, Human
agggugauauuaaccaggggc

SEQ ID NO: 670124 - RNA, 15 nt, Human
ucugucucaguccau

SEQ ID NO: 670125 - RNA, 15 nt, Human
augggaacaaggaag

SEQ ID NO: 670126 - RNA, 18 nt, Human
uaggaaauauuuuaaugu

SEQ ID NO: 670127 - RNA, 14 nt, Human
auucugccugcccu

SEQ ID NO: 670128 - RNA, 18 nt, Human
uaucccaaccucucccaa

SEQ ID NO: 670129 - RNA, 15 nt, Human
cagaauucauucacu

SEQ ID NO: 670130 - RNA, 14 nt, Human
gggaagacaagaag

SEQ ID NO: 670131 - RNA, 18 nt, Human
cagcugcucaauaaagua

SEQ ID NO: 670132 - RNA, 18 nt, Human
ggcucuggacaggcacua

SEQ ID NO: 670133 - RNA, 15 nt, Human
aguuuauauagaaau

SEQ ID NO: 670134 - RNA, 16 nt, Human
cuucuggguuccuucc

SEQ ID NO: 670135 - RNA, 15 nt, Human
ugccccccagcccuc

SEQ ID NO: 670136 - RNA, 20 nt, Human
aaaagacagugaaagaaaau

SEQ ID NO: 670137 - RNA, 15 nt, Human
augaauuaaguuuuu

SEQ ID NO: 670138 - RNA, 16 nt, Human
guugagguaccuccaa

SEQ ID NO: 670139 - RNA, 20 nt, Human
ccgauaucuucagaaaaccu

SEQ ID NO: 670140 - RNA, 14 nt, Human
uuucuguuaaaaua

SEQ ID NO: 670141 - RNA, 17 nt, Human
uugggguugggggggag

SEQ ID NO: 670142 - RNA, 18 nt, Human
acaccucagcugccuccc

SEQ ID NO: 670143 - RNA, 20 nt, Human
aagucuuucacauuuaaaua

SEQ ID NO: 670144 - RNA, 12 nt, Human
ucaccccuugcc

SEQ ID NO: 670145 - RNA, 20 nt, Human
acaagacacagugaccauac

SEQ ID NO: 670146 - RNA, 16 nt, Human
agcuccagugauaaga

SEQ ID NO: 670147 - RNA, 21 nt, Human
ccuccccaaaugcuuuccaug

SEQ ID NO: 670148 - RNA, 16 nt, Human
uaucaaaagaaagaaa

SEQ ID NO: 670149 - RNA, 14 nt, Human
aacaccucagcugc

SEQ ID NO: 670150 - RNA, 15 nt, Human
agccucagucucccu

SEQ ID NO: 670151 - RNA, 14 nt, Human
augaacuuuuuguu

SEQ ID NO: 670152 - RNA, 15 nt, Human
cuccacuggaaaacu

SEQ ID NO: 670153 - RNA, 12 nt, Human
ccugccagcugg

SEQ ID NO: 670154 - RNA, 15 nt, Human
aauacaaaaacuuag

SEQ ID NO: 670155 - RNA, 14 nt, Human
aaacuuuuccaaug

SEQ ID NO: 670156 - RNA, 16 nt, Human
cagaucaagccugccu

SEQ ID NO: 670157 - RNA, 21 nt, Human
uuggaaggcugaggcaggagg

SEQ ID NO: 670158 - RNA, 17 nt, Human
uccuacaagacacagug

SEQ ID NO: 670159 - RNA, 17 nt, Human
aagcuuuuuuugaauca

SEQ ID NO: 670160 - RNA, 14 nt, Human
acauagugaggagc

SEQ ID NO: 670161 - RNA, 19 nt, Human
auugaggacacugauaugg

SEQ ID NO: 670162 - RNA, 21 nt, Human
uccauccugaggcuccacuug

SEQ ID NO: 670163 - RNA, 16 nt, Human
gaugcuuugagaacau

SEQ ID NO: 670164 - RNA, 18 nt, Human
uucagcagagaaguuuuc

SEQ ID NO: 670165 - RNA, 21 nt, Human
ggaagacaagaaggaaagauu

SEQ ID NO: 670166 - RNA, 21 nt, Human
acaguuaccucugccucagaa

SEQ ID NO: 670167 - RNA, 17 nt, Human
uuauaucaauuuaaaaa

SEQ ID NO: 670168 - RNA, 13 nt, Human
auugauuauaugu

SEQ ID NO: 670169 - RNA, 22 nt, Human
gugaacaaauuuacagagacag

SEQ ID NO: 670170 - RNA, 18 nt, Human
ccaagcugguggcucugu

SEQ ID NO: 670171 - RNA, 19 nt, Human
ucaguccaugaagauguag

SEQ ID NO: 670172 - RNA, 17 nt, Human
caugagggcuggaugcu

SEQ ID NO: 670173 - RNA, 23 nt, Human
gaccccugagcuugcagagauga

SEQ ID NO: 670174 - RNA, 12 nt, Human
uuauucacugua

SEQ ID NO: 670175 - RNA, 15 nt, Human
auuuuaaaagaauga

SEQ ID NO: 670176 - RNA, 18 nt, Human
uuuuagugaaauauuauu

SEQ ID NO: 670177 - RNA, 23 nt, Human
agcccuccuuaucaaaggacacc

SEQ ID NO: 670178 - RNA, 19 nt, Human
auucagaauuucuaaaagu

SEQ ID NO: 670179 - RNA, 14 nt, Human
uuaugauuaaguaa

SEQ ID NO: 670180 - RNA, 18 nt, Human
cugcucaauaaaguacaa

SEQ ID NO: 670181 - RNA, 22 nt, Human
cuucaacucccugccccccagc

SEQ ID NO: 670182 - RNA, 12 nt, Human
caugggaaguga

SEQ ID NO: 670183 - RNA, 18 nt, Human
uccagcuggccgggagcc

SEQ ID NO: 670184 - RNA, 18 nt, Human
auucugguagcuaaauau

SEQ ID NO: 670185 - RNA, 16 nt, Human
cccacuggacucaccu

SEQ ID NO: 670186 - RNA, 20 nt, Human
uuuaaauaaaguguuugaaa

SEQ ID NO: 670187 - RNA, 19 nt, Human
aagcuaugugagcucacca

SEQ ID NO: 670188 - RNA, 16 nt, Human
cucaauaaaguacaag

SEQ ID NO: 670189 - RNA, 12 nt, Human
gacacugucucu

SEQ ID NO: 670190 - RNA, 15 nt, Human
ccacaagaaaugaaa

SEQ ID NO: 670191 - RNA, 18 nt, Human
gaaaauaacgauaaaaga

SEQ ID NO: 670192 - RNA, 15 nt, Human
ccucauguccacugg

SEQ ID NO: 670193 - RNA, 20 nt, Human
aaugauguuucauaagaauu

SEQ ID NO: 670194 - RNA, 13 nt, Human
ucucccucccuug

SEQ ID NO: 670195 - RNA, 15 nt, Human
caccucagcugccuc

SEQ ID NO: 670196 - RNA, 20 nt, Human
uuagcauaguaccucugcua

SEQ ID NO: 670197 - RNA, 18 nt, Human
auuugcuggagcucugcc

SEQ ID NO: 670198 - RNA, 22 nt, Human
ucuagcaugucgucaaagcuga

SEQ ID NO: 670199 - RNA, 21 nt, Human
aaucaccaaggcugauuaaac

SEQ ID NO: 670200 - RNA, 19 nt, Human
uccuauaauuuuagacauu

SEQ ID NO: 670201 - RNA, 23 nt, Human
cugaaaucauacuucuuaggguu

SEQ ID NO: 670202 - RNA, 20 nt, Human
caauaaaacuuuuccaauga

SEQ ID NO: 670203 - RNA, 13 nt, Human
acaaggaaaaaau

SEQ ID NO: 670204 - RNA, 17 nt, Human
uuauuacuguaagaaaa

SEQ ID NO: 670205 - RNA, 15 nt, Human
uaucuucacuuuuau

SEQ ID NO: 670206 - RNA, 20 nt, Human
acuaaauugacacuuaaaaa

SEQ ID NO: 670207 - RNA, 17 nt, Human
gauggaguuucucuaga

SEQ ID NO: 670208 - RNA, 19 nt, Human
agucccuccccaaaugcuu

SEQ ID NO: 670209 - RNA, 17 nt, Human
agccagguaccuucuca

SEQ ID NO: 670210 - RNA, 15 nt, Human
ugaugggcaaaaaac

SEQ ID NO: 670211 - RNA, 15 nt, Human
acagugaaagaaaau

SEQ ID NO: 670212 - RNA, 14 nt, Human
aucaggaaagagag

SEQ ID NO: 670213 - RNA, 13 nt, Human
gcucucuggccuu

SEQ ID NO: 670214 - RNA, 18 nt, Human
ugagcuaggggggucagc

SEQ ID NO: 670215 - RNA, 21 nt, Human
cugauauuggacaguaaaauc

SEQ ID NO: 670216 - RNA, 20 nt, Human
aagacagugaaagaaaauaa

SEQ ID NO: 670217 - RNA, 17 nt, Human
guugcugggggggauug

SEQ ID NO: 670218 - RNA, 21 nt, Human
augucauuugcuggagcucug

SEQ ID NO: 670219 - RNA, 23 nt, Human
gcagacucuggucaagaagcauc

SEQ ID NO: 670220 - RNA, 13 nt, Human
cucugagccuugg

SEQ ID NO: 670221 - RNA, 20 nt, Human
agggcaguguucccuggggc

SEQ ID NO: 670222 - RNA, 17 nt, Human
uaacugauuuguaacaa

SEQ ID NO: 670223 - RNA, 15 nt, Human
caaaacuuauuggaa

SEQ ID NO: 670224 - RNA, 18 nt, Human
cuuugagcgcccacuaga

SEQ ID NO: 670225 - RNA, 16 nt, Human
uaccccuggccaagga

SEQ ID NO: 670226 - RNA, 13 nt, Human
uaaacauguuuau

SEQ ID NO: 670227 - RNA, 22 nt, Human
cugccuccccagcucuauccca

SEQ ID NO: 670228 - RNA, 14 nt, Human
cagagaaguuuucu

SEQ ID NO: 670229 - RNA, 21 nt, Human
acagugauuaccagggacuga

SEQ ID NO: 670230 - RNA, 23 nt, Human
uaagaauucuguugauggaaaua

SEQ ID NO: 670231 - RNA, 20 nt, Human
ucugguagcuaaauauauau

SEQ ID NO: 670232 - RNA, 19 nt, Human
auaaaagacagugaaagaa

SEQ ID NO: 670233 - RNA, 22 nt, Human
agcccuccuuaucaaaggacac

SEQ ID NO: 670234 - RNA, 22 nt, Human
gcucuaucccaaccucucccaa

SEQ ID NO: 670235 - RNA, 18 nt, Human
cagucucccucccuuggg

SEQ ID NO: 670236 - RNA, 17 nt, Human
gucaaagcugaaaugga

SEQ ID NO: 670237 - RNA, 22 nt, Human
caaauuuacagagacagaaagc

SEQ ID NO: 670238 - RNA, 17 nt, Human
ccagguaccuucucacc

SEQ ID NO: 670239 - RNA, 14 nt, Human
uuaaacuuugauuu

SEQ ID NO: 670240 - RNA, 15 nt, Human
uucuguuaaaauaua

SEQ ID NO: 670241 - RNA, 20 nt, Human
ucacuguauguccuuggugc

SEQ ID NO: 670242 - RNA, 17 nt, Human
cuucuagcagugagcca

SEQ ID NO: 670243 - RNA, 19 nt, Human
agaaacaaaaaucaaacuu

SEQ ID NO: 670244 - RNA, 20 nt, Human
uaauaaguugcauagguuua

SEQ ID NO: 670245 - RNA, 14 nt, Human
uugugauugauuau

SEQ ID NO: 670246 - RNA, 16 nt, Human
ccaugugcagccacca

SEQ ID NO: 670247 - RNA, 23 nt, Human
agcagcccuuagcccuuccccuc

SEQ ID NO: 670248 - RNA, 23 nt, Human
agaguuuagcuggaaaaguaugu

SEQ ID NO: 670249 - RNA, 13 nt, Human
agaaguaaaaaca

SEQ ID NO: 670250 - RNA, 21 nt, Human
aaguuuaugguuguauuauuu

SEQ ID NO: 670251 - RNA, 18 nt, Human
aguccauugggcaggcag

SEQ ID NO: 670252 - RNA, 23 nt, Human
aucgugucuggcguuguggggau

SEQ ID NO: 670253 - RNA, 21 nt, Human
cucaagcuaugugagcucacc

SEQ ID NO: 670254 - RNA, 13 nt, Human
gggggaggugagg

SEQ ID NO: 670255 - RNA, 20 nt, Human
caaauauaaauaaaaauaau

SEQ ID NO: 670256 - RNA, 15 nt, Human
ucaagaucagccugg

SEQ ID NO: 670257 - RNA, 23 nt, Human
acucuauguucuaagaagugaaa

SEQ ID NO: 670258 - RNA, 17 nt, Human
ccaguaguuagcuuucu

SEQ ID NO: 670259 - RNA, 22 nt, Human
aucuauguagaauauauuuccu

SEQ ID NO: 670260 - RNA, 11 nt, Human
ggucacaggaa

SEQ ID NO: 670261 - RNA, 19 nt, Human
ccuccauccugaggcucca

SEQ ID NO: 670262 - RNA, 19 nt, Human
acuccuguucaugcccaua

SEQ ID NO: 670263 - RNA, 12 nt, Human
ugugaggagcug

SEQ ID NO: 670264 - RNA, 20 nt, Human
aaaacaagcacuaaacaaag

SEQ ID NO: 670265 - RNA, 15 nt, Human
uauuucacuuuagaa

SEQ ID NO: 670266 - RNA, 21 nt, Human
cuugaggcacagaaacuccug

SEQ ID NO: 670267 - RNA, 15 nt, Human
ggugcugcagccccu

SEQ ID NO: 670268 - RNA, 16 nt, Human
ccucaaaacuucagac

SEQ ID NO: 670269 - RNA, 18 nt, Human
cauagugagacacugucu

SEQ ID NO: 670270 - RNA, 17 nt, Human
auccugugggaccuggg

SEQ ID NO: 670271 - RNA, 16 nt, Human
agcuugaaaccuucac

SEQ ID NO: 670272 - RNA, 16 nt, Human
cugcacuccagccuga

SEQ ID NO: 670273 - RNA, 23 nt, Human
aggaugguucccuugaugaagaa

SEQ ID NO: 670274 - RNA, 21 nt, Human
aagucuuucacauuuaaauaa

SEQ ID NO: 670275 - RNA, 17 nt, Human
uuaauaauuuuuaauua

SEQ ID NO: 670276 - RNA, 16 nt, Human
agggcaguguucccug

SEQ ID NO: 670277 - RNA, 23 nt, Human
gggagccugaucaccugcccugc

SEQ ID NO: 670278 - RNA, 22 nt, Human
cccuauccuacuuccccuuccu

SEQ ID NO: 670279 - RNA, 16 nt, Human
auuuaaggauucugag

SEQ ID NO: 670280 - RNA, 15 nt, Human
aaaaauaacaaugaa

SEQ ID NO: 670281 - RNA, 14 nt, Human
ccaaauauaaauaa

SEQ ID NO: 670282 - RNA, 23 nt, Human
gucucccucccuuggggccuaug

SEQ ID NO: 670283 - RNA, 16 nt, Human
uaaaauccauacauuu

SEQ ID NO: 670284 - RNA, 12 nt, Human
cuuaucuuccua

SEQ ID NO: 670285 - RNA, 24 nt, Human
uggccgggagccugaucaccugcc

SEQ ID NO: 670286 - RNA, 18 nt, Human
gaaaauaacaauaaaaga

SEQ ID NO: 670287 - RNA, 17 nt, Human
uuauuuguacauuuuuu

SEQ ID NO: 670288 - RNA, 14 nt, Human
auuuguauaaaaua

SEQ ID NO: 670289 - RNA, 22 nt, Human
agcagcauaaauguugacaugg

SEQ ID NO: 670290 - RNA, 21 nt, Human
ugcuggccaccugcugagccc

SEQ ID NO: 670291 - RNA, 16 nt, Human
cauuuaguuauaaaaa

SEQ ID NO: 670292 - RNA, 23 nt, Human
guaauuccguagguuauuuucag

SEQ ID NO: 670293 - RNA, 19 nt, Human
uuauauuucuguuaaaaua

SEQ ID NO: 670294 - RNA, 12 nt, Human
ggcagcaccucc

SEQ ID NO: 670295 - RNA, 22 nt, Human
ucuggguuccuuccucugagcc

SEQ ID NO: 670296 - RNA, 16 nt, Human
cuccauccugaggcuc

SEQ ID NO: 670297 - RNA, 15 nt, Human
aaugauuaugaauua

SEQ ID NO: 670298 - RNA, 16 nt, Human
gcaucccuagaaagcc

SEQ ID NO: 670299 - RNA, 16 nt, Human
augaauacuuuauaaa

SEQ ID NO: 670300 - RNA, 17 nt, Human
uugugaagcaaaauuuu

SEQ ID NO: 670301 - RNA, 14 nt, Human
cugguggcucugug

SEQ ID NO: 670302 - RNA, 20 nt, Human
auccucgaggcccuagcauu

SEQ ID NO: 670303 - RNA, 17 nt, Human
aaucuuauaauuuaaaa

SEQ ID NO: 670304 - RNA, 15 nt, Human
cuacaagacacagug

SEQ ID NO: 670305 - RNA, 16 nt, Human
agugaaauauuauuuu

SEQ ID NO: 670306 - RNA, 17 nt, Human
ucugugagaugcuagaa

SEQ ID NO: 670307 - RNA, 14 nt, Human
ccaggcaugguggu

SEQ ID NO: 670308 - RNA, 20 nt, Human
ggccaugggacagggaggac

SEQ ID NO: 670309 - RNA, 14 nt, Human
aagagugaaggauu

SEQ ID NO: 670310 - RNA, 14 nt, Human
ccucagucucccuc

SEQ ID NO: 670311 - RNA, 12 nt, Human
gaaagucccaga

SEQ ID NO: 670312 - RNA, 15 nt, Human
ugagacacugucucu

SEQ ID NO: 670313 - RNA, 12 nt, Human
aauacuuuauaa

SEQ ID NO: 670314 - RNA, 15 nt, Human
aagaaaauaacaaua

SEQ ID NO: 670315 - RNA, 13 nt, Human
agcuucuguuccg

SEQ ID NO: 670316 - RNA, 17 nt, Human
ucuuuaucuuuuuagua

SEQ ID NO: 670317 - RNA, 18 nt, Human
gcuccauuuuuagugaaa

SEQ ID NO: 670318 - RNA, 12 nt, Human
uaaaugcucaau

SEQ ID NO: 670319 - RNA, 12 nt, Human
gccagggcaaga

SEQ ID NO: 670320 - RNA, 18 nt, Human
ugagaugguuucuagaga

SEQ ID NO: 670321 - RNA, 18 nt, Human
gccccgucccccucuggc

SEQ ID NO: 670322 - RNA, 12 nt, Human
auuauauuucca

SEQ ID NO: 670323 - RNA, 23 nt, Human
ggaggcagagguugcagugagcc

SEQ ID NO: 670324 - RNA, 18 nt, Human
ccucaagcuaugugagcu

SEQ ID NO: 670325 - RNA, 12 nt, Human
ccuucagccuga

SEQ ID NO: 670326 - RNA, 15 nt, Human
uuaguuuuuaaagua

SEQ ID NO: 670327 - RNA, 22 nt, Human
ugguagcuaaauauauauuuua

SEQ ID NO: 670328 - RNA, 18 nt, Human
cugagccuugggaccccu

SEQ ID NO: 670329 - RNA, 15 nt, Human
uggagacaucuggaa

SEQ ID NO: 670330 - RNA, 13 nt, Human
uauuuauuuuaau

SEQ ID NO: 670331 - RNA, 14 nt, Human
gauugagaaggagc

SEQ ID NO: 670332 - RNA, 18 nt, Human
aaagaaaaucaggcuggc

SEQ ID NO: 670333 - RNA, 17 nt, Human
augauuauuuuauguuu

SEQ ID NO: 670334 - RNA, 13 nt, Human
cuaugaaauauua

SEQ ID NO: 670335 - RNA, 19 nt, Human
gauggaguuucucuagaag

SEQ ID NO: 670336 - RNA, 14 nt, Human
cugccagcuggccu

SEQ ID NO: 670337 - RNA, 20 nt, Human
uuucauaagaauucuguuga

SEQ ID NO: 670338 - RNA, 22 nt, Human
aauuuuuucucuaggaaauauu

SEQ ID NO: 670339 - RNA, 18 nt, Human
acuggacucaccuccccc

SEQ ID NO: 670340 - RNA, 14 nt, Human
ugcagccccuggga

SEQ ID NO: 670341 - RNA, 20 nt, Human
cuugccauaauuacuauguc

SEQ ID NO: 670342 - RNA, 19 nt, Human
guacugagagugaacaaau

SEQ ID NO: 670343 - RNA, 15 nt, Human
cuaaggcaggaggau

SEQ ID NO: 670344 - RNA, 13 nt, Human
aacgucacaucuu

SEQ ID NO: 670345 - RNA, 17 nt, Human
agggaagggggaacaug

SEQ ID NO: 670346 - RNA, 22 nt, Human
acauccuacaagacacagugac

SEQ ID NO: 670347 - RNA, 16 nt, Human
aucaaaagaaagaaaa

SEQ ID NO: 670348 - RNA, 20 nt, Human
gcccacucugcaagaagaaa

SEQ ID NO: 670349 - RNA, 14 nt, Human
caguucugaagaag

SEQ ID NO: 670350 - RNA, 17 nt, Human
ccaugaugcugagcccg

SEQ ID NO: 670351 - RNA, 20 nt, Human
uguaaaggaauuuaaaaauc

SEQ ID NO: 670352 - RNA, 22 nt, Human
ggacaguaaaauccacagacca

SEQ ID NO: 670353 - RNA, 13 nt, Human
ccaccugccuaua

SEQ ID NO: 670354 - RNA, 22 nt, Human
caacacaucaggaaagagagca

SEQ ID NO: 670355 - RNA, 16 nt, Human
aaaagcuccauuuuua

SEQ ID NO: 670356 - RNA, 14 nt, Human
gacaugggccccag

SEQ ID NO: 670357 - RNA, 23 nt, Human
aagagccuuuuuuugaaaaaaag

SEQ ID NO: 670358 - RNA, 22 nt, Human
ugggcacuguggguagacacac

SEQ ID NO: 670359 - RNA, 20 nt, Human
uguuggugaacuugguuuua

SEQ ID NO: 670360 - RNA, 14 nt, Human
ucuaucccaaccuc

SEQ ID NO: 670361 - RNA, 22 nt, Human
ugaguuuuucuuuucauuuacc

SEQ ID NO: 670362 - RNA, 22 nt, Human
acagauuugagcucagcccugg

SEQ ID NO: 670363 - RNA, 14 nt, Human
cccugucucaauaa

SEQ ID NO: 670364 - RNA, 20 nt, Human
aaagacaaggaaaaaauaac

SEQ ID NO: 670365 - RNA, 20 nt, Human
aaguucaaaacuuauuggaa

SEQ ID NO: 670366 - RNA, 20 nt, Human
auuacuguaagaaaauauca

SEQ ID NO: 670367 - RNA, 12 nt, Human
cuuaagcuuuca

SEQ ID NO: 670368 - RNA, 19 nt, Human
ucagguguguugcaguguc

SEQ ID NO: 670369 - RNA, 19 nt, Human
ugaaauuguauuacaaauc

SEQ ID NO: 670370 - RNA, 19 nt, Human
aggucuaccaaaaaucuca

SEQ ID NO: 670371 - RNA, 17 nt, Human
uguucuaagaagugaaa

SEQ ID NO: 670372 - RNA, 22 nt, Human
cacuaguauuucuaugaaauau

SEQ ID NO: 670373 - RNA, 17 nt, Human
cacuuggacaugggccc

SEQ ID NO: 670374 - RNA, 21 nt, Human
cuuccaggcuggcgugcagca

SEQ ID NO: 670375 - RNA, 22 nt, Human
aacaaaguugauuaagaaagga

SEQ ID NO: 670376 - RNA, 16 nt, Human
uggauacuccaugggg

SEQ ID NO: 670377 - RNA, 16 nt, Human
uaagaaauaggaaaua

SEQ ID NO: 670378 - RNA, 15 nt, Human
accaaggcugauuaa

SEQ ID NO: 670379 - RNA, 23 nt, Human
cauuguggucacaggaaguagag

SEQ ID NO: 670380 - RNA, 14 nt, Human
ccccagaaugaccu

SEQ ID NO: 670381 - RNA, 15 nt, Human
agucuguuuucccuc

SEQ ID NO: 670382 - RNA, 17 nt, Human
gacacaugggugcuauu

SEQ ID NO: 670383 - RNA, 14 nt, Human
gggcuggaugcucu

SEQ ID NO: 670384 - RNA, 17 nt, Human
caccucccccaucucuu

SEQ ID NO: 670385 - RNA, 23 nt, Human
caauccaagaacuuauuuguaca

SEQ ID NO: 670386 - RNA, 21 nt, Human
augaauacuuuauaaaggauu

SEQ ID NO: 670387 - RNA, 15 nt, Human
uucugcacacagcac

SEQ ID NO: 670388 - RNA, 14 nt, Human
aacgauaaaagaca

SEQ ID NO: 670389 - RNA, 22 nt, Human
acaugagguacugagagugaac

SEQ ID NO: 670390 - RNA, 20 nt, Human
ugauuucugagcauuuaaua

SEQ ID NO: 670391 - RNA, 11 nt, Human
uaguuagcuuu

SEQ ID NO: 670392 - RNA, 17 nt, Human
ucuauaauuuaaauaua

SEQ ID NO: 670393 - RNA, 18 nt, Human
gaaggagcucccaggagg

SEQ ID NO: 670394 - RNA, 20 nt, Human
auagucauucugccugcccu

SEQ ID NO: 670395 - RNA, 18 nt, Human
uggcucuggacaggcacu

SEQ ID NO: 670396 - RNA, 18 nt, Human
uauagcuacuaauuuuaa

SEQ ID NO: 670397 - RNA, 13 nt, Human
guuuaaguucuau

SEQ ID NO: 670398 - RNA, 16 nt, Human
aaauaguuuaugauuc

SEQ ID NO: 670399 - RNA, 23 nt, Human
auaucuuuuuuuuaauaaaccau

SEQ ID NO: 670400 - RNA, 13 nt, Human
aacaauaaaagac

SEQ ID NO: 670401 - RNA, 22 nt, Human
cacuuccaagagccuuuuuuug

SEQ ID NO: 670402 - RNA, 13 nt, Human
aguuaccucugcc

SEQ ID NO: 670403 - RNA, 16 nt, Human
cugagcuugcagagau

SEQ ID NO: 670404 - RNA, 16 nt, Human
aucaauuuaaaaaaaa

SEQ ID NO: 670405 - RNA, 16 nt, Human
ugccucaccccuugcc

SEQ ID NO: 670406 - RNA, 16 nt, Human
ucuugagguaaaagca

SEQ ID NO: 670407 - RNA, 19 nt, Human
ccccucuggcuccagcugg

SEQ ID NO: 670408 - RNA, 14 nt, Human
uucagccugaaaga

SEQ ID NO: 670409 - RNA, 22 nt, Human
cggaggucgaggcuacagugag

SEQ ID NO: 670410 - RNA, 17 nt, Human
cugggaccaggcacccc

SEQ ID NO: 670411 - RNA, 17 nt, Human
ccucagucucccucccu

SEQ ID NO: 670412 - RNA, 16 nt, Human
caggaggcauccaaag

SEQ ID NO: 670413 - RNA, 12 nt, Human
aaggaugccccg

SEQ ID NO: 670414 - RNA, 22 nt, Human
gaaaacaauaacgauaaaagac

SEQ ID NO: 670415 - RNA, 15 nt, Human
ucgaggcuacaguga

SEQ ID NO: 670416 - RNA, 17 nt, Human
aggccaugggacaggga

SEQ ID NO: 670417 - RNA, 12 nt, Human
caagaaggaaag

SEQ ID NO: 670418 - RNA, 16 nt, Human
aauuccacagcugcuc

SEQ ID NO: 670419 - RNA, 19 nt, Human
ugcccugaaagucccagau

SEQ ID NO: 670420 - RNA, 20 nt, Human
aagaugguaccaccagucug

SEQ ID NO: 670421 - RNA, 16 nt, Human
uauaugucacuuugcu

SEQ ID NO: 670422 - RNA, 23 nt, Human
accuccauggaaacgaagcacca

SEQ ID NO: 670423 - RNA, 13 nt, Human
acacuuaaaaaug

SEQ ID NO: 670424 - RNA, 18 nt, Human
cuuagaugggcauggugg

SEQ ID NO: 670425 - RNA, 23 nt, Human
caggaaucacuggcuguuaaucu

SEQ ID NO: 670426 - RNA, 14 nt, Human
acuggacucaccuc

SEQ ID NO: 670427 - RNA, 14 nt, Human
gaaaacaauaacga

SEQ ID NO: 670428 - RNA, 17 nt, Human
ccacuggacucaccucc

SEQ ID NO: 670429 - RNA, 14 nt, Human
caugaacuuguaaa

SEQ ID NO: 670430 - RNA, 16 nt, Human
aagacugcacaucaaa

SEQ ID NO: 670431 - RNA, 20 nt, Human
auuuucaguuauuauauuua

SEQ ID NO: 670432 - RNA, 13 nt, Human
uuuugaaucauca

SEQ ID NO: 670433 - RNA, 13 nt, Human
agcccagcuugaa

SEQ ID NO: 670434 - RNA, 15 nt, Human
auagaaguaaaaaca

SEQ ID NO: 670435 - RNA, 13 nt, Human
ucugcagcuucca

SEQ ID NO: 670436 - RNA, 22 nt, Human
ugagacucugucucaguccaug

SEQ ID NO: 670437 - RNA, 22 nt, Human
aggcuccacuuggucugugaga

SEQ ID NO: 670438 - RNA, 13 nt, Human
aggcuagauguau

SEQ ID NO: 670439 - RNA, 18 nt, Human
gaaaauaucacuugucaa

SEQ ID NO: 670440 - RNA, 15 nt, Human
aaauaauuuuuauau

SEQ ID NO: 670441 - RNA, 15 nt, Human
cccaucucaggugug

SEQ ID NO: 670442 - RNA, 13 nt, Human
auuccucacuuug

SEQ ID NO: 670443 - RNA, 17 nt, Human
ggagcucguggaacagu

SEQ ID NO: 670444 - RNA, 16 nt, Human
auacuauuuaauuauu

SEQ ID NO: 670445 - RNA, 22 nt, Human
uuuccaagcaaguauuagaaua

SEQ ID NO: 670446 - RNA, 18 nt, Human
cagugaaagaaaauaaca

SEQ ID NO: 670447 - RNA, 22 nt, Human
gaugguucccuugaugaagaag

SEQ ID NO: 670448 - RNA, 20 nt, Human
ccccuauccuacuuccccuu

SEQ ID NO: 670449 - RNA, 17 nt, Human
auucagaauuucuaaaa

SEQ ID NO: 670450 - RNA, 16 nt, Human
cccuauccuacuuccc

SEQ ID NO: 670451 - RNA, 17 nt, Human
gcaugguuuagaaagcu

SEQ ID NO: 670452 - RNA, 16 nt, Human
cagaagcaacccaaau

SEQ ID NO: 670453 - RNA, 22 nt, Human
gaagugaaaaucuacacuccag

SEQ ID NO: 670454 - RNA, 20 nt, Human
ccauuguggucacaggaagu

SEQ ID NO: 670455 - RNA, 19 nt, Human
aaaagacagugaaagaaaa

SEQ ID NO: 670456 - RNA, 14 nt, Human
agaaacaaaaauca

SEQ ID NO: 670457 - RNA, 18 nt, Human
acugacucuuaagaagac

SEQ ID NO: 670458 - RNA, 16 nt, Human
uauuuuugugauuuug

SEQ ID NO: 670459 - RNA, 16 nt, Human
agaugagagaacaggg

SEQ ID NO: 670460 - RNA, 18 nt, Human
cuucacuguaaaauaaua

SEQ ID NO: 670461 - RNA, 16 nt, Human
cuccacauccuguggg

SEQ ID NO: 670462 - RNA, 13 nt, Human
agcgacagugaga

SEQ ID NO: 670463 - RNA, 23 nt, Human
caggcauggugguuuacgccuau

SEQ ID NO: 670464 - RNA, 18 nt, Human
caugaagauguagaggag

SEQ ID NO: 670465 - RNA, 20 nt, Human
caaaguugauuaagaaagga

SEQ ID NO: 670466 - RNA, 14 nt, Human
aaaggaauuuaaaa

SEQ ID NO: 670467 - RNA, 21 nt, Human
cucuacauaaaauacaaaaac

SEQ ID NO: 670468 - RNA, 13 nt, Human
ccaaggaugcccc

SEQ ID NO: 670469 - RNA, 18 nt, Human
gcccuggugggcagagag

SEQ ID NO: 670470 - RNA, 15 nt, Human
agaggcaaagaaagg

SEQ ID NO: 670471 - RNA, 22 nt, Human
ggccauuacccccagcuuugag

SEQ ID NO: 670472 - RNA, 20 nt, Human
gaaggcugaggcaggaggau

SEQ ID NO: 670473 - RNA, 18 nt, Human
agucuguuuucccuccuu

SEQ ID NO: 670474 - RNA, 20 nt, Human
acaucuggaaaguuuucucc

SEQ ID NO: 670475 - RNA, 14 nt, Human
ggaaguagaggagg

SEQ ID NO: 670476 - RNA, 14 nt, Human
ccaugggacaggga

SEQ ID NO: 670477 - RNA, 15 nt, Human
cuaagugcagccccg

SEQ ID NO: 670478 - RNA, 18 nt, Human
cuccauccugaggcucca

SEQ ID NO: 670479 - RNA, 19 nt, Human
aucuauguagaauauauuu

SEQ ID NO: 670480 - RNA, 14 nt, Human
caucucaggugugu

SEQ ID NO: 670481 - RNA, 14 nt, Human
acuaauuuuaaaau

SEQ ID NO: 670482 - RNA, 18 nt, Human
cucccuuggggccuaugc

SEQ ID NO: 670483 - RNA, 16 nt, Human
ggaacaaggaaggaaa

SEQ ID NO: 670484 - RNA, 19 nt, Human
gcccuuccccucugcagcu

SEQ ID NO: 670485 - RNA, 13 nt, Human
ucauucugccugc

SEQ ID NO: 670486 - RNA, 17 nt, Human
guccgaggugggcagau

SEQ ID NO: 670487 - RNA, 15 nt, Human
aaaauacaaaaaaaa

SEQ ID NO: 670488 - RNA, 15 nt, Human
uaaauaaauaaaaac

SEQ ID NO: 670489 - RNA, 15 nt, Human
uucggccuccauccu

SEQ ID NO: 670490 - RNA, 16 nt, Human
uagagaauuuccuuac

SEQ ID NO: 670491 - RNA, 18 nt, Human
ugaggcaggcacugccaa

SEQ ID NO: 670492 - RNA, 18 nt, Human
caguuguugcccacagcu

SEQ ID NO: 670493 - RNA, 15 nt, Human
uccauugggcaggca

SEQ ID NO: 670494 - RNA, 22 nt, Human
uguaacugucuucuagcaguga

SEQ ID NO: 670495 - RNA, 21 nt, Human
gaacagucucuugaggcacag

SEQ ID NO: 670496 - RNA, 20 nt, Human
guguggaaggugaucuggcu

SEQ ID NO: 670497 - RNA, 18 nt, Human
uaaaagacagugaaagaa

SEQ ID NO: 670498 - RNA, 15 nt, Human
cagucucccucccuu

SEQ ID NO: 670499 - RNA, 18 nt, Human
ugaagcuguguccucaug

SEQ ID NO: 670500 - RNA, 20 nt, Human
ugauuauaugucacuuugcu

SEQ ID NO: 670501 - RNA, 14 nt, Human
uaaauuuaucauuu

SEQ ID NO: 670502 - RNA, 20 nt, Human
acuauagugugagccaggaa

SEQ ID NO: 670503 - RNA, 20 nt, Human
ggaaggcugaggcaggagga

SEQ ID NO: 670504 - RNA, 21 nt, Human
ucaguuccagccuucucucaa

SEQ ID NO: 670505 - RNA, 22 nt, Human
ucucagcuucacccugagguga

SEQ ID NO: 670506 - RNA, 21 nt, Human
ucccuggggcuuuaacuccug

SEQ ID NO: 670507 - RNA, 21 nt, Human
cucagcuucacccugagguga

SEQ ID NO: 670508 - RNA, 22 nt, Human
agugagcagucaggaaagagaa

SEQ ID NO: 670509 - RNA, 18 nt, Human
auuuauuacuguaagaaa

SEQ ID NO: 670510 - RNA, 15 nt, Human
cgagacaagcagccc

SEQ ID NO: 670511 - RNA, 17 nt, Human
uggccgcagugaggcgg

SEQ ID NO: 670512 - RNA, 22 nt, Human
ucccuagaaagccaugugcagc

SEQ ID NO: 670513 - RNA, 11 nt, Human
gggaccugggc

SEQ ID NO: 670514 - RNA, 18 nt, Human
uguacuuuauuuucuaua

SEQ ID NO: 670515 - RNA, 18 nt, Human
uuuuauaucaauuuaaaa

SEQ ID NO: 670516 - RNA, 17 nt, Human
caccugcugagccccaa

SEQ ID NO: 670517 - RNA, 22 nt, Human
uagacacacaugaaguccaagc

SEQ ID NO: 670518 - RNA, 14 nt, Human
uacuaauuuuaaaa

SEQ ID NO: 670519 - RNA, 15 nt, Human
ccacaggaaccacaa

SEQ ID NO: 670520 - RNA, 12 nt, Human
gacgagaaaaca

SEQ ID NO: 670521 - RNA, 23 nt, Human
auguuaaaacugggacaggggag

SEQ ID NO: 670522 - RNA, 20 nt, Human
accuucccagcuagaauuca

SEQ ID NO: 670523 - RNA, 13 nt, Human
auaucuucagaaa

SEQ ID NO: 670524 - RNA, 11 nt, Human
cauaugaaaag

SEQ ID NO: 670525 - RNA, 18 nt, Human
ucuaugaaauauuauguu

SEQ ID NO: 670526 - RNA, 19 nt, Human
uuuccaagaaauauuccuu

SEQ ID NO: 670527 - RNA, 11 nt, Human
ugugugcagca

SEQ ID NO: 670528 - RNA, 19 nt, Human
aaaggaaggaagggacaca

SEQ ID NO: 670529 - RNA, 17 nt, Human
ugucuucaggggccaca

SEQ ID NO: 670530 - RNA, 22 nt, Human
gaugcaguuguugcccacagcu

SEQ ID NO: 670531 - RNA, 13 nt, Human
ccuucucaccugu

SEQ ID NO: 670532 - RNA, 22 nt, Human
aauuccuaccucuucaccugac

SEQ ID NO: 670533 - RNA, 18 nt, Human
aggaugggaacaaggaag

SEQ ID NO: 670534 - RNA, 20 nt, Human
uuugcaagccagauuuuccu

SEQ ID NO: 670535 - RNA, 19 nt, Human
gaaggcaccucucuggguu

SEQ ID NO: 670536 - RNA, 19 nt, Human
aaucagagauaaagcuuag

SEQ ID NO: 670537 - RNA, 19 nt, Human
cugagcccggaaacuccac

SEQ ID NO: 670538 - RNA, 15 nt, Human
aacaaggaaggaaag

SEQ ID NO: 670539 - RNA, 23 nt, Human
aacuuguaaaggaauuuaaaaau

SEQ ID NO: 670540 - RNA, 14 nt, Human
aaucucaauauuuc

SEQ ID NO: 670541 - RNA, 17 nt, Human
cccccugcaaagcccag

SEQ ID NO: 670542 - RNA, 16 nt, Human
cacuaguauuucuaug

SEQ ID NO: 670543 - RNA, 16 nt, Human
ugaaguacucauacau

SEQ ID NO: 670544 - RNA, 21 nt, Human
ccaugugcagccaccagucca

SEQ ID NO: 670545 - RNA, 16 nt, Human
aacuugguuuuaauua

SEQ ID NO: 670546 - RNA, 17 nt, Human
gcagcaucagcaucccu

SEQ ID NO: 670547 - RNA, 16 nt, Human
gucuucaggggccaca

SEQ ID NO: 670548 - RNA, 21 nt, Human
cucaaaacuucagacauagaa

SEQ ID NO: 670549 - RNA, 19 nt, Human
cuggggcuuuaacuccugc

SEQ ID NO: 670550 - RNA, 17 nt, Human
auaauuuaaauauaugc

SEQ ID NO: 670551 - RNA, 17 nt, Human
acaucgcagacacaugu

SEQ ID NO: 670552 - RNA, 13 nt, Human
auaacuggaaacu

SEQ ID NO: 670553 - RNA, 12 nt, Human
ggaggcugagau

SEQ ID NO: 670554 - RNA, 15 nt, Human
uaggaaauauuuauu

SEQ ID NO: 670555 - RNA, 19 nt, Human
cucaccucccccaucucuu

SEQ ID NO: 670556 - RNA, 18 nt, Human
ugauuauuuuauguuuua

SEQ ID NO: 670557 - RNA, 19 nt, Human
cuggacucaccucccccau

SEQ ID NO: 670558 - RNA, 16 nt, Human
ccuaugcagaggucca

SEQ ID NO: 670559 - RNA, 21 nt, Human
aagacaagaaggaaagauuuu

SEQ ID NO: 670560 - RNA, 15 nt, Human
aucaaaggacaccau

SEQ ID NO: 670561 - RNA, 20 nt, Human
aauaagucaucugaugagaa

SEQ ID NO: 670562 - RNA, 22 nt, Human
uguugcccacagcuguaugauu

SEQ ID NO: 670563 - RNA, 22 nt, Human
aaugauguuucauaagaauucu

SEQ ID NO: 670564 - RNA, 19 nt, Human
aagucuuucacauuuaaau

SEQ ID NO: 670565 - RNA, 22 nt, Human
uuuauagcuacuaauuuuaaaa

SEQ ID NO: 670566 - RNA, 13 nt, Human
aagacaaggaaaa

SEQ ID NO: 670567 - RNA, 22 nt, Human
aaacuuuacagaaagauuugau

SEQ ID NO: 670568 - RNA, 17 nt, Human
gggcaguguucccuggg

SEQ ID NO: 670569 - RNA, 22 nt, Human
ugauaguuguaccgcaauguga

SEQ ID NO: 670570 - RNA, 17 nt, Human
uaugcuaagugaaauaa

SEQ ID NO: 670571 - RNA, 15 nt, Human
acaaggaaaaaauaa

SEQ ID NO: 670572 - RNA, 13 nt, Human
uuuucuuuucauu

SEQ ID NO: 670573 - RNA, 14 nt, Human
ccacaaucuaggau

SEQ ID NO: 670574 - RNA, 12 nt, Human
ugacauuagaug

SEQ ID NO: 670575 - RNA, 15 nt, Human
ccucagucucccucc

SEQ ID NO: 670576 - RNA, 13 nt, Human
aaaaauccuacuu

SEQ ID NO: 670577 - RNA, 22 nt, Human
caugaguaacugauuuguaaca

SEQ ID NO: 670578 - RNA, 23 nt, Human
aauauuuauuuuaauaauguuuc

SEQ ID NO: 670579 - RNA, 11 nt, Human
aaauaaauaaa

SEQ ID NO: 670580 - RNA, 14 nt, Human
ccagcuagaauuca

SEQ ID NO: 670581 - RNA, 21 nt, Human
caaaguugauuaagaaaggaa

SEQ ID NO: 670582 - RNA, 15 nt, Human
cgaagcaccaucauu

SEQ ID NO: 670583 - RNA, 19 nt, Human
cccacuggacucaccuccc

SEQ ID NO: 670584 - RNA, 11 nt, Human
cuguuuuauaa

SEQ ID NO: 670585 - RNA, 16 nt, Human
cuggccuucggccucc

SEQ ID NO: 670586 - RNA, 20 nt, Human
uggauuuaauguggaaauga

SEQ ID NO: 670587 - RNA, 15 nt, Human
aucuuauaauuuaaa

SEQ ID NO: 670588 - RNA, 20 nt, Human
ggaaaguuuucuccacugga

SEQ ID NO: 670589 - RNA, 21 nt, Human
cuggccaccugcugagcccca

SEQ ID NO: 670590 - RNA, 15 nt, Human
agaaaacaauaacga

SEQ ID NO: 670591 - RNA, 19 nt, Human
augaauuacauuuguauaa

SEQ ID NO: 670592 - RNA, 13 nt, Human
aaggcaggaggau

SEQ ID NO: 670593 - RNA, 18 nt, Human
aaaguaacccuacaaaac

SEQ ID NO: 670594 - RNA, 17 nt, Human
acuccugcuagaacagu

SEQ ID NO: 670595 - RNA, 23 nt, Human
gcuguggauuuaauguggaaaug

SEQ ID NO: 670596 - RNA, 12 nt, Human
gguuuauauaag

SEQ ID NO: 670597 - RNA, 23 nt, Human
cagcaccuccuaagaaggcaccu

SEQ ID NO: 670598 - RNA, 15 nt, Human
agucaccucauggaa

SEQ ID NO: 670599 - RNA, 13 nt, Human
uccccaaaugcuu

SEQ ID NO: 670600 - RNA, 20 nt, Human
auauuuuauaucaauuuaaa

SEQ ID NO: 670601 - RNA, 23 nt, Human
aguaauuggaaaggcagcucuaa

SEQ ID NO: 670602 - RNA, 13 nt, Human
uuuuauaugcuau

SEQ ID NO: 670603 - RNA, 12 nt, Human
agacaucuggaa

SEQ ID NO: 670604 - RNA, 14 nt, Human
agaauucauucacu

SEQ ID NO: 670605 - RNA, 16 nt, Human
cucagcugccucccca

SEQ ID NO: 670606 - RNA, 17 nt, Human
ugaaauaagccagacau

SEQ ID NO: 670607 - RNA, 22 nt, Human
uuugaugcuacaggauuugaaa

SEQ ID NO: 670608 - RNA, 16 nt, Human
acaaggaugaauuaag

SEQ ID NO: 670609 - RNA, 22 nt, Human
uuaccucugccucagaaaacaa

SEQ ID NO: 670610 - RNA, 16 nt, Human
uucuauaauuuaaaua

SEQ ID NO: 670611 - RNA, 16 nt, Human
auccuugaagauuuac

SEQ ID NO: 670612 - RNA, 22 nt, Human
gacucaccucccccaucucuuc

SEQ ID NO: 670613 - RNA, 16 nt, Human
ggaguuucucuagaag

SEQ ID NO: 670614 - RNA, 15 nt, Human
caaggaaaaaauaac

SEQ ID NO: 670615 - RNA, 21 nt, Human
cuaggaugggaacaaggaagg

SEQ ID NO: 670616 - RNA, 19 nt, Human
augaguaacugauuuguaa

SEQ ID NO: 670617 - RNA, 19 nt, Human
gacagucaccucauggaau

SEQ ID NO: 670618 - RNA, 13 nt, Human
agcuaaauauaua

SEQ ID NO: 670619 - RNA, 17 nt, Human
cccaucucagguguguu

SEQ ID NO: 670620 - RNA, 17 nt, Human
cuccuaagaaggcaccu

SEQ ID NO: 670621 - RNA, 17 nt, Human
agacagugaaagaaaau

SEQ ID NO: 670622 - RNA, 16 nt, Human
cauuauggauaaagau

SEQ ID NO: 670623 - RNA, 13 nt, Human
uaccccuggccaa

SEQ ID NO: 670624 - RNA, 13 nt, Human
cacaacuauauug

SEQ ID NO: 670625 - RNA, 13 nt, Human
agagauaaagcuu

SEQ ID NO: 670626 - RNA, 18 nt, Human
uaucaaaagaaagaaaau

SEQ ID NO: 670627 - RNA, 15 nt, Human
aggauggcaggaggc

SEQ ID NO: 670628 - RNA, 18 nt, Human
cacuugccauaaaacuua

SEQ ID NO: 670629 - RNA, 21 nt, Human
gcgagacccugucucaauaaa

SEQ ID NO: 670630 - RNA, 12 nt, Human
agaauauauuuc

SEQ ID NO: 670631 - RNA, 16 nt, Human
uccuguaauggaagca

SEQ ID NO: 670632 - RNA, 20 nt, Human
ggucaacauagugagacacu

SEQ ID NO: 670633 - RNA, 23 nt, Human
cacagauuugagcucagcccugg

SEQ ID NO: 670634 - RNA, 20 nt, Human
uuuagacauucuuuaucuuu

SEQ ID NO: 670635 - RNA, 16 nt, Human
gacauugaggcaggca

SEQ ID NO: 670636 - RNA, 18 nt, Human
uuuuaucugcuaugcuau

SEQ ID NO: 670637 - RNA, 13 nt, Human
uguuuucccuccu

SEQ ID NO: 670638 - RNA, 17 nt, Human
ggaaggcugaggcagga

SEQ ID NO: 670639 - RNA, 16 nt, Human
cugcugagccccaagu

SEQ ID NO: 670640 - RNA, 18 nt, Human
agucauucugccugcccu

SEQ ID NO: 670641 - RNA, 13 nt, Human
augauuccaccua

SEQ ID NO: 670642 - RNA, 18 nt, Human
ugccauaauuacuauguc

SEQ ID NO: 670643 - RNA, 20 nt, Human
agccuaguugaucagcuuau

SEQ ID NO: 670644 - RNA, 18 nt, Human
auauuucuguuaaaauau

SEQ ID NO: 670645 - RNA, 16 nt, Human
gauuuaaggccaggca

SEQ ID NO: 670646 - RNA, 23 nt, Human
ccugggaccaggcacccccagaa

SEQ ID NO: 670647 - RNA, 12 nt, Human
uauaauuuaaaa

SEQ ID NO: 670648 - RNA, 14 nt, Human
auuauuucacuuua

SEQ ID NO: 670649 - RNA, 16 nt, Human
gucuguuuucccuccu

SEQ ID NO: 670650 - RNA, 11 nt, Human
ccacaucugag

SEQ ID NO: 670651 - RNA, 19 nt, Human
agccugaucaccugcccug

SEQ ID NO: 670652 - RNA, 19 nt, Human
acuauuuaauuauuucacu

SEQ ID NO: 670653 - RNA, 14 nt, Human
augggaacaaggaa

SEQ ID NO: 670654 - RNA, 14 nt, Human
gagagugaacaaau

SEQ ID NO: 670655 - RNA, 14 nt, Human
uauauauuuuagau

SEQ ID NO: 670656 - RNA, 22 nt, Human
aggcuccugagacacaugggug

SEQ ID NO: 670657 - RNA, 20 nt, Human
auguuucuuggggaauaugu

SEQ ID NO: 670658 - RNA, 14 nt, Human
uugggaaaaaguaa

SEQ ID NO: 670659 - RNA, 19 nt, Human
auuaaguuuuuuuuuaaaa

SEQ ID NO: 670660 - RNA, 19 nt, Human
acuaucucauuuccaagca

SEQ ID NO: 670661 - RNA, 22 nt, Human
cugccagaaucuagagcaaagc

SEQ ID NO: 670662 - RNA, 12 nt, Human
caauaaauaaau

SEQ ID NO: 670663 - RNA, 19 nt, Human
ccugagcggaccuucccag

SEQ ID NO: 670664 - RNA, 14 nt, Human
agagacagaaagca

SEQ ID NO: 670665 - RNA, 16 nt, Human
cgcauggaaaaguuuc

SEQ ID NO: 670666 - RNA, 19 nt, Human
auuauuuuuuaaaaaaauu

SEQ ID NO: 670667 - RNA, 19 nt, Human
gugacuuaaugccacuaaa

SEQ ID NO: 670668 - RNA, 20 nt, Human
aucuauguagaauauauuuc

SEQ ID NO: 670669 - RNA, 17 nt, Human
ugaugcuuugagaacau

SEQ ID NO: 670670 - RNA, 11 nt, Human
uuauauuucca

SEQ ID NO: 670671 - RNA, 20 nt, Human
cuucaacucccugcccccca

SEQ ID NO: 670672 - RNA, 13 nt, Human
aaacauccuacaa

SEQ ID NO: 670673 - RNA, 19 nt, Human
cugccagaaucuagagcaa

SEQ ID NO: 670674 - RNA, 12 nt, Human
accaggcacccc

SEQ ID NO: 670675 - RNA, 20 nt, Human
ucaagucuuucacauuuaaa

SEQ ID NO: 670676 - RNA, 14 nt, Human
accauuuuuacuug

SEQ ID NO: 670677 - RNA, 23 nt, Human
uuuauaugcuucuguuuuauaau

SEQ ID NO: 670678 - RNA, 21 nt, Human
gagcuaggggggucagccagc

SEQ ID NO: 670679 - RNA, 14 nt, Human
ugguauguuuucag

SEQ ID NO: 670680 - RNA, 13 nt, Human
ugagcgacaguga

SEQ ID NO: 670681 - RNA, 20 nt, Human
agggaagacaagaaggaaag

SEQ ID NO: 670682 - RNA, 13 nt, Human
ugaaauuguauua

SEQ ID NO: 670683 - RNA, 23 nt, Human
ugucaauucuugccaaauauaaa

SEQ ID NO: 670684 - RNA, 12 nt, Human
auuucaaaaaaa

SEQ ID NO: 670685 - RNA, 20 nt, Human
ccuucucaccugugagacca

SEQ ID NO: 670686 - RNA, 13 nt, Human
augcuagaacucc

SEQ ID NO: 670687 - RNA, 13 nt, Human
aaaauaacaauga

SEQ ID NO: 670688 - RNA, 21 nt, Human
gaaaugaguuuuucuuuucau

SEQ ID NO: 670689 - RNA, 14 nt, Human
ugcuggagcucugc

SEQ ID NO: 670690 - RNA, 23 nt, Human
cauccucgaggcccuagcauuuc

SEQ ID NO: 670691 - RNA, 19 nt, Human
caauucuugccaaauauaa

SEQ ID NO: 670692 - RNA, 18 nt, Human
uauaacaaugcuguauuu

SEQ ID NO: 670693 - RNA, 14 nt, Human
cagcaucagcaucc

SEQ ID NO: 670694 - RNA, 21 nt, Human
ccuuuuuuugaaaaaaagcuu

SEQ ID NO: 670695 - RNA, 14 nt, Human
agauguagaggaga

SEQ ID NO: 670696 - RNA, 14 nt, Human
cuacaagacacagu

SEQ ID NO: 670697 - RNA, 14 nt, Human
gcuggcgugcagca

SEQ ID NO: 670698 - RNA, 18 nt, Human
auaggaaauauuuuaaug

SEQ ID NO: 670699 - RNA, 13 nt, Human
uggcuccagcugg

SEQ ID NO: 670700 - RNA, 13 nt, Human
acacacaugaagu

SEQ ID NO: 670701 - RNA, 22 nt, Human
caccagucugacuguuuccauc

SEQ ID NO: 670702 - RNA, 16 nt, Human
ucuuauaauuuaaaau

SEQ ID NO: 670703 - RNA, 18 nt, Human
gaaggugaucuggcucug

SEQ ID NO: 670704 - RNA, 21 nt, Human
uauaaaauaauuuuuauauuu

SEQ ID NO: 670705 - RNA, 18 nt, Human
uccuaauuccacagcugc

SEQ ID NO: 670706 - RNA, 14 nt, Human
uuuuaaaaaagaaa

SEQ ID NO: 670707 - RNA, 14 nt, Human
uggcucugugugcu

SEQ ID NO: 670708 - RNA, 16 nt, Human
aggaggacaaaaggaa

SEQ ID NO: 670709 - RNA, 14 nt, Human
cauuuacuuuuaaa

SEQ ID NO: 670710 - RNA, 23 nt, Human
gcauuguuggcuguuccugcagu

SEQ ID NO: 670711 - RNA, 21 nt, Human
gaggugagguaccagccuugg

SEQ ID NO: 670712 - RNA, 18 nt, Human
gaccccugagcuugcaga

SEQ ID NO: 670713 - RNA, 21 nt, Human
uuuguauaaaauaauuuuuau

SEQ ID NO: 670714 - RNA, 21 nt, Human
auacuauuuaauuauuucacu

SEQ ID NO: 670715 - RNA, 14 nt, Human
aagcaucacaugaa

SEQ ID NO: 670716 - RNA, 20 nt, Human
acuaaaacaccucagcugcc

SEQ ID NO: 670717 - RNA, 22 nt, Human
ggccauagucauucugccugcc

SEQ ID NO: 670718 - RNA, 16 nt, Human
ugaauuaguuuuauau

SEQ ID NO: 670719 - RNA, 23 nt, Human
ucuagcaugucgucaaagcugaa

SEQ ID NO: 670720 - RNA, 21 nt, Human
uuagauaaggcuguucuuuaa

SEQ ID NO: 670721 - RNA, 18 nt, Human
agccugaucaccugcccu

SEQ ID NO: 670722 - RNA, 21 nt, Human
ccugagcggaccuucccagcu

SEQ ID NO: 670723 - RNA, 20 nt, Human
cuaggggggucagccagccc

SEQ ID NO: 670724 - RNA, 20 nt, Human
ccaaauguucaucaaugaau

SEQ ID NO: 670725 - RNA, 16 nt, Human
uaaaagacaaggaaaa

SEQ ID NO: 670726 - RNA, 19 nt, Human
augaaagcagggacuugaa

SEQ ID NO: 670727 - RNA, 18 nt, Human
ccauccugccccugagcc

SEQ ID NO: 670728 - RNA, 15 nt, Human
aaggcuccugagaca

SEQ ID NO: 670729 - RNA, 23 nt, Human
aucacagcuacuugggaggcuga

SEQ ID NO: 670730 - RNA, 13 nt, Human
cuaggcauagccc

SEQ ID NO: 670731 - RNA, 14 nt, Human
uugauggaaauaca

SEQ ID NO: 670732 - RNA, 20 nt, Human
ucuguuuucccuccuuggag

SEQ ID NO: 670733 - RNA, 22 nt, Human
agcucuaucccaaccucuccca

SEQ ID NO: 670734 - RNA, 17 nt, Human
auuuuaauaauguuuca

SEQ ID NO: 670735 - RNA, 19 nt, Human
ggugcugcagccccuggga

SEQ ID NO: 670736 - RNA, 13 nt, Human
uccuacuuccccu

SEQ ID NO: 670737 - RNA, 14 nt, Human
ugacuauuauauuu

SEQ ID NO: 670738 - RNA, 16 nt, Human
gccaugugcuaguaau

SEQ ID NO: 670739 - RNA, 22 nt, Human
uaucuauguagaauauauuucc

SEQ ID NO: 670740 - RNA, 15 nt, Human
cuucucuucacaguc

SEQ ID NO: 670741 - RNA, 22 nt, Human
ggggugguuuucccaucucagg

SEQ ID NO: 670742 - RNA, 20 nt, Human
uuaaugccacuaaauugaca

SEQ ID NO: 670743 - RNA, 12 nt, Human
uucagccugaaa

SEQ ID NO: 670744 - RNA, 16 nt, Human
uggcaagcucuaucac

SEQ ID NO: 670745 - RNA, 18 nt, Human
ggaggacgcucucuggcc

SEQ ID NO: 670746 - RNA, 18 nt, Human
cauagguuuaauaauuuu

SEQ ID NO: 670747 - RNA, 16 nt, Human
gauuaagaaaggaagu

SEQ ID NO: 670748 - RNA, 22 nt, Human
gaaaggaaguauaggccaggca

SEQ ID NO: 670749 - RNA, 17 nt, Human
cccaggcugagccucag

SEQ ID NO: 670750 - RNA, 18 nt, Human
uauuuucuauaauuuaaa

SEQ ID NO: 670751 - RNA, 17 nt, Human
uuagaugggcauggugg

SEQ ID NO: 670752 - RNA, 20 nt, Human
ccagcuugaaaccuucacuu

SEQ ID NO: 670753 - RNA, 17 nt, Human
aggagaggcaaagaaag

SEQ ID NO: 670754 - RNA, 11 nt, Human
gaguuucucua

SEQ ID NO: 670755 - RNA, 16 nt, Human
ucaaacuuuacagaaa

SEQ ID NO: 670756 - RNA, 14 nt, Human
ccucuucugacacu

SEQ ID NO: 670757 - RNA, 23 nt, Human
cccuagaaagccaugugcagcca

SEQ ID NO: 670758 - RNA, 17 nt, Human
cauuuguauaaaauaau

SEQ ID NO: 670759 - RNA, 16 nt, Human
gcagcaucagcauccc

SEQ ID NO: 670760 - RNA, 12 nt, Human
gagcucccagga

SEQ ID NO: 670761 - RNA, 22 nt, Human
agcacagccucuuagaugcagu

SEQ ID NO: 670762 - RNA, 17 nt, Human
cccacuggacucaccuc

SEQ ID NO: 670763 - RNA, 14 nt, Human
cuuuacagaaagau

SEQ ID NO: 670764 - RNA, 18 nt, Human
acucuuaagaagacugca

SEQ ID NO: 670765 - RNA, 11 nt, Human
guauggcaaac

SEQ ID NO: 670766 - RNA, 12 nt, Human
uauaggccaggc

SEQ ID NO: 670767 - RNA, 15 nt, Human
acuauuauauuucca

SEQ ID NO: 670768 - RNA, 14 nt, Human
caggaggggcuucu

SEQ ID NO: 670769 - RNA, 17 nt, Human
cugccucagaaaacaag

SEQ ID NO: 670770 - RNA, 15 nt, Human
caggauggcaggagg

SEQ ID NO: 670771 - RNA, 17 nt, Human
agggagucucagcuuca

SEQ ID NO: 670772 - RNA, 15 nt, Human
guaaggggaauugag

SEQ ID NO: 670773 - RNA, 22 nt, Human
ccgggaggcagagguugcagug

SEQ ID NO: 670774 - RNA, 13 nt, Human
aaaguguuugaaa

SEQ ID NO: 670775 - RNA, 19 nt, Human
agaugagagaacagggcug

SEQ ID NO: 670776 - RNA, 18 nt, Human
uguauuauuuuuuaaaaa

SEQ ID NO: 670777 - RNA, 21 nt, Human
ccaggaggggcuucugggcag

SEQ ID NO: 670778 - RNA, 22 nt, Human
auguccuuggugccuggagccu

SEQ ID NO: 670779 - RNA, 13 nt, Human
acaagagcuuaac

SEQ ID NO: 670780 - RNA, 15 nt, Human
aaaucaaacuuuaca

SEQ ID NO: 670781 - RNA, 12 nt, Human
ucaauaaaacuu

SEQ ID NO: 670782 - RNA, 17 nt, Human
aauaacaauaaaagaca

SEQ ID NO: 670783 - RNA, 16 nt, Human
ccugcaaagcccagcu

SEQ ID NO: 670784 - RNA, 23 nt, Human
augucaauucuugccaaauauaa

SEQ ID NO: 670785 - RNA, 21 nt, Human
gcccauccugccccugagccc

SEQ ID NO: 670786 - RNA, 16 nt, Human
agauagaugaagaagc

SEQ ID NO: 670787 - RNA, 16 nt, Human
aauauuuuaauguuuc

SEQ ID NO: 670788 - RNA, 22 nt, Human
ggcacaacacaucaggaaagag

SEQ ID NO: 670789 - RNA, 17 nt, Human
guggggcuaaggcagga

SEQ ID NO: 670790 - RNA, 14 nt, Human
uuuuuguuuuguuu

SEQ ID NO: 670791 - RNA, 15 nt, Human
cuccacauccugugg

SEQ ID NO: 670792 - RNA, 20 nt, Human
auuacauuuguauaaaauaa

SEQ ID NO: 670793 - RNA, 21 nt, Human
aaacgaggauugggaaaaagu

SEQ ID NO: 670794 - RNA, 13 nt, Human
ccacaacacacag

SEQ ID NO: 670795 - RNA, 20 nt, Human
agaugcaguucugaagaaga

SEQ ID NO: 670796 - RNA, 20 nt, Human
gauugugccccugcacucca

SEQ ID NO: 670797 - RNA, 12 nt, Human
gugggaccuggg

SEQ ID NO: 670798 - RNA, 13 nt, Human
gcuggagcucugc

SEQ ID NO: 670799 - RNA, 24 nt, Human
cauucuggaauaauccuaaacaua

SEQ ID NO: 670800 - RNA, 21 nt, Human
uggaaacguauucaaacaauu

SEQ ID NO: 670801 - RNA, 16 nt, Human
acauccuacaagacac

SEQ ID NO: 670802 - RNA, 13 nt, Human
cugccuccccagc

SEQ ID NO: 670803 - RNA, 23 nt, Human
cagaccgggguucccgugugccu

SEQ ID NO: 670804 - RNA, 14 nt, Human
gcuuuaacuccugc

SEQ ID NO: 670805 - RNA, 12 nt, Human
aaagaaacaaaa

SEQ ID NO: 670806 - RNA, 18 nt, Human
auuaaguuuuuuuuuaaa

SEQ ID NO: 670807 - RNA, 22 nt, Human
cucagcuucacccugaggugag

SEQ ID NO: 670808 - RNA, 13 nt, Human
uuuaaaaauccua

SEQ ID NO: 670809 - RNA, 22 nt, Human
cuugaauuguaggugacuauua

SEQ ID NO: 670810 - RNA, 22 nt, Human
uucuaugcuuguaacugucuuc

SEQ ID NO: 670811 - RNA, 16 nt, Human
ugagccccggaggucg

SEQ ID NO: 670812 - RNA, 17 nt, Human
cuacaugucuagagaac

SEQ ID NO: 670813 - RNA, 18 nt, Human
ccacaucugagccccgaa

SEQ ID NO: 670814 - RNA, 15 nt, Human
aaggguacacugccu

SEQ ID NO: 670815 - RNA, 12 nt, Human
acauaaaauaca

SEQ ID NO: 670816 - RNA, 16 nt, Human
acuaguuucccuugca

SEQ ID NO: 670817 - RNA, 17 nt, Human
aauaugcucuaaacaug

SEQ ID NO: 670818 - RNA, 14 nt, Human
cucccuuggggccu

SEQ ID NO: 670819 - RNA, 13 nt, Human
auaaauaaaaaua

SEQ ID NO: 670820 - RNA, 19 nt, Human
uuauggcacuaguauuucu

SEQ ID NO: 670821 - RNA, 11 nt, Human
caucuagugag

SEQ ID NO: 670822 - RNA, 18 nt, Human
cuccauuuuuagugaaau

SEQ ID NO: 670823 - RNA, 18 nt, Human
ggaugggaacaaggaagg

SEQ ID NO: 670824 - RNA, 13 nt, Human
cccugcacuccag

SEQ ID NO: 670825 - RNA, 15 nt, Human
gccagcccucuucug

SEQ ID NO: 670826 - RNA, 17 nt, Human
gcaucuccucaacucug

SEQ ID NO: 670827 - RNA, 22 nt, Human
cuuguacucugaaaguuuugga

SEQ ID NO: 670828 - RNA, 21 nt, Human
cuccauggaaacgaagcacca

SEQ ID NO: 670829 - RNA, 21 nt, Human
agucuguuuucccuccuugga

SEQ ID NO: 670830 - RNA, 17 nt, Human
acuugaacccauauuug

SEQ ID NO: 670831 - RNA, 16 nt, Human
ccucagucucccuccc

SEQ ID NO: 670832 - RNA, 17 nt, Human
ugaacuugguuuuaauu

SEQ ID NO: 670833 - RNA, 14 nt, Human
cuaagcauuccaac

SEQ ID NO: 670834 - RNA, 18 nt, Human
uaauuuuagacauucuuu

SEQ ID NO: 670835 - RNA, 22 nt, Human
ugugccugagcggaccuuccca

SEQ ID NO: 670836 - RNA, 20 nt, Human
uaugcuucuguuuuauaauu

SEQ ID NO: 670837 - RNA, 18 nt, Human
uuuauggcacuaguauuu

SEQ ID NO: 670838 - RNA, 15 nt, Human
uaacaauaaaagaca

SEQ ID NO: 670839 - RNA, 13 nt, Human
caugguggugugu

SEQ ID NO: 670840 - RNA, 10 nt, Human
caacucccug

SEQ ID NO: 670841 - RNA, 17 nt, Human
acccacuggacucaccu

SEQ ID NO: 670842 - RNA, 18 nt, Human
uuuguuaaaugauuucau

SEQ ID NO: 670843 - RNA, 19 nt, Human
ccgggcgugguggugagug

SEQ ID NO: 670844 - RNA, 20 nt, Human
guauuauuuuuuaaaaaaau

SEQ ID NO: 670845 - RNA, 18 nt, Human
ucaccagucccuccccaa

SEQ ID NO: 670846 - RNA, 15 nt, Human
ugagcucaccagucc

SEQ ID NO: 670847 - RNA, 12 nt, Human
gaugagagaaca

SEQ ID NO: 670848 - RNA, 12 nt, Human
acugaaaucaua

SEQ ID NO: 670849 - RNA, 15 nt, Human
acuuuuccaaugaca

SEQ ID NO: 670850 - RNA, 23 nt, Human
gaaaacaauaacgauaaaagaca

SEQ ID NO: 670851 - RNA, 14 nt, Human
uacaugucuagaga

SEQ ID NO: 670852 - RNA, 20 nt, Human
aggugacuauuauauuucca

SEQ ID NO: 670853 - RNA, 17 nt, Human
uuuuauaugcuauuuau

SEQ ID NO: 670854 - RNA, 13 nt, Human
aagaaaauaacga

SEQ ID NO: 670855 - RNA, 23 nt, Human
cccgcuccugguuggucacagaa

SEQ ID NO: 670856 - RNA, 17 nt, Human
ucccuccccaaaugcuu

SEQ ID NO: 670857 - RNA, 17 nt, Human
cuaaggcaggaggauca

SEQ ID NO: 670858 - RNA, 14 nt, Human
ugagguugugugug

SEQ ID NO: 670859 - RNA, 20 nt, Human
agagacacacugaagaagca

SEQ ID NO: 670860 - RNA, 16 nt, Human
ugagcucagcccuggu

SEQ ID NO: 670861 - RNA, 13 nt, Human
cacauccuguggg

SEQ ID NO: 670862 - RNA, 18 nt, Human
auguuccuaauaaagcuu

SEQ ID NO: 670863 - RNA, 13 nt, Human
aaaggaaggaagg

SEQ ID NO: 670864 - RNA, 23 nt, Human
agcuaggggggucagccagcccu

SEQ ID NO: 670865 - RNA, 20 nt, Human
acuagaguuuagcuggaaaa

SEQ ID NO: 670866 - RNA, 13 nt, Human
cgggaggcagagg

SEQ ID NO: 670867 - RNA, 22 nt, Human
accuaacgaaguauccuucagc

SEQ ID NO: 670868 - RNA, 19 nt, Human
ccugccuaagugcagcccc

SEQ ID NO: 670869 - RNA, 12 nt, Human
caccuccuaaga

SEQ ID NO: 670870 - RNA, 15 nt, Human
ccugaaagucccaga

SEQ ID NO: 670871 - RNA, 23 nt, Human
ggauguggggaaguuaggaacug

SEQ ID NO: 670872 - RNA, 20 nt, Human
cuggccaccugcugagcccc

SEQ ID NO: 670873 - RNA, 17 nt, Human
ccugucgguuuauucac

SEQ ID NO: 670874 - RNA, 18 nt, Human
ccucagcugccuccccag

SEQ ID NO: 670875 - RNA, 14 nt, Human
ucuaggaaauauuu

SEQ ID NO: 670876 - RNA, 13 nt, Human
agggggaacauga

SEQ ID NO: 670877 - RNA, 13 nt, Human
cccagauaccaug

SEQ ID NO: 670878 - RNA, 23 nt, Human
cugggccauagucauucugccug

SEQ ID NO: 670879 - RNA, 12 nt, Human
cuacagugagcc

SEQ ID NO: 670880 - RNA, 16 nt, Human
gucccagaucaagccu

SEQ ID NO: 670881 - RNA, 16 nt, Human
ugugcagccaccaguc

SEQ ID NO: 670882 - RNA, 13 nt, Human
acaagaaggaaag

SEQ ID NO: 670883 - RNA, 13 nt, Human
auugucuagugaa

SEQ ID NO: 670884 - RNA, 13 nt, Human
acuaauuuuaaaa

SEQ ID NO: 670885 - RNA, 12 nt, Human
acagagacagaa

SEQ ID NO: 670886 - RNA, 18 nt, Human
uauguuagagaauuuccu

SEQ ID NO: 670887 - RNA, 15 nt, Human
uccucaacucugagu

SEQ ID NO: 670888 - RNA, 12 nt, Human
caggcauggugg

SEQ ID NO: 670889 - RNA, 16 nt, Human
ucuuuuaguuuuuaaa

SEQ ID NO: 670890 - RNA, 12 nt, Human
cuugguuuuaau

SEQ ID NO: 670891 - RNA, 18 nt, Human
guauuauuuuuuaaaaaa

SEQ ID NO: 670892 - RNA, 14 nt, Human
cuuggucugugaga

SEQ ID NO: 670893 - RNA, 15 nt, Human
ggccuccauccugag

SEQ ID NO: 670894 - RNA, 15 nt, Human
gccucuuagaugcag

SEQ ID NO: 670895 - RNA, 21 nt, Human
cacaugaacuuguaaaggaau

SEQ ID NO: 670896 - RNA, 14 nt, Human
aaagaggaaugaag

SEQ ID NO: 670897 - RNA, 23 nt, Human
uggaaauguuuacagauccccaa

SEQ ID NO: 670898 - RNA, 20 nt, Human
cauagugagacacugucucu

SEQ ID NO: 670899 - RNA, 20 nt, Human
cuggcuaauuagcauggcca

SEQ ID NO: 670900 - RNA, 14 nt, Human
cgugcuugucccug

SEQ ID NO: 670901 - RNA, 14 nt, Human
uugaaauuguauua

SEQ ID NO: 670902 - RNA, 22 nt, Human
auauuuacaaaugggaaacaaa

SEQ ID NO: 670903 - RNA, 14 nt, Human
uauaaauaaaaaua

SEQ ID NO: 670904 - RNA, 22 nt, Human
auaucaaacugaaacaaaauua

SEQ ID NO: 670905 - RNA, 19 nt, Human
cagaaagcagaacagugau

SEQ ID NO: 670906 - RNA, 23 nt, Human
auuaccauuauggauaaagauga

SEQ ID NO: 670907 - RNA, 12 nt, Human
gauaaaagacag

SEQ ID NO: 670908 - RNA, 14 nt, Human
agaauauauuuccu

SEQ ID NO: 670909 - RNA, 16 nt, Human
aauugacccacaagaa

SEQ ID NO: 670910 - RNA, 17 nt, Human
ucuggaggucucugaac

SEQ ID NO: 670911 - RNA, 22 nt, Human
agcuaaugaaguguuuagcaua

SEQ ID NO: 670912 - RNA, 18 nt, Human
uguucaagaccagccugg

SEQ ID NO: 670913 - RNA, 23 nt, Human
caacggggugaaacccugucucu

SEQ ID NO: 670914 - RNA, 21 nt, Human
caucucagguguguugcagug

SEQ ID NO: 670915 - RNA, 19 nt, Human
aaagacagugaaagaaaau

SEQ ID NO: 670916 - RNA, 18 nt, Human
guuucaaacauauauaac

SEQ ID NO: 670917 - RNA, 15 nt, Human
uuggggaauauguua

SEQ ID NO: 670918 - RNA, 13 nt, Human
auuuuuuaaaaaa

SEQ ID NO: 670919 - RNA, 21 nt, Human
gacagugaaagaaaauaacaa

SEQ ID NO: 670920 - RNA, 12 nt, Human
ggcugaugcagu

SEQ ID NO: 670921 - RNA, 18 nt, Human
gcuacagugagccaagag

SEQ ID NO: 670922 - RNA, 20 nt, Human
uuccacagaagcuccaggua

SEQ ID NO: 670923 - RNA, 23 nt, Human
caucucuucuggguuccuuccuc

SEQ ID NO: 670924 - RNA, 14 nt, Human
cacuuauaggaauu

SEQ ID NO: 670925 - RNA, 22 nt, Human
cuccuccagggagucucagcuu

SEQ ID NO: 670926 - RNA, 18 nt, Human
uggcuguuaaucuuucaa

SEQ ID NO: 670927 - RNA, 15 nt, Human
gcuguuaaucuuuca

SEQ ID NO: 670928 - RNA, 19 nt, Human
gagguacugagagugaaca

SEQ ID NO: 670929 - RNA, 18 nt, Human
aaguugauaugccuuuuc

SEQ ID NO: 670930 - RNA, 11 nt, Human
aauuccacagc

SEQ ID NO: 670931 - RNA, 11 nt, Human
auuuuugaagc

SEQ ID NO: 670932 - RNA, 19 nt, Human
acuucagcgguuuauauaa

SEQ ID NO: 670933 - RNA, 18 nt, Human
auuuguauaaaauaauuu

SEQ ID NO: 670934 - RNA, 16 nt, Human
ugcuauugaaguuuug

SEQ ID NO: 670935 - RNA, 17 nt, Human
agcucuaucccaaccuc

SEQ ID NO: 670936 - RNA, 20 nt, Human
acaugagguacugagaguga

SEQ ID NO: 670937 - RNA, 18 nt, Human
uaggaugggaacaaggaa

SEQ ID NO: 670938 - RNA, 20 nt, Human
uccagccugagcgacaguga

SEQ ID NO: 670939 - RNA, 17 nt, Human
gcaaauugucacaggac

SEQ ID NO: 670940 - RNA, 22 nt, Human
auauauaacaaugcuguauuuu

SEQ ID NO: 670941 - RNA, 15 nt, Human
ggaacaaggaaggaa

SEQ ID NO: 670942 - RNA, 15 nt, Human
ugauuucauucaaua

SEQ ID NO: 670943 - RNA, 14 nt, Human
ucugccugcccuga

SEQ ID NO: 670944 - RNA, 22 nt, Human
cuuuccacagaagcuccaggua

SEQ ID NO: 670945 - RNA, 16 nt, Human
acaugucuagagaaca

SEQ ID NO: 670946 - RNA, 16 nt, Human
aaaagcaucacaugaa

SEQ ID NO: 670947 - RNA, 21 nt, Human
uccuucagccugaaagaggaa

SEQ ID NO: 670948 - RNA, 17 nt, Human
caagccuccuuuuaaag

SEQ ID NO: 670949 - RNA, 18 nt, Human
acaaaaggauaaugaaua

SEQ ID NO: 670950 - RNA, 18 nt, Human
ggaaguauaggccaggca

SEQ ID NO: 670951 - RNA, 19 nt, Human
uuggcaagcucuaucacca

SEQ ID NO: 670952 - RNA, 19 nt, Human
agcguugagccaccaagcu

SEQ ID NO: 670953 - RNA, 15 nt, Human
agcaccaucauuccc

SEQ ID NO: 670954 - RNA, 18 nt, Human
caagcuaugugagcucac

SEQ ID NO: 670955 - RNA, 14 nt, Human
uuucaauaaaacuu

SEQ ID NO: 670956 - RNA, 22 nt, Human
agcuuguauuccuuuuucucuc

SEQ ID NO: 670957 - RNA, 10 nt, Human
ccugagcccc

SEQ ID NO: 670958 - RNA, 12 nt, Human
uaaauauauauu

SEQ ID NO: 670959 - RNA, 19 nt, Human
aaucaaacuuuacagaaag

SEQ ID NO: 670960 - RNA, 15 nt, Human
aguauaggccaggca

SEQ ID NO: 670961 - RNA, 11 nt, Human
aggcaggagga

SEQ ID NO: 670962 - RNA, 19 nt, Human
uauauuuuugugauuuugu

SEQ ID NO: 670963 - RNA, 21 nt, Human
cuaguaucaaaagaaagaaaa

SEQ ID NO: 670964 - RNA, 16 nt, Human
ucaucaaugaaugaau

SEQ ID NO: 670965 - RNA, 22 nt, Human
aggcacaguggcucacaccugu

SEQ ID NO: 670966 - RNA, 17 nt, Human
aagacagugaaagaaaa

SEQ ID NO: 670967 - RNA, 19 nt, Human
accccugagcuugcagaga

SEQ ID NO: 670968 - RNA, 13 nt, Human
cugccuucucaac

SEQ ID NO: 670969 - RNA, 14 nt, Human
ggccuucggccucc

SEQ ID NO: 670970 - RNA, 14 nt, Human
aaaagacagugaaa

SEQ ID NO: 670971 - RNA, 18 nt, Human
augaugcuuugagaacau

SEQ ID NO: 670972 - RNA, 15 nt, Human
aauuauuucacuuua

SEQ ID NO: 670973 - RNA, 22 nt, Human
ccaaacauccuacaagacacag

SEQ ID NO: 670974 - RNA, 17 nt, Human
ugaucaccugcccugcu

SEQ ID NO: 670975 - RNA, 13 nt, Human
ucuacuaaaaaua

SEQ ID NO: 670976 - RNA, 23 nt, Human
aagccauccccgcuccugguugg

SEQ ID NO: 670977 - RNA, 18 nt, Human
gccccugcacuccagccu

SEQ ID NO: 670978 - RNA, 16 nt, Human
auuugaugcuacagga

SEQ ID NO: 670979 - RNA, 12 nt, Human
agugcagccccg

SEQ ID NO: 670980 - RNA, 21 nt, Human
gugccugagcggaccuuccca

SEQ ID NO: 670981 - RNA, 14 nt, Human
cagagguugcagug

SEQ ID NO: 670982 - RNA, 13 nt, Human
uuuaacuccugcu

SEQ ID NO: 670983 - RNA, 16 nt, Human
gcuguuaaucuuucaa

SEQ ID NO: 670984 - RNA, 22 nt, Human
ucuuccuuuuuuaguucuucaa

SEQ ID NO: 670985 - RNA, 21 nt, Human
ugcucaauaaaguacaagagc

SEQ ID NO: 670986 - RNA, 14 nt, Human
auuucuaugaaaua

SEQ ID NO: 670987 - RNA, 18 nt, Human
caaggcuagaaccaccug

SEQ ID NO: 670988 - RNA, 13 nt, Human
aauuauuucacuu

SEQ ID NO: 670989 - RNA, 13 nt, Human
ccagaucaagccu

SEQ ID NO: 670990 - RNA, 19 nt, Human
uccacaaguaaaaggaaau

SEQ ID NO: 670991 - RNA, 20 nt, Human
ucaaaacuucagacauagaa

SEQ ID NO: 670992 - RNA, 22 nt, Human
uccagccuucucucaaggagag

SEQ ID NO: 670993 - RNA, 17 nt, Human
ccaagcugguggcucug

SEQ ID NO: 670994 - RNA, 22 nt, Human
aauuuuagacauucuuuaucuu

SEQ ID NO: 670995 - RNA, 12 nt, Human
auagcaaauaag

SEQ ID NO: 670996 - RNA, 16 nt, Human
agguacuucaaauccu

SEQ ID NO: 670997 - RNA, 13 nt, Human
agacacagugacc

SEQ ID NO: 670998 - RNA, 18 nt, Human
ugaacuugguuuuaauua

SEQ ID NO: 670999 - RNA, 12 nt, Human
agaaucuagagc

SEQ ID NO: 671000 - RNA, 14 nt, Human
cucaacaaacauaa

SEQ ID NO: 671001 - RNA, 14 nt, Human
ccugcugagcccca

SEQ ID NO: 671002 - RNA, 17 nt, Human
uaucuuuuuuuuaauaa

SEQ ID NO: 671003 - RNA, 16 nt, Human
ugcauagguuuaauaa

SEQ ID NO: 671004 - RNA, 15 nt, Human
guggagacaucugga

SEQ ID NO: 671005 - RNA, 23 nt, Human
gauagauaggucagugcaaauac

SEQ ID NO: 671006 - RNA, 20 nt, Human
aauaauuuuuauauuugaaa

SEQ ID NO: 671007 - RNA, 16 nt, Human
guuaucuucacuuuua

SEQ ID NO: 671008 - RNA, 12 nt, Human
aaacuccacauc

SEQ ID NO: 671009 - RNA, 13 nt, Human
aucaggcuggcca

SEQ ID NO: 671010 - RNA, 15 nt, Human
ugaaauuguauuaca

SEQ ID NO: 671011 - RNA, 22 nt, Human
caucgcaauguaagacucggga

SEQ ID NO: 671012 - RNA, 15 nt, Human
gaaaacaaggaugaa

SEQ ID NO: 671013 - RNA, 19 nt, Human
uauuuaauuauuucacuuu

SEQ ID NO: 671014 - RNA, 11 nt, Human
uucacagggga

SEQ ID NO: 671015 - RNA, 12 nt, Human
gccccugagccc

SEQ ID NO: 671016 - RNA, 14 nt, Human
uuagagaauuuccu

SEQ ID NO: 671017 - RNA, 17 nt, Human
ccccuggccaaggaaga

SEQ ID NO: 671018 - RNA, 13 nt, Human
uguauauuuuaua

SEQ ID NO: 671019 - RNA, 19 nt, Human
caguccauugggcaggcag

SEQ ID NO: 671020 - RNA, 18 nt, Human
ggaaagaauaaccaacac

SEQ ID NO: 671021 - RNA, 12 nt, Human
auauaaauaaaa

SEQ ID NO: 671022 - RNA, 22 nt, Human
gucaagaucagccugggcaaca

SEQ ID NO: 671023 - RNA, 15 nt, Human
acucaccucccccau

SEQ ID NO: 671024 - RNA, 16 nt, Human
gacauuugcucaugga

SEQ ID NO: 671025 - RNA, 22 nt, Human
cagaucuaugccacaagaaccc

SEQ ID NO: 671026 - RNA, 17 nt, Human
ugguucccuugaugaag

SEQ ID NO: 671027 - RNA, 15 nt, Human
uugacccacaagaaa

SEQ ID NO: 671028 - RNA, 12 nt, Human
aauaaaaacaaa

SEQ ID NO: 671029 - RNA, 15 nt, Human
cuaggugcugcagcc

SEQ ID NO: 671030 - RNA, 20 nt, Human
aauuaaguuuuuuuuuaaaa

SEQ ID NO: 671031 - RNA, 21 nt, Human
ugcccugaaagucccagauca

SEQ ID NO: 671032 - RNA, 19 nt, Human
auagucauucugccugccc

SEQ ID NO: 671033 - RNA, 14 nt, Human
cucccucccuuggg

SEQ ID NO: 671034 - RNA, 21 nt, Human
ccuggugccucaccccuugcc

SEQ ID NO: 671035 - RNA, 13 nt, Human
cggauugagaagg

SEQ ID NO: 671036 - RNA, 13 nt, Human
ugaaaaucuuaua

SEQ ID NO: 671037 - RNA, 18 nt, Human
augauguuucauaagaau

SEQ ID NO: 671038 - RNA, 15 nt, Human
auccugccccugagc

SEQ ID NO: 671039 - RNA, 22 nt, Human
cugcuggagacauugaggcagg

SEQ ID NO: 671040 - RNA, 21 nt, Human
agaauucuguugauggaaaua

SEQ ID NO: 671041 - RNA, 23 nt, Human
caugcugucuacacuaagagaga

SEQ ID NO: 671042 - RNA, 21 nt, Human
cuauaaaacuaggugcugcag

SEQ ID NO: 671043 - RNA, 16 nt, Human
aagaagcuagaaaaca

SEQ ID NO: 671044 - RNA, 12 nt, Human
cccucugcagcu

SEQ ID NO: 671045 - RNA, 20 nt, Human
aauuuugugaagcaaaauuu

SEQ ID NO: 671046 - RNA, 19 nt, Human
cuuccagauccuggaaauc

SEQ ID NO: 671047 - RNA, 14 nt, Human
cagaaugaccuggc

SEQ ID NO: 671048 - RNA, 18 nt, Human
agaagcaacccaaauguu

SEQ ID NO: 671049 - RNA, 19 nt, Human
agaucacuugagcucagga

SEQ ID NO: 671050 - RNA, 23 nt, Human
ccucagcugccuccccagcucua

SEQ ID NO: 671051 - RNA, 20 nt, Human
uaucuucacuuuuauaagaa

SEQ ID NO: 671052 - RNA, 19 nt, Human
ccucagcugccuccccagc

SEQ ID NO: 671053 - RNA, 13 nt, Human
aagaucagccugg

SEQ ID NO: 671054 - RNA, 14 nt, Human
cauccugugggacc

SEQ ID NO: 671055 - RNA, 21 nt, Human
gcauggccacaucugagcccc

SEQ ID NO: 671056 - RNA, 19 nt, Human
cuccagcuggccgggagcc

SEQ ID NO: 671057 - RNA, 23 nt, Human
aaagcccagcuugaaaccuucac

SEQ ID NO: 671058 - RNA, 20 nt, Human
accugauuucugagcauuua

SEQ ID NO: 671059 - RNA, 21 nt, Human
aggacagcccuucuuuccaca

SEQ ID NO: 671060 - RNA, 22 nt, Human
ucaacuccaaacugacucuuaa

SEQ ID NO: 671061 - RNA, 20 nt, Human
auaaauaaaaacaaaguuga

SEQ ID NO: 671062 - RNA, 17 nt, Human
auuauuuuuuaaaaaaa

SEQ ID NO: 671063 - RNA, 18 nt, Human
gucuucuagcagugagcc

SEQ ID NO: 671064 - RNA, 22 nt, Human
ccaaaggcuccugagacacaug

SEQ ID NO: 671065 - RNA, 16 nt, Human
cagucucccucccuug

SEQ ID NO: 671066 - RNA, 15 nt, Human
gaaaugauguuucau

SEQ ID NO: 671067 - RNA, 19 nt, Human
uggcaaacugccaucauuu

SEQ ID NO: 671068 - RNA, 13 nt, Human
aagacagugaaag

SEQ ID NO: 671069 - RNA, 15 nt, Human
aauauauauuuuaga

SEQ ID NO: 671070 - RNA, 14 nt, Human
aacuuugauuuuau

SEQ ID NO: 671071 - RNA, 14 nt, Human
cuauuauauuucca

SEQ ID NO: 671072 - RNA, 19 nt, Human
ccagccagggcaagagagc

SEQ ID NO: 671073 - RNA, 20 nt, Human
aaaaucuuauaauuuaaaau

SEQ ID NO: 671074 - RNA, 13 nt, Human
caaaaggaaugug

SEQ ID NO: 671075 - RNA, 13 nt, Human
uaugaaauauuau

SEQ ID NO: 671076 - RNA, 13 nt, Human
caagccugccuca

SEQ ID NO: 671077 - RNA, 18 nt, Human
caaucaguauucauauuu

SEQ ID NO: 671078 - RNA, 13 nt, Human
ccaaccucuccca

SEQ ID NO: 671079 - RNA, 13 nt, Human
cacaggauggcag

SEQ ID NO: 671080 - RNA, 16 nt, Human
gaauauaaauuuauca

SEQ ID NO: 671081 - RNA, 16 nt, Human
ucaaaagaaagaaaau

SEQ ID NO: 671082 - RNA, 14 nt, Human
guagcuaaauauau

SEQ ID NO: 671083 - RNA, 13 nt, Human
ggaccuucccagc

SEQ ID NO: 671084 - RNA, 19 nt, Human
ucuguuuucccuccuugga

SEQ ID NO: 671085 - RNA, 23 nt, Human
caccucauggaauuggagcucgu

SEQ ID NO: 671086 - RNA, 13 nt, Human
ucucagggcagau

SEQ ID NO: 671087 - RNA, 15 nt, Human
agacaaggaaaaaau

SEQ ID NO: 671088 - RNA, 19 nt, Human
gaucacuuuaggccuggug

SEQ ID NO: 671089 - RNA, 15 nt, Human
aaucucaauauuuca

SEQ ID NO: 671090 - RNA, 14 nt, Human
cugaacccagggaa

SEQ ID NO: 671091 - RNA, 18 nt, Human
uuaucauuuaguuauaaa

SEQ ID NO: 671092 - RNA, 12 nt, Human
ccagucccuccc

SEQ ID NO: 671093 - RNA, 19 nt, Human
auuggagcucgugggacag

SEQ ID NO: 671094 - RNA, 12 nt, Human
agggcaagagag

SEQ ID NO: 671095 - RNA, 20 nt, Human
ugccccccagcccuccuuau

SEQ ID NO: 671096 - RNA, 20 nt, Human
uuugccgcuuaagcuuucag

SEQ ID NO: 671097 - RNA, 13 nt, Human
acagcccuucuuu

SEQ ID NO: 671098 - RNA, 21 nt, Human
caucuagcaugucgucaaagc

SEQ ID NO: 671099 - RNA, 22 nt, Human
uauuucagauaaucacaauaca

SEQ ID NO: 671100 - RNA, 21 nt, Human
cccccauuguggucacaggaa

SEQ ID NO: 671101 - RNA, 14 nt, Human
ccccugagcuugca

SEQ ID NO: 671102 - RNA, 20 nt, Human
cuuccaggcuggcgugcagc

SEQ ID NO: 671103 - RNA, 19 nt, Human
uguuugccgcuuaagcuuu

SEQ ID NO: 671104 - RNA, 18 nt, Human
gaagcaccaaucaugaau

SEQ ID NO: 671105 - RNA, 19 nt, Human
cuuacucuugauuguggga

SEQ ID NO: 671106 - RNA, 22 nt, Human
ccccuuccuaauuccacagcug

SEQ ID NO: 671107 - RNA, 16 nt, Human
caggaaguagaggagg

SEQ ID NO: 671108 - RNA, 16 nt, Human
ugacaagcucacagac

SEQ ID NO: 671109 - RNA, 23 nt, Human
uauguuaaaacugggacagggga

SEQ ID NO: 671110 - RNA, 23 nt, Human
uguugagguaccuccaaggaccg

SEQ ID NO: 671111 - RNA, 17 nt, Human
uuauaaucuuucacagg

SEQ ID NO: 671112 - RNA, 21 nt, Human
aguuguugcccacagcuguau

SEQ ID NO: 671113 - RNA, 19 nt, Human
cucugcauacucauuagga

SEQ ID NO: 671114 - RNA, 13 nt, Human
ucuuauaauuuaa

SEQ ID NO: 671115 - RNA, 15 nt, Human
aaauauuuauuuuaa

SEQ ID NO: 671116 - RNA, 16 nt, Human
uuucacauuuaaauaa

SEQ ID NO: 671117 - RNA, 13 nt, Human
aacauuuauguuc

SEQ ID NO: 671118 - RNA, 14 nt, Human
aaagagaacuucca

SEQ ID NO: 671119 - RNA, 22 nt, Human
acaggauggcaggaggcaucca

SEQ ID NO: 671120 - RNA, 21 nt, Human
ugccuaggcauagcccugccu

SEQ ID NO: 671121 - RNA, 21 nt, Human
cccugggaccaggcaccccca

SEQ ID NO: 671122 - RNA, 14 nt, Human
ccaaugaaaugagu

SEQ ID NO: 671123 - RNA, 12 nt, Human
uaguacacacuu

SEQ ID NO: 671124 - RNA, 14 nt, Human
cuucugacacuaaa

SEQ ID NO: 671125 - RNA, 15 nt, Human
cuuaagaagacugca

SEQ ID NO: 671126 - RNA, 18 nt, Human
uuccaagaaauauuccuu

SEQ ID NO: 671127 - RNA, 13 nt, Human
aucaaugaaugaa

SEQ ID NO: 671128 - RNA, 16 nt, Human
ucccagaucaagccug

SEQ ID NO: 671129 - RNA, 17 nt, Human
aggcuagaaccaccugc

SEQ ID NO: 671130 - RNA, 24 nt, Human
ugucuugaauuguaggugacuauu

SEQ ID NO: 671131 - RNA, 15 nt, Human
aggcaccucucuggg

SEQ ID NO: 671132 - RNA, 14 nt, Human
cuccagugagacag

SEQ ID NO: 671133 - RNA, 20 nt, Human
gagccucagucucccucccu

SEQ ID NO: 671134 - RNA, 14 nt, Human
cucccugcccccca

SEQ ID NO: 671135 - RNA, 22 nt, Human
uggacgagaaaacaauaacgau

SEQ ID NO: 671136 - RNA, 16 nt, Human
cuacacuccagugaga

SEQ ID NO: 671137 - RNA, 20 nt, Human
ucaauaaaauccauacauuu

SEQ ID NO: 671138 - RNA, 21 nt, Human
auaguuguaccgcaaugugac

SEQ ID NO: 671139 - RNA, 12 nt, Human
ucugcacacagc

SEQ ID NO: 671140 - RNA, 12 nt, Human
caagccugccuc

SEQ ID NO: 671141 - RNA, 16 nt, Human
ucuucucagaaggaaa

SEQ ID NO: 671142 - RNA, 23 nt, Human
uaucuauguagaauauauuuccu

SEQ ID NO: 671143 - RNA, 14 nt, Human
cagccaccagucca

SEQ ID NO: 671144 - RNA, 17 nt, Human
agaggcaaagaaaggag

SEQ ID NO: 671145 - RNA, 18 nt, Human
acaugaacuuguaaagga

SEQ ID NO: 671146 - RNA, 16 nt, Human
uuaaauuguaauaggc

SEQ ID NO: 671147 - RNA, 15 nt, Human
uaucaauuuaaaaaa

SEQ ID NO: 671148 - RNA, 18 nt, Human
cucuggccuucggccucc

SEQ ID NO: 671149 - RNA, 15 nt, Human
ccccagaaugaccug

SEQ ID NO: 671150 - RNA, 20 nt, Human
aaauaauuuuuauauuugaa

SEQ ID NO: 671151 - RNA, 14 nt, Human
agaaaugaaagcag

SEQ ID NO: 671152 - RNA, 16 nt, Human
aaaguguuugaaagcu

SEQ ID NO: 671153 - RNA, 14 nt, Human
gccucagucucccu

SEQ ID NO: 671154 - RNA, 19 nt, Human
cggccuccauccugaggcu

SEQ ID NO: 671155 - RNA, 14 nt, Human
augggccauaugaa

SEQ ID NO: 671156 - RNA, 16 nt, Human
aauuacauuuguauaa

SEQ ID NO: 671157 - RNA, 12 nt, Human
ucagcugccucc

SEQ ID NO: 671158 - RNA, 21 nt, Human
caagacugcacaucaaaauau

SEQ ID NO: 671159 - RNA, 18 nt, Human
gccuuggggcugaugcag

SEQ ID NO: 671160 - RNA, 16 nt, Human
aaggagaggcaaagaa

SEQ ID NO: 671161 - RNA, 21 nt, Human
aaaauaugccccauucaacau

SEQ ID NO: 671162 - RNA, 13 nt, Human
acuguaaaauaau

SEQ ID NO: 671163 - RNA, 22 nt, Human
aacugcccacucugcaagaaga

SEQ ID NO: 671164 - RNA, 17 nt, Human
cccacuagacccacugg

SEQ ID NO: 671165 - RNA, 21 nt, Human
acgcucucuggccuucggccu

SEQ ID NO: 671166 - RNA, 18 nt, Human
ccugucucaauaaauaaa

SEQ ID NO: 671167 - RNA, 20 nt, Human
uaugaaaaggcuaagcuuca

SEQ ID NO: 671168 - RNA, 16 nt, Human
aagcuucacuguaaaa

SEQ ID NO: 671169 - RNA, 23 nt, Human
aaaauaucacuugucaauaaaau

SEQ ID NO: 671170 - RNA, 21 nt, Human
ccagccuggucaacauaguga

SEQ ID NO: 671171 - RNA, 16 nt, Human
aacaauaaaagacaag

SEQ ID NO: 671172 - RNA, 18 nt, Human
gcuaucaauccaagaacu

SEQ ID NO: 671173 - RNA, 16 nt, Human
cugaucaccugcccug

SEQ ID NO: 671174 - RNA, 13 nt, Human
cuagcagugagcc

SEQ ID NO: 671175 - RNA, 22 nt, Human
cugagcggaccuucccagcuag

SEQ ID NO: 671176 - RNA, 18 nt, Human
cugagggcauagaaguaa

SEQ ID NO: 671177 - RNA, 17 nt, Human
aaacaccucagcugccu

SEQ ID NO: 671178 - RNA, 22 nt, Human
uauccuacuuccccuuccuaau

SEQ ID NO: 671179 - RNA, 11 nt, Human
aaagaaacaaa

SEQ ID NO: 671180 - RNA, 16 nt, Human
cagcucuaucccaacc

SEQ ID NO: 671181 - RNA, 23 nt, Human
auaauguguucauucuggaauaa

SEQ ID NO: 671182 - RNA, 18 nt, Human
aaagagugaaggauuuau

SEQ ID NO: 671183 - RNA, 19 nt, Human
ugaaauggacuuuuguaca

SEQ ID NO: 671184 - RNA, 13 nt, Human
cuccccagcucua

SEQ ID NO: 671185 - RNA, 22 nt, Human
agaccaaauugagcuagggggg

SEQ ID NO: 671186 - RNA, 16 nt, Human
augcuaagugaaauaa

SEQ ID NO: 671187 - RNA, 21 nt, Human
aggaagggacacauaucaaac

SEQ ID NO: 671188 - RNA, 12 nt, Human
gccauaaaacuu

SEQ ID NO: 671189 - RNA, 14 nt, Human
ccaugaccaacauc

SEQ ID NO: 671190 - RNA, 21 nt, Human
uguccucaugagggcuggaug

SEQ ID NO: 671191 - RNA, 18 nt, Human
aaggagaggcaaagaaag

SEQ ID NO: 671192 - RNA, 22 nt, Human
aaauaacaaugaaaguugauaa

SEQ ID NO: 671193 - RNA, 20 nt, Human
cucccugccccccagcccuc

SEQ ID NO: 671194 - RNA, 14 nt, Human
ggccgcagugaggc

SEQ ID NO: 671195 - RNA, 18 nt, Human
ugaagaagcuagaaaaca

SEQ ID NO: 671196 - RNA, 23 nt, Human
aggaggaucacuuuaggccuggu

SEQ ID NO: 671197 - RNA, 20 nt, Human
uggggcuuuaacuccugcua

SEQ ID NO: 671198 - RNA, 18 nt, Human
aaaaucuuauaauuuaaa

SEQ ID NO: 671199 - RNA, 21 nt, Human
ccccugcaaagcccagcuuga

SEQ ID NO: 671200 - RNA, 21 nt, Human
guggggaugaacuuuuuguuu

SEQ ID NO: 671201 - RNA, 14 nt, Human
uauuugcuguuauu

SEQ ID NO: 671202 - RNA, 19 nt, Human
uguggauuuaauguggaaa

SEQ ID NO: 671203 - RNA, 20 nt, Human
uaauucugguagcuaaauau

SEQ ID NO: 671204 - RNA, 20 nt, Human
accggccuuugcaccuccau

SEQ ID NO: 671205 - RNA, 14 nt, Human
cuaaacauaugaau

SEQ ID NO: 671206 - RNA, 21 nt, Human
cuggaaacacauguuccccuu

SEQ ID NO: 671207 - RNA, 21 nt, Human
cucccaggaggggcuucuggg

SEQ ID NO: 671208 - RNA, 15 nt, Human
aacugaaacaaaauu

SEQ ID NO: 671209 - RNA, 14 nt, Human
gucucaauaaauaa

SEQ ID NO: 671210 - RNA, 12 nt, Human
ccccuugccaua

SEQ ID NO: 671211 - RNA, 22 nt, Human
auagccagguaccuucucaccu

SEQ ID NO: 671212 - RNA, 17 nt, Human
aaaauuagaaauguaau

SEQ ID NO: 671213 - RNA, 22 nt, Human
agacucgggauuaguacacacu

SEQ ID NO: 671214 - RNA, 21 nt, Human
uaaaagacagugaaagaaaau

SEQ ID NO: 671215 - RNA, 21 nt, Human
ucacaugaacuuguaaaggaa

SEQ ID NO: 671216 - RNA, 16 nt, Human
acaaauccaaugaaau

SEQ ID NO: 671217 - RNA, 13 nt, Human
acaucaggaaaga

SEQ ID NO: 671218 - RNA, 13 nt, Human
ggaaguagaggag

SEQ ID NO: 671219 - RNA, 17 nt, Human
ucagacauagaauuaac

SEQ ID NO: 671220 - RNA, 15 nt, Human
agugacaagcucaca

SEQ ID NO: 671221 - RNA, 21 nt, Human
ucagccagcccucuucugaca

SEQ ID NO: 671222 - RNA, 16 nt, Human
ugagccccgaaucuga

SEQ ID NO: 671223 - RNA, 15 nt, Human
aauugacccacaaga

SEQ ID NO: 671224 - RNA, 21 nt, Human
uuccuaauuccacagcugcuc

SEQ ID NO: 671225 - RNA, 23 nt, Human
cagagguugcagugagccgagau

SEQ ID NO: 671226 - RNA, 24 nt, Human
uaauuuaaaauaugcucuaaacau

SEQ ID NO: 671227 - RNA, 21 nt, Human
cuggguuuuggggggacgcua

SEQ ID NO: 671228 - RNA, 16 nt, Human
gagaaacuggaacucu

SEQ ID NO: 671229 - RNA, 18 nt, Human
ccaagccuggcaagggaa

SEQ ID NO: 671230 - RNA, 22 nt, Human
aaacaccucagcugccucccca

SEQ ID NO: 671231 - RNA, 13 nt, Human
cacauuuaaauaa

SEQ ID NO: 671232 - RNA, 13 nt, Human
uuuaaaaaaaaac

SEQ ID NO: 671233 - RNA, 23 nt, Human
gcugccuccccagcucuauccca

SEQ ID NO: 671234 - RNA, 16 nt, Human
guccauugggcaggca

SEQ ID NO: 671235 - RNA, 15 nt, Human
cuaagcaaaauguga

SEQ ID NO: 671236 - RNA, 21 nt, Human
gugcucuauuaccauuaugga

SEQ ID NO: 671237 - RNA, 15 nt, Human
ucaccagucccuccc

SEQ ID NO: 671238 - RNA, 21 nt, Human
augaugcuuugagaacauacu

SEQ ID NO: 671239 - RNA, 19 nt, Human
caaaacuuauuggaauguu

SEQ ID NO: 671240 - RNA, 22 nt, Human
gaauuucuucaacucccugccc

SEQ ID NO: 671241 - RNA, 19 nt, Human
cagauccccaagccuggca

SEQ ID NO: 671242 - RNA, 22 nt, Human
gagcuaggggggucagccagcc

SEQ ID NO: 671243 - RNA, 15 nt, Human
acaugugcuggccac

SEQ ID NO: 671244 - RNA, 22 nt, Human
cgaggugggcagaucacuugag

SEQ ID NO: 671245 - RNA, 13 nt, Human
uuuagugaaauau

SEQ ID NO: 671246 - RNA, 13 nt, Human
aucucaauauuuc

SEQ ID NO: 671247 - RNA, 14 nt, Human
ggcaccucucuggg

SEQ ID NO: 671248 - RNA, 21 nt, Human
ggguucccgugugccugagcg

SEQ ID NO: 671249 - RNA, 14 nt, Human
ucccaacuauaaaa

SEQ ID NO: 671250 - RNA, 18 nt, Human
uguauucuuuuaguuuuu

SEQ ID NO: 671251 - RNA, 21 nt, Human
gucaagaucagccugggcaac

SEQ ID NO: 671252 - RNA, 16 nt, Human
agccuacuaaaugcuc

SEQ ID NO: 671253 - RNA, 20 nt, Human
cagguaccuucucaccugug

SEQ ID NO: 671254 - RNA, 17 nt, Human
agagacagaaagcagaa

SEQ ID NO: 671255 - RNA, 16 nt, Human
accuccuaagaaggca

SEQ ID NO: 671256 - RNA, 18 nt, Human
auuagaaauguaauuaug

SEQ ID NO: 671257 - RNA, 18 nt, Human
uuuaguuauaaaaauaua

SEQ ID NO: 671258 - RNA, 15 nt, Human
accucccccaucucu

SEQ ID NO: 671259 - RNA, 17 nt, Human
cagugaaagaaaauaac

SEQ ID NO: 671260 - RNA, 23 nt, Human
cucagucucccucccuuggggcc

SEQ ID NO: 671261 - RNA, 19 nt, Human
ucucaaggagaggcaaaga

SEQ ID NO: 671262 - RNA, 15 nt, Human
cccaaccucucccaa

SEQ ID NO: 671263 - RNA, 22 nt, Human
cuccagccugagcgacagugag

SEQ ID NO: 671264 - RNA, 14 nt, Human
ugagcucagcccug

SEQ ID NO: 671265 - RNA, 14 nt, Human
auuuucuauaauuu

SEQ ID NO: 671266 - RNA, 16 nt, Human
auaguaccucugcuau

SEQ ID NO: 671267 - RNA, 22 nt, Human
aacaaggaaggaaagaugugaa

SEQ ID NO: 671268 - RNA, 19 nt, Human
acauuuguauaaaauaauu

SEQ ID NO: 671269 - RNA, 14 nt, Human
agcguugagccacc

SEQ ID NO: 671270 - RNA, 22 nt, Human
caguauggcagcuuuccucaaa

SEQ ID NO: 671271 - RNA, 15 nt, Human
ucaguauucauauuu

SEQ ID NO: 671272 - RNA, 18 nt, Human
accaagcugguggcucug

SEQ ID NO: 671273 - RNA, 23 nt, Human
ucaauaucuuuuuuuuaauaaac

SEQ ID NO: 671274 - RNA, 20 nt, Human
auaucauagcaaauaaguca

SEQ ID NO: 671275 - RNA, 19 nt, Human
auaauuuuuauauuugaaa

SEQ ID NO: 671276 - RNA, 21 nt, Human
uccuacaagacacagugacca

SEQ ID NO: 671277 - RNA, 16 nt, Human
ggcugaggcaggagga

SEQ ID NO: 671278 - RNA, 21 nt, Human
gcccugcugagucccaggcug

SEQ ID NO: 671279 - RNA, 18 nt, Human
aacugccaucauuuacuu

SEQ ID NO: 671280 - RNA, 12 nt, Human
gacagugaaaga

SEQ ID NO: 671281 - RNA, 11 nt, Human
ggguugggggg

SEQ ID NO: 671282 - RNA, 16 nt, Human
uucucaccugugagac

SEQ ID NO: 671283 - RNA, 12 nt, Human
cuaagaagugaa

SEQ ID NO: 671284 - RNA, 15 nt, Human
ugcaauuccacuuau

SEQ ID NO: 671285 - RNA, 23 nt, Human
gaacagauuucaaaaaaaaaccc

SEQ ID NO: 671286 - RNA, 14 nt, Human
cuuuuaguuuuuaa

SEQ ID NO: 671287 - RNA, 22 nt, Human
ccagcuggccuugugaggagcu

SEQ ID NO: 671288 - RNA, 18 nt, Human
agugucaaugcagccccc

SEQ ID NO: 671289 - RNA, 17 nt, Human
gacaaggaaaaaauaac

SEQ ID NO: 671290 - RNA, 14 nt, Human
ggacucaccucccc

SEQ ID NO: 671291 - RNA, 22 nt, Human
gugugaccacugcagaagacag

SEQ ID NO: 671292 - RNA, 19 nt, Human
auccugugggaccugggcc

SEQ ID NO: 671293 - RNA, 23 nt, Human
ccacuuggacaugggccccagau

SEQ ID NO: 671294 - RNA, 21 nt, Human
ucaagucuuucacauuuaaau

SEQ ID NO: 671295 - RNA, 12 nt, Human
cauuauauuuau

SEQ ID NO: 671296 - RNA, 18 nt, Human
uaguaucaaaagaaagaa

SEQ ID NO: 671297 - RNA, 17 nt, Human
ccuauccuacuuccccu

SEQ ID NO: 671298 - RNA, 16 nt, Human
cucagcccuggugggc

SEQ ID NO: 671299 - RNA, 15 nt, Human
ucaagggugugugca

SEQ ID NO: 671300 - RNA, 18 nt, Human
auagucaaauugugugaa

SEQ ID NO: 671301 - RNA, 14 nt, Human
cccugccucaagcu

SEQ ID NO: 671302 - RNA, 13 nt, Human
cuacauaaaauac

SEQ ID NO: 671303 - RNA, 19 nt, Human
gguuuaauaauuuuuaauu

SEQ ID NO: 671304 - RNA, 15 nt, Human
ccagaaugaccuggc

SEQ ID NO: 671305 - RNA, 15 nt, Human
aggagcucccaggag

SEQ ID NO: 671306 - RNA, 16 nt, Human
cucucccaacuauaaa

SEQ ID NO: 671307 - RNA, 20 nt, Human
caucccuagaaagccaugug

SEQ ID NO: 671308 - RNA, 22 nt, Human
aucaucaagucuuucacauuua

SEQ ID NO: 671309 - RNA, 20 nt, Human
gcagagaugaggccgccaug

SEQ ID NO: 671310 - RNA, 21 nt, Human
auccugugggaccugggccau

SEQ ID NO: 671311 - RNA, 23 nt, Human
accucucuggguugaagggcagu

SEQ ID NO: 671312 - RNA, 14 nt, Human
uaaauaaaaauaau

SEQ ID NO: 671313 - RNA, 14 nt, Human
uaaaggaauuuaaa

SEQ ID NO: 671314 - RNA, 20 nt, Human
aguugauuuaaggccaggca

SEQ ID NO: 671315 - RNA, 18 nt, Human
auuuaggccaugggacag

SEQ ID NO: 671316 - RNA, 14 nt, Human
aucuauguagaaua

SEQ ID NO: 671317 - RNA, 12 nt, Human
ccccugggacca

SEQ ID NO: 671318 - RNA, 17 nt, Human
gauacuccauggggugg

SEQ ID NO: 671319 - RNA, 16 nt, Human
augggaacaaggaagg

SEQ ID NO: 671320 - RNA, 22 nt, Human
agacacugucucuaccaaaaaa

SEQ ID NO: 671321 - RNA, 16 nt, Human
caauccaagaacuuau

SEQ ID NO: 671322 - RNA, 22 nt, Human
ccucccuuggggccuaugcaga

SEQ ID NO: 671323 - RNA, 13 nt, Human
uucaaaaaaaaac

SEQ ID NO: 671324 - RNA, 14 nt, Human
aaaaaggaaggaag

SEQ ID NO: 671325 - RNA, 18 nt, Human
ggaacuggugucuucagg

SEQ ID NO: 671326 - RNA, 14 nt, Human
aauauuauuuuaua

SEQ ID NO: 671327 - RNA, 15 nt, Human
aaggaaaaaauaaca

SEQ ID NO: 671328 - RNA, 19 nt, Human
cugccaaaacaucaaccug

SEQ ID NO: 671329 - RNA, 15 nt, Human
ccuggugggcagaga

SEQ ID NO: 671330 - RNA, 15 nt, Human
aguucuucaaagaua

SEQ ID NO: 671331 - RNA, 23 nt, Human
gccccugcacuccagccugagcg

SEQ ID NO: 671332 - RNA, 14 nt, Human
accacaagacugca

SEQ ID NO: 671333 - RNA, 17 nt, Human
ccugagcuugcagagau

SEQ ID NO: 671334 - RNA, 14 nt, Human
ugagcuaggggggu

SEQ ID NO: 671335 - RNA, 16 nt, Human
uugauuaagaaaggaa

SEQ ID NO: 671336 - RNA, 18 nt, Human
cccacuggacucaccucc

SEQ ID NO: 671337 - RNA, 20 nt, Human
uaaaacaagcacuaaacaaa

SEQ ID NO: 671338 - RNA, 14 nt, Human
aaacugaaacaaaa

SEQ ID NO: 671339 - RNA, 12 nt, Human
acucccugcccc

SEQ ID NO: 671340 - RNA, 14 nt, Human
gaaaaaauaacaau

SEQ ID NO: 671341 - RNA, 18 nt, Human
ccacuuggucugugagau

SEQ ID NO: 671342 - RNA, 21 nt, Human
cucuucuggguuccuuccucu

SEQ ID NO: 671343 - RNA, 18 nt, Human
aagggaauuucuucaacu

SEQ ID NO: 671344 - RNA, 14 nt, Human
cacuaaacaaagag

SEQ ID NO: 671345 - RNA, 18 nt, Human
agguccacaacacacaga

SEQ ID NO: 671346 - RNA, 19 nt, Human
ucaguuauuauauuuacaa

SEQ ID NO: 671347 - RNA, 14 nt, Human
agggcuaauaucuu

SEQ ID NO: 671348 - RNA, 12 nt, Human
aacuuuacagaa

SEQ ID NO: 671349 - RNA, 16 nt, Human
aaacuuuuccaaugac

SEQ ID NO: 671350 - RNA, 19 nt, Human
uccagaaagugacaagcuc

SEQ ID NO: 671351 - RNA, 22 nt, Human
accauuucuugagguaaaagca

SEQ ID NO: 671352 - RNA, 18 nt, Human
cauggugaaaccuggucu

SEQ ID NO: 671353 - RNA, 12 nt, Human
uagcauuucucc

SEQ ID NO: 671354 - RNA, 16 nt, Human
ugauuuaaggccaggc

SEQ ID NO: 671355 - RNA, 21 nt, Human
aacauggugaaaccuggucuc

SEQ ID NO: 671356 - RNA, 16 nt, Human
ugcaugguuuagaaag

SEQ ID NO: 671357 - RNA, 17 nt, Human
acuuccagauccuggaa

SEQ ID NO: 671358 - RNA, 22 nt, Human
auaacaaugcuguauuuuaaaa

SEQ ID NO: 671359 - RNA, 15 nt, Human
aaagaaagaaaauca

SEQ ID NO: 671360 - RNA, 20 nt, Human
caggcugagccucagucucc

SEQ ID NO: 671361 - RNA, 19 nt, Human
uuacagaaagauuugaugu

SEQ ID NO: 671362 - RNA, 21 nt, Human
caaggagaggcaaagaaagga

SEQ ID NO: 671363 - RNA, 17 nt, Human
agucugacuguuuccau

SEQ ID NO: 671364 - RNA, 20 nt, Human
ugagcgcccacuagacccac

SEQ ID NO: 671365 - RNA, 13 nt, Human
caauccaagaacu

SEQ ID NO: 671366 - RNA, 15 nt, Human
aaaaaagaaacauuu

SEQ ID NO: 671367 - RNA, 16 nt, Human
uugccauaauuacuau

SEQ ID NO: 671368 - RNA, 15 nt, Human
agaugggcauggugg

SEQ ID NO: 671369 - RNA, 22 nt, Human
gaauaaccaacacccugagguu

SEQ ID NO: 671370 - RNA, 19 nt, Human
guuguauuauuuuuuaaaa

SEQ ID NO: 671371 - RNA, 16 nt, Human
cccuuuacccccauga

SEQ ID NO: 671372 - RNA, 19 nt, Human
cccagcuagaauucacucc

SEQ ID NO: 671373 - RNA, 14 nt, Human
ugaggcaggaggau

SEQ ID NO: 671374 - RNA, 17 nt, Human
ccugagcggaccuuccc

SEQ ID NO: 671375 - RNA, 13 nt, Human
auuuuaaaagaau

SEQ ID NO: 671376 - RNA, 23 nt, Human
aucucuucuggguuccuuccucu

SEQ ID NO: 671377 - RNA, 15 nt, Human
cgagacccugucuca

SEQ ID NO: 671378 - RNA, 16 nt, Human
gcuucuguuccgugcu

SEQ ID NO: 671379 - RNA, 15 nt, Human
uuaauuuguaguguu

SEQ ID NO: 671380 - RNA, 21 nt, Human
gaagugaaaaucuacacucca

SEQ ID NO: 671381 - RNA, 14 nt, Human
ucaauaaauaaaua

SEQ ID NO: 671382 - RNA, 22 nt, Human
ugaagcaaaauuuuuucucuag

SEQ ID NO: 671383 - RNA, 15 nt, Human
auguuagagaauuuc

SEQ ID NO: 671384 - RNA, 18 nt, Human
guuuaugguuguauuauu

SEQ ID NO: 671385 - RNA, 22 nt, Human
uauuccuuuuucucuccucucc

SEQ ID NO: 671386 - RNA, 12 nt, Human
cagaacagugau

SEQ ID NO: 671387 - RNA, 18 nt, Human
augucugaaauggaacag

SEQ ID NO: 671388 - RNA, 16 nt, Human
gccuucucucaaggag

SEQ ID NO: 671389 - RNA, 14 nt, Human
agcaaguauuagaa

SEQ ID NO: 671390 - RNA, 19 nt, Human
aagcauuccaacuaucuca

SEQ ID NO: 671391 - RNA, 17 nt, Human
uccauccugaggcucca

SEQ ID NO: 671392 - RNA, 12 nt, Human
caacccaaaugu

SEQ ID NO: 671393 - RNA, 23 nt, Human
cacuggacucaccucccccaucu

SEQ ID NO: 671394 - RNA, 13 nt, Human
cauuuguauaaaa

SEQ ID NO: 671395 - RNA, 18 nt, Human
cuggguuaggccuugccu

SEQ ID NO: 671396 - RNA, 12 nt, Human
acacuuaaaaau

SEQ ID NO: 671397 - RNA, 21 nt, Human
acagugaaagaaaauaacaau

SEQ ID NO: 671398 - RNA, 18 nt, Human
auucuugccaaauauaaa

SEQ ID NO: 671399 - RNA, 13 nt, Human
auaacgauaaaag

SEQ ID NO: 671400 - RNA, 19 nt, Human
gagcucaccagucccuccc

SEQ ID NO: 671401 - RNA, 17 nt, Human
uugcaguuuuuuccuag

SEQ ID NO: 671402 - RNA, 14 nt, Human
auaccaugaugcug

SEQ ID NO: 671403 - RNA, 20 nt, Human
agagaucucuguagaaggag

SEQ ID NO: 671404 - RNA, 19 nt, Human
uggccacaucugagccccg

SEQ ID NO: 671405 - RNA, 13 nt, Human
uagcuaaguuuug

SEQ ID NO: 671406 - RNA, 15 nt, Human
uuucccagucuucag

SEQ ID NO: 671407 - RNA, 22 nt, Human
aauugacccacaagaaaugaaa

SEQ ID NO: 671408 - RNA, 21 nt, Human
ugagcucagcccuggugggca

SEQ ID NO: 671409 - RNA, 19 nt, Human
cagugagccaaauguaaaa

SEQ ID NO: 671410 - RNA, 14 nt, Human
ggccacaucugagc

SEQ ID NO: 671411 - RNA, 16 nt, Human
uauccuacuuccccuu

SEQ ID NO: 671412 - RNA, 23 nt, Human
aggaccggccuuugcaccuccau

SEQ ID NO: 671413 - RNA, 13 nt, Human
aucuggcucugga

SEQ ID NO: 671414 - RNA, 21 nt, Human
accaacacccugagguugugu

SEQ ID NO: 671415 - RNA, 15 nt, Human
uacaggauuugaaau

SEQ ID NO: 671416 - RNA, 12 nt, Human
guagacacacau

SEQ ID NO: 671417 - RNA, 21 nt, Human
ugaccauacuaauuauacccc

SEQ ID NO: 671418 - RNA, 20 nt, Human
acagcccuucuuuccacaga

SEQ ID NO: 671419 - RNA, 22 nt, Human
gagucccaggcugagccucagu

SEQ ID NO: 671420 - RNA, 15 nt, Human
uuaaguauuuuauua

SEQ ID NO: 671421 - RNA, 20 nt, Human
auauguuagagaauuuccuu

SEQ ID NO: 671422 - RNA, 21 nt, Human
auuuacaaaugggaaacaaaa

SEQ ID NO: 671423 - RNA, 17 nt, Human
gccaugggacagggagg

SEQ ID NO: 671424 - RNA, 12 nt, Human
guaaaggcaaac

SEQ ID NO: 671425 - RNA, 20 nt, Human
ucucguugacccucacagga

SEQ ID NO: 671426 - RNA, 21 nt, Human
aaggcaggaggaucacuugag

SEQ ID NO: 671427 - RNA, 19 nt, Human
uaaugaaguguuuagcaua

SEQ ID NO: 671428 - RNA, 14 nt, Human
cauggccacaucug

SEQ ID NO: 671429 - RNA, 15 nt, Human
cauuuaguuauaaaa

SEQ ID NO: 671430 - RNA, 15 nt, Human
cuucugaggagcugu

SEQ ID NO: 671431 - RNA, 12 nt, Human
cagugaaagaaa

SEQ ID NO: 671432 - RNA, 15 nt, Human
ucaaaggacaccauu

SEQ ID NO: 671433 - RNA, 20 nt, Human
cccagcuagaauucacucca

SEQ ID NO: 671434 - RNA, 14 nt, Human
cugaaacaaaauua

SEQ ID NO: 671435 - RNA, 14 nt, Human
auuuauuaaguauu

SEQ ID NO: 671436 - RNA, 12 nt, Human
agacagugaaag

SEQ ID NO: 671437 - RNA, 20 nt, Human
gccagcccucuucugacacu

SEQ ID NO: 671438 - RNA, 22 nt, Human
uucauagaguucccaugaacua

SEQ ID NO: 671439 - RNA, 17 nt, Human
augauuaaguaaugaua

SEQ ID NO: 671440 - RNA, 15 nt, Human
auuucacuuuagaaa

SEQ ID NO: 671441 - RNA, 14 nt, Human
ggggaacaugagcc

SEQ ID NO: 671442 - RNA, 21 nt, Human
cuccagggagucucagcuuca

SEQ ID NO: 671443 - RNA, 15 nt, Human
auuauuuuuuaaaaa

SEQ ID NO: 671444 - RNA, 17 nt, Human
aggcaggaggaucacuu

SEQ ID NO: 671445 - RNA, 23 nt, Human
caaauaagucaucugaugagaac

SEQ ID NO: 671446 - RNA, 15 nt, Human
cccccagcccuccuu

SEQ ID NO: 671447 - RNA, 20 nt, Human
uccaagccucauguccacug

SEQ ID NO: 671448 - RNA, 23 nt, Human
cuucaacucccugccccccagcc

SEQ ID NO: 671449 - RNA, 20 nt, Human
agaagaacugaaaucauacu

SEQ ID NO: 671450 - RNA, 19 nt, Human
uggauacuccauggggugg

SEQ ID NO: 671451 - RNA, 18 nt, Human
acaggauggcaggaggca

SEQ ID NO: 671452 - RNA, 20 nt, Human
gaacguaaucguguccccua

SEQ ID NO: 671453 - RNA, 21 nt, Human
gacagucaccucauggaauug

SEQ ID NO: 671454 - RNA, 19 nt, Human
acagucaccucauggaauu

SEQ ID NO: 671455 - RNA, 19 nt, Human
cgcccacuagacccacugg

SEQ ID NO: 671456 - RNA, 15 nt, Human
uucaagaccagccug

SEQ ID NO: 671457 - RNA, 18 nt, Human
ugagccaccaagcuggug

SEQ ID NO: 671458 - RNA, 20 nt, Human
agcuuauugucuagugaaac

SEQ ID NO: 671459 - RNA, 17 nt, Human
guuucuagagaugguuu

SEQ ID NO: 671460 - RNA, 14 nt, Human
cuagaauucacucc

SEQ ID NO: 671461 - RNA, 17 nt, Human
aaagaaacauuugguaa

SEQ ID NO: 671462 - RNA, 15 nt, Human
caaggagaggcaaag

SEQ ID NO: 671463 - RNA, 14 nt, Human
cuggaaaucagggu

SEQ ID NO: 671464 - RNA, 20 nt, Human
ggguuccuuccucugagccu

SEQ ID NO: 671465 - RNA, 21 nt, Human
uggggcuuuaacuccugcuag

SEQ ID NO: 671466 - RNA, 22 nt, Human
uguuuuuccaguaguuagcuuu

SEQ ID NO: 671467 - RNA, 15 nt, Human
acaagacccaaaagg

SEQ ID NO: 671468 - RNA, 24 nt, Human
ccccugagcuugcagagaugaggc

SEQ ID NO: 671469 - RNA, 18 nt, Human
ugcugcagccccugggac

SEQ ID NO: 671470 - RNA, 21 nt, Human
cuguuaucuucacuuuuauaa

SEQ ID NO: 671471 - RNA, 21 nt, Human
gccucaagcuaugugagcuca

SEQ ID NO: 671472 - RNA, 15 nt, Human
acgagauacagaauu

SEQ ID NO: 671473 - RNA, 22 nt, Human
auggaaauguuuacagaucccc

SEQ ID NO: 671474 - RNA, 14 nt, Human
ugcucauggaauug

SEQ ID NO: 671475 - RNA, 16 nt, Human
aaauauaaauaaaaau

SEQ ID NO: 671476 - RNA, 21 nt, Human
acuauuauauuuccaagaaau

SEQ ID NO: 671477 - RNA, 16 nt, Human
cauagucauucugccu

SEQ ID NO: 671478 - RNA, 15 nt, Human
auaaaguguuugaaa

SEQ ID NO: 671479 - RNA, 12 nt, Human
gaaaauaacaau

SEQ ID NO: 671480 - RNA, 17 nt, Human
agccuuggauacuccau

SEQ ID NO: 671481 - RNA, 19 nt, Human
caaggaugccccguccccc

SEQ ID NO: 671482 - RNA, 21 nt, Human
caggcacuaucuggguuuugg

SEQ ID NO: 671483 - RNA, 13 nt, Human
aacacaacuauau

SEQ ID NO: 671484 - RNA, 23 nt, Human
cauuuuuuuuuucaauaaaacuu

SEQ ID NO: 671485 - RNA, 14 nt, Human
ggcuacagugagcc

SEQ ID NO: 671486 - RNA, 18 nt, Human
uaaugaauacuuuauaaa

SEQ ID NO: 671487 - RNA, 17 nt, Human
gccugagcgacagugag

SEQ ID NO: 671488 - RNA, 14 nt, Human
cuaagucuuauaua

SEQ ID NO: 671489 - RNA, 22 nt, Human
ccugggaccaggcacccccaga

SEQ ID NO: 671490 - RNA, 21 nt, Human
gaaauguuuacagauccccaa

SEQ ID NO: 671491 - RNA, 20 nt, Human
aggagaggcaaagaaaggag

SEQ ID NO: 671492 - RNA, 18 nt, Human
acaagccuccuuuuaaag

SEQ ID NO: 671493 - RNA, 21 nt, Human
ccacauccugugggaccuggg

SEQ ID NO: 671494 - RNA, 14 nt, Human
gucccaggcugagc

SEQ ID NO: 671495 - RNA, 10 nt, Human
aaacacaugu

SEQ ID NO: 671496 - RNA, 16 nt, Human
gaaauguauucuuuua

SEQ ID NO: 671497 - RNA, 21 nt, Human
cccuauccuacuuccccuucc

SEQ ID NO: 671498 - RNA, 19 nt, Human
aaugagcacgcauggaaaa

SEQ ID NO: 671499 - RNA, 18 nt, Human
uccaggcuggcgugcagc

SEQ ID NO: 671500 - RNA, 14 nt, Human
acccaaaaggcaga

SEQ ID NO: 671501 - RNA, 22 nt, Human
cccccugcaaagcccagcuuga

SEQ ID NO: 671502 - RNA, 15 nt, Human
auuuauuaaguauuu

SEQ ID NO: 671503 - RNA, 16 nt, Human
ugcaaauugucacagg

SEQ ID NO: 671504 - RNA, 20 nt, Human
ucuaugagggcuaauaucuu

SEQ ID NO: 671505 - RNA, 16 nt, Human
ugacacuuaaaaaugg

SEQ ID NO: 671506 - RNA, 19 nt, Human
cacauccugugggaccugg

SEQ ID NO: 671507 - RNA, 16 nt, Human
gcuucacuguaaaaua

SEQ ID NO: 671508 - RNA, 14 nt, Human
aaccugagccccaa

SEQ ID NO: 671509 - RNA, 20 nt, Human
gaaacgaggauugggaaaaa

SEQ ID NO: 671510 - RNA, 21 nt, Human
gucucuaccaaaaaaaggaag

SEQ ID NO: 671511 - RNA, 21 nt, Human
aauuaaguuuuuuuuuaaaaa

SEQ ID NO: 671512 - RNA, 14 nt, Human
ugugaaaagcucca

SEQ ID NO: 671513 - RNA, 18 nt, Human
cauccaaaggcuccugag

SEQ ID NO: 671514 - RNA, 23 nt, Human
cuagacccacuggacucaccucc

SEQ ID NO: 671515 - RNA, 15 nt, Human
aguucugaagaagau

SEQ ID NO: 671516 - RNA, 23 nt, Human
gagguaccagccuuggauacucc

SEQ ID NO: 671517 - RNA, 20 nt, Human
ugaggcuccacuuggucugu

SEQ ID NO: 671518 - RNA, 15 nt, Human
auagucauucugccu

SEQ ID NO: 671519 - RNA, 13 nt, Human
agcucugcccauc

SEQ ID NO: 671520 - RNA, 17 nt, Human
aaaaauccuacuuucau

SEQ ID NO: 671521 - RNA, 20 nt, Human
cugacacuaaaacaccucag

SEQ ID NO: 671522 - RNA, 20 nt, Human
ugcagccaccaguccauugg

SEQ ID NO: 671523 - RNA, 21 nt, Human
cagcccuuagcccuuccccuc

SEQ ID NO: 671524 - RNA, 18 nt, Human
auuuuaacucuauaaugu

SEQ ID NO: 671525 - RNA, 23 nt, Human
cagccagcccucuucugacacua

SEQ ID NO: 671526 - RNA, 16 nt, Human
uucucuaggaaauauu

SEQ ID NO: 671527 - RNA, 12 nt, Human
uaagaaggcacc

SEQ ID NO: 671528 - RNA, 15 nt, Human
ggccuucggccucca

SEQ ID NO: 671529 - RNA, 20 nt, Human
caaacugccaucauuuacuu

SEQ ID NO: 671530 - RNA, 15 nt, Human
caaauugagcuaggg

SEQ ID NO: 671531 - RNA, 19 nt, Human
agaaaauaacgauaaaaga

SEQ ID NO: 671532 - RNA, 19 nt, Human
uguauacugugugcuaaaa

SEQ ID NO: 671533 - RNA, 22 nt, Human
cuaagcuucacuguaaaauaau

SEQ ID NO: 671534 - RNA, 21 nt, Human
cugggaccaggcacccccaga

SEQ ID NO: 671535 - RNA, 19 nt, Human
gaccggccuuugcaccucc

SEQ ID NO: 671536 - RNA, 14 nt, Human
augauguuuagaaa

SEQ ID NO: 671537 - RNA, 14 nt, Human
ucuuuuuuuuaaua

SEQ ID NO: 671538 - RNA, 18 nt, Human
cucuauguucuaagaagu

SEQ ID NO: 671539 - RNA, 20 nt, Human
uaggaauugacccacaagaa

SEQ ID NO: 671540 - RNA, 19 nt, Human
agcucugcccauccugccc

SEQ ID NO: 671541 - RNA, 19 nt, Human
agauuugagcucagcccug

SEQ ID NO: 671542 - RNA, 13 nt, Human
cucagaaaacaag

SEQ ID NO: 671543 - RNA, 17 nt, Human
agugauuaccagggacu

SEQ ID NO: 671544 - RNA, 12 nt, Human
aauuuuaaaaug

SEQ ID NO: 671545 - RNA, 14 nt, Human
ccugccccccagcc

SEQ ID NO: 671546 - RNA, 13 nt, Human
ccagcccuccuua

SEQ ID NO: 671547 - RNA, 15 nt, Human
gucaaugcagccccc

SEQ ID NO: 671548 - RNA, 14 nt, Human
guauuuuaaaagaa

SEQ ID NO: 671549 - RNA, 22 nt, Human
cagcuagaauucacuccacuug

SEQ ID NO: 671550 - RNA, 23 nt, Human
auuuauguuccuuuuaaagaaac

SEQ ID NO: 671551 - RNA, 18 nt, Human
auucacuccacuuggaca

SEQ ID NO: 671552 - RNA, 21 nt, Human
uauuacuguaagaaaauauca

SEQ ID NO: 671553 - RNA, 17 nt, Human
uucuccacuggaaaacu

SEQ ID NO: 671554 - RNA, 14 nt, Human
auauauuuccuuau

SEQ ID NO: 671555 - RNA, 21 nt, Human
uauaagaaauaggaaauauuu

SEQ ID NO: 671556 - RNA, 15 nt, Human
ucauaagaauucugu

SEQ ID NO: 671557 - RNA, 17 nt, Human
agggcauagaaguaaaa

SEQ ID NO: 671558 - RNA, 23 nt, Human
aucuuccuauaauuuuagacauu

SEQ ID NO: 671559 - RNA, 12 nt, Human
auuuaucauuua

SEQ ID NO: 671560 - RNA, 17 nt, Human
caaacauauauaacaau

SEQ ID NO: 671561 - RNA, 21 nt, Human
cagcucuaucccaaccucucc

SEQ ID NO: 671562 - RNA, 12 nt, Human
caggacagcccu

SEQ ID NO: 671563 - RNA, 12 nt, Human
gggggucagcca

SEQ ID NO: 671564 - RNA, 17 nt, Human
caagaaaugaaagcagg

SEQ ID NO: 671565 - RNA, 22 nt, Human
augucuagagaacacugugcuc

SEQ ID NO: 671566 - RNA, 15 nt, Human
uccuacaagacacag

SEQ ID NO: 671567 - RNA, 18 nt, Human
gcugagcccggaaacucc

SEQ ID NO: 671568 - RNA, 13 nt, Human
ucuaccaaaaaaa

SEQ ID NO: 671569 - RNA, 13 nt, Human
uuccucugagccu

SEQ ID NO: 671570 - RNA, 14 nt, Human
aaauauuauuuuau

SEQ ID NO: 671571 - RNA, 17 nt, Human
ccaaaaaucucaauauu

SEQ ID NO: 671572 - RNA, 19 nt, Human
agacucgggauuaguacac

SEQ ID NO: 671573 - RNA, 19 nt, Human
gcauggccacaucugagcc

SEQ ID NO: 671574 - RNA, 22 nt, Human
gucucagcuucacccugaggug

SEQ ID NO: 671575 - RNA, 19 nt, Human
agugaggagcuuugaaacg

SEQ ID NO: 671576 - RNA, 16 nt, Human
aucaagccugccucaa

SEQ ID NO: 671577 - RNA, 18 nt, Human
aaaaccuaagcaaacuua

SEQ ID NO: 671578 - RNA, 21 nt, Human
gcccccacuugccauaaaacu

SEQ ID NO: 671579 - RNA, 22 nt, Human
agcuguguccucaugagggcug

SEQ ID NO: 671580 - RNA, 12 nt, Human
auccugugggac

SEQ ID NO: 671581 - RNA, 14 nt, Human
ugagaugcuagaac

SEQ ID NO: 671582 - RNA, 20 nt, Human
accucauggaauuggagcuc

SEQ ID NO: 671583 - RNA, 18 nt, Human
uggccaccugcugagccc

SEQ ID NO: 671584 - RNA, 15 nt, Human
aagccaugugcagcc

SEQ ID NO: 671585 - RNA, 17 nt, Human
cuuauuuguacauuuuu

SEQ ID NO: 671586 - RNA, 14 nt, Human
agguugcagugagc

SEQ ID NO: 671587 - RNA, 18 nt, Human
uggagggaagccuugggg

SEQ ID NO: 671588 - RNA, 18 nt, Human
ucaaggguacacugccuu

SEQ ID NO: 671589 - RNA, 22 nt, Human
cucuggucaagaagcaucgugu

SEQ ID NO: 671590 - RNA, 22 nt, Human
aauuguaggugacuauuauauu

SEQ ID NO: 671591 - RNA, 18 nt, Human
cuaauaucuuaucuuccu

SEQ ID NO: 671592 - RNA, 16 nt, Human
aaaaugugauauguac

SEQ ID NO: 671593 - RNA, 22 nt, Human
cuuuaaugccgauaucuucaga

SEQ ID NO: 671594 - RNA, 21 nt, Human
auccccaagccuggcaaggga

SEQ ID NO: 671595 - RNA, 14 nt, Human
uuccccucugcagc

SEQ ID NO: 671596 - RNA, 13 nt, Human
uaauuuuuauauu

SEQ ID NO: 671597 - RNA, 17 nt, Human
ggugcugcagccccugg

SEQ ID NO: 671598 - RNA, 21 nt, Human
gaaaacaauaacgauaaaaga

SEQ ID NO: 671599 - RNA, 15 nt, Human
cccucuucugacacu

SEQ ID NO: 671600 - RNA, 18 nt, Human
gagccucagucucccucc

SEQ ID NO: 671601 - RNA, 23 nt, Human
uugaaguuuuggcaauugacuau

SEQ ID NO: 671602 - RNA, 15 nt, Human
acuuuuauaagaaau

SEQ ID NO: 671603 - RNA, 21 nt, Human
aggguuaugauuaaguaauga

SEQ ID NO: 671604 - RNA, 18 nt, Human
cuaucccaaccucuccca

SEQ ID NO: 671605 - RNA, 18 nt, Human
cuaccaaaaaaaggaagg

SEQ ID NO: 671606 - RNA, 23 nt, Human
gcuuuggucuaucuuugagcgcc

SEQ ID NO: 671607 - RNA, 18 nt, Human
ugcuauuuauuaaguauu

SEQ ID NO: 671608 - RNA, 15 nt, Human
gaaaugaaagcaggg

SEQ ID NO: 671609 - RNA, 17 nt, Human
caggagcaucuccucaa

SEQ ID NO: 671610 - RNA, 20 nt, Human
acaaugacuuguacucugaa

SEQ ID NO: 671611 - RNA, 23 nt, Human
uauuuuauuaggaguaccauaau

SEQ ID NO: 671612 - RNA, 19 nt, Human
acaaauuuacagagacaga

SEQ ID NO: 671613 - RNA, 19 nt, Human
uggugaacuugguuuuaau

SEQ ID NO: 671614 - RNA, 15 nt, Human
ggcaauagucaaauu

SEQ ID NO: 671615 - RNA, 15 nt, Human
ucacaggacagcccu

SEQ ID NO: 671616 - RNA, 21 nt, Human
ucuuaggguuaugauuaagua

SEQ ID NO: 671617 - RNA, 12 nt, Human
agcuuggaaugu

SEQ ID NO: 671618 - RNA, 12 nt, Human
uuuuauauuuga

SEQ ID NO: 671619 - RNA, 20 nt, Human
uaucauuuaguuauaaaaau

SEQ ID NO: 671620 - RNA, 13 nt, Human
gcagaacagugau

SEQ ID NO: 671621 - RNA, 23 nt, Human
augaauuaaguuuuuuuuuaaaa

SEQ ID NO: 671622 - RNA, 18 nt, Human
auccuucagccugaaaga

SEQ ID NO: 671623 - RNA, 16 nt, Human
acaugaaguccaagca

SEQ ID NO: 671624 - RNA, 17 nt, Human
aaaggaaggaagggaca

SEQ ID NO: 671625 - RNA, 15 nt, Human
aaugaauggcuaagc

SEQ ID NO: 671626 - RNA, 16 nt, Human
ccccugcacuccagcc

SEQ ID NO: 671627 - RNA, 18 nt, Human
auuauuuuuuaaaaaaau

SEQ ID NO: 671628 - RNA, 16 nt, Human
cauuuguauaaaauaa

SEQ ID NO: 671629 - RNA, 17 nt, Human
agauagaugaagaagcu

SEQ ID NO: 671630 - RNA, 15 nt, Human
accuucccagcuaga

SEQ ID NO: 671631 - RNA, 19 nt, Human
aagccaugugcagccacca

SEQ ID NO: 671632 - RNA, 17 nt, Human
aacagauuucaaaaaaa

SEQ ID NO: 671633 - RNA, 22 nt, Human
agacccugucucaauaaauaaa

SEQ ID NO: 671634 - RNA, 15 nt, Human
gcacagccucuuaga

SEQ ID NO: 671635 - RNA, 20 nt, Human
cugauauuggacaguaaaau

SEQ ID NO: 671636 - RNA, 19 nt, Human
aauauuauguuaaaacugg

SEQ ID NO: 671637 - RNA, 13 nt, Human
cucaccuccccca

SEQ ID NO: 671638 - RNA, 15 nt, Human
cacaggacagcccuu

SEQ ID NO: 671639 - RNA, 20 nt, Human
ggaggcauccaaaggcuccu

SEQ ID NO: 671640 - RNA, 14 nt, Human
uacguuaggaggac

SEQ ID NO: 671641 - RNA, 14 nt, Human
accugugagaccaa

SEQ ID NO: 671642 - RNA, 21 nt, Human
acugccaaaacaucaaccugc

SEQ ID NO: 671643 - RNA, 13 nt, Human
ccucuggcuccag

SEQ ID NO: 671644 - RNA, 16 nt, Human
cugucucuaccaaaaa

SEQ ID NO: 671645 - RNA, 20 nt, Human
uugauaaguacaugauaagc

SEQ ID NO: 671646 - RNA, 14 nt, Human
gucauucugccugc

SEQ ID NO: 671647 - RNA, 21 nt, Human
auuauauggcuugaguuuaaa

SEQ ID NO: 671648 - RNA, 22 nt, Human
aaguggaacgagacaagcagcc

SEQ ID NO: 671649 - RNA, 19 nt, Human
caagaaggaaagauuuugu

SEQ ID NO: 671650 - RNA, 16 nt, Human
auuuaguuauaaaaau

SEQ ID NO: 671651 - RNA, 14 nt, Human
ggaaacuccacauc

SEQ ID NO: 671652 - RNA, 20 nt, Human
auaaauggcuuccuggcaau

SEQ ID NO: 671653 - RNA, 16 nt, Human
ugcacaucaaaauaug

SEQ ID NO: 671654 - RNA, 12 nt, Human
cuuccucugagc

SEQ ID NO: 671655 - RNA, 24 nt, Human
gcuucugggcagacucuggucaag

SEQ ID NO: 671656 - RNA, 21 nt, Human
gccuauagucccacuacuugu

SEQ ID NO: 671657 - RNA, 18 nt, Human
auguuccuuuuaaagaaa

SEQ ID NO: 671658 - RNA, 15 nt, Human
cuaucuuugagcgcc

SEQ ID NO: 671659 - RNA, 15 nt, Human
gcuguucuuuaaaug

SEQ ID NO: 671660 - RNA, 18 nt, Human
cugaugggcaaaaaacca

SEQ ID NO: 671661 - RNA, 18 nt, Human
acuguacuccagccaggg

SEQ ID NO: 671662 - RNA, 17 nt, Human
cuuccuaauuccacagc

SEQ ID NO: 671663 - RNA, 22 nt, Human
cugaaauggaacagauuucaaa

SEQ ID NO: 671664 - RNA, 16 nt, Human
uucugacacuaaaaca

SEQ ID NO: 671665 - RNA, 17 nt, Human
gccaugugcagccacca

SEQ ID NO: 671666 - RNA, 18 nt, Human
cuaauuagcauggccaca

SEQ ID NO: 671667 - RNA, 23 nt, Human
uuacgaaauacguuaggaggaca

SEQ ID NO: 671668 - RNA, 16 nt, Human
ccaaauugagcuaggg

SEQ ID NO: 671669 - RNA, 21 nt, Human
auggaaauacacuguuaucuu

SEQ ID NO: 671670 - RNA, 18 nt, Human
gccugggcaacaugguga

SEQ ID NO: 671671 - RNA, 12 nt, Human
aaugcagccccc

SEQ ID NO: 671672 - RNA, 14 nt, Human
cuucucuucacagu

SEQ ID NO: 671673 - RNA, 18 nt, Human
aguuuauauagaaaugua

SEQ ID NO: 671674 - RNA, 21 nt, Human
aauaauccucaguuuuuguga

SEQ ID NO: 671675 - RNA, 18 nt, Human
ggcacagaaacuccuguu

SEQ ID NO: 671676 - RNA, 19 nt, Human
auuuugugaagcaaaauuu

SEQ ID NO: 671677 - RNA, 22 nt, Human
caucaucuucuggguuaggccu

SEQ ID NO: 671678 - RNA, 19 nt, Human
acuggacucaccuccccca

SEQ ID NO: 671679 - RNA, 22 nt, Human
cuaggaugggaacaaggaagga

SEQ ID NO: 671680 - RNA, 12 nt, Human
aucuucagaaaa

SEQ ID NO: 671681 - RNA, 20 nt, Human
aaaaaccugagccccaaaag

SEQ ID NO: 671682 - RNA, 21 nt, Human
gauguggggaaguuaggaacu

SEQ ID NO: 671683 - RNA, 13 nt, Human
gauggcaggaggc

SEQ ID NO: 671684 - RNA, 17 nt, Human
gauaaaagacagugaaa

SEQ ID NO: 671685 - RNA, 16 nt, Human
cuuggagacagggccc

SEQ ID NO: 671686 - RNA, 20 nt, Human
gaaauacacuguuaucuuca

SEQ ID NO: 671687 - RNA, 17 nt, Human
cagcagugccaaaauau

SEQ ID NO: 671688 - RNA, 21 nt, Human
aggauggcaggaggcauccaa

SEQ ID NO: 671689 - RNA, 14 nt, Human
uggacucaccuccc

SEQ ID NO: 671690 - RNA, 15 nt, Human
acugaagaagcacca

SEQ ID NO: 671691 - RNA, 15 nt, Human
guuuuucuuuucauu

SEQ ID NO: 671692 - RNA, 20 nt, Human
acaagacccaaaaggcagaa

SEQ ID NO: 671693 - RNA, 12 nt, Human
gcucagcccugg

SEQ ID NO: 671694 - RNA, 19 nt, Human
uugugggauacuauuuaau

SEQ ID NO: 671695 - RNA, 12 nt, Human
aagaaaauaaca

SEQ ID NO: 671696 - RNA, 20 nt, Human
aaugaauacuuuauaaagga

SEQ ID NO: 671697 - RNA, 22 nt, Human
aaaaaaccugagccccaaaagg

SEQ ID NO: 671698 - RNA, 16 nt, Human
ccugagcuugcagaga

SEQ ID NO: 671699 - RNA, 17 nt, Human
augccccgucccccucu

SEQ ID NO: 671700 - RNA, 19 nt, Human
aaacaauaacgauaaaaga

SEQ ID NO: 671701 - RNA, 15 nt, Human
cucccuuggggccua

SEQ ID NO: 671702 - RNA, 14 nt, Human
acugccaucauuua

SEQ ID NO: 671703 - RNA, 22 nt, Human
caggggccacaccaaccuucug

SEQ ID NO: 671704 - RNA, 17 nt, Human
ucugguagcuaaauaua

SEQ ID NO: 671705 - RNA, 16 nt, Human
aaaauaacaauaaaag

SEQ ID NO: 671706 - RNA, 15 nt, Human
uuuaauaauuuuuaa

SEQ ID NO: 671707 - RNA, 21 nt, Human
ccggccuuugcaccuccaugg

SEQ ID NO: 671708 - RNA, 21 nt, Human
ugaacaaauuuacagagacag

SEQ ID NO: 671709 - RNA, 16 nt, Human
ccucaaucaguauuca

SEQ ID NO: 671710 - RNA, 14 nt, Human
ucucagaaggaaag

SEQ ID NO: 671711 - RNA, 18 nt, Human
cuuuucccaacuccagaa

SEQ ID NO: 671712 - RNA, 13 nt, Human
ccagcacagccuc

SEQ ID NO: 671713 - RNA, 16 nt, Human
agccucagucucccuc

SEQ ID NO: 671714 - RNA, 20 nt, Human
cugagccucagucucccucc

SEQ ID NO: 671715 - RNA, 11 nt, Human
ugccauaaaac

SEQ ID NO: 671716 - RNA, 22 nt, Human
uauagccagguaccuucucacc

SEQ ID NO: 671717 - RNA, 14 nt, Human
ggugcugcagcccc

SEQ ID NO: 671718 - RNA, 21 nt, Human
cucagugucaaugcagccccc

SEQ ID NO: 671719 - RNA, 14 nt, Human
ccugccccugagcc

SEQ ID NO: 671720 - RNA, 15 nt, Human
gccccauucaacauc

SEQ ID NO: 671721 - RNA, 22 nt, Human
aagagccuuuuuuugaaaaaaa

SEQ ID NO: 671722 - RNA, 17 nt, Human
aaauauaaauaaaaaua

SEQ ID NO: 671723 - RNA, 23 nt, Human
ggucuaucuuugagcgcccacua

SEQ ID NO: 671724 - RNA, 12 nt, Human
uaaaaauuaaaa

SEQ ID NO: 671725 - RNA, 14 nt, Human
cccacuugccauaa

SEQ ID NO: 671726 - RNA, 20 nt, Human
uuuaaggccaggcauggugg

SEQ ID NO: 671727 - RNA, 16 nt, Human
ucauucugccugcccu

SEQ ID NO: 671728 - RNA, 15 nt, Human
caggcaaauuccuga

SEQ ID NO: 671729 - RNA, 18 nt, Human
auagggagggaaggggga

SEQ ID NO: 671730 - RNA, 23 nt, Human
cucauguccacugguucuucuug

SEQ ID NO: 671731 - RNA, 19 nt, Human
acaauaacgauaaaagaca

SEQ ID NO: 671732 - RNA, 14 nt, Human
guccacaaguaaaa

SEQ ID NO: 671733 - RNA, 18 nt, Human
ugcaagaagaaaucauga

SEQ ID NO: 671734 - RNA, 17 nt, Human
acucaccucccccaucu

SEQ ID NO: 671735 - RNA, 19 nt, Human
agucaaauugugugaaagg

SEQ ID NO: 671736 - RNA, 20 nt, Human
agaaggcuguggauuuaaug

SEQ ID NO: 671737 - RNA, 14 nt, Human
uugccaugugcuag

SEQ ID NO: 671738 - RNA, 22 nt, Human
uggaaaguuuaugguuguauua

SEQ ID NO: 671739 - RNA, 18 nt, Human
agcauuguuggcuguucc

SEQ ID NO: 671740 - RNA, 18 nt, Human
uacauuuguauaaaauaa

SEQ ID NO: 671741 - RNA, 20 nt, Human
aucaaccugccagcuggccu

SEQ ID NO: 671742 - RNA, 13 nt, Human
acaugucuagaga

SEQ ID NO: 671743 - RNA, 14 nt, Human
ccacauccuguggg

SEQ ID NO: 671744 - RNA, 18 nt, Human
cuuuuaaagaaacaaaaa

SEQ ID NO: 671745 - RNA, 16 nt, Human
caaaaggauaaugaau

SEQ ID NO: 671746 - RNA, 14 nt, Human
uaauccuaaacaua

SEQ ID NO: 671747 - RNA, 16 nt, Human
aaauauuccuuaagau

SEQ ID NO: 671748 - RNA, 23 nt, Human
uuuuauagcuacuaauuuuaaaa

SEQ ID NO: 671749 - RNA, 17 nt, Human
uaucaauuuaaaaaaaa

SEQ ID NO: 671750 - RNA, 17 nt, Human
cuggagggaagccuugg

SEQ ID NO: 671751 - RNA, 20 nt, Human
ccaaguaaauguuuguccuu

SEQ ID NO: 671752 - RNA, 17 nt, Human
uuacagagacagaaagc

SEQ ID NO: 671753 - RNA, 16 nt, Human
ccugaucaccugcccu

SEQ ID NO: 671754 - RNA, 12 nt, Human
acaagaaaugaa

SEQ ID NO: 671755 - RNA, 17 nt, Human
uaugccacaagaacccc

SEQ ID NO: 671756 - RNA, 18 nt, Human
ugggcacaggguuuaugu

SEQ ID NO: 671757 - RNA, 16 nt, Human
cauuucuaaagccauu

SEQ ID NO: 671758 - RNA, 15 nt, Human
ccugcaaagcccagc

SEQ ID NO: 671759 - RNA, 23 nt, Human
ucuaccaaaaaucucaauauuuc

SEQ ID NO: 671760 - RNA, 15 nt, Human
uucacauuuaaauaa

SEQ ID NO: 671761 - RNA, 16 nt, Human
ccuaagugcagccccg

SEQ ID NO: 671762 - RNA, 21 nt, Human
cugagccucagucucccuccc

SEQ ID NO: 671763 - RNA, 15 nt, Human
gccuaagugcagccc

SEQ ID NO: 671764 - RNA, 18 nt, Human
ggggcuuuaacuccugcu

SEQ ID NO: 671765 - RNA, 16 nt, Human
auugucuagugaaacu

SEQ ID NO: 671766 - RNA, 21 nt, Human
cuggccuucggccuccauccu

SEQ ID NO: 671767 - RNA, 18 nt, Human
caagccucauguccacug

SEQ ID NO: 671768 - RNA, 18 nt, Human
agggugcacacaggaugg

SEQ ID NO: 671769 - RNA, 23 nt, Human
ccccugggaccaggcacccccag

SEQ ID NO: 671770 - RNA, 17 nt, Human
auuucuaaaaguuuaag

SEQ ID NO: 671771 - RNA, 22 nt, Human
gaaauaagccagacaucaacag

SEQ ID NO: 671772 - RNA, 15 nt, Human
ugcagccaccagucc

SEQ ID NO: 671773 - RNA, 17 nt, Human
uaugcuauugaaguuuu

SEQ ID NO: 671774 - RNA, 18 nt, Human
acaaaugcauuucuaaag

SEQ ID NO: 671775 - RNA, 17 nt, Human
auuuucuauaauuuaaa

SEQ ID NO: 671776 - RNA, 22 nt, Human
ugaccauacuaauuauaccccc

SEQ ID NO: 671777 - RNA, 11 nt, Human
aaaggaaggaa

SEQ ID NO: 671778 - RNA, 16 nt, Human
uuccuuacucuugauu

SEQ ID NO: 671779 - RNA, 16 nt, Human
cuggguugaagggcag

SEQ ID NO: 671780 - RNA, 15 nt, Human
uagauaggccauggg

SEQ ID NO: 671781 - RNA, 14 nt, Human
acauauauaacaau

SEQ ID NO: 671782 - RNA, 21 nt, Human
uaagucaucugaugagaacaa

SEQ ID NO: 671783 - RNA, 20 nt, Human
ccagaaugaccuggccgcag

SEQ ID NO: 671784 - RNA, 17 nt, Human
ucgggauuaguacacac

SEQ ID NO: 671785 - RNA, 15 nt, Human
gugaccacugcagaa

SEQ ID NO: 671786 - RNA, 23 nt, Human
aaguauccuucagccugaaagag

SEQ ID NO: 671787 - RNA, 19 nt, Human
aaauuaaaaccucuuugug

SEQ ID NO: 671788 - RNA, 16 nt, Human
uggggauagugaggca

SEQ ID NO: 671789 - RNA, 21 nt, Human
gaaggaaagaauaaccaacac

SEQ ID NO: 671790 - RNA, 22 nt, Human
ugguuguauuauuuuuuaaaaa

SEQ ID NO: 671791 - RNA, 18 nt, Human
ccaggaggggcuucuggg

SEQ ID NO: 671792 - RNA, 20 nt, Human
agcccuuccccucugcagcu

SEQ ID NO: 671793 - RNA, 21 nt, Human
uuccuagucuguuuucccucc

SEQ ID NO: 671794 - RNA, 17 nt, Human
uuccaagugauugaaac

SEQ ID NO: 671795 - RNA, 20 nt, Human
accucugccucagaaaacaa

SEQ ID NO: 671796 - RNA, 13 nt, Human
uuucuaaaaguuu

SEQ ID NO: 671797 - RNA, 22 nt, Human
uggguuccuuccucugagccuu

SEQ ID NO: 671798 - RNA, 16 nt, Human
cuccaugggguggggg

SEQ ID NO: 671799 - RNA, 20 nt, Human
uaagugaaauaagccagaca

SEQ ID NO: 671800 - RNA, 16 nt, Human
gugcugcagccccugg

SEQ ID NO: 671801 - RNA, 23 nt, Human
cuagucuguuuucccuccuugga

SEQ ID NO: 671802 - RNA, 13 nt, Human
gguccacaacaca

SEQ ID NO: 671803 - RNA, 22 nt, Human
aaacauccuacaagacacagug

SEQ ID NO: 671804 - RNA, 16 nt, Human
ugaugggcaaaaaacc

SEQ ID NO: 671805 - RNA, 13 nt, Human
agaauauauuucc

SEQ ID NO: 671806 - RNA, 16 nt, Human
auuauacccccugcaa

SEQ ID NO: 671807 - RNA, 18 nt, Human
aacagauuucaaaaaaaa

SEQ ID NO: 671808 - RNA, 20 nt, Human
guucugcagauaaacaguag

SEQ ID NO: 671809 - RNA, 15 nt, Human
gacaguauggcagcu

SEQ ID NO: 671810 - RNA, 17 nt, Human
aucauuuacuuuuaaac

SEQ ID NO: 671811 - RNA, 13 nt, Human
cguuaauguaaag

SEQ ID NO: 671812 - RNA, 13 nt, Human
ccaggcugagccu

SEQ ID NO: 671813 - RNA, 13 nt, Human
gacaaggaaaaaa

SEQ ID NO: 671814 - RNA, 16 nt, Human
gauguugacucuaaag

SEQ ID NO: 671815 - RNA, 20 nt, Human
cuuccccucugcagcuucca

SEQ ID NO: 671816 - RNA, 14 nt, Human
gaacgagacaagca

SEQ ID NO: 671817 - RNA, 19 nt, Human
uaccauuauggauaaagau

SEQ ID NO: 671818 - RNA, 19 nt, Human
cauaucaaacugaaacaaa

SEQ ID NO: 671819 - RNA, 18 nt, Human
auggccacaucugagccc

SEQ ID NO: 671820 - RNA, 21 nt, Human
ucuucaacucccugcccccca

SEQ ID NO: 671821 - RNA, 15 nt, Human
augauaacuggaaac

SEQ ID NO: 671822 - RNA, 15 nt, Human
auaugcuucuuugug

SEQ ID NO: 671823 - RNA, 14 nt, Human
caaaugcauuucua

SEQ ID NO: 671824 - RNA, 14 nt, Human
uccacuuggucugu

SEQ ID NO: 671825 - RNA, 17 nt, Human
uuuccaugaguugcagu

SEQ ID NO: 671826 - RNA, 17 nt, Human
caucgcagacacaugug

SEQ ID NO: 671827 - RNA, 19 nt, Human
ucccucccaaguaaauguu

SEQ ID NO: 671828 - RNA, 20 nt, Human
auguuccuuuuaaagaaaca

SEQ ID NO: 671829 - RNA, 18 nt, Human
aaggagcucccaggaggg

SEQ ID NO: 671830 - RNA, 18 nt, Human
cagagucaagggugugug

SEQ ID NO: 671831 - RNA, 14 nt, Human
gagcucagcccugg

SEQ ID NO: 671832 - RNA, 24 nt, Human
cuggcuaauuagcauggccacauc

SEQ ID NO: 671833 - RNA, 19 nt, Human
caaguaaaaggaaaugcuc

SEQ ID NO: 671834 - RNA, 19 nt, Human
auuuucuauaauuuaaaua

SEQ ID NO: 671835 - RNA, 14 nt, Human
acaugucuagagaa

SEQ ID NO: 671836 - RNA, 12 nt, Human
aauuuaaauaua

SEQ ID NO: 671837 - RNA, 18 nt, Human
auagcuacuaauuuuaaa

SEQ ID NO: 671838 - RNA, 22 nt, Human
cugcucaauaaaguacaagagc

SEQ ID NO: 671839 - RNA, 14 nt, Human
uuuuauaagaaaua

SEQ ID NO: 671840 - RNA, 15 nt, Human
ggauacuccaugggg

SEQ ID NO: 671841 - RNA, 22 nt, Human
ggguuccuuccucugagccuug

SEQ ID NO: 671842 - RNA, 15 nt, Human
uagggugauauuaac

SEQ ID NO: 671843 - RNA, 20 nt, Human
auaagccagacaucaacaga

SEQ ID NO: 671844 - RNA, 14 nt, Human
ugcuaagucuuaua

SEQ ID NO: 671845 - RNA, 18 nt, Human
cacaaguaaaaggaaaug

SEQ ID NO: 671846 - RNA, 22 nt, Human
cugaaacaaaauuagaaaugua

SEQ ID NO: 671847 - RNA, 18 nt, Human
ccugcccugaaaguccca

SEQ ID NO: 671848 - RNA, 16 nt, Human
ugcagugucugcugga

SEQ ID NO: 671849 - RNA, 15 nt, Human
cccacucugcaagaa

SEQ ID NO: 671850 - RNA, 16 nt, Human
cacaucaggaaagaga

SEQ ID NO: 671851 - RNA, 18 nt, Human
augggggcagcaccuccu

SEQ ID NO: 671852 - RNA, 12 nt, Human
accccugagcuu

SEQ ID NO: 671853 - RNA, 23 nt, Human
aaugcuccuccagggagucucag

SEQ ID NO: 671854 - RNA, 21 nt, Human
caccagucugacuguuuccau

SEQ ID NO: 671855 - RNA, 20 nt, Human
auuuccuuauucagaauuuc

SEQ ID NO: 671856 - RNA, 17 nt, Human
uagaauauauuuccuua

SEQ ID NO: 671857 - RNA, 15 nt, Human
aaauguauucuuuua

SEQ ID NO: 671858 - RNA, 17 nt, Human
gcucaccagucccuccc

SEQ ID NO: 671859 - RNA, 16 nt, Human
uguugagguaccucca

SEQ ID NO: 671860 - RNA, 20 nt, Human
ucagaaggaaagaauaacca

SEQ ID NO: 671861 - RNA, 15 nt, Human
ucuggcuccagcugg

SEQ ID NO: 671862 - RNA, 13 nt, Human
ccugagcuugcag

SEQ ID NO: 671863 - RNA, 16 nt, Human
augagcacgcauggaa

SEQ ID NO: 671864 - RNA, 19 nt, Human
cauggccacaucugagccc

SEQ ID NO: 671865 - RNA, 20 nt, Human
aucauuuaguuauaaaaaua

SEQ ID NO: 671866 - RNA, 16 nt, Human
aaugaaagcagggacu

SEQ ID NO: 671867 - RNA, 14 nt, Human
acaagagcuuaaca

SEQ ID NO: 671868 - RNA, 21 nt, Human
ugaaacgaggauugggaaaaa

SEQ ID NO: 671869 - RNA, 16 nt, Human
ccuccuuaucaaagga

SEQ ID NO: 671870 - RNA, 22 nt, Human
cauuuaaauaaaguguuugaaa

SEQ ID NO: 671871 - RNA, 17 nt, Human
cuagaaaacaggcaaau

SEQ ID NO: 671872 - RNA, 22 nt, Human
auuacuguaagaaaauaucacu

SEQ ID NO: 671873 - RNA, 13 nt, Human
aaauccuugaaga

SEQ ID NO: 671874 - RNA, 19 nt, Human
cauggaauuggagcucgug

SEQ ID NO: 671875 - RNA, 20 nt, Human
ucagaauuucuaaaaguuua

SEQ ID NO: 671876 - RNA, 20 nt, Human
aggacaaaaggaauguguaa

SEQ ID NO: 671877 - RNA, 18 nt, Human
aucuauguagaauauauu

SEQ ID NO: 671878 - RNA, 19 nt, Human
cagagucaagggugugugc

SEQ ID NO: 671879 - RNA, 15 nt, Human
ugguuuagaaagcuu

SEQ ID NO: 671880 - RNA, 15 nt, Human
cucguggaacaguua

SEQ ID NO: 671881 - RNA, 18 nt, Human
auuuuagacauucuuuau

SEQ ID NO: 671882 - RNA, 14 nt, Human
agcggaccuuccca

SEQ ID NO: 671883 - RNA, 18 nt, Human
uguugcagugucugcugg

SEQ ID NO: 671884 - RNA, 22 nt, Human
uuccuagucuguuuucccuccu

SEQ ID NO: 671885 - RNA, 23 nt, Human
acgaggauugggaaaaaguaauu

SEQ ID NO: 671886 - RNA, 20 nt, Human
gaaacauuugguaaggggaa

SEQ ID NO: 671887 - RNA, 16 nt, Human
ucccugccccccagcc

SEQ ID NO: 671888 - RNA, 22 nt, Human
gucacaggaaguagaggaggcc

SEQ ID NO: 671889 - RNA, 19 nt, Human
ccacuuggacaugggcccc

SEQ ID NO: 671890 - RNA, 15 nt, Human
ccgucccccucuggc

SEQ ID NO: 671891 - RNA, 16 nt, Human
uccugcaauuccacuu

SEQ ID NO: 671892 - RNA, 22 nt, Human
ccgggagccugaucaccugccc

SEQ ID NO: 671893 - RNA, 21 nt, Human
cugcccugcugagucccaggc

SEQ ID NO: 671894 - RNA, 18 nt, Human
acauuuauauuuuuguga

SEQ ID NO: 671895 - RNA, 23 nt, Human
uccagguagaggguguguaagua

SEQ ID NO: 671896 - RNA, 21 nt, Human
gagauuuugcuugagcaggau

SEQ ID NO: 671897 - RNA, 17 nt, Human
uuucacauuuaaauaaa

SEQ ID NO: 671898 - RNA, 17 nt, Human
aggcuggcgugcagcau

SEQ ID NO: 671899 - RNA, 14 nt, Human
aauggcuaagcaaa

SEQ ID NO: 671900 - RNA, 23 nt, Human
uaacgauaaaagacagugaaaga

SEQ ID NO: 671901 - RNA, 15 nt, Human
cugcacuccagccug

SEQ ID NO: 671902 - RNA, 15 nt, Human
aagccuggcaaggga

SEQ ID NO: 671903 - RNA, 17 nt, Human
gacagugaaagaaaaua

SEQ ID NO: 671904 - RNA, 19 nt, Human
ugcuugucccuguggaagu

SEQ ID NO: 671905 - RNA, 15 nt, Human
gaauaaccaacaccc

SEQ ID NO: 671906 - RNA, 22 nt, Human
uuccccuuccuaauuccacagc

SEQ ID NO: 671907 - RNA, 11 nt, Human
acuuugaagag

SEQ ID NO: 671908 - RNA, 17 nt, Human
guuuaauucugaaagca

SEQ ID NO: 671909 - RNA, 17 nt, Human
aaagcuccauuuuuagu

SEQ ID NO: 671910 - RNA, 16 nt, Human
caaacugaaacaaaau

SEQ ID NO: 671911 - RNA, 16 nt, Human
agggaggacgcucucu

SEQ ID NO: 671912 - RNA, 24 nt, Human
ccagguaccuucucaccugugaga

SEQ ID NO: 671913 - RNA, 15 nt, Human
auuucauucaauauc

SEQ ID NO: 671914 - RNA, 18 nt, Human
ggggucagccagcccucu

SEQ ID NO: 671915 - RNA, 17 nt, Human
caggcuggcgugcagca

SEQ ID NO: 671916 - RNA, 19 nt, Human
cucaagcuaugugagcuca

SEQ ID NO: 671917 - RNA, 17 nt, Human
aggccaggcacaguggc

SEQ ID NO: 671918 - RNA, 13 nt, Human
ugcauuucuaaag

SEQ ID NO: 671919 - RNA, 12 nt, Human
uauucacaagac

SEQ ID NO: 671920 - RNA, 12 nt, Human
caaccugccagc

SEQ ID NO: 671921 - RNA, 18 nt, Human
aacaaugcuguauuuuaa

SEQ ID NO: 671922 - RNA, 22 nt, Human
aauaauccuaaacauaugaauu

SEQ ID NO: 671923 - RNA, 16 nt, Human
agugagacagcucugc

SEQ ID NO: 671924 - RNA, 15 nt, Human
gcuguauuuuaaaag

SEQ ID NO: 671925 - RNA, 18 nt, Human
ugagcucagcccuggugg

SEQ ID NO: 671926 - RNA, 15 nt, Human
cauuccaagccucau

SEQ ID NO: 671927 - RNA, 14 nt, Human
cuggccgggagccu

SEQ ID NO: 671928 - RNA, 19 nt, Human
gaaggagcucccaggaggg

SEQ ID NO: 671929 - RNA, 19 nt, Human
agauaccaugaugcugagc

SEQ ID NO: 671930 - RNA, 22 nt, Human
acccugaggugagcaucaucuu

SEQ ID NO: 671931 - RNA, 16 nt, Human
ggcuaauaucuuaucu

SEQ ID NO: 671932 - RNA, 20 nt, Human
acggacgaaccuugaaaacu

SEQ ID NO: 671933 - RNA, 19 nt, Human
agacagugaaagaaaauaa

SEQ ID NO: 671934 - RNA, 20 nt, Human
aguuguuucuacuacaugga

SEQ ID NO: 671935 - RNA, 15 nt, Human
cccugagguugugug

SEQ ID NO: 671936 - RNA, 15 nt, Human
agguguguugcagug

SEQ ID NO: 671937 - RNA, 14 nt, Human
uauguauauuuuau

SEQ ID NO: 671938 - RNA, 20 nt, Human
uagaugcaguucugaagaag

SEQ ID NO: 671939 - RNA, 19 nt, Human
aaaacuaggugcugcagcc

SEQ ID NO: 671940 - RNA, 16 nt, Human
cugcugagucccaggc

SEQ ID NO: 671941 - RNA, 21 nt, Human
ccucuguucugcacacagcac

SEQ ID NO: 671942 - RNA, 20 nt, Human
ccgaggugggcagaucacuu

SEQ ID NO: 671943 - RNA, 18 nt, Human
ccugcaaagcccagcuug

SEQ ID NO: 671944 - RNA, 12 nt, Human
auaaaauacaaa

SEQ ID NO: 671945 - RNA, 20 nt, Human
aaggagccaaacauccuaca

SEQ ID NO: 671946 - RNA, 15 nt, Human
gugaacuugguuuua

SEQ ID NO: 671947 - RNA, 15 nt, Human
ccaugugcagccacc

SEQ ID NO: 671948 - RNA, 18 nt, Human
uuauguuccuuuuaaaga

SEQ ID NO: 671949 - RNA, 20 nt, Human
uggaauaauccuaaacauau

SEQ ID NO: 671950 - RNA, 15 nt, Human
aggaacuggugucuu

SEQ ID NO: 671951 - RNA, 22 nt, Human
caaggaugccccgucccccucu

SEQ ID NO: 671952 - RNA, 15 nt, Human
uauaauuuaaauaua

SEQ ID NO: 671953 - RNA, 13 nt, Human
auuggacaguaaa

SEQ ID NO: 671954 - RNA, 19 nt, Human
uuuccugaaaacccuugcc

SEQ ID NO: 671955 - RNA, 15 nt, Human
aagccuccuuuuaaa

SEQ ID NO: 671956 - RNA, 22 nt, Human
gugccucaccccuugccauaau

SEQ ID NO: 671957 - RNA, 18 nt, Human
agucuucagcagagaagu

SEQ ID NO: 671958 - RNA, 14 nt, Human
acccugaggugagc

SEQ ID NO: 671959 - RNA, 20 nt, Human
aaagacagugaaagaaaaua

SEQ ID NO: 671960 - RNA, 22 nt, Human
uucugguagcuaaauauauauu

SEQ ID NO: 671961 - RNA, 12 nt, Human
cuuuaucuuuuu

SEQ ID NO: 671962 - RNA, 20 nt, Human
auucccagccagcacagccu

SEQ ID NO: 671963 - RNA, 14 nt, Human
caucaucuucuggg

SEQ ID NO: 671964 - RNA, 18 nt, Human
auuuuuagugaaauauua

SEQ ID NO: 671965 - RNA, 14 nt, Human
aucaccaaggcuga

SEQ ID NO: 671966 - RNA, 22 nt, Human
aaagacagugaaagaaaauaac

SEQ ID NO: 671967 - RNA, 18 nt, Human
uagaauauauuuccuuau

SEQ ID NO: 671968 - RNA, 14 nt, Human
ggcaauagucaaau

SEQ ID NO: 671969 - RNA, 14 nt, Human
acgagaaaacaaua

SEQ ID NO: 671970 - RNA, 19 nt, Human
agcuacuaauuuuaaaaug

SEQ ID NO: 671971 - RNA, 14 nt, Human
auuuccaagaaaua

SEQ ID NO: 671972 - RNA, 19 nt, Human
uugagaaggagcucccagg

SEQ ID NO: 671973 - RNA, 21 nt, Human
ugcccauccugccccugagcc

SEQ ID NO: 671974 - RNA, 21 nt, Human
gaaaaguauguuagugcaaau

SEQ ID NO: 671975 - RNA, 20 nt, Human
uggaacagauuucaaaaaaa

SEQ ID NO: 671976 - RNA, 14 nt, Human
gccauuacccccag

SEQ ID NO: 671977 - RNA, 19 nt, Human
guggauuuaauguggaaau

SEQ ID NO: 671978 - RNA, 16 nt, Human
gagcaucaucuucugg

SEQ ID NO: 671979 - RNA, 22 nt, Human
uuugcuguuauuuuaucugcua

SEQ ID NO: 671980 - RNA, 17 nt, Human
uguuggcuguuccugca

SEQ ID NO: 671981 - RNA, 23 nt, Human
uuguaacaagccuccuuuuaaag

SEQ ID NO: 671982 - RNA, 21 nt, Human
auaauuuuuauauuugaaaua

SEQ ID NO: 671983 - RNA, 13 nt, Human
aagcauuccaacu

SEQ ID NO: 671984 - RNA, 17 nt, Human
uacagaacuaaaaauua

SEQ ID NO: 671985 - RNA, 19 nt, Human
cccacuugccauaaaacuu

SEQ ID NO: 671986 - RNA, 18 nt, Human
ccuuccuaauuccacagc

SEQ ID NO: 671987 - RNA, 16 nt, Human
aaguaaaggcaaacuu

SEQ ID NO: 671988 - RNA, 15 nt, Human
cauuuacuuuuaaac

SEQ ID NO: 671989 - RNA, 16 nt, Human
uagaaagccaugugca

SEQ ID NO: 671990 - RNA, 18 nt, Human
ccaaccuucugaggagcu

SEQ ID NO: 671991 - RNA, 15 nt, Human
aauacuuuauaaagg

SEQ ID NO: 671992 - RNA, 16 nt, Human
ccagucccuccccaaa

SEQ ID NO: 671993 - RNA, 23 nt, Human
uagauaggucagugcaaauacuc

SEQ ID NO: 671994 - RNA, 15 nt, Human
uggacgagaaaacaa

SEQ ID NO: 671995 - RNA, 18 nt, Human
uaauaauguuucaaacau

SEQ ID NO: 671996 - RNA, 18 nt, Human
uuguacucugaaaguuuu

SEQ ID NO: 671997 - RNA, 15 nt, Human
auuugguaaggggaa

SEQ ID NO: 671998 - RNA, 21 nt, Human
ggagacauugaggcaggcacu

SEQ ID NO: 671999 - RNA, 14 nt, Human
caauugacuauagu

SEQ ID NO: 672000 - RNA, 15 nt, Human
cuucaacucccugcc

SEQ ID NO: 672001 - RNA, 15 nt, Human
aauagugaauaaagu

SEQ ID NO: 672002 - RNA, 14 nt, Human
ugagacucugucuc

SEQ ID NO: 672003 - RNA, 22 nt, Human
cucuggccuucggccuccaucc

SEQ ID NO: 672004 - RNA, 17 nt, Human
acauagugagacacugu

SEQ ID NO: 672005 - RNA, 17 nt, Human
ccuuggugccuggagcc

SEQ ID NO: 672006 - RNA, 22 nt, Human
aaaucaggguuaguauugucca

SEQ ID NO: 672007 - RNA, 19 nt, Human
acuuauuuguacauuuuuu

SEQ ID NO: 672008 - RNA, 13 nt, Human
uggacgagaaaac

SEQ ID NO: 672009 - RNA, 21 nt, Human
gagcaucuccucaacucugag

SEQ ID NO: 672010 - RNA, 20 nt, Human
acuccacuuggacaugggcc

SEQ ID NO: 672011 - RNA, 15 nt, Human
cugacucuuaagaag

SEQ ID NO: 672012 - RNA, 14 nt, Human
aaaagaaacauuug

SEQ ID NO: 672013 - RNA, 18 nt, Human
ugaaaaaguucugcagau

SEQ ID NO: 672014 - RNA, 17 nt, Human
caaagagaaagaggguu

SEQ ID NO: 672015 - RNA, 17 nt, Human
ccaccugcugagcccca

SEQ ID NO: 672016 - RNA, 13 nt, Human
cacuuugaagagu

SEQ ID NO: 672017 - RNA, 22 nt, Human
cccaugauguuuagaaacacaa

SEQ ID NO: 672018 - RNA, 12 nt, Human
ccagcuuugagg

SEQ ID NO: 672019 - RNA, 22 nt, Human
aggcugaugggcaaaaaaccaa

SEQ ID NO: 672020 - RNA, 17 nt, Human
uucucuaggaaauauuu

SEQ ID NO: 672021 - RNA, 20 nt, Human
cucuguucugcacacagcac

SEQ ID NO: 672022 - RNA, 21 nt, Human
cuaaauugacacuuaaaaaug

SEQ ID NO: 672023 - RNA, 17 nt, Human
gaacagauuucaaaaaa

SEQ ID NO: 672024 - RNA, 20 nt, Human
augcuucuguuuuauaauuu

SEQ ID NO: 672025 - RNA, 15 nt, Human
acaucaacagauaaa

SEQ ID NO: 672026 - RNA, 21 nt, Human
acacugucucuaccaaaaaaa

SEQ ID NO: 672027 - RNA, 21 nt, Human
ccugaucaccugcccugcuga

SEQ ID NO: 672028 - RNA, 17 nt, Human
cacauguuccccuuggg

SEQ ID NO: 672029 - RNA, 20 nt, Human
uuuccaaugacauuuuguug

SEQ ID NO: 672030 - RNA, 15 nt, Human
cagccccugggacca

SEQ ID NO: 672031 - RNA, 18 nt, Human
acaaggaaggaaagaugu

SEQ ID NO: 672032 - RNA, 17 nt, Human
gaaguauaggccaggca

SEQ ID NO: 672033 - RNA, 19 nt, Human
uuccucccuucucuucaca

SEQ ID NO: 672034 - RNA, 13 nt, Human
ugggaggcugaga

SEQ ID NO: 672035 - RNA, 16 nt, Human
acagagacagaaagca

SEQ ID NO: 672036 - RNA, 18 nt, Human
cagcuuauugucuaguga

SEQ ID NO: 672037 - RNA, 19 nt, Human
uucccuugaugaagaaguu

SEQ ID NO: 672038 - RNA, 21 nt, Human
uugaggaaaaugggcuuugga

SEQ ID NO: 672039 - RNA, 18 nt, Human
uaauuuuaacucuauaau

SEQ ID NO: 672040 - RNA, 15 nt, Human
aucuuuaacccacua

SEQ ID NO: 672041 - RNA, 23 nt, Human
gagaaaugagcacgcauggaaaa

SEQ ID NO: 672042 - RNA, 23 nt, Human
ggagcaucuccucaacucugagu

SEQ ID NO: 672043 - RNA, 21 nt, Human
cucaguccaugaagauguaga

SEQ ID NO: 672044 - RNA, 15 nt, Human
uggauuccucacuuu

SEQ ID NO: 672045 - RNA, 16 nt, Human
aaauaacaaugaaagu

SEQ ID NO: 672046 - RNA, 12 nt, Human
uugggcaggcag

SEQ ID NO: 672047 - RNA, 16 nt, Human
ccuggugggcagagag

SEQ ID NO: 672048 - RNA, 21 nt, Human
uagggugauauuaaccagggg

SEQ ID NO: 672049 - RNA, 16 nt, Human
guuggcuguuccugca

SEQ ID NO: 672050 - RNA, 19 nt, Human
gcucauggaauuggagcuc

SEQ ID NO: 672051 - RNA, 18 nt, Human
uguaaaggaauuuaaaaa

SEQ ID NO: 672052 - RNA, 22 nt, Human
guguccccuauccuacuucccc

SEQ ID NO: 672053 - RNA, 12 nt, Human
gcuaaggcagga

SEQ ID NO: 672054 - RNA, 14 nt, Human
cugagucccaggcu

SEQ ID NO: 672055 - RNA, 20 nt, Human
cucagcuucacccugaggug

SEQ ID NO: 672056 - RNA, 17 nt, Human
agaugggagaaucacuu

SEQ ID NO: 672057 - RNA, 19 nt, Human
ggaaaaaauaacaaugaaa

SEQ ID NO: 672058 - RNA, 18 nt, Human
auccccaagccuggcaag

SEQ ID NO: 672059 - RNA, 19 nt, Human
gaggcauccaaaggcuccu

SEQ ID NO: 672060 - RNA, 23 nt, Human
ugcauagguuuaauaauuuuuaa

SEQ ID NO: 672061 - RNA, 15 nt, Human
uauaaauaaaaauaa

SEQ ID NO: 672062 - RNA, 15 nt, Human
aauauaaauaaaaau

SEQ ID NO: 672063 - RNA, 21 nt, Human
cuauuuaauuauuucacuuua

SEQ ID NO: 672064 - RNA, 23 nt, Human
aauacacuguuaucuucacuuuu

SEQ ID NO: 672065 - RNA, 19 nt, Human
ugcuauugggguugggggg

SEQ ID NO: 672066 - RNA, 18 nt, Human
cccaggcugagccucagu

SEQ ID NO: 672067 - RNA, 16 nt, Human
uuucuauaauuuaaau

SEQ ID NO: 672068 - RNA, 21 nt, Human
aauucauucacucaacaaaca

SEQ ID NO: 672069 - RNA, 12 nt, Human
cuaccaaaaaaa

SEQ ID NO: 672070 - RNA, 16 nt, Human
caggcugagccucagu

SEQ ID NO: 672071 - RNA, 13 nt, Human
cuccacuggaaaa

SEQ ID NO: 672072 - RNA, 22 nt, Human
caaugcuguauuuuaaaagaau

SEQ ID NO: 672073 - RNA, 19 nt, Human
aguauuucuaugaaauauu

SEQ ID NO: 672074 - RNA, 13 nt, Human
gagcuaggggggu

SEQ ID NO: 672075 - RNA, 19 nt, Human
uaccuccaaggaccggccu

SEQ ID NO: 672076 - RNA, 21 nt, Human
aggcucuuuugggauuuuuga

SEQ ID NO: 672077 - RNA, 15 nt, Human
ugcuucuguuuuaua

SEQ ID NO: 672078 - RNA, 21 nt, Human
agcccuucuuuccacagaagc

SEQ ID NO: 672079 - RNA, 21 nt, Human
gcuggccaccugcugagcccc

SEQ ID NO: 672080 - RNA, 21 nt, Human
caaagcccagcuugaaaccuu

SEQ ID NO: 672081 - RNA, 18 nt, Human
cuacauaaaauacaaaaa

SEQ ID NO: 672082 - RNA, 14 nt, Human
uugcuggagcucug

SEQ ID NO: 672083 - RNA, 19 nt, Human
aacacaucaggaaagagag

SEQ ID NO: 672084 - RNA, 16 nt, Human
aagaaaggagauacag

SEQ ID NO: 672085 - RNA, 14 nt, Human
caacuauaaaacua

SEQ ID NO: 672086 - RNA, 13 nt, Human
ugccaaaauauaa

SEQ ID NO: 672087 - RNA, 23 nt, Human
ggcuaagcuucacuguaaaauaa

SEQ ID NO: 672088 - RNA, 18 nt, Human
gccuucggccuccauccu

SEQ ID NO: 672089 - RNA, 17 nt, Human
cucacaggagcaucucc

SEQ ID NO: 672090 - RNA, 19 nt, Human
cuaguaucaaaagaaagaa

SEQ ID NO: 672091 - RNA, 18 nt, Human
uauuuucaguuauuauau

SEQ ID NO: 672092 - RNA, 23 nt, Human
uccaaacugacucuuaagaagac

SEQ ID NO: 672093 - RNA, 13 nt, Human
caccaaggagcca

SEQ ID NO: 672094 - RNA, 13 nt, Human
cacacugaagaag

SEQ ID NO: 672095 - RNA, 17 nt, Human
uaaauuuaucauuuagu

SEQ ID NO: 672096 - RNA, 16 nt, Human
uuugcuguuauuuuau

SEQ ID NO: 672097 - RNA, 18 nt, Human
cagguaccuucucaccug

SEQ ID NO: 672098 - RNA, 16 nt, Human
acaucaggaaagagag

SEQ ID NO: 672099 - RNA, 14 nt, Human
aauuguauuacaaa

SEQ ID NO: 672100 - RNA, 20 nt, Human
ccacuuggacaugggcccca

SEQ ID NO: 672101 - RNA, 21 nt, Human
aagauauuaacugagaaggcu

SEQ ID NO: 672102 - RNA, 15 nt, Human
cuccucaacucugag

SEQ ID NO: 672103 - RNA, 13 nt, Human
gaugggcaaaaaa

SEQ ID NO: 672104 - RNA, 18 nt, Human
acugccuucucaacucca

SEQ ID NO: 672105 - RNA, 17 nt, Human
aguaaaaggaaaugcuc

SEQ ID NO: 672106 - RNA, 21 nt, Human
acaaagacaucgauugauaug

SEQ ID NO: 672107 - RNA, 16 nt, Human
accucugccucagaaa

SEQ ID NO: 672108 - RNA, 16 nt, Human
aagaaaauaacaauaa

SEQ ID NO: 672109 - RNA, 16 nt, Human
ugaaguccaagcauuu

SEQ ID NO: 672110 - RNA, 15 nt, Human
cugccagcuggccuu

SEQ ID NO: 672111 - RNA, 17 nt, Human
agaaucacuugaacccg

SEQ ID NO: 672112 - RNA, 19 nt, Human
ccuuagcccuuccccucug

SEQ ID NO: 672113 - RNA, 13 nt, Human
agagguccacaac

SEQ ID NO: 672114 - RNA, 17 nt, Human
ccccaguuguuucuacu

SEQ ID NO: 672115 - RNA, 20 nt, Human
auacugugugcuaaaacaag

SEQ ID NO: 672116 - RNA, 15 nt, Human
ugagaaggagcuccc

SEQ ID NO: 672117 - RNA, 12 nt, Human
auuuuaaaagaa

SEQ ID NO: 672118 - RNA, 17 nt, Human
uauuuauuaaguauuuu

SEQ ID NO: 672119 - RNA, 20 nt, Human
ggcuaauaucuuaucuuccu

SEQ ID NO: 672120 - RNA, 13 nt, Human
auaauuuuagaca

SEQ ID NO: 672121 - RNA, 15 nt, Human
uuagugaaauauuau

SEQ ID NO: 672122 - RNA, 20 nt, Human
cucuaccaaaaaaaggaagg

SEQ ID NO: 672123 - RNA, 14 nt, Human
ccucagcugccucc

SEQ ID NO: 672124 - RNA, 17 nt, Human
ugcauuuuggaaggcug

SEQ ID NO: 672125 - RNA, 19 nt, Human
gucuuucacauuuaaauaa

SEQ ID NO: 672126 - RNA, 22 nt, Human
uagaaauguauucuuuuaguuu

SEQ ID NO: 672127 - RNA, 15 nt, Human
cugcagauaaacagu

SEQ ID NO: 672128 - RNA, 13 nt, Human
caacauagugaga

SEQ ID NO: 672129 - RNA, 18 nt, Human
cuuccucugagccuuggg

SEQ ID NO: 672130 - RNA, 18 nt, Human
aucuggcucuggacaggc

SEQ ID NO: 672131 - RNA, 16 nt, Human
aaauauuauguuaaaa

SEQ ID NO: 672132 - RNA, 22 nt, Human
uguucugauauuggacaguaaa

SEQ ID NO: 672133 - RNA, 19 nt, Human
aaucuacacuccagugaga

SEQ ID NO: 672134 - RNA, 20 nt, Human
agaggagaaacuggaacucu

SEQ ID NO: 672135 - RNA, 19 nt, Human
cuguuauuuuaucugcuau

SEQ ID NO: 672136 - RNA, 13 nt, Human
uuuuaaaaaagaa

SEQ ID NO: 672137 - RNA, 15 nt, Human
aaaacaggcaaauuc

SEQ ID NO: 672138 - RNA, 16 nt, Human
ggggcuucugggcaga

SEQ ID NO: 672139 - RNA, 19 nt, Human
uccugugggaccugggcca

SEQ ID NO: 672140 - RNA, 15 nt, Human
gcaagcucuaucacc

SEQ ID NO: 672141 - RNA, 21 nt, Human
ucuggguugaagggcaguguu

SEQ ID NO: 672142 - RNA, 15 nt, Human
aaaagacaaggaaaa

SEQ ID NO: 672143 - RNA, 20 nt, Human
uuucuucaacucccugcccc

SEQ ID NO: 672144 - RNA, 13 nt, Human
acaauaaaagaca

SEQ ID NO: 672145 - RNA, 16 nt, Human
aauauaaauaaaaaua

SEQ ID NO: 672146 - RNA, 19 nt, Human
gaggcagagguugcaguga

SEQ ID NO: 672147 - RNA, 22 nt, Human
agaucacuugagcucaggaggu

SEQ ID NO: 672148 - RNA, 22 nt, Human
auauaaauaaaaauaauccuca

SEQ ID NO: 672149 - RNA, 15 nt, Human
aaaugauguuucaua

SEQ ID NO: 672150 - RNA, 17 nt, Human
cuauccuacuuccccuu

SEQ ID NO: 672151 - RNA, 18 nt, Human
uauauuuccuuauucaga

SEQ ID NO: 672152 - RNA, 15 nt, Human
aggguuuggaagcca

SEQ ID NO: 672153 - RNA, 23 nt, Human
ugaauuauguuugcauguucacu

SEQ ID NO: 672154 - RNA, 17 nt, Human
ggcucuggacaggcacu

SEQ ID NO: 672155 - RNA, 17 nt, Human
gucaaaguucauagagu

SEQ ID NO: 672156 - RNA, 15 nt, Human
cauguccacugguuc

SEQ ID NO: 672157 - RNA, 12 nt, Human
cagccccuggga

SEQ ID NO: 672158 - RNA, 14 nt, Human
ggagcaucuccuca

SEQ ID NO: 672159 - RNA, 20 nt, Human
agggcagaugaugcuuugag

SEQ ID NO: 672160 - RNA, 17 nt, Human
guauuauuuuuuaaaaa

SEQ ID NO: 672161 - RNA, 22 nt, Human
cagcucuaucccaaccucuccc

SEQ ID NO: 672162 - RNA, 19 nt, Human
cucuugaggcacagaaacu

SEQ ID NO: 672163 - RNA, 19 nt, Human
cuuggacaugggccccaga

SEQ ID NO: 672164 - RNA, 22 nt, Human
caagcacuaaacaaagagugaa

SEQ ID NO: 672165 - RNA, 13 nt, Human
aaaugggaaacaa

SEQ ID NO: 672166 - RNA, 14 nt, Human
aauaguuuaugauu

SEQ ID NO: 672167 - RNA, 15 nt, Human
auaggaaauauuuua

SEQ ID NO: 672168 - RNA, 17 nt, Human
gacucaccucccccauc

SEQ ID NO: 672169 - RNA, 11 nt, Human
cugacaaagac

SEQ ID NO: 672170 - RNA, 22 nt, Human
uaaaguugauuuaaggccaggc

SEQ ID NO: 672171 - RNA, 22 nt, Human
ugauugugggauacuauuuaau

SEQ ID NO: 672172 - RNA, 17 nt, Human
gugccuguaaucacagc

SEQ ID NO: 672173 - RNA, 17 nt, Human
ggcacaacacaucagga

SEQ ID NO: 672174 - RNA, 16 nt, Human
auccuacaagacacag

SEQ ID NO: 672175 - RNA, 13 nt, Human
uuaaauuguaaua

SEQ ID NO: 672176 - RNA, 20 nt, Human
auaacaaugcuguauuuuaa

SEQ ID NO: 672177 - RNA, 19 nt, Human
guauucuuuuaguuuuuaa

SEQ ID NO: 672178 - RNA, 16 nt, Human
uugucaauaaaaucca

SEQ ID NO: 672179 - RNA, 18 nt, Human
aagaccucauuuugaagg

SEQ ID NO: 672180 - RNA, 15 nt, Human
guuauaaaaauauau

SEQ ID NO: 672181 - RNA, 14 nt, Human
cugaaagucccaga

SEQ ID NO: 672182 - RNA, 18 nt, Human
agcagugccaaaauauaa

SEQ ID NO: 672183 - RNA, 19 nt, Human
gagacauugaggcaggcac

SEQ ID NO: 672184 - RNA, 17 nt, Human
cauauuuauagccaggu

SEQ ID NO: 672185 - RNA, 19 nt, Human
ccuccagggagucucagcu

SEQ ID NO: 672186 - RNA, 14 nt, Human
caaggcuagaacca

SEQ ID NO: 672187 - RNA, 22 nt, Human
caagcucuaucaccaaggagcc

SEQ ID NO: 672188 - RNA, 16 nt, Human
uuuucucuaggaaaua

SEQ ID NO: 672189 - RNA, 18 nt, Human
aaauauuuauuuuaauaa

SEQ ID NO: 672190 - RNA, 16 nt, Human
gaugggcaaaaaacca

SEQ ID NO: 672191 - RNA, 21 nt, Human
cagugagacagcucugcauac

SEQ ID NO: 672192 - RNA, 15 nt, Human
ccaaggagccaaaca

SEQ ID NO: 672193 - RNA, 20 nt, Human
cugcacuccagccugagcga

SEQ ID NO: 672194 - RNA, 16 nt, Human
aguuuauauagaaaug

SEQ ID NO: 672195 - RNA, 11 nt, Human
cuauuuaauua

SEQ ID NO: 672196 - RNA, 22 nt, Human
caugucuagagaacacugugcu

SEQ ID NO: 672197 - RNA, 17 nt, Human
cuacacuccagugagac

SEQ ID NO: 672198 - RNA, 18 nt, Human
ccaaccuggaguugaaaa

SEQ ID NO: 672199 - RNA, 15 nt, Human
uuuagugaaauauua

SEQ ID NO: 672200 - RNA, 16 nt, Human
uacauuuguauaaaau

SEQ ID NO: 672201 - RNA, 20 nt, Human
ccaaccucucccaacuauaa

SEQ ID NO: 672202 - RNA, 17 nt, Human
ccugugggaccugggcc

SEQ ID NO: 672203 - RNA, 17 nt, Human
aaacauccuacaagaca

SEQ ID NO: 672204 - RNA, 22 nt, Human
cagugagccaaauguaaaauag

SEQ ID NO: 672205 - RNA, 19 nt, Human
auuagaaauguaauuaugu

SEQ ID NO: 672206 - RNA, 23 nt, Human
gacacauaucaaacugaaacaaa

SEQ ID NO: 672207 - RNA, 14 nt, Human
auuuauguuuaauu

SEQ ID NO: 672208 - RNA, 21 nt, Human
acacaucaggaaagagagcac

SEQ ID NO: 672209 - RNA, 22 nt, Human
ccauacuaauuauacccccugc

SEQ ID NO: 672210 - RNA, 14 nt, Human
aaauaggaaauauu

SEQ ID NO: 672211 - RNA, 23 nt, Human
aggcugaggcaggaggaucacuu

SEQ ID NO: 672212 - RNA, 15 nt, Human
cugaaagaggaauga

SEQ ID NO: 672213 - RNA, 14 nt, Human
cauagaaguaaaaa

SEQ ID NO: 672214 - RNA, 16 nt, Human
guuuuuuuuuaaaaaa

SEQ ID NO: 672215 - RNA, 17 nt, Human
ugcccauaccccuggcc

SEQ ID NO: 672216 - RNA, 16 nt, Human
cagggcucacagaauu

SEQ ID NO: 672217 - RNA, 16 nt, Human
ccuacaugagguacug

SEQ ID NO: 672218 - RNA, 20 nt, Human
aaaugauguuucauaagaau

SEQ ID NO: 672219 - RNA, 13 nt, Human
aacuauaaaacua

SEQ ID NO: 672220 - RNA, 20 nt, Human
ggagccugaucaccugcccu

SEQ ID NO: 672221 - RNA, 19 nt, Human
cuggcucuggacaggcacu

SEQ ID NO: 672222 - RNA, 20 nt, Human
agccuuuuuuugaaaaaaag

SEQ ID NO: 672223 - RNA, 18 nt, Human
ugccauguggcagaucua

SEQ ID NO: 672224 - RNA, 21 nt, Human
uugaggcacagaaacuccugu

SEQ ID NO: 672225 - RNA, 21 nt, Human
ggaaagaauaaccaacacccu

SEQ ID NO: 672226 - RNA, 19 nt, Human
aguugauuuaaggccaggc

SEQ ID NO: 672227 - RNA, 19 nt, Human
auucccagccagcacagcc

SEQ ID NO: 672228 - RNA, 17 nt, Human
agcucccaggaggggcu

SEQ ID NO: 672229 - RNA, 17 nt, Human
gcccuuccccucugcag

SEQ ID NO: 672230 - RNA, 16 nt, Human
cuucaacucccugccc

SEQ ID NO: 672231 - RNA, 15 nt, Human
uuauauuucuguuaa

SEQ ID NO: 672232 - RNA, 15 nt, Human
guucugcagauaaac

SEQ ID NO: 672233 - RNA, 14 nt, Human
ucagucucccuccc

SEQ ID NO: 672234 - RNA, 14 nt, Human
uaguaucaaaagaa

SEQ ID NO: 672235 - RNA, 12 nt, Human
cuacaagacaca

SEQ ID NO: 672236 - RNA, 17 nt, Human
agcuucacuguaaaaua

SEQ ID NO: 672237 - RNA, 14 nt, Human
gaaggugaucuggc

SEQ ID NO: 672238 - RNA, 16 nt, Human
cugagcauuuaauaug

SEQ ID NO: 672239 - RNA, 17 nt, Human
ccagaucaagccugccu

SEQ ID NO: 672240 - RNA, 13 nt, Human
ugagcggaccuuc

SEQ ID NO: 672241 - RNA, 16 nt, Human
acuaggugcugcagcc

SEQ ID NO: 672242 - RNA, 17 nt, Human
ugaaauauuauuuuaua

SEQ ID NO: 672243 - RNA, 13 nt, Human
aggagcucccagg

SEQ ID NO: 672244 - RNA, 23 nt, Human
ugcagagguccacaacacacaga

SEQ ID NO: 672245 - RNA, 18 nt, Human
uuccuaauaaagcuucug

SEQ ID NO: 672246 - RNA, 19 nt, Human
cucugcaagaagaaaucau

SEQ ID NO: 672247 - RNA, 20 nt, Human
ucgugucuggcguugugggg

SEQ ID NO: 672248 - RNA, 20 nt, Human
ugguuguauuauuuuuuaaa

SEQ ID NO: 672249 - RNA, 12 nt, Human
ucuauguagaau

SEQ ID NO: 672250 - RNA, 22 nt, Human
ucugguagcuaaauauauauuu

SEQ ID NO: 672251 - RNA, 16 nt, Human
acuguauguccuuggu

SEQ ID NO: 672252 - RNA, 12 nt, Human
cuguuaaaauau

SEQ ID NO: 672253 - RNA, 18 nt, Human
uuacaaaugggaaacaaa

SEQ ID NO: 672254 - RNA, 14 nt, Human
guaacugauuugua

SEQ ID NO: 672255 - RNA, 14 nt, Human
cugaggcuccacuu

SEQ ID NO: 672256 - RNA, 17 nt, Human
ggccaugggacagggag

SEQ ID NO: 672257 - RNA, 15 nt, Human
aagaaggaaagauuu

SEQ ID NO: 672258 - RNA, 17 nt, Human
agauacaguggagacau

SEQ ID NO: 672259 - RNA, 15 nt, Human
cugggaccaggcacc

SEQ ID NO: 672260 - RNA, 16 nt, Human
caugguuuagaaagcu

SEQ ID NO: 672261 - RNA, 21 nt, Human
cuccacuuggacaugggcccc

SEQ ID NO: 672262 - RNA, 18 nt, Human
cagccucuuagaugcagu

SEQ ID NO: 672263 - RNA, 16 nt, Human
augccccgucccccuc

SEQ ID NO: 672264 - RNA, 23 nt, Human
uggcuugaguuuaaauuguaaua

SEQ ID NO: 672265 - RNA, 23 nt, Human
uaauuuguaguguuggagaagaa

SEQ ID NO: 672266 - RNA, 18 nt, Human
aggaaaaaauaacaauga

SEQ ID NO: 672267 - RNA, 13 nt, Human
ugauuauauguca

SEQ ID NO: 672268 - RNA, 14 nt, Human
uaaagaaacaaaaa

SEQ ID NO: 672269 - RNA, 13 nt, Human
uacuuuauuuucu

SEQ ID NO: 672270 - RNA, 14 nt, Human
ucccuugaugaaga

SEQ ID NO: 672271 - RNA, 14 nt, Human
uaaaagacaaggaa

SEQ ID NO: 672272 - RNA, 21 nt, Human
uccagccuucucucaaggaga

SEQ ID NO: 672273 - RNA, 12 nt, Human
aagaaaauaacg

SEQ ID NO: 672274 - RNA, 15 nt, Human
ucauaauaaguugca

SEQ ID NO: 672275 - RNA, 12 nt, Human
ugagagacacac

SEQ ID NO: 672276 - RNA, 15 nt, Human
ucuaugaaauauuau

SEQ ID NO: 672277 - RNA, 14 nt, Human
aggaaagaugugaa

SEQ ID NO: 672278 - RNA, 15 nt, Human
cuacuaauuuuaaaa

SEQ ID NO: 672279 - RNA, 12 nt, Human
uacuauuuaauu

SEQ ID NO: 672280 - RNA, 19 nt, Human
uccacauccugugggaccu

SEQ ID NO: 672281 - RNA, 22 nt, Human
auauuuuagauagaugaagaag

SEQ ID NO: 672282 - RNA, 17 nt, Human
uaaaagacagugaaaga

SEQ ID NO: 672283 - RNA, 19 nt, Human
gcacuaguauuucuaugaa

SEQ ID NO: 672284 - RNA, 16 nt, Human
cuaaaaauuaaaaccu

SEQ ID NO: 672285 - RNA, 22 nt, Human
uucaauaucuuuuuuuuaauaa

SEQ ID NO: 672286 - RNA, 18 nt, Human
cuguuuucccuccuugga

SEQ ID NO: 672287 - RNA, 10 nt, Human
aauaaaacuu

SEQ ID NO: 672288 - RNA, 19 nt, Human
cccauggcacucuauguuc

SEQ ID NO: 672289 - RNA, 17 nt, Human
auaaaguacaagagcuu

SEQ ID NO: 672290 - RNA, 14 nt, Human
ucugggcagacucu

SEQ ID NO: 672291 - RNA, 14 nt, Human
ucaagccugccuca

SEQ ID NO: 672292 - RNA, 15 nt, Human
aauuuaucauuuagu

SEQ ID NO: 672293 - RNA, 15 nt, Human
uugcucauggaauug

SEQ ID NO: 672294 - RNA, 22 nt, Human
uggagacauugaggcaggcacu

SEQ ID NO: 672295 - RNA, 13 nt, Human
uuuaaaaaagaaa

SEQ ID NO: 672296 - RNA, 19 nt, Human
acccccagcuuugaggaaa

SEQ ID NO: 672297 - RNA, 18 nt, Human
ugcauagguuuaauaauu

SEQ ID NO: 672298 - RNA, 13 nt, Human
ccugccccccagc

SEQ ID NO: 672299 - RNA, 12 nt, Human
guauaggccagg

SEQ ID NO: 672300 - RNA, 18 nt, Human
guuaguauuguccagguc

SEQ ID NO: 672301 - RNA, 15 nt, Human
ucucagaaggaaaga

SEQ ID NO: 672302 - RNA, 15 nt, Human
ccaugaugcugagcc

SEQ ID NO: 672303 - RNA, 18 nt, Human
ucuauguagaauauauuu

SEQ ID NO: 672304 - RNA, 17 nt, Human
uuccaagccucaugucc

SEQ ID NO: 672305 - RNA, 14 nt, Human
acuuugauuuuaua

SEQ ID NO: 672306 - RNA, 11 nt, Human
ucaccuccccc

SEQ ID NO: 672307 - RNA, 14 nt, Human
aaauaaauaaauaa

SEQ ID NO: 672308 - RNA, 14 nt, Human
ugaucaccugcccu

SEQ ID NO: 672309 - RNA, 20 nt, Human
ccucaagcuaugugagcuca

SEQ ID NO: 672310 - RNA, 18 nt, Human
agcugcucaauaaaguac

SEQ ID NO: 672311 - RNA, 14 nt, Human
auccaaugaaauga

SEQ ID NO: 672312 - RNA, 19 nt, Human
ggagcuggaaacacauguu

SEQ ID NO: 672313 - RNA, 15 nt, Human
guguugcagugucug

SEQ ID NO: 672314 - RNA, 13 nt, Human
aucuacacuccag

SEQ ID NO: 672315 - RNA, 14 nt, Human
gcguugagccacca

SEQ ID NO: 672316 - RNA, 22 nt, Human
aauuuaaaaaaaaaccugagcc

SEQ ID NO: 672317 - RNA, 15 nt, Human
uucacuguaaaauaa

SEQ ID NO: 672318 - RNA, 22 nt, Human
uucuacuggcugccagaaucua

SEQ ID NO: 672319 - RNA, 15 nt, Human
ugggacagggaggac

SEQ ID NO: 672320 - RNA, 15 nt, Human
ugucaauaaaaucca

SEQ ID NO: 672321 - RNA, 15 nt, Human
ucucaauaaauaaau

SEQ ID NO: 672322 - RNA, 22 nt, Human
uaagaauucuguugauggaaau

SEQ ID NO: 672323 - RNA, 12 nt, Human
aguguuugaaag

SEQ ID NO: 672324 - RNA, 20 nt, Human
cuuauucacaagacccaaaa

SEQ ID NO: 672325 - RNA, 11 nt, Human
agaauauauuu

SEQ ID NO: 672326 - RNA, 16 nt, Human
uagaaaacaggcaaau

SEQ ID NO: 672327 - RNA, 20 nt, Human
gagcaucaucuucuggguua

SEQ ID NO: 672328 - RNA, 21 nt, Human
caaggaaaaaauaacaaugaa

SEQ ID NO: 672329 - RNA, 15 nt, Human
gcccacuagacccac

SEQ ID NO: 672330 - RNA, 19 nt, Human
uucuuuaucuuuuuaguau

SEQ ID NO: 672331 - RNA, 19 nt, Human
cuuuuaaagaaacaaaaau

SEQ ID NO: 672332 - RNA, 12 nt, Human
uaauuccacagc

SEQ ID NO: 672333 - RNA, 15 nt, Human
ggcaagcucuaucac

SEQ ID NO: 672334 - RNA, 22 nt, Human
caggauuagauaaggcuguucu

SEQ ID NO: 672335 - RNA, 18 nt, Human
ccuucggccuccauccug

SEQ ID NO: 672336 - RNA, 19 nt, Human
uuguggggaugaacuuuuu

SEQ ID NO: 672337 - RNA, 14 nt, Human
ucuucagaaaaccu

SEQ ID NO: 672338 - RNA, 19 nt, Human
gguuccuuccucugagccu

SEQ ID NO: 672339 - RNA, 21 nt, Human
cgacagugagacucugucuca

SEQ ID NO: 672340 - RNA, 21 nt, Human
cugagcccggaaacuccacau

SEQ ID NO: 672341 - RNA, 15 nt, Human
gucucuacauaaaau

SEQ ID NO: 672342 - RNA, 13 nt, Human
cugaagcuguguc

SEQ ID NO: 672343 - RNA, 15 nt, Human
aaaaaauaacaauga

SEQ ID NO: 672344 - RNA, 18 nt, Human
uuguaaaggaauuuaaaa

SEQ ID NO: 672345 - RNA, 15 nt, Human
gauccugcaauucca

SEQ ID NO: 672346 - RNA, 17 nt, Human
uucacuguaaaauaaua

SEQ ID NO: 672347 - RNA, 13 nt, Human
aauaucucuucuc

SEQ ID NO: 672348 - RNA, 17 nt, Human
guugauuuaaggccagg

SEQ ID NO: 672349 - RNA, 17 nt, Human
cugagcgacagugagac

SEQ ID NO: 672350 - RNA, 16 nt, Human
cugagcgacagugaga

SEQ ID NO: 672351 - RNA, 14 nt, Human
auugaggcaggcac

SEQ ID NO: 672352 - RNA, 18 nt, Human
ucaagggugugugcagca

SEQ ID NO: 672353 - RNA, 14 nt, Human
auuauuuuuuaaaa

SEQ ID NO: 672354 - RNA, 14 nt, Human
uauaauuuaaaaua

SEQ ID NO: 672355 - RNA, 19 nt, Human
gcacacagcacgggggcca

SEQ ID NO: 672356 - RNA, 22 nt, Human
cacuuggacaugggccccagau

SEQ ID NO: 672357 - RNA, 12 nt, Human
agcuuucuuccu

SEQ ID NO: 672358 - RNA, 14 nt, Human
aagcugaguguuuc

SEQ ID NO: 672359 - RNA, 21 nt, Human
cauuuucuucucacauuuaua

SEQ ID NO: 672360 - RNA, 16 nt, Human
uaaauaaaaauaaucc

SEQ ID NO: 672361 - RNA, 14 nt, Human
aauuagaaauguaa

SEQ ID NO: 672362 - RNA, 16 nt, Human
agcuaaauauauauuu

SEQ ID NO: 672363 - RNA, 16 nt, Human
ucucuaggaaauauuu

SEQ ID NO: 672364 - RNA, 14 nt, Human
uauauuuccuuauu

SEQ ID NO: 672365 - RNA, 16 nt, Human
aaaugggaaacaaaag

SEQ ID NO: 672366 - RNA, 15 nt, Human
uggacucaccucccc

SEQ ID NO: 672367 - RNA, 13 nt, Human
cacuguaaaauaa

SEQ ID NO: 672368 - RNA, 14 nt, Human
caaggaaggaaaga

SEQ ID NO: 672369 - RNA, 20 nt, Human
uauaugcuaagucuuauaua

SEQ ID NO: 672370 - RNA, 13 nt, Human
cuauuauauuucc

SEQ ID NO: 672371 - RNA, 14 nt, Human
acuuggucugugag

SEQ ID NO: 672372 - RNA, 21 nt, Human
gauaaaagacagugaaagaaa

SEQ ID NO: 672373 - RNA, 15 nt, Human
cagugaaagaaaaua

SEQ ID NO: 672374 - RNA, 18 nt, Human
agcugccuccccagcucu

SEQ ID NO: 672375 - RNA, 14 nt, Human
cacuuggacauggg

SEQ ID NO: 672376 - RNA, 15 nt, Human
uggcuaauuagcaug

SEQ ID NO: 672377 - RNA, 19 nt, Human
aacugaaacaaaauuagaa

SEQ ID NO: 672378 - RNA, 21 nt, Human
caacacacagauuugagcuca

SEQ ID NO: 672379 - RNA, 20 nt, Human
aaggaugccccgucccccuc

SEQ ID NO: 672380 - RNA, 16 nt, Human
augcuguauuuuaaaa

SEQ ID NO: 672381 - RNA, 21 nt, Human
guccccuauccuacuuccccu

SEQ ID NO: 672382 - RNA, 14 nt, Human
auuguccaggucua

SEQ ID NO: 672383 - RNA, 17 nt, Human
ccucuggcuccagcugg

SEQ ID NO: 672384 - RNA, 24 nt, Human
cauaugaaaaggcuaagcuucacu

SEQ ID NO: 672385 - RNA, 20 nt, Human
acuucuuaggguuaugauua

SEQ ID NO: 672386 - RNA, 16 nt, Human
caucugaugagaacaa

SEQ ID NO: 672387 - RNA, 15 nt, Human
gggucagccagcccu

SEQ ID NO: 672388 - RNA, 19 nt, Human
cucugccucagaaaacaag

SEQ ID NO: 672389 - RNA, 13 nt, Human
accaacacccuga

SEQ ID NO: 672390 - RNA, 23 nt, Human
aggcacccccagaaugaccuggc

SEQ ID NO: 672391 - RNA, 18 nt, Human
auugagaaggagcuccca

SEQ ID NO: 672392 - RNA, 20 nt, Human
ccauacuaauuauacccccu

SEQ ID NO: 672393 - RNA, 13 nt, Human
aguguuugaaagc

SEQ ID NO: 672394 - RNA, 14 nt, Human
uggcuugaguuuaa

SEQ ID NO: 672395 - RNA, 22 nt, Human
ccacuuggacaugggccccaga

SEQ ID NO: 672396 - RNA, 23 nt, Human
caggcacaguggcucacaccugu

SEQ ID NO: 672397 - RNA, 16 nt, Human
aaagacaaggaaaaaa

SEQ ID NO: 672398 - RNA, 16 nt, Human
ggccuccauccugagg

SEQ ID NO: 672399 - RNA, 19 nt, Human
cacaggaaccacaagacug

SEQ ID NO: 672400 - RNA, 16 nt, Human
aaaauccauacauuug

SEQ ID NO: 672401 - RNA, 15 nt, Human
aagaagugaaaaucu

SEQ ID NO: 672402 - RNA, 21 nt, Human
aaagcugaaauggacuuuugu

SEQ ID NO: 672403 - RNA, 15 nt, Human
uguauuuuaaaagaa

SEQ ID NO: 672404 - RNA, 15 nt, Human
cccugcaaagcccag

SEQ ID NO: 672405 - RNA, 21 nt, Human
ccuuccccucugcagcuucca

SEQ ID NO: 672406 - RNA, 21 nt, Human
uagaugagagaacagggcuga

SEQ ID NO: 672407 - RNA, 17 nt, Human
caaauccaaugaaauga

SEQ ID NO: 672408 - RNA, 18 nt, Human
ccugagcggaccuuccca

SEQ ID NO: 672409 - RNA, 16 nt, Human
acuaaacaaagaguga

SEQ ID NO: 672410 - RNA, 14 nt, Human
auauauuuuagaua

SEQ ID NO: 672411 - RNA, 19 nt, Human
cuagaguuuagcuggaaaa

SEQ ID NO: 672412 - RNA, 21 nt, Human
uaauaggcguaacuaauuuua

SEQ ID NO: 672413 - RNA, 18 nt, Human
cauguuccccuugggggu

SEQ ID NO: 672414 - RNA, 12 nt, Human
aaaugaaagcag

SEQ ID NO: 672415 - RNA, 19 nt, Human
cccuuccccucugcagcuu

SEQ ID NO: 672416 - RNA, 18 nt, Human
uaggugacuauuauauuu

SEQ ID NO: 672417 - RNA, 21 nt, Human
cucuugaaguauauauaucau

SEQ ID NO: 672418 - RNA, 18 nt, Human
gaaacaaaaggauaauga

SEQ ID NO: 672419 - RNA, 21 nt, Human
aauaggcugaugggcaaaaaa

SEQ ID NO: 672420 - RNA, 14 nt, Human
uaaggauucugaga

SEQ ID NO: 672421 - RNA, 21 nt, Human
cucuaucccaaccucucccaa

SEQ ID NO: 672422 - RNA, 19 nt, Human
aaggaaguauaggccaggc

SEQ ID NO: 672423 - RNA, 16 nt, Human
uaaugaauacuuuaua

SEQ ID NO: 672424 - RNA, 19 nt, Human
uaucuauguagaauauauu

SEQ ID NO: 672425 - RNA, 16 nt, Human
gaaaaaauaacaauga

SEQ ID NO: 672426 - RNA, 22 nt, Human
cagacacaugugcuggccaccu

SEQ ID NO: 672427 - RNA, 21 nt, Human
agggcagaugaugcuuugaga

SEQ ID NO: 672428 - RNA, 13 nt, Human
gauuguaaaaugg

SEQ ID NO: 672429 - RNA, 22 nt, Human
aacucccugccccccagcccuc

SEQ ID NO: 672430 - RNA, 19 nt, Human
ccccuauccuacuuccccu

SEQ ID NO: 672431 - RNA, 15 nt, Human
acauccuacaagaca

SEQ ID NO: 672432 - RNA, 13 nt, Human
ccaaaagguauuu

SEQ ID NO: 672433 - RNA, 18 nt, Human
augagcacgcauggaaaa

SEQ ID NO: 672434 - RNA, 16 nt, Human
guuccuuccucugagc

SEQ ID NO: 672435 - RNA, 11 nt, Human
cgauaaaagac

SEQ ID NO: 672436 - RNA, 14 nt, Human
uccacaacacacag

SEQ ID NO: 672437 - RNA, 15 nt, Human
auaucuuaucuuccu

SEQ ID NO: 672438 - RNA, 15 nt, Human
uagaauauauuuccu

SEQ ID NO: 672439 - RNA, 18 nt, Human
uuuauguuuaauucugaa

SEQ ID NO: 672440 - RNA, 13 nt, Human
cccuccuuaucaa

SEQ ID NO: 672441 - RNA, 14 nt, Human
acccgggaggcaga

SEQ ID NO: 672442 - RNA, 14 nt, Human
uguauucuuuuagu

SEQ ID NO: 672443 - RNA, 14 nt, Human
cagugaaagaaaau

SEQ ID NO: 672444 - RNA, 14 nt, Human
aguuuuuuuuuaaa

SEQ ID NO: 672445 - RNA, 17 nt, Human
auaaguacaugauaagc

SEQ ID NO: 672446 - RNA, 18 nt, Human
ucugcaagaagaaaucau

SEQ ID NO: 672447 - RNA, 14 nt, Human
cccugccccccagc

SEQ ID NO: 672448 - RNA, 18 nt, Human
ucuucaacucccugcccc

SEQ ID NO: 672449 - RNA, 16 nt, Human
aacaauuugaauauaa

SEQ ID NO: 672450 - RNA, 18 nt, Human
ucucagguguguugcagu

SEQ ID NO: 672451 - RNA, 19 nt, Human
cugcaaagcccagcuugaa

SEQ ID NO: 672452 - RNA, 23 nt, Human
cucuugaggcacagaaacuccug

SEQ ID NO: 672453 - RNA, 21 nt, Human
auuuuccugaaaacccuugcc

SEQ ID NO: 672454 - RNA, 21 nt, Human
gucucagugucaaugcagccc

SEQ ID NO: 672455 - RNA, 13 nt, Human
aaggaaggaaaga

SEQ ID NO: 672456 - RNA, 19 nt, Human
accuccuaagaaggcaccu

SEQ ID NO: 672457 - RNA, 22 nt, Human
uuagauaaggcuguucuuuaaa

SEQ ID NO: 672458 - RNA, 21 nt, Human
aaauaauuuuuauauuugaaa

SEQ ID NO: 672459 - RNA, 13 nt, Human
cuuaucaaaggac

SEQ ID NO: 672460 - RNA, 13 nt, Human
cuuuccaugaguu

SEQ ID NO: 672461 - RNA, 17 nt, Human
ucuauguagaauauauu

SEQ ID NO: 672462 - RNA, 11 nt, Human
gcuacagugag

SEQ ID NO: 672463 - RNA, 13 nt, Human
ucacuguaaaaua

SEQ ID NO: 672464 - RNA, 19 nt, Human
uguuaucuucacuuuuaua

SEQ ID NO: 672465 - RNA, 20 nt, Human
aauucugguagcuaaauaua

SEQ ID NO: 672466 - RNA, 15 nt, Human
cugaggcaggaggau

SEQ ID NO: 672467 - RNA, 13 nt, Human
gccacaagaaccc

SEQ ID NO: 672468 - RNA, 15 nt, Human
uccacaaguaaaagg

SEQ ID NO: 672469 - RNA, 16 nt, Human
agcggaccuucccagc

SEQ ID NO: 672470 - RNA, 22 nt, Human
agaagcaccaaucaugaauuag

SEQ ID NO: 672471 - RNA, 18 nt, Human
gacccacuggacucaccu

SEQ ID NO: 672472 - RNA, 15 nt, Human
gcaacccaaauguuc

SEQ ID NO: 672473 - RNA, 15 nt, Human
cuggacucaccuccc

SEQ ID NO: 672474 - RNA, 23 nt, Human
caauaacgauaaaagacagugaa

SEQ ID NO: 672475 - RNA, 13 nt, Human
agaaaugaaagca

SEQ ID NO: 672476 - RNA, 16 nt, Human
cagcuuuccucaaaac

SEQ ID NO: 672477 - RNA, 18 nt, Human
aauaaaacuuuuccaaug

SEQ ID NO: 672478 - RNA, 17 nt, Human
aaccuagggugauauua

SEQ ID NO: 672479 - RNA, 22 nt, Human
acaccuuguacuuuauuuucua

SEQ ID NO: 672480 - RNA, 15 nt, Human
cuggguuccuuccuc

SEQ ID NO: 672481 - RNA, 22 nt, Human
uuuuauagcuacuaauuuuaaa

SEQ ID NO: 672482 - RNA, 12 nt, Human
acaugagguacu

SEQ ID NO: 672483 - RNA, 19 nt, Human
ugaucaccugcccugcuga

SEQ ID NO: 672484 - RNA, 15 nt, Human
cuggaaacacauguu

SEQ ID NO: 672485 - RNA, 19 nt, Human
uggggcuuuaacuccugcu

SEQ ID NO: 672486 - RNA, 19 nt, Human
caaagugucuugaauugua

SEQ ID NO: 672487 - RNA, 12 nt, Human
aauaauuuuuaa

SEQ ID NO: 672488 - RNA, 17 nt, Human
gucucagcuucacccug

SEQ ID NO: 672489 - RNA, 16 nt, Human
guccgaggugggcaga

SEQ ID NO: 672490 - RNA, 20 nt, Human
gcauuguuggcuguuccugc

SEQ ID NO: 672491 - RNA, 19 nt, Human
ccaggcacccccagaauga

SEQ ID NO: 672492 - RNA, 17 nt, Human
gaaacaaaaaucaaacu

SEQ ID NO: 672493 - RNA, 14 nt, Human
aaaaaaggaaggaa

SEQ ID NO: 672494 - RNA, 17 nt, Human
uucugagcauuuaauau

SEQ ID NO: 672495 - RNA, 14 nt, Human
ugagcuugcagaga

SEQ ID NO: 672496 - RNA, 20 nt, Human
augggccccagauaccauga

SEQ ID NO: 672497 - RNA, 14 nt, Human
cucaauaaauaaau

SEQ ID NO: 672498 - RNA, 16 nt, Human
ggcugagccucagucu

SEQ ID NO: 672499 - RNA, 22 nt, Human
ugcuggagacauugaggcaggc

SEQ ID NO: 672500 - RNA, 14 nt, Human
auguagaauauauu

SEQ ID NO: 672501 - RNA, 19 nt, Human
agaguuuagcuggaaaagu

SEQ ID NO: 672502 - RNA, 14 nt, Human
agagguccacaaca

SEQ ID NO: 672503 - RNA, 11 nt, Human
accauuuuuac

SEQ ID NO: 672504 - RNA, 15 nt, Human
gagaugcuagaacuc

SEQ ID NO: 672505 - RNA, 20 nt, Human
gcuggagacauugaggcagg

SEQ ID NO: 672506 - RNA, 13 nt, Human
gaagaacugaaau

SEQ ID NO: 672507 - RNA, 17 nt, Human
ugcccugaaagucccag

SEQ ID NO: 672508 - RNA, 22 nt, Human
gucaagaagcaucgugucuggc

SEQ ID NO: 672509 - RNA, 23 nt, Human
gcugaguguuucacaccuuaucu

SEQ ID NO: 672510 - RNA, 21 nt, Human
ugccuguaaucacagcuacuu

SEQ ID NO: 672511 - RNA, 18 nt, Human
uucugauauuggacagua

SEQ ID NO: 672512 - RNA, 23 nt, Human
aacuuuuccaaugacauuuuguu

SEQ ID NO: 672513 - RNA, 11 nt, Human
auggauaaaga

SEQ ID NO: 672514 - RNA, 19 nt, Human
aauuuuguuauguauauuu

SEQ ID NO: 672515 - RNA, 22 nt, Human
cugggacaggggagaaccuagg

SEQ ID NO: 672516 - RNA, 21 nt, Human
ucccagaucaagccugccuca

SEQ ID NO: 672517 - RNA, 15 nt, Human
aucaauuuaaaaaaa

SEQ ID NO: 672518 - RNA, 12 nt, Human
gcugaggcagga

SEQ ID NO: 672519 - RNA, 18 nt, Human
auagugagacacugucuc

SEQ ID NO: 672520 - RNA, 22 nt, Human
aaauguugacaugggacauuug

SEQ ID NO: 672521 - RNA, 21 nt, Human
gcugagucccaggcugagccu

SEQ ID NO: 672522 - RNA, 16 nt, Human
aaauauuuauuuuaau

SEQ ID NO: 672523 - RNA, 14 nt, Human
aucuaugccacaag

SEQ ID NO: 672524 - RNA, 21 nt, Human
ugaugcuacaggauuugaaau

SEQ ID NO: 672525 - RNA, 22 nt, Human
gaaaaucuuauaauuuaaaaua

SEQ ID NO: 672526 - RNA, 16 nt, Human
gauggcaggaggcauc

SEQ ID NO: 672527 - RNA, 17 nt, Human
caggaggggcuucuggg

SEQ ID NO: 672528 - RNA, 18 nt, Human
cccagaaugaccuggccg

SEQ ID NO: 672529 - RNA, 13 nt, Human
aagcuucuguucc

SEQ ID NO: 672530 - RNA, 22 nt, Human
augcagagguccacaacacaca

SEQ ID NO: 672531 - RNA, 21 nt, Human
uuauagcuacuaauuuuaaaa

SEQ ID NO: 672532 - RNA, 19 nt, Human
uuuauaucaauuuaaaaaa

SEQ ID NO: 672533 - RNA, 18 nt, Human
uagugaaauauuauuuua

SEQ ID NO: 672534 - RNA, 13 nt, Human
caaaaaaaaaccc

SEQ ID NO: 672535 - RNA, 18 nt, Human
acagagacagaaagcaga

SEQ ID NO: 672536 - RNA, 15 nt, Human
gacagggaggacgcu

SEQ ID NO: 672537 - RNA, 15 nt, Human
ggccauuacccccag

SEQ ID NO: 672538 - RNA, 14 nt, Human
cgucccccucuggc

SEQ ID NO: 672539 - RNA, 21 nt, Human
auauuuccuuauucagaauuu

SEQ ID NO: 672540 - RNA, 16 nt, Human
gacuauuauauuucca

SEQ ID NO: 672541 - RNA, 13 nt, Human
aaaauaacgauaa

SEQ ID NO: 672542 - RNA, 16 nt, Human
uguucuaagaagugaa

SEQ ID NO: 672543 - RNA, 23 nt, Human
aauguauucuuuuaguuuuuaaa

SEQ ID NO: 672544 - RNA, 23 nt, Human
uaaguuuuuuuuuaaaaaagaaa

SEQ ID NO: 672545 - RNA, 19 nt, Human
cugccccccagcccuccuu

SEQ ID NO: 672546 - RNA, 12 nt, Human
aauauauuuccu

SEQ ID NO: 672547 - RNA, 16 nt, Human
cuguggauuuaaugug

SEQ ID NO: 672548 - RNA, 18 nt, Human
aggaaguauaggccaggc

SEQ ID NO: 672549 - RNA, 16 nt, Human
aucacuugagccccgg

SEQ ID NO: 672550 - RNA, 23 nt, Human
cuacacgagauacagaauuuuau

SEQ ID NO: 672551 - RNA, 21 nt, Human
guuuguuuauuuguuuuucca

SEQ ID NO: 672552 - RNA, 21 nt, Human
gaagcuagaaaacaggcaaau

SEQ ID NO: 672553 - RNA, 22 nt, Human
ccauagucauucugccugcccu

SEQ ID NO: 672554 - RNA, 20 nt, Human
caggaggggcuucugggcag

SEQ ID NO: 672555 - RNA, 23 nt, Human
gcccuggugccucaccccuugcc

SEQ ID NO: 672556 - RNA, 15 nt, Human
ccccugagcuugcag

SEQ ID NO: 672557 - RNA, 16 nt, Human
agcccugccucaagcu

SEQ ID NO: 672558 - RNA, 14 nt, Human
aauauuuauuuuaa

SEQ ID NO: 672559 - RNA, 17 nt, Human
acaagaaaugaaagcag

SEQ ID NO: 672560 - RNA, 17 nt, Human
gaucuggcucuggacag

SEQ ID NO: 672561 - RNA, 16 nt, Human
uuauaauuuaaaauau

SEQ ID NO: 672562 - RNA, 13 nt, Human
guuuucccaucuc

SEQ ID NO: 672563 - RNA, 21 nt, Human
aaaaaguucugcagauaaaca

SEQ ID NO: 672564 - RNA, 19 nt, Human
cuaccaaaaaaaggaagga

SEQ ID NO: 672565 - RNA, 20 nt, Human
augcaguuguugcccacagc

SEQ ID NO: 672566 - RNA, 20 nt, Human
uaaaagacaaggaaaaaaua

SEQ ID NO: 672567 - RNA, 20 nt, Human
uuaacacaugauccugcaau

SEQ ID NO: 672568 - RNA, 23 nt, Human
acugucuuguuggacgagaaaac

SEQ ID NO: 672569 - RNA, 18 nt, Human
uuaggaggacaaaaggaa

SEQ ID NO: 672570 - RNA, 22 nt, Human
gagccucagucucccucccuug

SEQ ID NO: 672571 - RNA, 16 nt, Human
uaggauguugaaaaag

SEQ ID NO: 672572 - RNA, 20 nt, Human
acuuuauuuucuauaauuua

SEQ ID NO: 672573 - RNA, 17 nt, Human
accugcugagccccaag

SEQ ID NO: 672574 - RNA, 13 nt, Human
cacaacacacaga

SEQ ID NO: 672575 - RNA, 17 nt, Human
gaaagccaugugcagcc

SEQ ID NO: 672576 - RNA, 23 nt, Human
uaaaauauaugaggcuacagaac

SEQ ID NO: 672577 - RNA, 12 nt, Human
aucauuuacuuu

SEQ ID NO: 672578 - RNA, 15 nt, Human
auaaauaaaaauaau

SEQ ID NO: 672579 - RNA, 20 nt, Human
uugaacccgggaggcagagg

SEQ ID NO: 672580 - RNA, 15 nt, Human
uaaaguaaaggcaaa

SEQ ID NO: 672581 - RNA, 21 nt, Human
agccucuuagaugcaguucug

SEQ ID NO: 672582 - RNA, 22 nt, Human
cuaucaauccaagaacuuauuu

SEQ ID NO: 672583 - RNA, 23 nt, Human
ccuuuguugcuaucaauccaaga

SEQ ID NO: 672584 - RNA, 19 nt, Human
cucacauuuauauuuuugu

SEQ ID NO: 672585 - RNA, 14 nt, Human
cugccccccagccc

SEQ ID NO: 672586 - RNA, 16 nt, Human
uuauauuuccaagaaa

SEQ ID NO: 672587 - RNA, 21 nt, Human
uuacauuuguauaaaauaauu

SEQ ID NO: 672588 - RNA, 23 nt, Human
agccccaaguggaacgagacaag

SEQ ID NO: 672589 - RNA, 11 nt, Human
uuauauuuauu

SEQ ID NO: 672590 - RNA, 14 nt, Human
aaaauacaaaaaaa

SEQ ID NO: 672591 - RNA, 13 nt, Human
agguaccagccuu

SEQ ID NO: 672592 - RNA, 22 nt, Human
aaacaaggaugaauuaaguuuu

SEQ ID NO: 672593 - RNA, 19 nt, Human
ccccugcaaagcccagcuu

SEQ ID NO: 672594 - RNA, 14 nt, Human
ugacacuaaaacac

SEQ ID NO: 672595 - RNA, 15 nt, Human
cucaacaaacauaau

SEQ ID NO: 672596 - RNA, 23 nt, Human
ucggccuccauccugaggcucca

SEQ ID NO: 672597 - RNA, 14 nt, Human
auuaagaaaggaag

SEQ ID NO: 672598 - RNA, 20 nt, Human
uccucaugagggcuggaugc

SEQ ID NO: 672599 - RNA, 21 nt, Human
cuuguuggacgagaaaacaau

SEQ ID NO: 672600 - RNA, 17 nt, Human
ggaaauauuuauuuuaa

SEQ ID NO: 672601 - RNA, 18 nt, Human
acauaaaauacaaaaacu

SEQ ID NO: 672602 - RNA, 16 nt, Human
gcccugaaagucccag

SEQ ID NO: 672603 - RNA, 16 nt, Human
aagcauuuagauguau

SEQ ID NO: 672604 - RNA, 15 nt, Human
cucgugggacaguca

SEQ ID NO: 672605 - RNA, 15 nt, Human
cagaacuaaaaauua

SEQ ID NO: 672606 - RNA, 15 nt, Human
uuuaaaugucugaaa

SEQ ID NO: 672607 - RNA, 14 nt, Human
aagaagugaaaauc

SEQ ID NO: 672608 - RNA, 14 nt, Human
gaaagcagaacagu

SEQ ID NO: 672609 - RNA, 17 nt, Human
uauauuuccaagaaaua

SEQ ID NO: 672610 - RNA, 20 nt, Human
uguaauaggcguaacuaauu

SEQ ID NO: 672611 - RNA, 18 nt, Human
acuguuaucuucacuuuu

SEQ ID NO: 672612 - RNA, 19 nt, Human
ccccugagcuugcagagau

SEQ ID NO: 672613 - RNA, 16 nt, Human
cagccagcccucuucu

SEQ ID NO: 672614 - RNA, 14 nt, Human
agucucccucccuu

SEQ ID NO: 672615 - RNA, 21 nt, Human
cagacacaugugcuggccacc

SEQ ID NO: 672616 - RNA, 17 nt, Human
aggaaaaugggcuuugg

SEQ ID NO: 672617 - RNA, 15 nt, Human
gaauauauuuccuua

SEQ ID NO: 672618 - RNA, 18 nt, Human
cagaaagcagaacaguga

SEQ ID NO: 672619 - RNA, 19 nt, Human
auuuaguuauaaaaauaua

SEQ ID NO: 672620 - RNA, 14 nt, Human
aucucuucucagaa

SEQ ID NO: 672621 - RNA, 17 nt, Human
aaauaacgauaaaagac

SEQ ID NO: 672622 - RNA, 13 nt, Human
accuggccgcagu

SEQ ID NO: 672623 - RNA, 18 nt, Human
ugcccauaccccuggcca

SEQ ID NO: 672624 - RNA, 16 nt, Human
cuaguuuauauagaaa

SEQ ID NO: 672625 - RNA, 17 nt, Human
ccucagcugccucccca

SEQ ID NO: 672626 - RNA, 21 nt, Human
ugucucuaccaaaaaaaggaa

SEQ ID NO: 672627 - RNA, 22 nt, Human
cauaaauguugacaugggacau

SEQ ID NO: 672628 - RNA, 20 nt, Human
gauugagaaggagcucccag

SEQ ID NO: 672629 - RNA, 18 nt, Human
agagaaugagagacacac

SEQ ID NO: 672630 - RNA, 15 nt, Human
agacagcucugcaua

SEQ ID NO: 672631 - RNA, 22 nt, Human
ggaaaugauguuucauaagaau

SEQ ID NO: 672632 - RNA, 23 nt, Human
gaggcauccaaaggcuccugaga

SEQ ID NO: 672633 - RNA, 13 nt, Human
caacaucuaguga

SEQ ID NO: 672634 - RNA, 14 nt, Human
auuuaauuauuuca

SEQ ID NO: 672635 - RNA, 22 nt, Human
uccuuuuaaagaaacaaaaauc

SEQ ID NO: 672636 - RNA, 14 nt, Human
agauuucaaaaaaa

SEQ ID NO: 672637 - RNA, 19 nt, Human
ucuucacuuuuauaagaaa

SEQ ID NO: 672638 - RNA, 12 nt, Human
acacugaagaag

SEQ ID NO: 672639 - RNA, 22 nt, Human
gccugguguguucaagaccagc

SEQ ID NO: 672640 - RNA, 23 nt, Human
cgaaauacguuaggaggacaaaa

SEQ ID NO: 672641 - RNA, 19 nt, Human
aaguugcauagguuuaaua

SEQ ID NO: 672642 - RNA, 21 nt, Human
uacaugagguacugagaguga

SEQ ID NO: 672643 - RNA, 12 nt, Human
aauaaaguacaa

SEQ ID NO: 672644 - RNA, 17 nt, Human
caaaacuuauuggaaug

SEQ ID NO: 672645 - RNA, 19 nt, Human
ucagugucaaugcagcccc

SEQ ID NO: 672646 - RNA, 20 nt, Human
gcuuccaggcuggcgugcag

SEQ ID NO: 672647 - RNA, 12 nt, Human
acaagacacagu

SEQ ID NO: 672648 - RNA, 16 nt, Human
uucccaacuccagaaa

SEQ ID NO: 672649 - RNA, 22 nt, Human
agccugccucaaucaguauuca

SEQ ID NO: 672650 - RNA, 22 nt, Human
gucucuacuaaaaauacaaaaa

SEQ ID NO: 672651 - RNA, 22 nt, Human
auguuccuuuuaaagaaacaaa

SEQ ID NO: 672652 - RNA, 17 nt, Human
cucugcaagaagaaauc

SEQ ID NO: 672653 - RNA, 15 nt, Human
uggaaacgaagcacc

SEQ ID NO: 672654 - RNA, 21 nt, Human
uuguuuuucagcguuaaugua

SEQ ID NO: 672655 - RNA, 20 nt, Human
uuauucacuguauguccuug

SEQ ID NO: 672656 - RNA, 18 nt, Human
uaagcuucacuguaaaau

SEQ ID NO: 672657 - RNA, 19 nt, Human
aaaauaacgauaaaagaca

SEQ ID NO: 672658 - RNA, 18 nt, Human
acagaaagcagaacagug

SEQ ID NO: 672659 - RNA, 18 nt, Human
ucaggaaagagagcacca

SEQ ID NO: 672660 - RNA, 17 nt, Human
agacacacugaagaagc

SEQ ID NO: 672661 - RNA, 16 nt, Human
gcaggcagauguuccu

SEQ ID NO: 672662 - RNA, 23 nt, Human
auauaacaaugcuguauuuuaaa

SEQ ID NO: 672663 - RNA, 17 nt, Human
gccccagauaccaugau

SEQ ID NO: 672664 - RNA, 14 nt, Human
cagauccccaagcc

SEQ ID NO: 672665 - RNA, 14 nt, Human
ccaccugcugagcc

SEQ ID NO: 672666 - RNA, 13 nt, Human
ccuccuuuuaaag

SEQ ID NO: 672667 - RNA, 15 nt, Human
uacuaauuuuaaaau

SEQ ID NO: 672668 - RNA, 12 nt, Human
auaaaaacaaag

SEQ ID NO: 672669 - RNA, 20 nt, Human
cacagcacgggggccaagga

SEQ ID NO: 672670 - RNA, 21 nt, Human
ucauucacucaacaaacauaa

SEQ ID NO: 672671 - RNA, 19 nt, Human
auacuaauuauacccccug

SEQ ID NO: 672672 - RNA, 18 nt, Human
cagauuugagcucagccc

SEQ ID NO: 672673 - RNA, 22 nt, Human
cagcccuggugggcagagaggu

SEQ ID NO: 672674 - RNA, 14 nt, Human
uaaaauccauacau

SEQ ID NO: 672675 - RNA, 19 nt, Human
caugaguaacugauuugua

SEQ ID NO: 672676 - RNA, 22 nt, Human
uguauacugugugcuaaaacaa

SEQ ID NO: 672677 - RNA, 21 nt, Human
cuagucuguuuucccuccuug

SEQ ID NO: 672678 - RNA, 14 nt, Human
gccagggcaagaga

SEQ ID NO: 672679 - RNA, 21 nt, Human
uuuucaggcuagauguaugua

SEQ ID NO: 672680 - RNA, 17 nt, Human
uaucuucagaaaaccua

SEQ ID NO: 672681 - RNA, 14 nt, Human
aauauaaauaaaaa

SEQ ID NO: 672682 - RNA, 19 nt, Human
uaguuuaugauuccaccua

SEQ ID NO: 672683 - RNA, 22 nt, Human
aauaugccccauucaacaucua

SEQ ID NO: 672684 - RNA, 17 nt, Human
guguccccuauccuacu

SEQ ID NO: 672685 - RNA, 14 nt, Human
auccuugaagauuu

SEQ ID NO: 672686 - RNA, 13 nt, Human
ucuagagcaaagc

SEQ ID NO: 672687 - RNA, 22 nt, Human
uaccucugcuauuugcuguuau

SEQ ID NO: 672688 - RNA, 17 nt, Human
cuacagaacuaaaaauu

SEQ ID NO: 672689 - RNA, 16 nt, Human
gcugcagccccuggga

SEQ ID NO: 672690 - RNA, 12 nt, Human
guugauggaaau

SEQ ID NO: 672691 - RNA, 20 nt, Human
agaaaaccuaagcaaacuua

SEQ ID NO: 672692 - RNA, 21 nt, Human
acugaaacaaaauuagaaaug

SEQ ID NO: 672693 - RNA, 12 nt, Human
uguuugaaagcu

SEQ ID NO: 672694 - RNA, 16 nt, Human
agaauauauuuccuua

SEQ ID NO: 672695 - RNA, 17 nt, Human
ucauacuucuuaggguu

SEQ ID NO: 672696 - RNA, 16 nt, Human
caugucuagagaacac

SEQ ID NO: 672697 - RNA, 22 nt, Human
uccaugaguugcaguuuuuucc

SEQ ID NO: 672698 - RNA, 13 nt, Human
guaacuaauuuua

SEQ ID NO: 672699 - RNA, 21 nt, Human
uaucuuccuauaauuuuagac

SEQ ID NO: 672700 - RNA, 17 nt, Human
aaaacaccucagcugcc

SEQ ID NO: 672701 - RNA, 14 nt, Human
aggggaccagagag

SEQ ID NO: 672702 - RNA, 13 nt, Human
auaaaaauauaua

SEQ ID NO: 672703 - RNA, 16 nt, Human
gaagauguagaggaga

SEQ ID NO: 672704 - RNA, 19 nt, Human
acugccaucauuuacuuuu

SEQ ID NO: 672705 - RNA, 20 nt, Human
gcacccccagaaugaccugg

SEQ ID NO: 672706 - RNA, 21 nt, Human
uaggugacuauuauauuucca

SEQ ID NO: 672707 - RNA, 23 nt, Human
gggaaacaaaaggauaaugaaua

SEQ ID NO: 672708 - RNA, 19 nt, Human
agccuucucucaaggagag

SEQ ID NO: 672709 - RNA, 14 nt, Human
gauaaaagacagug

SEQ ID NO: 672710 - RNA, 15 nt, Human
uaaaaggaaaugcuc

SEQ ID NO: 672711 - RNA, 20 nt, Human
cagcuuccaggcuggcgugc

SEQ ID NO: 672712 - RNA, 16 nt, Human
cagauccccaagccug

SEQ ID NO: 672713 - RNA, 15 nt, Human
augucuagagaacac

SEQ ID NO: 672714 - RNA, 14 nt, Human
auuuuaucugcuau

SEQ ID NO: 672715 - RNA, 21 nt, Human
acaagaaggaaagauuuuguu

SEQ ID NO: 672716 - RNA, 13 nt, Human
augaguugcaguu

SEQ ID NO: 672717 - RNA, 23 nt, Human
cugagaaggcuguggauuuaaug

SEQ ID NO: 672718 - RNA, 17 nt, Human
accucagcugccucccc

SEQ ID NO: 672719 - RNA, 14 nt, Human
aagcucuaucacca

SEQ ID NO: 672720 - RNA, 19 nt, Human
accaaaaaaaggaaggaag

SEQ ID NO: 672721 - RNA, 12 nt, Human
uaguuuuuaaag

SEQ ID NO: 672722 - RNA, 14 nt, Human
ugcaccuccaugga

SEQ ID NO: 672723 - RNA, 14 nt, Human
ccuuaucaaaggac

SEQ ID NO: 672724 - RNA, 23 nt, Human
aauuaaaaccucuuugugucccu

SEQ ID NO: 672725 - RNA, 14 nt, Human
cugucucaguccau

SEQ ID NO: 672726 - RNA, 14 nt, Human
cucugccucagaaa

SEQ ID NO: 672727 - RNA, 20 nt, Human
gccugagcggaccuucccag

SEQ ID NO: 672728 - RNA, 18 nt, Human
cuuuccacagaagcucca

SEQ ID NO: 672729 - RNA, 13 nt, Human
aacucccugcccc

SEQ ID NO: 672730 - RNA, 17 nt, Human
aguauuucuaugaaaua

SEQ ID NO: 672731 - RNA, 14 nt, Human
cucagcugccuccc

SEQ ID NO: 672732 - RNA, 20 nt, Human
cagugaaagaaaauaacgau

SEQ ID NO: 672733 - RNA, 12 nt, Human
ugccaaaauaua

SEQ ID NO: 672734 - RNA, 23 nt, Human
gagcucccaggaggggcuucugg

SEQ ID NO: 672735 - RNA, 12 nt, Human
ucuuaagaagac

SEQ ID NO: 672736 - RNA, 18 nt, Human
ggaaggcugaggcaggag

SEQ ID NO: 672737 - RNA, 22 nt, Human
uauuucuaugaaauauuauguu

SEQ ID NO: 672738 - RNA, 22 nt, Human
cacagauuugagcucagcccug

SEQ ID NO: 672739 - RNA, 15 nt, Human
ugagcucagcccugg

SEQ ID NO: 672740 - RNA, 15 nt, Human
gccuugggaccccug

SEQ ID NO: 672741 - RNA, 18 nt, Human
gggaacaaggaaggaaag

SEQ ID NO: 672742 - RNA, 17 nt, Human
cuaagcuucacuguaaa

SEQ ID NO: 672743 - RNA, 15 nt, Human
cauucugccugcccu

SEQ ID NO: 672744 - RNA, 17 nt, Human
auaucaauuuaaaaaaa

SEQ ID NO: 672745 - RNA, 17 nt, Human
cagacaucaacagauaa

SEQ ID NO: 672746 - RNA, 17 nt, Human
cauaguaccucugcuau

SEQ ID NO: 672747 - RNA, 22 nt, Human
uacugagagugaacaaauuuac

SEQ ID NO: 672748 - RNA, 22 nt, Human
uugacccacaagaaaugaaagc

SEQ ID NO: 672749 - RNA, 19 nt, Human
ugcuauuugcuguuauuuu

SEQ ID NO: 672750 - RNA, 13 nt, Human
ugaaagaaaauaa

SEQ ID NO: 672751 - RNA, 22 nt, Human
auaucuuuuuuuuaauaaacca

SEQ ID NO: 672752 - RNA, 16 nt, Human
uggggaugaacuuuuu

SEQ ID NO: 672753 - RNA, 19 nt, Human
cuaagcuucacuguaaaau

SEQ ID NO: 672754 - RNA, 16 nt, Human
gucucaauaaauaaau

SEQ ID NO: 672755 - RNA, 17 nt, Human
cauccugugggaccugg

SEQ ID NO: 672756 - RNA, 16 nt, Human
auaucaauuuaaaaaa

SEQ ID NO: 672757 - RNA, 18 nt, Human
agauauuaacugagaagg

SEQ ID NO: 672758 - RNA, 20 nt, Human
gaaaauaacgauaaaagaca

SEQ ID NO: 672759 - RNA, 13 nt, Human
uaaauaaauaaau

SEQ ID NO: 672760 - RNA, 22 nt, Human
ccauuucuugagguaaaagcau

SEQ ID NO: 672761 - RNA, 17 nt, Human
cuccaaguucaaaacuu

SEQ ID NO: 672762 - RNA, 19 nt, Human
gcuggccuugugaggagcu

SEQ ID NO: 672763 - RNA, 13 nt, Human
gggcugaagcugu

SEQ ID NO: 672764 - RNA, 19 nt, Human
cuggccuucggccuccauc

SEQ ID NO: 672765 - RNA, 21 nt, Human
ucccaggaggggcuucugggc

SEQ ID NO: 672766 - RNA, 20 nt, Human
gagccugaucaccugcccug

SEQ ID NO: 672767 - RNA, 18 nt, Human
gaagcaaaauuuuuucuc

SEQ ID NO: 672768 - RNA, 15 nt, Human
ugaaacccugucucu

SEQ ID NO: 672769 - RNA, 19 nt, Human
gagccugaucaccugcccu

SEQ ID NO: 672770 - RNA, 15 nt, Human
aaggaauuuaaaaau

SEQ ID NO: 672771 - RNA, 15 nt, Human
uuacagagacagaaa

SEQ ID NO: 672772 - RNA, 13 nt, Human
acuauaaaacuag

SEQ ID NO: 672773 - RNA, 13 nt, Human
ccucccccaucuc

SEQ ID NO: 672774 - RNA, 14 nt, Human
uaugaauuacauuu

SEQ ID NO: 672775 - RNA, 14 nt, Human
gccaggcacagugg

SEQ ID NO: 672776 - RNA, 19 nt, Human
ggaauuucuucaacucccu

SEQ ID NO: 672777 - RNA, 20 nt, Human
gcccauccugccccugagcc

SEQ ID NO: 672778 - RNA, 19 nt, Human
gaaagaaaauaacaauaaa

SEQ ID NO: 672779 - RNA, 13 nt, Human
cuuagcccuuccc

SEQ ID NO: 672780 - RNA, 12 nt, Human
uucucuaggaaa

SEQ ID NO: 672781 - RNA, 14 nt, Human
cucagucucccucc

SEQ ID NO: 672782 - RNA, 12 nt, Human
auucugaaagca

SEQ ID NO: 672783 - RNA, 14 nt, Human
agacacugucucua

SEQ ID NO: 672784 - RNA, 13 nt, Human
aacaaaauuagaa

SEQ ID NO: 672785 - RNA, 22 nt, Human
gaauuaaguuuuuuuuuaaaaa

SEQ ID NO: 672786 - RNA, 13 nt, Human
aaagaaaggagau

SEQ ID NO: 672787 - RNA, 18 nt, Human
cccucuucugacacuaaa

SEQ ID NO: 672788 - RNA, 22 nt, Human
ccacagcuguaugauucccagc

SEQ ID NO: 672789 - RNA, 15 nt, Human
gaacuaaaaauuaaa

SEQ ID NO: 672790 - RNA, 22 nt, Human
cgugcuugucccuguggaagua

SEQ ID NO: 672791 - RNA, 21 nt, Human
ugccagcuggccuugugagga

SEQ ID NO: 672792 - RNA, 22 nt, Human
uauaagaaauaggaaauauuuu

SEQ ID NO: 672793 - RNA, 14 nt, Human
ucuccucaacucug

SEQ ID NO: 672794 - RNA, 17 nt, Human
ccugggcaacaugguga

SEQ ID NO: 672795 - RNA, 14 nt, Human
agcucuaucaccaa

SEQ ID NO: 672796 - RNA, 19 nt, Human
auuucuucaacucccugcc

SEQ ID NO: 672797 - RNA, 19 nt, Human
agagccuuuuuuugaaaaa

SEQ ID NO: 672798 - RNA, 16 nt, Human
ccaggcugagccucag

SEQ ID NO: 672799 - RNA, 20 nt, Human
cugaggcaggaggaucacuu

SEQ ID NO: 672800 - RNA, 18 nt, Human
cagagacagaaagcagaa

SEQ ID NO: 672801 - RNA, 21 nt, Human
aaaugucuugcuugauuguau

SEQ ID NO: 672802 - RNA, 21 nt, Human
aauaauguuucaaacauauau

SEQ ID NO: 672803 - RNA, 18 nt, Human
auaccccuggccaaggaa

SEQ ID NO: 672804 - RNA, 12 nt, Human
aacuuauuugua

SEQ ID NO: 672805 - RNA, 15 nt, Human
uccauccugaggcuc

SEQ ID NO: 672806 - RNA, 17 nt, Human
aguugauaaguacauga

SEQ ID NO: 672807 - RNA, 14 nt, Human
caugggccccagau

SEQ ID NO: 672808 - RNA, 19 nt, Human
uauacugugugcuaaaaca

SEQ ID NO: 672809 - RNA, 20 nt, Human
agcccuggugggcagagagg

SEQ ID NO: 672810 - RNA, 15 nt, Human
agauuucaaaaaaaa

SEQ ID NO: 672811 - RNA, 14 nt, Human
auuugaaauuguau

SEQ ID NO: 672812 - RNA, 19 nt, Human
uggugagugccuguaauca

SEQ ID NO: 672813 - RNA, 14 nt, Human
cagauuugagcuca

SEQ ID NO: 672814 - RNA, 16 nt, Human
ccccaucucuucuggg

SEQ ID NO: 672815 - RNA, 18 nt, Human
cagggaggacgcucucug

SEQ ID NO: 672816 - RNA, 18 nt, Human
gggggucagccagcccuc

SEQ ID NO: 672817 - RNA, 14 nt, Human
augaugcuuugaga

SEQ ID NO: 672818 - RNA, 14 nt, Human
aagcaacccaaaug

SEQ ID NO: 672819 - RNA, 16 nt, Human
cuggaugcucucguug

SEQ ID NO: 672820 - RNA, 22 nt, Human
agaaaacaauaacgauaaaaga

SEQ ID NO: 672821 - RNA, 18 nt, Human
uguggucacaggaaguag

SEQ ID NO: 672822 - RNA, 21 nt, Human
ugagcuaggggggucagccag

SEQ ID NO: 672823 - RNA, 16 nt, Human
aacagauuucaaaaaa

SEQ ID NO: 672824 - RNA, 12 nt, Human
ggugcugcagcc

SEQ ID NO: 672825 - RNA, 20 nt, Human
aauuguaggugacuauuaua

SEQ ID NO: 672826 - RNA, 17 nt, Human
cucgugggacagucacc

SEQ ID NO: 672827 - RNA, 13 nt, Human
uacagagacagaa

SEQ ID NO: 672828 - RNA, 15 nt, Human
aaauauaaucagaga

SEQ ID NO: 672829 - RNA, 23 nt, Human
agggaagggggaacaugagccuu

SEQ ID NO: 672830 - RNA, 20 nt, Human
uggggcuaaggcaggaggau

SEQ ID NO: 672831 - RNA, 22 nt, Human
cagcacgggggccaaggaugcc

SEQ ID NO: 672832 - RNA, 18 nt, Human
auguuucauaagaauucu

SEQ ID NO: 672833 - RNA, 17 nt, Human
caucagcaucccuagaa

SEQ ID NO: 672834 - RNA, 18 nt, Human
uccugugggaccugggcc

SEQ ID NO: 672835 - RNA, 21 nt, Human
auuuguauaaaauaauuuuua

SEQ ID NO: 672836 - RNA, 21 nt, Human
aggaagaucccuuuguccaca

SEQ ID NO: 672837 - RNA, 22 nt, Human
ccuuccccucugcagcuuccag

SEQ ID NO: 672838 - RNA, 19 nt, Human
caucaaggguacacugccu

SEQ ID NO: 672839 - RNA, 20 nt, Human
guaucaaaagaaagaaaauc

SEQ ID NO: 672840 - RNA, 19 nt, Human
cauccaaaggcuccugaga

SEQ ID NO: 672841 - RNA, 15 nt, Human
acaaaguugauuaag

SEQ ID NO: 672842 - RNA, 14 nt, Human
uaaaauagugaaua

SEQ ID NO: 672843 - RNA, 18 nt, Human
uaauuauuucacuuuaga

SEQ ID NO: 672844 - RNA, 23 nt, Human
cagagucaagggugugugcagca

SEQ ID NO: 672845 - RNA, 14 nt, Human
auuuauuuuaauaa

SEQ ID NO: 672846 - RNA, 22 nt, Human
caucucuucuggguuccuuccu

SEQ ID NO: 672847 - RNA, 11 nt, Human
augggacaggg

SEQ ID NO: 672848 - RNA, 23 nt, Human
aagucccagaucaagccugccuc

SEQ ID NO: 672849 - RNA, 13 nt, Human
ccccucugcagcu

SEQ ID NO: 672850 - RNA, 21 nt, Human
uccccuugggggugguggaug

SEQ ID NO: 672851 - RNA, 18 nt, Human
cuggaaacuucagcgguu

SEQ ID NO: 672852 - RNA, 15 nt, Human
acucugcaagaagaa

SEQ ID NO: 672853 - RNA, 12 nt, Human
agggacccccaa

SEQ ID NO: 672854 - RNA, 17 nt, Human
cuucacuguaaaauaau

SEQ ID NO: 672855 - RNA, 17 nt, Human
uuuuuaauuauauggcu

SEQ ID NO: 672856 - RNA, 23 nt, Human
uaagaaauaggaaauauuuuaau

SEQ ID NO: 672857 - RNA, 15 nt, Human
uccaagccucauguc

SEQ ID NO: 672858 - RNA, 22 nt, Human
cccagcccuccuuaucaaagga

SEQ ID NO: 672859 - RNA, 17 nt, Human
auguuuacagaucccca

SEQ ID NO: 672860 - RNA, 14 nt, Human
auggcaggaggcau

SEQ ID NO: 672861 - RNA, 18 nt, Human
cccaagccuggcaaggga

SEQ ID NO: 672862 - RNA, 23 nt, Human
uuauagcuacuaauuuuaaaaug

SEQ ID NO: 672863 - RNA, 15 nt, Human
auauaucauagcaaa

SEQ ID NO: 672864 - RNA, 22 nt, Human
cuggugucuucaggggccacac

SEQ ID NO: 672865 - RNA, 15 nt, Human
agagacagaaagcag

SEQ ID NO: 672866 - RNA, 14 nt, Human
cauuuauguuccuu

SEQ ID NO: 672867 - RNA, 20 nt, Human
ggcaggaggaucacuugagc

SEQ ID NO: 672868 - RNA, 20 nt, Human
accaggcacccccagaauga

SEQ ID NO: 672869 - RNA, 16 nt, Human
gugagacagcucugca

SEQ ID NO: 672870 - RNA, 21 nt, Human
gacagaaagcagaacagugau

SEQ ID NO: 672871 - RNA, 17 nt, Human
ugaccacugcagaagac

SEQ ID NO: 672872 - RNA, 16 nt, Human
agauagggagggaagg

SEQ ID NO: 672873 - RNA, 23 nt, Human
auuucugagcauuuaauauggau

SEQ ID NO: 672874 - RNA, 23 nt, Human
gauaaggcuguucuuuaaauguc

SEQ ID NO: 672875 - RNA, 23 nt, Human
uaaaagacagugaaagaaaauaa

SEQ ID NO: 672876 - RNA, 19 nt, Human
ugggccauagucauucugc

SEQ ID NO: 672877 - RNA, 12 nt, Human
gguauuuuaauc

SEQ ID NO: 672878 - RNA, 15 nt, Human
cagugucugcuggag

SEQ ID NO: 672879 - RNA, 21 nt, Human
aucuuuuuuuuaauaaaccau

SEQ ID NO: 672880 - RNA, 14 nt, Human
uuuguauaaaauaa

SEQ ID NO: 672881 - RNA, 14 nt, Human
augcuccuccaggg

SEQ ID NO: 672882 - RNA, 14 nt, Human
ccuugaugaagaag

SEQ ID NO: 672883 - RNA, 16 nt, Human
gggucagccagcccuc

SEQ ID NO: 672884 - RNA, 13 nt, Human
uuauaaaaauaua

SEQ ID NO: 672885 - RNA, 17 nt, Human
agcgacagugagacucu

SEQ ID NO: 672886 - RNA, 21 nt, Human
agucucccucccuuggggccu

SEQ ID NO: 672887 - RNA, 20 nt, Human
agaauucuguugauggaaau

SEQ ID NO: 672888 - RNA, 23 nt, Human
cacaagaaaugaaagcagggacu

SEQ ID NO: 672889 - RNA, 14 nt, Human
cugcaaagcccagc

SEQ ID NO: 672890 - RNA, 13 nt, Human
uacauaaaauaca

SEQ ID NO: 672891 - RNA, 14 nt, Human
gauuaguacacacu

SEQ ID NO: 672892 - RNA, 19 nt, Human
uuugccaaguucuccacua

SEQ ID NO: 672893 - RNA, 16 nt, Human
auaauccuaaacauau

SEQ ID NO: 672894 - RNA, 22 nt, Human
cuccugccuaagugcagccccg

SEQ ID NO: 672895 - RNA, 21 nt, Human
uuauuuucuauaauuuaaaua

SEQ ID NO: 672896 - RNA, 22 nt, Human
agucuuucacauuuaaauaaag

SEQ ID NO: 672897 - RNA, 14 nt, Human
cuuucauaauaagu

SEQ ID NO: 672898 - RNA, 18 nt, Human
aguucuccacuagcuaug

SEQ ID NO: 672899 - RNA, 17 nt, Human
gacgagaaaacaauaac

SEQ ID NO: 672900 - RNA, 22 nt, Human
uacaugagguacugagagugaa

SEQ ID NO: 672901 - RNA, 16 nt, Human
cuaggcauagcccugc

SEQ ID NO: 672902 - RNA, 22 nt, Human
uuuauggcacuaguauuucuau

SEQ ID NO: 672903 - RNA, 13 nt, Human
aaaaaugguuuaa

SEQ ID NO: 672904 - RNA, 23 nt, Human
ccacaccaaccuucugaggagcu

SEQ ID NO: 672905 - RNA, 19 nt, Human
uacaaaaaaaaaaaaaaau

SEQ ID NO: 672906 - RNA, 17 nt, Human
uucacuuuuauaagaaa

SEQ ID NO: 672907 - RNA, 15 nt, Human
cccugccccccagcc

SEQ ID NO: 672908 - RNA, 22 nt, Human
uaaaacaagcacuaaacaaaga

SEQ ID NO: 672909 - RNA, 16 nt, Human
ucuuggucucaguguc

SEQ ID NO: 672910 - RNA, 23 nt, Human
auuauauggcuugaguuuaaauu

SEQ ID NO: 672911 - RNA, 17 nt, Human
agaaugacugacaaaga

SEQ ID NO: 672912 - RNA, 11 nt, Human
aaaaaggaagg

SEQ ID NO: 672913 - RNA, 22 nt, Human
uugccuaggcauagcccugccu

SEQ ID NO: 672914 - RNA, 20 nt, Human
uuaaauggucaauuuuguua

SEQ ID NO: 672915 - RNA, 18 nt, Human
cccucuggcuccagcugg

SEQ ID NO: 672916 - RNA, 23 nt, Human
aucaccaaggcugauuaaaccaa

SEQ ID NO: 672917 - RNA, 14 nt, Human
aguauaggccaggc

SEQ ID NO: 672918 - RNA, 21 nt, Human
cugguagcuaaauauauauuu

SEQ ID NO: 672919 - RNA, 17 nt, Human
cuucugaggagcuguug

SEQ ID NO: 672920 - RNA, 17 nt, Human
ccaaaagguauuuuaau

SEQ ID NO: 672921 - RNA, 23 nt, Human
aucuaugccacaagaacccccuu

SEQ ID NO: 672922 - RNA, 13 nt, Human
cugagacacaugg

SEQ ID NO: 672923 - RNA, 23 nt, Human
uccaacuaucucauuuccaagca

SEQ ID NO: 672924 - RNA, 20 nt, Human
agcagugagccaaauguaaa

SEQ ID NO: 672925 - RNA, 17 nt, Human
uccagcuggccgggagc

SEQ ID NO: 672926 - RNA, 19 nt, Human
acgaaauacguuaggagga

SEQ ID NO: 672927 - RNA, 14 nt, Human
uaguuucccuugca

SEQ ID NO: 672928 - RNA, 16 nt, Human
caaguaaaaggaaaug

SEQ ID NO: 672929 - RNA, 16 nt, Human
uaggaaauauuuuaau

SEQ ID NO: 672930 - RNA, 12 nt, Human
ggggugggggug

SEQ ID NO: 672931 - RNA, 12 nt, Human
cuccaaggaccg

SEQ ID NO: 672932 - RNA, 16 nt, Human
uuuaaggauucugaga

SEQ ID NO: 672933 - RNA, 17 nt, Human
ucuggcguuguggggau

SEQ ID NO: 672934 - RNA, 15 nt, Human
uacaaaugcauuucu

SEQ ID NO: 672935 - RNA, 20 nt, Human
aagucaucugaugagaacaa

SEQ ID NO: 672936 - RNA, 18 nt, Human
aaggaugccccguccccc

SEQ ID NO: 672937 - RNA, 19 nt, Human
aaacaaaaggauaaugaau

SEQ ID NO: 672938 - RNA, 16 nt, Human
gcagugucugcuggag

SEQ ID NO: 672939 - RNA, 20 nt, Human
caccuccuaagaaggcaccu

SEQ ID NO: 672940 - RNA, 17 nt, Human
acucuggucaagaagca

SEQ ID NO: 672941 - RNA, 21 nt, Human
uuuauauaagcuuguauuccu

SEQ ID NO: 672942 - RNA, 11 nt, Human
ccgugugccug

SEQ ID NO: 672943 - RNA, 22 nt, Human
aucucuucuggguuccuuccuc

SEQ ID NO: 672944 - RNA, 22 nt, Human
aggauggcuaguaucaaaagaa

SEQ ID NO: 672945 - RNA, 21 nt, Human
ucacagaaugacugacaaaga

SEQ ID NO: 672946 - RNA, 18 nt, Human
gcagcccuuagcccuucc

SEQ ID NO: 672947 - RNA, 12 nt, Human
cauagaaguaaa

SEQ ID NO: 672948 - RNA, 19 nt, Human
auaaaagacaaggaaaaaa

SEQ ID NO: 672949 - RNA, 18 nt, Human
cauuauggauaaagauga

SEQ ID NO: 672950 - RNA, 16 nt, Human
uaaacuuugauuuuau

SEQ ID NO: 672951 - RNA, 14 nt, Human
uauuugaaauauug

SEQ ID NO: 672952 - RNA, 18 nt, Human
uuauuacuguaagaaaau

SEQ ID NO: 672953 - RNA, 15 nt, Human
ggaaauauuuuaaug

SEQ ID NO: 672954 - RNA, 16 nt, Human
uguaguccuguaaugg

SEQ ID NO: 672955 - RNA, 23 nt, Human
uuucccaucucagguguguugca

SEQ ID NO: 672956 - RNA, 13 nt, Human
uaaaauacaaaaa

SEQ ID NO: 672957 - RNA, 14 nt, Human
uggccaccugcuga

SEQ ID NO: 672958 - RNA, 23 nt, Human
cuaggaugggaacaaggaaggaa

SEQ ID NO: 672959 - RNA, 16 nt, Human
ccaggcacccccagaa

SEQ ID NO: 672960 - RNA, 21 nt, Human
cuccagcuggccgggagccug

SEQ ID NO: 672961 - RNA, 21 nt, Human
gcacuguggguagacacacau

SEQ ID NO: 672962 - RNA, 17 nt, Human
auggcuaguaucaaaag

SEQ ID NO: 672963 - RNA, 21 nt, Human
aacauagugagacacugucuc

SEQ ID NO: 672964 - RNA, 18 nt, Human
agaucaagccugccucaa

SEQ ID NO: 672965 - RNA, 14 nt, Human
aaauaaaaacaaag

SEQ ID NO: 672966 - RNA, 19 nt, Human
cuuccuaauuccacagcug

SEQ ID NO: 672967 - RNA, 18 nt, Human
aucuuauaauuuaaaaua

SEQ ID NO: 672968 - RNA, 15 nt, Human
uaaaagacaaggaaa

SEQ ID NO: 672969 - RNA, 20 nt, Human
agugaggcggauugagaagg

SEQ ID NO: 672970 - RNA, 22 nt, Human
cugaggcuccacuuggucugug

SEQ ID NO: 672971 - RNA, 13 nt, Human
uucuauaauuuaa

SEQ ID NO: 672972 - RNA, 16 nt, Human
auauuuccaagaaaua

SEQ ID NO: 672973 - RNA, 15 nt, Human
ugcuguauuuuaaaa

SEQ ID NO: 672974 - RNA, 18 nt, Human
uuuuaaaaaagaaacauu

SEQ ID NO: 672975 - RNA, 17 nt, Human
ccugccccccagcccuc

SEQ ID NO: 672976 - RNA, 17 nt, Human
cucuggucaagaagcau

SEQ ID NO: 672977 - RNA, 20 nt, Human
cagccugagcgacagugaga

SEQ ID NO: 672978 - RNA, 14 nt, Human
gaucuaugccacaa

SEQ ID NO: 672979 - RNA, 15 nt, Human
ggggcuucugggcag

SEQ ID NO: 672980 - RNA, 19 nt, Human
uugugccccugcacuccag

SEQ ID NO: 672981 - RNA, 17 nt, Human
aacaaaauuagaaaugu

SEQ ID NO: 672982 - RNA, 21 nt, Human
gcucccaggaggggcuucugg

SEQ ID NO: 672983 - RNA, 18 nt, Human
ugaagagugugaggaaaa

SEQ ID NO: 672984 - RNA, 19 nt, Human
uccccuauccuacuucccc

SEQ ID NO: 672985 - RNA, 12 nt, Human
cagauuuuccug

SEQ ID NO: 672986 - RNA, 22 nt, Human
caccucccccaucucuucuggg

SEQ ID NO: 672987 - RNA, 14 nt, Human
uauaauuuaaauau

SEQ ID NO: 672988 - RNA, 14 nt, Human
gggcaagagagcga

SEQ ID NO: 672989 - RNA, 14 nt, Human
gaaacgaagcacca

SEQ ID NO: 672990 - RNA, 20 nt, Human
ccagugagacagcucugcau

SEQ ID NO: 672991 - RNA, 15 nt, Human
ggacucaccuccccc

SEQ ID NO: 672992 - RNA, 14 nt, Human
ccacuggacucacc

SEQ ID NO: 672993 - RNA, 15 nt, Human
caggcacccccagaa

SEQ ID NO: 672994 - RNA, 15 nt, Human
ccaacuauaaaacua

SEQ ID NO: 672995 - RNA, 23 nt, Human
aaccugccagcuggccuugugag

SEQ ID NO: 672996 - RNA, 20 nt, Human
agcuacuaauuuuaaaaugu

SEQ ID NO: 672997 - RNA, 23 nt, Human
ucaugcccauaccccuggccaag

SEQ ID NO: 672998 - RNA, 18 nt, Human
gagcgacagugagacucu

SEQ ID NO: 672999 - RNA, 17 nt, Human
augcagagguccacaac

SEQ ID NO: 673000 - RNA, 21 nt, Human
aauuccugacugcuaguuuau

SEQ ID NO: 673001 - RNA, 23 nt, Human
auuuuauagcuacuaauuuuaaa

SEQ ID NO: 673002 - RNA, 22 nt, Human
aagcugguggcucugugugcuc

SEQ ID NO: 673003 - RNA, 21 nt, Human
guauacugugugcuaaaacaa

SEQ ID NO: 673004 - RNA, 20 nt, Human
uauuuauuacuguaagaaaa

SEQ ID NO: 673005 - RNA, 19 nt, Human
gucaaauugugugaaaggu

SEQ ID NO: 673006 - RNA, 15 nt, Human
cuaguaauuggaaag

SEQ ID NO: 673007 - RNA, 15 nt, Human
uacagaacuaaaaau

SEQ ID NO: 673008 - RNA, 22 nt, Human
ugaauuguaggugacuauuaua

SEQ ID NO: 673009 - RNA, 21 nt, Human
acaugggugcuauugggguug

SEQ ID NO: 673010 - RNA, 14 nt, Human
guccauugggcagg

SEQ ID NO: 673011 - RNA, 17 nt, Human
cucagucucccucccuu

SEQ ID NO: 673012 - RNA, 19 nt, Human
auuuccuuauucagaauuu

SEQ ID NO: 673013 - RNA, 16 nt, Human
ggagaggcaaagaaag

SEQ ID NO: 673014 - RNA, 22 nt, Human
auauaugcuaagucuuauauau

SEQ ID NO: 673015 - RNA, 15 nt, Human
aagccagauuuuccu

SEQ ID NO: 673016 - RNA, 12 nt, Human
ggaggggcuucu

SEQ ID NO: 673017 - RNA, 16 nt, Human
uaucuuccuauaauuu

SEQ ID NO: 673018 - RNA, 19 nt, Human
ucaccaaggcugauuaaac

SEQ ID NO: 673019 - RNA, 21 nt, Human
auaugcucuaaacauguuuau

SEQ ID NO: 673020 - RNA, 16 nt, Human
agaucaagccugccuc

SEQ ID NO: 673021 - RNA, 15 nt, Human
aauguuuguccuugg

SEQ ID NO: 673022 - RNA, 21 nt, Human
cuaccaaaaaucucaauauuu

SEQ ID NO: 673023 - RNA, 19 nt, Human
ugauggaguuucucuagaa

SEQ ID NO: 673024 - RNA, 21 nt, Human
uuagaaauguaauuauguucu

SEQ ID NO: 673025 - RNA, 18 nt, Human
aaaaguucugcagauaaa

SEQ ID NO: 673026 - RNA, 23 nt, Human
ucugacacuaaaacaccucagcu

SEQ ID NO: 673027 - RNA, 20 nt, Human
aauuuuuucucuaggaaaua

SEQ ID NO: 673028 - RNA, 18 nt, Human
gaaauacguuaggaggac

SEQ ID NO: 673029 - RNA, 16 nt, Human
uggaaacgaagcacca

SEQ ID NO: 673030 - RNA, 11 nt, Human
gagguaaaagc

SEQ ID NO: 673031 - RNA, 23 nt, Human
uuagaugcaguucugaagaagau

SEQ ID NO: 673032 - RNA, 15 nt, Human
gcacuacuguacucc

SEQ ID NO: 673033 - RNA, 20 nt, Human
aaagaaaggagauacagugg

SEQ ID NO: 673034 - RNA, 22 nt, Human
ucuuccuggauuccucacuuug

SEQ ID NO: 673035 - RNA, 19 nt, Human
auagugaggagcuuugaaa

SEQ ID NO: 673036 - RNA, 12 nt, Human
uauuauuuuuua

SEQ ID NO: 673037 - RNA, 13 nt, Human
agacacugucucu

SEQ ID NO: 673038 - RNA, 15 nt, Human
aauauauuuccuuau

SEQ ID NO: 673039 - RNA, 19 nt, Human
ccagaucuaugccacaaga

SEQ ID NO: 673040 - RNA, 14 nt, Human
aaaagaaagaaaau

SEQ ID NO: 673041 - RNA, 23 nt, Human
cuugauaaauggcuuccuggcaa

SEQ ID NO: 673042 - RNA, 16 nt, Human
aaaauaauccucaguu

SEQ ID NO: 673043 - RNA, 13 nt, Human
agguaccuucuca

SEQ ID NO: 673044 - RNA, 22 nt, Human
uuuccuuauucagaauuucuaa

SEQ ID NO: 673045 - RNA, 18 nt, Human
ucuucuggguuccuuccu

SEQ ID NO: 673046 - RNA, 17 nt, Human
agaaacaaaaaucaaac

SEQ ID NO: 673047 - RNA, 20 nt, Human
uacaucccuuaccugggaaa

SEQ ID NO: 673048 - RNA, 22 nt, Human
cauuuaguuauaaaaauauaua

SEQ ID NO: 673049 - RNA, 23 nt, Human
cuggggcuuuaacuccugcuaga

SEQ ID NO: 673050 - RNA, 20 nt, Human
uggccacacaggaucuuuug

SEQ ID NO: 673051 - RNA, 21 nt, Human
aagacucgggauuaguacaca

SEQ ID NO: 673052 - RNA, 18 nt, Human
ugugaccacugcagaaga

SEQ ID NO: 673053 - RNA, 16 nt, Human
uaaaggaauuuaaaaa

SEQ ID NO: 673054 - RNA, 23 nt, Human
cucagcccuggugggcagagagg

SEQ ID NO: 673055 - RNA, 20 nt, Human
uccaaaggcuccugagacac

SEQ ID NO: 673056 - RNA, 15 nt, Human
auaauuuugugaagc

SEQ ID NO: 673057 - RNA, 15 nt, Human
gcagagguugcagug

SEQ ID NO: 673058 - RNA, 14 nt, Human
gaaaguuuucucca

SEQ ID NO: 673059 - RNA, 16 nt, Human
gccuaagugcagcccc

SEQ ID NO: 673060 - RNA, 17 nt, Human
agaaaugaaagcaggga

SEQ ID NO: 673061 - RNA, 16 nt, Human
ugacuauuauauuucc

SEQ ID NO: 673062 - RNA, 14 nt, Human
ugaaagucccagau

SEQ ID NO: 673063 - RNA, 16 nt, Human
uaaauaaauaaauaaa

SEQ ID NO: 673064 - RNA, 16 nt, Human
aaauaaauaaauaaau

SEQ ID NO: 673065 - RNA, 16 nt, Human
auaaauaaauaaauaa

SEQ ID NO: 673066 - RNA, 16 nt, Human
aauaaauaaauaaaua

SEQ ID NO: 673067 - RNA, 14 nt, Human
agucugacuguuuc

SEQ ID NO: 673068 - RNA, 20 nt, Human
gacaggcacuaucuggguuu

SEQ ID NO: 673069 - RNA, 19 nt, Human
cucuguucugcacacagca

SEQ ID NO: 673070 - RNA, 21 nt, Human
auguuuaauucugaaagcaac

SEQ ID NO: 673071 - RNA, 22 nt, Human
ggcuaagcuucacuguaaaaua

SEQ ID NO: 673072 - RNA, 18 nt, Human
cuccccaaaugcuuucca

SEQ ID NO: 673073 - RNA, 12 nt, Human
cuucaacucccu

SEQ ID NO: 673074 - RNA, 16 nt, Human
uagcuacuaauuuuaa

SEQ ID NO: 673075 - RNA, 20 nt, Human
cacuagacccacuggacuca

SEQ ID NO: 673076 - RNA, 15 nt, Human
cagccagcacagccu

SEQ ID NO: 673077 - RNA, 18 nt, Human
ugagaaggagcucccagg

SEQ ID NO: 673078 - RNA, 20 nt, Human
aagggcuguuauaaucuuuc

SEQ ID NO: 673079 - RNA, 23 nt, Human
uuuauauuucuguuaaaauauau

SEQ ID NO: 673080 - RNA, 22 nt, Human
gauaaaagacagugaaagaaaa

SEQ ID NO: 673081 - RNA, 16 nt, Human
uauaucaauuuaaaaa

SEQ ID NO: 673082 - RNA, 15 nt, Human
guuucuuccuuuuuu

SEQ ID NO: 673083 - RNA, 11 nt, Human
ugcagugagcc

SEQ ID NO: 673084 - RNA, 16 nt, Human
auccaaugaaaugagu

SEQ ID NO: 673085 - RNA, 22 nt, Human
gaugggaacaaggaaggaaaga

SEQ ID NO: 673086 - RNA, 21 nt, Human
ccauccugccccugagcccau

SEQ ID NO: 673087 - RNA, 16 nt, Human
ccaccugcugagcccc

SEQ ID NO: 673088 - RNA, 15 nt, Human
agccccugggaccag

SEQ ID NO: 673089 - RNA, 18 nt, Human
gaugccccgucccccucu

SEQ ID NO: 673090 - RNA, 14 nt, Human
caggcacaguggcu

SEQ ID NO: 673091 - RNA, 23 nt, Human
ccccucuggcuccagcuggccgg

SEQ ID NO: 673092 - RNA, 18 nt, Human
acugugugcuaaaacaag

SEQ ID NO: 673093 - RNA, 22 nt, Human
agccaaacauccuacaagacac

SEQ ID NO: 673094 - RNA, 16 nt, Human
guuucacaccuuaucu

SEQ ID NO: 673095 - RNA, 17 nt, Human
ucagcguuaauguaaag

SEQ ID NO: 673096 - RNA, 23 nt, Human
cuggccgggagccugaucaccug

SEQ ID NO: 673097 - RNA, 16 nt, Human
agagguccacaacaca

SEQ ID NO: 673098 - RNA, 15 nt, Human
uuuuuaguucuucaa

SEQ ID NO: 673099 - RNA, 12 nt, Human
gcaacaugguga

SEQ ID NO: 673100 - RNA, 15 nt, Human
ugcuugucccugugg

SEQ ID NO: 673101 - RNA, 21 nt, Human
uucagcucagcuaaugaagug

SEQ ID NO: 673102 - RNA, 23 nt, Human
cccagcccuccuuaucaaaggac

SEQ ID NO: 673103 - RNA, 14 nt, Human
caccucagcugccu

SEQ ID NO: 673104 - RNA, 18 nt, Human
aauuuuagacauucuuua

SEQ ID NO: 673105 - RNA, 19 nt, Human
agaugcuagaacucccuuu

SEQ ID NO: 673106 - RNA, 15 nt, Human
aaucagagauaaagc

SEQ ID NO: 673107 - RNA, 14 nt, Human
cguguccccuaucc

SEQ ID NO: 673108 - RNA, 19 nt, Human
uauguagaauauauuuccu

SEQ ID NO: 673109 - RNA, 21 nt, Human
gccucagggugcacacaggau

SEQ ID NO: 673110 - RNA, 20 nt, Human
caagcucuaucaccaaggag

SEQ ID NO: 673111 - RNA, 21 nt, Human
cgaaguauccuucagccugaa

SEQ ID NO: 673112 - RNA, 18 nt, Human
acacuguuaucuucacuu

SEQ ID NO: 673113 - RNA, 15 nt, Human
gaucuggcucuggac

SEQ ID NO: 673114 - RNA, 15 nt, Human
augguuguauuauuu

SEQ ID NO: 673115 - RNA, 22 nt, Human
uuauaagaaauaggaaauauuu

SEQ ID NO: 673116 - RNA, 15 nt, Human
gucucuugaggcaca

SEQ ID NO: 673117 - RNA, 11 nt, Human
ucaccugcccu

SEQ ID NO: 673118 - RNA, 14 nt, Human
auauuugaaauauu

SEQ ID NO: 673119 - RNA, 12 nt, Human
ucuacacuccag

SEQ ID NO: 673120 - RNA, 16 nt, Human
ucucuaccaaaaaaag

SEQ ID NO: 673121 - RNA, 13 nt, Human
aaauaaaaauaau

SEQ ID NO: 673122 - RNA, 14 nt, Human
gagguaccagccuu

SEQ ID NO: 673123 - RNA, 21 nt, Human
cuccccagcucuaucccaacc

SEQ ID NO: 673124 - RNA, 22 nt, Human
ggacagcccuucuuuccacaga

SEQ ID NO: 673125 - RNA, 16 nt, Human
ugagaugcuagaacuc

SEQ ID NO: 673126 - RNA, 18 nt, Human
uuuucaauaaaacuuuuc

SEQ ID NO: 673127 - RNA, 13 nt, Human
ucagccagcccuc

SEQ ID NO: 673128 - RNA, 20 nt, Human
cugagguuguguguggaagg

SEQ ID NO: 673129 - RNA, 24 nt, Human
aacuauaaaacuaggugcugcagc

SEQ ID NO: 673130 - RNA, 14 nt, Human
aaugauuaugaauu

SEQ ID NO: 673131 - RNA, 16 nt, Human
ugacuuaaugccacua

SEQ ID NO: 673132 - RNA, 18 nt, Human
ucucuaggaaauauuuau

SEQ ID NO: 673133 - RNA, 17 nt, Human
cauaaaauacaaaaacu

SEQ ID NO: 673134 - RNA, 19 nt, Human
cagcacgggggccaaggau

SEQ ID NO: 673135 - RNA, 15 nt, Human
caaaaaaaggaagga

SEQ ID NO: 673136 - RNA, 19 nt, Human
acucugcaagaagaaauca

SEQ ID NO: 673137 - RNA, 21 nt, Human
gaaaaaaagcuuuuuuugaau

SEQ ID NO: 673138 - RNA, 19 nt, Human
gauaaagcuuaggucaaag

SEQ ID NO: 673139 - RNA, 20 nt, Human
acaccuuaucuauguagaau

SEQ ID NO: 673140 - RNA, 21 nt, Human
uggggaauauguuagagaauu

SEQ ID NO: 673141 - RNA, 17 nt, Human
gauaucuucagaaaacc

SEQ ID NO: 673142 - RNA, 12 nt, Human
accuucucaccu

SEQ ID NO: 673143 - RNA, 21 nt, Human
augcuacaggauuugaaauug

SEQ ID NO: 673144 - RNA, 12 nt, Human
caucaggaaaga

SEQ ID NO: 673145 - RNA, 22 nt, Human
gcagagagguagggauggggcu

SEQ ID NO: 673146 - RNA, 15 nt, Human
gccccugcacuccag

SEQ ID NO: 673147 - RNA, 23 nt, Human
caucaacagauaaauaguuuaug

SEQ ID NO: 673148 - RNA, 15 nt, Human
uguuaaaugauuuca

SEQ ID NO: 673149 - RNA, 19 nt, Human
cagcuacuugggaggcuga

SEQ ID NO: 673150 - RNA, 13 nt, Human
acuuauuggaaug

SEQ ID NO: 673151 - RNA, 19 nt, Human
uccauccugaggcuccacu

SEQ ID NO: 673152 - RNA, 16 nt, Human
ugagccaaauguaaaa

SEQ ID NO: 673153 - RNA, 16 nt, Human
cccccagcccuccuua

SEQ ID NO: 673154 - RNA, 20 nt, Human
aaucuuucacaggggacagg

SEQ ID NO: 673155 - RNA, 15 nt, Human
ccugagcggaccuuc

SEQ ID NO: 673156 - RNA, 17 nt, Human
ccacugcagaagacagu

SEQ ID NO: 673157 - RNA, 19 nt, Human
cuuggggccuaugcagagg

SEQ ID NO: 673158 - RNA, 16 nt, Human
ucagcagagaaguuuu

SEQ ID NO: 673159 - RNA, 20 nt, Human
caagccuccuuuuaaaguaa

SEQ ID NO: 673160 - RNA, 13 nt, Human
caagaaggaaaga

SEQ ID NO: 673161 - RNA, 16 nt, Human
acaaaaggaaugugua

SEQ ID NO: 673162 - RNA, 15 nt, Human
aauaaauaaauaaaa

SEQ ID NO: 673163 - RNA, 19 nt, Human
cugacugcuaguuuauaua

SEQ ID NO: 673164 - RNA, 13 nt, Human
guggaaaaacaga

SEQ ID NO: 673165 - RNA, 14 nt, Human
ugacacuuaaaaau

SEQ ID NO: 673166 - RNA, 21 nt, Human
caauuuuguuauguauauuuu

SEQ ID NO: 673167 - RNA, 19 nt, Human
uaggggggucagccagccc

SEQ ID NO: 673168 - RNA, 18 nt, Human
gcagugucugcuggagac

SEQ ID NO: 673169 - RNA, 17 nt, Human
accugagccccaaaagg

SEQ ID NO: 673170 - RNA, 18 nt, Human
ggccacaucugagccccg

SEQ ID NO: 673171 - RNA, 15 nt, Human
ccagauccuggaaau

SEQ ID NO: 673172 - RNA, 14 nt, Human
cucuugaggcacag

SEQ ID NO: 673173 - RNA, 17 nt, Human
cucuuuugggauuuuug

SEQ ID NO: 673174 - RNA, 22 nt, Human
uucccagcuagaauucacucca

SEQ ID NO: 673175 - RNA, 19 nt, Human
ucaauucuugccaaauaua

SEQ ID NO: 673176 - RNA, 12 nt, Human
agaaaacaauaa

SEQ ID NO: 673177 - RNA, 22 nt, Human
agggagucucagcuucacccug

SEQ ID NO: 673178 - RNA, 12 nt, Human
ucaagaagcauc

SEQ ID NO: 673179 - RNA, 18 nt, Human
uauaggauguggggaagu

SEQ ID NO: 673180 - RNA, 15 nt, Human
ugagcgcccacuaga

SEQ ID NO: 673181 - RNA, 23 nt, Human
ucacagaaugacugacaaagaca

SEQ ID NO: 673182 - RNA, 12 nt, Human
uaccuccaagga

SEQ ID NO: 673183 - RNA, 14 nt, Human
cuugagguaaaagc

SEQ ID NO: 673184 - RNA, 11 nt, Human
auuuaaaaauc

SEQ ID NO: 673185 - RNA, 21 nt, Human
gccuuuucccaacuccagaaa

SEQ ID NO: 673186 - RNA, 19 nt, Human
auuguaguccuguaaugga

SEQ ID NO: 673187 - RNA, 16 nt, Human
aaguauaggccaggca

SEQ ID NO: 673188 - RNA, 23 nt, Human
gccugagcggaccuucccagcua

SEQ ID NO: 673189 - RNA, 16 nt, Human
aauuuuuaauuauaug

SEQ ID NO: 673190 - RNA, 16 nt, Human
uuuuagugaaauauua

SEQ ID NO: 673191 - RNA, 23 nt, Human
aaaaugggcuuuggaugauuauu

SEQ ID NO: 673192 - RNA, 20 nt, Human
aguuuuuuuuuaaaaaagaa

SEQ ID NO: 673193 - RNA, 16 nt, Human
caaaguugauuaagaa

SEQ ID NO: 673194 - RNA, 20 nt, Human
ccagcuggccgggagccuga

SEQ ID NO: 673195 - RNA, 21 nt, Human
cccacuggacucaccuccccc

SEQ ID NO: 673196 - RNA, 13 nt, Human
aacaagccuccuu

SEQ ID NO: 673197 - RNA, 19 nt, Human
agaucuacaugucuagaga

SEQ ID NO: 673198 - RNA, 13 nt, Human
uaagugcagcccc

SEQ ID NO: 673199 - RNA, 14 nt, Human
cuaucaauccaaga

SEQ ID NO: 673200 - RNA, 20 nt, Human
aaaguugauuaagaaaggaa

SEQ ID NO: 673201 - RNA, 16 nt, Human
auuccuuaagauauua

SEQ ID NO: 673202 - RNA, 21 nt, Human
cccccucuggcuccagcuggc

SEQ ID NO: 673203 - RNA, 20 nt, Human
ccuccugccuaagugcagcc

SEQ ID NO: 673204 - RNA, 15 nt, Human
agggaagacaagaag

SEQ ID NO: 673205 - RNA, 17 nt, Human
cucugauccgagcucag

SEQ ID NO: 673206 - RNA, 16 nt, Human
ucuucugacacuaaaa

SEQ ID NO: 673207 - RNA, 14 nt, Human
cuguaaucacagcu

SEQ ID NO: 673208 - RNA, 23 nt, Human
cucuacuaaaaauacaaaaaaaa

SEQ ID NO: 673209 - RNA, 23 nt, Human
ugaaaugaguuuuucuuuucauu

SEQ ID NO: 673210 - RNA, 15 nt, Human
cugcuacuaucuguu

SEQ ID NO: 673211 - RNA, 16 nt, Human
uccucacuuugaagag

SEQ ID NO: 673212 - RNA, 14 nt, Human
gcagaucacuugag

SEQ ID NO: 673213 - RNA, 22 nt, Human
aaggagaggcaaagaaaggaga

SEQ ID NO: 673214 - RNA, 20 nt, Human
gaccauacuaauuauacccc

SEQ ID NO: 673215 - RNA, 18 nt, Human
aagaaauaggaaauauuu

SEQ ID NO: 673216 - RNA, 16 nt, Human
gagcucgugggacagu

SEQ ID NO: 673217 - RNA, 20 nt, Human
uuucuuccuggauuccucac

SEQ ID NO: 673218 - RNA, 15 nt, Human
cagcuggccuuguga

SEQ ID NO: 673219 - RNA, 23 nt, Human
uugacccucacaggagcaucucc

SEQ ID NO: 673220 - RNA, 18 nt, Human
uucaauaucuuuuuuuua

SEQ ID NO: 673221 - RNA, 19 nt, Human
auguuccuuuuaaagaaac

SEQ ID NO: 673222 - RNA, 16 nt, Human
acuuuuauaagaaaua

SEQ ID NO: 673223 - RNA, 14 nt, Human
auauuuauuuuaau

SEQ ID NO: 673224 - RNA, 22 nt, Human
ucauucccguugaacgucacau

SEQ ID NO: 673225 - RNA, 15 nt, Human
uaugcuuguaacugu

SEQ ID NO: 673226 - RNA, 17 nt, Human
cucaugagggcuggaug

SEQ ID NO: 673227 - RNA, 23 nt, Human
caacacccugagguugugugugg

SEQ ID NO: 673228 - RNA, 17 nt, Human
aaagcagggacuugaac

SEQ ID NO: 673229 - RNA, 17 nt, Human
gaaugagagacacacug

SEQ ID NO: 673230 - RNA, 19 nt, Human
cuagucuguuuucccuccu

SEQ ID NO: 673231 - RNA, 23 nt, Human
uagauguauagguugaugguggu

SEQ ID NO: 673232 - RNA, 21 nt, Human
aagaaauaggaaauauuuuaa

SEQ ID NO: 673233 - RNA, 15 nt, Human
ucagucucccucccu

SEQ ID NO: 673234 - RNA, 15 nt, Human
gaaagaaaauaacga

SEQ ID NO: 673235 - RNA, 22 nt, Human
uuuauaagaaauaggaaauauu

SEQ ID NO: 673236 - RNA, 13 nt, Human
uaagaaaggaagu

SEQ ID NO: 673237 - RNA, 23 nt, Human
gaaugagagacacacugaagaag

SEQ ID NO: 673238 - RNA, 20 nt, Human
aaagagugaaggauuuaugu

SEQ ID NO: 673239 - RNA, 18 nt, Human
agauccccaagccuggca

SEQ ID NO: 673240 - RNA, 13 nt, Human
uuguaacugucuu

SEQ ID NO: 673241 - RNA, 16 nt, Human
guucugcacacagcac

SEQ ID NO: 673242 - RNA, 15 nt, Human
ucaguuuuugugaaa

SEQ ID NO: 673243 - RNA, 21 nt, Human
aguuagcuuucuuccuggauu

SEQ ID NO: 673244 - RNA, 18 nt, Human
aucuacacuccagugaga

SEQ ID NO: 673245 - RNA, 19 nt, Human
gcugaugggcaaaaaacca

SEQ ID NO: 673246 - RNA, 12 nt, Human
auaacuggaaac

SEQ ID NO: 673247 - RNA, 11 nt, Human
aacauuuaugu

SEQ ID NO: 673248 - RNA, 16 nt, Human
gucauuauuaggaagu

SEQ ID NO: 673249 - RNA, 19 nt, Human
guaguccuguaauggaagc

SEQ ID NO: 673250 - RNA, 23 nt, Human
auacaguggagacaucuggaaag

SEQ ID NO: 673251 - RNA, 19 nt, Human
uuuuaucugcuaugcuauu

SEQ ID NO: 673252 - RNA, 17 nt, Human
gccccccagcccuccuu

SEQ ID NO: 673253 - RNA, 22 nt, Human
aagacccaaaaggcagaagcaa

SEQ ID NO: 673254 - RNA, 23 nt, Human
gauauuaaccaggggccaugaau

SEQ ID NO: 673255 - RNA, 19 nt, Human
uaucacuugucaauaaaau

SEQ ID NO: 673256 - RNA, 18 nt, Human
uucucuaggaaauauuua

SEQ ID NO: 673257 - RNA, 16 nt, Human
ccugccccccagcccu

SEQ ID NO: 673258 - RNA, 17 nt, Human
agguccacaacacacag

SEQ ID NO: 673259 - RNA, 18 nt, Human
gcaggaggaucacuugag

SEQ ID NO: 673260 - RNA, 16 nt, Human
gccucagucucccucc

SEQ ID NO: 673261 - RNA, 21 nt, Human
uuccugacugcuaguuuauau

SEQ ID NO: 673262 - RNA, 20 nt, Human
aaauccuugaagauuuacca

SEQ ID NO: 673263 - RNA, 14 nt, Human
ugcuagaacucccu

SEQ ID NO: 673264 - RNA, 15 nt, Human
cuagaauucacucca

SEQ ID NO: 673265 - RNA, 20 nt, Human
cuuuuuuaguucuucaaaga

SEQ ID NO: 673266 - RNA, 15 nt, Human
cuuuucccaacucca

SEQ ID NO: 673267 - RNA, 15 nt, Human
agcagugccaaaaua

SEQ ID NO: 673268 - RNA, 12 nt, Human
aucguguccccu

SEQ ID NO: 673269 - RNA, 15 nt, Human
gauuaagaaaggaag

SEQ ID NO: 673270 - RNA, 19 nt, Human
aauaaaacuuuuccaauga

SEQ ID NO: 673271 - RNA, 20 nt, Human
agcagcccuuagcccuuccc

SEQ ID NO: 673272 - RNA, 13 nt, Human
cucugcagcuucc

SEQ ID NO: 673273 - RNA, 14 nt, Human
auaaauaaauaaaa

SEQ ID NO: 673274 - RNA, 17 nt, Human
gacagucaccucaugga

SEQ ID NO: 673275 - RNA, 15 nt, Human
caggaaguagaggag

SEQ ID NO: 673276 - RNA, 14 nt, Human
ggccgggagccuga

SEQ ID NO: 673277 - RNA, 16 nt, Human
uagaauauauuuccuu

SEQ ID NO: 673278 - RNA, 19 nt, Human
gaaugggggcagcaccucc

SEQ ID NO: 673279 - RNA, 19 nt, Human
uguucaugcccauaccccu

SEQ ID NO: 673280 - RNA, 15 nt, Human
uuuaugguuguauua

SEQ ID NO: 673281 - RNA, 16 nt, Human
gacaaggaaaaaauaa

SEQ ID NO: 673282 - RNA, 23 nt, Human
aaauuuacagagacagaaagcag

SEQ ID NO: 673283 - RNA, 18 nt, Human
aaaucuuauaauuuaaaa

SEQ ID NO: 673284 - RNA, 14 nt, Human
cucaacucugagug

SEQ ID NO: 673285 - RNA, 20 nt, Human
uggaaacacauguuccccuu

SEQ ID NO: 673286 - RNA, 13 nt, Human
ucccaaguaaaug

SEQ ID NO: 673287 - RNA, 14 nt, Human
accugggccauagu

SEQ ID NO: 673288 - RNA, 21 nt, Human
caacacaucaggaaagagagc

SEQ ID NO: 673289 - RNA, 18 nt, Human
agcaaaauuuuuucucua

SEQ ID NO: 673290 - RNA, 13 nt, Human
auccugaggcucc

SEQ ID NO: 673291 - RNA, 23 nt, Human
aaaaacagaccgggguucccgug

SEQ ID NO: 673292 - RNA, 16 nt, Human
auuucaaaaaaaaacc

SEQ ID NO: 673293 - RNA, 14 nt, Human
cagucucccucccu

SEQ ID NO: 673294 - RNA, 20 nt, Human
gaauucauucacucaacaaa

SEQ ID NO: 673295 - RNA, 22 nt, Human
agaauuuuaugcggcauuuucu

SEQ ID NO: 673296 - RNA, 12 nt, Human
uuuuuuuuaaaa

SEQ ID NO: 673297 - RNA, 19 nt, Human
acauauagcagcucuugaa

SEQ ID NO: 673298 - RNA, 12 nt, Human
augaccaacauc

SEQ ID NO: 673299 - RNA, 21 nt, Human
ggucaagaagcaucgugucug

SEQ ID NO: 673300 - RNA, 20 nt, Human
cccugcacuccagccugagc

SEQ ID NO: 673301 - RNA, 15 nt, Human
uccaaugacauuuug

SEQ ID NO: 673302 - RNA, 18 nt, Human
aaacugccaucauuuacu

SEQ ID NO: 673303 - RNA, 16 nt, Human
uucacauuuaaauaaa

SEQ ID NO: 673304 - RNA, 23 nt, Human
gaacaugagccuuuguugcuauc

SEQ ID NO: 673305 - RNA, 18 nt, Human
cagaucaagccugccuca

SEQ ID NO: 673306 - RNA, 23 nt, Human
uccacaaguaaaaggaaaugcuc

SEQ ID NO: 673307 - RNA, 22 nt, Human
aaucacuggcuguuaaucuuuc

SEQ ID NO: 673308 - RNA, 13 nt, Human
aggccuggugugu

SEQ ID NO: 673309 - RNA, 20 nt, Human
augucgucaaagcugaaaug

SEQ ID NO: 673310 - RNA, 20 nt, Human
gauaccaugaugcugagccc

SEQ ID NO: 673311 - RNA, 10 nt, Human
agcuuugagg

SEQ ID NO: 673312 - RNA, 21 nt, Human
auauaugcuaagucuuauaua

SEQ ID NO: 673313 - RNA, 18 nt, Human
gccuuggauacuccaugg

SEQ ID NO: 673314 - RNA, 12 nt, Human
agggauggggcu

SEQ ID NO: 673315 - RNA, 15 nt, Human
ccacaucugagcccc

SEQ ID NO: 673316 - RNA, 13 nt, Human
gugcugcagcccc

SEQ ID NO: 673317 - RNA, 20 nt, Human
gggcaagagagcgagacccu

SEQ ID NO: 673318 - RNA, 13 nt, Human
uuauucacaagac

SEQ ID NO: 673319 - RNA, 17 nt, Human
gugggauacuauuuaau

SEQ ID NO: 673320 - RNA, 17 nt, Human
uccacaacacacagauu

SEQ ID NO: 673321 - RNA, 15 nt, Human
agaauaccacaggaa

SEQ ID NO: 673322 - RNA, 17 nt, Human
aaaguacaagagcuuaa

SEQ ID NO: 673323 - RNA, 21 nt, Human
gcagcauuguuggcuguuccu

SEQ ID NO: 673324 - RNA, 14 nt, Human
gagaggcaaagaaa

SEQ ID NO: 673325 - RNA, 18 nt, Human
cugagucccaggcugagc

SEQ ID NO: 673326 - RNA, 20 nt, Human
uaaaagacagugaaagaaaa

SEQ ID NO: 673327 - RNA, 16 nt, Human
ucuaaaaguuuaaguu

SEQ ID NO: 673328 - RNA, 14 nt, Human
cucaccccuugcca

SEQ ID NO: 673329 - RNA, 22 nt, Human
aaugggcacaggguuuauguuu

SEQ ID NO: 673330 - RNA, 16 nt, Human
agaacuaaaaauuaaa

SEQ ID NO: 673331 - RNA, 13 nt, Human
gaccagccugguc

SEQ ID NO: 673332 - RNA, 23 nt, Human
uuuccaucaaggguacacugccu

SEQ ID NO: 673333 - RNA, 17 nt, Human
aggguguguaaguagau

SEQ ID NO: 673334 - RNA, 16 nt, Human
guuuuguuucuuccuu

SEQ ID NO: 673335 - RNA, 17 nt, Human
aaauccuacuuucauaa

SEQ ID NO: 673336 - RNA, 22 nt, Human
gcuaaaacaagcacuaaacaaa

SEQ ID NO: 673337 - RNA, 17 nt, Human
cugagaugggagaauca

SEQ ID NO: 673338 - RNA, 11 nt, Human
caacucccugc

SEQ ID NO: 673339 - RNA, 22 nt, Human
aauaagucaucugaugagaaca

SEQ ID NO: 673340 - RNA, 19 nt, Human
augaaguacucauacaugu

SEQ ID NO: 673341 - RNA, 19 nt, Human
guacaagagcuuaacagug

SEQ ID NO: 673342 - RNA, 16 nt, Human
ugugagaugcuagaac

SEQ ID NO: 673343 - RNA, 15 nt, Human
acuuuauaaaggauu

SEQ ID NO: 673344 - RNA, 21 nt, Human
aauauauuuccuuauucagaa

SEQ ID NO: 673345 - RNA, 14 nt, Human
cagccccugggacc

SEQ ID NO: 673346 - RNA, 12 nt, Human
uauauuuccuua

SEQ ID NO: 673347 - RNA, 13 nt, Human
aacucuauaaugu

SEQ ID NO: 673348 - RNA, 18 nt, Human
uuggggccuaugcagagg

SEQ ID NO: 673349 - RNA, 15 nt, Human
ccuugccaugugcua

SEQ ID NO: 673350 - RNA, 22 nt, Human
cuucagaaaaccuaagcaaacu

SEQ ID NO: 673351 - RNA, 22 nt, Human
accccugagcuugcagagauga

SEQ ID NO: 673352 - RNA, 22 nt, Human
auauuuccuuauucagaauuuc

SEQ ID NO: 673353 - RNA, 23 nt, Human
agcuggaaacacauguuccccuu

SEQ ID NO: 673354 - RNA, 14 nt, Human
aaaacuuauuggaa

SEQ ID NO: 673355 - RNA, 21 nt, Human
cuguguccucaugagggcugg

SEQ ID NO: 673356 - RNA, 18 nt, Human
cacuccagugagacagcu

SEQ ID NO: 673357 - RNA, 19 nt, Human
gcaggcacugccaaaacau

SEQ ID NO: 673358 - RNA, 13 nt, Human
uauuuaauuauuu

SEQ ID NO: 673359 - RNA, 19 nt, Human
aaauaugccccauucaaca

SEQ ID NO: 673360 - RNA, 13 nt, Human
aggauuugaaauu

SEQ ID NO: 673361 - RNA, 16 nt, Human
cuucacuguaaaauaa

SEQ ID NO: 673362 - RNA, 18 nt, Human
aaauauaaauaaaaauaa

SEQ ID NO: 673363 - RNA, 22 nt, Human
gcuugcagagaugaggccgcca

SEQ ID NO: 673364 - RNA, 12 nt, Human
aagaaaggaagu

SEQ ID NO: 673365 - RNA, 22 nt, Human
agaaugagagacacacugaaga

SEQ ID NO: 673366 - RNA, 17 nt, Human
aauaaaguguuugaaag

SEQ ID NO: 673367 - RNA, 21 nt, Human
cagccccugggaccaggcacc

SEQ ID NO: 673368 - RNA, 18 nt, Human
uagcccuuccccucugca

SEQ ID NO: 673369 - RNA, 23 nt, Human
gggccuaugcagagguccacaac

SEQ ID NO: 673370 - RNA, 16 nt, Human
cuucugggcagacucu

SEQ ID NO: 673371 - RNA, 15 nt, Human
gccucagucucccuc

SEQ ID NO: 673372 - RNA, 17 nt, Human
cacaccaaccuucugag

SEQ ID NO: 673373 - RNA, 18 nt, Human
gcacuccagccugagcga

SEQ ID NO: 673374 - RNA, 22 nt, Human
aaacguauucaaacaauuugaa

SEQ ID NO: 673375 - RNA, 20 nt, Human
auaauccuaaacauaugaau

SEQ ID NO: 673376 - RNA, 23 nt, Human
uguugcccacagcuguaugauuc

SEQ ID NO: 673377 - RNA, 13 nt, Human
agggagggaaggg

SEQ ID NO: 673378 - RNA, 17 nt, Human
ugaauauaaauuuauca

SEQ ID NO: 673379 - RNA, 13 nt, Human
ugccagcuggccu

SEQ ID NO: 673380 - RNA, 11 nt, Human
aauaaauaaau

SEQ ID NO: 673381 - RNA, 19 nt, Human
ggacucaccucccccaucu

SEQ ID NO: 673382 - RNA, 19 nt, Human
gcuccagugauaagagaug

SEQ ID NO: 673383 - RNA, 10 nt, Human
accugagccc

SEQ ID NO: 673384 - RNA, 22 nt, Human
uaauaucuuaucuuccuauaau

SEQ ID NO: 673385 - RNA, 16 nt, Human
ggggcagcaccuccua

SEQ ID NO: 673386 - RNA, 19 nt, Human
ugggacaggggagaaccua

SEQ ID NO: 673387 - RNA, 17 nt, Human
guuccuuuuaaagaaac

SEQ ID NO: 673388 - RNA, 17 nt, Human
ugaaggauuuauguuua

SEQ ID NO: 673389 - RNA, 22 nt, Human
aggacaccauuuuggcaagcuc

SEQ ID NO: 673390 - RNA, 17 nt, Human
cuccuuaucaaaggaca

SEQ ID NO: 673391 - RNA, 22 nt, Human
acacauaucaaacugaaacaaa

SEQ ID NO: 673392 - RNA, 17 nt, Human
ucgcagacacaugugcu

SEQ ID NO: 673393 - RNA, 22 nt, Human
agaaagugacaagcucacagac

SEQ ID NO: 673394 - RNA, 13 nt, Human
ugaauauaaauuu

SEQ ID NO: 673395 - RNA, 16 nt, Human
ucaguuuuugugaaaa

SEQ ID NO: 673396 - RNA, 21 nt, Human
cuauguucuaagaagugaaaa

SEQ ID NO: 673397 - RNA, 17 nt, Human
caauaaauaaauaaaua

SEQ ID NO: 673398 - RNA, 21 nt, Human
auguuuacagauccccaagcc

SEQ ID NO: 673399 - RNA, 23 nt, Human
acugcuaguuuauauagaaaugu

SEQ ID NO: 673400 - RNA, 19 nt, Human
cccccucuggcuccagcug

SEQ ID NO: 673401 - RNA, 15 nt, Human
cuccagggagucuca

SEQ ID NO: 673402 - RNA, 22 nt, Human
augguuguauuauuuuuuaaaa

SEQ ID NO: 673403 - RNA, 17 nt, Human
uugccaaauauaaauaa

SEQ ID NO: 673404 - RNA, 19 nt, Human
uauauuuuuuguuaaauga

SEQ ID NO: 673405 - RNA, 23 nt, Human
aauaauccucaguuuuugugaaa

SEQ ID NO: 673406 - RNA, 22 nt, Human
aucuucacuuuuauaagaaaua

SEQ ID NO: 673407 - RNA, 20 nt, Human
ugagagugaacaaauuuaca

SEQ ID NO: 673408 - RNA, 14 nt, Human
gaucaagccugccu

SEQ ID NO: 673409 - RNA, 16 nt, Human
uauucagaauuucuaa

SEQ ID NO: 673410 - RNA, 19 nt, Human
ucugagcauuuaauaugga

SEQ ID NO: 673411 - RNA, 20 nt, Human
uuaaguuuuuuuuuaaaaaa

SEQ ID NO: 673412 - RNA, 19 nt, Human
uggcaagcucuaucaccaa

SEQ ID NO: 673413 - RNA, 23 nt, Human
uguagguagaucuggucuuuaga

SEQ ID NO: 673414 - RNA, 22 nt, Human
acuuugauuuuauaugcuauuu

SEQ ID NO: 673415 - RNA, 15 nt, Human
auauuuuuuguuaaa

SEQ ID NO: 673416 - RNA, 18 nt, Human
acagucucuugaggcaca

SEQ ID NO: 673417 - RNA, 20 nt, Human
cuggccuucggccuccaucc

SEQ ID NO: 673418 - RNA, 23 nt, Human
agaaugauuaugaauuacauuug

SEQ ID NO: 673419 - RNA, 20 nt, Human
caaacauccuacaagacaca

SEQ ID NO: 673420 - RNA, 16 nt, Human
aaacuaggugcugcag

SEQ ID NO: 673421 - RNA, 18 nt, Human
aaacaaaauuagaaaugu

SEQ ID NO: 673422 - RNA, 15 nt, Human
gacaugggccccaga

SEQ ID NO: 673423 - RNA, 13 nt, Human
uccugugggaccu

SEQ ID NO: 673424 - RNA, 18 nt, Human
gccugagcgacagugaga

SEQ ID NO: 673425 - RNA, 23 nt, Human
agucccagaucaagccugccuca

SEQ ID NO: 673426 - RNA, 17 nt, Human
ccaaggaugccccgucc

SEQ ID NO: 673427 - RNA, 17 nt, Human
auuagcauggccacauc

SEQ ID NO: 673428 - RNA, 21 nt, Human
aggcauccaaaggcuccugag

SEQ ID NO: 673429 - RNA, 17 nt, Human
ucuaccaaaaaaaggaa

SEQ ID NO: 673430 - RNA, 10 nt, Human
auguuuucag

SEQ ID NO: 673431 - RNA, 22 nt, Human
aauuacauuuguauaaaauaau

SEQ ID NO: 673432 - RNA, 12 nt, Human
aucuucacuuuu

SEQ ID NO: 673433 - RNA, 11 nt, Human
auuaaaaccuc

SEQ ID NO: 673434 - RNA, 17 nt, Human
gaagcaccaaucaugaa

SEQ ID NO: 673435 - RNA, 20 nt, Human
uauguccuuggugccuggag

SEQ ID NO: 673436 - RNA, 17 nt, Human
cucguggaacaguuacc

SEQ ID NO: 673437 - RNA, 22 nt, Human
aguauguuagugcaaauuguca

SEQ ID NO: 673438 - RNA, 15 nt, Human
cuguauguccuuggu

SEQ ID NO: 673439 - RNA, 19 nt, Human
auuguaggugacuauuaua

SEQ ID NO: 673440 - RNA, 18 nt, Human
uuuugugaagcaaaauuu

SEQ ID NO: 673441 - RNA, 22 nt, Human
ucuacuaaaaauacaaaaaaaa

SEQ ID NO: 673442 - RNA, 15 nt, Human
auaauccuaaacaua

SEQ ID NO: 673443 - RNA, 14 nt, Human
gugagcuacaaaug

SEQ ID NO: 673444 - RNA, 17 nt, Human
acuaggugcugcagccc

SEQ ID NO: 673445 - RNA, 17 nt, Human
ucuauaauguguucauu

SEQ ID NO: 673446 - RNA, 17 nt, Human
uggcuaagcaaaaugug

SEQ ID NO: 673447 - RNA, 23 nt, Human
agccaccaguccauugggcaggc

SEQ ID NO: 673448 - RNA, 14 nt, Human
gaggcacagaaacu

SEQ ID NO: 673449 - RNA, 16 nt, Human
agaugcuagaacuccc

SEQ ID NO: 673450 - RNA, 17 nt, Human
ucuuucacauuuaaaua

SEQ ID NO: 673451 - RNA, 20 nt, Human
uuuuaaagaaacaaaaauca

SEQ ID NO: 673452 - RNA, 23 nt, Human
aguacucauacauguuacaacac

SEQ ID NO: 673453 - RNA, 20 nt, Human
ccugagcggaccuucccagc

SEQ ID NO: 673454 - RNA, 20 nt, Human
cagcuggccgggagccugau

SEQ ID NO: 673455 - RNA, 12 nt, Human
gaagaccucauu

SEQ ID NO: 673456 - RNA, 16 nt, Human
acauuugcucauggaa

SEQ ID NO: 673457 - RNA, 19 nt, Human
aaaauaacaauaaaagaca

SEQ ID NO: 673458 - RNA, 13 nt, Human
uaaaaguuuaagu

SEQ ID NO: 673459 - RNA, 14 nt, Human
cacccugagguugu

SEQ ID NO: 673460 - RNA, 18 nt, Human
uuuucucuccucucccca

SEQ ID NO: 673461 - RNA, 19 nt, Human
accauuuuggcaagcucua

SEQ ID NO: 673462 - RNA, 18 nt, Human
aaaguugauuaagaaagg

SEQ ID NO: 673463 - RNA, 17 nt, Human
acucugcaagaagaaau

SEQ ID NO: 673464 - RNA, 22 nt, Human
gcacagccucuuagaugcaguu

SEQ ID NO: 673465 - RNA, 18 nt, Human
uauguuccuuuuaaagaa

SEQ ID NO: 673466 - RNA, 16 nt, Human
gacaagcucacagacc

SEQ ID NO: 673467 - RNA, 22 nt, Human
uuguaacaagccuccuuuuaaa

SEQ ID NO: 673468 - RNA, 19 nt, Human
ggagccugaucaccugccc

SEQ ID NO: 673469 - RNA, 23 nt, Human
auucaauaucuuuuuuuuaauaa

SEQ ID NO: 673470 - RNA, 17 nt, Human
acacuguuaucuucacu

SEQ ID NO: 673471 - RNA, 19 nt, Human
gccugaucaccugcccugc

SEQ ID NO: 673472 - RNA, 16 nt, Human
auuccaccuacaugag

SEQ ID NO: 673473 - RNA, 23 nt, Human
gaaaaaguucugcagauaaacag

SEQ ID NO: 673474 - RNA, 13 nt, Human
ggugugugcagca

SEQ ID NO: 673475 - RNA, 18 nt, Human
auaucaaacugaaacaaa

SEQ ID NO: 673476 - RNA, 15 nt, Human
uaacgauaaaagaca

SEQ ID NO: 673477 - RNA, 21 nt, Human
cuaagcuucacuguaaaauaa

SEQ ID NO: 673478 - RNA, 18 nt, Human
auagaauuaacacaugau

SEQ ID NO: 673479 - RNA, 19 nt, Human
auuuucaguuauuauauuu

SEQ ID NO: 673480 - RNA, 13 nt, Human
aauuuuuauauuu

SEQ ID NO: 673481 - RNA, 12 nt, Human
gaauuggagcuc

SEQ ID NO: 673482 - RNA, 19 nt, Human
aaaaucuuauaauuuaaaa

SEQ ID NO: 673483 - RNA, 15 nt, Human
agggcucacagaauu

SEQ ID NO: 673484 - RNA, 16 nt, Human
auaaauaaauaaaaac

SEQ ID NO: 673485 - RNA, 22 nt, Human
ugggccccagauaccaugaugc

SEQ ID NO: 673486 - RNA, 12 nt, Human
gaugcugagccc

SEQ ID NO: 673487 - RNA, 20 nt, Human
ugaaaaucuuauaauuuaaa

SEQ ID NO: 673488 - RNA, 16 nt, Human
aacgagacaagcagcc

SEQ ID NO: 673489 - RNA, 13 nt, Human
caucgcagacaca

SEQ ID NO: 673490 - RNA, 16 nt, Human
aaguugauuaagaaag

SEQ ID NO: 673491 - RNA, 22 nt, Human
uggaagccagaucuaugccaca

SEQ ID NO: 673492 - RNA, 23 nt, Human
ccagguaccuucucaccugugag

SEQ ID NO: 673493 - RNA, 17 nt, Human
aaccuucugaggagcug

SEQ ID NO: 673494 - RNA, 22 nt, Human
ugugagcucaccagucccuccc

SEQ ID NO: 673495 - RNA, 13 nt, Human
gccuccccagcuc

SEQ ID NO: 673496 - RNA, 14 nt, Human
ucuauaauuuaaau

SEQ ID NO: 673497 - RNA, 17 nt, Human
caaccuucugaggagcu

SEQ ID NO: 673498 - RNA, 22 nt, Human
ugccugagcggaccuucccagc

SEQ ID NO: 673499 - RNA, 15 nt, Human
ugagcggaccuuccc

SEQ ID NO: 673500 - RNA, 14 nt, Human
cagaccgggguucc

SEQ ID NO: 673501 - RNA, 18 nt, Human
acuugccauaaaacuuag

SEQ ID NO: 673502 - RNA, 14 nt, Human
uaauaucuuaucuu

SEQ ID NO: 673503 - RNA, 16 nt, Human
auaaugaauacuuuau

SEQ ID NO: 673504 - RNA, 23 nt, Human
ugauguuucauaagaauucuguu

SEQ ID NO: 673505 - RNA, 14 nt, Human
auugucuagugaaa

SEQ ID NO: 673506 - RNA, 14 nt, Human
uaaauaguuuauga

SEQ ID NO: 673507 - RNA, 23 nt, Human
caagagagcgagacccugucuca

SEQ ID NO: 673508 - RNA, 14 nt, Human
caggaggcauccaa

SEQ ID NO: 673509 - RNA, 16 nt, Human
ugcuaagucuuauaua

SEQ ID NO: 673510 - RNA, 16 nt, Human
agugaaagaaaauaac

SEQ ID NO: 673511 - RNA, 19 nt, Human
agugccuccaaguucaaaa

SEQ ID NO: 673512 - RNA, 14 nt, Human
uucuaugaaauauu

SEQ ID NO: 673513 - RNA, 11 nt, Human
aaaaaaaaacc

SEQ ID NO: 673514 - RNA, 22 nt, Human
cucagcccuggugggcagagag

SEQ ID NO: 673515 - RNA, 14 nt, Human
cuucacccugaggu

SEQ ID NO: 673516 - RNA, 11 nt, Human
caaaaaucaaa

SEQ ID NO: 673517 - RNA, 22 nt, Human
aggaugccccgucccccucugg

SEQ ID NO: 673518 - RNA, 20 nt, Human
agcuucacuguaaaauaaua

SEQ ID NO: 673519 - RNA, 12 nt, Human
cugaggagcugu

SEQ ID NO: 673520 - RNA, 14 nt, Human
uucacauuuaaaua

SEQ ID NO: 673521 - RNA, 17 nt, Human
aauaacgauaaaagaca

SEQ ID NO: 673522 - RNA, 19 nt, Human
ugccucaagcuaugugagc

SEQ ID NO: 673523 - RNA, 16 nt, Human
uauuuuaauguuucuu

SEQ ID NO: 673524 - RNA, 22 nt, Human
cucugagccuugggaccccuga

SEQ ID NO: 673525 - RNA, 13 nt, Human
caucugagccccg

SEQ ID NO: 673526 - RNA, 23 nt, Human
ggaugguucccuugaugaagaag

SEQ ID NO: 673527 - RNA, 18 nt, Human
ugcagugucugcuggaga

SEQ ID NO: 673528 - RNA, 15 nt, Human
auacguuaggaggac

SEQ ID NO: 673529 - RNA, 13 nt, Human
ccucauggaauug

SEQ ID NO: 673530 - RNA, 14 nt, Human
cugcuaguuuauau

SEQ ID NO: 673531 - RNA, 14 nt, Human
uaacuaauuuuaac

SEQ ID NO: 673532 - RNA, 21 nt, Human
aaugugacuuaaugccacuaa

SEQ ID NO: 673533 - RNA, 20 nt, Human
cccuuccuaauuccacagcu

SEQ ID NO: 673534 - RNA, 19 nt, Human
cuucuggguuccuuccucu

SEQ ID NO: 673535 - RNA, 17 nt, Human
uaacgauaaaagacagu

SEQ ID NO: 673536 - RNA, 17 nt, Human
aagacaaggaaaaaaua

SEQ ID NO: 673537 - RNA, 17 nt, Human
aagaaacaaaaaucaaa

SEQ ID NO: 673538 - RNA, 15 nt, Human
uuccaagaaauauuc

SEQ ID NO: 673539 - RNA, 17 nt, Human
auguuucauaagaauuc

SEQ ID NO: 673540 - RNA, 13 nt, Human
acaagaaaugaaa

SEQ ID NO: 673541 - RNA, 16 nt, Human
agauaaggcuguucuu

SEQ ID NO: 673542 - RNA, 12 nt, Human
cuggcuccagcu

SEQ ID NO: 673543 - RNA, 19 nt, Human
uauuuuaauaauguuucaa

SEQ ID NO: 673544 - RNA, 20 nt, Human
caagagccuuuuuuugaaaa

SEQ ID NO: 673545 - RNA, 19 nt, Human
cuccuuggagacagggccc

SEQ ID NO: 673546 - RNA, 21 nt, Human
agucaagggugugugcagcau

SEQ ID NO: 673547 - RNA, 11 nt, Human
aaccugagccc

SEQ ID NO: 673548 - RNA, 21 nt, Human
aacuuguaaaggaauuuaaaa

SEQ ID NO: 673549 - RNA, 14 nt, Human
cuccugagacacau

SEQ ID NO: 673550 - RNA, 16 nt, Human
uaggugcugcagcccc

SEQ ID NO: 673551 - RNA, 20 nt, Human
cuaaaugucaaucagccuag

SEQ ID NO: 673552 - RNA, 21 nt, Human
agaagcuagaaaacaggcaaa

SEQ ID NO: 673553 - RNA, 15 nt, Human
caagcucacagaccu

SEQ ID NO: 673554 - RNA, 14 nt, Human
acuauuauauuucc

SEQ ID NO: 673555 - RNA, 15 nt, Human
gaccacugcagaaga

SEQ ID NO: 673556 - RNA, 13 nt, Human
guuguguguggaa

SEQ ID NO: 673557 - RNA, 16 nt, Human
gaaguaucuugguugu

SEQ ID NO: 673558 - RNA, 20 nt, Human
gccgggcgugguggugagug

SEQ ID NO: 673559 - RNA, 20 nt, Human
aauaucuuuuuuuuaauaaa

SEQ ID NO: 673560 - RNA, 17 nt, Human
uccugccccugagccca

SEQ ID NO: 673561 - RNA, 23 nt, Human
ugaauuacauuuguauaaaauaa

SEQ ID NO: 673562 - RNA, 22 nt, Human
ugaauggcuaagcaaaauguga

SEQ ID NO: 673563 - RNA, 16 nt, Human
uauugggguugggggg

SEQ ID NO: 673564 - RNA, 16 nt, Human
ccauuuuuagugaaau

SEQ ID NO: 673565 - RNA, 13 nt, Human
auagugagacacu

SEQ ID NO: 673566 - RNA, 14 nt, Human
acaagcagcccuua

SEQ ID NO: 673567 - RNA, 23 nt, Human
ucucuaccaaaaaaaggaaggaa

SEQ ID NO: 673568 - RNA, 21 nt, Human
uaguauuucuaugaaauauua

SEQ ID NO: 673569 - RNA, 17 nt, Human
aaagacaaggaaaaaau

SEQ ID NO: 673570 - RNA, 14 nt, Human
gcugauuaaaccaa

SEQ ID NO: 673571 - RNA, 15 nt, Human
ucccuuuguccacaa

SEQ ID NO: 673572 - RNA, 15 nt, Human
auauugacuuuuuau

SEQ ID NO: 673573 - RNA, 16 nt, Human
auuuguauaaaauaau

SEQ ID NO: 673574 - RNA, 16 nt, Human
auaaauaaaaacaaag

SEQ ID NO: 673575 - RNA, 22 nt, Human
ucugcuggagacauugaggcag

SEQ ID NO: 673576 - RNA, 22 nt, Human
guauucauauuuauagccaggu

SEQ ID NO: 673577 - RNA, 15 nt, Human
ucugcagauaaacag

SEQ ID NO: 673578 - RNA, 21 nt, Human
gagaaggagcucccaggaggg

SEQ ID NO: 673579 - RNA, 23 nt, Human
auuccugacugcuaguuuauaua

SEQ ID NO: 673580 - RNA, 20 nt, Human
gacauuugcucauggaauug

SEQ ID NO: 673581 - RNA, 21 nt, Human
accaccugccuauauuuuuug

SEQ ID NO: 673582 - RNA, 22 nt, Human
cuggguuccuuccucugagccu

SEQ ID NO: 673583 - RNA, 20 nt, Human
guugagccaccaagcuggug

SEQ ID NO: 673584 - RNA, 21 nt, Human
aaaauuuuuucucuaggaaau

SEQ ID NO: 673585 - RNA, 19 nt, Human
agcagcuuauucacaagac

SEQ ID NO: 673586 - RNA, 16 nt, Human
aguaaaggcaaacuua

SEQ ID NO: 673587 - RNA, 17 nt, Human
guuagagaauuuccuua

SEQ ID NO: 673588 - RNA, 12 nt, Human
cauucugccugc

SEQ ID NO: 673589 - RNA, 22 nt, Human
gcuaauuagcauggccacaucu

SEQ ID NO: 673590 - RNA, 17 nt, Human
gcagcauuguuggcugu

SEQ ID NO: 673591 - RNA, 12 nt, Human
aggaaauauuuu

SEQ ID NO: 673592 - RNA, 21 nt, Human
cuacauaaaauacaaaaacuu

SEQ ID NO: 673593 - RNA, 14 nt, Human
uucuggaauaaucc

SEQ ID NO: 673594 - RNA, 23 nt, Human
uagacacacaugaaguccaagca

SEQ ID NO: 673595 - RNA, 13 nt, Human
ggacaaaaggaau

SEQ ID NO: 673596 - RNA, 23 nt, Human
ugucuucaggggccacaccaacc

SEQ ID NO: 673597 - RNA, 16 nt, Human
auaucauagcaaauaa

SEQ ID NO: 673598 - RNA, 23 nt, Human
caaagcugaaauggacuuuugua

SEQ ID NO: 673599 - RNA, 21 nt, Human
cccuagaaagccaugugcagc

SEQ ID NO: 673600 - RNA, 21 nt, Human
ccaguccauugggcaggcaga

SEQ ID NO: 673601 - RNA, 20 nt, Human
aggugggcagaucacuugag

SEQ ID NO: 673602 - RNA, 20 nt, Human
gcuugcagagaugaggccgc

SEQ ID NO: 673603 - RNA, 20 nt, Human
ggccuaugcagagguccaca

SEQ ID NO: 673604 - RNA, 23 nt, Human
ggucucagugucaaugcagcccc

SEQ ID NO: 673605 - RNA, 22 nt, Human
ucugcuaugcuauugaaguuuu

SEQ ID NO: 673606 - RNA, 17 nt, Human
cuuccucugagccuugg

SEQ ID NO: 673607 - RNA, 19 nt, Human
uaggaggacaaaaggaaug

SEQ ID NO: 673608 - RNA, 12 nt, Human
cuguuaucuuca

SEQ ID NO: 673609 - RNA, 13 nt, Human
acggggugaaacc

SEQ ID NO: 673610 - RNA, 19 nt, Human
agagaacagggcugaagcu

SEQ ID NO: 673611 - RNA, 20 nt, Human
ugagucccaggcugagccuc

SEQ ID NO: 673612 - RNA, 17 nt, Human
cuaucucauuuccaagc

SEQ ID NO: 673613 - RNA, 23 nt, Human
aauaggcugaugggcaaaaaacc

SEQ ID NO: 673614 - RNA, 16 nt, Human
cuucggccuccauccu

SEQ ID NO: 673615 - RNA, 15 nt, Human
aaacaauuugaauau

SEQ ID NO: 673616 - RNA, 16 nt, Human
acaccaaccuucugag

SEQ ID NO: 673617 - RNA, 13 nt, Human
uaacgauaaaaga

SEQ ID NO: 673618 - RNA, 20 nt, Human
cagucccuccccaaaugcuu

SEQ ID NO: 673619 - RNA, 15 nt, Human
agccugaaagaggaa

SEQ ID NO: 673620 - RNA, 19 nt, Human
auuuuagauagaugaagaa

SEQ ID NO: 673621 - RNA, 14 nt, Human
aaauuuaucauuua

SEQ ID NO: 673622 - RNA, 17 nt, Human
uccucacuuugaagagu

SEQ ID NO: 673623 - RNA, 11 nt, Human
agccagguacc

SEQ ID NO: 673624 - RNA, 22 nt, Human
accucagcugccuccccagcuc

SEQ ID NO: 673625 - RNA, 11 nt, Human
gccaugggaca

SEQ ID NO: 673626 - RNA, 18 nt, Human
gcaaagcccagcuugaaa

SEQ ID NO: 673627 - RNA, 17 nt, Human
acaaaugcauuucuaaa

SEQ ID NO: 673628 - RNA, 14 nt, Human
aaaacuucagacau

SEQ ID NO: 673629 - RNA, 21 nt, Human
caagacccaaaaggcagaagc

SEQ ID NO: 673630 - RNA, 22 nt, Human
agaaauaggaaauauuuuaaug

SEQ ID NO: 673631 - RNA, 20 nt, Human
auuuugugauugauuauaug

SEQ ID NO: 673632 - RNA, 14 nt, Human
agcguuaauguaaa

SEQ ID NO: 673633 - RNA, 16 nt, Human
agugucaaugcagccc

SEQ ID NO: 673634 - RNA, 20 nt, Human
aggcugagaugggagaauca

SEQ ID NO: 673635 - RNA, 14 nt, Human
aucaaaagaaagaa

SEQ ID NO: 673636 - RNA, 16 nt, Human
gaagccagaucuaugc

SEQ ID NO: 673637 - RNA, 17 nt, Human
auaucuuaucuuccuau

SEQ ID NO: 673638 - RNA, 14 nt, Human
uuucuaugaaauau

SEQ ID NO: 673639 - RNA, 23 nt, Human
gucucagcuucacccugagguga

SEQ ID NO: 673640 - RNA, 16 nt, Human
acauuuauauuuuugu

SEQ ID NO: 673641 - RNA, 14 nt, Human
cacaagaaaugaaa

SEQ ID NO: 673642 - RNA, 14 nt, Human
uugacccacaagaa

SEQ ID NO: 673643 - RNA, 17 nt, Human
ccccagaaugaccuggc

SEQ ID NO: 673644 - RNA, 16 nt, Human
gacauagaauuaacac

SEQ ID NO: 673645 - RNA, 13 nt, Human
gagcucaggaggu

SEQ ID NO: 673646 - RNA, 18 nt, Human
caugaauuaguuuuauau

SEQ ID NO: 673647 - RNA, 12 nt, Human
cagacacaugug

SEQ ID NO: 673648 - RNA, 13 nt, Human
uccccagcucuau

SEQ ID NO: 673649 - RNA, 18 nt, Human
cuucucacauuuauauuu

SEQ ID NO: 673650 - RNA, 21 nt, Human
auuuuuucucuaggaaauauu

SEQ ID NO: 673651 - RNA, 18 nt, Human
cuccagccugagcgacag

SEQ ID NO: 673652 - RNA, 17 nt, Human
gccuccuuuuaaaguaa

SEQ ID NO: 673653 - RNA, 16 nt, Human
auaacuggaaacuuca

SEQ ID NO: 673654 - RNA, 20 nt, Human
gaagggacacauaucaaacu

SEQ ID NO: 673655 - RNA, 13 nt, Human
ggcacccccagaa

SEQ ID NO: 673656 - RNA, 15 nt, Human
aagcacuaaacaaag

SEQ ID NO: 673657 - RNA, 12 nt, Human
acacuaaaacac

SEQ ID NO: 673658 - RNA, 12 nt, Human
acuauaaaacua

SEQ ID NO: 673659 - RNA, 17 nt, Human
ucauauuuauagccagg

SEQ ID NO: 673660 - RNA, 20 nt, Human
ugggccccagauaccaugau

SEQ ID NO: 673661 - RNA, 21 nt, Human
gaccaggcacccccagaauga

SEQ ID NO: 673662 - RNA, 17 nt, Human
ccuacuuccccuuccua

SEQ ID NO: 673663 - RNA, 14 nt, Human
ggagauacagugga

SEQ ID NO: 673664 - RNA, 21 nt, Human
gacugcuaguuuauauagaaa

SEQ ID NO: 673665 - RNA, 19 nt, Human
uguaguguuggagaagaac

SEQ ID NO: 673666 - RNA, 20 nt, Human
cugagcggaccuucccagcu

SEQ ID NO: 673667 - RNA, 18 nt, Human
auguuaaaacugggacag

SEQ ID NO: 673668 - RNA, 12 nt, Human
agauuucaaaaa

SEQ ID NO: 673669 - RNA, 18 nt, Human
aaauaacgauaaaagaca

SEQ ID NO: 673670 - RNA, 20 nt, Human
ucacaugaacuuguaaagga

SEQ ID NO: 673671 - RNA, 15 nt, Human
aaacugaaacaaaau

SEQ ID NO: 673672 - RNA, 16 nt, Human
ccugagcgacagugag

SEQ ID NO: 673673 - RNA, 18 nt, Human
acauguuacaacacggac

SEQ ID NO: 673674 - RNA, 16 nt, Human
cagggacuugaaccca

SEQ ID NO: 673675 - RNA, 18 nt, Human
ugggauacuauuuaauua

SEQ ID NO: 673676 - RNA, 19 nt, Human
acauuuauguuccuuuuaa

SEQ ID NO: 673677 - RNA, 18 nt, Human
uggucaauuuuguuaugu

SEQ ID NO: 673678 - RNA, 17 nt, Human
agcccuuccccucugca

SEQ ID NO: 673679 - RNA, 21 nt, Human
cacuaaaacaccucagcugcc

SEQ ID NO: 673680 - RNA, 14 nt, Human
auuuaaggccaggc

SEQ ID NO: 673681 - RNA, 17 nt, Human
gaucuacaugucuagag

SEQ ID NO: 673682 - RNA, 20 nt, Human
cccugccccccagcccuccu

SEQ ID NO: 673683 - RNA, 20 nt, Human
guuccuuccucugagccuug

SEQ ID NO: 673684 - RNA, 14 nt, Human
ugcugcagccccug

SEQ ID NO: 673685 - RNA, 22 nt, Human
gccauagucauucugccugccc

SEQ ID NO: 673686 - RNA, 19 nt, Human
uuguacucugaaaguuuug

SEQ ID NO: 673687 - RNA, 19 nt, Human
uaccccuggccaaggaaga

SEQ ID NO: 673688 - RNA, 20 nt, Human
agcauuguuggcuguuccug

SEQ ID NO: 673689 - RNA, 17 nt, Human
uuagauagaugaagaag

SEQ ID NO: 673690 - RNA, 17 nt, Human
gggcuaaggcaggagga

SEQ ID NO: 673691 - RNA, 17 nt, Human
uaauuccacagcugcuc

SEQ ID NO: 673692 - RNA, 14 nt, Human
agaugcuagaacuc

SEQ ID NO: 673693 - RNA, 17 nt, Human
agcuaaauauauauuuu

SEQ ID NO: 673694 - RNA, 16 nt, Human
ccuuccccucugcagc

SEQ ID NO: 673695 - RNA, 13 nt, Human
aagugcagccccg

SEQ ID NO: 673696 - RNA, 17 nt, Human
gcucaggaggucaagau

SEQ ID NO: 673697 - RNA, 14 nt, Human
cugcugagucccag

SEQ ID NO: 673698 - RNA, 19 nt, Human
guuauuauauuuacaaaug

SEQ ID NO: 673699 - RNA, 13 nt, Human
uaguuuuuaaagu

SEQ ID NO: 673700 - RNA, 19 nt, Human
gccauagucauucugccug

SEQ ID NO: 673701 - RNA, 22 nt, Human
gugucuggcguuguggggauga

SEQ ID NO: 673702 - RNA, 14 nt, Human
agagaauuuccuua

SEQ ID NO: 673703 - RNA, 14 nt, Human
cccugaggugagca

SEQ ID NO: 673704 - RNA, 18 nt, Human
acuuuaugcuaagugaaa

SEQ ID NO: 673705 - RNA, 19 nt, Human
aauuuuuauauuugaaaua

SEQ ID NO: 673706 - RNA, 22 nt, Human
ugaaaaaguucugcagauaaac

SEQ ID NO: 673707 - RNA, 20 nt, Human
cucuucugacacuaaaacac

SEQ ID NO: 673708 - RNA, 17 nt, Human
cugaucaccugcccugc

SEQ ID NO: 673709 - RNA, 13 nt, Human
uauauuuuagaua

SEQ ID NO: 673710 - RNA, 20 nt, Human
acagaaagauuugauguaug

SEQ ID NO: 673711 - RNA, 18 nt, Human
aagucuuucacauuuaaa

SEQ ID NO: 673712 - RNA, 12 nt, Human
uauuuuaauguu

SEQ ID NO: 673713 - RNA, 22 nt, Human
auacuuuggccauuacccccag

SEQ ID NO: 673714 - RNA, 13 nt, Human
aucaagccugccu

SEQ ID NO: 673715 - RNA, 17 nt, Human
aaucuuucacaggggac

SEQ ID NO: 673716 - RNA, 11 nt, Human
ccugagcccca

SEQ ID NO: 673717 - RNA, 22 nt, Human
aucaccaaggcugauuaaacca

SEQ ID NO: 673718 - RNA, 17 nt, Human
uucugacacuaaaacac

SEQ ID NO: 673719 - RNA, 12 nt, Human
aguuauaaaaau

SEQ ID NO: 673720 - RNA, 16 nt, Human
cuuuaugcuaagugaa

SEQ ID NO: 673721 - RNA, 22 nt, Human
cuggagacauugaggcaggcac

SEQ ID NO: 673722 - RNA, 23 nt, Human
ucuuagaugcaguucugaagaag

SEQ ID NO: 673723 - RNA, 15 nt, Human
ugccccgucccccuc

SEQ ID NO: 673724 - RNA, 13 nt, Human
augacauuuuguu

SEQ ID NO: 673725 - RNA, 12 nt, Human
cucccugccccc

SEQ ID NO: 673726 - RNA, 12 nt, Human
aaaauaacaaua

SEQ ID NO: 673727 - RNA, 18 nt, Human
acaaauccaaugaaauga

SEQ ID NO: 673728 - RNA, 14 nt, Human
ucucuacauaaaau

SEQ ID NO: 673729 - RNA, 21 nt, Human
acagcccuucuuuccacagaa

SEQ ID NO: 673730 - RNA, 16 nt, Human
uggcaauugacuauag

SEQ ID NO: 673731 - RNA, 18 nt, Human
ggccuugugaggagcugg

SEQ ID NO: 673732 - RNA, 16 nt, Human
ucagucucccucccuu

SEQ ID NO: 673733 - RNA, 15 nt, Human
auuucuaugaaauau

SEQ ID NO: 673734 - RNA, 14 nt, Human
gacaagaaggaaag

SEQ ID NO: 673735 - RNA, 14 nt, Human
auacaaaaaaaaaa

SEQ ID NO: 673736 - RNA, 16 nt, Human
auacauguuacaacac

SEQ ID NO: 673737 - RNA, 16 nt, Human
aaaaauuccaagugau

SEQ ID NO: 673738 - RNA, 21 nt, Human
cagagguccacaacacacaga

SEQ ID NO: 673739 - RNA, 16 nt, Human
aucacuuuaggccugg

SEQ ID NO: 673740 - RNA, 18 nt, Human
acauuugcucauggaauu

SEQ ID NO: 673741 - RNA, 22 nt, Human
uuugaaacgaggauugggaaaa

SEQ ID NO: 673742 - RNA, 19 nt, Human
gagccucagucucccuccc

SEQ ID NO: 673743 - RNA, 22 nt, Human
acacugucucuaccaaaaaaag

SEQ ID NO: 673744 - RNA, 17 nt, Human
uaaaagacaaggaaaaa

SEQ ID NO: 673745 - RNA, 15 nt, Human
caaauccaaugaaau

SEQ ID NO: 673746 - RNA, 17 nt, Human
ggauacuccauggggug

SEQ ID NO: 673747 - RNA, 18 nt, Human
gcauggccacaucugagc

SEQ ID NO: 673748 - RNA, 15 nt, Human
aaacauaugaauuau

SEQ ID NO: 673749 - RNA, 20 nt, Human
ugagagacacacugaagaag

SEQ ID NO: 673750 - RNA, 14 nt, Human
caagaaggaaagau

SEQ ID NO: 673751 - RNA, 17 nt, Human
aacaaaaaucaaacuuu

SEQ ID NO: 673752 - RNA, 17 nt, Human
ucucuggccuucggccu

SEQ ID NO: 673753 - RNA, 19 nt, Human
cagguaccuucucaccugu

SEQ ID NO: 673754 - RNA, 16 nt, Human
cugagccucagucucc

SEQ ID NO: 673755 - RNA, 17 nt, Human
auuuaguuauaaaaaua

SEQ ID NO: 673756 - RNA, 18 nt, Human
auguuagagaauuuccuu

SEQ ID NO: 673757 - RNA, 16 nt, Human
aaagaaaggagauaca

SEQ ID NO: 673758 - RNA, 21 nt, Human
uuauguuuaauucugaaagca

SEQ ID NO: 673759 - RNA, 20 nt, Human
cuauguagaauauauuuccu

SEQ ID NO: 673760 - RNA, 15 nt, Human
gucccaggcugagcc

SEQ ID NO: 673761 - RNA, 22 nt, Human
agacucugucucaguccaugaa

SEQ ID NO: 673762 - RNA, 18 nt, Human
uaaauugacacuuaaaaa

SEQ ID NO: 673763 - RNA, 13 nt, Human
cauggaaaaguuu

SEQ ID NO: 673764 - RNA, 20 nt, Human
uccacuuggacaugggcccc

SEQ ID NO: 673765 - RNA, 16 nt, Human
ugaaauuguauuacaa

SEQ ID NO: 673766 - RNA, 21 nt, Human
aauuuuuauauuugaaauauu

SEQ ID NO: 673767 - RNA, 13 nt, Human
auugggcaggcag

SEQ ID NO: 673768 - RNA, 17 nt, Human
gcuauugggguuggggg

SEQ ID NO: 673769 - RNA, 12 nt, Human
uaagaagacugc

SEQ ID NO: 673770 - RNA, 23 nt, Human
cucaggggggugguuuucccauc

SEQ ID NO: 673771 - RNA, 22 nt, Human
ucucucaaggagaggcaaagaa

SEQ ID NO: 673772 - RNA, 16 nt, Human
cacuggacucaccucc

SEQ ID NO: 673773 - RNA, 22 nt, Human
cuuccccucugcagcuuccagg

SEQ ID NO: 673774 - RNA, 15 nt, Human
auuuaauuauuucac

SEQ ID NO: 673775 - RNA, 18 nt, Human
uaaaagacaaggaaaaaa

SEQ ID NO: 673776 - RNA, 23 nt, Human
uaggauggcuaguaucaaaagaa

SEQ ID NO: 673777 - RNA, 15 nt, Human
ucccccaucucuucu

SEQ ID NO: 673778 - RNA, 19 nt, Human
agaaaauaacaauaaaaga

SEQ ID NO: 673779 - RNA, 17 nt, Human
uccaaaggcuccugaga

SEQ ID NO: 673780 - RNA, 21 nt, Human
gccaaauauaaauaaaaauaa

SEQ ID NO: 673781 - RNA, 21 nt, Human
ccaaauauaaauaaaaauaau

SEQ ID NO: 673782 - RNA, 12 nt, Human
uuaauaaaccau

SEQ ID NO: 673783 - RNA, 13 nt, Human
uguccacaaguaa

SEQ ID NO: 673784 - RNA, 11 nt, Human
gcaugguuuag

SEQ ID NO: 673785 - RNA, 17 nt, Human
ugagcggaccuucccag

SEQ ID NO: 673786 - RNA, 16 nt, Human
ccuccuuuuaaaguaa

SEQ ID NO: 673787 - RNA, 20 nt, Human
accuacacgagauacagaau

SEQ ID NO: 673788 - RNA, 20 nt, Human
gaaacugcccacucugcaag

SEQ ID NO: 673789 - RNA, 16 nt, Human
accagccuuggauacu

SEQ ID NO: 673790 - RNA, 14 nt, Human
acgcauggaaaagu

SEQ ID NO: 673791 - RNA, 15 nt, Human
uccagauccuggaaa

SEQ ID NO: 673792 - RNA, 22 nt, Human
uugagaaggagcucccaggagg

SEQ ID NO: 673793 - RNA, 14 nt, Human
uuaauuauuucacu

SEQ ID NO: 673794 - RNA, 17 nt, Human
ucccagaucaagccugc

SEQ ID NO: 673795 - RNA, 19 nt, Human
acuauuauauuuccaagaa

SEQ ID NO: 673796 - RNA, 13 nt, Human
uaaagaaacaaaa

SEQ ID NO: 673797 - RNA, 16 nt, Human
cauagaaguaaaaaca

SEQ ID NO: 673798 - RNA, 11 nt, Human
uuuuuuuucaa

SEQ ID NO: 673799 - RNA, 13 nt, Human
ucuaagaagugaa

SEQ ID NO: 673800 - RNA, 12 nt, Human
ucccccucuggc

SEQ ID NO: 673801 - RNA, 13 nt, Human
ucuauaauuuaaa

SEQ ID NO: 673802 - RNA, 20 nt, Human
aguugauuaagaaaggaagu

SEQ ID NO: 673803 - RNA, 12 nt, Human
cuccauuuuuag

SEQ ID NO: 673804 - RNA, 16 nt, Human
aggguguguaaguaga

SEQ ID NO: 673805 - RNA, 21 nt, Human
acaaggaaggaaagaugugaa

SEQ ID NO: 673806 - RNA, 20 nt, Human
acuccagugagacagcucug

SEQ ID NO: 673807 - RNA, 16 nt, Human
uauguucuaagaagug

SEQ ID NO: 673808 - RNA, 17 nt, Human
uaggaugggaacaagga

SEQ ID NO: 673809 - RNA, 23 nt, Human
uacaaaugggaaacaaaaggaua

SEQ ID NO: 673810 - RNA, 14 nt, Human
cuacagaacuaaaa

SEQ ID NO: 673811 - RNA, 18 nt, Human
caaggcugauuaaaccaa

SEQ ID NO: 673812 - RNA, 19 nt, Human
gucaaucagccuaguugau

SEQ ID NO: 673813 - RNA, 12 nt, Human
gcugaugcaguu

SEQ ID NO: 673814 - RNA, 19 nt, Human
gcuuguauuccuuuuucuc

SEQ ID NO: 673815 - RNA, 15 nt, Human
auauagaaauguauu

SEQ ID NO: 673816 - RNA, 17 nt, Human
aguuuauauagaaaugu

SEQ ID NO: 673817 - RNA, 19 nt, Human
cccugcaaagcccagcuug

SEQ ID NO: 673818 - RNA, 21 nt, Human
uguauaaaauaauuuuuauau

SEQ ID NO: 673819 - RNA, 23 nt, Human
gcuggcgugcagcaucagcaucc

SEQ ID NO: 673820 - RNA, 17 nt, Human
uauauuguagauaauac

SEQ ID NO: 673821 - RNA, 23 nt, Human
cccacuggacucaccucccccau

SEQ ID NO: 673822 - RNA, 17 nt, Human
cugcacuccagccugag

SEQ ID NO: 673823 - RNA, 12 nt, Human
cacaacacacag

SEQ ID NO: 673824 - RNA, 21 nt, Human
aaacaauaacgauaaaagaca

SEQ ID NO: 673825 - RNA, 18 nt, Human
gaauaauccuaaacauau

SEQ ID NO: 673826 - RNA, 14 nt, Human
aggacaaaaggaau

SEQ ID NO: 673827 - RNA, 23 nt, Human
cacagaaacuccuguucaugccc

SEQ ID NO: 673828 - RNA, 17 nt, Human
gccuaagugcagccccg

SEQ ID NO: 673829 - RNA, 14 nt, Human
uauuauauuuccaa

SEQ ID NO: 673830 - RNA, 13 nt, Human
uaacaauaaaaga

SEQ ID NO: 673831 - RNA, 12 nt, Human
gucccaggcuga

SEQ ID NO: 673832 - RNA, 17 nt, Human
gcaagcucuaucaccaa

SEQ ID NO: 673833 - RNA, 23 nt, Human
ccucuucugacacuaaaacaccu

SEQ ID NO: 673834 - RNA, 17 nt, Human
cguaaucguguccccua

SEQ ID NO: 673835 - RNA, 17 nt, Human
cagucucuugaggcaca

SEQ ID NO: 673836 - RNA, 13 nt, Human
aaguucaaaacuu

SEQ ID NO: 673837 - RNA, 23 nt, Human
gcuaugcuauugaaguuuuggca

SEQ ID NO: 673838 - RNA, 14 nt, Human
cucaccagucccuc

SEQ ID NO: 673839 - RNA, 17 nt, Human
caggaaucacuggcugu

SEQ ID NO: 673840 - RNA, 17 nt, Human
uuauuucccucccaagu

SEQ ID NO: 673841 - RNA, 19 nt, Human
acagugauuaccagggacu

SEQ ID NO: 673842 - RNA, 17 nt, Human
ugcacaucaaaauaugc

SEQ ID NO: 673843 - RNA, 19 nt, Human
acuuuuauaagaaauagga

SEQ ID NO: 673844 - RNA, 21 nt, Human
cacuugaacccgggaggcaga

SEQ ID NO: 673845 - RNA, 22 nt, Human
cuuuuccaaugacauuuuguug

SEQ ID NO: 673846 - RNA, 17 nt, Human
uuucccuccuuggagac

SEQ ID NO: 673847 - RNA, 16 nt, Human
gucucuacauaaaaua

SEQ ID NO: 673848 - RNA, 14 nt, Human
cagauccuggaaau

SEQ ID NO: 673849 - RNA, 15 nt, Human
aagucauuauuagga

SEQ ID NO: 673850 - RNA, 23 nt, Human
ggaugaauuaaguuuuuuuuuaa

SEQ ID NO: 673851 - RNA, 21 nt, Human
cuucucacauuuauauuuuug

SEQ ID NO: 673852 - RNA, 20 nt, Human
guccccuauccuacuucccc

SEQ ID NO: 673853 - RNA, 22 nt, Human
gagucaagggugugugcagcau

SEQ ID NO: 673854 - RNA, 22 nt, Human
aagaugagaugguuucuagaga

SEQ ID NO: 673855 - RNA, 18 nt, Human
aaaagacaaggaaaaaau

SEQ ID NO: 673856 - RNA, 13 nt, Human
ccccagcccuccu

SEQ ID NO: 673857 - RNA, 17 nt, Human
auguugacaugggacau

SEQ ID NO: 673858 - RNA, 14 nt, Human
gaaugauuaugaau

SEQ ID NO: 673859 - RNA, 22 nt, Human
accaaucaugaauuaguuuuau

SEQ ID NO: 673860 - RNA, 16 nt, Human
aaauguaauuauguuc

SEQ ID NO: 673861 - RNA, 14 nt, Human
ugcuucuguuuuau

SEQ ID NO: 673862 - RNA, 21 nt, Human
ugccugagcggaccuucccag

SEQ ID NO: 673863 - RNA, 14 nt, Human
gagacacugucucu

SEQ ID NO: 673864 - RNA, 19 nt, Human
aauauaugaggcuacagaa

SEQ ID NO: 673865 - RNA, 20 nt, Human
uaauaucuuaucuuccuaua

SEQ ID NO: 673866 - RNA, 20 nt, Human
ccaacacccugagguugugu

SEQ ID NO: 673867 - RNA, 15 nt, Human
augugcagccaccag

SEQ ID NO: 673868 - RNA, 18 nt, Human
gaggcggauugagaagga

SEQ ID NO: 673869 - RNA, 14 nt, Human
caucauuuacuuuu

SEQ ID NO: 673870 - RNA, 16 nt, Human
aauuucuucaacuccc

SEQ ID NO: 673871 - RNA, 19 nt, Human
ucccagaucaagccugccu

SEQ ID NO: 673872 - RNA, 22 nt, Human
aaccuacacgagauacagaauu

SEQ ID NO: 673873 - RNA, 21 nt, Human
auucauagcagcuuauucaca

SEQ ID NO: 673874 - RNA, 23 nt, Human
uuuauuaggaguaccauaauucu

SEQ ID NO: 673875 - RNA, 19 nt, Human
cuucacccugaggugagca

SEQ ID NO: 673876 - RNA, 22 nt, Human
uucauucacucaacaaacauaa

SEQ ID NO: 673877 - RNA, 21 nt, Human
aaugaauggcuaagcaaaaug

SEQ ID NO: 673878 - RNA, 16 nt, Human
ccacuuauaggaauug

SEQ ID NO: 673879 - RNA, 14 nt, Human
cauuuaguuauaaa

SEQ ID NO: 673880 - RNA, 16 nt, Human
ccacaagaacccccuu

SEQ ID NO: 673881 - RNA, 12 nt, Human
acaccuuaucua

SEQ ID NO: 673882 - RNA, 21 nt, Human
aauuuacagagacagaaagca

SEQ ID NO: 673883 - RNA, 20 nt, Human
cuacuuccccuuccuaauuc

SEQ ID NO: 673884 - RNA, 16 nt, Human
cuagaaccaccugccu

SEQ ID NO: 673885 - RNA, 19 nt, Human
augcagagguccacaacac

SEQ ID NO: 673886 - RNA, 14 nt, Human
ugcuguauuuuaaa

SEQ ID NO: 673887 - RNA, 18 nt, Human
uuacagguccugcugaaa

SEQ ID NO: 673888 - RNA, 18 nt, Human
uaugaggcuacagaacua

SEQ ID NO: 673889 - RNA, 15 nt, Human
gcuaauaucuuaucu

SEQ ID NO: 673890 - RNA, 19 nt, Human
accucagcugccuccccag

SEQ ID NO: 673891 - RNA, 23 nt, Human
gaaaaucuuauaauuuaaaauau

SEQ ID NO: 673892 - RNA, 14 nt, Human
ccucugcagcuucc

SEQ ID NO: 673893 - RNA, 17 nt, Human
aaauguucaucaaugaa

SEQ ID NO: 673894 - RNA, 16 nt, Human
caugggacagggagga

SEQ ID NO: 673895 - RNA, 21 nt, Human
uauacugugugcuaaaacaag

SEQ ID NO: 673896 - RNA, 20 nt, Human
cuucuuuguguuauuucccu

SEQ ID NO: 673897 - RNA, 13 nt, Human
uuauguuuaauuc

SEQ ID NO: 673898 - RNA, 23 nt, Human
agcucugcccauccugccccuga

SEQ ID NO: 673899 - RNA, 23 nt, Human
cuaguaauuggaaaggcagcucu

SEQ ID NO: 673900 - RNA, 23 nt, Human
acuggcuaauuagcauggccaca

SEQ ID NO: 673901 - RNA, 13 nt, Human
ccuuugcaccucc

SEQ ID NO: 673902 - RNA, 15 nt, Human
augcccauaccccug

SEQ ID NO: 673903 - RNA, 19 nt, Human
auuuacagagacagaaagc

SEQ ID NO: 673904 - RNA, 17 nt, Human
agcuacuaauuuuaaaa

SEQ ID NO: 673905 - RNA, 22 nt, Human
ugucucuacuaaaaauacaaaa

SEQ ID NO: 673906 - RNA, 21 nt, Human
gggagccugaucaccugcccu

SEQ ID NO: 673907 - RNA, 18 nt, Human
gaaaugaaagcagggacu

SEQ ID NO: 673908 - RNA, 16 nt, Human
gucuaucuuugagcgc

SEQ ID NO: 673909 - RNA, 17 nt, Human
acacuaagagagaauga

SEQ ID NO: 673910 - RNA, 19 nt, Human
caggcagauguuccuaaua

SEQ ID NO: 673911 - RNA, 15 nt, Human
cuguaaaauaauaac

SEQ ID NO: 673912 - RNA, 22 nt, Human
caaaugggaaacaaaaggauaa

SEQ ID NO: 673913 - RNA, 11 nt, Human
ugggggcagca

SEQ ID NO: 673914 - RNA, 18 nt, Human
gagucccaggcugagccu

SEQ ID NO: 673915 - RNA, 15 nt, Human
ccugccccccagccc

SEQ ID NO: 673916 - RNA, 22 nt, Human
cuacauaaaauacaaaaacuua

SEQ ID NO: 673917 - RNA, 20 nt, Human
ggugggcagaucacuugagc

SEQ ID NO: 673918 - RNA, 16 nt, Human
ggaugccccguccccc

SEQ ID NO: 673919 - RNA, 18 nt, Human
gaauuuccuuacucuuga

SEQ ID NO: 673920 - RNA, 16 nt, Human
cuagaauucacuccac

SEQ ID NO: 673921 - RNA, 14 nt, Human
caaggaaaaaauaa

SEQ ID NO: 673922 - RNA, 22 nt, Human
ggcauuuaggccaugggacagg

SEQ ID NO: 673923 - RNA, 21 nt, Human
ugggaggcugagaugggagaa

SEQ ID NO: 673924 - RNA, 22 nt, Human
gcuccuccagggagucucagcu

SEQ ID NO: 673925 - RNA, 16 nt, Human
cccaaccucucccaac

SEQ ID NO: 673926 - RNA, 15 nt, Human
aacgauaaaagacag

SEQ ID NO: 673927 - RNA, 18 nt, Human
ugugcuggccaccugcug

SEQ ID NO: 673928 - RNA, 18 nt, Human
ccuuugcaccuccaugga

SEQ ID NO: 673929 - RNA, 18 nt, Human
uaaguuuuuuuuuaaaaa

SEQ ID NO: 673930 - RNA, 14 nt, Human
uccagauccuggaa

SEQ ID NO: 673931 - RNA, 15 nt, Human
aaauauaaauaaaaa

SEQ ID NO: 673932 - RNA, 21 nt, Human
agacaagaaggaaagauuuug

SEQ ID NO: 673933 - RNA, 14 nt, Human
ccgcuuaagcuuuc

SEQ ID NO: 673934 - RNA, 19 nt, Human
cccugccucaagcuaugug

SEQ ID NO: 673935 - RNA, 22 nt, Human
caauaaaagacaaggaaaaaau

SEQ ID NO: 673936 - RNA, 20 nt, Human
aacaaugcuguauuuuaaaa

SEQ ID NO: 673937 - RNA, 12 nt, Human
cuacauaaaaua

SEQ ID NO: 673938 - RNA, 16 nt, Human
acaugugcuggccacc

SEQ ID NO: 673939 - RNA, 18 nt, Human
ccucuggcuccagcuggc

SEQ ID NO: 673940 - RNA, 15 nt, Human
uuauaugcuauuuau

SEQ ID NO: 673941 - RNA, 18 nt, Human
uuacuguaagaaaauauc

SEQ ID NO: 673942 - RNA, 20 nt, Human
gaaaauaacaauaaaagaca

SEQ ID NO: 673943 - RNA, 17 nt, Human
agucccaggcugagccu

SEQ ID NO: 673944 - RNA, 18 nt, Human
ccugaggugagcaucauc

SEQ ID NO: 673945 - RNA, 21 nt, Human
acaggauggcaggaggcaucc

SEQ ID NO: 673946 - RNA, 20 nt, Human
aucuacaugucuagagaaca

SEQ ID NO: 673947 - RNA, 16 nt, Human
auuuuuagugaaauau

SEQ ID NO: 673948 - RNA, 11 nt, Human
aacaaggaagg

SEQ ID NO: 673949 - RNA, 16 nt, Human
agugaaggauuuaugu

SEQ ID NO: 673950 - RNA, 19 nt, Human
ccuucccagcuagaauuca

SEQ ID NO: 673951 - RNA, 18 nt, Human
acaaaugggaaacaaaag

SEQ ID NO: 673952 - RNA, 12 nt, Human
acugaaacaaaa

SEQ ID NO: 673953 - RNA, 20 nt, Human
uaugcuauuuauuaaguauu

SEQ ID NO: 673954 - RNA, 17 nt, Human
ccauagucauucugccu

SEQ ID NO: 673955 - RNA, 20 nt, Human
gggaggcagagguugcagug

SEQ ID NO: 673956 - RNA, 17 nt, Human
aacugccaucauuuacu

SEQ ID NO: 673957 - RNA, 18 nt, Human
auaaaguguuugaaagcu

SEQ ID NO: 673958 - RNA, 21 nt, Human
acaugagguacugagagugaa

SEQ ID NO: 673959 - RNA, 18 nt, Human
aggcauagcccugccuca

SEQ ID NO: 673960 - RNA, 17 nt, Human
uaauuuuuauauuugaa

SEQ ID NO: 673961 - RNA, 15 nt, Human
ccaucucaggugugu

SEQ ID NO: 673962 - RNA, 15 nt, Human
aauaacgauaaaaga

SEQ ID NO: 673963 - RNA, 18 nt, Human
uauuucuguuaaaauaua

SEQ ID NO: 673964 - RNA, 17 nt, Human
uucaaaacuuauuggaa

SEQ ID NO: 673965 - RNA, 22 nt, Human
cuuguaaaggaauuuaaaaauc

SEQ ID NO: 673966 - RNA, 19 nt, Human
ugagucccaggcugagccu

SEQ ID NO: 673967 - RNA, 17 nt, Human
gaugggaacaaggaagg

SEQ ID NO: 673968 - RNA, 14 nt, Human
cuuguacucugaaa

SEQ ID NO: 673969 - RNA, 19 nt, Human
ugaacaaauuuacagagac

SEQ ID NO: 673970 - RNA, 15 nt, Human
ugcagauaaacagua

SEQ ID NO: 673971 - RNA, 15 nt, Human
uuucaaaaaaaaacc

SEQ ID NO: 673972 - RNA, 20 nt, Human
uguaagaaaauaucacuugu

SEQ ID NO: 673973 - RNA, 16 nt, Human
uggucugugagaugcu

SEQ ID NO: 673974 - RNA, 13 nt, Human
cagcugccucccc

SEQ ID NO: 673975 - RNA, 20 nt, Human
guaaaauagugaauaaaguc

SEQ ID NO: 673976 - RNA, 20 nt, Human
uuacaaauccaaugaaauga

SEQ ID NO: 673977 - RNA, 19 nt, Human
gugaacuugguuuuaauua

SEQ ID NO: 673978 - RNA, 17 nt, Human
agucuucagcagagaag

SEQ ID NO: 673979 - RNA, 15 nt, Human
cacuuggucugugag

SEQ ID NO: 673980 - RNA, 14 nt, Human
agcucaccaguccc

SEQ ID NO: 673981 - RNA, 22 nt, Human
uaauucugguagcuaaauauau

SEQ ID NO: 673982 - RNA, 21 nt, Human
uuuauagccagguaccuucuc

SEQ ID NO: 673983 - RNA, 20 nt, Human
caaauguucaucaaugaaug

SEQ ID NO: 673984 - RNA, 22 nt, Human
gcuauuugcuguuauuuuaucu

SEQ ID NO: 673985 - RNA, 21 nt, Human
auggcagcuuuccucaaaacu

SEQ ID NO: 673986 - RNA, 12 nt, Human
ucccaaccucuc

SEQ ID NO: 673987 - RNA, 18 nt, Human
aguagcugcccuuucuca

SEQ ID NO: 673988 - RNA, 13 nt, Human
aggcauagcccug

SEQ ID NO: 673989 - RNA, 16 nt, Human
acaggauggcaggagg

SEQ ID NO: 673990 - RNA, 17 nt, Human
uguaaaggaauuuaaaa

SEQ ID NO: 673991 - RNA, 16 nt, Human
ccacuuggucugugag

SEQ ID NO: 673992 - RNA, 15 nt, Human
agcuaaauauauauu

SEQ ID NO: 673993 - RNA, 22 nt, Human
cuuaucuauguagaauauauuu

SEQ ID NO: 673994 - RNA, 21 nt, Human
gcaaaauuuuuucucuaggaa

SEQ ID NO: 673995 - RNA, 23 nt, Human
gaucuacaugucuagagaacacu

SEQ ID NO: 673996 - RNA, 15 nt, Human
gaagauguagaggag

SEQ ID NO: 673997 - RNA, 18 nt, Human
gcuauaggauguggggaa

SEQ ID NO: 673998 - RNA, 19 nt, Human
ugcacacagcacgggggcc

SEQ ID NO: 673999 - RNA, 21 nt, Human
aggaugggaacaaggaaggaa

SEQ ID NO: 674000 - RNA, 22 nt, Human
gucucuaccaaaaaaaggaagg

SEQ ID NO: 674001 - RNA, 13 nt, Human
cugaugggcaaaa

SEQ ID NO: 674002 - RNA, 16 nt, Human
uuuauauuugaaauau

SEQ ID NO: 674003 - RNA, 21 nt, Human
gcagaucuacaugucuagaga

SEQ ID NO: 674004 - RNA, 20 nt, Human
cagagaaguuuucuggaggu

SEQ ID NO: 674005 - RNA, 18 nt, Human
aacaaaguugauuaagaa

SEQ ID NO: 674006 - RNA, 15 nt, Human
ccaaaauauaaucag

SEQ ID NO: 674007 - RNA, 21 nt, Human
uuuuauggcacuaguauuucu

SEQ ID NO: 674008 - RNA, 22 nt, Human
ggguggaaaaacagaccggggu

SEQ ID NO: 674009 - RNA, 20 nt, Human
ccugccuaagugcagccccg

SEQ ID NO: 674010 - RNA, 17 nt, Human
ugacuauuauauuucca

SEQ ID NO: 674011 - RNA, 19 nt, Human
uauauuuccaagaaauauu

SEQ ID NO: 674012 - RNA, 20 nt, Human
agcccucuucugacacuaaa

SEQ ID NO: 674013 - RNA, 14 nt, Human
gccaggcauggugg

SEQ ID NO: 674014 - RNA, 16 nt, Human
auagucauucugccug

SEQ ID NO: 674015 - RNA, 15 nt, Human
uuaauucugaaagca

SEQ ID NO: 674016 - RNA, 17 nt, Human
guuuaauaauuuuuaau

SEQ ID NO: 674017 - RNA, 17 nt, Human
caagacccaaaaggcag

SEQ ID NO: 674018 - RNA, 20 nt, Human
uaacaagccuccuuuuaaag

SEQ ID NO: 674019 - RNA, 20 nt, Human
aacagucucuugaggcacag

SEQ ID NO: 674020 - RNA, 20 nt, Human
auuacccccagcuuugagga

SEQ ID NO: 674021 - RNA, 18 nt, Human
uaauuagcauggccacau

SEQ ID NO: 674022 - RNA, 14 nt, Human
cucuggcuccagcu

SEQ ID NO: 674023 - RNA, 14 nt, Human
gcugguggcucugu

SEQ ID NO: 674024 - RNA, 19 nt, Human
ucuuaucuuccuauaauuu

SEQ ID NO: 674025 - RNA, 23 nt, Human
agcaugucgucaaagcugaaaug

SEQ ID NO: 674026 - RNA, 15 nt, Human
ucuuauaauuuaaaa

SEQ ID NO: 674027 - RNA, 16 nt, Human
ugagcucaggagguca

SEQ ID NO: 674028 - RNA, 19 nt, Human
uguuggacgagaaaacaau

SEQ ID NO: 674029 - RNA, 16 nt, Human
aagaaauauuccuuaa

SEQ ID NO: 674030 - RNA, 23 nt, Human
aggugaucuggcucuggacaggc

SEQ ID NO: 674031 - RNA, 15 nt, Human
ucuugaggcacagaa

SEQ ID NO: 674032 - RNA, 22 nt, Human
aaaggaauguguaagucuuuaa

SEQ ID NO: 674033 - RNA, 21 nt, Human
ccauaccccuggccaaggaag

SEQ ID NO: 674034 - RNA, 13 nt, Human
auugaggcaggca

SEQ ID NO: 674035 - RNA, 21 nt, Human
aagcuccauuuuuagugaaau

SEQ ID NO: 674036 - RNA, 23 nt, Human
uguggaaggugaucuggcucugg

SEQ ID NO: 674037 - RNA, 19 nt, Human
aaugaauggcuaagcaaaa

SEQ ID NO: 674038 - RNA, 17 nt, Human
aaggugaucuggcucug

SEQ ID NO: 674039 - RNA, 14 nt, Human
auuuaaauauaugc

SEQ ID NO: 674040 - RNA, 16 nt, Human
cuuuuaguuuuuaaag

SEQ ID NO: 674041 - RNA, 21 nt, Human
auacaguggagacaucuggaa

SEQ ID NO: 674042 - RNA, 22 nt, Human
cugccaaaacaucaaccugcca

SEQ ID NO: 674043 - RNA, 16 nt, Human
gccaaggaagaucccu

SEQ ID NO: 674044 - RNA, 19 nt, Human
uggaaauguuuacagaucc

SEQ ID NO: 674045 - RNA, 23 nt, Human
cuuaagaagacugcauuauauuu

SEQ ID NO: 674046 - RNA, 21 nt, Human
cuucucaccugugagaccaaa

SEQ ID NO: 674047 - RNA, 23 nt, Human
caccaaggagccaaacauccuac

SEQ ID NO: 674048 - RNA, 21 nt, Human
agccuuggauacuccaugggg

SEQ ID NO: 674049 - RNA, 22 nt, Human
guacacugccuucucaacucca

SEQ ID NO: 674050 - RNA, 12 nt, Human
caaguaaauguu

SEQ ID NO: 674051 - RNA, 14 nt, Human
ugagcucaccaguc

SEQ ID NO: 674052 - RNA, 13 nt, Human
caacucccugccc

SEQ ID NO: 674053 - RNA, 22 nt, Human
aaaugauguuucauaagaauuc

SEQ ID NO: 674054 - RNA, 19 nt, Human
cucauggaauuggagcucg

SEQ ID NO: 674055 - RNA, 13 nt, Human
aagaccagccugg

SEQ ID NO: 674056 - RNA, 15 nt, Human
acaggguuuauguuu

SEQ ID NO: 674057 - RNA, 16 nt, Human
uacaaaugggaaacaa

SEQ ID NO: 674058 - RNA, 16 nt, Human
aauaaaguguuugaaa

SEQ ID NO: 674059 - RNA, 20 nt, Human
augguuuagaaagcuugccc

SEQ ID NO: 674060 - RNA, 18 nt, Human
cuaggcauagcccugccu

SEQ ID NO: 674061 - RNA, 14 nt, Human
guaacuaauuuuaa

SEQ ID NO: 674062 - RNA, 21 nt, Human
gcaucgugucuggcguugugg

SEQ ID NO: 674063 - RNA, 14 nt, Human
aaauguaaaauagu

SEQ ID NO: 674064 - RNA, 23 nt, Human
ugaaaaucuuauaauuuaaaaua

SEQ ID NO: 674065 - RNA, 19 nt, Human
aaacaccucagcugccucc

SEQ ID NO: 674066 - RNA, 16 nt, Human
cacgggggccaaggau

SEQ ID NO: 674067 - RNA, 17 nt, Human
aaauaacaauaaaagac

SEQ ID NO: 674068 - RNA, 20 nt, Human
cauaucaaacugaaacaaaa

SEQ ID NO: 674069 - RNA, 21 nt, Human
uguaaaauggugugaccacug

SEQ ID NO: 674070 - RNA, 20 nt, Human
uauacugugugcuaaaacaa

SEQ ID NO: 674071 - RNA, 14 nt, Human
agcuggaaacacau

SEQ ID NO: 674072 - RNA, 18 nt, Human
cuggggcuuuaacuccug

SEQ ID NO: 674073 - RNA, 21 nt, Human
ugagaaggcuguggauuuaau

SEQ ID NO: 674074 - RNA, 21 nt, Human
ccucccuuggggccuaugcag

SEQ ID NO: 674075 - RNA, 17 nt, Human
uacaaaugcauuucuaa

SEQ ID NO: 674076 - RNA, 13 nt, Human
agacagcucugca

SEQ ID NO: 674077 - RNA, 13 nt, Human
cugcacuccagcc

SEQ ID NO: 674078 - RNA, 21 nt, Human
uauuauuuuauagcuacuaau

SEQ ID NO: 674079 - RNA, 15 nt, Human
ccagcacagccucuu

SEQ ID NO: 674080 - RNA, 19 nt, Human
ugggccccagauaccauga

SEQ ID NO: 674081 - RNA, 13 nt, Human
gagacagcucugc

SEQ ID NO: 674082 - RNA, 13 nt, Human
aggaaaaaauaac

SEQ ID NO: 674083 - RNA, 21 nt, Human
auuauauuuccaagaaauauu

SEQ ID NO: 674084 - RNA, 22 nt, Human
gaugcaguucugaagaagaugg

SEQ ID NO: 674085 - RNA, 15 nt, Human
uauuuauuuuaauaa

SEQ ID NO: 674086 - RNA, 23 nt, Human
ggaacaguuaccucugccucaga

SEQ ID NO: 674087 - RNA, 16 nt, Human
ucuuggggaauauguu

SEQ ID NO: 674088 - RNA, 13 nt, Human
auguagaauauau

SEQ ID NO: 674089 - RNA, 18 nt, Human
ugccuaggcauagcccug

SEQ ID NO: 674090 - RNA, 16 nt, Human
agguugcagugagccg

SEQ ID NO: 674091 - RNA, 23 nt, Human
aacuccugcuagaacagucucuu

SEQ ID NO: 674092 - RNA, 16 nt, Human
cuagaacucccuuuca

SEQ ID NO: 674093 - RNA, 17 nt, Human
auauuugaaauauugac

SEQ ID NO: 674094 - RNA, 21 nt, Human
gaaagcagggacuugaaccca

SEQ ID NO: 674095 - RNA, 13 nt, Human
aaaugaaagcagg

SEQ ID NO: 674096 - RNA, 14 nt, Human
gcaaagcccagcuu

SEQ ID NO: 674097 - RNA, 20 nt, Human
agccuucucucaaggagagg

SEQ ID NO: 674098 - RNA, 20 nt, Human
ucugaaaguuuuggaaacgu

SEQ ID NO: 674099 - RNA, 14 nt, Human
uuauuauauuuaca

SEQ ID NO: 674100 - RNA, 22 nt, Human
uuuaauaauguuucaaacauau

SEQ ID NO: 674101 - RNA, 17 nt, Human
cauuguuggcuguuccu

SEQ ID NO: 674102 - RNA, 18 nt, Human
caaguaaaaggaaaugcu

SEQ ID NO: 674103 - RNA, 14 nt, Human
agacaucaacagau

SEQ ID NO: 674104 - RNA, 21 nt, Human
aaagauuugauguauguaaua

SEQ ID NO: 674105 - RNA, 21 nt, Human
aaagaaaauaacgauaaaaga

SEQ ID NO: 674106 - RNA, 21 nt, Human
aaaagguauuuuaaucaccaa

SEQ ID NO: 674107 - RNA, 23 nt, Human
uguucccuggggcuuuaacuccu

SEQ ID NO: 674108 - RNA, 15 nt, Human
auaucaauuuaaaaa

SEQ ID NO: 674109 - RNA, 21 nt, Human
cuuuuccaaugacauuuuguu

SEQ ID NO: 674110 - RNA, 22 nt, Human
auuuucuucucacauuuauauu

SEQ ID NO: 674111 - RNA, 14 nt, Human
aauauuauguuaaa

SEQ ID NO: 674112 - RNA, 11 nt, Human
aauuuaaauau

SEQ ID NO: 674113 - RNA, 17 nt, Human
acuauuuaauuauuuca

SEQ ID NO: 674114 - RNA, 22 nt, Human
gaaugaccuggccgcagugagg

SEQ ID NO: 674115 - RNA, 22 nt, Human
gaggggagcaugggaagugacg

SEQ ID NO: 674116 - RNA, 21 nt, Human
agcccuuccccucugcagcuu

SEQ ID NO: 674117 - RNA, 19 nt, Human
caacucccugccccccagc

SEQ ID NO: 674118 - RNA, 17 nt, Human
guggcucugugugcucu

SEQ ID NO: 674119 - RNA, 14 nt, Human
auaaauaaaaauaa

SEQ ID NO: 674120 - RNA, 14 nt, Human
aaauauaaauaaaa

SEQ ID NO: 674121 - RNA, 11 nt, Human
auaauuuaaau

SEQ ID NO: 674122 - RNA, 18 nt, Human
gaggcuccacuuggucug

SEQ ID NO: 674123 - RNA, 18 nt, Human
uacaugucuagagaacac

SEQ ID NO: 674124 - RNA, 19 nt, Human
auccuacaagacacaguga

SEQ ID NO: 674125 - RNA, 20 nt, Human
ucuucuggguuccuuccucu

SEQ ID NO: 674126 - RNA, 18 nt, Human
uaauuauguucuaagugc

SEQ ID NO: 674127 - RNA, 15 nt, Human
aagugaaaaucuaca

SEQ ID NO: 674128 - RNA, 13 nt, Human
uuggacgagaaaa

SEQ ID NO: 674129 - RNA, 13 nt, Human
aaguaaaggcaaa

SEQ ID NO: 674130 - RNA, 20 nt, Human
aauucuugccaaauauaaau

SEQ ID NO: 674131 - RNA, 20 nt, Human
cacuguggguagacacacau

SEQ ID NO: 674132 - RNA, 15 nt, Human
auauaaauaaaaaua

SEQ ID NO: 674133 - RNA, 19 nt, Human
auagcuacuaauuuuaaaa

SEQ ID NO: 674134 - RNA, 15 nt, Human
ggccaccugcugagc

SEQ ID NO: 674135 - RNA, 13 nt, Human
cagaaacuccugu

SEQ ID NO: 674136 - RNA, 19 nt, Human
acucugucucaguccauga

SEQ ID NO: 674137 - RNA, 17 nt, Human
gaagaccucauuuugaa

SEQ ID NO: 674138 - RNA, 18 nt, Human
auggcuugaguuuaaauu

SEQ ID NO: 674139 - RNA, 21 nt, Human
acuuuuccaaugacauuuugu

SEQ ID NO: 674140 - RNA, 13 nt, Human
cuucucaacucca

SEQ ID NO: 674141 - RNA, 22 nt, Human
gaggcggauugagaaggagcuc

SEQ ID NO: 674142 - RNA, 15 nt, Human
cucccugccccccag

SEQ ID NO: 674143 - RNA, 16 nt, Human
ggcagagagguaggga

SEQ ID NO: 674144 - RNA, 17 nt, Human
agcuggaaacacauguu

SEQ ID NO: 674145 - RNA, 16 nt, Human
uucaguuauuauauuu

SEQ ID NO: 674146 - RNA, 16 nt, Human
gccaaauguaaaauag

SEQ ID NO: 674147 - RNA, 18 nt, Human
ccaaaggcuccugagaca

SEQ ID NO: 674148 - RNA, 17 nt, Human
agugagacagcucugca

SEQ ID NO: 674149 - RNA, 17 nt, Human
caaauaagucaucugau

SEQ ID NO: 674150 - RNA, 24 nt, Human
gccugcccugaaagucccagauca

SEQ ID NO: 674151 - RNA, 22 nt, Human
gacacaugugcuggccaccugc

SEQ ID NO: 674152 - RNA, 17 nt, Human
uuucauaagaauucugu

SEQ ID NO: 674153 - RNA, 17 nt, Human
cgauaaaagacagugaa

SEQ ID NO: 674154 - RNA, 17 nt, Human
ggaacauuuauguuccu

SEQ ID NO: 674155 - RNA, 20 nt, Haemophilus influenzae Rd
uuuuugauaugccaccguca

SEQ ID NO: 674156 - RNA, 21 nt, Haemophilus influenzae Rd
uuuuugcaauuuaacauaauu

SEQ ID NO: 674157 - RNA, 22 nt, Haemophilus influenzae Rd
uuuuuggugcuaccgaaagaua

SEQ ID NO: 674158 - RNA, 13 nt, Haemophilus influenzae Rd
uuuuuguaaaaua

SEQ ID NO: 674159 - RNA, 13 nt, Haemophilus influenzae Rd
uuuucuuuugccc

SEQ ID NO: 674160 - RNA, 15 nt, Haemophilus influenzae Rd
uuuucuucagcauca

SEQ ID NO: 674161 - RNA, 16 nt, Haemophilus influenzae Rd
uuuucuucuaauucuu

SEQ ID NO: 674162 - RNA, 13 nt, Haemophilus influenzae Rd
uuuugaaucucau

SEQ ID NO: 674163 - RNA, 22 nt, Haemophilus influenzae Rd
uuuugaugaaaguugaauauuu

SEQ ID NO: 674164 - RNA, 17 nt, Haemophilus influenzae Rd
uuuucucuguuuuaucu

SEQ ID NO: 674165 - RNA, 18 nt, Haemophilus influenzae Rd
uuuucacccaucuaaacu

SEQ ID NO: 674166 - RNA, 18 nt, Haemophilus influenzae Rd
uuuucaccgcacuuucuu

SEQ ID NO: 674167 - RNA, 22 nt, Haemophilus influenzae Rd
uuuucacgguuuuccacuucuu

SEQ ID NO: 674168 - RNA, 22 nt, Haemophilus influenzae Rd
uuuucacaccgucuaaaaaucc

SEQ ID NO: 674169 - RNA, 16 nt, Haemophilus influenzae Rd
uuuucaacaaaaaaca

SEQ ID NO: 674170 - RNA, 22 nt, Haemophilus influenzae Rd
uuuuauauuuuuuacuauucuu

SEQ ID NO: 674171 - RNA, 20 nt, Haemophilus influenzae Rd
uuuuaucagaaugauuaucu

SEQ ID NO: 674172 - RNA, 14 nt, Haemophilus influenzae Rd
uuuuaucgguuauu

SEQ ID NO: 674173 - RNA, 15 nt, Haemophilus influenzae Rd
uuuuauuccaccaca

SEQ ID NO: 674174 - RNA, 16 nt, Haemophilus influenzae Rd
uuuuacggauuuauau

SEQ ID NO: 674175 - RNA, 14 nt, Haemophilus influenzae Rd
uuuuaauuuauacu

SEQ ID NO: 674176 - RNA, 15 nt, Haemophilus influenzae Rd
uuuuacaauaccaau

SEQ ID NO: 674177 - RNA, 19 nt, Haemophilus influenzae Rd
uuuuacugcuuuauuuucu

SEQ ID NO: 674178 - RNA, 18 nt, Haemophilus influenzae Rd
uuuuagagcuuuuugcgc

SEQ ID NO: 674179 - RNA, 21 nt, Haemophilus influenzae Rd
uuuuagccuaagauuuuaucu

SEQ ID NO: 674180 - RNA, 22 nt, Haemophilus influenzae Rd
uuuuagcugucucauuuugcuc

SEQ ID NO: 674181 - RNA, 13 nt, Haemophilus influenzae Rd
uuuguccuuuauc

SEQ ID NO: 674182 - RNA, 23 nt, Haemophilus influenzae Rd
uuugucgccuuagauauuauuua

SEQ ID NO: 674183 - RNA, 14 nt, Haemophilus influenzae Rd
uuucgcagccacuu

SEQ ID NO: 674184 - RNA, 23 nt, Haemophilus influenzae Rd
uuucgcuuugcuuggaucacgca

SEQ ID NO: 674185 - RNA, 15 nt, Haemophilus influenzae Rd
uuugcaaaauugcuu

SEQ ID NO: 674186 - RNA, 13 nt, Haemophilus influenzae Rd
uuugccaucacga

SEQ ID NO: 674187 - RNA, 13 nt, Haemophilus influenzae Rd
uuugcccacauag

SEQ ID NO: 674188 - RNA, 22 nt, Haemophilus influenzae Rd
uuuggugcauguuuacuuaaau

SEQ ID NO: 674189 - RNA, 14 nt, Haemophilus influenzae Rd
uuugguggcuuuuu

SEQ ID NO: 674190 - RNA, 21 nt, Haemophilus influenzae Rd
uuuguaaacgccaucaaccau

SEQ ID NO: 674191 - RNA, 14 nt, Haemophilus influenzae Rd
uuugguaauguuua

SEQ ID NO: 674192 - RNA, 15 nt, Haemophilus influenzae Rd
uugguguaauuugau

SEQ ID NO: 674193 - RNA, 20 nt, Haemophilus influenzae Rd
uugguuuugcucuuuuucca

SEQ ID NO: 674194 - RNA, 17 nt, Haemophilus influenzae Rd
uuguaaaauauccacau

SEQ ID NO: 674195 - RNA, 19 nt, Haemophilus influenzae Rd
uugguagcuaaaaauaauu

SEQ ID NO: 674196 - RNA, 23 nt, Haemophilus influenzae Rd
uuggucaauauauucuugguucg

SEQ ID NO: 674197 - RNA, 19 nt, Haemophilus influenzae Rd
uugugucacuagauuuucu

SEQ ID NO: 674198 - RNA, 22 nt, Haemophilus influenzae Rd
uugugucuaccgauuccaccac

SEQ ID NO: 674199 - RNA, 13 nt, Haemophilus influenzae Rd
uuguuuuaaaauu

SEQ ID NO: 674200 - RNA, 19 nt, Haemophilus influenzae Rd
uuguggaauaccauucguu

SEQ ID NO: 674201 - RNA, 14 nt, Haemophilus influenzae Rd
uugugaguaaaaua

SEQ ID NO: 674202 - RNA, 19 nt, Haemophilus influenzae Rd
uugugaguaaaauacgaau

SEQ ID NO: 674203 - RNA, 17 nt, Haemophilus influenzae Rd
uuguuucuaauuuuuca

SEQ ID NO: 674204 - RNA, 15 nt, Haemophilus influenzae Rd
uuguuuuaauaucau

SEQ ID NO: 674205 - RNA, 19 nt, Haemophilus influenzae Rd
uuuaaaccauuuuaaucau

SEQ ID NO: 674206 - RNA, 14 nt, Haemophilus influenzae Rd
uuuaaaaaauaauu

SEQ ID NO: 674207 - RNA, 18 nt, Haemophilus influenzae Rd
uugucagauuuauaaaua

SEQ ID NO: 674208 - RNA, 19 nt, Haemophilus influenzae Rd
uugucauuaaaaaauaauu

SEQ ID NO: 674209 - RNA, 23 nt, Haemophilus influenzae Rd
uugucguucuuaccccaacaaac

SEQ ID NO: 674210 - RNA, 19 nt, Haemophilus influenzae Rd
uuuccuuugagccuucaaa

SEQ ID NO: 674211 - RNA, 15 nt, Haemophilus influenzae Rd
uuucgauacuuucuu

SEQ ID NO: 674212 - RNA, 20 nt, Haemophilus influenzae Rd
uuucauuugaacaauuaacg

SEQ ID NO: 674213 - RNA, 12 nt, Haemophilus influenzae Rd
uuuccaaccaau

SEQ ID NO: 674214 - RNA, 22 nt, Haemophilus influenzae Rd
uuucauccuaaaaaaauaaccg

SEQ ID NO: 674215 - RNA, 14 nt, Haemophilus influenzae Rd
uuucaucguuaauu

SEQ ID NO: 674216 - RNA, 16 nt, Haemophilus influenzae Rd
uuucauauuuuaaaua

SEQ ID NO: 674217 - RNA, 20 nt, Haemophilus influenzae Rd
uuucauauuuuaaauaauua

SEQ ID NO: 674218 - RNA, 21 nt, Haemophilus influenzae Rd
uuucauucguauaaauauuuc

SEQ ID NO: 674219 - RNA, 19 nt, Haemophilus influenzae Rd
uuucauucuauuuuaaaaa

SEQ ID NO: 674220 - RNA, 23 nt, Haemophilus influenzae Rd
uuucaaaggcucuaccuaaaaua

SEQ ID NO: 674221 - RNA, 16 nt, Haemophilus influenzae Rd
uuucaaccauuaaaua

SEQ ID NO: 674222 - RNA, 16 nt, Haemophilus influenzae Rd
uuucaauaauuuuucu

SEQ ID NO: 674223 - RNA, 22 nt, Haemophilus influenzae Rd
uuucaaucgaaaguggcuuuuu

SEQ ID NO: 674224 - RNA, 20 nt, Haemophilus influenzae Rd
uuucaaggccauauuuuccc

SEQ ID NO: 674225 - RNA, 23 nt, Haemophilus influenzae Rd
uuuaaauuuuaaaaaauaauuua

SEQ ID NO: 674226 - RNA, 15 nt, Haemophilus influenzae Rd
uuuaaaguaauagcg

SEQ ID NO: 674227 - RNA, 15 nt, Haemophilus influenzae Rd
uuuaaauaaauaaua

SEQ ID NO: 674228 - RNA, 12 nt, Haemophilus influenzae Rd
uuuaaauauuua

SEQ ID NO: 674229 - RNA, 20 nt, Haemophilus influenzae Rd
uuuaggggccuuuuuuaucu

SEQ ID NO: 674230 - RNA, 21 nt, Haemophilus influenzae Rd
uuuaauaaucuuaaauaauua

SEQ ID NO: 674231 - RNA, 17 nt, Haemophilus influenzae Rd
uuuaauaaaguaaaaua

SEQ ID NO: 674232 - RNA, 15 nt, Haemophilus influenzae Rd
uuuaauaaaucuugg

SEQ ID NO: 674233 - RNA, 22 nt, Haemophilus influenzae Rd
uuuaaguaaugcuaaauauaua

SEQ ID NO: 674234 - RNA, 18 nt, Haemophilus influenzae Rd
uuuaaccugauuaaucaa

SEQ ID NO: 674235 - RNA, 16 nt, Haemophilus influenzae Rd
uuuaagaguaaauuua

SEQ ID NO: 674236 - RNA, 21 nt, Haemophilus influenzae Rd
uuuauaaacuacccaaauuua

SEQ ID NO: 674237 - RNA, 18 nt, Haemophilus influenzae Rd
uuuagguuagaauaaacc

SEQ ID NO: 674238 - RNA, 23 nt, Haemophilus influenzae Rd
uuuaguuagaagugaaauauuuc

SEQ ID NO: 674239 - RNA, 19 nt, Haemophilus influenzae Rd
uuuagcgucgguaauaucg

SEQ ID NO: 674240 - RNA, 20 nt, Haemophilus influenzae Rd
uuuagcuaauccuuuaccaa

SEQ ID NO: 674241 - RNA, 19 nt, Haemophilus influenzae Rd
uuuagcugcaauaauuuua

SEQ ID NO: 674242 - RNA, 13 nt, Haemophilus influenzae Rd
uuuaguaauuuua

SEQ ID NO: 674243 - RNA, 17 nt, Haemophilus influenzae Rd
uuuauagaaaugguuac

SEQ ID NO: 674244 - RNA, 14 nt, Haemophilus influenzae Rd
uuuauaacauaauu

SEQ ID NO: 674245 - RNA, 13 nt, Haemophilus influenzae Rd
uuuauaaucuuua

SEQ ID NO: 674246 - RNA, 16 nt, Haemophilus influenzae Rd
uuuauaggcgcucuuc

SEQ ID NO: 674247 - RNA, 21 nt, Haemophilus influenzae Rd
uuuauauucuggcaauauuuc

SEQ ID NO: 674248 - RNA, 18 nt, Haemophilus influenzae Rd
uuuauuauuaaauaaacg

SEQ ID NO: 674249 - RNA, 13 nt, Haemophilus influenzae Rd
uuuauucauaaau

SEQ ID NO: 674250 - RNA, 14 nt, Haemophilus influenzae Rd
uuuauuuaacaaua

SEQ ID NO: 674251 - RNA, 14 nt, Haemophilus influenzae Rd
uuuauuuaauaaca

SEQ ID NO: 674252 - RNA, 20 nt, Haemophilus influenzae Rd
uuuauuuacugauuuaaaaa

SEQ ID NO: 674253 - RNA, 15 nt, Haemophilus influenzae Rd
uuuauuuuaauuuua

SEQ ID NO: 674254 - RNA, 17 nt, Haemophilus influenzae Rd
uuuauuuuuauuauuua

SEQ ID NO: 674255 - RNA, 17 nt, Haemophilus influenzae Rd
uuuauuuuuucaucauu

SEQ ID NO: 674256 - RNA, 17 nt, Haemophilus influenzae Rd
uugauugcgaauauuaa

SEQ ID NO: 674257 - RNA, 19 nt, Haemophilus influenzae Rd
uugauugcgagucaaauuu

SEQ ID NO: 674258 - RNA, 14 nt, Haemophilus influenzae Rd
uugauuaucuaauu

SEQ ID NO: 674259 - RNA, 12 nt, Haemophilus influenzae Rd
uugauuuaaaaa

SEQ ID NO: 674260 - RNA, 15 nt, Haemophilus influenzae Rd
uugauuuaucauaau

SEQ ID NO: 674261 - RNA, 23 nt, Haemophilus influenzae Rd
uugcaaaaaguacuugcaaggga

SEQ ID NO: 674262 - RNA, 21 nt, Haemophilus influenzae Rd
uugcaaaaaugacaucauuaa

SEQ ID NO: 674263 - RNA, 22 nt, Haemophilus influenzae Rd
uugcaacuaauagcgugaaaag

SEQ ID NO: 674264 - RNA, 20 nt, Haemophilus influenzae Rd
uugauaaccuucaaugguuu

SEQ ID NO: 674265 - RNA, 20 nt, Haemophilus influenzae Rd
uugaguagcugaauaucaga

SEQ ID NO: 674266 - RNA, 20 nt, Haemophilus influenzae Rd
uugauaauuuaagcaaaauc

SEQ ID NO: 674267 - RNA, 20 nt, Haemophilus influenzae Rd
uugcccacgcacuuuuccaa

SEQ ID NO: 674268 - RNA, 15 nt, Haemophilus influenzae Rd
uugcacaauuuggcg

SEQ ID NO: 674269 - RNA, 15 nt, Haemophilus influenzae Rd
uugcaauggcuuuua

SEQ ID NO: 674270 - RNA, 17 nt, Haemophilus influenzae Rd
uugcaccuuguaaccaa

SEQ ID NO: 674271 - RNA, 11 nt, Haemophilus influenzae Rd
uugcagcccaa

SEQ ID NO: 674272 - RNA, 21 nt, Haemophilus influenzae Rd
uugcaucuuggcauuuuugcu

SEQ ID NO: 674273 - RNA, 15 nt, Haemophilus influenzae Rd
uugcaugaaauguag

SEQ ID NO: 674274 - RNA, 20 nt, Haemophilus influenzae Rd
uugcauauccgcugcaaauu

SEQ ID NO: 674275 - RNA, 17 nt, Haemophilus influenzae Rd
uugaagcacugaaauau

SEQ ID NO: 674276 - RNA, 20 nt, Haemophilus influenzae Rd
uugaagguuagggauaauuu

SEQ ID NO: 674277 - RNA, 22 nt, Haemophilus influenzae Rd
uugaauaucaaggagcuaguuu

SEQ ID NO: 674278 - RNA, 17 nt, Haemophilus influenzae Rd
uuccuaaaguuuuugca

SEQ ID NO: 674279 - RNA, 23 nt, Haemophilus influenzae Rd
uuccuccgccaucaauuuuuacg

SEQ ID NO: 674280 - RNA, 17 nt, Haemophilus influenzae Rd
uugaacccauuaaccaa

SEQ ID NO: 674281 - RNA, 15 nt, Haemophilus influenzae Rd
uugaacugaauuaaa

SEQ ID NO: 674282 - RNA, 15 nt, Haemophilus influenzae Rd
uugaagaacguaaau

SEQ ID NO: 674283 - RNA, 22 nt, Haemophilus influenzae Rd
uugagauuuaauccguuaauuu

SEQ ID NO: 674284 - RNA, 22 nt, Haemophilus influenzae Rd
uugagauuuaauuuauuuucua

SEQ ID NO: 674285 - RNA, 19 nt, Haemophilus influenzae Rd
uugacgaaaaauuaaccau

SEQ ID NO: 674286 - RNA, 23 nt, Haemophilus influenzae Rd
uuggauuaagaaucuuacgaaga

SEQ ID NO: 674287 - RNA, 14 nt, Haemophilus influenzae Rd
uuggcaaaauaauc

SEQ ID NO: 674288 - RNA, 17 nt, Haemophilus influenzae Rd
uuggacaagaaauaaua

SEQ ID NO: 674289 - RNA, 19 nt, Haemophilus influenzae Rd
uuggaguucuugaauacaa

SEQ ID NO: 674290 - RNA, 19 nt, Haemophilus influenzae Rd
uuggauacguuuuguuaau

SEQ ID NO: 674291 - RNA, 18 nt, Haemophilus influenzae Rd
uuggaagaaaagcauuaa

SEQ ID NO: 674292 - RNA, 14 nt, Haemophilus influenzae Rd
uuggaagaauguuu

SEQ ID NO: 674293 - RNA, 18 nt, Haemophilus influenzae Rd
uugcugauugcacauuag

SEQ ID NO: 674294 - RNA, 19 nt, Haemophilus influenzae Rd
uugcugccacuucagcuaa

SEQ ID NO: 674295 - RNA, 19 nt, Haemophilus influenzae Rd
uugcuucaauuugacgaau

SEQ ID NO: 674296 - RNA, 17 nt, Haemophilus influenzae Rd
uugcuguugguuaaaaa

SEQ ID NO: 674297 - RNA, 14 nt, Haemophilus influenzae Rd
uugcuuaacauuaa

SEQ ID NO: 674298 - RNA, 15 nt, Haemophilus influenzae Rd
uugcuuagugaaaag

SEQ ID NO: 674299 - RNA, 13 nt, Haemophilus influenzae Rd
uugcuuuaacuga

SEQ ID NO: 674300 - RNA, 21 nt, Haemophilus influenzae Rd
uugcuauccaaccuaauaacg

SEQ ID NO: 674301 - RNA, 13 nt, Haemophilus influenzae Rd
uugcuauuuucua

SEQ ID NO: 674302 - RNA, 18 nt, Haemophilus influenzae Rd
uugcucgugugccaucag

SEQ ID NO: 674303 - RNA, 17 nt, Haemophilus influenzae Rd
uugcucuaauuuuacca

SEQ ID NO: 674304 - RNA, 18 nt, Haemophilus influenzae Rd
uugcgagucaaauuuuua

SEQ ID NO: 674305 - RNA, 18 nt, Haemophilus influenzae Rd
uugccuuucaucauugcu

SEQ ID NO: 674306 - RNA, 15 nt, Haemophilus influenzae Rd
uugccuaauagaaaa

SEQ ID NO: 674307 - RNA, 21 nt, Haemophilus influenzae Rd
uugccgcagguucgccacugg

SEQ ID NO: 674308 - RNA, 20 nt, Haemophilus influenzae Rd
uugcggaucaagauuugcaa

SEQ ID NO: 674309 - RNA, 17 nt, Haemophilus influenzae Rd
uugcgccacaauauuua

SEQ ID NO: 674310 - RNA, 14 nt, Haemophilus influenzae Rd
uugcgccuaaacca

SEQ ID NO: 674311 - RNA, 14 nt, Haemophilus influenzae Rd
uggcaguuuggaaa

SEQ ID NO: 674312 - RNA, 19 nt, Haemophilus influenzae Rd
uggcacuaaagcaauauuu

SEQ ID NO: 674313 - RNA, 12 nt, Haemophilus influenzae Rd
uggauuggcaau

SEQ ID NO: 674314 - RNA, 19 nt, Haemophilus influenzae Rd
uggauggagagaauagcua

SEQ ID NO: 674315 - RNA, 15 nt, Haemophilus influenzae Rd
uggaauggcaaaauu

SEQ ID NO: 674316 - RNA, 14 nt, Haemophilus influenzae Rd
uggcguaaugguuu

SEQ ID NO: 674317 - RNA, 19 nt, Haemophilus influenzae Rd
uggcguaaugccaucacca

SEQ ID NO: 674318 - RNA, 16 nt, Haemophilus influenzae Rd
ugggaaaguuggccaa

SEQ ID NO: 674319 - RNA, 17 nt, Haemophilus influenzae Rd
ugggcgauaaaaauuaa

SEQ ID NO: 674320 - RNA, 19 nt, Haemophilus influenzae Rd
uguuaccaauaacuaaaaa

SEQ ID NO: 674321 - RNA, 20 nt, Haemophilus influenzae Rd
uguuagaucaaauuugaucu

SEQ ID NO: 674322 - RNA, 14 nt, Haemophilus influenzae Rd
uguuaagcaccauc

SEQ ID NO: 674323 - RNA, 15 nt, Haemophilus influenzae Rd
uguuaaauguuaaug

SEQ ID NO: 674324 - RNA, 20 nt, Haemophilus influenzae Rd
uguucacuaaagagaaacau

SEQ ID NO: 674325 - RNA, 18 nt, Haemophilus influenzae Rd
uguugauauucaauuuau

SEQ ID NO: 674326 - RNA, 21 nt, Haemophilus influenzae Rd
uguguaacagcucuguaaaac

SEQ ID NO: 674327 - RNA, 17 nt, Haemophilus influenzae Rd
ugugauuuuagaaaaau

SEQ ID NO: 674328 - RNA, 22 nt, Haemophilus influenzae Rd
ugucauuuauggaaauaaaucc

SEQ ID NO: 674329 - RNA, 23 nt, Haemophilus influenzae Rd
uguagcuugaauauuugggaaau

SEQ ID NO: 674330 - RNA, 14 nt, Haemophilus influenzae Rd
ugucagauuuauaa

SEQ ID NO: 674331 - RNA, 23 nt, Haemophilus influenzae Rd
uguacuauuuuauaaucuuuaaa

SEQ ID NO: 674332 - RNA, 15 nt, Haemophilus influenzae Rd
ugguacgagaaaaau

SEQ ID NO: 674333 - RNA, 16 nt, Haemophilus influenzae Rd
ugguaauuuuggcgaa

SEQ ID NO: 674334 - RNA, 14 nt, Haemophilus influenzae Rd
ugguaauaaaucaa

SEQ ID NO: 674335 - RNA, 20 nt, Haemophilus influenzae Rd
ugguaaaucuaacaaucgac

SEQ ID NO: 674336 - RNA, 16 nt, Haemophilus influenzae Rd
ugguugcgaauugcau

SEQ ID NO: 674337 - RNA, 14 nt, Haemophilus influenzae Rd
ugguguauuuauaa

SEQ ID NO: 674338 - RNA, 19 nt, Haemophilus influenzae Rd
uguacgccaugccaagcua

SEQ ID NO: 674339 - RNA, 18 nt, Haemophilus influenzae Rd
uuacagaacaaaauaauu

SEQ ID NO: 674340 - RNA, 17 nt, Haemophilus influenzae Rd
uuacagauuuugguugu

SEQ ID NO: 674341 - RNA, 15 nt, Haemophilus influenzae Rd
uuacauauaaagauu

SEQ ID NO: 674342 - RNA, 16 nt, Haemophilus influenzae Rd
uuacaucgaauuguuu

SEQ ID NO: 674343 - RNA, 16 nt, Haemophilus influenzae Rd
uuacaucuacaauuug

SEQ ID NO: 674344 - RNA, 21 nt, Haemophilus influenzae Rd
uuacaucuucaaaaacauaau

SEQ ID NO: 674345 - RNA, 11 nt, Haemophilus influenzae Rd
uuacauuuaaa

SEQ ID NO: 674346 - RNA, 15 nt, Haemophilus influenzae Rd
uuacugcuugguucu

SEQ ID NO: 674347 - RNA, 17 nt, Haemophilus influenzae Rd
uuagcuaaacgcucaaa

SEQ ID NO: 674348 - RNA, 14 nt, Haemophilus influenzae Rd
uuacuucaucaaaa

SEQ ID NO: 674349 - RNA, 13 nt, Haemophilus influenzae Rd
uuagaauuuauag

SEQ ID NO: 674350 - RNA, 20 nt, Haemophilus influenzae Rd
uuaucucuuucuuaaaauac

SEQ ID NO: 674351 - RNA, 14 nt, Haemophilus influenzae Rd
uuaugaaauugcug

SEQ ID NO: 674352 - RNA, 17 nt, Haemophilus influenzae Rd
uuaucaauguuugugcg

SEQ ID NO: 674353 - RNA, 23 nt, Haemophilus influenzae Rd
uuaucaaggcuuuaauuuuaucu

SEQ ID NO: 674354 - RNA, 13 nt, Haemophilus influenzae Rd
uuaucaacaucaa

SEQ ID NO: 674355 - RNA, 21 nt, Haemophilus influenzae Rd
uuauauguaaaauuuuuaucu

SEQ ID NO: 674356 - RNA, 18 nt, Haemophilus influenzae Rd
uuauauguuccuuuuugg

SEQ ID NO: 674357 - RNA, 15 nt, Haemophilus influenzae Rd
uuauauucauuuaaa

SEQ ID NO: 674358 - RNA, 16 nt, Haemophilus influenzae Rd
uuaucuaacuaaaaua

SEQ ID NO: 674359 - RNA, 15 nt, Haemophilus influenzae Rd
uuaucuaccacauca

SEQ ID NO: 674360 - RNA, 15 nt, Haemophilus influenzae Rd
uuaggacaauauuua

SEQ ID NO: 674361 - RNA, 12 nt, Haemophilus influenzae Rd
uuagcuuucaua

SEQ ID NO: 674362 - RNA, 15 nt, Haemophilus influenzae Rd
uuaggguauuucggu

SEQ ID NO: 674363 - RNA, 17 nt, Haemophilus influenzae Rd
uuauaguauauuuaucu

SEQ ID NO: 674364 - RNA, 21 nt, Haemophilus influenzae Rd
uuagucauaaaaaagugcggu

SEQ ID NO: 674365 - RNA, 17 nt, Haemophilus influenzae Rd
uuagucgucuauuuauu

SEQ ID NO: 674366 - RNA, 20 nt, Haemophilus influenzae Rd
uuaauccguuaauuucaucc

SEQ ID NO: 674367 - RNA, 16 nt, Haemophilus influenzae Rd
uuaauccguuggucga

SEQ ID NO: 674368 - RNA, 15 nt, Haemophilus influenzae Rd
uuaaucgcacuuaaa

SEQ ID NO: 674369 - RNA, 14 nt, Haemophilus influenzae Rd
uuaaucaccauauc

SEQ ID NO: 674370 - RNA, 14 nt, Haemophilus influenzae Rd
uuaaucauuuucac

SEQ ID NO: 674371 - RNA, 23 nt, Haemophilus influenzae Rd
uuacaaaaaguacuugcaaggga

SEQ ID NO: 674372 - RNA, 14 nt, Haemophilus influenzae Rd
uuaaugccugaucu

SEQ ID NO: 674373 - RNA, 21 nt, Haemophilus influenzae Rd
uuaaugcgcccuuuaaauuac

SEQ ID NO: 674374 - RNA, 14 nt, Haemophilus influenzae Rd
uguuggaauuucaa

SEQ ID NO: 674375 - RNA, 18 nt, Haemophilus influenzae Rd
uguuggcccaacagaaau

SEQ ID NO: 674376 - RNA, 17 nt, Haemophilus influenzae Rd
uguuuucgaucauuuga

SEQ ID NO: 674377 - RNA, 17 nt, Haemophilus influenzae Rd
uuaaauuauauuuuccu

SEQ ID NO: 674378 - RNA, 22 nt, Haemophilus influenzae Rd
uguuuuaccaccgcuaaaucau

SEQ ID NO: 674379 - RNA, 19 nt, Haemophilus influenzae Rd
uuaacaggaauuugcucaa

SEQ ID NO: 674380 - RNA, 12 nt, Haemophilus influenzae Rd
uuaaauuuauca

SEQ ID NO: 674381 - RNA, 20 nt, Haemophilus influenzae Rd
uuaacaaauacaucuucaca

SEQ ID NO: 674382 - RNA, 17 nt, Haemophilus influenzae Rd
uucacugcggcaaaauc

SEQ ID NO: 674383 - RNA, 12 nt, Haemophilus influenzae Rd
uucacacccaug

SEQ ID NO: 674384 - RNA, 17 nt, Haemophilus influenzae Rd
uucaguaucaauaccaa

SEQ ID NO: 674385 - RNA, 19 nt, Haemophilus influenzae Rd
uucaguauccgccaaugcu

SEQ ID NO: 674386 - RNA, 11 nt, Haemophilus influenzae Rd
uucaguuucac

SEQ ID NO: 674387 - RNA, 21 nt, Haemophilus influenzae Rd
uucaguuaauuagaauaacaa

SEQ ID NO: 674388 - RNA, 15 nt, Haemophilus influenzae Rd
uucacuuaaauucau

SEQ ID NO: 674389 - RNA, 14 nt, Haemophilus influenzae Rd
uucacugauuucac

SEQ ID NO: 674390 - RNA, 22 nt, Haemophilus influenzae Rd
uucaauuucucuacuaauucau

SEQ ID NO: 674391 - RNA, 21 nt, Haemophilus influenzae Rd
uucaauuugagucucaaauuu

SEQ ID NO: 674392 - RNA, 18 nt, Haemophilus influenzae Rd
uucaauuuuaauugguuu

SEQ ID NO: 674393 - RNA, 18 nt, Haemophilus influenzae Rd
uuauuacuucaccaauca

SEQ ID NO: 674394 - RNA, 14 nt, Haemophilus influenzae Rd
uucaaaucuugaca

SEQ ID NO: 674395 - RNA, 13 nt, Haemophilus influenzae Rd
uuauuaauaaacu

SEQ ID NO: 674396 - RNA, 18 nt, Haemophilus influenzae Rd
uuauuaaaaaagugcggu

SEQ ID NO: 674397 - RNA, 22 nt, Haemophilus influenzae Rd
uucaucauaaauuuccucaggu

SEQ ID NO: 674398 - RNA, 13 nt, Haemophilus influenzae Rd
uucaucacaucag

SEQ ID NO: 674399 - RNA, 13 nt, Haemophilus influenzae Rd
uucauaccgauaa

SEQ ID NO: 674400 - RNA, 14 nt, Haemophilus influenzae Rd
uucauaaauaucaa

SEQ ID NO: 674401 - RNA, 15 nt, Haemophilus influenzae Rd
uucccgcauuuauca

SEQ ID NO: 674402 - RNA, 17 nt, Haemophilus influenzae Rd
guuaauaaugcuaauuu

SEQ ID NO: 674403 - RNA, 15 nt, Haemophilus influenzae Rd
guuaauacuugcgau

SEQ ID NO: 674404 - RNA, 14 nt, Haemophilus influenzae Rd
guuaauagcgaaac

SEQ ID NO: 674405 - RNA, 13 nt, Haemophilus influenzae Rd
guuaagcaaauuu

SEQ ID NO: 674406 - RNA, 11 nt, Haemophilus influenzae Rd
guuaaauuuag

SEQ ID NO: 674407 - RNA, 20 nt, Haemophilus influenzae Rd
guuaaaaguaagcaauuuuc

SEQ ID NO: 674408 - RNA, 12 nt, Haemophilus influenzae Rd
guuaaaauugcc

SEQ ID NO: 674409 - RNA, 12 nt, Haemophilus influenzae Rd
guucagccacuu

SEQ ID NO: 674410 - RNA, 21 nt, Haemophilus influenzae Rd
guuacaaacaaucuuaacugc

SEQ ID NO: 674411 - RNA, 15 nt, Haemophilus influenzae Rd
guuaauuaauugcuc

SEQ ID NO: 674412 - RNA, 19 nt, Haemophilus influenzae Rd
guuagauacuuuacguaaa

SEQ ID NO: 674413 - RNA, 21 nt, Haemophilus influenzae Rd
guuaguuuguauuugagcauu

SEQ ID NO: 674414 - RNA, 19 nt, Haemophilus influenzae Rd
guucaaaaucagcuaauaa

SEQ ID NO: 674415 - RNA, 17 nt, Haemophilus influenzae Rd
guucaauaauauuaucc

SEQ ID NO: 674416 - RNA, 16 nt, Haemophilus influenzae Rd
guugauuagcuaauau

SEQ ID NO: 674417 - RNA, 18 nt, Haemophilus influenzae Rd
guugcucagccaguuuuc

SEQ ID NO: 674418 - RNA, 21 nt, Haemophilus influenzae Rd
guugcucagccaguuuucuag

SEQ ID NO: 674419 - RNA, 13 nt, Haemophilus influenzae Rd
guuguuuuggauu

SEQ ID NO: 674420 - RNA, 17 nt, Haemophilus influenzae Rd
guucuuuguuaccuuuu

SEQ ID NO: 674421 - RNA, 22 nt, Haemophilus influenzae Rd
guucgauaacaauuuuugcauu

SEQ ID NO: 674422 - RNA, 16 nt, Haemophilus influenzae Rd
guuccgaucaaauugu

SEQ ID NO: 674423 - RNA, 12 nt, Haemophilus influenzae Rd
uaaaagugcggu

SEQ ID NO: 674424 - RNA, 22 nt, Haemophilus influenzae Rd
uaaaaguccgcugcucuaccga

SEQ ID NO: 674425 - RNA, 16 nt, Haemophilus influenzae Rd
uaaaaauuuaaaagca

SEQ ID NO: 674426 - RNA, 17 nt, Haemophilus influenzae Rd
uaaaaauuuaaauauaa

SEQ ID NO: 674427 - RNA, 12 nt, Haemophilus influenzae Rd
uaaaaagugggu

SEQ ID NO: 674428 - RNA, 15 nt, Haemophilus influenzae Rd
uaaaaauaaguucau

SEQ ID NO: 674429 - RNA, 16 nt, Haemophilus influenzae Rd
uaaaaauaauuuuacu

SEQ ID NO: 674430 - RNA, 18 nt, Haemophilus influenzae Rd
uaaaaagaaaagugcgga

SEQ ID NO: 674431 - RNA, 14 nt, Haemophilus influenzae Rd
uaaagaaauaagca

SEQ ID NO: 674432 - RNA, 18 nt, Haemophilus influenzae Rd
uaaagaguucguccaaaa

SEQ ID NO: 674433 - RNA, 23 nt, Haemophilus influenzae Rd
uaaaauauaacauuuauuuuucu

SEQ ID NO: 674434 - RNA, 16 nt, Haemophilus influenzae Rd
uaaaauacuuucagaa

SEQ ID NO: 674435 - RNA, 20 nt, Haemophilus influenzae Rd
uaaaauaauauccaauguaa

SEQ ID NO: 674436 - RNA, 19 nt, Haemophilus influenzae Rd
uaaaauagagcaaauauaa

SEQ ID NO: 674437 - RNA, 15 nt, Haemophilus influenzae Rd
uaaacacuccaacac

SEQ ID NO: 674438 - RNA, 22 nt, Haemophilus influenzae Rd
uaaacagucugcgccuaaaaua

SEQ ID NO: 674439 - RNA, 13 nt, Haemophilus influenzae Rd
uaaaucuaaaaua

SEQ ID NO: 674440 - RNA, 22 nt, Haemophilus influenzae Rd
uaaaucuacuuggacauuguug

SEQ ID NO: 674441 - RNA, 15 nt, Haemophilus influenzae Rd
uaaauccguaaaaua

SEQ ID NO: 674442 - RNA, 23 nt, Haemophilus influenzae Rd
uaaauccucagcaauuucuucag

SEQ ID NO: 674443 - RNA, 16 nt, Haemophilus influenzae Rd
uaaauaguuaauugau

SEQ ID NO: 674444 - RNA, 23 nt, Haemophilus influenzae Rd
uaaauaaauuccuacacccauua

SEQ ID NO: 674445 - RNA, 12 nt, Haemophilus influenzae Rd
uaaauagcgauc

SEQ ID NO: 674446 - RNA, 13 nt, Haemophilus influenzae Rd
uaaauaauucagc

SEQ ID NO: 674447 - RNA, 23 nt, Haemophilus influenzae Rd
uaaagugcggaaauauuuuaaua

SEQ ID NO: 674448 - RNA, 21 nt, Haemophilus influenzae Rd
uaaagugcggucugaaaauca

SEQ ID NO: 674449 - RNA, 14 nt, Haemophilus influenzae Rd
uaaauuuuuuugca

SEQ ID NO: 674450 - RNA, 16 nt, Haemophilus influenzae Rd
uaacaauaauuugcca

SEQ ID NO: 674451 - RNA, 13 nt, Haemophilus influenzae Rd
uaaauuuuuaaug

SEQ ID NO: 674452 - RNA, 14 nt, Haemophilus influenzae Rd
uaaauuuuaaaaua

SEQ ID NO: 674453 - RNA, 23 nt, Haemophilus influenzae Rd
uaaauuuuaaccgcacuuuaucu

SEQ ID NO: 674454 - RNA, 22 nt, Haemophilus influenzae Rd
uaacaaaagggcgauuaaaaac

SEQ ID NO: 674455 - RNA, 17 nt, Haemophilus influenzae Rd
uaacaaaauggcuuuuu

SEQ ID NO: 674456 - RNA, 21 nt, Haemophilus influenzae Rd
uaacaaaauggcuuuuuugcc

SEQ ID NO: 674457 - RNA, 15 nt, Haemophilus influenzae Rd
uaaaugcuguagaaa

SEQ ID NO: 674458 - RNA, 14 nt, Haemophilus influenzae Rd
uaaaucuucuuuac

SEQ ID NO: 674459 - RNA, 20 nt, Haemophilus influenzae Rd
uaaaugcaguauaaaccgca

SEQ ID NO: 674460 - RNA, 14 nt, Haemophilus influenzae Rd
uaaaugcaucauua

SEQ ID NO: 674461 - RNA, 18 nt, Haemophilus influenzae Rd
uaaccaucuuuuuuugca

SEQ ID NO: 674462 - RNA, 19 nt, Haemophilus influenzae Rd
uaaccacguauuuuuuaau

SEQ ID NO: 674463 - RNA, 13 nt, Haemophilus influenzae Rd
uaacacauaagca

SEQ ID NO: 674464 - RNA, 13 nt, Haemophilus influenzae Rd
uaacauuuuuuuu

SEQ ID NO: 674465 - RNA, 21 nt, Haemophilus influenzae Rd
uaacgcauaauuugcuguggu

SEQ ID NO: 674466 - RNA, 23 nt, Haemophilus influenzae Rd
uaaccuuaaaucaaacaaaauuu

SEQ ID NO: 674467 - RNA, 18 nt, Haemophilus influenzae Rd
uaacuaugccuucuucac

SEQ ID NO: 674468 - RNA, 16 nt, Haemophilus influenzae Rd
uacagcgaacauuuuu

SEQ ID NO: 674469 - RNA, 23 nt, Haemophilus influenzae Rd
uacagcacuaaaagcauuacaaa

SEQ ID NO: 674470 - RNA, 18 nt, Haemophilus influenzae Rd
uacaccguccaagguuuu

SEQ ID NO: 674471 - RNA, 17 nt, Haemophilus influenzae Rd
uacaaaaaagugcgguu

SEQ ID NO: 674472 - RNA, 11 nt, Haemophilus influenzae Rd
uaauuuuaauu

SEQ ID NO: 674473 - RNA, 17 nt, Haemophilus influenzae Rd
uaauuuuaccaagaaau

SEQ ID NO: 674474 - RNA, 15 nt, Haemophilus influenzae Rd
uaauuuuacguuuca

SEQ ID NO: 674475 - RNA, 20 nt, Haemophilus influenzae Rd
uaauuuuccuaacaauaauu

SEQ ID NO: 674476 - RNA, 14 nt, Haemophilus influenzae Rd
uaauuuuucacuga

SEQ ID NO: 674477 - RNA, 19 nt, Haemophilus influenzae Rd
uaauuuuuuguucauuuua

SEQ ID NO: 674478 - RNA, 19 nt, Haemophilus influenzae Rd
uaaugcauugauugcuaaa

SEQ ID NO: 674479 - RNA, 22 nt, Haemophilus influenzae Rd
uaauuaaacagcacacuaauaa

SEQ ID NO: 674480 - RNA, 19 nt, Haemophilus influenzae Rd
uaauuaaacuuucaauuuu

SEQ ID NO: 674481 - RNA, 14 nt, Haemophilus influenzae Rd
uaauuaaagucaga

SEQ ID NO: 674482 - RNA, 15 nt, Haemophilus influenzae Rd
uaauuaaucuuuuuu

SEQ ID NO: 674483 - RNA, 14 nt, Haemophilus influenzae Rd
uaauugacguaaaa

SEQ ID NO: 674484 - RNA, 22 nt, Haemophilus influenzae Rd
uaauuauggugaauaaaaccgc

SEQ ID NO: 674485 - RNA, 23 nt, Haemophilus influenzae Rd
uaauuaggcgacgcugcaaaaug

SEQ ID NO: 674486 - RNA, 13 nt, Haemophilus influenzae Rd
uaauuauaaaaua

SEQ ID NO: 674487 - RNA, 18 nt, Haemophilus influenzae Rd
uaauuacgccuaaccaag

SEQ ID NO: 674488 - RNA, 22 nt, Haemophilus influenzae Rd
uaauuagaauaacaacaaaagu

SEQ ID NO: 674489 - RNA, 20 nt, Haemophilus influenzae Rd
uaauuccccuucaaauauaa

SEQ ID NO: 674490 - RNA, 15 nt, Haemophilus influenzae Rd
uaauucauuagccaa

SEQ ID NO: 674491 - RNA, 18 nt, Haemophilus influenzae Rd
uaauucaccgccuacaug

SEQ ID NO: 674492 - RNA, 17 nt, Haemophilus influenzae Rd
uaauaucaagucaaaaa

SEQ ID NO: 674493 - RNA, 15 nt, Haemophilus influenzae Rd
uaauauaaaggauuu

SEQ ID NO: 674494 - RNA, 20 nt, Haemophilus influenzae Rd
uaauauaccccaaacuauau

SEQ ID NO: 674495 - RNA, 15 nt, Haemophilus influenzae Rd
uaaguuuuuugccaa

SEQ ID NO: 674496 - RNA, 14 nt, Haemophilus influenzae Rd
uaauagaguaccaa

SEQ ID NO: 674497 - RNA, 21 nt, Haemophilus influenzae Rd
uaauagaacuguuauuugcaa

SEQ ID NO: 674498 - RNA, 23 nt, Haemophilus influenzae Rd
uaauaggcgaaucaaaaucugcu

SEQ ID NO: 674499 - RNA, 17 nt, Haemophilus influenzae Rd
uaaucgaucaauuugcg

SEQ ID NO: 674500 - RNA, 17 nt, Haemophilus influenzae Rd
uaauccuucuucggcga

SEQ ID NO: 674501 - RNA, 20 nt, Haemophilus influenzae Rd
uaaugauaaguuuugucuga

SEQ ID NO: 674502 - RNA, 20 nt, Haemophilus influenzae Rd
uaaguagaaaaauugguacg

SEQ ID NO: 674503 - RNA, 20 nt, Haemophilus influenzae Rd
uaagcccuguagauuacaga

SEQ ID NO: 674504 - RNA, 18 nt, Haemophilus influenzae Rd
uaaguaugccauaaaaua

SEQ ID NO: 674505 - RNA, 21 nt, Haemophilus influenzae Rd
uaagccagaacauauaaccca

SEQ ID NO: 674506 - RNA, 22 nt, Haemophilus influenzae Rd
uaagcauuuuaucacaaguuaa

SEQ ID NO: 674507 - RNA, 14 nt, Haemophilus influenzae Rd
uaacugcuuuuuuc

SEQ ID NO: 674508 - RNA, 15 nt, Haemophilus influenzae Rd
uaacugauaugccaa

SEQ ID NO: 674509 - RNA, 14 nt, Haemophilus influenzae Rd
uaccgcucauugcu

SEQ ID NO: 674510 - RNA, 16 nt, Haemophilus influenzae Rd
uaccgcauuuuuaaug

SEQ ID NO: 674511 - RNA, 15 nt, Haemophilus influenzae Rd
uacgcauaucacgau

SEQ ID NO: 674512 - RNA, 14 nt, Haemophilus influenzae Rd
uacgagaaaaaucu

SEQ ID NO: 674513 - RNA, 21 nt, Haemophilus influenzae Rd
uacgagaaaaaucuuuaccaa

SEQ ID NO: 674514 - RNA, 18 nt, Haemophilus influenzae Rd
uacccauugcucgauaag

SEQ ID NO: 674515 - RNA, 13 nt, Haemophilus influenzae Rd
uaccccaauuaag

SEQ ID NO: 674516 - RNA, 17 nt, Haemophilus influenzae Rd
uacaucacuaauacgcg

SEQ ID NO: 674517 - RNA, 19 nt, Haemophilus influenzae Rd
uacauaaugggcuuuccaa

SEQ ID NO: 674518 - RNA, 19 nt, Haemophilus influenzae Rd
uagcgcagcguugauuaag

SEQ ID NO: 674519 - RNA, 18 nt, Haemophilus influenzae Rd
uagcauaaaacaguauuu

SEQ ID NO: 674520 - RNA, 17 nt, Haemophilus influenzae Rd
uagccaauaauaaagcu

SEQ ID NO: 674521 - RNA, 21 nt, Haemophilus influenzae Rd
uagauaaaaagugcgguaaau

SEQ ID NO: 674522 - RNA, 20 nt, Haemophilus influenzae Rd
uacuaauaggaguaaaaaua

SEQ ID NO: 674523 - RNA, 17 nt, Haemophilus influenzae Rd
uacuagcucguaaagau

SEQ ID NO: 674524 - RNA, 22 nt, Haemophilus influenzae Rd
uagacacaagggauuuaaaauc

SEQ ID NO: 674525 - RNA, 20 nt, Haemophilus influenzae Rd
uagagcaagcaauauaauca

SEQ ID NO: 674526 - RNA, 13 nt, Haemophilus influenzae Rd
uagagagaaaaau

SEQ ID NO: 674527 - RNA, 21 nt, Haemophilus influenzae Rd
uagagcagcggacuuuuaauc

SEQ ID NO: 674528 - RNA, 15 nt, Haemophilus influenzae Rd
uagacuaugaaauca

SEQ ID NO: 674529 - RNA, 15 nt, Haemophilus influenzae Rd
uacuuuaaagaauau

SEQ ID NO: 674530 - RNA, 14 nt, Haemophilus influenzae Rd
uagaaucaauggcu

SEQ ID NO: 674531 - RNA, 19 nt, Haemophilus influenzae Rd
uagaauuuuuauuuuuacu

SEQ ID NO: 674532 - RNA, 16 nt, Haemophilus influenzae Rd
uaugauuuuaaagcca

SEQ ID NO: 674533 - RNA, 23 nt, Haemophilus influenzae Rd
uaucgcucaauaaggugcuaauu

SEQ ID NO: 674534 - RNA, 17 nt, Haemophilus influenzae Rd
uaucuccaagaauauuu

SEQ ID NO: 674535 - RNA, 18 nt, Haemophilus influenzae Rd
uaucuccaagaauauuuc

SEQ ID NO: 674536 - RNA, 21 nt, Haemophilus influenzae Rd
uaucggagggggauuuucucg

SEQ ID NO: 674537 - RNA, 17 nt, Haemophilus influenzae Rd
uaucgagguuuucguau

SEQ ID NO: 674538 - RNA, 13 nt, Haemophilus influenzae Rd
uauuaguaauaaa

SEQ ID NO: 674539 - RNA, 15 nt, Haemophilus influenzae Rd
uauucuguaucaauu

SEQ ID NO: 674540 - RNA, 14 nt, Haemophilus influenzae Rd
uauucuguugaaug

SEQ ID NO: 674541 - RNA, 19 nt, Haemophilus influenzae Rd
uauucuuuuuaaauauuua

SEQ ID NO: 674542 - RNA, 13 nt, Haemophilus influenzae Rd
uauugauucaauu

SEQ ID NO: 674543 - RNA, 14 nt, Haemophilus influenzae Rd
uaugcgggcaaaaa

SEQ ID NO: 674544 - RNA, 16 nt, Haemophilus influenzae Rd
uauuaccuaaccaaag

SEQ ID NO: 674545 - RNA, 14 nt, Haemophilus influenzae Rd
uauuacucuuaauu

SEQ ID NO: 674546 - RNA, 20 nt, Haemophilus influenzae Rd
ucaaaaucagcaaauuguuu

SEQ ID NO: 674547 - RNA, 17 nt, Haemophilus influenzae Rd
uauuuugauugcgaaua

SEQ ID NO: 674548 - RNA, 16 nt, Haemophilus influenzae Rd
uauuuugcagaauacu

SEQ ID NO: 674549 - RNA, 22 nt, Haemophilus influenzae Rd
uauuuuuuucuaacaucggcaa

SEQ ID NO: 674550 - RNA, 23 nt, Haemophilus influenzae Rd
uauuuuuuucuaacaucggcaac

SEQ ID NO: 674551 - RNA, 17 nt, Haemophilus influenzae Rd
uauuuuuuauaugccaa

SEQ ID NO: 674552 - RNA, 21 nt, Haemophilus influenzae Rd
uauuuacuaaauucuuuugcc

SEQ ID NO: 674553 - RNA, 21 nt, Haemophilus influenzae Rd
uauuuauaauccauucagccc

SEQ ID NO: 674554 - RNA, 15 nt, Haemophilus influenzae Rd
uauuuauauaaagcu

SEQ ID NO: 674555 - RNA, 15 nt, Haemophilus influenzae Rd
uauugcggguuuuau

SEQ ID NO: 674556 - RNA, 18 nt, Haemophilus influenzae Rd
uauuuucuuuccaaccag

SEQ ID NO: 674557 - RNA, 22 nt, Haemophilus influenzae Rd
ucaacaucaaaaccauuuuucg

SEQ ID NO: 674558 - RNA, 15 nt, Haemophilus influenzae Rd
ucaacauuuuuugcu

SEQ ID NO: 674559 - RNA, 18 nt, Haemophilus influenzae Rd
ucaaagaagcguucaaaa

SEQ ID NO: 674560 - RNA, 19 nt, Haemophilus influenzae Rd
ucaaaggcuaauucuacac

SEQ ID NO: 674561 - RNA, 18 nt, Haemophilus influenzae Rd
ucaaaauccgccgcacuu

SEQ ID NO: 674562 - RNA, 21 nt, Haemophilus influenzae Rd
ucaaauuucaacuauuuuagu

SEQ ID NO: 674563 - RNA, 13 nt, Haemophilus influenzae Rd
ucaaauuuuucac

SEQ ID NO: 674564 - RNA, 20 nt, Haemophilus influenzae Rd
ucaaauccuuguuuuucaaa

SEQ ID NO: 674565 - RNA, 17 nt, Haemophilus influenzae Rd
ucaaaucuacuaaaaua

SEQ ID NO: 674566 - RNA, 14 nt, Haemophilus influenzae Rd
ucaaaucuucagca

SEQ ID NO: 674567 - RNA, 20 nt, Haemophilus influenzae Rd
ucaaaugccgcuaaugguug

SEQ ID NO: 674568 - RNA, 17 nt, Haemophilus influenzae Rd
ucaaauuaaccgcacuu

SEQ ID NO: 674569 - RNA, 15 nt, Haemophilus influenzae Rd
ucaaauucugcuugu

SEQ ID NO: 674570 - RNA, 13 nt, Haemophilus influenzae Rd
ucaagauuugcaa

SEQ ID NO: 674571 - RNA, 14 nt, Haemophilus influenzae Rd
ucaauauaaguugu

SEQ ID NO: 674572 - RNA, 18 nt, Haemophilus influenzae Rd
ucaauagaacguaauaau

SEQ ID NO: 674573 - RNA, 22 nt, Haemophilus influenzae Rd
ucaauagauaaaucaaaacgau

SEQ ID NO: 674574 - RNA, 21 nt, Haemophilus influenzae Rd
ucaagugguuuauuuuuuacu

SEQ ID NO: 674575 - RNA, 20 nt, Haemophilus influenzae Rd
ucaaguuacuuaauuuugcu

SEQ ID NO: 674576 - RNA, 21 nt, Haemophilus influenzae Rd
ucaauaagcaaguaauuuaaa

SEQ ID NO: 674577 - RNA, 13 nt, Haemophilus influenzae Rd
ucaauaauuucaa

SEQ ID NO: 674578 - RNA, 13 nt, Haemophilus influenzae Rd
ucaauaauauuug

SEQ ID NO: 674579 - RNA, 17 nt, Haemophilus influenzae Rd
ucaaguaacuuucacaa

SEQ ID NO: 674580 - RNA, 23 nt, Haemophilus influenzae Rd
ucaagugauuauuucucuauaau

SEQ ID NO: 674581 - RNA, 23 nt, Haemophilus influenzae Rd
ucacccauuaaauaaaaaugaug

SEQ ID NO: 674582 - RNA, 22 nt, Haemophilus influenzae Rd
ucacauugccauuuuucagcaa

SEQ ID NO: 674583 - RNA, 16 nt, Haemophilus influenzae Rd
ucacauaaauuacaau

SEQ ID NO: 674584 - RNA, 18 nt, Haemophilus influenzae Rd
ucaauuucacggcggauu

SEQ ID NO: 674585 - RNA, 15 nt, Haemophilus influenzae Rd
ucacaaaauggcaaa

SEQ ID NO: 674586 - RNA, 17 nt, Haemophilus influenzae Rd
ucacaaucuaaagcgau

SEQ ID NO: 674587 - RNA, 15 nt, Haemophilus influenzae Rd
ucaauuuacccacuu

SEQ ID NO: 674588 - RNA, 19 nt, Haemophilus influenzae Rd
ucaauucuuucacuuuuac

SEQ ID NO: 674589 - RNA, 23 nt, Haemophilus influenzae Rd
ucaauugccauaggauuauucac

SEQ ID NO: 674590 - RNA, 15 nt, Haemophilus influenzae Rd
ucacgccuuugucuu

SEQ ID NO: 674591 - RNA, 20 nt, Haemophilus influenzae Rd
ucagauaaucuacaaaacau

SEQ ID NO: 674592 - RNA, 23 nt, Haemophilus influenzae Rd
ucagaguuaaaagucgcuacauu

SEQ ID NO: 674593 - RNA, 21 nt, Haemophilus influenzae Rd
ucagcauaaagagaauauuuc

SEQ ID NO: 674594 - RNA, 15 nt, Haemophilus influenzae Rd
ucagcauaccuagca

SEQ ID NO: 674595 - RNA, 15 nt, Haemophilus influenzae Rd
ucauuuacaaacaua

SEQ ID NO: 674596 - RNA, 21 nt, Haemophilus influenzae Rd
ucauuugacgauuaauaccaa

SEQ ID NO: 674597 - RNA, 18 nt, Haemophilus influenzae Rd
uccaauacuguuuggcaa

SEQ ID NO: 674598 - RNA, 16 nt, Haemophilus influenzae Rd
uccaaucaucagaaua

SEQ ID NO: 674599 - RNA, 17 nt, Haemophilus influenzae Rd
ucaucccagauuuuacu

SEQ ID NO: 674600 - RNA, 16 nt, Haemophilus influenzae Rd
ucaucgagaaauacga

SEQ ID NO: 674601 - RNA, 16 nt, Haemophilus influenzae Rd
ucaucgauaaauucaa

SEQ ID NO: 674602 - RNA, 16 nt, Haemophilus influenzae Rd
ucauuacuugaaauug

SEQ ID NO: 674603 - RNA, 13 nt, Haemophilus influenzae Rd
ucauuaaauaacu

SEQ ID NO: 674604 - RNA, 13 nt, Haemophilus influenzae Rd
ucauaaucgccaa

SEQ ID NO: 674605 - RNA, 22 nt, Haemophilus influenzae Rd
ucaguaccuuuaauuaaagcca

SEQ ID NO: 674606 - RNA, 22 nt, Haemophilus influenzae Rd
ucauaguccacuguauauuguu

SEQ ID NO: 674607 - RNA, 18 nt, Haemophilus influenzae Rd
ucauauacaucucauaaa

SEQ ID NO: 674608 - RNA, 17 nt, Haemophilus influenzae Rd
uccauaucacauuuuau

SEQ ID NO: 674609 - RNA, 18 nt, Haemophilus influenzae Rd
uccaucaccuucaacaua

SEQ ID NO: 674610 - RNA, 22 nt, Haemophilus influenzae Rd
ucccauauacuugccaaaacga

SEQ ID NO: 674611 - RNA, 23 nt, Haemophilus influenzae Rd
ucccauauacuugccaaaacgac

SEQ ID NO: 674612 - RNA, 17 nt, Haemophilus influenzae Rd
ucccauucuuaaaucau

SEQ ID NO: 674613 - RNA, 13 nt, Haemophilus influenzae Rd
uccgcauuuggug

SEQ ID NO: 674614 - RNA, 13 nt, Haemophilus influenzae Rd
uccgauuuuaauu

SEQ ID NO: 674615 - RNA, 23 nt, Haemophilus influenzae Rd
ucucagcuuucuaacgcaaacua

SEQ ID NO: 674616 - RNA, 18 nt, Haemophilus influenzae Rd
ucuaguaacuguucgguu

SEQ ID NO: 674617 - RNA, 19 nt, Haemophilus influenzae Rd
ucuaguaccugauuuguaa

SEQ ID NO: 674618 - RNA, 19 nt, Haemophilus influenzae Rd
ucuaguccuaacacuuuac

SEQ ID NO: 674619 - RNA, 23 nt, Haemophilus influenzae Rd
ucuaaggcuuguuguucaaaauu

SEQ ID NO: 674620 - RNA, 14 nt, Haemophilus influenzae Rd
ucuaaccuaaaaua

SEQ ID NO: 674621 - RNA, 20 nt, Haemophilus influenzae Rd
ucguuguuuuaauaaacaua

SEQ ID NO: 674622 - RNA, 16 nt, Haemophilus influenzae Rd
ucguuguaaucuucau

SEQ ID NO: 674623 - RNA, 18 nt, Haemophilus influenzae Rd
ucguuucauaugccauug

SEQ ID NO: 674624 - RNA, 22 nt, Haemophilus influenzae Rd
ucuaaaaauaauuuuacuugug

SEQ ID NO: 674625 - RNA, 17 nt, Haemophilus influenzae Rd
ucuaaauuaucguuuac

SEQ ID NO: 674626 - RNA, 15 nt, Haemophilus influenzae Rd
ucuaaauuugcugcg

SEQ ID NO: 674627 - RNA, 14 nt, Haemophilus influenzae Rd
ucguggaauuucau

SEQ ID NO: 674628 - RNA, 13 nt, Haemophilus influenzae Rd
ucgugaucugcau

SEQ ID NO: 674629 - RNA, 21 nt, Haemophilus influenzae Rd
ucguauuuuugucccaaaaua

SEQ ID NO: 674630 - RNA, 11 nt, Haemophilus influenzae Rd
ucgucaaaauc

SEQ ID NO: 674631 - RNA, 22 nt, Haemophilus influenzae Rd
ucguaguaagcugauucuucau

SEQ ID NO: 674632 - RNA, 13 nt, Haemophilus influenzae Rd
ucgguaaaaauca

SEQ ID NO: 674633 - RNA, 20 nt, Haemophilus influenzae Rd
ucggaauguaaaaucgguuu

SEQ ID NO: 674634 - RNA, 16 nt, Haemophilus influenzae Rd
ucggcgaugguaaaau

SEQ ID NO: 674635 - RNA, 14 nt, Haemophilus influenzae Rd
ucgccccaaaagcu

SEQ ID NO: 674636 - RNA, 22 nt, Haemophilus influenzae Rd
ucgccgacuuuuacaucauugu

SEQ ID NO: 674637 - RNA, 14 nt, Haemophilus influenzae Rd
ucgcccuauuaaaa

SEQ ID NO: 674638 - RNA, 15 nt, Haemophilus influenzae Rd
ucgcaucgucuuuac

SEQ ID NO: 674639 - RNA, 16 nt, Haemophilus influenzae Rd
ucgcaucaaucacagc

SEQ ID NO: 674640 - RNA, 16 nt, Haemophilus influenzae Rd
ucgcaggugucacagc

SEQ ID NO: 674641 - RNA, 21 nt, Haemophilus influenzae Rd
ucgcaguuucuuuguucacau

SEQ ID NO: 674642 - RNA, 18 nt, Haemophilus influenzae Rd
ucgcacuuaaaagauuaa

SEQ ID NO: 674643 - RNA, 21 nt, Haemophilus influenzae Rd
ucgccuuguaauugauuuuca

SEQ ID NO: 674644 - RNA, 16 nt, Haemophilus influenzae Rd
ucgccugauuucgcuu

SEQ ID NO: 674645 - RNA, 18 nt, Haemophilus influenzae Rd
ucgccguuaguuuguauu

SEQ ID NO: 674646 - RNA, 14 nt, Haemophilus influenzae Rd
ucgacuuuguccaa

SEQ ID NO: 674647 - RNA, 18 nt, Haemophilus influenzae Rd
ucgauuuuucuaaaauca

SEQ ID NO: 674648 - RNA, 18 nt, Haemophilus influenzae Rd
ucgcaagauagcaaaaua

SEQ ID NO: 674649 - RNA, 19 nt, Haemophilus influenzae Rd
ucgcaaucagcauauugaa

SEQ ID NO: 674650 - RNA, 13 nt, Haemophilus influenzae Rd
ucgauauuuauaa

SEQ ID NO: 674651 - RNA, 19 nt, Haemophilus influenzae Rd
ucgaucucugccauacuga

SEQ ID NO: 674652 - RNA, 15 nt, Haemophilus influenzae Rd
ugaaagacugcuacu

SEQ ID NO: 674653 - RNA, 20 nt, Haemophilus influenzae Rd
ugaaaguaacaauguagaaa

SEQ ID NO: 674654 - RNA, 14 nt, Haemophilus influenzae Rd
ucuuucaaaaauca

SEQ ID NO: 674655 - RNA, 16 nt, Haemophilus influenzae Rd
ucuuugacuaaaucau

SEQ ID NO: 674656 - RNA, 23 nt, Haemophilus influenzae Rd
ugaacccuacaggcuuccaacaa

SEQ ID NO: 674657 - RNA, 19 nt, Haemophilus influenzae Rd
ugaacuuucgcguaauaac

SEQ ID NO: 674658 - RNA, 18 nt, Haemophilus influenzae Rd
ugaaauuuuaccgcacuu

SEQ ID NO: 674659 - RNA, 19 nt, Haemophilus influenzae Rd
ugaaauuacuugaaucuaa

SEQ ID NO: 674660 - RNA, 18 nt, Haemophilus influenzae Rd
ugaaauuucaccgcacuu

SEQ ID NO: 674661 - RNA, 17 nt, Haemophilus influenzae Rd
ugaaauuucaccgcauu

SEQ ID NO: 674662 - RNA, 20 nt, Haemophilus influenzae Rd
ugaaauuccuugccaaagug

SEQ ID NO: 674663 - RNA, 19 nt, Haemophilus influenzae Rd
ugaaauucuaccugcugua

SEQ ID NO: 674664 - RNA, 18 nt, Haemophilus influenzae Rd
ugaauacgaucugcaucu

SEQ ID NO: 674665 - RNA, 22 nt, Haemophilus influenzae Rd
ugaauauauucaugaaucguuu

SEQ ID NO: 674666 - RNA, 18 nt, Haemophilus influenzae Rd
ugaauuuuaaccgcacuu

SEQ ID NO: 674667 - RNA, 20 nt, Haemophilus influenzae Rd
ugaauucucaauugcagauu

SEQ ID NO: 674668 - RNA, 20 nt, Haemophilus influenzae Rd
ugaauuaccacaucauuauu

SEQ ID NO: 674669 - RNA, 22 nt, Haemophilus influenzae Rd
ugaaugugcgguagauuuucau

SEQ ID NO: 674670 - RNA, 21 nt, Haemophilus influenzae Rd
ugaagugaaagauaaauuaca

SEQ ID NO: 674671 - RNA, 16 nt, Haemophilus influenzae Rd
ugaauaauuuuuauaa

SEQ ID NO: 674672 - RNA, 14 nt, Haemophilus influenzae Rd
ugaagaacguaaau

SEQ ID NO: 674673 - RNA, 17 nt, Haemophilus influenzae Rd
ugaccuacgcugagaau

SEQ ID NO: 674674 - RNA, 16 nt, Haemophilus influenzae Rd
ugacccgcuuuuaaug

SEQ ID NO: 674675 - RNA, 17 nt, Haemophilus influenzae Rd
ugacacccaaauuaaaa

SEQ ID NO: 674676 - RNA, 12 nt, Haemophilus influenzae Rd
ugaccaacacca

SEQ ID NO: 674677 - RNA, 18 nt, Haemophilus influenzae Rd
ugacaucaagcacaucau

SEQ ID NO: 674678 - RNA, 16 nt, Haemophilus influenzae Rd
ugaucuaauuugccaa

SEQ ID NO: 674679 - RNA, 12 nt, Haemophilus influenzae Rd
ugaucugcauca

SEQ ID NO: 674680 - RNA, 16 nt, Haemophilus influenzae Rd
ugauccauuaauaacu

SEQ ID NO: 674681 - RNA, 17 nt, Haemophilus influenzae Rd
ugaucgaccauugcacg

SEQ ID NO: 674682 - RNA, 17 nt, Haemophilus influenzae Rd
ugaguucuguaauucac

SEQ ID NO: 674683 - RNA, 19 nt, Haemophilus influenzae Rd
ugaguugauuuuaaaauau

SEQ ID NO: 674684 - RNA, 15 nt, Haemophilus influenzae Rd
ugcacccgcuuuaau

SEQ ID NO: 674685 - RNA, 15 nt, Haemophilus influenzae Rd
ugcaaucacgcucaa

SEQ ID NO: 674686 - RNA, 18 nt, Haemophilus influenzae Rd
ugcaauaauaucugcuuu

SEQ ID NO: 674687 - RNA, 16 nt, Haemophilus influenzae Rd
ugaugcgugucaaauu

SEQ ID NO: 674688 - RNA, 22 nt, Haemophilus influenzae Rd
ugauucaaacgcguuaaaucac

SEQ ID NO: 674689 - RNA, 16 nt, Haemophilus influenzae Rd
ugauuaauaucacugc

SEQ ID NO: 674690 - RNA, 15 nt, Haemophilus influenzae Rd
ugauucgauaaauua

SEQ ID NO: 674691 - RNA, 18 nt, Haemophilus influenzae Rd
ugauuuuuaaccgcccuu

SEQ ID NO: 674692 - RNA, 18 nt, Haemophilus influenzae Rd
ugauuuuuacaccgccuu

SEQ ID NO: 674693 - RNA, 18 nt, Haemophilus influenzae Rd
ugauuuucagaccgcacu

SEQ ID NO: 674694 - RNA, 16 nt, Haemophilus influenzae Rd
ugcaaagccuucaccu

SEQ ID NO: 674695 - RNA, 19 nt, Haemophilus influenzae Rd
ugcaaagugcgguaagaaa

SEQ ID NO: 674696 - RNA, 16 nt, Haemophilus influenzae Rd
ugauuuuuuugccuua

SEQ ID NO: 674697 - RNA, 17 nt, Haemophilus influenzae Rd
ugcaaaaguaaauaauc

SEQ ID NO: 674698 - RNA, 23 nt, Haemophilus influenzae Rd
ugauuuugagcaaaaaaaaaagc

SEQ ID NO: 674699 - RNA, 13 nt, Haemophilus influenzae Rd
ugaggcuaauaau

SEQ ID NO: 674700 - RNA, 17 nt, Haemophilus influenzae Rd
ugagcacuucuguaccu

SEQ ID NO: 674701 - RNA, 19 nt, Haemophilus influenzae Rd
ugagcaucuacccaauaaa

SEQ ID NO: 674702 - RNA, 21 nt, Haemophilus influenzae Rd
ugacguacaauuucaaauaaa

SEQ ID NO: 674703 - RNA, 16 nt, Haemophilus influenzae Rd
ugcgaccugaagauga

SEQ ID NO: 674704 - RNA, 13 nt, Haemophilus influenzae Rd
ugcgauucaucac

SEQ ID NO: 674705 - RNA, 19 nt, Haemophilus influenzae Rd
ugcgauuuuugcacgaauu

SEQ ID NO: 674706 - RNA, 16 nt, Haemophilus influenzae Rd
ugcgcggugauuuagc

SEQ ID NO: 674707 - RNA, 17 nt, Haemophilus influenzae Rd
ugcggcagaauuucguc

SEQ ID NO: 674708 - RNA, 18 nt, Haemophilus influenzae Rd
ugcggauuucacuagaua

SEQ ID NO: 674709 - RNA, 17 nt, Haemophilus influenzae Rd
ugcaucuaaaaauaauu

SEQ ID NO: 674710 - RNA, 13 nt, Haemophilus influenzae Rd
ugcaucaauauug

SEQ ID NO: 674711 - RNA, 18 nt, Haemophilus influenzae Rd
ugcauauccgcugcaaau

SEQ ID NO: 674712 - RNA, 23 nt, Haemophilus influenzae Rd
ugcaguuuuuuguuuuuccgcuu

SEQ ID NO: 674713 - RNA, 20 nt, Haemophilus influenzae Rd
ugcauagccaagugcuuuac

SEQ ID NO: 674714 - RNA, 21 nt, Haemophilus influenzae Rd
gcuggcuaacaaauaaugccu

SEQ ID NO: 674715 - RNA, 16 nt, Haemophilus influenzae Rd
gcuguagaaauuaaua

SEQ ID NO: 674716 - RNA, 18 nt, Haemophilus influenzae Rd
gcuuagugaaaagaaaac

SEQ ID NO: 674717 - RNA, 18 nt, Haemophilus influenzae Rd
gcuuaaaaaccccgcuaa

SEQ ID NO: 674718 - RNA, 18 nt, Haemophilus influenzae Rd
gcuuaaaugaucagcuaa

SEQ ID NO: 674719 - RNA, 17 nt, Haemophilus influenzae Rd
gcuuauuuacuuuauaa

SEQ ID NO: 674720 - RNA, 21 nt, Haemophilus influenzae Rd
gcuucaucagccgcuuuuuga

SEQ ID NO: 674721 - RNA, 17 nt, Haemophilus influenzae Rd
ggaauuucagaaaucgu

SEQ ID NO: 674722 - RNA, 15 nt, Haemophilus influenzae Rd
ggacugcauauucau

SEQ ID NO: 674723 - RNA, 18 nt, Haemophilus influenzae Rd
gcuuucuuauauauaaaa

SEQ ID NO: 674724 - RNA, 13 nt, Haemophilus influenzae Rd
gcuuuaacugaag

SEQ ID NO: 674725 - RNA, 21 nt, Haemophilus influenzae Rd
ggaaaauuuuaaacagcaaaa

SEQ ID NO: 674726 - RNA, 19 nt, Haemophilus influenzae Rd
gcuuugcuuggaucacgca

SEQ ID NO: 674727 - RNA, 13 nt, Haemophilus influenzae Rd
ggaauaauaucgu

SEQ ID NO: 674728 - RNA, 15 nt, Haemophilus influenzae Rd
ggaauaaaauaaucu

SEQ ID NO: 674729 - RNA, 16 nt, Haemophilus influenzae Rd
ggaaauuugagauuuu

SEQ ID NO: 674730 - RNA, 15 nt, Haemophilus influenzae Rd
gcugccuaacccccu

SEQ ID NO: 674731 - RNA, 13 nt, Haemophilus influenzae Rd
gcugacuuaaugc

SEQ ID NO: 674732 - RNA, 12 nt, Haemophilus influenzae Rd
gcugcaauaauu

SEQ ID NO: 674733 - RNA, 21 nt, Haemophilus influenzae Rd
gcugaaugugcgguagauuuu

SEQ ID NO: 674734 - RNA, 20 nt, Haemophilus influenzae Rd
gcugacauaaauacaccacu

SEQ ID NO: 674735 - RNA, 16 nt, Haemophilus influenzae Rd
gcucccauaaaucggc

SEQ ID NO: 674736 - RNA, 19 nt, Haemophilus influenzae Rd
gcuaccaauauucuuuaaa

SEQ ID NO: 674737 - RNA, 19 nt, Haemophilus influenzae Rd
gcuaaugguugcauuugcu

SEQ ID NO: 674738 - RNA, 18 nt, Haemophilus influenzae Rd
gcuaauuauuuaaaucua

SEQ ID NO: 674739 - RNA, 15 nt, Haemophilus influenzae Rd
gcuacaaauaagcca

SEQ ID NO: 674740 - RNA, 11 nt, Haemophilus influenzae Rd
gcggugauuuu

SEQ ID NO: 674741 - RNA, 21 nt, Haemophilus influenzae Rd
gcggugauuuuuuuauuuguu

SEQ ID NO: 674742 - RNA, 16 nt, Haemophilus influenzae Rd
gcguaagcaccuucaa

SEQ ID NO: 674743 - RNA, 13 nt, Haemophilus influenzae Rd
gcgucauuuaauu

SEQ ID NO: 674744 - RNA, 20 nt, Haemophilus influenzae Rd
gcguagccuagugcuaaaau

SEQ ID NO: 674745 - RNA, 16 nt, Haemophilus influenzae Rd
gcguugaaaauaaauu

SEQ ID NO: 674746 - RNA, 16 nt, Haemophilus influenzae Rd
gcguggaggauuaauu

SEQ ID NO: 674747 - RNA, 22 nt, Haemophilus influenzae Rd
gcguuuuuuuaucauagagcca

SEQ ID NO: 674748 - RNA, 17 nt, Haemophilus influenzae Rd
gcuaaaaagaaauaaaa

SEQ ID NO: 674749 - RNA, 19 nt, Haemophilus influenzae Rd
gcuaacaaaauuaaugcca

SEQ ID NO: 674750 - RNA, 14 nt, Haemophilus influenzae Rd
gcuaacaaauuuaa

SEQ ID NO: 674751 - RNA, 13 nt, Haemophilus influenzae Rd
gccgugauaacgc

SEQ ID NO: 674752 - RNA, 12 nt, Haemophilus influenzae Rd
gccuuauuugua

SEQ ID NO: 674753 - RNA, 15 nt, Haemophilus influenzae Rd
gccuugcaaauuuuc

SEQ ID NO: 674754 - RNA, 16 nt, Haemophilus influenzae Rd
gccuugcauaaugcca

SEQ ID NO: 674755 - RNA, 17 nt, Haemophilus influenzae Rd
gcgaaacuugagauuuu

SEQ ID NO: 674756 - RNA, 21 nt, Haemophilus influenzae Rd
gcgauaguguucgcaauuaau

SEQ ID NO: 674757 - RNA, 15 nt, Haemophilus influenzae Rd
gcgaguaaaauaaaa

SEQ ID NO: 674758 - RNA, 18 nt, Haemophilus influenzae Rd
gcgaguaagggcaaaaaa

SEQ ID NO: 674759 - RNA, 13 nt, Haemophilus influenzae Rd
gcgacauuaagug

SEQ ID NO: 674760 - RNA, 23 nt, Haemophilus influenzae Rd
ggcauuuuugcuggcguuuuuua

SEQ ID NO: 674761 - RNA, 19 nt, Haemophilus influenzae Rd
ggcagaauuacguuguugu

SEQ ID NO: 674762 - RNA, 13 nt, Haemophilus influenzae Rd
ggcaauaauuuaa

SEQ ID NO: 674763 - RNA, 14 nt, Haemophilus influenzae Rd
ggcaaacaaaauaa

SEQ ID NO: 674764 - RNA, 22 nt, Haemophilus influenzae Rd
ggauuuuuuauuuugugaucuu

SEQ ID NO: 674765 - RNA, 23 nt, Haemophilus influenzae Rd
ggcaaaaacacucucagaauuaa

SEQ ID NO: 674766 - RNA, 14 nt, Haemophilus influenzae Rd
ggauuggauucacg

SEQ ID NO: 674767 - RNA, 12 nt, Haemophilus influenzae Rd
ggauuggauuuu

SEQ ID NO: 674768 - RNA, 21 nt, Haemophilus influenzae Rd
  misc_feature (11)..(11): n is a, c, g or u
ggauuaauagnaaaaauuuag

SEQ ID NO: 674769 - RNA, 17 nt, Haemophilus influenzae Rd
ggcccaucauuuguuaa

SEQ ID NO: 674770 - RNA, 23 nt, Haemophilus influenzae Rd
ggcgacaaaaugucgcuuucuua

SEQ ID NO: 674771 - RNA, 15 nt, Haemophilus influenzae Rd
gggcaaacgcucuuu

SEQ ID NO: 674772 - RNA, 23 nt, Haemophilus influenzae Rd
gggauuuucaucuauuuuauuaa

SEQ ID NO: 674773 - RNA, 17 nt, Haemophilus influenzae Rd
ggcuguaaaaaaucuuu

SEQ ID NO: 674774 - RNA, 21 nt, Haemophilus influenzae Rd
ggcuuuucucaaaacaucuuu

SEQ ID NO: 674775 - RNA, 12 nt, Haemophilus influenzae Rd
ggcuuuucugau

SEQ ID NO: 674776 - RNA, 21 nt, Haemophilus influenzae Rd
ggcuuucacuauuucaucuuu

SEQ ID NO: 674777 - RNA, 13 nt, Haemophilus influenzae Rd
ggcuuguuuuuuc

SEQ ID NO: 674778 - RNA, 18 nt, Haemophilus influenzae Rd
ggcugaauccgaaauuaa

SEQ ID NO: 674779 - RNA, 15 nt, Haemophilus influenzae Rd
ggcugaaaaauucaa

SEQ ID NO: 674780 - RNA, 22 nt, Haemophilus influenzae Rd
guacaucuggauauugcucaau

SEQ ID NO: 674781 - RNA, 22 nt, Haemophilus influenzae Rd
guacauuaauguaaucaauugg

SEQ ID NO: 674782 - RNA, 17 nt, Haemophilus influenzae Rd
guaauguuggaucccaa

SEQ ID NO: 674783 - RNA, 18 nt, Haemophilus influenzae Rd
guaauuuggcguaaacac

SEQ ID NO: 674784 - RNA, 18 nt, Haemophilus influenzae Rd
guaauuuggggcuaauuu

SEQ ID NO: 674785 - RNA, 22 nt, Haemophilus influenzae Rd
guaauuucaucuuuuaaauaac

SEQ ID NO: 674786 - RNA, 12 nt, Haemophilus influenzae Rd
guaauuguugaa

SEQ ID NO: 674787 - RNA, 14 nt, Haemophilus influenzae Rd
guaauuuaucgcca

SEQ ID NO: 674788 - RNA, 19 nt, Haemophilus influenzae Rd
guaaaucuaaaauaaucgg

SEQ ID NO: 674789 - RNA, 20 nt, Haemophilus influenzae Rd
guaaaucaauguuuucagcu

SEQ ID NO: 674790 - RNA, 17 nt, Haemophilus influenzae Rd
guaaauugguuuuaucc

SEQ ID NO: 674791 - RNA, 20 nt, Haemophilus influenzae Rd
gguuuuuuuauuuuuaucau

SEQ ID NO: 674792 - RNA, 13 nt, Haemophilus influenzae Rd
gguguauuuauaa

SEQ ID NO: 674793 - RNA, 20 nt, Haemophilus influenzae Rd
gguguauuuuuguuuauuua

SEQ ID NO: 674794 - RNA, 24 nt, Haemophilus influenzae Rd
gguuacuaaaugugacauuguaaa

SEQ ID NO: 674795 - RNA, 14 nt, Haemophilus influenzae Rd
guacucgaaaaggc

SEQ ID NO: 674796 - RNA, 20 nt, Haemophilus influenzae Rd
guaccuuuaaauucuucgaa

SEQ ID NO: 674797 - RNA, 17 nt, Haemophilus influenzae Rd
guacgauugcaauaauc

SEQ ID NO: 674798 - RNA, 15 nt, Haemophilus influenzae Rd
guaguagauaacaac

SEQ ID NO: 674799 - RNA, 20 nt, Haemophilus influenzae Rd
guaguuuagcuaauccuuua

SEQ ID NO: 674800 - RNA, 12 nt, Haemophilus influenzae Rd
guaguuggcaua

SEQ ID NO: 674801 - RNA, 18 nt, Haemophilus influenzae Rd
guauauucgccuucacaa

SEQ ID NO: 674802 - RNA, 18 nt, Haemophilus influenzae Rd
guauagccuucgcuauuu

SEQ ID NO: 674803 - RNA, 22 nt, Haemophilus influenzae Rd
guaucccgaaagugcgguuaau

SEQ ID NO: 674804 - RNA, 23 nt, Haemophilus influenzae Rd
gucaaaugugaccgcuuguuuau

SEQ ID NO: 674805 - RNA, 23 nt, Haemophilus influenzae Rd
gguagauuuucaucguuaauuaa

SEQ ID NO: 674806 - RNA, 21 nt, Haemophilus influenzae Rd
gguagcaauaaccaauaacga

SEQ ID NO: 674807 - RNA, 20 nt, Haemophilus influenzae Rd
gguaucacaaagcacuaauc

SEQ ID NO: 674808 - RNA, 16 nt, Haemophilus influenzae Rd
gguauacuuuauugau

SEQ ID NO: 674809 - RNA, 13 nt, Haemophilus influenzae Rd
ggucacuugugau

SEQ ID NO: 674810 - RNA, 12 nt, Haemophilus influenzae Rd
gggcgguuaaaa

SEQ ID NO: 674811 - RNA, 13 nt, Haemophilus influenzae Rd
ggguucuuuuuug

SEQ ID NO: 674812 - RNA, 13 nt, Haemophilus influenzae Rd
gguaaaauuaaug

SEQ ID NO: 674813 - RNA, 14 nt, Haemophilus influenzae Rd
gguaaaauaaugca

SEQ ID NO: 674814 - RNA, 22 nt, Haemophilus influenzae Rd
ggguuuacaucuugcguuaaau

SEQ ID NO: 674815 - RNA, 14 nt, Haemophilus influenzae Rd
gguaaggauugacc

SEQ ID NO: 674816 - RNA, 14 nt, Haemophilus influenzae Rd
ggucgcaccaccuu

SEQ ID NO: 674817 - RNA, 19 nt, Haemophilus influenzae Rd
ggucgcaccaccuuuauua

SEQ ID NO: 674818 - RNA, 19 nt, Haemophilus influenzae Rd
ggugcagauuuuuuauuaa

SEQ ID NO: 674819 - RNA, 19 nt, Haemophilus influenzae Rd
ggugcagauuuuuuauuua

SEQ ID NO: 674820 - RNA, 23 nt, Haemophilus influenzae Rd
gugauugacauuuuacuuuagca

SEQ ID NO: 674821 - RNA, 18 nt, Haemophilus influenzae Rd
gugauuaagugcggugaa

SEQ ID NO: 674822 - RNA, 18 nt, Haemophilus influenzae Rd
gugauguaccaauuugua

SEQ ID NO: 674823 - RNA, 21 nt, Haemophilus influenzae Rd
gucccugcccuugauauucaa

SEQ ID NO: 674824 - RNA, 20 nt, Haemophilus influenzae Rd
gucagauuuacccaaauuau

SEQ ID NO: 674825 - RNA, 16 nt, Haemophilus influenzae Rd
cguuuauuuaacaaua

SEQ ID NO: 674826 - RNA, 23 nt, Haemophilus influenzae Rd
cguuuauccuguuguuuuuuacc

SEQ ID NO: 674827 - RNA, 15 nt, Haemophilus influenzae Rd
cuaaauggcaaaauu

SEQ ID NO: 674828 - RNA, 14 nt, Haemophilus influenzae Rd
cuaaaugugauuuc

SEQ ID NO: 674829 - RNA, 14 nt, Haemophilus influenzae Rd
cuaacauaaugccu

SEQ ID NO: 674830 - RNA, 16 nt, Haemophilus influenzae Rd
cuaaccaaagcgucca

SEQ ID NO: 674831 - RNA, 22 nt, Haemophilus influenzae Rd
cuaaauauucaauccuauuuuu

SEQ ID NO: 674832 - RNA, 23 nt, Haemophilus influenzae Rd
cuaaauauuuuucaaggccauau

SEQ ID NO: 674833 - RNA, 22 nt, Haemophilus influenzae Rd
cuaaaucggcuuuaucaucuuu

SEQ ID NO: 674834 - RNA, 12 nt, Haemophilus influenzae Rd
cuaaaucuaauu

SEQ ID NO: 674835 - RNA, 19 nt, Haemophilus influenzae Rd
cuaaaucuguuucauuugu

SEQ ID NO: 674836 - RNA, 21 nt, Haemophilus influenzae Rd
cuaaauaaccuaaaauauuua

SEQ ID NO: 674837 - RNA, 17 nt, Haemophilus influenzae Rd
cuaaauaaaaacgcccu

SEQ ID NO: 674838 - RNA, 21 nt, Haemophilus influenzae Rd
cuaaauacuugcuuaugcaaa

SEQ ID NO: 674839 - RNA, 20 nt, Haemophilus influenzae Rd
cuaaagugcgguuaauuuuu

SEQ ID NO: 674840 - RNA, 16 nt, Haemophilus influenzae Rd
cuaaaccugcaaguuc

SEQ ID NO: 674841 - RNA, 23 nt, Haemophilus influenzae Rd
cuaaacgaucuaauacaguuucu

SEQ ID NO: 674842 - RNA, 16 nt, Haemophilus influenzae Rd
cuaaacgcucuuuaau

SEQ ID NO: 674843 - RNA, 22 nt, Haemophilus influenzae Rd
cuaaaauauaacauuuauuuuu

SEQ ID NO: 674844 - RNA, 20 nt, Haemophilus influenzae Rd
cuaaaaucacacuaaucuaa

SEQ ID NO: 674845 - RNA, 19 nt, Haemophilus influenzae Rd
cuaaaaaucccauuuaggu

SEQ ID NO: 674846 - RNA, 16 nt, Haemophilus influenzae Rd
cuaucuaaauggcaaa

SEQ ID NO: 674847 - RNA, 19 nt, Haemophilus influenzae Rd
cuaacucugguucaaaaug

SEQ ID NO: 674848 - RNA, 21 nt, Haemophilus influenzae Rd
cuaagauucgcacguuuuuac

SEQ ID NO: 674849 - RNA, 17 nt, Haemophilus influenzae Rd
cuaagauacccauuucg

SEQ ID NO: 674850 - RNA, 23 nt, Haemophilus influenzae Rd
cuaauaaaaaauaaagugcgguc

SEQ ID NO: 674851 - RNA, 16 nt, Haemophilus influenzae Rd
cuaauaaucgcaaugc

SEQ ID NO: 674852 - RNA, 16 nt, Haemophilus influenzae Rd
cuaauaagcuuggcuu

SEQ ID NO: 674853 - RNA, 21 nt, Haemophilus influenzae Rd
cuaauaagcuuggcuuauuua

SEQ ID NO: 674854 - RNA, 22 nt, Haemophilus influenzae Rd
cuaauaagcuuggcuuauuuac

SEQ ID NO: 674855 - RNA, 20 nt, Haemophilus influenzae Rd
cuaaguauucaugauguaau

SEQ ID NO: 674856 - RNA, 13 nt, Haemophilus influenzae Rd
cuaagguuuccau

SEQ ID NO: 674857 - RNA, 16 nt, Haemophilus influenzae Rd
cuaauauaauaaauuc

SEQ ID NO: 674858 - RNA, 14 nt, Haemophilus influenzae Rd
cuaauaauuuuagc

SEQ ID NO: 674859 - RNA, 20 nt, Haemophilus influenzae Rd
cuaauagacaggcauauuuc

SEQ ID NO: 674860 - RNA, 15 nt, Haemophilus influenzae Rd
cuaaucgguuuugac

SEQ ID NO: 674861 - RNA, 19 nt, Haemophilus influenzae Rd
cuaaucguugccccaucau

SEQ ID NO: 674862 - RNA, 16 nt, Haemophilus influenzae Rd
cuaccaauuccaccac

SEQ ID NO: 674863 - RNA, 18 nt, Haemophilus influenzae Rd
cuacaacaaaggguaaau

SEQ ID NO: 674864 - RNA, 19 nt, Haemophilus influenzae Rd
cuaauuugacgauaauauu

SEQ ID NO: 674865 - RNA, 15 nt, Haemophilus influenzae Rd
cuaauuuaagaaaaa

SEQ ID NO: 674866 - RNA, 17 nt, Haemophilus influenzae Rd
cuaauugcggaaaaauu

SEQ ID NO: 674867 - RNA, 14 nt, Haemophilus influenzae Rd
cuaauuggaaaagu

SEQ ID NO: 674868 - RNA, 15 nt, Haemophilus influenzae Rd
cuaaugugcaaucag

SEQ ID NO: 674869 - RNA, 20 nt, Haemophilus influenzae Rd
cuaauucaagcaaauauuua

SEQ ID NO: 674870 - RNA, 22 nt, Haemophilus influenzae Rd
cuaaugcaggcaacucaguuuu

SEQ ID NO: 674871 - RNA, 13 nt, Haemophilus influenzae Rd
cuaaugaaauuuc

SEQ ID NO: 674872 - RNA, 18 nt, Haemophilus influenzae Rd
cucaaaauacucacaagu

SEQ ID NO: 674873 - RNA, 16 nt, Haemophilus influenzae Rd
cuauuuuuucugcaaa

SEQ ID NO: 674874 - RNA, 15 nt, Haemophilus influenzae Rd
cuauuuuuagaaaau

SEQ ID NO: 674875 - RNA, 19 nt, Haemophilus influenzae Rd
cuauugauucuaaaaacuc

SEQ ID NO: 674876 - RNA, 14 nt, Haemophilus influenzae Rd
cuauuccuuucuuu

SEQ ID NO: 674877 - RNA, 14 nt, Haemophilus influenzae Rd
cuauuggauaaauu

SEQ ID NO: 674878 - RNA, 17 nt, Haemophilus influenzae Rd
cuauuggcguaauacca

SEQ ID NO: 674879 - RNA, 21 nt, Haemophilus influenzae Rd
cuauuucuuugaguaaaaaau

SEQ ID NO: 674880 - RNA, 19 nt, Haemophilus influenzae Rd
cucaguugguagagcacga

SEQ ID NO: 674881 - RNA, 11 nt, Haemophilus influenzae Rd
cucgaauauug

SEQ ID NO: 674882 - RNA, 18 nt, Haemophilus influenzae Rd
cugcacaaaguugauaau

SEQ ID NO: 674883 - RNA, 14 nt, Haemophilus influenzae Rd
cugaugcuuuaaca

SEQ ID NO: 674884 - RNA, 12 nt, Haemophilus influenzae Rd
cucucuuaauua

SEQ ID NO: 674885 - RNA, 15 nt, Haemophilus influenzae Rd
cgucuuuuaacauua

SEQ ID NO: 674886 - RNA, 16 nt, Haemophilus influenzae Rd
cgucuuugaagccuga

SEQ ID NO: 674887 - RNA, 18 nt, Haemophilus influenzae Rd
cgguggauuaauuggcga

SEQ ID NO: 674888 - RNA, 14 nt, Haemophilus influenzae Rd
cguaguauggcaag

SEQ ID NO: 674889 - RNA, 16 nt, Haemophilus influenzae Rd
cguauaagcuaaagca

SEQ ID NO: 674890 - RNA, 21 nt, Haemophilus influenzae Rd
cguauaauauuuucuuuuauc

SEQ ID NO: 674891 - RNA, 15 nt, Haemophilus influenzae Rd
cguauccguuccacu

SEQ ID NO: 674892 - RNA, 15 nt, Haemophilus influenzae Rd
cgguuaauuuugagc

SEQ ID NO: 674893 - RNA, 22 nt, Haemophilus influenzae Rd
cguaauucuugaccgauuaauu

SEQ ID NO: 674894 - RNA, 20 nt, Haemophilus influenzae Rd
cugcugcaagauuugcugcu

SEQ ID NO: 674895 - RNA, 13 nt, Haemophilus influenzae Rd
cugcucugugcca

SEQ ID NO: 674896 - RNA, 16 nt, Haemophilus influenzae Rd
cuggcuaacaaauaau

SEQ ID NO: 674897 - RNA, 17 nt, Haemophilus influenzae Rd
cugcuugcgcuugugcu

SEQ ID NO: 674898 - RNA, 17 nt, Haemophilus influenzae Rd
cugcuucguuuucugcu

SEQ ID NO: 674899 - RNA, 16 nt, Haemophilus influenzae Rd
cuggcaaucgccaaug

SEQ ID NO: 674900 - RNA, 18 nt, Haemophilus influenzae Rd
cuguugcuucaauuguug

SEQ ID NO: 674901 - RNA, 15 nt, Haemophilus influenzae Rd
cuguugguuaaaaau

SEQ ID NO: 674902 - RNA, 13 nt, Haemophilus influenzae Rd
cuuaccuuccacu

SEQ ID NO: 674903 - RNA, 15 nt, Haemophilus influenzae Rd
cuuaauccuuucacu

SEQ ID NO: 674904 - RNA, 18 nt, Haemophilus influenzae Rd
cuuauucgcugcaaaauc

SEQ ID NO: 674905 - RNA, 12 nt, Haemophilus influenzae Rd
cuuaucuacaau

SEQ ID NO: 674906 - RNA, 12 nt, Haemophilus influenzae Rd
cuuaucuacugc

SEQ ID NO: 674907 - RNA, 22 nt, Haemophilus influenzae Rd
cuuacucauuuaucaaacaagc

SEQ ID NO: 674908 - RNA, 19 nt, Haemophilus influenzae Rd
cuucaaaugaagugcguuu

SEQ ID NO: 674909 - RNA, 17 nt, Haemophilus influenzae Rd
cuucaaaaagugcgguu

SEQ ID NO: 674910 - RNA, 18 nt, Haemophilus influenzae Rd
cuguggugaagugcgguu

SEQ ID NO: 674911 - RNA, 13 nt, Haemophilus influenzae Rd
cuguggcaaaauc

SEQ ID NO: 674912 - RNA, 13 nt, Haemophilus influenzae Rd
cugucucauuuug

SEQ ID NO: 674913 - RNA, 15 nt, Haemophilus influenzae Rd
cuguauuggaaaagu

SEQ ID NO: 674914 - RNA, 13 nt, Haemophilus influenzae Rd
cugucacaauauu

SEQ ID NO: 674915 - RNA, 14 nt, Haemophilus influenzae Rd
cuguaucuuuagcu

SEQ ID NO: 674916 - RNA, 22 nt, Haemophilus influenzae Rd
cuucuucccaaccuaauuguuc

SEQ ID NO: 674917 - RNA, 22 nt, Haemophilus influenzae Rd
cuucuucaggugcaacuuguug

SEQ ID NO: 674918 - RNA, 21 nt, Haemophilus influenzae Rd
cuucuuuuagugguucagauu

SEQ ID NO: 674919 - RNA, 20 nt, Haemophilus influenzae Rd
cuucugcaggaaaaauaaau

SEQ ID NO: 674920 - RNA, 14 nt, Haemophilus influenzae Rd
cuuccagaaaauug

SEQ ID NO: 674921 - RNA, 13 nt, Haemophilus influenzae Rd
cuucauuguggaa

SEQ ID NO: 674922 - RNA, 16 nt, Haemophilus influenzae Rd
cuucacaguaaagauu

SEQ ID NO: 674923 - RNA, 15 nt, Haemophilus influenzae Rd
cuucacauagaggaa

SEQ ID NO: 674924 - RNA, 13 nt, Haemophilus influenzae Rd
cuucacaaauaau

SEQ ID NO: 674925 - RNA, 15 nt, Haemophilus influenzae Rd
cuugcauuucuucag

SEQ ID NO: 674926 - RNA, 17 nt, Haemophilus influenzae Rd
cuugauauaaguucuaa

SEQ ID NO: 674927 - RNA, 13 nt, Haemophilus influenzae Rd
cuugauauucaag

SEQ ID NO: 674928 - RNA, 15 nt, Haemophilus influenzae Rd
cuugauuaacaucuu

SEQ ID NO: 674929 - RNA, 21 nt, Haemophilus influenzae Rd
cuugacauaauuucacaauuu

SEQ ID NO: 674930 - RNA, 20 nt, Haemophilus influenzae Rd
cuuggcuaacuucuuccacu

SEQ ID NO: 674931 - RNA, 17 nt, Haemophilus influenzae Rd
cuuguacaacagcaaua

SEQ ID NO: 674932 - RNA, 14 nt, Haemophilus influenzae Rd
cuuggaauaaauua

SEQ ID NO: 674933 - RNA, 18 nt, Haemophilus influenzae Rd
cuuguacaguaauuguug

SEQ ID NO: 674934 - RNA, 17 nt, Haemophilus influenzae Rd
cuuguagcacauaaaga

SEQ ID NO: 674935 - RNA, 21 nt, Haemophilus influenzae Rd
cuuucauccucucgccaaauc

SEQ ID NO: 674936 - RNA, 16 nt, Haemophilus influenzae Rd
cuuucauuuuccaacc

SEQ ID NO: 674937 - RNA, 19 nt, Haemophilus influenzae Rd
cuuugacuaaaguaaauuu

SEQ ID NO: 674938 - RNA, 11 nt, Haemophilus influenzae Rd
cuuuggcuaaa

SEQ ID NO: 674939 - RNA, 14 nt, Haemophilus influenzae Rd
cuuugaaacggcga

SEQ ID NO: 674940 - RNA, 22 nt, Haemophilus influenzae Rd
cuuucuauuaaaaaaucaucaa

SEQ ID NO: 674941 - RNA, 19 nt, Haemophilus influenzae Rd
gaaaaucccuauaaugcac

SEQ ID NO: 674942 - RNA, 20 nt, Haemophilus influenzae Rd
gaaaauagcacagccaagug

SEQ ID NO: 674943 - RNA, 15 nt, Haemophilus influenzae Rd
cuuuuaaaaugaaca

SEQ ID NO: 674944 - RNA, 13 nt, Haemophilus influenzae Rd
gaaaaaauaacca

SEQ ID NO: 674945 - RNA, 15 nt, Haemophilus influenzae Rd
cuuugugccauuucu

SEQ ID NO: 674946 - RNA, 13 nt, Haemophilus influenzae Rd
cuuuguacugcca

SEQ ID NO: 674947 - RNA, 12 nt, Haemophilus influenzae Rd
gaaaacaauaaa

SEQ ID NO: 674948 - RNA, 14 nt, Haemophilus influenzae Rd
gaaaaagcuuccuu

SEQ ID NO: 674949 - RNA, 14 nt, Haemophilus influenzae Rd
gaaaaaggcaguaa

SEQ ID NO: 674950 - RNA, 17 nt, Haemophilus influenzae Rd
gaagaaaagcauuaaua

SEQ ID NO: 674951 - RNA, 17 nt, Haemophilus influenzae Rd
gaacuuuuaaaacacgc

SEQ ID NO: 674952 - RNA, 21 nt, Haemophilus influenzae Rd
gaacuuucgcguaauaacaag

SEQ ID NO: 674953 - RNA, 19 nt, Haemophilus influenzae Rd
gaacguuuuuuacuugcga

SEQ ID NO: 674954 - RNA, 20 nt, Haemophilus influenzae Rd
gacauaaaaacauaguaaau

SEQ ID NO: 674955 - RNA, 23 nt, Haemophilus influenzae Rd
gacaguuucgccugcuaauggcu

SEQ ID NO: 674956 - RNA, 15 nt, Haemophilus influenzae Rd
gacaccuuuuuccuu

SEQ ID NO: 674957 - RNA, 19 nt, Haemophilus influenzae Rd
gacaaagggucguuaagaa

SEQ ID NO: 674958 - RNA, 21 nt, Haemophilus influenzae Rd
gaauugcaucguuuacaucac

SEQ ID NO: 674959 - RNA, 15 nt, Haemophilus influenzae Rd
gaauugguucuaaau

SEQ ID NO: 674960 - RNA, 23 nt, Haemophilus influenzae Rd
gaaguaaaauagcugauaauaaa

SEQ ID NO: 674961 - RNA, 17 nt, Haemophilus influenzae Rd
gaagucagcaauacccg

SEQ ID NO: 674962 - RNA, 15 nt, Haemophilus influenzae Rd
gaaucaaggcuuugu

SEQ ID NO: 674963 - RNA, 17 nt, Haemophilus influenzae Rd
gaauaaaagauaacaaa

SEQ ID NO: 674964 - RNA, 17 nt, Haemophilus influenzae Rd
gaauagcaaauacgccu

SEQ ID NO: 674965 - RNA, 15 nt, Haemophilus influenzae Rd
gaauaucuuccacaa

SEQ ID NO: 674966 - RNA, 17 nt, Haemophilus influenzae Rd
gaauaucuuccacaaca

SEQ ID NO: 674967 - RNA, 18 nt, Haemophilus influenzae Rd
gaauaucuuugacuaaau

SEQ ID NO: 674968 - RNA, 22 nt, Haemophilus influenzae Rd
gaauauauucaugaaucguuuu

SEQ ID NO: 674969 - RNA, 23 nt, Haemophilus influenzae Rd
gaauaucaaggagcuaguuuagu

SEQ ID NO: 674970 - RNA, 19 nt, Haemophilus influenzae Rd
gaauugcauuuucuuccaa

SEQ ID NO: 674971 - RNA, 22 nt, Haemophilus influenzae Rd
gacgaacgugggaauuuuccca

SEQ ID NO: 674972 - RNA, 21 nt, Haemophilus influenzae Rd
gaccguuuuuucuuuuuccug

SEQ ID NO: 674973 - RNA, 19 nt, Haemophilus influenzae Rd
gagcuuuccaaacaaggcu

SEQ ID NO: 674974 - RNA, 15 nt, Haemophilus influenzae Rd
gauaacuuagaaaau

SEQ ID NO: 674975 - RNA, 19 nt, Haemophilus influenzae Rd
gauaaguaaugaaaauugc

SEQ ID NO: 674976 - RNA, 15 nt, Haemophilus influenzae Rd
gauaaucgcaaguag

SEQ ID NO: 674977 - RNA, 17 nt, Haemophilus influenzae Rd
gauagucaccaucacaa

SEQ ID NO: 674978 - RNA, 20 nt, Haemophilus influenzae Rd
gauagggauuuuuacuaaau

SEQ ID NO: 674979 - RNA, 23 nt, Haemophilus influenzae Rd
gauagcugugguaaauaauuuuc

SEQ ID NO: 674980 - RNA, 19 nt, Haemophilus influenzae Rd
gauacaaaauguuuacgcu

SEQ ID NO: 674981 - RNA, 15 nt, Haemophilus influenzae Rd
gaucaacauaacguu

SEQ ID NO: 674982 - RNA, 20 nt, Haemophilus influenzae Rd
gaucaaaucaaauuuuccuu

SEQ ID NO: 674983 - RNA, 14 nt, Haemophilus influenzae Rd
gagcauauuuucca

SEQ ID NO: 674984 - RNA, 21 nt, Haemophilus influenzae Rd
gagcaguaugaugauuguuau

SEQ ID NO: 674985 - RNA, 17 nt, Haemophilus influenzae Rd
gagcgaucugcacgaua

SEQ ID NO: 674986 - RNA, 15 nt, Haemophilus influenzae Rd
gaucuauaagaaaau

SEQ ID NO: 674987 - RNA, 13 nt, Haemophilus influenzae Rd
gaucguuuucucg

SEQ ID NO: 674988 - RNA, 12 nt, Haemophilus influenzae Rd
gaugauaagccc

SEQ ID NO: 674989 - RNA, 15 nt, Haemophilus influenzae Rd
gaugauuuucauucc

SEQ ID NO: 674990 - RNA, 12 nt, Haemophilus influenzae Rd
gauuaagaaaau

SEQ ID NO: 674991 - RNA, 20 nt, Haemophilus influenzae Rd
gauuuucuuagcuucaucuu

SEQ ID NO: 674992 - RNA, 16 nt, Haemophilus influenzae Rd
gauuuuaauugugcaa

SEQ ID NO: 674993 - RNA, 14 nt, Haemophilus influenzae Rd
gauuuguugugaaa

SEQ ID NO: 674994 - RNA, 14 nt, Haemophilus influenzae Rd
gauuuuguaauaaa

SEQ ID NO: 674995 - RNA, 15 nt, Haemophilus influenzae Rd
gcaaaagcaauaaug

SEQ ID NO: 674996 - RNA, 16 nt, Haemophilus influenzae Rd
gcaaaagccaauaaga

SEQ ID NO: 674997 - RNA, 16 nt, Haemophilus influenzae Rd
gauugaaucaauuuuu

SEQ ID NO: 674998 - RNA, 19 nt, Haemophilus influenzae Rd
gauucaguccgcauugaaa

SEQ ID NO: 674999 - RNA, 22 nt, Haemophilus influenzae Rd
gauucacgguguuuuuuaauaa

SEQ ID NO: 675000 - RNA, 13 nt, Haemophilus influenzae Rd
gauugcaccuaau

SEQ ID NO: 675001 - RNA, 21 nt, Haemophilus influenzae Rd
gcacgauaguggaauaaugaa

SEQ ID NO: 675002 - RNA, 20 nt, Haemophilus influenzae Rd
gcaccacuucgccacguaac

SEQ ID NO: 675003 - RNA, 18 nt, Haemophilus influenzae Rd
gcaauaauguugcugauu

SEQ ID NO: 675004 - RNA, 22 nt, Haemophilus influenzae Rd
gcaauaaucacaguaccuacau

SEQ ID NO: 675005 - RNA, 17 nt, Haemophilus influenzae Rd
gcaauuugaaaagaauu

SEQ ID NO: 675006 - RNA, 22 nt, Haemophilus influenzae Rd
gcaauuugaauuaauacgccaa

SEQ ID NO: 675007 - RNA, 14 nt, Haemophilus influenzae Rd
gcacauaaagacgc

SEQ ID NO: 675008 - RNA, 18 nt, Haemophilus influenzae Rd
gcacacggguauuaaugc

SEQ ID NO: 675009 - RNA, 21 nt, Haemophilus influenzae Rd
gcaucaaaacguucuaagaau

SEQ ID NO: 675010 - RNA, 18 nt, Haemophilus influenzae Rd
gcaucaacauaaauagag

SEQ ID NO: 675011 - RNA, 12 nt, Haemophilus influenzae Rd
gcauaucagcau

SEQ ID NO: 675012 - RNA, 15 nt, Haemophilus influenzae Rd
gcauccacuuuuuuc

SEQ ID NO: 675013 - RNA, 23 nt, Haemophilus influenzae Rd
gccaguaacuuucuucaauaauu

SEQ ID NO: 675014 - RNA, 16 nt, Haemophilus influenzae Rd
gccaguuggguuaaau

SEQ ID NO: 675015 - RNA, 16 nt, Haemophilus influenzae Rd
gccauccgcaauuaau

SEQ ID NO: 675016 - RNA, 18 nt, Haemophilus influenzae Rd
gccacuucuucaaagauu

SEQ ID NO: 675017 - RNA, 15 nt, Haemophilus influenzae Rd
gccacuggugcugaa

SEQ ID NO: 675018 - RNA, 22 nt, Haemophilus influenzae Rd
gccaacuuguaagcguaaugca

SEQ ID NO: 675019 - RNA, 15 nt, Haemophilus influenzae Rd
gccaaucuaaacaca

SEQ ID NO: 675020 - RNA, 17 nt, Haemophilus influenzae Rd
gccgauaguuaauggca

SEQ ID NO: 675021 - RNA, 11 nt, Haemophilus influenzae Rd
gccgcaaucaa

SEQ ID NO: 675022 - RNA, 12 nt, Haemophilus influenzae Rd
gccgcaccuuga

SEQ ID NO: 675023 - RNA, 20 nt, Haemophilus influenzae Rd
gcccuuuauuuuguuaaaag

SEQ ID NO: 675024 - RNA, 13 nt, Haemophilus influenzae Rd
ccuauaaauaaac

SEQ ID NO: 675025 - RNA, 15 nt, Haemophilus influenzae Rd
ccucaggaacaucac

SEQ ID NO: 675026 - RNA, 19 nt, Haemophilus influenzae Rd
ccucagguucaaacaucac

SEQ ID NO: 675027 - RNA, 18 nt, Haemophilus influenzae Rd
ccuagauugcuuugagcc

SEQ ID NO: 675028 - RNA, 17 nt, Haemophilus influenzae Rd
ccugacauuuuugccag

SEQ ID NO: 675029 - RNA, 23 nt, Haemophilus influenzae Rd
ccugaugcuuuaacaccaauauu

SEQ ID NO: 675030 - RNA, 23 nt, Haemophilus influenzae Rd
ccugaacuuucgcguaauaacaa

SEQ ID NO: 675031 - RNA, 21 nt, Haemophilus influenzae Rd
ccguauugucaaaaucagcuu

SEQ ID NO: 675032 - RNA, 13 nt, Haemophilus influenzae Rd
ccgcaucaaaauu

SEQ ID NO: 675033 - RNA, 19 nt, Haemophilus influenzae Rd
ccgcaauauuuaaauacac

SEQ ID NO: 675034 - RNA, 18 nt, Haemophilus influenzae Rd
ccgcaaucuucacaaaua

SEQ ID NO: 675035 - RNA, 14 nt, Haemophilus influenzae Rd
cgaugcauacuugu

SEQ ID NO: 675036 - RNA, 22 nt, Haemophilus influenzae Rd
cgaugcauugauugcuuuaacu

SEQ ID NO: 675037 - RNA, 22 nt, Haemophilus influenzae Rd
cgauggaaaugaguaaaccgau

SEQ ID NO: 675038 - RNA, 17 nt, Haemophilus influenzae Rd
cgaugggcaauggcaau

SEQ ID NO: 675039 - RNA, 18 nt, Haemophilus influenzae Rd
cgagggucaaaagaaaga

SEQ ID NO: 675040 - RNA, 17 nt, Haemophilus influenzae Rd
cgaguacgaaauacgca

SEQ ID NO: 675041 - RNA, 16 nt, Haemophilus influenzae Rd
cgaguuggaucacaaa

SEQ ID NO: 675042 - RNA, 13 nt, Haemophilus influenzae Rd
cgaguugauuaau

SEQ ID NO: 675043 - RNA, 18 nt, Haemophilus influenzae Rd
cgauacuuuuaauuaaau

SEQ ID NO: 675044 - RNA, 16 nt, Haemophilus influenzae Rd
cgauacggcaaauuaa

SEQ ID NO: 675045 - RNA, 18 nt, Haemophilus influenzae Rd
cgauacggcaaauuaaau

SEQ ID NO: 675046 - RNA, 16 nt, Haemophilus influenzae Rd
cgauauuuaagucuaa

SEQ ID NO: 675047 - RNA, 14 nt, Haemophilus influenzae Rd
cgccacaauauuua

SEQ ID NO: 675048 - RNA, 17 nt, Haemophilus influenzae Rd
cgccaagcgcugcagua

SEQ ID NO: 675049 - RNA, 22 nt, Haemophilus influenzae Rd
cgcauuuaaauaaaauaacaaa

SEQ ID NO: 675050 - RNA, 15 nt, Haemophilus influenzae Rd
cgcacuuuagaaaau

SEQ ID NO: 675051 - RNA, 20 nt, Haemophilus influenzae Rd
cgcacuuucgccuucauaag

SEQ ID NO: 675052 - RNA, 20 nt, Haemophilus influenzae Rd
cgcacuuuuuuguauaaaaa

SEQ ID NO: 675053 - RNA, 22 nt, Haemophilus influenzae Rd
cgcaggauaagaugauaaauuc

SEQ ID NO: 675054 - RNA, 15 nt, Haemophilus influenzae Rd
ccuuucaucauugcu

SEQ ID NO: 675055 - RNA, 19 nt, Haemophilus influenzae Rd
cgaaaucaucgaaaucuaa

SEQ ID NO: 675056 - RNA, 16 nt, Haemophilus influenzae Rd
cgaauaucgacuaaua

SEQ ID NO: 675057 - RNA, 21 nt, Haemophilus influenzae Rd
cgaauguuugaucgguuuuau

SEQ ID NO: 675058 - RNA, 13 nt, Haemophilus influenzae Rd
cgaauugcaaugc

SEQ ID NO: 675059 - RNA, 17 nt, Haemophilus influenzae Rd
cgaauugcaucguuuac

SEQ ID NO: 675060 - RNA, 19 nt, Haemophilus influenzae Rd
cgacacuaaaaagcccaaa

SEQ ID NO: 675061 - RNA, 22 nt, Haemophilus influenzae Rd
cgaaauuaaaugggacaaagca

SEQ ID NO: 675062 - RNA, 18 nt, Haemophilus influenzae Rd
cgacucaccgcaauaaua

SEQ ID NO: 675063 - RNA, 19 nt, Haemophilus influenzae Rd
cggaauuauguauuuuacg

SEQ ID NO: 675064 - RNA, 15 nt, Haemophilus influenzae Rd
cgguacuucacagua

SEQ ID NO: 675065 - RNA, 23 nt, Haemophilus influenzae Rd
cgguauuuuuuauugaaauuuua

SEQ ID NO: 675066 - RNA, 20 nt, Haemophilus influenzae Rd
cgcccagagcaccaaauuaa

SEQ ID NO: 675067 - RNA, 16 nt, Haemophilus influenzae Rd
cagcaauuuauuguag

SEQ ID NO: 675068 - RNA, 12 nt, Haemophilus influenzae Rd
cagcaauuaauu

SEQ ID NO: 675069 - RNA, 20 nt, Haemophilus influenzae Rd
cagaauuuaguccuuuuacu

SEQ ID NO: 675070 - RNA, 16 nt, Haemophilus influenzae Rd
cagaauuucgucaaaa

SEQ ID NO: 675071 - RNA, 17 nt, Haemophilus influenzae Rd
cagccaaauuuuucuuu

SEQ ID NO: 675072 - RNA, 12 nt, Haemophilus influenzae Rd
cacgaucacuug

SEQ ID NO: 675073 - RNA, 18 nt, Haemophilus influenzae Rd
cacgaccaauauugaaaa

SEQ ID NO: 675074 - RNA, 22 nt, Haemophilus influenzae Rd
caccuuuuuccuuuaauugaaa

SEQ ID NO: 675075 - RNA, 16 nt, Haemophilus influenzae Rd
caccuuuccagccuaa

SEQ ID NO: 675076 - RNA, 17 nt, Haemophilus influenzae Rd
caccugcaagugcggua

SEQ ID NO: 675077 - RNA, 20 nt, Haemophilus influenzae Rd
cacucuuucaaaaaucaaau

SEQ ID NO: 675078 - RNA, 19 nt, Haemophilus influenzae Rd
cacugcgccuaauuggaaa

SEQ ID NO: 675079 - RNA, 20 nt, Haemophilus influenzae Rd
cacugcaguaaaaucuucac

SEQ ID NO: 675080 - RNA, 23 nt, Haemophilus influenzae Rd
cacuucaggguuuucaucauuac

SEQ ID NO: 675081 - RNA, 14 nt, Haemophilus influenzae Rd
cacuucauaaauug

SEQ ID NO: 675082 - RNA, 15 nt, Haemophilus influenzae Rd
cacuucagaauucau

SEQ ID NO: 675083 - RNA, 15 nt, Haemophilus influenzae Rd
cacuuaaaaauaaag

SEQ ID NO: 675084 - RNA, 13 nt, Haemophilus influenzae Rd
cacuuaauaaaaa

SEQ ID NO: 675085 - RNA, 14 nt, Haemophilus influenzae Rd
cacuguaaauaaac

SEQ ID NO: 675086 - RNA, 14 nt, Haemophilus influenzae Rd
cacuguauuggaaa

SEQ ID NO: 675087 - RNA, 17 nt, Haemophilus influenzae Rd
cagaacauauaacccau

SEQ ID NO: 675088 - RNA, 20 nt, Haemophilus influenzae Rd
cagaaccuaaugcaguaacu

SEQ ID NO: 675089 - RNA, 13 nt, Haemophilus influenzae Rd
cacuuuaaaagug

SEQ ID NO: 675090 - RNA, 15 nt, Haemophilus influenzae Rd
cacuuucacauaaau

SEQ ID NO: 675091 - RNA, 23 nt, Haemophilus influenzae Rd
cacuugggcugcaugaagaacuu

SEQ ID NO: 675092 - RNA, 13 nt, Haemophilus influenzae Rd
cacuuuagaaaau

SEQ ID NO: 675093 - RNA, 23 nt, Haemophilus influenzae Rd
cacuuuagaaaauauaauuaauc

SEQ ID NO: 675094 - RNA, 15 nt, Haemophilus influenzae Rd
cacuuuauuagaaau

SEQ ID NO: 675095 - RNA, 18 nt, Haemophilus influenzae Rd
cacuugucauuaaaaaau

SEQ ID NO: 675096 - RNA, 15 nt, Haemophilus influenzae Rd
cagcuauuaaaaaaa

SEQ ID NO: 675097 - RNA, 14 nt, Haemophilus influenzae Rd
caggaucgguaagu

SEQ ID NO: 675098 - RNA, 23 nt, Haemophilus influenzae Rd
cagguaaggauugaccgcccaac

SEQ ID NO: 675099 - RNA, 21 nt, Haemophilus influenzae Rd
cagguacuuggauugcaugaa

SEQ ID NO: 675100 - RNA, 14 nt, Haemophilus influenzae Rd
caggggauugaaaa

SEQ ID NO: 675101 - RNA, 18 nt, Haemophilus influenzae Rd
caggucgagggucaaaag

SEQ ID NO: 675102 - RNA, 22 nt, Haemophilus influenzae Rd
caucagguuuaauaaucgaaaa

SEQ ID NO: 675103 - RNA, 15 nt, Haemophilus influenzae Rd
cauccgaaauuaauu

SEQ ID NO: 675104 - RNA, 15 nt, Haemophilus influenzae Rd
caucauuuuuauuua

SEQ ID NO: 675105 - RNA, 14 nt, Haemophilus influenzae Rd
caucauuaugaaaa

SEQ ID NO: 675106 - RNA, 19 nt, Haemophilus influenzae Rd
caucaaccaaaauacaauc

SEQ ID NO: 675107 - RNA, 18 nt, Haemophilus influenzae Rd
cauauugcuugcauucac

SEQ ID NO: 675108 - RNA, 13 nt, Haemophilus influenzae Rd
cauauuaucugcu

SEQ ID NO: 675109 - RNA, 16 nt, Haemophilus influenzae Rd
cauauucauaaaaggc

SEQ ID NO: 675110 - RNA, 19 nt, Haemophilus influenzae Rd
cauauaguaagcaccaaaa

SEQ ID NO: 675111 - RNA, 18 nt, Haemophilus influenzae Rd
cauaucuucuucuugcag

SEQ ID NO: 675112 - RNA, 20 nt, Haemophilus influenzae Rd
caguuggguuaaauauaaau

SEQ ID NO: 675113 - RNA, 23 nt, Haemophilus influenzae Rd
caguuucugguuuaucgucugca

SEQ ID NO: 675114 - RNA, 22 nt, Haemophilus influenzae Rd
cauaacgcugcuuaaagcaauc

SEQ ID NO: 675115 - RNA, 16 nt, Haemophilus influenzae Rd
cauaacggcaagcaaa

SEQ ID NO: 675116 - RNA, 20 nt, Haemophilus influenzae Rd
cauaacgccaagguuauuua

SEQ ID NO: 675117 - RNA, 13 nt, Haemophilus influenzae Rd
cauaacaagugcu

SEQ ID NO: 675118 - RNA, 20 nt, Haemophilus influenzae Rd
cauaccauuuaaaaguaaaa

SEQ ID NO: 675119 - RNA, 15 nt, Haemophilus influenzae Rd
cauaccgcucauugc

SEQ ID NO: 675120 - RNA, 20 nt, Haemophilus influenzae Rd
cauacuaugacguuuauuua

SEQ ID NO: 675121 - RNA, 12 nt, Haemophilus influenzae Rd
cauauaaaagug

SEQ ID NO: 675122 - RNA, 23 nt, Haemophilus influenzae Rd
cauaguuuuaugcugcaaaagcu

SEQ ID NO: 675123 - RNA, 22 nt, Haemophilus influenzae Rd
cauaguuauccauccagaaaau

SEQ ID NO: 675124 - RNA, 16 nt, Haemophilus influenzae Rd
cauacuuagauaaauu

SEQ ID NO: 675125 - RNA, 15 nt, Haemophilus influenzae Rd
ccacauaauaagaaa

SEQ ID NO: 675126 - RNA, 23 nt, Haemophilus influenzae Rd
ccacauaauaagaaaguaauugc

SEQ ID NO: 675127 - RNA, 12 nt, Haemophilus influenzae Rd
ccaauaaaagua

SEQ ID NO: 675128 - RNA, 16 nt, Haemophilus influenzae Rd
ccaagguuauuuagcc

SEQ ID NO: 675129 - RNA, 14 nt, Haemophilus influenzae Rd
ccaacgcacguaac

SEQ ID NO: 675130 - RNA, 17 nt, Haemophilus influenzae Rd
ccaacguauuuauacca

SEQ ID NO: 675131 - RNA, 23 nt, Haemophilus influenzae Rd
ccaaauuccauucacuuucacau

SEQ ID NO: 675132 - RNA, 23 nt, Haemophilus influenzae Rd
ccaaauucuuuaaauucaauaaa

SEQ ID NO: 675133 - RNA, 16 nt, Haemophilus influenzae Rd
ccaaaggcuuucgcaa

SEQ ID NO: 675134 - RNA, 17 nt, Haemophilus influenzae Rd
ccaaauauucuucuaaa

SEQ ID NO: 675135 - RNA, 22 nt, Haemophilus influenzae Rd
cauuuucgcauagcgaucugcu

SEQ ID NO: 675136 - RNA, 23 nt, Haemophilus influenzae Rd
cauuuucugcauccaaacgccac

SEQ ID NO: 675137 - RNA, 16 nt, Haemophilus influenzae Rd
cauugucuuuuacguu

SEQ ID NO: 675138 - RNA, 21 nt, Haemophilus influenzae Rd
cauugugacggugaauuuauc

SEQ ID NO: 675139 - RNA, 17 nt, Haemophilus influenzae Rd
cauugugauguucuaaa

SEQ ID NO: 675140 - RNA, 14 nt, Haemophilus influenzae Rd
cauuugcauauuuu

SEQ ID NO: 675141 - RNA, 20 nt, Haemophilus influenzae Rd
cauuuggcauuuuguaagca

SEQ ID NO: 675142 - RNA, 17 nt, Haemophilus influenzae Rd
cauucuguaaacuaaau

SEQ ID NO: 675143 - RNA, 18 nt, Haemophilus influenzae Rd
cauuggauuaaucaauuu

SEQ ID NO: 675144 - RNA, 20 nt, Haemophilus influenzae Rd
cauuccauuuugcauauuga

SEQ ID NO: 675145 - RNA, 20 nt, Haemophilus influenzae Rd
cauggaacguuuuuuacuug

SEQ ID NO: 675146 - RNA, 16 nt, Haemophilus influenzae Rd
caugacuauuacaauu

SEQ ID NO: 675147 - RNA, 17 nt, Haemophilus influenzae Rd
caucuaauugugcuaaa

SEQ ID NO: 675148 - RNA, 16 nt, Haemophilus influenzae Rd
caucugcauaacgaua

SEQ ID NO: 675149 - RNA, 16 nt, Haemophilus influenzae Rd
caucugcugguuuuag

SEQ ID NO: 675150 - RNA, 23 nt, Haemophilus influenzae Rd
caucuugauccauauauugaaca

SEQ ID NO: 675151 - RNA, 23 nt, Haemophilus influenzae Rd
caucguaucaauuuuauugaaua

SEQ ID NO: 675152 - RNA, 13 nt, Haemophilus influenzae Rd
caucguauuaaaa

SEQ ID NO: 675153 - RNA, 21 nt, Haemophilus influenzae Rd
caucguauuaaaagugcggug

SEQ ID NO: 675154 - RNA, 21 nt, Haemophilus influenzae Rd
ccagauaaaaacugugcgguc

SEQ ID NO: 675155 - RNA, 19 nt, Haemophilus influenzae Rd
ccacgcuaaaaucuugcac

SEQ ID NO: 675156 - RNA, 16 nt, Haemophilus influenzae Rd
ccacguuuucaacagu

SEQ ID NO: 675157 - RNA, 13 nt, Haemophilus influenzae Rd
cccacauagcuug

SEQ ID NO: 675158 - RNA, 20 nt, Haemophilus influenzae Rd
cccagcauuccguucacaaa

SEQ ID NO: 675159 - RNA, 19 nt, Haemophilus influenzae Rd
cccaggaguaaccacaaaa

SEQ ID NO: 675160 - RNA, 20 nt, Haemophilus influenzae Rd
ccauuuacagguuugacauu

SEQ ID NO: 675161 - RNA, 16 nt, Haemophilus influenzae Rd
ccauugcuaaauuuau

SEQ ID NO: 675162 - RNA, 20 nt, Haemophilus influenzae Rd
ccauuuuuaaaaauaacaua

SEQ ID NO: 675163 - RNA, 19 nt, Haemophilus influenzae Rd
ccauuuuuaauuaaacguu

SEQ ID NO: 675164 - RNA, 18 nt, Haemophilus influenzae Rd
cccaagauucuaaauauu

SEQ ID NO: 675165 - RNA, 21 nt, Haemophilus influenzae Rd
cccaauuacgaaguggcguuu

SEQ ID NO: 675166 - RNA, 15 nt, Haemophilus influenzae Rd
cccaauuauuggcaa

SEQ ID NO: 675167 - RNA, 18 nt, Haemophilus influenzae Rd
cccaauauuuuucauaaa

SEQ ID NO: 675168 - RNA, 19 nt, Haemophilus influenzae Rd
ccagguaauguuucauaaa

SEQ ID NO: 675169 - RNA, 17 nt, Haemophilus influenzae Rd
ccaguaacuuucuucaa

SEQ ID NO: 675170 - RNA, 12 nt, Haemophilus influenzae Rd
ccaucaaaacuu

SEQ ID NO: 675171 - RNA, 22 nt, Haemophilus influenzae Rd
ccaucaaauccgccaaucauac

SEQ ID NO: 675172 - RNA, 22 nt, Haemophilus influenzae Rd
ccaucaagaaaguuuuaagugc

SEQ ID NO: 675173 - RNA, 12 nt, Haemophilus influenzae Rd
ccauaaaacguu

SEQ ID NO: 675174 - RNA, 13 nt, Haemophilus influenzae Rd
ccauaauaaucac

SEQ ID NO: 675175 - RNA, 14 nt, Haemophilus influenzae Rd
ccgaaucugauugc

SEQ ID NO: 675176 - RNA, 17 nt, Haemophilus influenzae Rd
ccgaauccaaugccuug

SEQ ID NO: 675177 - RNA, 13 nt, Haemophilus influenzae Rd
ccccuauagcuua

SEQ ID NO: 675178 - RNA, 22 nt, Haemophilus influenzae Rd
cccaugcgaacagguucauuaa

SEQ ID NO: 675179 - RNA, 18 nt, Haemophilus influenzae Rd
cccgcauauaaaauaaag

SEQ ID NO: 675180 - RNA, 21 nt, Haemophilus influenzae Rd
cccgauuaagaauacugcacc

SEQ ID NO: 675181 - RNA, 17 nt, Haemophilus influenzae Rd
aucaggcuuucauuuuc

SEQ ID NO: 675182 - RNA, 13 nt, Haemophilus influenzae Rd
auauuguaggaag

SEQ ID NO: 675183 - RNA, 14 nt, Haemophilus influenzae Rd
auauuguuuuaauu

SEQ ID NO: 675184 - RNA, 19 nt, Haemophilus influenzae Rd
aucaguuaugcaaauacau

SEQ ID NO: 675185 - RNA, 14 nt, Haemophilus influenzae Rd
aucaugguuguaau

SEQ ID NO: 675186 - RNA, 22 nt, Haemophilus influenzae Rd
aucauugcaagugcaguuucag

SEQ ID NO: 675187 - RNA, 19 nt, Haemophilus influenzae Rd
aucauuuucaccaauuuau

SEQ ID NO: 675188 - RNA, 15 nt, Haemophilus influenzae Rd
auccaacucauuaca

SEQ ID NO: 675189 - RNA, 22 nt, Haemophilus influenzae Rd
auccaaccuacauuaaucacca

SEQ ID NO: 675190 - RNA, 15 nt, Haemophilus influenzae Rd
aucauuucaauguuu

SEQ ID NO: 675191 - RNA, 15 nt, Haemophilus influenzae Rd
aucaucccuucuuuu

SEQ ID NO: 675192 - RNA, 15 nt, Haemophilus influenzae Rd
aucaucuagauuucu

SEQ ID NO: 675193 - RNA, 17 nt, Haemophilus influenzae Rd
auccauaauuucagcau

SEQ ID NO: 675194 - RNA, 17 nt, Haemophilus influenzae Rd
auccauuucuaaaggca

SEQ ID NO: 675195 - RNA, 20 nt, Haemophilus influenzae Rd
aucggagggggauuuucucg

SEQ ID NO: 675196 - RNA, 17 nt, Haemophilus influenzae Rd
aucucuuucaauuucaa

SEQ ID NO: 675197 - RNA, 14 nt, Haemophilus influenzae Rd
aucguuaauaucau

SEQ ID NO: 675198 - RNA, 13 nt, Haemophilus influenzae Rd
aucguauaagccc

SEQ ID NO: 675199 - RNA, 15 nt, Haemophilus influenzae Rd
aucgcuugcauuucu

SEQ ID NO: 675200 - RNA, 23 nt, Haemophilus influenzae Rd
aucgcuugccagucauuuuuuac

SEQ ID NO: 675201 - RNA, 19 nt, Haemophilus influenzae Rd
aucgcuaagaauaaaguga

SEQ ID NO: 675202 - RNA, 23 nt, Haemophilus influenzae Rd
aucgcgaagcucgucuaaaucuu

SEQ ID NO: 675203 - RNA, 22 nt, Haemophilus influenzae Rd
aucgcaucaaaggcuaauucua

SEQ ID NO: 675204 - RNA, 19 nt, Haemophilus influenzae Rd
aucgcagaaauagauucuu

SEQ ID NO: 675205 - RNA, 18 nt, Haemophilus influenzae Rd
aucgaguuuuaucuucaa

SEQ ID NO: 675206 - RNA, 17 nt, Haemophilus influenzae Rd
augccauuuuuuauaau

SEQ ID NO: 675207 - RNA, 13 nt, Haemophilus influenzae Rd
augccaagauuuc

SEQ ID NO: 675208 - RNA, 23 nt, Haemophilus influenzae Rd
augauucguggcaauuuuucuaa

SEQ ID NO: 675209 - RNA, 17 nt, Haemophilus influenzae Rd
augauuuagaacaauau

SEQ ID NO: 675210 - RNA, 14 nt, Haemophilus influenzae Rd
augaugauuguuau

SEQ ID NO: 675211 - RNA, 16 nt, Haemophilus influenzae Rd
augaucuuugguucau

SEQ ID NO: 675212 - RNA, 14 nt, Haemophilus influenzae Rd
aucugcaucuaauu

SEQ ID NO: 675213 - RNA, 17 nt, Haemophilus influenzae Rd
aucugaugggaauucau

SEQ ID NO: 675214 - RNA, 16 nt, Haemophilus influenzae Rd
aucugcacgauagcaa

SEQ ID NO: 675215 - RNA, 15 nt, Haemophilus influenzae Rd
aucugauaaauuuug

SEQ ID NO: 675216 - RNA, 22 nt, Haemophilus influenzae Rd
aucugauccgugaacugaguuu

SEQ ID NO: 675217 - RNA, 17 nt, Haemophilus influenzae Rd
aucugaacuuuguucau

SEQ ID NO: 675218 - RNA, 14 nt, Haemophilus influenzae Rd
augcgaacagguuc

SEQ ID NO: 675219 - RNA, 13 nt, Haemophilus influenzae Rd
augcgaaaauggc

SEQ ID NO: 675220 - RNA, 14 nt, Haemophilus influenzae Rd
augccucuuuuuuc

SEQ ID NO: 675221 - RNA, 23 nt, Haemophilus influenzae Rd
augccucaucuuuuggguuaaau

SEQ ID NO: 675222 - RNA, 17 nt, Haemophilus influenzae Rd
augccuacuuuuuauuu

SEQ ID NO: 675223 - RNA, 13 nt, Haemophilus influenzae Rd
augccuuccgcuu

SEQ ID NO: 675224 - RNA, 22 nt, Haemophilus influenzae Rd
augcgugguuacgaaaaguuga

SEQ ID NO: 675225 - RNA, 23 nt, Haemophilus influenzae Rd
augcguuuucgcaauaucaucau

SEQ ID NO: 675226 - RNA, 13 nt, Haemophilus influenzae Rd
augcuaauuucaa

SEQ ID NO: 675227 - RNA, 18 nt, Haemophilus influenzae Rd
augcuaaaauuaaaggca

SEQ ID NO: 675228 - RNA, 18 nt, Haemophilus influenzae Rd
augcuaaauuccccaagg

SEQ ID NO: 675229 - RNA, 17 nt, Haemophilus influenzae Rd
augccgcaaucaagcaa

SEQ ID NO: 675230 - RNA, 16 nt, Haemophilus influenzae Rd
auguuuuaaagaauau

SEQ ID NO: 675231 - RNA, 19 nt, Haemophilus influenzae Rd
auuaacuaaaccauuuaau

SEQ ID NO: 675232 - RNA, 22 nt, Haemophilus influenzae Rd
auuaacuugcuauuuucuaauu

SEQ ID NO: 675233 - RNA, 11 nt, Haemophilus influenzae Rd
auuaagaauac

SEQ ID NO: 675234 - RNA, 17 nt, Haemophilus influenzae Rd
auuaagcacaggcguaa

SEQ ID NO: 675235 - RNA, 13 nt, Haemophilus influenzae Rd
auuaaaaauaaau

SEQ ID NO: 675236 - RNA, 20 nt, Haemophilus influenzae Rd
auuaaaaauaaguucaucaa

SEQ ID NO: 675237 - RNA, 16 nt, Haemophilus influenzae Rd
auuaaaaccaauuuuu

SEQ ID NO: 675238 - RNA, 18 nt, Haemophilus influenzae Rd
auuaccgcacuuuuuauu

SEQ ID NO: 675239 - RNA, 19 nt, Haemophilus influenzae Rd
auuaccacaugcauuuuuc

SEQ ID NO: 675240 - RNA, 20 nt, Haemophilus influenzae Rd
auuaccacccaaaauuucag

SEQ ID NO: 675241 - RNA, 17 nt, Haemophilus influenzae Rd
auuaccacugcauuuuc

SEQ ID NO: 675242 - RNA, 16 nt, Haemophilus influenzae Rd
auuacgcauaucacga

SEQ ID NO: 675243 - RNA, 18 nt, Haemophilus influenzae Rd
auuaauuuuauuuuuugc

SEQ ID NO: 675244 - RNA, 19 nt, Haemophilus influenzae Rd
auuacagugcgguuauuua

SEQ ID NO: 675245 - RNA, 19 nt, Haemophilus influenzae Rd
auuaaguauagcuuuuugc

SEQ ID NO: 675246 - RNA, 14 nt, Haemophilus influenzae Rd
auuaagugauguuc

SEQ ID NO: 675247 - RNA, 15 nt, Haemophilus influenzae Rd
auuaaguuaaaagug

SEQ ID NO: 675248 - RNA, 18 nt, Haemophilus influenzae Rd
auuaauaaacugcgaucu

SEQ ID NO: 675249 - RNA, 19 nt, Haemophilus influenzae Rd
auuaauaagaaagaaucga

SEQ ID NO: 675250 - RNA, 17 nt, Haemophilus influenzae Rd
auuaauccaucauuuuu

SEQ ID NO: 675251 - RNA, 22 nt, Haemophilus influenzae Rd
auuaaucggcaauguuuuaagu

SEQ ID NO: 675252 - RNA, 23 nt, Haemophilus influenzae Rd
auuaaucuuuuuucuuucuagua

SEQ ID NO: 675253 - RNA, 18 nt, Haemophilus influenzae Rd
auuaauuugcugaaauau

SEQ ID NO: 675254 - RNA, 23 nt, Haemophilus influenzae Rd
auuaauuaacgcucaaaaauuuc

SEQ ID NO: 675255 - RNA, 15 nt, Haemophilus influenzae Rd
auucaaucuuuuugu

SEQ ID NO: 675256 - RNA, 13 nt, Haemophilus influenzae Rd
auucaauuacuau

SEQ ID NO: 675257 - RNA, 21 nt, Haemophilus influenzae Rd
auucaaauaacgcauaauuug

SEQ ID NO: 675258 - RNA, 19 nt, Haemophilus influenzae Rd
auuaucgccaucacgccau

SEQ ID NO: 675259 - RNA, 14 nt, Haemophilus influenzae Rd
auuauuuacaauug

SEQ ID NO: 675260 - RNA, 13 nt, Haemophilus influenzae Rd
auucaauuuuccc

SEQ ID NO: 675261 - RNA, 16 nt, Haemophilus influenzae Rd
auucacaggguucagc

SEQ ID NO: 675262 - RNA, 22 nt, Haemophilus influenzae Rd
auuccaacaaguucuucuauug

SEQ ID NO: 675263 - RNA, 15 nt, Haemophilus influenzae Rd
auuacgguuugcgcc

SEQ ID NO: 675264 - RNA, 19 nt, Haemophilus influenzae Rd
auuacggccuuuacuaaag

SEQ ID NO: 675265 - RNA, 21 nt, Haemophilus influenzae Rd
auuacgccuaaccaagccaaa

SEQ ID NO: 675266 - RNA, 17 nt, Haemophilus influenzae Rd
auuagacuuaauuucac

SEQ ID NO: 675267 - RNA, 14 nt, Haemophilus influenzae Rd
auuagcauccacac

SEQ ID NO: 675268 - RNA, 17 nt, Haemophilus influenzae Rd
auuagguaaauuugguu

SEQ ID NO: 675269 - RNA, 14 nt, Haemophilus influenzae Rd
auuauacauuuaac

SEQ ID NO: 675270 - RNA, 16 nt, Haemophilus influenzae Rd
auuaucaacaguaaau

SEQ ID NO: 675271 - RNA, 20 nt, Haemophilus influenzae Rd
auuaguuuuucgcugcagcu

SEQ ID NO: 675272 - RNA, 15 nt, Haemophilus influenzae Rd
auuucugaacacaag

SEQ ID NO: 675273 - RNA, 13 nt, Haemophilus influenzae Rd
auuucuaucacga

SEQ ID NO: 675274 - RNA, 18 nt, Haemophilus influenzae Rd
auuugaaaagaauuucau

SEQ ID NO: 675275 - RNA, 12 nt, Haemophilus influenzae Rd
auuugaaaaucu

SEQ ID NO: 675276 - RNA, 15 nt, Haemophilus influenzae Rd
auuucuuuaaauggc

SEQ ID NO: 675277 - RNA, 17 nt, Haemophilus influenzae Rd
auuucguuguuuuaaua

SEQ ID NO: 675278 - RNA, 19 nt, Haemophilus influenzae Rd
auuucuaaugcaauuucaa

SEQ ID NO: 675279 - RNA, 18 nt, Haemophilus influenzae Rd
auuucggcaguacucgaa

SEQ ID NO: 675280 - RNA, 22 nt, Haemophilus influenzae Rd
auuucgcccuuauacaaaacua

SEQ ID NO: 675281 - RNA, 23 nt, Haemophilus influenzae Rd
auuuguugguaaaucuaacaauc

SEQ ID NO: 675282 - RNA, 16 nt, Haemophilus influenzae Rd
auuuguuacuaaaaua

SEQ ID NO: 675283 - RNA, 16 nt, Haemophilus influenzae Rd
auuugcauaaaaccag

SEQ ID NO: 675284 - RNA, 20 nt, Haemophilus influenzae Rd
auuugcacccgccauaaaac

SEQ ID NO: 675285 - RNA, 23 nt, Haemophilus influenzae Rd
auuugacgauaauauuuuugcca

SEQ ID NO: 675286 - RNA, 18 nt, Haemophilus influenzae Rd
auuugauaagaacggcga

SEQ ID NO: 675287 - RNA, 14 nt, Haemophilus influenzae Rd
auuugccucuucuu

SEQ ID NO: 675288 - RNA, 16 nt, Haemophilus influenzae Rd
auuugggaauaccaca

SEQ ID NO: 675289 - RNA, 19 nt, Haemophilus influenzae Rd
auuuggucuguuucuucua

SEQ ID NO: 675290 - RNA, 12 nt, Haemophilus influenzae Rd
auuuauaccaga

SEQ ID NO: 675291 - RNA, 23 nt, Haemophilus influenzae Rd
auuuauacgugaaccaacccaau

SEQ ID NO: 675292 - RNA, 19 nt, Haemophilus influenzae Rd
auuuauauaauuuaacaua

SEQ ID NO: 675293 - RNA, 20 nt, Haemophilus influenzae Rd
auuuaccgcacuuugauuuu

SEQ ID NO: 675294 - RNA, 16 nt, Haemophilus influenzae Rd
auuuaccgcacuuuuc

SEQ ID NO: 675295 - RNA, 17 nt, Haemophilus influenzae Rd
auuuaccgcuuucaauu

SEQ ID NO: 675296 - RNA, 21 nt, Haemophilus influenzae Rd
auuuaccugauucauugcauu

SEQ ID NO: 675297 - RNA, 20 nt, Haemophilus influenzae Rd
auuuaacaauggcaacaaau

SEQ ID NO: 675298 - RNA, 21 nt, Haemophilus influenzae Rd
auuuaacuguaucuacuuuau

SEQ ID NO: 675299 - RNA, 22 nt, Haemophilus influenzae Rd
auuuaacuguaucuacuuuauu

SEQ ID NO: 675300 - RNA, 20 nt, Haemophilus influenzae Rd
auuuaauaacaaaagggcga

SEQ ID NO: 675301 - RNA, 17 nt, Haemophilus influenzae Rd
auuuaaauggcuuuauu

SEQ ID NO: 675302 - RNA, 18 nt, Haemophilus influenzae Rd
auuccauauuacccguac

SEQ ID NO: 675303 - RNA, 13 nt, Haemophilus influenzae Rd
auucccaaauuuu

SEQ ID NO: 675304 - RNA, 14 nt, Haemophilus influenzae Rd
auuuauuucaucaa

SEQ ID NO: 675305 - RNA, 14 nt, Haemophilus influenzae Rd
auuucaacuauuuu

SEQ ID NO: 675306 - RNA, 19 nt, Haemophilus influenzae Rd
auuuccuauuuacguaaaa

SEQ ID NO: 675307 - RNA, 19 nt, Haemophilus influenzae Rd
auuuccuccccacacuuug

SEQ ID NO: 675308 - RNA, 12 nt, Haemophilus influenzae Rd
caaagcaaaauu

SEQ ID NO: 675309 - RNA, 13 nt, Haemophilus influenzae Rd
caaagacuaauac

SEQ ID NO: 675310 - RNA, 12 nt, Haemophilus influenzae Rd
caaacggaaaau

SEQ ID NO: 675311 - RNA, 20 nt, Haemophilus influenzae Rd
caaaauagauguaaccuuuc

SEQ ID NO: 675312 - RNA, 22 nt, Haemophilus influenzae Rd
caaaaucauauugauuuacauu

SEQ ID NO: 675313 - RNA, 16 nt, Haemophilus influenzae Rd
caaaaucgcauauuga

SEQ ID NO: 675314 - RNA, 15 nt, Haemophilus influenzae Rd
caaaaucgcccgaca

SEQ ID NO: 675315 - RNA, 19 nt, Haemophilus influenzae Rd
caaaacgugucacuuuacu

SEQ ID NO: 675316 - RNA, 21 nt, Haemophilus influenzae Rd
caaaacuuuuuccuucugcca

SEQ ID NO: 675317 - RNA, 18 nt, Haemophilus influenzae Rd
caaaaccaucuaauacgu

SEQ ID NO: 675318 - RNA, 19 nt, Haemophilus influenzae Rd
caaaaauuugaauguaaaa

SEQ ID NO: 675319 - RNA, 17 nt, Haemophilus influenzae Rd
caaaaauagccuucauc

SEQ ID NO: 675320 - RNA, 21 nt, Haemophilus influenzae Rd
caaaaacacguuuugcaccac

SEQ ID NO: 675321 - RNA, 12 nt, Haemophilus influenzae Rd
caaaaaauacau

SEQ ID NO: 675322 - RNA, 17 nt, Haemophilus influenzae Rd
auuuuucuuuucuucua

SEQ ID NO: 675323 - RNA, 19 nt, Haemophilus influenzae Rd
auuuuugauccugaucuuu

SEQ ID NO: 675324 - RNA, 19 nt, Haemophilus influenzae Rd
auuuuugcacgaauuucag

SEQ ID NO: 675325 - RNA, 18 nt, Haemophilus influenzae Rd
auuuuugccguuuucuac

SEQ ID NO: 675326 - RNA, 15 nt, Haemophilus influenzae Rd
auuuuuauuguguuu

SEQ ID NO: 675327 - RNA, 12 nt, Haemophilus influenzae Rd
auuuuuaucaua

SEQ ID NO: 675328 - RNA, 13 nt, Haemophilus influenzae Rd
auuuuuguuguuu

SEQ ID NO: 675329 - RNA, 17 nt, Haemophilus influenzae Rd
auuuuuuauaaugucau

SEQ ID NO: 675330 - RNA, 14 nt, Haemophilus influenzae Rd
auuuuuuacguaau

SEQ ID NO: 675331 - RNA, 20 nt, Haemophilus influenzae Rd
auuuuagaggcuaugauuuu

SEQ ID NO: 675332 - RNA, 14 nt, Haemophilus influenzae Rd
auuuuauuuacuug

SEQ ID NO: 675333 - RNA, 19 nt, Haemophilus influenzae Rd
auuuucaccugaagaauac

SEQ ID NO: 675334 - RNA, 19 nt, Haemophilus influenzae Rd
auuuuuaauuuacuggaaa

SEQ ID NO: 675335 - RNA, 13 nt, Haemophilus influenzae Rd
auuuuuaauuuau

SEQ ID NO: 675336 - RNA, 15 nt, Haemophilus influenzae Rd
auuuuuaccaauuug

SEQ ID NO: 675337 - RNA, 20 nt, Haemophilus influenzae Rd
auuuuuaccgcacuuuuuug

SEQ ID NO: 675338 - RNA, 22 nt, Haemophilus influenzae Rd
auuuuuagugaaacuggcauuu

SEQ ID NO: 675339 - RNA, 20 nt, Haemophilus influenzae Rd
auuuuuaauaaaguaaaaua

SEQ ID NO: 675340 - RNA, 23 nt, Haemophilus influenzae Rd
auuuugguaaauuagcaauaccu

SEQ ID NO: 675341 - RNA, 18 nt, Haemophilus influenzae Rd
auuuuguaagcauuaaaa

SEQ ID NO: 675342 - RNA, 21 nt, Haemophilus influenzae Rd
auuuucugcucuucaucaaaa

SEQ ID NO: 675343 - RNA, 16 nt, Haemophilus influenzae Rd
auuuucuuaauuuuau

SEQ ID NO: 675344 - RNA, 18 nt, Haemophilus influenzae Rd
auuuucuucacugcaucu

SEQ ID NO: 675345 - RNA, 23 nt, Haemophilus influenzae Rd
auuuucuaaggcuuguuguucaa

SEQ ID NO: 675346 - RNA, 16 nt, Haemophilus influenzae Rd
auuuugacaauuugau

SEQ ID NO: 675347 - RNA, 14 nt, Haemophilus influenzae Rd
caacaucauaaggu

SEQ ID NO: 675348 - RNA, 23 nt, Haemophilus influenzae Rd
caacauauggauagaugaaaugc

SEQ ID NO: 675349 - RNA, 19 nt, Haemophilus influenzae Rd
caacagauuuaauaccaua

SEQ ID NO: 675350 - RNA, 19 nt, Haemophilus influenzae Rd
caacacuugcagcccaaca

SEQ ID NO: 675351 - RNA, 19 nt, Haemophilus influenzae Rd
caaagugcgguaagaaaau

SEQ ID NO: 675352 - RNA, 17 nt, Haemophilus influenzae Rd
caaauaaacaaacuuuc

SEQ ID NO: 675353 - RNA, 23 nt, Haemophilus influenzae Rd
caaauaaccacuccaaauaauac

SEQ ID NO: 675354 - RNA, 16 nt, Haemophilus influenzae Rd
caagaacaauuaauac

SEQ ID NO: 675355 - RNA, 13 nt, Haemophilus influenzae Rd
caagcaagcaaaa

SEQ ID NO: 675356 - RNA, 18 nt, Haemophilus influenzae Rd
caagagccuccacaagca

SEQ ID NO: 675357 - RNA, 18 nt, Haemophilus influenzae Rd
caccgcacuuuuuacuuu

SEQ ID NO: 675358 - RNA, 10 nt, Haemophilus influenzae Rd
caccauuucc

SEQ ID NO: 675359 - RNA, 16 nt, Haemophilus influenzae Rd
cacccggcacauaaau

SEQ ID NO: 675360 - RNA, 19 nt, Haemophilus influenzae Rd
caccagugaauaaacacca

SEQ ID NO: 675361 - RNA, 17 nt, Haemophilus influenzae Rd
caccacuucauccaauc

SEQ ID NO: 675362 - RNA, 19 nt, Haemophilus influenzae Rd
caaugcaccaaaaauccuc

SEQ ID NO: 675363 - RNA, 22 nt, Haemophilus influenzae Rd
caaugacacgacgagcuguugc

SEQ ID NO: 675364 - RNA, 13 nt, Haemophilus influenzae Rd
caagguacuugaa

SEQ ID NO: 675365 - RNA, 15 nt, Haemophilus influenzae Rd
caauucaaagauuuu

SEQ ID NO: 675366 - RNA, 20 nt, Haemophilus influenzae Rd
caauucuuuuuguaauuuuu

SEQ ID NO: 675367 - RNA, 17 nt, Haemophilus influenzae Rd
caauguuuuagagaaau

SEQ ID NO: 675368 - RNA, 14 nt, Haemophilus influenzae Rd
caauuaacuauuua

SEQ ID NO: 675369 - RNA, 19 nt, Haemophilus influenzae Rd
caauuaaguagauaacaaa

SEQ ID NO: 675370 - RNA, 14 nt, Haemophilus influenzae Rd
caauuaauauaaag

SEQ ID NO: 675371 - RNA, 18 nt, Haemophilus influenzae Rd
caauuaauauaaaggauu

SEQ ID NO: 675372 - RNA, 19 nt, Haemophilus influenzae Rd
caauuaauucguccauucu

SEQ ID NO: 675373 - RNA, 16 nt, Haemophilus influenzae Rd
caauuacguagauaau

SEQ ID NO: 675374 - RNA, 13 nt, Haemophilus influenzae Rd
cacagauuuuacc

SEQ ID NO: 675375 - RNA, 17 nt, Haemophilus influenzae Rd
cacagaccaaaauucua

SEQ ID NO: 675376 - RNA, 12 nt, Haemophilus influenzae Rd
cacaaagcaaau

SEQ ID NO: 675377 - RNA, 14 nt, Haemophilus influenzae Rd
cacaaacacguucu

SEQ ID NO: 675378 - RNA, 20 nt, Haemophilus influenzae Rd
caauuuuuuaucaaauaacg

SEQ ID NO: 675379 - RNA, 18 nt, Haemophilus influenzae Rd
caauuuuuucaaauaaau

SEQ ID NO: 675380 - RNA, 22 nt, Haemophilus influenzae Rd
caauuuuuucugaauaaauuuu

SEQ ID NO: 675381 - RNA, 16 nt, Haemophilus influenzae Rd
cacaaaucuucuugaa

SEQ ID NO: 675382 - RNA, 17 nt, Haemophilus influenzae Rd
cacagggcugauaaauu

SEQ ID NO: 675383 - RNA, 18 nt, Haemophilus influenzae Rd
cacagggcugauaaauuu

SEQ ID NO: 675384 - RNA, 22 nt, Haemophilus influenzae Rd
cacaguuuuauuuuccaucauc

SEQ ID NO: 675385 - RNA, 22 nt, Haemophilus influenzae Rd
cacaguguccagcacuuaauac

SEQ ID NO: 675386 - RNA, 14 nt, Haemophilus influenzae Rd
agcuucuucaucgc

SEQ ID NO: 675387 - RNA, 15 nt, Haemophilus influenzae Rd
agcuuuagcaaucaa

SEQ ID NO: 675388 - RNA, 12 nt, Haemophilus influenzae Rd
aggaauaaauug

SEQ ID NO: 675389 - RNA, 23 nt, Haemophilus influenzae Rd
aggaauaucuuugacuaaaucau

SEQ ID NO: 675390 - RNA, 17 nt, Haemophilus influenzae Rd
agcuucaucuucaucaa

SEQ ID NO: 675391 - RNA, 19 nt, Haemophilus influenzae Rd
aggcacagggcugauaaau

SEQ ID NO: 675392 - RNA, 13 nt, Haemophilus influenzae Rd
aggaucacuaauu

SEQ ID NO: 675393 - RNA, 19 nt, Haemophilus influenzae Rd
agggcugcuacaauuucau

SEQ ID NO: 675394 - RNA, 20 nt, Haemophilus influenzae Rd
agggcuuuguuguuuauaac

SEQ ID NO: 675395 - RNA, 15 nt, Haemophilus influenzae Rd
aggguuccugcauca

SEQ ID NO: 675396 - RNA, 14 nt, Haemophilus influenzae Rd
aggguuuucaucau

SEQ ID NO: 675397 - RNA, 17 nt, Haemophilus influenzae Rd
agggcgacaauuuaucg

SEQ ID NO: 675398 - RNA, 13 nt, Haemophilus influenzae Rd
aggcuuaauucuu

SEQ ID NO: 675399 - RNA, 17 nt, Haemophilus influenzae Rd
aggcucauuuuuucucu

SEQ ID NO: 675400 - RNA, 22 nt, Haemophilus influenzae Rd
auaacgucgaauaacuuuauuu

SEQ ID NO: 675401 - RNA, 15 nt, Haemophilus influenzae Rd
auaacgggcauuuuu

SEQ ID NO: 675402 - RNA, 18 nt, Haemophilus influenzae Rd
auaacgucauuaauuuuu

SEQ ID NO: 675403 - RNA, 14 nt, Haemophilus influenzae Rd
auaagauuaaugau

SEQ ID NO: 675404 - RNA, 18 nt, Haemophilus influenzae Rd
auaagauuugcuuuuugu

SEQ ID NO: 675405 - RNA, 19 nt, Haemophilus influenzae Rd
auaauaauuagcuaaauac

SEQ ID NO: 675406 - RNA, 18 nt, Haemophilus influenzae Rd
auaaguggggaaaaauau

SEQ ID NO: 675407 - RNA, 21 nt, Haemophilus influenzae Rd
auaagugagaaaguuaaucaa

SEQ ID NO: 675408 - RNA, 14 nt, Haemophilus influenzae Rd
auaaguaggcaaaa

SEQ ID NO: 675409 - RNA, 22 nt, Haemophilus influenzae Rd
aguuuguagcgauauucuuuug

SEQ ID NO: 675410 - RNA, 17 nt, Haemophilus influenzae Rd
auaacauuguuuuaaug

SEQ ID NO: 675411 - RNA, 23 nt, Haemophilus influenzae Rd
auaaccgccauucagcacuaauu

SEQ ID NO: 675412 - RNA, 21 nt, Haemophilus influenzae Rd
auaaccuuacugccuuuuucu

SEQ ID NO: 675413 - RNA, 20 nt, Haemophilus influenzae Rd
auacauuucuaaaauaauau

SEQ ID NO: 675414 - RNA, 15 nt, Haemophilus influenzae Rd
auaauauucaaaaca

SEQ ID NO: 675415 - RNA, 23 nt, Haemophilus influenzae Rd
auaauacuugaccaaaauugccu

SEQ ID NO: 675416 - RNA, 18 nt, Haemophilus influenzae Rd
auaauaucugcuuuuucu

SEQ ID NO: 675417 - RNA, 19 nt, Haemophilus influenzae Rd
auacaauccaccaaaugca

SEQ ID NO: 675418 - RNA, 16 nt, Haemophilus influenzae Rd
auaccuagacgauugc

SEQ ID NO: 675419 - RNA, 18 nt, Haemophilus influenzae Rd
auacgccaagauaacuca

SEQ ID NO: 675420 - RNA, 20 nt, Haemophilus influenzae Rd
auacgcgcccauucauuuug

SEQ ID NO: 675421 - RNA, 14 nt, Haemophilus influenzae Rd
auagcuaacaauau

SEQ ID NO: 675422 - RNA, 20 nt, Haemophilus influenzae Rd
auagcggucaucuacccaca

SEQ ID NO: 675423 - RNA, 20 nt, Haemophilus influenzae Rd
auagcuguaagauaaacgca

SEQ ID NO: 675424 - RNA, 17 nt, Haemophilus influenzae Rd
auagcucaguugguaga

SEQ ID NO: 675425 - RNA, 17 nt, Haemophilus influenzae Rd
auagcuucugccagcau

SEQ ID NO: 675426 - RNA, 15 nt, Haemophilus influenzae Rd
auaggauaaauaaac

SEQ ID NO: 675427 - RNA, 15 nt, Haemophilus influenzae Rd
auagacaggcauauu

SEQ ID NO: 675428 - RNA, 20 nt, Haemophilus influenzae Rd
auagaccgcuauuuuuaauu

SEQ ID NO: 675429 - RNA, 17 nt, Haemophilus influenzae Rd
auagaacuguuauuugc

SEQ ID NO: 675430 - RNA, 19 nt, Haemophilus influenzae Rd
auagacaauauugaaauaa

SEQ ID NO: 675431 - RNA, 21 nt, Haemophilus influenzae Rd
auacguaaucccauuucaucu

SEQ ID NO: 675432 - RNA, 20 nt, Haemophilus influenzae Rd
auagaaaccaauaauuucau

SEQ ID NO: 675433 - RNA, 19 nt, Haemophilus influenzae Rd
auaggcaaguucguuuuuu

SEQ ID NO: 675434 - RNA, 20 nt, Haemophilus influenzae Rd
auaguauggcucuaaauuaa

SEQ ID NO: 675435 - RNA, 23 nt, Haemophilus influenzae Rd
auaguacuaccgcaucuuuuucu

SEQ ID NO: 675436 - RNA, 14 nt, Haemophilus influenzae Rd
auaguaaacuuuua

SEQ ID NO: 675437 - RNA, 22 nt, Haemophilus influenzae Rd
auaggguaaacgauaagaaugu

SEQ ID NO: 675438 - RNA, 15 nt, Haemophilus influenzae Rd
auaggguaaauaaaa

SEQ ID NO: 675439 - RNA, 14 nt, Haemophilus influenzae Rd
auaguuuaaacuca

SEQ ID NO: 675440 - RNA, 16 nt, Haemophilus influenzae Rd
auaucgaggcuuuuuu

SEQ ID NO: 675441 - RNA, 23 nt, Haemophilus influenzae Rd
auauauuuguuuuuaguuuuuuu

SEQ ID NO: 675442 - RNA, 15 nt, Haemophilus influenzae Rd
auauauuauugugau

SEQ ID NO: 675443 - RNA, 12 nt, Haemophilus influenzae Rd
auauauaaauuu

SEQ ID NO: 675444 - RNA, 21 nt, Haemophilus influenzae Rd
auauaucacagauuuuuuauu

SEQ ID NO: 675445 - RNA, 19 nt, Haemophilus influenzae Rd
auauacauuaacaaugcgg

SEQ ID NO: 675446 - RNA, 12 nt, Haemophilus influenzae Rd
auauacuuuuuu

SEQ ID NO: 675447 - RNA, 17 nt, Haemophilus influenzae Rd
auaguuuuauuuuaauu

SEQ ID NO: 675448 - RNA, 21 nt, Haemophilus influenzae Rd
auauaagaaaucucuuucaau

SEQ ID NO: 675449 - RNA, 15 nt, Haemophilus influenzae Rd
auauaauacguaaau

SEQ ID NO: 675450 - RNA, 13 nt, Haemophilus influenzae Rd
auauucggaaaaa

SEQ ID NO: 675451 - RNA, 14 nt, Haemophilus influenzae Rd
auauucacuuucau

SEQ ID NO: 675452 - RNA, 18 nt, Haemophilus influenzae Rd
auauucaauucuuuuugu

SEQ ID NO: 675453 - RNA, 18 nt, Haemophilus influenzae Rd
auauucaauccuauuuuu

SEQ ID NO: 675454 - RNA, 16 nt, Haemophilus influenzae Rd
auauuauucuuuucaa

SEQ ID NO: 675455 - RNA, 16 nt, Haemophilus influenzae Rd
auauuccuuauucaaa

SEQ ID NO: 675456 - RNA, 12 nt, Haemophilus influenzae Rd
auauucauuuuc

SEQ ID NO: 675457 - RNA, 19 nt, Haemophilus influenzae Rd
auaucuuugacuaaaucau

SEQ ID NO: 675458 - RNA, 14 nt, Haemophilus influenzae Rd
auaucuaaacuuca

SEQ ID NO: 675459 - RNA, 21 nt, Haemophilus influenzae Rd
agugaucuugauccccauaca

SEQ ID NO: 675460 - RNA, 18 nt, Haemophilus influenzae Rd
agugcggcaaaaaauggc

SEQ ID NO: 675461 - RNA, 14 nt, Haemophilus influenzae Rd
aguuauaaacccau

SEQ ID NO: 675462 - RNA, 15 nt, Haemophilus influenzae Rd
aguuacacaaugcca

SEQ ID NO: 675463 - RNA, 17 nt, Haemophilus influenzae Rd
aguguuuuauuuaucag

SEQ ID NO: 675464 - RNA, 19 nt, Haemophilus influenzae Rd
agucugcacgggaaaucca

SEQ ID NO: 675465 - RNA, 12 nt, Haemophilus influenzae Rd
agucugcuaaug

SEQ ID NO: 675466 - RNA, 17 nt, Haemophilus influenzae Rd
agugaaauuacucaucu

SEQ ID NO: 675467 - RNA, 15 nt, Haemophilus influenzae Rd
agucaauuugaccga

SEQ ID NO: 675468 - RNA, 13 nt, Haemophilus influenzae Rd
aguauuuuuguga

SEQ ID NO: 675469 - RNA, 16 nt, Haemophilus influenzae Rd
aguauaagcaaugcaa

SEQ ID NO: 675470 - RNA, 19 nt, Haemophilus influenzae Rd
aguagauaacaaaagugcg

SEQ ID NO: 675471 - RNA, 20 nt, Haemophilus influenzae Rd
aguacgacaucuuaaauuau

SEQ ID NO: 675472 - RNA, 20 nt, Haemophilus influenzae Rd
agcagauuauugcacuaaua

SEQ ID NO: 675473 - RNA, 19 nt, Haemophilus influenzae Rd
agcauaacguauuuucuca

SEQ ID NO: 675474 - RNA, 20 nt, Haemophilus influenzae Rd
agcacgaucuaauugcggaa

SEQ ID NO: 675475 - RNA, 14 nt, Haemophilus influenzae Rd
agcagaagaaucuu

SEQ ID NO: 675476 - RNA, 17 nt, Haemophilus influenzae Rd
agcaaacuuaaauacau

SEQ ID NO: 675477 - RNA, 23 nt, Haemophilus influenzae Rd
agcaauaauuucauuguuaaaua

SEQ ID NO: 675478 - RNA, 20 nt, Haemophilus influenzae Rd
agauauaaggcacagggcug

SEQ ID NO: 675479 - RNA, 13 nt, Haemophilus influenzae Rd
agauuuucaucgu

SEQ ID NO: 675480 - RNA, 15 nt, Haemophilus influenzae Rd
agauuuacagaacaa

SEQ ID NO: 675481 - RNA, 16 nt, Haemophilus influenzae Rd
agauuuauuucugaag

SEQ ID NO: 675482 - RNA, 16 nt, Haemophilus influenzae Rd
agaaguaaaauagcug

SEQ ID NO: 675483 - RNA, 19 nt, Haemophilus influenzae Rd
agaagucacauauuguuuc

SEQ ID NO: 675484 - RNA, 20 nt, Haemophilus influenzae Rd
agaaugaaguagaaauugcc

SEQ ID NO: 675485 - RNA, 22 nt, Haemophilus influenzae Rd
agaaucaucuucaucugcauca

SEQ ID NO: 675486 - RNA, 13 nt, Haemophilus influenzae Rd
agaauauaaguuc

SEQ ID NO: 675487 - RNA, 16 nt, Haemophilus influenzae Rd
agaauuucgucaaaaa

SEQ ID NO: 675488 - RNA, 19 nt, Haemophilus influenzae Rd
agaauuacguuguuguucu

SEQ ID NO: 675489 - RNA, 18 nt, Haemophilus influenzae Rd
agaaaucacuaaauuuca

SEQ ID NO: 675490 - RNA, 20 nt, Haemophilus influenzae Rd
agaaaucucuuucaauuuca

SEQ ID NO: 675491 - RNA, 13 nt, Haemophilus influenzae Rd
agaaauuuuaauc

SEQ ID NO: 675492 - RNA, 22 nt, Haemophilus influenzae Rd
agaacaccgagaugcauuuuuu

SEQ ID NO: 675493 - RNA, 14 nt, Haemophilus influenzae Rd
agaacggucaaaau

SEQ ID NO: 675494 - RNA, 22 nt, Haemophilus influenzae Rd
agaaccuaucucauccacuaaa

SEQ ID NO: 675495 - RNA, 22 nt, Haemophilus influenzae Rd
agaagaaucuucuaauuugcca

SEQ ID NO: 675496 - RNA, 19 nt, Haemophilus influenzae Rd
agaagauaaucgcaaagaa

SEQ ID NO: 675497 - RNA, 15 nt, Haemophilus influenzae Rd
agaacuggcuuccaa

SEQ ID NO: 675498 - RNA, 14 nt, Haemophilus influenzae Rd
agacauuaaggcuu

SEQ ID NO: 675499 - RNA, 16 nt, Haemophilus influenzae Rd
agagaauuuucaucaa

SEQ ID NO: 675500 - RNA, 16 nt, Haemophilus influenzae Rd
agauaaugaugaaugc

SEQ ID NO: 675501 - RNA, 16 nt, Haemophilus influenzae Rd
agauaacuucuucauu

SEQ ID NO: 675502 - RNA, 16 nt, Haemophilus influenzae Rd
agcgcuguuacuucuu

SEQ ID NO: 675503 - RNA, 21 nt, Haemophilus influenzae Rd
agccuguuaugcuuuauucuu

SEQ ID NO: 675504 - RNA, 16 nt, Haemophilus influenzae Rd
agccugaaaaagcuaa

SEQ ID NO: 675505 - RNA, 13 nt, Haemophilus influenzae Rd
agcgaaaauuuug

SEQ ID NO: 675506 - RNA, 13 nt, Haemophilus influenzae Rd
guugcuuuuauca

SEQ ID NO: 675507 - RNA, 19 nt, Haemophilus influenzae Rd
guuggcaacauauuuucua

SEQ ID NO: 675508 - RNA, 20 nt, Haemophilus influenzae Rd
guuguuccgcuaguuuuuua

SEQ ID NO: 675509 - RNA, 15 nt, Haemophilus influenzae Rd
guuuaaauuaaaacc

SEQ ID NO: 675510 - RNA, 22 nt, Haemophilus influenzae Rd
guuuaauucuucgaugcuuuuu

SEQ ID NO: 675511 - RNA, 16 nt, Haemophilus influenzae Rd
guuuacgauaaugcca

SEQ ID NO: 675512 - RNA, 19 nt, Haemophilus influenzae Rd
guuuauauuuccaucaaaa

SEQ ID NO: 675513 - RNA, 24 nt, Haemophilus influenzae Rd
guuuacuuaaaucuuuaccuugua

SEQ ID NO: 675514 - RNA, 13 nt, Haemophilus influenzae Rd
guuuacuuggcau

SEQ ID NO: 675515 - RNA, 20 nt, Haemophilus influenzae Rd
guuuauguaguugugauuuu

SEQ ID NO: 675516 - RNA, 16 nt, Haemophilus influenzae Rd
guucuaauguuaauuu

SEQ ID NO: 675517 - RNA, 14 nt, Haemophilus influenzae Rd
guucuacguaauuu

SEQ ID NO: 675518 - RNA, 14 nt, Haemophilus influenzae Rd
guucuaguuuuucc

SEQ ID NO: 675519 - RNA, 15 nt, Haemophilus influenzae Rd
guucugcaucaauaa

SEQ ID NO: 675520 - RNA, 22 nt, Haemophilus influenzae Rd
guucaacccauuuuccauuggu

SEQ ID NO: 675521 - RNA, 13 nt, Haemophilus influenzae Rd
guucaaauaagcg

SEQ ID NO: 675522 - RNA, 13 nt, Haemophilus influenzae Rd
guucaauaacucu

SEQ ID NO: 675523 - RNA, 17 nt, Haemophilus influenzae Rd
guucgccugauuucgcu

SEQ ID NO: 675524 - RNA, 18 nt, Haemophilus influenzae Rd
uaaauuuaaaggcggauu

SEQ ID NO: 675525 - RNA, 16 nt, Haemophilus influenzae Rd
uaaauuguaacuauau

SEQ ID NO: 675526 - RNA, 18 nt, Haemophilus influenzae Rd
uaaauuucaauuaaauca

SEQ ID NO: 675527 - RNA, 21 nt, Haemophilus influenzae Rd
uaaauuugguucaauuuuaau

SEQ ID NO: 675528 - RNA, 18 nt, Haemophilus influenzae Rd
uaaauuuuaaaauaguuu

SEQ ID NO: 675529 - RNA, 13 nt, Haemophilus influenzae Rd
uaaauuuuuuugc

SEQ ID NO: 675530 - RNA, 18 nt, Haemophilus influenzae Rd
uaaauucggaauauucaa

SEQ ID NO: 675531 - RNA, 17 nt, Haemophilus influenzae Rd
uaaauugacuugcacaa

SEQ ID NO: 675532 - RNA, 24 nt, Haemophilus influenzae Rd
uaaauuauauuuuuaauuuauacu

SEQ ID NO: 675533 - RNA, 22 nt, Haemophilus influenzae Rd
uaaauuaccuuguuuugcaaua

SEQ ID NO: 675534 - RNA, 15 nt, Haemophilus influenzae Rd
uaacagcaaacuuaa

SEQ ID NO: 675535 - RNA, 13 nt, Haemophilus influenzae Rd
uaacacuuuuucu

SEQ ID NO: 675536 - RNA, 16 nt, Haemophilus influenzae Rd
uaaccguuauaacguu

SEQ ID NO: 675537 - RNA, 14 nt, Haemophilus influenzae Rd
uaacaccaauauug

SEQ ID NO: 675538 - RNA, 19 nt, Haemophilus influenzae Rd
uaacaccagugaauaaaca

SEQ ID NO: 675539 - RNA, 11 nt, Haemophilus influenzae Rd
uaacaccauug

SEQ ID NO: 675540 - RNA, 15 nt, Haemophilus influenzae Rd
uaacaagaaaaauca

SEQ ID NO: 675541 - RNA, 15 nt, Haemophilus influenzae Rd
uaacaaugaaaucgc

SEQ ID NO: 675542 - RNA, 20 nt, Haemophilus influenzae Rd
uaacaaugcggagaaaagca

SEQ ID NO: 675543 - RNA, 18 nt, Haemophilus influenzae Rd
uaacacaaccaucuucaa

SEQ ID NO: 675544 - RNA, 15 nt, Haemophilus influenzae Rd
uaaaugcuaaaauua

SEQ ID NO: 675545 - RNA, 16 nt, Haemophilus influenzae Rd
uaaaugaaguuuuacu

SEQ ID NO: 675546 - RNA, 14 nt, Haemophilus influenzae Rd
uaaaucggugcggu

SEQ ID NO: 675547 - RNA, 16 nt, Haemophilus influenzae Rd
uaaaucgguucuacac

SEQ ID NO: 675548 - RNA, 19 nt, Haemophilus influenzae Rd
uaaaucggcguauuuuaca

SEQ ID NO: 675549 - RNA, 20 nt, Haemophilus influenzae Rd
uaaaucggcguauuuuacaa

SEQ ID NO: 675550 - RNA, 16 nt, Haemophilus influenzae Rd
uaaaucuacauuuuua

SEQ ID NO: 675551 - RNA, 15 nt, Haemophilus influenzae Rd
uaaaucagaacuggc

SEQ ID NO: 675552 - RNA, 22 nt, Haemophilus influenzae Rd
uaaauccccugucaauuuuucu

SEQ ID NO: 675553 - RNA, 21 nt, Haemophilus influenzae Rd
uaaaucccuugugucuaccga

SEQ ID NO: 675554 - RNA, 12 nt, Haemophilus influenzae Rd
uaaauaaaucaa

SEQ ID NO: 675555 - RNA, 12 nt, Haemophilus influenzae Rd
uaaauaaaucac

SEQ ID NO: 675556 - RNA, 22 nt, Haemophilus influenzae Rd
uaaauaacacaucagaaaauca

SEQ ID NO: 675557 - RNA, 16 nt, Haemophilus influenzae Rd
uaaauaaccuaaaaua

SEQ ID NO: 675558 - RNA, 13 nt, Haemophilus influenzae Rd
uaaauaauuuucu

SEQ ID NO: 675559 - RNA, 20 nt, Haemophilus influenzae Rd
uaaauacauuggguuacggc

SEQ ID NO: 675560 - RNA, 22 nt, Haemophilus influenzae Rd
uaaauaugccuuauauuucacu

SEQ ID NO: 675561 - RNA, 16 nt, Haemophilus influenzae Rd
uaaaucaccuaaaucu

SEQ ID NO: 675562 - RNA, 19 nt, Haemophilus influenzae Rd
uaaaauuguggcaauaguu

SEQ ID NO: 675563 - RNA, 19 nt, Haemophilus influenzae Rd
uaaaauuccuuauuuuacu

SEQ ID NO: 675564 - RNA, 20 nt, Haemophilus influenzae Rd
uaaaauuuauuuuaaaauca

SEQ ID NO: 675565 - RNA, 15 nt, Haemophilus influenzae Rd
uaaaauuaccgcacu

SEQ ID NO: 675566 - RNA, 16 nt, Haemophilus influenzae Rd
uaaaauuauaauauuu

SEQ ID NO: 675567 - RNA, 18 nt, Haemophilus influenzae Rd
uaaaauucuauuaaaaua

SEQ ID NO: 675568 - RNA, 16 nt, Haemophilus influenzae Rd
uaaaaguagaagguuu

SEQ ID NO: 675569 - RNA, 20 nt, Haemophilus influenzae Rd
uaaaaggcaaagcaaaauca

SEQ ID NO: 675570 - RNA, 18 nt, Haemophilus influenzae Rd
uaaaaguuagauugaacg

SEQ ID NO: 675571 - RNA, 17 nt, Haemophilus influenzae Rd
uaaaagaagaaugcggu

SEQ ID NO: 675572 - RNA, 16 nt, Haemophilus influenzae Rd
uaaaacuuuauuuuau

SEQ ID NO: 675573 - RNA, 15 nt, Haemophilus influenzae Rd
uaaaagauaaaacag

SEQ ID NO: 675574 - RNA, 14 nt, Haemophilus influenzae Rd
uaaaagagugcggu

SEQ ID NO: 675575 - RNA, 16 nt, Haemophilus influenzae Rd
guuucaaugucuuuuu

SEQ ID NO: 675576 - RNA, 19 nt, Haemophilus influenzae Rd
guuuaucgaaacgguuagu

SEQ ID NO: 675577 - RNA, 20 nt, Haemophilus influenzae Rd
guuuccaagaauuuuaauaa

SEQ ID NO: 675578 - RNA, 19 nt, Haemophilus influenzae Rd
uaaagagaucacuguaaau

SEQ ID NO: 675579 - RNA, 22 nt, Haemophilus influenzae Rd
uaaagauuaaaaucgcacggau

SEQ ID NO: 675580 - RNA, 20 nt, Haemophilus influenzae Rd
uaaacuuuagagauuuuauu

SEQ ID NO: 675581 - RNA, 13 nt, Haemophilus influenzae Rd
uaaacuuuuaauu

SEQ ID NO: 675582 - RNA, 20 nt, Haemophilus influenzae Rd
uaaacuugaauaauaacguu

SEQ ID NO: 675583 - RNA, 23 nt, Haemophilus influenzae Rd
uaaacacaaacugguuaaaaucc

SEQ ID NO: 675584 - RNA, 14 nt, Haemophilus influenzae Rd
uaaacguaacuaaa

SEQ ID NO: 675585 - RNA, 23 nt, Haemophilus influenzae Rd
uaaacuaauuccgacuaaaacca

SEQ ID NO: 675586 - RNA, 17 nt, Haemophilus influenzae Rd
uaaagggcugcuacaau

SEQ ID NO: 675587 - RNA, 20 nt, Haemophilus influenzae Rd
uaaaguaaauuuuaaaaucu

SEQ ID NO: 675588 - RNA, 14 nt, Haemophilus influenzae Rd
uaaauaaaaaugau

SEQ ID NO: 675589 - RNA, 15 nt, Haemophilus influenzae Rd
uaaauaaaauauuug

SEQ ID NO: 675590 - RNA, 12 nt, Haemophilus influenzae Rd
uaacuuuuaauu

SEQ ID NO: 675591 - RNA, 17 nt, Haemophilus influenzae Rd
uaacgauaagauuugcu

SEQ ID NO: 675592 - RNA, 16 nt, Haemophilus influenzae Rd
uaagaaauaacgauaa

SEQ ID NO: 675593 - RNA, 12 nt, Haemophilus influenzae Rd
uaagaaauaauc

SEQ ID NO: 675594 - RNA, 15 nt, Haemophilus influenzae Rd
uaagauaauuuuucu

SEQ ID NO: 675595 - RNA, 14 nt, Haemophilus influenzae Rd
uaagauuuugccua

SEQ ID NO: 675596 - RNA, 20 nt, Haemophilus influenzae Rd
uaagauuuuuaaccgcacuu

SEQ ID NO: 675597 - RNA, 23 nt, Haemophilus influenzae Rd
uaagcaccgaaagguguuuuuuu

SEQ ID NO: 675598 - RNA, 15 nt, Haemophilus influenzae Rd
uaauaaagauaaauu

SEQ ID NO: 675599 - RNA, 17 nt, Haemophilus influenzae Rd
uaagcuaaguacaaaag

SEQ ID NO: 675600 - RNA, 21 nt, Haemophilus influenzae Rd
uaagcuaccugccauaauaac

SEQ ID NO: 675601 - RNA, 22 nt, Haemophilus influenzae Rd
uaagcuuuucuagcaauaaaga

SEQ ID NO: 675602 - RNA, 16 nt, Haemophilus influenzae Rd
uaagcuuuuuuuaauc

SEQ ID NO: 675603 - RNA, 17 nt, Haemophilus influenzae Rd
uaaggaaacguaaaaua

SEQ ID NO: 675604 - RNA, 13 nt, Haemophilus influenzae Rd
uaauacaccaaua

SEQ ID NO: 675605 - RNA, 21 nt, Haemophilus influenzae Rd
uaauaauccucuuuaaaauua

SEQ ID NO: 675606 - RNA, 22 nt, Haemophilus influenzae Rd
uaauaaagucgguucauuuggg

SEQ ID NO: 675607 - RNA, 21 nt, Haemophilus influenzae Rd
uaauaaauuuuucgccuaauu

SEQ ID NO: 675608 - RNA, 13 nt, Haemophilus influenzae Rd
uaauuaccgcacu

SEQ ID NO: 675609 - RNA, 13 nt, Haemophilus influenzae Rd
uaauuagaauaac

SEQ ID NO: 675610 - RNA, 20 nt, Haemophilus influenzae Rd
uaauuagauaauacagaaau

SEQ ID NO: 675611 - RNA, 15 nt, Haemophilus influenzae Rd
uaauuagcuaaauac

SEQ ID NO: 675612 - RNA, 21 nt, Haemophilus influenzae Rd
uaauucagcgagagaauauuu

SEQ ID NO: 675613 - RNA, 21 nt, Haemophilus influenzae Rd
uaauucagggauuaagaaaau

SEQ ID NO: 675614 - RNA, 23 nt, Haemophilus influenzae Rd
uaauucaguguaauguuuuaaua

SEQ ID NO: 675615 - RNA, 17 nt, Haemophilus influenzae Rd
uaauucaguucaauuua

SEQ ID NO: 675616 - RNA, 15 nt, Haemophilus influenzae Rd
uaauucaaacaggcu

SEQ ID NO: 675617 - RNA, 20 nt, Haemophilus influenzae Rd
uaauucauugaugcccacuu

SEQ ID NO: 675618 - RNA, 13 nt, Haemophilus influenzae Rd
uaauuccgcaccu

SEQ ID NO: 675619 - RNA, 23 nt, Haemophilus influenzae Rd
uaaugcagaccaacguaaaaucg

SEQ ID NO: 675620 - RNA, 21 nt, Haemophilus influenzae Rd
uaaugccgccuuaucuaaacu

SEQ ID NO: 675621 - RNA, 15 nt, Haemophilus influenzae Rd
uaauggaauauggcg

SEQ ID NO: 675622 - RNA, 13 nt, Haemophilus influenzae Rd
uaauccuuuuguu

SEQ ID NO: 675623 - RNA, 23 nt, Haemophilus influenzae Rd
uaauccauuuugaacaagguuuc

SEQ ID NO: 675624 - RNA, 18 nt, Haemophilus influenzae Rd
uaauccagucauugggcg

SEQ ID NO: 675625 - RNA, 20 nt, Haemophilus influenzae Rd
uaaucauuuuuuaacuugau

SEQ ID NO: 675626 - RNA, 15 nt, Haemophilus influenzae Rd
uaauacguaaauuca

SEQ ID NO: 675627 - RNA, 22 nt, Haemophilus influenzae Rd
uaauacgucaauugcuaaaccu

SEQ ID NO: 675628 - RNA, 13 nt, Haemophilus influenzae Rd
uaauacguuguug

SEQ ID NO: 675629 - RNA, 20 nt, Haemophilus influenzae Rd
uaauaccauacauaaaaucu

SEQ ID NO: 675630 - RNA, 13 nt, Haemophilus influenzae Rd
uaaucgaucaauu

SEQ ID NO: 675631 - RNA, 18 nt, Haemophilus influenzae Rd
uaaugaacgaacuaaaau

SEQ ID NO: 675632 - RNA, 16 nt, Haemophilus influenzae Rd
uaaugacauuaaagca

SEQ ID NO: 675633 - RNA, 23 nt, Haemophilus influenzae Rd
aagucuuuuuuuguugguugagu

SEQ ID NO: 675634 - RNA, 21 nt, Haemophilus influenzae Rd
aagugauauccgcuuuuaaaa

SEQ ID NO: 675635 - RNA, 20 nt, Haemophilus influenzae Rd
aagugaucuugauccccaua

SEQ ID NO: 675636 - RNA, 20 nt, Haemophilus influenzae Rd
aagugcaucaaccgauaaau

SEQ ID NO: 675637 - RNA, 21 nt, Haemophilus influenzae Rd
aagugcggggacaauugcagc

SEQ ID NO: 675638 - RNA, 23 nt, Haemophilus influenzae Rd
aagugcgguaaaaauuaaccgca

SEQ ID NO: 675639 - RNA, 18 nt, Haemophilus influenzae Rd
aagugcgguaaaauuuuu

SEQ ID NO: 675640 - RNA, 13 nt, Haemophilus influenzae Rd
aagugcgguaaau

SEQ ID NO: 675641 - RNA, 14 nt, Haemophilus influenzae Rd
guggcguuuuaucg

SEQ ID NO: 675642 - RNA, 23 nt, Haemophilus influenzae Rd
guuaaagcacccaucacauuuuc

SEQ ID NO: 675643 - RNA, 20 nt, Haemophilus influenzae Rd
guguucuagugcaacaacaa

SEQ ID NO: 675644 - RNA, 18 nt, Haemophilus influenzae Rd
guuaauaagcccaacuua

SEQ ID NO: 675645 - RNA, 22 nt, Haemophilus influenzae Rd
guuaauuuuuaaagaaaucauu

SEQ ID NO: 675646 - RNA, 16 nt, Haemophilus influenzae Rd
guuacaaacaaucuua

SEQ ID NO: 675647 - RNA, 19 nt, Haemophilus influenzae Rd
aaguguuuacuauuaauuc

SEQ ID NO: 675648 - RNA, 22 nt, Haemophilus influenzae Rd
aaguucgggcuucgcgcuaaau

SEQ ID NO: 675649 - RNA, 18 nt, Haemophilus influenzae Rd
aaguucuaaaauuauaga

SEQ ID NO: 675650 - RNA, 23 nt, Haemophilus influenzae Rd
guuaugcguuuuuaauuuuaugc

SEQ ID NO: 675651 - RNA, 13 nt, Haemophilus influenzae Rd
aaguuauuuuuac

SEQ ID NO: 675652 - RNA, 23 nt, Haemophilus influenzae Rd
aaguucaccgggcgauaaaaucg

SEQ ID NO: 675653 - RNA, 24 nt, Haemophilus influenzae Rd
gugugcaauaaccguacauucuuc

SEQ ID NO: 675654 - RNA, 20 nt, Haemophilus influenzae Rd
gugggcugaagcccacccua

SEQ ID NO: 675655 - RNA, 16 nt, Haemophilus influenzae Rd
uagguugcacccacuu

SEQ ID NO: 675656 - RNA, 16 nt, Haemophilus influenzae Rd
uagguuuuauuugcgg

SEQ ID NO: 675657 - RNA, 19 nt, Haemophilus influenzae Rd
uaguaagugguaucaaucg

SEQ ID NO: 675658 - RNA, 18 nt, Haemophilus influenzae Rd
uagcugugguaaauaauu

SEQ ID NO: 675659 - RNA, 16 nt, Haemophilus influenzae Rd
aaguugaauuuucaau

SEQ ID NO: 675660 - RNA, 12 nt, Haemophilus influenzae Rd
uagugcuaaaau

SEQ ID NO: 675661 - RNA, 14 nt, Haemophilus influenzae Rd
uaguggcaauccaa

SEQ ID NO: 675662 - RNA, 14 nt, Haemophilus influenzae Rd
uagucuuuuuaauu

SEQ ID NO: 675663 - RNA, 14 nt, Haemophilus influenzae Rd
uagugaaauauuua

SEQ ID NO: 675664 - RNA, 15 nt, Haemophilus influenzae Rd
uaucaucaagauuua

SEQ ID NO: 675665 - RNA, 22 nt, Haemophilus influenzae Rd
uaucaauguuugugcguuuuuu

SEQ ID NO: 675666 - RNA, 13 nt, Haemophilus influenzae Rd
uaucaaugccauc

SEQ ID NO: 675667 - RNA, 21 nt, Haemophilus influenzae Rd
uaucaaucauaucaucaacca

SEQ ID NO: 675668 - RNA, 17 nt, Haemophilus influenzae Rd
uaucaaaaaguugaauu

SEQ ID NO: 675669 - RNA, 19 nt, Haemophilus influenzae Rd
uaucauuugaauuaauaac

SEQ ID NO: 675670 - RNA, 17 nt, Haemophilus influenzae Rd
uaucauuuaauaauuua

SEQ ID NO: 675671 - RNA, 12 nt, Haemophilus influenzae Rd
uauaaaaaaucc

SEQ ID NO: 675672 - RNA, 22 nt, Haemophilus influenzae Rd
uaguuuuuuuauaaaaaaaucg

SEQ ID NO: 675673 - RNA, 21 nt, Haemophilus influenzae Rd
uauaaccaguuauucuucaga

SEQ ID NO: 675674 - RNA, 20 nt, Haemophilus influenzae Rd
uauaacuaggcaucaaaauu

SEQ ID NO: 675675 - RNA, 20 nt, Haemophilus influenzae Rd
uauaaucaggaauaaaccac

SEQ ID NO: 675676 - RNA, 14 nt, Haemophilus influenzae Rd
uauaauacguaaau

SEQ ID NO: 675677 - RNA, 20 nt, Haemophilus influenzae Rd
uauaguaagcaccaaaauuu

SEQ ID NO: 675678 - RNA, 18 nt, Haemophilus influenzae Rd
uauauacauuaacaaugc

SEQ ID NO: 675679 - RNA, 15 nt, Haemophilus influenzae Rd
uauaguuuaaacuca

SEQ ID NO: 675680 - RNA, 14 nt, Haemophilus influenzae Rd
uauagugaaaaaau

SEQ ID NO: 675681 - RNA, 15 nt, Haemophilus influenzae Rd
uauagugauuauuua

SEQ ID NO: 675682 - RNA, 21 nt, Haemophilus influenzae Rd
uauaguggcuuuaaagguuua

SEQ ID NO: 675683 - RNA, 20 nt, Haemophilus influenzae Rd
ucaacagcuucuccuacauc

SEQ ID NO: 675684 - RNA, 15 nt, Haemophilus influenzae Rd
ucaaaauaaaaccau

SEQ ID NO: 675685 - RNA, 14 nt, Haemophilus influenzae Rd
ucaaauuaaccgca

SEQ ID NO: 675686 - RNA, 14 nt, Haemophilus influenzae Rd
ucaaauuuuucaca

SEQ ID NO: 675687 - RNA, 21 nt, Haemophilus influenzae Rd
uauuuuuuuugaggcuaaacu

SEQ ID NO: 675688 - RNA, 13 nt, Haemophilus influenzae Rd
uauuuuucacuga

SEQ ID NO: 675689 - RNA, 19 nt, Haemophilus influenzae Rd
ucaaaacauuaauugacaa

SEQ ID NO: 675690 - RNA, 21 nt, Haemophilus influenzae Rd
ucaaaaauuucgcuauuuucu

SEQ ID NO: 675691 - RNA, 21 nt, Haemophilus influenzae Rd
ucaaaaaacgaaauuuuucac

SEQ ID NO: 675692 - RNA, 13 nt, Haemophilus influenzae Rd
uauuuauauaauu

SEQ ID NO: 675693 - RNA, 20 nt, Haemophilus influenzae Rd
uauuuauuugaaacaauaaa

SEQ ID NO: 675694 - RNA, 12 nt, Haemophilus influenzae Rd
uauuuauuugcu

SEQ ID NO: 675695 - RNA, 15 nt, Haemophilus influenzae Rd
uauuuauuugcuaaa

SEQ ID NO: 675696 - RNA, 13 nt, Haemophilus influenzae Rd
uauuucaauauug

SEQ ID NO: 675697 - RNA, 21 nt, Haemophilus influenzae Rd
uauugaagaguaaaacuaauu

SEQ ID NO: 675698 - RNA, 14 nt, Haemophilus influenzae Rd
uauuuuauuugccu

SEQ ID NO: 675699 - RNA, 18 nt, Haemophilus influenzae Rd
uauuuuaauaacgccuua

SEQ ID NO: 675700 - RNA, 23 nt, Haemophilus influenzae Rd
uauuuuauauauuaaaaaaaucu

SEQ ID NO: 675701 - RNA, 20 nt, Haemophilus influenzae Rd
uauuuuguggaauaucaauu

SEQ ID NO: 675702 - RNA, 20 nt, Haemophilus influenzae Rd
uauuuuucaaggccauauuu

SEQ ID NO: 675703 - RNA, 12 nt, Haemophilus influenzae Rd
uauuucuucaau

SEQ ID NO: 675704 - RNA, 18 nt, Haemophilus influenzae Rd
uauuuuaaauaaaaaaua

SEQ ID NO: 675705 - RNA, 13 nt, Haemophilus influenzae Rd
uauuuuacggauu

SEQ ID NO: 675706 - RNA, 13 nt, Haemophilus influenzae Rd
uauuuuacuaauu

SEQ ID NO: 675707 - RNA, 15 nt, Haemophilus influenzae Rd
uauucagcaaaauca

SEQ ID NO: 675708 - RNA, 21 nt, Haemophilus influenzae Rd
uauguagcaguugcuaaauca

SEQ ID NO: 675709 - RNA, 20 nt, Haemophilus influenzae Rd
uauguauaauuccuaaaaua

SEQ ID NO: 675710 - RNA, 13 nt, Haemophilus influenzae Rd
uauguaauauuuu

SEQ ID NO: 675711 - RNA, 17 nt, Haemophilus influenzae Rd
uaugggcugacauaaau

SEQ ID NO: 675712 - RNA, 13 nt, Haemophilus influenzae Rd
uauucaucgccaa

SEQ ID NO: 675713 - RNA, 22 nt, Haemophilus influenzae Rd
uauucugaaaccacuaaaaaca

SEQ ID NO: 675714 - RNA, 15 nt, Haemophilus influenzae Rd
uauggaucacccauu

SEQ ID NO: 675715 - RNA, 18 nt, Haemophilus influenzae Rd
uaugcgcuucaucaaauu

SEQ ID NO: 675716 - RNA, 20 nt, Haemophilus influenzae Rd
uaugcguugaugcaacauuu

SEQ ID NO: 675717 - RNA, 21 nt, Haemophilus influenzae Rd
uaugcguugaugcaacauuua

SEQ ID NO: 675718 - RNA, 14 nt, Haemophilus influenzae Rd
uaucgcaaucacga

SEQ ID NO: 675719 - RNA, 21 nt, Haemophilus influenzae Rd
uaucgaauagauuuuuaccaa

SEQ ID NO: 675720 - RNA, 22 nt, Haemophilus influenzae Rd
uagcagguuguuuuuguaaaau

SEQ ID NO: 675721 - RNA, 22 nt, Haemophilus influenzae Rd
uagcaucaaaauaaauaaaaua

SEQ ID NO: 675722 - RNA, 18 nt, Haemophilus influenzae Rd
uagccguaaguuaaacca

SEQ ID NO: 675723 - RNA, 15 nt, Haemophilus influenzae Rd
uagcgaguauaagca

SEQ ID NO: 675724 - RNA, 19 nt, Haemophilus influenzae Rd
uacggacuaaauaaaucac

SEQ ID NO: 675725 - RNA, 22 nt, Haemophilus influenzae Rd
uacggauuuuugaacguuuuug

SEQ ID NO: 675726 - RNA, 15 nt, Haemophilus influenzae Rd
uacuauuggcguaau

SEQ ID NO: 675727 - RNA, 14 nt, Haemophilus influenzae Rd
uacuucccaaauuu

SEQ ID NO: 675728 - RNA, 21 nt, Haemophilus influenzae Rd
uagauaaucagcccaagcuuu

SEQ ID NO: 675729 - RNA, 23 nt, Haemophilus influenzae Rd
uagauacauaacgccaagguuau

SEQ ID NO: 675730 - RNA, 14 nt, Haemophilus influenzae Rd
uagauauuguucua

SEQ ID NO: 675731 - RNA, 21 nt, Haemophilus influenzae Rd
uagauauuguucuacugguuu

SEQ ID NO: 675732 - RNA, 21 nt, Haemophilus influenzae Rd
uagagacaaacaacguaaaag

SEQ ID NO: 675733 - RNA, 18 nt, Haemophilus influenzae Rd
uagaauauuuugcauguu

SEQ ID NO: 675734 - RNA, 23 nt, Haemophilus influenzae Rd
uagaauaacaacaaaagugcggu

SEQ ID NO: 675735 - RNA, 22 nt, Haemophilus influenzae Rd
uagaaguaaacgcguaaaccua

SEQ ID NO: 675736 - RNA, 19 nt, Haemophilus influenzae Rd
uacuucuuuagcugcaaua

SEQ ID NO: 675737 - RNA, 19 nt, Haemophilus influenzae Rd
uagaaaucaaaaaugcuuu

SEQ ID NO: 675738 - RNA, 14 nt, Haemophilus influenzae Rd
uaauuuuuaaaaua

SEQ ID NO: 675739 - RNA, 16 nt, Haemophilus influenzae Rd
uaauucgugcaaauuu

SEQ ID NO: 675740 - RNA, 13 nt, Haemophilus influenzae Rd
uaauuuugcgguu

SEQ ID NO: 675741 - RNA, 22 nt, Haemophilus influenzae Rd
uaauuuuucagguacaacauuu

SEQ ID NO: 675742 - RNA, 18 nt, Haemophilus influenzae Rd
uaauuuuuuacgauauuu

SEQ ID NO: 675743 - RNA, 19 nt, Haemophilus influenzae Rd
uaauuugacgauaauauuu

SEQ ID NO: 675744 - RNA, 16 nt, Haemophilus influenzae Rd
uaauuugccaucacga

SEQ ID NO: 675745 - RNA, 17 nt, Haemophilus influenzae Rd
uaauuugccaucacuca

SEQ ID NO: 675746 - RNA, 19 nt, Haemophilus influenzae Rd
uaauuugccaucacucaau

SEQ ID NO: 675747 - RNA, 20 nt, Haemophilus influenzae Rd
uaauuugcucaaaguucggg

SEQ ID NO: 675748 - RNA, 14 nt, Haemophilus influenzae Rd
uaauuugugcggau

SEQ ID NO: 675749 - RNA, 22 nt, Haemophilus influenzae Rd
uacaaacauauuggcgauuaau

SEQ ID NO: 675750 - RNA, 19 nt, Haemophilus influenzae Rd
uacaaaauuagacuuucuu

SEQ ID NO: 675751 - RNA, 15 nt, Haemophilus influenzae Rd
uaccauugugccaaa

SEQ ID NO: 675752 - RNA, 19 nt, Haemophilus influenzae Rd
uaccauucuuucaauaauu

SEQ ID NO: 675753 - RNA, 18 nt, Haemophilus influenzae Rd
uacccgggccaaauaaua

SEQ ID NO: 675754 - RNA, 21 nt, Haemophilus influenzae Rd
uaccgauaauauguuuugcca

SEQ ID NO: 675755 - RNA, 20 nt, Haemophilus influenzae Rd
uaccuaguuugcuauauuac

SEQ ID NO: 675756 - RNA, 14 nt, Haemophilus influenzae Rd
uaccguuaaggcau

SEQ ID NO: 675757 - RNA, 21 nt, Haemophilus influenzae Rd
uaccggaaaccagcuuuccaa

SEQ ID NO: 675758 - RNA, 11 nt, Haemophilus influenzae Rd
uccaaauaaua

SEQ ID NO: 675759 - RNA, 19 nt, Haemophilus influenzae Rd
uccaaaccgucagugcuuu

SEQ ID NO: 675760 - RNA, 18 nt, Haemophilus influenzae Rd
ucauggcacaaaauaaug

SEQ ID NO: 675761 - RNA, 20 nt, Haemophilus influenzae Rd
uccaaaacgugucacuuuac

SEQ ID NO: 675762 - RNA, 16 nt, Haemophilus influenzae Rd
uccaacauuaauaacg

SEQ ID NO: 675763 - RNA, 15 nt, Haemophilus influenzae Rd
uccaaauauaaaaua

SEQ ID NO: 675764 - RNA, 23 nt, Haemophilus influenzae Rd
uccaccacagcccaaaauucagc

SEQ ID NO: 675765 - RNA, 13 nt, Haemophilus influenzae Rd
ucauccacuaauu

SEQ ID NO: 675766 - RNA, 20 nt, Haemophilus influenzae Rd
ucaguuaucucccaaauccc

SEQ ID NO: 675767 - RNA, 22 nt, Haemophilus influenzae Rd
ucaucaauaacacucauuguaa

SEQ ID NO: 675768 - RNA, 20 nt, Haemophilus influenzae Rd
ucacauuuuugucuuuguug

SEQ ID NO: 675769 - RNA, 22 nt, Haemophilus influenzae Rd
ucacacguucauuacgugcaaa

SEQ ID NO: 675770 - RNA, 13 nt, Haemophilus influenzae Rd
ucacguaaaauca

SEQ ID NO: 675771 - RNA, 18 nt, Haemophilus influenzae Rd
ucacgauauugcacaaua

SEQ ID NO: 675772 - RNA, 22 nt, Haemophilus influenzae Rd
ucagauuuuucgcauuuuaacu

SEQ ID NO: 675773 - RNA, 17 nt, Haemophilus influenzae Rd
ucagauuuuuuucagaa

SEQ ID NO: 675774 - RNA, 15 nt, Haemophilus influenzae Rd
ucacuguaaauaaua

SEQ ID NO: 675775 - RNA, 21 nt, Haemophilus influenzae Rd
ucacuguaucuuuuuguaauu

SEQ ID NO: 675776 - RNA, 19 nt, Haemophilus influenzae Rd
ucagaauauaaguucuucc

SEQ ID NO: 675777 - RNA, 21 nt, Haemophilus influenzae Rd
ucagcauaaacaaaauaaacu

SEQ ID NO: 675778 - RNA, 20 nt, Haemophilus influenzae Rd
ucagcauaaagagaauauuu

SEQ ID NO: 675779 - RNA, 17 nt, Haemophilus influenzae Rd
aauacaaauacauuuug

SEQ ID NO: 675780 - RNA, 18 nt, Haemophilus influenzae Rd
aauacagcucaaaaugcu

SEQ ID NO: 675781 - RNA, 15 nt, Haemophilus influenzae Rd
ucccuguauaaagau

SEQ ID NO: 675782 - RNA, 21 nt, Haemophilus influenzae Rd
uccccauacaaguauuuuccu

SEQ ID NO: 675783 - RNA, 18 nt, Haemophilus influenzae Rd
uccccauucuuuucgcaa

SEQ ID NO: 675784 - RNA, 18 nt, Haemophilus influenzae Rd
ucccauucuuaaaucaua

SEQ ID NO: 675785 - RNA, 16 nt, Haemophilus influenzae Rd
uccucugcauucugaa

SEQ ID NO: 675786 - RNA, 21 nt, Haemophilus influenzae Rd
ucgauaaaagaagcuauuacu

SEQ ID NO: 675787 - RNA, 18 nt, Haemophilus influenzae Rd
ucgauaaauucaaucgcu

SEQ ID NO: 675788 - RNA, 21 nt, Haemophilus influenzae Rd
ucgccgugauaauaucgcccg

SEQ ID NO: 675789 - RNA, 16 nt, Haemophilus influenzae Rd
ucgccuguuucacgau

SEQ ID NO: 675790 - RNA, 15 nt, Haemophilus influenzae Rd
ucgcccaauuuggca

SEQ ID NO: 675791 - RNA, 20 nt, Haemophilus influenzae Rd
ucgccacuggugcugaaaau

SEQ ID NO: 675792 - RNA, 17 nt, Haemophilus influenzae Rd
ucgccaauucuucagau

SEQ ID NO: 675793 - RNA, 20 nt, Haemophilus influenzae Rd
ucgcauugauucuuuaugaa

SEQ ID NO: 675794 - RNA, 14 nt, Haemophilus influenzae Rd
ucgcauuuuuauua

SEQ ID NO: 675795 - RNA, 20 nt, Haemophilus influenzae Rd
ucgcguuuauuuaacaauaa

SEQ ID NO: 675796 - RNA, 16 nt, Haemophilus influenzae Rd
ucgcuucauucucuuc

SEQ ID NO: 675797 - RNA, 12 nt, Haemophilus influenzae Rd
ucguagccugau

SEQ ID NO: 675798 - RNA, 13 nt, Haemophilus influenzae Rd
ucguauaagcguu

SEQ ID NO: 675799 - RNA, 16 nt, Haemophilus influenzae Rd
ucguauaagcguuuac

SEQ ID NO: 675800 - RNA, 15 nt, Haemophilus influenzae Rd
ucguaguaagcugau

SEQ ID NO: 675801 - RNA, 16 nt, Haemophilus influenzae Rd
ucucgccaaaucucaa

SEQ ID NO: 675802 - RNA, 15 nt, Haemophilus influenzae Rd
ucuccgcgacauuaa

SEQ ID NO: 675803 - RNA, 22 nt, Haemophilus influenzae Rd
ucucagaauuuauucccccauu

SEQ ID NO: 675804 - RNA, 17 nt, Haemophilus influenzae Rd
ucucguccgcauuuggu

SEQ ID NO: 675805 - RNA, 16 nt, Haemophilus influenzae Rd
ucucugcaucguugcu

SEQ ID NO: 675806 - RNA, 14 nt, Haemophilus influenzae Rd
ucucucacgugaau

SEQ ID NO: 675807 - RNA, 20 nt, Haemophilus influenzae Rd
ucucuuuacgacuaaaacga

SEQ ID NO: 675808 - RNA, 14 nt, Haemophilus influenzae Rd
ucugcaccauccau

SEQ ID NO: 675809 - RNA, 21 nt, Haemophilus influenzae Rd
ucugcaccuuaaaggcugaau

SEQ ID NO: 675810 - RNA, 19 nt, Haemophilus influenzae Rd
ucugauguagcuugaauau

SEQ ID NO: 675811 - RNA, 13 nt, Haemophilus influenzae Rd
ucugcaacaacga

SEQ ID NO: 675812 - RNA, 16 nt, Haemophilus influenzae Rd
ucuggauuaucuguaa

SEQ ID NO: 675813 - RNA, 22 nt, Haemophilus influenzae Rd
ucuuaauuaagauaauuuuucu

SEQ ID NO: 675814 - RNA, 20 nt, Haemophilus influenzae Rd
ucuuacguuuaaauuuauga

SEQ ID NO: 675815 - RNA, 18 nt, Haemophilus influenzae Rd
ucuuaggguauuucgguu

SEQ ID NO: 675816 - RNA, 19 nt, Haemophilus influenzae Rd
ucuucaccucgugcuguuu

SEQ ID NO: 675817 - RNA, 16 nt, Haemophilus influenzae Rd
ucuuccaauaauucuu

SEQ ID NO: 675818 - RNA, 17 nt, Haemophilus influenzae Rd
ugaaccuucacagauuu

SEQ ID NO: 675819 - RNA, 22 nt, Haemophilus influenzae Rd
ugaaccuucacagauuucaauu

SEQ ID NO: 675820 - RNA, 13 nt, Haemophilus influenzae Rd
ugaaaucaaaaug

SEQ ID NO: 675821 - RNA, 23 nt, Haemophilus influenzae Rd
ugaaaucaaaauggguaaggaaa

SEQ ID NO: 675822 - RNA, 24 nt, Haemophilus influenzae Rd
ucuuugaauuguuuguauaagcca

SEQ ID NO: 675823 - RNA, 14 nt, Haemophilus influenzae Rd
ucuuucaauuucaa

SEQ ID NO: 675824 - RNA, 16 nt, Haemophilus influenzae Rd
ucuuuauuugagccaa

SEQ ID NO: 675825 - RNA, 15 nt, Haemophilus influenzae Rd
ucuuucaaaaaucaa

SEQ ID NO: 675826 - RNA, 13 nt, Haemophilus influenzae Rd
ucuuuccauuuga

SEQ ID NO: 675827 - RNA, 16 nt, Haemophilus influenzae Rd
ucuuucgccaguuuag

SEQ ID NO: 675828 - RNA, 20 nt, Haemophilus influenzae Rd
ugcaccacguucuuuuaaug

SEQ ID NO: 675829 - RNA, 17 nt, Haemophilus influenzae Rd
ugaugggaugaaaucaa

SEQ ID NO: 675830 - RNA, 11 nt, Haemophilus influenzae Rd
ugcacuuuaaa

SEQ ID NO: 675831 - RNA, 19 nt, Haemophilus influenzae Rd
ugcacuaguucagcgauuu

SEQ ID NO: 675832 - RNA, 20 nt, Haemophilus influenzae Rd
ugcacuauauacauuaacaa

SEQ ID NO: 675833 - RNA, 15 nt, Haemophilus influenzae Rd
ugcacgggaaaucca

SEQ ID NO: 675834 - RNA, 20 nt, Haemophilus influenzae Rd
ugcagauuuuuuauuuauua

SEQ ID NO: 675835 - RNA, 12 nt, Haemophilus influenzae Rd
ugccauuacaag

SEQ ID NO: 675836 - RNA, 13 nt, Haemophilus influenzae Rd
ugcauauccgcug

SEQ ID NO: 675837 - RNA, 23 nt, Haemophilus influenzae Rd
ugcccgcuucuucgauaaaaucu

SEQ ID NO: 675838 - RNA, 18 nt, Haemophilus influenzae Rd
ugcccgcuacaaauaagc

SEQ ID NO: 675839 - RNA, 14 nt, Haemophilus influenzae Rd
ugauauuuaauaaa

SEQ ID NO: 675840 - RNA, 12 nt, Haemophilus influenzae Rd
ugaugaagauga

SEQ ID NO: 675841 - RNA, 24 nt, Haemophilus influenzae Rd
ugaucugcacuccaaaaguuggau

SEQ ID NO: 675842 - RNA, 14 nt, Haemophilus influenzae Rd
ugauacauuucuaa

SEQ ID NO: 675843 - RNA, 15 nt, Haemophilus influenzae Rd
ugauaccaagcauau

SEQ ID NO: 675844 - RNA, 14 nt, Haemophilus influenzae Rd
ugauaaucuaaaaa

SEQ ID NO: 675845 - RNA, 20 nt, Haemophilus influenzae Rd
ugauaaaaauaucguaaaaa

SEQ ID NO: 675846 - RNA, 21 nt, Haemophilus influenzae Rd
ugacgauuaauaccaauaaua

SEQ ID NO: 675847 - RNA, 23 nt, Haemophilus influenzae Rd
ugacgccauccaaaacuaauaaa

SEQ ID NO: 675848 - RNA, 19 nt, Haemophilus influenzae Rd
ugacgauaauauuuuugcc

SEQ ID NO: 675849 - RNA, 15 nt, Haemophilus influenzae Rd
aauguguugauuucu

SEQ ID NO: 675850 - RNA, 23 nt, Haemophilus influenzae Rd
aauguuauugccuaauaaaaaau

SEQ ID NO: 675851 - RNA, 23 nt, Haemophilus influenzae Rd
aauguucacugcggcaaaaucuu

SEQ ID NO: 675852 - RNA, 16 nt, Haemophilus influenzae Rd
aauguucgauuuuacu

SEQ ID NO: 675853 - RNA, 15 nt, Haemophilus influenzae Rd
acaaaauuaaugcca

SEQ ID NO: 675854 - RNA, 16 nt, Haemophilus influenzae Rd
acaaaauuggcguaac

SEQ ID NO: 675855 - RNA, 23 nt, Haemophilus influenzae Rd
acaaaauauuaguuagcuaaaaa

SEQ ID NO: 675856 - RNA, 21 nt, Haemophilus influenzae Rd
acaaacaaucuuaacugcaag

SEQ ID NO: 675857 - RNA, 11 nt, Haemophilus influenzae Rd
acaaaauuuug

SEQ ID NO: 675858 - RNA, 21 nt, Haemophilus influenzae Rd
acaaaagugcgguuuauuuuu

SEQ ID NO: 675859 - RNA, 14 nt, Haemophilus influenzae Rd
acaaaauaaaugau

SEQ ID NO: 675860 - RNA, 19 nt, Haemophilus influenzae Rd
acaaaacagacugaaauuc

SEQ ID NO: 675861 - RNA, 14 nt, Haemophilus influenzae Rd
aauuuuuuuucuaa

SEQ ID NO: 675862 - RNA, 23 nt, Haemophilus influenzae Rd
aauuuuuuguugauuagcuaaua

SEQ ID NO: 675863 - RNA, 23 nt, Haemophilus influenzae Rd
aauuuuucgcaagauagcaaaau

SEQ ID NO: 675864 - RNA, 11 nt, Haemophilus influenzae Rd
aauuuuucuac

SEQ ID NO: 675865 - RNA, 19 nt, Haemophilus influenzae Rd
aauuuuucuacuuuugugc

SEQ ID NO: 675866 - RNA, 11 nt, Haemophilus influenzae Rd
aauuuuucuca

SEQ ID NO: 675867 - RNA, 22 nt, Haemophilus influenzae Rd
acaaccagcgcaccacacaaua

SEQ ID NO: 675868 - RNA, 20 nt, Haemophilus influenzae Rd
acaaccaucuucaacgauaa

SEQ ID NO: 675869 - RNA, 15 nt, Haemophilus influenzae Rd
acaaauuuaaaugau

SEQ ID NO: 675870 - RNA, 21 nt, Haemophilus influenzae Rd
acaacagugaauugacgaaau

SEQ ID NO: 675871 - RNA, 23 nt, Haemophilus influenzae Rd
acaaccaagcgcgugugaaauuc

SEQ ID NO: 675872 - RNA, 15 nt, Haemophilus influenzae Rd
acaaccaccaauuaa

SEQ ID NO: 675873 - RNA, 15 nt, Haemophilus influenzae Rd
acaacaucuuguuuu

SEQ ID NO: 675874 - RNA, 18 nt, Haemophilus influenzae Rd
acaacacuugcuguuuuu

SEQ ID NO: 675875 - RNA, 22 nt, Haemophilus influenzae Rd
acaaauccauaaggaaauugca

SEQ ID NO: 675876 - RNA, 23 nt, Haemophilus influenzae Rd
acaaaucguaauuaaaaucacau

SEQ ID NO: 675877 - RNA, 15 nt, Haemophilus influenzae Rd
acaaagguugaaugc

SEQ ID NO: 675878 - RNA, 21 nt, Haemophilus influenzae Rd
acaacgagcgagaccacuuua

SEQ ID NO: 675879 - RNA, 16 nt, Haemophilus influenzae Rd
acaacgguugaaauug

SEQ ID NO: 675880 - RNA, 13 nt, Haemophilus influenzae Rd
acaacucacaaua

SEQ ID NO: 675881 - RNA, 16 nt, Haemophilus influenzae Rd
acaagaugacugcaau

SEQ ID NO: 675882 - RNA, 20 nt, Haemophilus influenzae Rd
acaauuucauuaauuuuauu

SEQ ID NO: 675883 - RNA, 13 nt, Haemophilus influenzae Rd
acaaugucagaaa

SEQ ID NO: 675884 - RNA, 14 nt, Haemophilus influenzae Rd
acaauacaaccgaa

SEQ ID NO: 675885 - RNA, 16 nt, Haemophilus influenzae Rd
acaauaaaacuuuauu

SEQ ID NO: 675886 - RNA, 20 nt, Haemophilus influenzae Rd
acaauagcuuccgcuuuuuu

SEQ ID NO: 675887 - RNA, 19 nt, Haemophilus influenzae Rd
acacaccuauuuuuuccug

SEQ ID NO: 675888 - RNA, 16 nt, Haemophilus influenzae Rd
acacgcgcaaauuuuc

SEQ ID NO: 675889 - RNA, 24 nt, Haemophilus influenzae Rd
acacuuccccuguaauaaaugcgu

SEQ ID NO: 675890 - RNA, 14 nt, Haemophilus influenzae Rd
acagcacacuaaua

SEQ ID NO: 675891 - RNA, 15 nt, Haemophilus influenzae Rd
acagccugcgagcag

SEQ ID NO: 675892 - RNA, 14 nt, Haemophilus influenzae Rd
acauucgcauauuu

SEQ ID NO: 675893 - RNA, 23 nt, Haemophilus influenzae Rd
accaauaauuaaugcuaaaccaa

SEQ ID NO: 675894 - RNA, 16 nt, Haemophilus influenzae Rd
accaauacgauaauua

SEQ ID NO: 675895 - RNA, 19 nt, Haemophilus influenzae Rd
accaauaggaagcauuucu

SEQ ID NO: 675896 - RNA, 16 nt, Haemophilus influenzae Rd
accaauauaauuuacu

SEQ ID NO: 675897 - RNA, 14 nt, Haemophilus influenzae Rd
accaaggcauuuuu

SEQ ID NO: 675898 - RNA, 15 nt, Haemophilus influenzae Rd
accaacggcauuucc

SEQ ID NO: 675899 - RNA, 17 nt, Haemophilus influenzae Rd
accaacguggcuuuucu

SEQ ID NO: 675900 - RNA, 14 nt, Haemophilus influenzae Rd
accaagcaauuuca

SEQ ID NO: 675901 - RNA, 13 nt, Haemophilus influenzae Rd
accaagccauuua

SEQ ID NO: 675902 - RNA, 12 nt, Haemophilus influenzae Rd
accaagaaucaa

SEQ ID NO: 675903 - RNA, 18 nt, Haemophilus influenzae Rd
accaacauacauuaaugc

SEQ ID NO: 675904 - RNA, 12 nt, Haemophilus influenzae Rd
accaacacgcca

SEQ ID NO: 675905 - RNA, 14 nt, Haemophilus influenzae Rd
accaaaucacaaua

SEQ ID NO: 675906 - RNA, 21 nt, Haemophilus influenzae Rd
acauagugucagcaucggaua

SEQ ID NO: 675907 - RNA, 14 nt, Haemophilus influenzae Rd
acauauucuaccgc

SEQ ID NO: 675908 - RNA, 14 nt, Haemophilus influenzae Rd
acauacuuuguuga

SEQ ID NO: 675909 - RNA, 14 nt, Haemophilus influenzae Rd
accacaugaauuuc

SEQ ID NO: 675910 - RNA, 20 nt, Haemophilus influenzae Rd
accaauauucuuuaaaacau

SEQ ID NO: 675911 - RNA, 17 nt, Haemophilus influenzae Rd
accacaucaaauuuauc

SEQ ID NO: 675912 - RNA, 18 nt, Haemophilus influenzae Rd
accagccgacuauuacaa

SEQ ID NO: 675913 - RNA, 22 nt, Haemophilus influenzae Rd
accagcagaaaauaacgcauca

SEQ ID NO: 675914 - RNA, 13 nt, Haemophilus influenzae Rd
accacuaaaacac

SEQ ID NO: 675915 - RNA, 20 nt, Haemophilus influenzae Rd
accacguucuuuuaaugcuu

SEQ ID NO: 675916 - RNA, 18 nt, Haemophilus influenzae Rd
acccauuggaagauuucu

SEQ ID NO: 675917 - RNA, 17 nt, Haemophilus influenzae Rd
accgccaaaaauuaaua

SEQ ID NO: 675918 - RNA, 12 nt, Haemophilus influenzae Rd
accgcaucaaaa

SEQ ID NO: 675919 - RNA, 21 nt, Haemophilus influenzae Rd
accgcacuuuggaauauucuu

SEQ ID NO: 675920 - RNA, 19 nt, Haemophilus influenzae Rd
accgcacuuuuuaucuaaa

SEQ ID NO: 675921 - RNA, 23 nt, Haemophilus influenzae Rd
accgcacuuuuuauuagauggaa

SEQ ID NO: 675922 - RNA, 22 nt, Haemophilus influenzae Rd
accgaccauuggaacgauuaaa

SEQ ID NO: 675923 - RNA, 13 nt, Haemophilus influenzae Rd
accgcuuuaucaa

SEQ ID NO: 675924 - RNA, 17 nt, Haemophilus influenzae Rd
acgcgcacauacuucuu

SEQ ID NO: 675925 - RNA, 18 nt, Haemophilus influenzae Rd
acgccauuuucgguuaag

SEQ ID NO: 675926 - RNA, 20 nt, Haemophilus influenzae Rd
acgccauuuucgguuaagua

SEQ ID NO: 675927 - RNA, 15 nt, Haemophilus influenzae Rd
acgcaagguauuuuu

SEQ ID NO: 675928 - RNA, 18 nt, Haemophilus influenzae Rd
acgcaauuuagauacaaa

SEQ ID NO: 675929 - RNA, 20 nt, Haemophilus influenzae Rd
acgcaaugacgcgccuaaua

SEQ ID NO: 675930 - RNA, 22 nt, Haemophilus influenzae Rd
acgaagugcggaugaaauuuuu

SEQ ID NO: 675931 - RNA, 21 nt, Haemophilus influenzae Rd
accuuguaaauacucaauggu

SEQ ID NO: 675932 - RNA, 23 nt, Haemophilus influenzae Rd
accuuuacuuauucguucuuuug

SEQ ID NO: 675933 - RNA, 17 nt, Haemophilus influenzae Rd
accuucacagauuucaa

SEQ ID NO: 675934 - RNA, 16 nt, Haemophilus influenzae Rd
accuuaacauuuucug

SEQ ID NO: 675935 - RNA, 18 nt, Haemophilus influenzae Rd
accuuaauuagauuuauu

SEQ ID NO: 675936 - RNA, 23 nt, Haemophilus influenzae Rd
accuguuucguacauuguuucaa

SEQ ID NO: 675937 - RNA, 13 nt, Haemophilus influenzae Rd
accuuccacuuuu

SEQ ID NO: 675938 - RNA, 23 nt, Haemophilus influenzae Rd
accuaaugcaguaacuucugcug

SEQ ID NO: 675939 - RNA, 23 nt, Haemophilus influenzae Rd
accuaucucauccacuaaaccau

SEQ ID NO: 675940 - RNA, 23 nt, Haemophilus influenzae Rd
accucgaauagcaauaucugcua

SEQ ID NO: 675941 - RNA, 14 nt, Haemophilus influenzae Rd
accugaaaaaccuu

SEQ ID NO: 675942 - RNA, 15 nt, Haemophilus influenzae Rd
acugaaucgcguaau

SEQ ID NO: 675943 - RNA, 21 nt, Haemophilus influenzae Rd
acugaucgccaucuucuucug

SEQ ID NO: 675944 - RNA, 23 nt, Haemophilus influenzae Rd
acugaaaugauuauaauuagugg

SEQ ID NO: 675945 - RNA, 17 nt, Haemophilus influenzae Rd
acuccuauuaguauuua

SEQ ID NO: 675946 - RNA, 17 nt, Haemophilus influenzae Rd
acuccacuuugcucuaa

SEQ ID NO: 675947 - RNA, 22 nt, Haemophilus influenzae Rd
acuccaacaccagucaauaaac

SEQ ID NO: 675948 - RNA, 13 nt, Haemophilus influenzae Rd
acgguaguaaaua

SEQ ID NO: 675949 - RNA, 14 nt, Haemophilus influenzae Rd
acgguauuuucuua

SEQ ID NO: 675950 - RNA, 16 nt, Haemophilus influenzae Rd
acggugaauuuaucau

SEQ ID NO: 675951 - RNA, 13 nt, Haemophilus influenzae Rd
acguagauacaua

SEQ ID NO: 675952 - RNA, 13 nt, Haemophilus influenzae Rd
acguuuuuucgac

SEQ ID NO: 675953 - RNA, 18 nt, Haemophilus influenzae Rd
acuaaaaaagcgaauuuc

SEQ ID NO: 675954 - RNA, 22 nt, Haemophilus influenzae Rd
acuaaaacaacaguagaaauca

SEQ ID NO: 675955 - RNA, 20 nt, Haemophilus influenzae Rd
acuaaaaccacaucauuuuu

SEQ ID NO: 675956 - RNA, 12 nt, Haemophilus influenzae Rd
acuaaauucagu

SEQ ID NO: 675957 - RNA, 14 nt, Haemophilus influenzae Rd
aauauaaaauaaaa

SEQ ID NO: 675958 - RNA, 17 nt, Haemophilus influenzae Rd
aauauaaccuuguccgc

SEQ ID NO: 675959 - RNA, 13 nt, Haemophilus influenzae Rd
ugccuugcaaaaa

SEQ ID NO: 675960 - RNA, 22 nt, Haemophilus influenzae Rd
ugcgccgauaacaccgcuaaua

SEQ ID NO: 675961 - RNA, 13 nt, Haemophilus influenzae Rd
ugcgccaauaaua

SEQ ID NO: 675962 - RNA, 15 nt, Haemophilus influenzae Rd
aauagccuucaucac

SEQ ID NO: 675963 - RNA, 17 nt, Haemophilus influenzae Rd
aauagccuucaucacaa

SEQ ID NO: 675964 - RNA, 15 nt, Haemophilus influenzae Rd
ugcggucauuuuuca

SEQ ID NO: 675965 - RNA, 13 nt, Haemophilus influenzae Rd
ugcgguuaaaauu

SEQ ID NO: 675966 - RNA, 15 nt, Haemophilus influenzae Rd
ugcgguagauuuuca

SEQ ID NO: 675967 - RNA, 19 nt, Haemophilus influenzae Rd
ugcgguaaaaauuucucuc

SEQ ID NO: 675968 - RNA, 15 nt, Haemophilus influenzae Rd
ugcgguaaauuuuaa

SEQ ID NO: 675969 - RNA, 18 nt, Haemophilus influenzae Rd
ugcgccuaauuggaaaag

SEQ ID NO: 675970 - RNA, 19 nt, Haemophilus influenzae Rd
ugcggaaacauaucaaaaa

SEQ ID NO: 675971 - RNA, 15 nt, Haemophilus influenzae Rd
ugcggcaaagguuuu

SEQ ID NO: 675972 - RNA, 18 nt, Haemophilus influenzae Rd
ugcguuaaaucaaaacca

SEQ ID NO: 675973 - RNA, 16 nt, Haemophilus influenzae Rd
ugcguucaauaugcaa

SEQ ID NO: 675974 - RNA, 19 nt, Haemophilus influenzae Rd
aauauagaugaagugaacu

SEQ ID NO: 675975 - RNA, 23 nt, Haemophilus influenzae Rd
aauaucaagucaaaaaccgcuuu

SEQ ID NO: 675976 - RNA, 20 nt, Haemophilus influenzae Rd
aauauaugggaaacaauaug

SEQ ID NO: 675977 - RNA, 16 nt, Haemophilus influenzae Rd
aauauauuauuaaguc

SEQ ID NO: 675978 - RNA, 16 nt, Haemophilus influenzae Rd
aauauauuaagugcgg

SEQ ID NO: 675979 - RNA, 15 nt, Haemophilus influenzae Rd
ugcucccccccaaua

SEQ ID NO: 675980 - RNA, 12 nt, Haemophilus influenzae Rd
ugcuuaaaagcu

SEQ ID NO: 675981 - RNA, 19 nt, Haemophilus influenzae Rd
ugcuuccauuuggaauacu

SEQ ID NO: 675982 - RNA, 18 nt, Haemophilus influenzae Rd
ugcuuguucagcaacauc

SEQ ID NO: 675983 - RNA, 22 nt, Haemophilus influenzae Rd
ugcuuuaccuguugcauuagaa

SEQ ID NO: 675984 - RNA, 15 nt, Haemophilus influenzae Rd
ugcuuuauuuggcau

SEQ ID NO: 675985 - RNA, 16 nt, Haemophilus influenzae Rd
uggaaugagcauaauc

SEQ ID NO: 675986 - RNA, 23 nt, Haemophilus influenzae Rd
ugcuuuuaauaauguauuucuaa

SEQ ID NO: 675987 - RNA, 20 nt, Haemophilus influenzae Rd
uggcccgauauuuuggcuaa

SEQ ID NO: 675988 - RNA, 16 nt, Haemophilus influenzae Rd
uggcgauauucuccuu

SEQ ID NO: 675989 - RNA, 23 nt, Haemophilus influenzae Rd
uggguucacagagaauaaaucac

SEQ ID NO: 675990 - RNA, 21 nt, Haemophilus influenzae Rd
aauaucuaaaugacgugcuaa

SEQ ID NO: 675991 - RNA, 13 nt, Haemophilus influenzae Rd
aauaucugcaaaa

SEQ ID NO: 675992 - RNA, 16 nt, Haemophilus influenzae Rd
aauaugaaaaaggcgg

SEQ ID NO: 675993 - RNA, 20 nt, Haemophilus influenzae Rd
aauaugacgaagacccaauu

SEQ ID NO: 675994 - RNA, 13 nt, Haemophilus influenzae Rd
aauauuacgcaua

SEQ ID NO: 675995 - RNA, 19 nt, Haemophilus influenzae Rd
aauauguuuaccaccgaua

SEQ ID NO: 675996 - RNA, 16 nt, Haemophilus influenzae Rd
aauauucuuuuuaaau

SEQ ID NO: 675997 - RNA, 14 nt, Haemophilus influenzae Rd
aauauuuauacacu

SEQ ID NO: 675998 - RNA, 23 nt, Haemophilus influenzae Rd
uguaguagauaacaacuaaaaau

SEQ ID NO: 675999 - RNA, 17 nt, Haemophilus influenzae Rd
uguagcuugaauauuug

SEQ ID NO: 676000 - RNA, 13 nt, Haemophilus influenzae Rd
ugguuguaauaau

SEQ ID NO: 676001 - RNA, 15 nt, Haemophilus influenzae Rd
ugguuuaaauuuuaa

SEQ ID NO: 676002 - RNA, 16 nt, Haemophilus influenzae Rd
uguaagacacagggcu

SEQ ID NO: 676003 - RNA, 21 nt, Haemophilus influenzae Rd
uguaagcauuaaaaauuuaaa

SEQ ID NO: 676004 - RNA, 14 nt, Haemophilus influenzae Rd
uguaauccugcauu

SEQ ID NO: 676005 - RNA, 16 nt, Haemophilus influenzae Rd
uguaccacgguugaua

SEQ ID NO: 676006 - RNA, 18 nt, Haemophilus influenzae Rd
uggugaaaucaacaaucc

SEQ ID NO: 676007 - RNA, 19 nt, Haemophilus influenzae Rd
aauauuuuagcaagugcgc

SEQ ID NO: 676008 - RNA, 18 nt, Haemophilus influenzae Rd
aauauuucacuauucagc

SEQ ID NO: 676009 - RNA, 16 nt, Haemophilus influenzae Rd
uugccgccaaaaugag

SEQ ID NO: 676010 - RNA, 12 nt, Haemophilus influenzae Rd
aaucauauuucu

SEQ ID NO: 676011 - RNA, 16 nt, Haemophilus influenzae Rd
aaucauuaacuuacca

SEQ ID NO: 676012 - RNA, 15 nt, Haemophilus influenzae Rd
uugccauuugcuucu

SEQ ID NO: 676013 - RNA, 17 nt, Haemophilus influenzae Rd
uugccauaaaaaauuaa

SEQ ID NO: 676014 - RNA, 23 nt, Haemophilus influenzae Rd
uugaucuuagacaaauuaaauua

SEQ ID NO: 676015 - RNA, 20 nt, Haemophilus influenzae Rd
uucuucagauuuuauaucaa

SEQ ID NO: 676016 - RNA, 13 nt, Haemophilus influenzae Rd
uucuucccaaccu

SEQ ID NO: 676017 - RNA, 20 nt, Haemophilus influenzae Rd
uucuuauccguuacauuauu

SEQ ID NO: 676018 - RNA, 16 nt, Haemophilus influenzae Rd
uucuuaaauauaucaa

SEQ ID NO: 676019 - RNA, 13 nt, Haemophilus influenzae Rd
uucuucaauaugu

SEQ ID NO: 676020 - RNA, 14 nt, Haemophilus influenzae Rd
uucuucaauaacaa

SEQ ID NO: 676021 - RNA, 19 nt, Haemophilus influenzae Rd
uucuucaauagaacguaau

SEQ ID NO: 676022 - RNA, 15 nt, Haemophilus influenzae Rd
uucugucuauuuauu

SEQ ID NO: 676023 - RNA, 17 nt, Haemophilus influenzae Rd
uucuguaugacuauuua

SEQ ID NO: 676024 - RNA, 20 nt, Haemophilus influenzae Rd
uucugcucuuucaaauaauu

SEQ ID NO: 676025 - RNA, 15 nt, Haemophilus influenzae Rd
uucugguuccauuac

SEQ ID NO: 676026 - RNA, 21 nt, Haemophilus influenzae Rd
uucugcuugggcaaucaaauu

SEQ ID NO: 676027 - RNA, 17 nt, Haemophilus influenzae Rd
uugcauaaaccaacuau

SEQ ID NO: 676028 - RNA, 18 nt, Haemophilus influenzae Rd
uugccacaggauaaaaac

SEQ ID NO: 676029 - RNA, 23 nt, Haemophilus influenzae Rd
uugcauuaaagcgagaauaguua

SEQ ID NO: 676030 - RNA, 19 nt, Haemophilus influenzae Rd
uugcaagcuaccuuguggc

SEQ ID NO: 676031 - RNA, 23 nt, Haemophilus influenzae Rd
uugauuuagccaguaauuuuaca

SEQ ID NO: 676032 - RNA, 17 nt, Haemophilus influenzae Rd
uugauuuuaaaauauca

SEQ ID NO: 676033 - RNA, 14 nt, Haemophilus influenzae Rd
uugauuuugguucg

SEQ ID NO: 676034 - RNA, 14 nt, Haemophilus influenzae Rd
uugauuuuucaacu

SEQ ID NO: 676035 - RNA, 13 nt, Haemophilus influenzae Rd
uugcacugguucu

SEQ ID NO: 676036 - RNA, 20 nt, Haemophilus influenzae Rd
uugcaccaucguuaaaccaa

SEQ ID NO: 676037 - RNA, 15 nt, Haemophilus influenzae Rd
uugcacugcuaauuc

SEQ ID NO: 676038 - RNA, 16 nt, Haemophilus influenzae Rd
uuggcgaauuugguuu

SEQ ID NO: 676039 - RNA, 18 nt, Haemophilus influenzae Rd
uuggguguguauccacaa

SEQ ID NO: 676040 - RNA, 19 nt, Haemophilus influenzae Rd
aauccacauuuuuuguaau

SEQ ID NO: 676041 - RNA, 13 nt, Haemophilus influenzae Rd
aaucccaauaggu

SEQ ID NO: 676042 - RNA, 15 nt, Haemophilus influenzae Rd
aauccauuuuuaaau

SEQ ID NO: 676043 - RNA, 15 nt, Haemophilus influenzae Rd
uugugaaauaaaaua

SEQ ID NO: 676044 - RNA, 20 nt, Haemophilus influenzae Rd
uugugacggugaauuuauca

SEQ ID NO: 676045 - RNA, 17 nt, Haemophilus influenzae Rd
uugugaguaaaauacga

SEQ ID NO: 676046 - RNA, 20 nt, Haemophilus influenzae Rd
uugugauugaugccccugca

SEQ ID NO: 676047 - RNA, 14 nt, Haemophilus influenzae Rd
uugugguaauuuau

SEQ ID NO: 676048 - RNA, 18 nt, Haemophilus influenzae Rd
uuguggaauaaaauaauc

SEQ ID NO: 676049 - RNA, 12 nt, Haemophilus influenzae Rd
uuguuaaaacgc

SEQ ID NO: 676050 - RNA, 14 nt, Haemophilus influenzae Rd
uuguuuuaaaacua

SEQ ID NO: 676051 - RNA, 13 nt, Haemophilus influenzae Rd
uuguuuuaaaaug

SEQ ID NO: 676052 - RNA, 17 nt, Haemophilus influenzae Rd
uuguuuuaauaaacaua

SEQ ID NO: 676053 - RNA, 23 nt, Haemophilus influenzae Rd
uugucccaaaauauuuucaaaua

SEQ ID NO: 676054 - RNA, 16 nt, Haemophilus influenzae Rd
uugucggaaaauaaua

SEQ ID NO: 676055 - RNA, 20 nt, Haemophilus influenzae Rd
uugguucuaaauauuuuuca

SEQ ID NO: 676056 - RNA, 14 nt, Haemophilus influenzae Rd
uuguaagcaaaauc

SEQ ID NO: 676057 - RNA, 14 nt, Haemophilus influenzae Rd
uuguaaauugguuu

SEQ ID NO: 676058 - RNA, 20 nt, Haemophilus influenzae Rd
uuguaaacuuuccucaaguu

SEQ ID NO: 676059 - RNA, 15 nt, Haemophilus influenzae Rd
uuguaaagcaccaua

SEQ ID NO: 676060 - RNA, 18 nt, Haemophilus influenzae Rd
uuguauuugcgauaauuu

SEQ ID NO: 676061 - RNA, 16 nt, Haemophilus influenzae Rd
uugucacguaauacac

SEQ ID NO: 676062 - RNA, 24 nt, Haemophilus influenzae Rd
uuucuucguuaaaguugcugaaua

SEQ ID NO: 676063 - RNA, 22 nt, Haemophilus influenzae Rd
uuucuuauuauacauuuaacca

SEQ ID NO: 676064 - RNA, 12 nt, Haemophilus influenzae Rd
uuucuugcuaaa

SEQ ID NO: 676065 - RNA, 15 nt, Haemophilus influenzae Rd
uuucuugcuaaaaua

SEQ ID NO: 676066 - RNA, 23 nt, Haemophilus influenzae Rd
uuucuugcuguugguuaaaaaua

SEQ ID NO: 676067 - RNA, 17 nt, Haemophilus influenzae Rd
uuucuuuucuucuaauu

SEQ ID NO: 676068 - RNA, 22 nt, Haemophilus influenzae Rd
uuucuggguuuuaaaauaguua

SEQ ID NO: 676069 - RNA, 18 nt, Haemophilus influenzae Rd
uuucuuauauauaaaaua

SEQ ID NO: 676070 - RNA, 21 nt, Haemophilus influenzae Rd
uuucuuaugaaaaaaaauuua

SEQ ID NO: 676071 - RNA, 14 nt, Haemophilus influenzae Rd
uuucugcaauuuua

SEQ ID NO: 676072 - RNA, 20 nt, Haemophilus influenzae Rd
uuucucuagccgaacaagcc

SEQ ID NO: 676073 - RNA, 16 nt, Haemophilus influenzae Rd
uuucgcggaauuucag

SEQ ID NO: 676074 - RNA, 23 nt, Haemophilus influenzae Rd
uuucgcugcgaugugaccacgga

SEQ ID NO: 676075 - RNA, 19 nt, Haemophilus influenzae Rd
uuuccccacuuaucuuaaa

SEQ ID NO: 676076 - RNA, 21 nt, Haemophilus influenzae Rd
uuuccgcacuuuuuauucaaa

SEQ ID NO: 676077 - RNA, 14 nt, Haemophilus influenzae Rd
uuucccucaaaauu

SEQ ID NO: 676078 - RNA, 13 nt, Haemophilus influenzae Rd
uuuaauuaaaaua

SEQ ID NO: 676079 - RNA, 20 nt, Haemophilus influenzae Rd
uuuacaacgccaucuuuaaa

SEQ ID NO: 676080 - RNA, 21 nt, Haemophilus influenzae Rd
uuuaauuuauuuucuaauaag

SEQ ID NO: 676081 - RNA, 13 nt, Haemophilus influenzae Rd
uuuaaauuuuccu

SEQ ID NO: 676082 - RNA, 15 nt, Haemophilus influenzae Rd
uuuaauuucuucaac

SEQ ID NO: 676083 - RNA, 15 nt, Haemophilus influenzae Rd
uuuaaaacacgaaaa

SEQ ID NO: 676084 - RNA, 23 nt, Haemophilus influenzae Rd
uuuaaaacgcgcauuaaacugga

SEQ ID NO: 676085 - RNA, 20 nt, Haemophilus influenzae Rd
uuuaaacuugaauaauaacg

SEQ ID NO: 676086 - RNA, 22 nt, Haemophilus influenzae Rd
uuuaacacgaaaccaacgaaaa

SEQ ID NO: 676087 - RNA, 17 nt, Haemophilus influenzae Rd
uuuaaauucuucgaaaa

SEQ ID NO: 676088 - RNA, 13 nt, Haemophilus influenzae Rd
uuuaaauauaauu

SEQ ID NO: 676089 - RNA, 12 nt, Haemophilus influenzae Rd
uuuaaauauuuu

SEQ ID NO: 676090 - RNA, 21 nt, Haemophilus influenzae Rd
uuuaaaucaauuaacuauuua

SEQ ID NO: 676091 - RNA, 18 nt, Haemophilus influenzae Rd
uuuuaauuuuaguuaucu

SEQ ID NO: 676092 - RNA, 12 nt, Haemophilus influenzae Rd
uuuuaauucagg

SEQ ID NO: 676093 - RNA, 16 nt, Haemophilus influenzae Rd
uuuguaaacgccauca

SEQ ID NO: 676094 - RNA, 16 nt, Haemophilus influenzae Rd
uuuguaauaaauuuua

SEQ ID NO: 676095 - RNA, 18 nt, Haemophilus influenzae Rd
uuuguaauugcucuaauu

SEQ ID NO: 676096 - RNA, 17 nt, Haemophilus influenzae Rd
uuugucugaaauuuuua

SEQ ID NO: 676097 - RNA, 18 nt, Haemophilus influenzae Rd
uuugucccaaaauauuuu

SEQ ID NO: 676098 - RNA, 17 nt, Haemophilus influenzae Rd
uuugcuaauuuauccaa

SEQ ID NO: 676099 - RNA, 24 nt, Haemophilus influenzae Rd
uuugcuaaacccacuucacaacuu

SEQ ID NO: 676100 - RNA, 13 nt, Haemophilus influenzae Rd
uuuggaauaaacu

SEQ ID NO: 676101 - RNA, 23 nt, Haemophilus influenzae Rd
uuuggaaugaagugaaagauaaa

SEQ ID NO: 676102 - RNA, 12 nt, Haemophilus influenzae Rd
uuuggguuaaau

SEQ ID NO: 676103 - RNA, 16 nt, Haemophilus influenzae Rd
uuuggguuaaauaaug

SEQ ID NO: 676104 - RNA, 19 nt, Haemophilus influenzae Rd
uuugauaauacacguuaau

SEQ ID NO: 676105 - RNA, 13 nt, Haemophilus influenzae Rd
uuugacauauuuu

SEQ ID NO: 676106 - RNA, 16 nt, Haemophilus influenzae Rd
uuugacgaaauaaaug

SEQ ID NO: 676107 - RNA, 13 nt, Haemophilus influenzae Rd
uuugaauaaauau

SEQ ID NO: 676108 - RNA, 15 nt, Haemophilus influenzae Rd
uuugaauuaauaacg

SEQ ID NO: 676109 - RNA, 22 nt, Haemophilus influenzae Rd
uuugcaauaaauucguacaaau

SEQ ID NO: 676110 - RNA, 22 nt, Haemophilus influenzae Rd
uuugaugaaaguugaauauuuu

SEQ ID NO: 676111 - RNA, 14 nt, Haemophilus influenzae Rd
uuugauuaccacga

SEQ ID NO: 676112 - RNA, 19 nt, Haemophilus influenzae Rd
aauggcaacgccaauaaaa

SEQ ID NO: 676113 - RNA, 23 nt, Haemophilus influenzae Rd
aauggagguuuuacauauaaaga

SEQ ID NO: 676114 - RNA, 23 nt, Haemophilus influenzae Rd
aaugcguucacgacgaagcgcau

SEQ ID NO: 676115 - RNA, 22 nt, Haemophilus influenzae Rd
aaugaucaaaucaaauuuuccu

SEQ ID NO: 676116 - RNA, 23 nt, Haemophilus influenzae Rd
aaugaugaaacugaaccagccau

SEQ ID NO: 676117 - RNA, 16 nt, Haemophilus influenzae Rd
aaugaucauuuugggc

SEQ ID NO: 676118 - RNA, 21 nt, Haemophilus influenzae Rd
aaugagcacgccuaauaccaa

SEQ ID NO: 676119 - RNA, 11 nt, Haemophilus influenzae Rd
aaugauaaauu

SEQ ID NO: 676120 - RNA, 23 nt, Haemophilus influenzae Rd
aauguauaaagcauaauauuccu

SEQ ID NO: 676121 - RNA, 15 nt, Haemophilus influenzae Rd
aauguagagauaaua

SEQ ID NO: 676122 - RNA, 22 nt, Haemophilus influenzae Rd
aauggcuuuucucaaaacaucu

SEQ ID NO: 676123 - RNA, 15 nt, Haemophilus influenzae Rd
aauggggcuuuuuuu

SEQ ID NO: 676124 - RNA, 14 nt, Haemophilus influenzae Rd
uuuuugcaauggcu

SEQ ID NO: 676125 - RNA, 13 nt, Haemophilus influenzae Rd
uuuuugaauaaau

SEQ ID NO: 676126 - RNA, 21 nt, Haemophilus influenzae Rd
aaugaacaaaaaauuaaccgc

SEQ ID NO: 676127 - RNA, 20 nt, Haemophilus influenzae Rd
aaucgguuucacaaaacgca

SEQ ID NO: 676128 - RNA, 15 nt, Haemophilus influenzae Rd
aaucguccaauuuca

SEQ ID NO: 676129 - RNA, 16 nt, Haemophilus influenzae Rd
aaucuacuaaaauaag

SEQ ID NO: 676130 - RNA, 18 nt, Haemophilus influenzae Rd
aaucuacucguuuacuau

SEQ ID NO: 676131 - RNA, 19 nt, Haemophilus influenzae Rd
uuuuuacugcuucauaaau

SEQ ID NO: 676132 - RNA, 18 nt, Haemophilus influenzae Rd
uuuuuacuuuuacaaucc

SEQ ID NO: 676133 - RNA, 15 nt, Haemophilus influenzae Rd
uuuuguuuauuuacu

SEQ ID NO: 676134 - RNA, 22 nt, Haemophilus influenzae Rd
uuuuuauuaauuauaaaauagc

SEQ ID NO: 676135 - RNA, 12 nt, Haemophilus influenzae Rd
uuuuuauuuauu

SEQ ID NO: 676136 - RNA, 12 nt, Haemophilus influenzae Rd
uuuuuauuaucu

SEQ ID NO: 676137 - RNA, 17 nt, Haemophilus influenzae Rd
uuuuaggacuaaaucaa

SEQ ID NO: 676138 - RNA, 14 nt, Haemophilus influenzae Rd
uuuuaggacuugug

SEQ ID NO: 676139 - RNA, 12 nt, Haemophilus influenzae Rd
uuuuuauuuucu

SEQ ID NO: 676140 - RNA, 15 nt, Haemophilus influenzae Rd
uuuuucaaaaagaua

SEQ ID NO: 676141 - RNA, 11 nt, Haemophilus influenzae Rd
uguggcaaaau

SEQ ID NO: 676142 - RNA, 18 nt, Haemophilus influenzae Rd
ugugcgauuaacaauaau

SEQ ID NO: 676143 - RNA, 23 nt, Haemophilus influenzae Rd
ugugcgauuuucucuugcagaac

SEQ ID NO: 676144 - RNA, 17 nt, Haemophilus influenzae Rd
ugugccauguacauuaa

SEQ ID NO: 676145 - RNA, 15 nt, Haemophilus influenzae Rd
uguuacaucuucaaa

SEQ ID NO: 676146 - RNA, 19 nt, Haemophilus influenzae Rd
uguucaacaaguaaaucaa

SEQ ID NO: 676147 - RNA, 14 nt, Haemophilus influenzae Rd
ugucacaauauuug

SEQ ID NO: 676148 - RNA, 17 nt, Haemophilus influenzae Rd
ugugacauuggauuaau

SEQ ID NO: 676149 - RNA, 16 nt, Haemophilus influenzae Rd
ugugaaugcaauauuc

SEQ ID NO: 676150 - RNA, 24 nt, Haemophilus influenzae Rd
uguugcagggaaagucgcaguauu

SEQ ID NO: 676151 - RNA, 21 nt, Haemophilus influenzae Rd
uguugaauaguaaagaauauu

SEQ ID NO: 676152 - RNA, 20 nt, Haemophilus influenzae Rd
uguugaaacagguaauuucu

SEQ ID NO: 676153 - RNA, 22 nt, Haemophilus influenzae Rd
uuaaauaaaaaugaugauaauu

SEQ ID NO: 676154 - RNA, 20 nt, Haemophilus influenzae Rd
uuaaagccauuuugcucaaa

SEQ ID NO: 676155 - RNA, 21 nt, Haemophilus influenzae Rd
uuaaaucuuuaccuuguaaac

SEQ ID NO: 676156 - RNA, 18 nt, Haemophilus influenzae Rd
uuaaaugauuaucuugua

SEQ ID NO: 676157 - RNA, 23 nt, Haemophilus influenzae Rd
uuaaagugcgguagaaauuacca

SEQ ID NO: 676158 - RNA, 14 nt, Haemophilus influenzae Rd
uuaaacguugaauc

SEQ ID NO: 676159 - RNA, 16 nt, Haemophilus influenzae Rd
uuaaacucgaaggaaa

SEQ ID NO: 676160 - RNA, 20 nt, Haemophilus influenzae Rd
uuaaacugccgccuucuucc

SEQ ID NO: 676161 - RNA, 16 nt, Haemophilus influenzae Rd
uuaaagaaaauauuua

SEQ ID NO: 676162 - RNA, 17 nt, Haemophilus influenzae Rd
uuaaacgauaaaagggu

SEQ ID NO: 676163 - RNA, 12 nt, Haemophilus influenzae Rd
uuaaaaugguuu

SEQ ID NO: 676164 - RNA, 18 nt, Haemophilus influenzae Rd
uuaacacaugcaagucga

SEQ ID NO: 676165 - RNA, 13 nt, Haemophilus influenzae Rd
uuaacaaauaauu

SEQ ID NO: 676166 - RNA, 22 nt, Haemophilus influenzae Rd
uuaacaaauucacugucuucca

SEQ ID NO: 676167 - RNA, 17 nt, Haemophilus influenzae Rd
uuaaauguuaauggcuu

SEQ ID NO: 676168 - RNA, 13 nt, Haemophilus influenzae Rd
uuaaauuaaaacc

SEQ ID NO: 676169 - RNA, 23 nt, Haemophilus influenzae Rd
uuaaauccacgccagcuacaucu

SEQ ID NO: 676170 - RNA, 19 nt, Haemophilus influenzae Rd
uuaauaaugcuaauuucaa

SEQ ID NO: 676171 - RNA, 17 nt, Haemophilus influenzae Rd
uuaaccguaauuucaaa

SEQ ID NO: 676172 - RNA, 20 nt, Haemophilus influenzae Rd
uuaauacugcugaauaaacc

SEQ ID NO: 676173 - RNA, 16 nt, Haemophilus influenzae Rd
uuaauagauucuugcg

SEQ ID NO: 676174 - RNA, 13 nt, Haemophilus influenzae Rd
uuaaucaauuaaa

SEQ ID NO: 676175 - RNA, 14 nt, Haemophilus influenzae Rd
uuacagaaauauua

SEQ ID NO: 676176 - RNA, 21 nt, Haemophilus influenzae Rd
uuaccaaccgaauauaugguu

SEQ ID NO: 676177 - RNA, 17 nt, Haemophilus influenzae Rd
uuaccaaccgguaaaau

SEQ ID NO: 676178 - RNA, 15 nt, Haemophilus influenzae Rd
uuaccaauuugugcg

SEQ ID NO: 676179 - RNA, 15 nt, Haemophilus influenzae Rd
uuacacgaauuaacg

SEQ ID NO: 676180 - RNA, 12 nt, Haemophilus influenzae Rd
uuaaucgaucaa

SEQ ID NO: 676181 - RNA, 16 nt, Haemophilus influenzae Rd
uuaaucugcaccuuaa

SEQ ID NO: 676182 - RNA, 17 nt, Haemophilus influenzae Rd
uuauaaaaauauuuuaa

SEQ ID NO: 676183 - RNA, 23 nt, Haemophilus influenzae Rd
uuaguucaaggacugaguucugu

SEQ ID NO: 676184 - RNA, 14 nt, Haemophilus influenzae Rd
uuaguucagucggu

SEQ ID NO: 676185 - RNA, 19 nt, Haemophilus influenzae Rd
uuaguuguuucaccauuuc

SEQ ID NO: 676186 - RNA, 19 nt, Haemophilus influenzae Rd
uuaguuucuaauucuucca

SEQ ID NO: 676187 - RNA, 21 nt, Haemophilus influenzae Rd
uuauaagauaagggcguagau

SEQ ID NO: 676188 - RNA, 12 nt, Haemophilus influenzae Rd
uuaucaauaaag

SEQ ID NO: 676189 - RNA, 20 nt, Haemophilus influenzae Rd
uuaggaucguugaaugcacu

SEQ ID NO: 676190 - RNA, 16 nt, Haemophilus influenzae Rd
uuaguaauaaauucaa

SEQ ID NO: 676191 - RNA, 13 nt, Haemophilus influenzae Rd
uuagucauacaga

SEQ ID NO: 676192 - RNA, 18 nt, Haemophilus influenzae Rd
uuaguaguuagaauuuua

SEQ ID NO: 676193 - RNA, 23 nt, Haemophilus influenzae Rd
uuaguccuuaaacaaauguaucu

SEQ ID NO: 676194 - RNA, 19 nt, Haemophilus influenzae Rd
uuacgugauuuaguugggu

SEQ ID NO: 676195 - RNA, 17 nt, Haemophilus influenzae Rd
uuacgugcgaauuuuua

SEQ ID NO: 676196 - RNA, 22 nt, Haemophilus influenzae Rd
uuagcuaaauacuugcuuaugc

SEQ ID NO: 676197 - RNA, 16 nt, Haemophilus influenzae Rd
uuagcggcuuuuugcu

SEQ ID NO: 676198 - RNA, 21 nt, Haemophilus influenzae Rd
uuagccuguucuuccaccgcu

SEQ ID NO: 676199 - RNA, 14 nt, Haemophilus influenzae Rd
uuagcccaccaauu

SEQ ID NO: 676200 - RNA, 12 nt, Haemophilus influenzae Rd
uuagacaaaaau

SEQ ID NO: 676201 - RNA, 17 nt, Haemophilus influenzae Rd
uuagauaaaaaccuaaa

SEQ ID NO: 676202 - RNA, 13 nt, Haemophilus influenzae Rd
uuagauaagccau

SEQ ID NO: 676203 - RNA, 20 nt, Haemophilus influenzae Rd
uuagagagaaaaaucgucaa

SEQ ID NO: 676204 - RNA, 19 nt, Haemophilus influenzae Rd
uuagauacuuuacguaaag

SEQ ID NO: 676205 - RNA, 22 nt, Haemophilus influenzae Rd
uuagagcaggcgacucauaauc

SEQ ID NO: 676206 - RNA, 20 nt, Haemophilus influenzae Rd
uucguucaacccauuuucca

SEQ ID NO: 676207 - RNA, 14 nt, Haemophilus influenzae Rd
uucguuucaagaua

SEQ ID NO: 676208 - RNA, 24 nt, Haemophilus influenzae Rd
uucguuuguuugaaaaauuaucaa

SEQ ID NO: 676209 - RNA, 20 nt, Haemophilus influenzae Rd
uucguuuugguaauuugcgu

SEQ ID NO: 676210 - RNA, 18 nt, Haemophilus influenzae Rd
uucugcucugcaccaucc

SEQ ID NO: 676211 - RNA, 12 nt, Haemophilus influenzae Rd
uucuaaugguug

SEQ ID NO: 676212 - RNA, 21 nt, Haemophilus influenzae Rd
uucuaauucaguguaauguuu

SEQ ID NO: 676213 - RNA, 13 nt, Haemophilus influenzae Rd
uucuaauucuucc

SEQ ID NO: 676214 - RNA, 21 nt, Haemophilus influenzae Rd
uucuaauuuuugcaauggcuu

SEQ ID NO: 676215 - RNA, 22 nt, Haemophilus influenzae Rd
uuccuuuggcuugaaaauauuc

SEQ ID NO: 676216 - RNA, 18 nt, Haemophilus influenzae Rd
uucgccaccuuuuaccaa

SEQ ID NO: 676217 - RNA, 16 nt, Haemophilus influenzae Rd
uuccgcuuuaauaauc

SEQ ID NO: 676218 - RNA, 14 nt, Haemophilus influenzae Rd
uucgccgaguaaau

SEQ ID NO: 676219 - RNA, 21 nt, Haemophilus influenzae Rd
uucgccgaguaaauucaccaa

SEQ ID NO: 676220 - RNA, 15 nt, Haemophilus influenzae Rd
uucgcuuaaacgaau

SEQ ID NO: 676221 - RNA, 19 nt, Haemophilus influenzae Rd
uucaucgcgcaaaauaaua

SEQ ID NO: 676222 - RNA, 18 nt, Haemophilus influenzae Rd
uucaucguaauuaaacaa

SEQ ID NO: 676223 - RNA, 17 nt, Haemophilus influenzae Rd
uucaucgucuucuucgc

SEQ ID NO: 676224 - RNA, 21 nt, Haemophilus influenzae Rd
uucaucgugagcauaacgaua

SEQ ID NO: 676225 - RNA, 19 nt, Haemophilus influenzae Rd
uucaucuaagugaaugaag

SEQ ID NO: 676226 - RNA, 19 nt, Haemophilus influenzae Rd
uucaucaauaacacucauu

SEQ ID NO: 676227 - RNA, 18 nt, Haemophilus influenzae Rd
uucagggauuaagaaaau

SEQ ID NO: 676228 - RNA, 22 nt, Haemophilus influenzae Rd
uucacuacuugaacuaauauca

SEQ ID NO: 676229 - RNA, 20 nt, Haemophilus influenzae Rd
uucacgguuauaccacauaa

SEQ ID NO: 676230 - RNA, 19 nt, Haemophilus influenzae Rd
uucacgcucguuaaaucac

SEQ ID NO: 676231 - RNA, 18 nt, Haemophilus influenzae Rd
uucaccugaagaauacaa

SEQ ID NO: 676232 - RNA, 15 nt, Haemophilus influenzae Rd
uucacgauauugcac

SEQ ID NO: 676233 - RNA, 19 nt, Haemophilus influenzae Rd
uucacgaucacggcgcaau

SEQ ID NO: 676234 - RNA, 15 nt, Haemophilus influenzae Rd
uucaggagaaucaga

SEQ ID NO: 676235 - RNA, 20 nt, Haemophilus influenzae Rd
uucagcaagaaacucaaggu

SEQ ID NO: 676236 - RNA, 15 nt, Haemophilus influenzae Rd
uucagauuucuucgc

SEQ ID NO: 676237 - RNA, 13 nt, Haemophilus influenzae Rd
uuccagugguaaa

SEQ ID NO: 676238 - RNA, 16 nt, Haemophilus influenzae Rd
uuccaggaaaauuuua

SEQ ID NO: 676239 - RNA, 13 nt, Haemophilus influenzae Rd
uuccauaauaacg

SEQ ID NO: 676240 - RNA, 14 nt, Haemophilus influenzae Rd
uuccgcaauauuua

SEQ ID NO: 676241 - RNA, 12 nt, Haemophilus influenzae Rd
uucccaaauauc

SEQ ID NO: 676242 - RNA, 18 nt, Haemophilus influenzae Rd
uuccauucuaaaaaaauc

SEQ ID NO: 676243 - RNA, 16 nt, Haemophilus influenzae Rd
uucccuauaaauaaac

SEQ ID NO: 676244 - RNA, 21 nt, Haemophilus influenzae Rd
uuccacuucuucuuuaaacac

SEQ ID NO: 676245 - RNA, 16 nt, Haemophilus influenzae Rd
uuccagaaaauuggcg

SEQ ID NO: 676246 - RNA, 14 nt, Haemophilus influenzae Rd
uucauuaaauuagu

SEQ ID NO: 676247 - RNA, 19 nt, Haemophilus influenzae Rd
uucauucguauaaauauuu

SEQ ID NO: 676248 - RNA, 19 nt, Haemophilus influenzae Rd
uucauuguuaaauaaaucc

SEQ ID NO: 676249 - RNA, 15 nt, Haemophilus influenzae Rd
uucauuguuucucaa

SEQ ID NO: 676250 - RNA, 13 nt, Haemophilus influenzae Rd
uucauuuaaaaca

SEQ ID NO: 676251 - RNA, 20 nt, Haemophilus influenzae Rd
uuccaauacaaucagcugcu

SEQ ID NO: 676252 - RNA, 12 nt, Haemophilus influenzae Rd
uucauuuuuugg

SEQ ID NO: 676253 - RNA, 14 nt, Haemophilus influenzae Rd
uucauuuuaaauua

SEQ ID NO: 676254 - RNA, 21 nt, Haemophilus influenzae Rd
uuccaaugugaccaaauaauc

SEQ ID NO: 676255 - RNA, 16 nt, Haemophilus influenzae Rd
aaauaugauaaaugca

SEQ ID NO: 676256 - RNA, 20 nt, Haemophilus influenzae Rd
aaauauauuuagauacaaaa

SEQ ID NO: 676257 - RNA, 17 nt, Haemophilus influenzae Rd
aaauaucuucaauuucu

SEQ ID NO: 676258 - RNA, 14 nt, Haemophilus influenzae Rd
aaauaucuuguuuu

SEQ ID NO: 676259 - RNA, 22 nt, Haemophilus influenzae Rd
aaauauagccuagaaauaucua

SEQ ID NO: 676260 - RNA, 21 nt, Haemophilus influenzae Rd
aaauaguggugccuucuucag

SEQ ID NO: 676261 - RNA, 18 nt, Haemophilus influenzae Rd
aaauagcuaacaaauuua

SEQ ID NO: 676262 - RNA, 22 nt, Haemophilus influenzae Rd
aaauaggcacauaaguaaaaua

SEQ ID NO: 676263 - RNA, 16 nt, Haemophilus influenzae Rd
aaaguugagaauuuuu

SEQ ID NO: 676264 - RNA, 12 nt, Haemophilus influenzae Rd
aaaguugauauu

SEQ ID NO: 676265 - RNA, 19 nt, Haemophilus influenzae Rd
aaaguuaucaaacaguuca

SEQ ID NO: 676266 - RNA, 17 nt, Haemophilus influenzae Rd
aaauacagccacuauua

SEQ ID NO: 676267 - RNA, 20 nt, Haemophilus influenzae Rd
aaauagauacaagaaagaaa

SEQ ID NO: 676268 - RNA, 19 nt, Haemophilus influenzae Rd
aaauagagcaaauauaaau

SEQ ID NO: 676269 - RNA, 19 nt, Haemophilus influenzae Rd
aaauaccgcaccuuuccag

SEQ ID NO: 676270 - RNA, 17 nt, Haemophilus influenzae Rd
aaauaccgcacuuuuau

SEQ ID NO: 676271 - RNA, 18 nt, Haemophilus influenzae Rd
aaauaccgcacuuuuauu

SEQ ID NO: 676272 - RNA, 13 nt, Haemophilus influenzae Rd
aaauacguuguuu

SEQ ID NO: 676273 - RNA, 18 nt, Haemophilus influenzae Rd
aaaaauacggugaaauuu

SEQ ID NO: 676274 - RNA, 23 nt, Haemophilus influenzae Rd
aaaaauauccguuacauauuuca

SEQ ID NO: 676275 - RNA, 15 nt, Haemophilus influenzae Rd
aaaaauggcuuuaau

SEQ ID NO: 676276 - RNA, 16 nt, Haemophilus influenzae Rd
aaaaauggcuuuaauu

SEQ ID NO: 676277 - RNA, 22 nt, Haemophilus influenzae Rd
aaaaauggguuaaagcuucauu

SEQ ID NO: 676278 - RNA, 13 nt, Haemophilus influenzae Rd
aaaaauguaauuc

SEQ ID NO: 676279 - RNA, 15 nt, Haemophilus influenzae Rd
aaaaauuaaauugua

SEQ ID NO: 676280 - RNA, 18 nt, Haemophilus influenzae Rd
aaaaauucaaugaaaugc

SEQ ID NO: 676281 - RNA, 19 nt, Haemophilus influenzae Rd
aaaggcgaacauaacuuuu

SEQ ID NO: 676282 - RNA, 16 nt, Haemophilus influenzae Rd
aaaguauuaaauuuuu

SEQ ID NO: 676283 - RNA, 15 nt, Haemophilus influenzae Rd
aaagugcggcaaaaa

SEQ ID NO: 676284 - RNA, 17 nt, Haemophilus influenzae Rd
aaagugcgguaauuuuu

SEQ ID NO: 676285 - RNA, 18 nt, Haemophilus influenzae Rd
aaagugcggucaauuuuu

SEQ ID NO: 676286 - RNA, 17 nt, Haemophilus influenzae Rd
aaagugcggucauuuuu

SEQ ID NO: 676287 - RNA, 17 nt, Haemophilus influenzae Rd
aaaggacuaagcuuuuu

SEQ ID NO: 676288 - RNA, 21 nt, Haemophilus influenzae Rd
aaagcuugcuuucuugcugac

SEQ ID NO: 676289 - RNA, 23 nt, Haemophilus influenzae Rd
aaagcuucauuugcuuuaaccca

SEQ ID NO: 676290 - RNA, 20 nt, Haemophilus influenzae Rd
aaaggaauggcaaagaauac

SEQ ID NO: 676291 - RNA, 14 nt, Haemophilus influenzae Rd
aaaaaacguuaaau

SEQ ID NO: 676292 - RNA, 12 nt, Haemophilus influenzae Rd
aaaaaacucuuc

SEQ ID NO: 676293 - RNA, 12 nt, Haemophilus influenzae Rd
aaaaaagccuug

SEQ ID NO: 676294 - RNA, 13 nt, Haemophilus influenzae Rd
aaaaacaauacua

SEQ ID NO: 676295 - RNA, 13 nt, Haemophilus influenzae Rd
aaaaaacauuaau

SEQ ID NO: 676296 - RNA, 22 nt, Haemophilus influenzae Rd
aaacgaugaaguuuucauuaaa

SEQ ID NO: 676297 - RNA, 17 nt, Haemophilus influenzae Rd
aaacgaucaucuauacc

SEQ ID NO: 676298 - RNA, 13 nt, Haemophilus influenzae Rd
aaacgcacuuuuu

SEQ ID NO: 676299 - RNA, 18 nt, Haemophilus influenzae Rd
aaacguugugaacuuugu

SEQ ID NO: 676300 - RNA, 17 nt, Haemophilus influenzae Rd
aaacgugcaauuaauuc

SEQ ID NO: 676301 - RNA, 22 nt, Haemophilus influenzae Rd
aaacugaugauggccaugacaa

SEQ ID NO: 676302 - RNA, 20 nt, Haemophilus influenzae Rd
aaacucuugugccaaauuca

SEQ ID NO: 676303 - RNA, 22 nt, Haemophilus influenzae Rd
aaacucgacuuuugcauuugcu

SEQ ID NO: 676304 - RNA, 12 nt, Haemophilus influenzae Rd
aaagauaaaaca

SEQ ID NO: 676305 - RNA, 16 nt, Haemophilus influenzae Rd
aaagauauaaacugau

SEQ ID NO: 676306 - RNA, 21 nt, Haemophilus influenzae Rd
aaagaucaggaucaaaaauau

SEQ ID NO: 676307 - RNA, 12 nt, Haemophilus influenzae Rd
aaagauaaauua

SEQ ID NO: 676308 - RNA, 13 nt, Haemophilus influenzae Rd
aaaaagcuaaaaa

SEQ ID NO: 676309 - RNA, 18 nt, Haemophilus influenzae Rd
aacagcuaccaauucaaa

SEQ ID NO: 676310 - RNA, 14 nt, Haemophilus influenzae Rd
aacacuuuuucuau

SEQ ID NO: 676311 - RNA, 12 nt, Haemophilus influenzae Rd
aacaagcauuuu

SEQ ID NO: 676312 - RNA, 16 nt, Haemophilus influenzae Rd
aaaagccacuuucaau

SEQ ID NO: 676313 - RNA, 22 nt, Haemophilus influenzae Rd
aaaaggaaauaauuuccuuuuu

SEQ ID NO: 676314 - RNA, 18 nt, Haemophilus influenzae Rd
aaaaggcgugauauuuuu

SEQ ID NO: 676315 - RNA, 19 nt, Haemophilus influenzae Rd
aaaugggcgggcaaaccgu

SEQ ID NO: 676316 - RNA, 23 nt, Haemophilus influenzae Rd
aaauguagaucgacuccacuuug

SEQ ID NO: 676317 - RNA, 19 nt, Haemophilus influenzae Rd
aaaugcuuuugccgaaaau

SEQ ID NO: 676318 - RNA, 12 nt, Haemophilus influenzae Rd
aaauggcaaaca

SEQ ID NO: 676319 - RNA, 19 nt, Haemophilus influenzae Rd
aaauggcgaccacgaaaau

SEQ ID NO: 676320 - RNA, 21 nt, Haemophilus influenzae Rd
aaaugccuuuccguucauaaa

SEQ ID NO: 676321 - RNA, 16 nt, Haemophilus influenzae Rd
aaaugcgcuuuuaauu

SEQ ID NO: 676322 - RNA, 15 nt, Haemophilus influenzae Rd
aaaugcggacuuuuu

SEQ ID NO: 676323 - RNA, 14 nt, Haemophilus influenzae Rd
aaaucuaagccuug

SEQ ID NO: 676324 - RNA, 18 nt, Haemophilus influenzae Rd
aaaucuauuccuuucuuu

SEQ ID NO: 676325 - RNA, 13 nt, Haemophilus influenzae Rd
aaaucuacuuuau

SEQ ID NO: 676326 - RNA, 14 nt, Haemophilus influenzae Rd
aaaucuacuuuauu

SEQ ID NO: 676327 - RNA, 17 nt, Haemophilus influenzae Rd
aaaucaaagugcgguaa

SEQ ID NO: 676328 - RNA, 19 nt, Haemophilus influenzae Rd
aaauauuuuuuauuuuuuu

SEQ ID NO: 676329 - RNA, 18 nt, Haemophilus influenzae Rd
aaauauuuuccccuuucc

SEQ ID NO: 676330 - RNA, 20 nt, Haemophilus influenzae Rd
aaaucaaucaggcuuucauu

SEQ ID NO: 676331 - RNA, 19 nt, Haemophilus influenzae Rd
aaaucaaccgcacuuuauu

SEQ ID NO: 676332 - RNA, 15 nt, Haemophilus influenzae Rd
aaaucacgaauugau

SEQ ID NO: 676333 - RNA, 19 nt, Haemophilus influenzae Rd
aaaucaccgcacuuuuauu

SEQ ID NO: 676334 - RNA, 19 nt, Haemophilus influenzae Rd
aaaucaccgcacuuuuugu

SEQ ID NO: 676335 - RNA, 17 nt, Haemophilus influenzae Rd
aaauucuauuaaaauau

SEQ ID NO: 676336 - RNA, 16 nt, Haemophilus influenzae Rd
aaauucucaagaauau

SEQ ID NO: 676337 - RNA, 16 nt, Haemophilus influenzae Rd
aaauuaucaaagaauu

SEQ ID NO: 676338 - RNA, 23 nt, Haemophilus influenzae Rd
aaauuaucguuuacuuaaaaucu

SEQ ID NO: 676339 - RNA, 18 nt, Haemophilus influenzae Rd
aaauuaucugcucucauu

SEQ ID NO: 676340 - RNA, 21 nt, Haemophilus influenzae Rd
aaauugcuggauucaguugau

SEQ ID NO: 676341 - RNA, 23 nt, Haemophilus influenzae Rd
aaauuguguguuuuaaaccaccg

SEQ ID NO: 676342 - RNA, 19 nt, Haemophilus influenzae Rd
aaauugacggcuucagaaa

SEQ ID NO: 676343 - RNA, 21 nt, Haemophilus influenzae Rd
aaaagagugcgguuaauuuug

SEQ ID NO: 676344 - RNA, 19 nt, Haemophilus influenzae Rd
aaaagauacacucacuuuu

SEQ ID NO: 676345 - RNA, 14 nt, Haemophilus influenzae Rd
aaaagcccaaaugc

SEQ ID NO: 676346 - RNA, 13 nt, Haemophilus influenzae Rd
aaccgcauuacuu

SEQ ID NO: 676347 - RNA, 15 nt, Haemophilus influenzae Rd
aaccgcacuuuaaau

SEQ ID NO: 676348 - RNA, 19 nt, Haemophilus influenzae Rd
aaccgcacuuucauuccau

SEQ ID NO: 676349 - RNA, 15 nt, Haemophilus influenzae Rd
aaccgcacuuuuaau

SEQ ID NO: 676350 - RNA, 16 nt, Haemophilus influenzae Rd
aaccgcacuuuuauau

SEQ ID NO: 676351 - RNA, 16 nt, Haemophilus influenzae Rd
aaccgcacuuuuuaau

SEQ ID NO: 676352 - RNA, 14 nt, Haemophilus influenzae Rd
aaccgauuuuaaau

SEQ ID NO: 676353 - RNA, 22 nt, Haemophilus influenzae Rd
aaccauuguuuaauucgugcca

SEQ ID NO: 676354 - RNA, 14 nt, Haemophilus influenzae Rd
aaccauuuuacaau

SEQ ID NO: 676355 - RNA, 16 nt, Haemophilus influenzae Rd
aaccauuaaauaggca

SEQ ID NO: 676356 - RNA, 14 nt, Haemophilus influenzae Rd
aaccauuaacccca

SEQ ID NO: 676357 - RNA, 20 nt, Haemophilus influenzae Rd
aaccagcuuuccaaugcgcg

SEQ ID NO: 676358 - RNA, 16 nt, Haemophilus influenzae Rd
aacauaguaaauuuua

SEQ ID NO: 676359 - RNA, 21 nt, Haemophilus influenzae Rd
aacaucaacgguuuucauugc

SEQ ID NO: 676360 - RNA, 17 nt, Haemophilus influenzae Rd
aacaucuuguuuuaauu

SEQ ID NO: 676361 - RNA, 14 nt, Haemophilus influenzae Rd
aacaucaucaucgc

SEQ ID NO: 676362 - RNA, 13 nt, Haemophilus influenzae Rd
aacauuucaucgc

SEQ ID NO: 676363 - RNA, 14 nt, Haemophilus influenzae Rd
aacauucccuuucc

SEQ ID NO: 676364 - RNA, 17 nt, Haemophilus influenzae Rd
aacauuuuuauuuuuac

SEQ ID NO: 676365 - RNA, 13 nt, Haemophilus influenzae Rd
aaccaaaauacaa

SEQ ID NO: 676366 - RNA, 20 nt, Haemophilus influenzae Rd
aaccaaaaucuaaaccagca

SEQ ID NO: 676367 - RNA, 18 nt, Haemophilus influenzae Rd
aaccaacguggcuuuucu

SEQ ID NO: 676368 - RNA, 19 nt, Haemophilus influenzae Rd
aacgguaacugauuuugcu

SEQ ID NO: 676369 - RNA, 15 nt, Haemophilus influenzae Rd
aacgguugaaauugc

SEQ ID NO: 676370 - RNA, 16 nt, Haemophilus influenzae Rd
aacgguugaaauugcg

SEQ ID NO: 676371 - RNA, 19 nt, Haemophilus influenzae Rd
aacgguuaauaaauucuug

SEQ ID NO: 676372 - RNA, 17 nt, Haemophilus influenzae Rd
aacguauuuauaccaga

SEQ ID NO: 676373 - RNA, 15 nt, Haemophilus influenzae Rd
aacggcaagcaaaca

SEQ ID NO: 676374 - RNA, 13 nt, Haemophilus influenzae Rd
aacgcuuuuaaac

SEQ ID NO: 676375 - RNA, 13 nt, Haemophilus influenzae Rd
aaccuuuuucuaa

SEQ ID NO: 676376 - RNA, 23 nt, Haemophilus influenzae Rd
aaccuuggaaauuaacaauacga

SEQ ID NO: 676377 - RNA, 15 nt, Haemophilus influenzae Rd
aaccuuguccgccac

SEQ ID NO: 676378 - RNA, 20 nt, Haemophilus influenzae Rd
aacgaugaagaaaauuucug

SEQ ID NO: 676379 - RNA, 18 nt, Haemophilus influenzae Rd
aaccuuucauauaaauaa

SEQ ID NO: 676380 - RNA, 19 nt, Haemophilus influenzae Rd
aacgcauauuuuguucuac

SEQ ID NO: 676381 - RNA, 16 nt, Haemophilus influenzae Rd
aagcacgauuuucaau

SEQ ID NO: 676382 - RNA, 16 nt, Haemophilus influenzae Rd
aagcaaauagcgagua

SEQ ID NO: 676383 - RNA, 14 nt, Haemophilus influenzae Rd
aagauuucuucuac

SEQ ID NO: 676384 - RNA, 19 nt, Haemophilus influenzae Rd
aagcaauagaacgcacaca

SEQ ID NO: 676385 - RNA, 15 nt, Haemophilus influenzae Rd
aagauuaauuuuccu

SEQ ID NO: 676386 - RNA, 22 nt, Haemophilus influenzae Rd
aagauuuauguugaauuuucac

SEQ ID NO: 676387 - RNA, 21 nt, Haemophilus influenzae Rd
aagauggcuauuuaagccuug

SEQ ID NO: 676388 - RNA, 15 nt, Haemophilus influenzae Rd
aagaugaaagugcgg

SEQ ID NO: 676389 - RNA, 15 nt, Haemophilus influenzae Rd
aagauagggcugcau

SEQ ID NO: 676390 - RNA, 21 nt, Haemophilus influenzae Rd
aagaucaguuaccauacauuc

SEQ ID NO: 676391 - RNA, 18 nt, Haemophilus influenzae Rd
aacguuuuaaguuuucac

SEQ ID NO: 676392 - RNA, 19 nt, Haemophilus influenzae Rd
aacguuuuaauccuuccaa

SEQ ID NO: 676393 - RNA, 17 nt, Haemophilus influenzae Rd
aacuaauuguuuuaaaa

SEQ ID NO: 676394 - RNA, 19 nt, Haemophilus influenzae Rd
aacuaaaagggucaaugcc

SEQ ID NO: 676395 - RNA, 14 nt, Haemophilus influenzae Rd
aacguuauaaacaa

SEQ ID NO: 676396 - RNA, 23 nt, Haemophilus influenzae Rd
aagauaaggacgaaggauaaauu

SEQ ID NO: 676397 - RNA, 21 nt, Haemophilus influenzae Rd
aagaguuuccuuauauucaga

SEQ ID NO: 676398 - RNA, 23 nt, Haemophilus influenzae Rd
aagcuaauugguaaaauuaagca

SEQ ID NO: 676399 - RNA, 14 nt, Haemophilus influenzae Rd
aagcucgcuauuuu

SEQ ID NO: 676400 - RNA, 13 nt, Haemophilus influenzae Rd
aagcucgaaguuu

SEQ ID NO: 676401 - RNA, 18 nt, Haemophilus influenzae Rd
aagcuauucauaccgaua

SEQ ID NO: 676402 - RNA, 18 nt, Haemophilus influenzae Rd
aagcaucgcuggauaaau

SEQ ID NO: 676403 - RNA, 22 nt, Haemophilus influenzae Rd
aagcaucgcuggauaaaugccg

SEQ ID NO: 676404 - RNA, 12 nt, Haemophilus influenzae Rd
aagcauuaaguu

SEQ ID NO: 676405 - RNA, 22 nt, Haemophilus influenzae Rd
aagcauauuugcugcacgaguu

SEQ ID NO: 676406 - RNA, 20 nt, Haemophilus influenzae Rd
aagcagguuuuucuuuuaau

SEQ ID NO: 676407 - RNA, 17 nt, Haemophilus influenzae Rd
aagcaguuuauugagcg

SEQ ID NO: 676408 - RNA, 17 nt, Haemophilus influenzae Rd
aagccugcaaagccuuc

SEQ ID NO: 676409 - RNA, 21 nt, Haemophilus influenzae Rd
aagcgaggauaaugcugagua

SEQ ID NO: 676410 - RNA, 13 nt, Haemophilus influenzae Rd
aagccuuuuaaaa

SEQ ID NO: 676411 - RNA, 13 nt, Haemophilus influenzae Rd
aagccuuuuauuu

SEQ ID NO: 676412 - RNA, 17 nt, Haemophilus influenzae Rd
aaguaaacaauuuuccu

SEQ ID NO: 676413 - RNA, 16 nt, Haemophilus influenzae Rd
aagguuuccaagaauu

SEQ ID NO: 676414 - RNA, 20 nt, Haemophilus influenzae Rd
aaggguaucuaaauuugcug

SEQ ID NO: 676415 - RNA, 15 nt, Haemophilus influenzae Rd
aaguagaaauugcca

SEQ ID NO: 676416 - RNA, 12 nt, Haemophilus influenzae Rd
aaguaaugcgau

SEQ ID NO: 676417 - RNA, 23 nt, Haemophilus influenzae Rd
aaguaggcugaauacauuaagua

SEQ ID NO: 676418 - RNA, 14 nt, Haemophilus influenzae Rd
aaguauuuuucuaa

SEQ ID NO: 676419 - RNA, 15 nt, Haemophilus influenzae Rd
aagucaaaauaagua

SEQ ID NO: 676420 - RNA, 18 nt, Haemophilus influenzae Rd
aaggcuuuucuuuuauac

SEQ ID NO: 676421 - RNA, 18 nt, Haemophilus influenzae Rd
aaggaauauucuuuaaau

SEQ ID NO: 676422 - RNA, 19 nt, Haemophilus influenzae Rd
aaggcgagggauuuuaaau

SEQ ID NO: 676423 - RNA, 15 nt, Haemophilus influenzae Rd
aaguuuguuuuuuac

SEQ ID NO: 676424 - RNA, 11 nt, Haemophilus influenzae Rd
aaguuuucuac

SEQ ID NO: 676425 - RNA, 23 nt, Haemophilus influenzae Rd
aaguuugagcaaaucaaaaccuu

SEQ ID NO: 676426 - RNA, 13 nt, Haemophilus influenzae Rd
aaguccaaguuuu

SEQ ID NO: 676427 - RNA, 17 nt, Haemophilus influenzae Rd
aauaacuuuauuuacaa

SEQ ID NO: 676428 - RNA, 21 nt, Haemophilus influenzae Rd
aauaagaauacaaauucgcca

SEQ ID NO: 676429 - RNA, 16 nt, Haemophilus influenzae Rd
aauaagcccaacuuaa

SEQ ID NO: 676430 - RNA, 13 nt, Haemophilus influenzae Rd
aauaagcgauugc

SEQ ID NO: 676431 - RNA, 13 nt, Haemophilus influenzae Rd
aauaaaaaguggg

SEQ ID NO: 676432 - RNA, 23 nt, Haemophilus influenzae Rd
aauaaaaauauauuuagauacaa

SEQ ID NO: 676433 - RNA, 17 nt, Haemophilus influenzae Rd
aauaacgauaagauuug

SEQ ID NO: 676434 - RNA, 21 nt, Haemophilus influenzae Rd
aauaaaccguuagguuuaaaa

SEQ ID NO: 676435 - RNA, 22 nt, Haemophilus influenzae Rd
aauaccuucuugauuauuuaau

SEQ ID NO: 676436 - RNA, 20 nt, Haemophilus influenzae Rd
aauagacugaaaaaagugcg

SEQ ID NO: 676437 - RNA, 14 nt, Haemophilus influenzae Rd
aauaccugauuucg

SEQ ID NO: 676438 - RNA, 17 nt, Haemophilus influenzae Rd
aauaauaccuuuccauu

SEQ ID NO: 676439 - RNA, 20 nt, Haemophilus influenzae Rd
aauaauuucaauauaaguug

SEQ ID NO: 676440 - RNA, 15 nt, Haemophilus influenzae Rd
aauacacaaaaucca

SEQ ID NO: 676441 - RNA, 14 nt, Haemophilus influenzae Rd
aauacaccccaaaa

SEQ ID NO: 676442 - RNA, 21 nt, Haemophilus influenzae Rd
aauacauuggguuacggcuaa

SEQ ID NO: 676443 - RNA, 15 nt, Haemophilus influenzae Rd
aauacacuucuaaaa

SEQ ID NO: 676444 - RNA, 20 nt, Haemophilus influenzae Rd
aauacacuuuaaauuuuccu

SEQ ID NO: 676445 - RNA, 23 nt, Haemophilus influenzae Rd
aauuauugcuuaugauuuagugc

SEQ ID NO: 676446 - RNA, 18 nt, Haemophilus influenzae Rd
aauuaguuuuuuauuucu

SEQ ID NO: 676447 - RNA, 14 nt, Haemophilus influenzae Rd
aauuauagagaaau

SEQ ID NO: 676448 - RNA, 15 nt, Haemophilus influenzae Rd
aauuauagagaaaua

SEQ ID NO: 676449 - RNA, 15 nt, Haemophilus influenzae Rd
aauuauagauaaaua

SEQ ID NO: 676450 - RNA, 14 nt, Haemophilus influenzae Rd
aauuauauuuuccu

SEQ ID NO: 676451 - RNA, 14 nt, Haemophilus influenzae Rd
aauuacaauacgau

SEQ ID NO: 676452 - RNA, 21 nt, Haemophilus influenzae Rd
aauuacucacuauaacuuuuc

SEQ ID NO: 676453 - RNA, 21 nt, Haemophilus influenzae Rd
aauguguuucgauacuuucuu

SEQ ID NO: 676454 - RNA, 16 nt, Haemophilus influenzae Rd
aaugucuuuuucuuac

SEQ ID NO: 676455 - RNA, 20 nt, Haemophilus influenzae Rd
aaugugagccaauggaaaua

SEQ ID NO: 676456 - RNA, 12 nt, Haemophilus influenzae Rd
aaugugauuucc

SEQ ID NO: 676457 - RNA, 20 nt, Haemophilus influenzae Rd
aaugugcgguagauuuucau

SEQ ID NO: 676458 - RNA, 23 nt, Haemophilus influenzae Rd
aaugugcgguagauuuucaucgu

SEQ ID NO: 676459 - RNA, 20 nt, Haemophilus influenzae Rd
aauguucccuauaaauaaac

SEQ ID NO: 676460 - RNA, 12 nt, Haemophilus influenzae Rd
aauucacgaaug

SEQ ID NO: 676461 - RNA, 14 nt, Haemophilus influenzae Rd
aauucuaaauucuc

SEQ ID NO: 676462 - RNA, 24 nt, Haemophilus influenzae Rd
aauucuacaccagcuuuaaccauu

SEQ ID NO: 676463 - RNA, 19 nt, Haemophilus influenzae Rd
aauuuaaggcuuuuucugc

SEQ ID NO: 676464 - RNA, 22 nt, Haemophilus influenzae Rd
aauucuuuugcuaguaagauuu

SEQ ID NO: 676465 - RNA, 21 nt, Haemophilus influenzae Rd
aauucuuuuucacuauuaccg

SEQ ID NO: 676466 - RNA, 21 nt, Haemophilus influenzae Rd
aauucuucuauuuuaucaaga

SEQ ID NO: 676467 - RNA, 21 nt, Haemophilus influenzae Rd
aauucuugacguaauucucgc

SEQ ID NO: 676468 - RNA, 14 nt, Haemophilus influenzae Rd
aauuuaccgcacuu

SEQ ID NO: 676469 - RNA, 22 nt, Haemophilus influenzae Rd
aauuuaagccuguuaugcuuua

SEQ ID NO: 676470 - RNA, 18 nt, Haemophilus influenzae Rd
aauuuaucugcuuuaauu

SEQ ID NO: 676471 - RNA, 20 nt, Haemophilus influenzae Rd
aauuugacauuccuauucua

SEQ ID NO: 676472 - RNA, 14 nt, Haemophilus influenzae Rd
aauuuauuaaaaau

SEQ ID NO: 676473 - RNA, 23 nt, Haemophilus influenzae Rd
aauuugcuguggugaagugcggu

SEQ ID NO: 676474 - RNA, 20 nt, Haemophilus influenzae Rd
aauuugagucucaaauuuuu

SEQ ID NO: 676475 - RNA, 16 nt, Haemophilus influenzae Rd
aauuugcaucauuucu

SEQ ID NO: 676476 - RNA, 15 nt, Haemophilus influenzae Rd
aaugagauuauuucu

SEQ ID NO: 676477 - RNA, 18 nt, Haemophilus influenzae Rd
aaucugcaacugaauucu

SEQ ID NO: 676478 - RNA, 15 nt, Haemophilus influenzae Rd
aaucugaaagugcgg

SEQ ID NO: 676479 - RNA, 17 nt, Haemophilus influenzae Rd
aaucucgcauugauucu

SEQ ID NO: 676480 - RNA, 22 nt, Haemophilus influenzae Rd
aaugauucaauuugaccuugaa

SEQ ID NO: 676481 - RNA, 17 nt, Haemophilus influenzae Rd
aaugaucgaguaaaaau

SEQ ID NO: 676482 - RNA, 22 nt, Haemophilus influenzae Rd
aaugaugaaacaagcuguagca

SEQ ID NO: 676483 - RNA, 15 nt, Haemophilus influenzae Rd
aaugguuugcugguc

SEQ ID NO: 676484 - RNA, 19 nt, Haemophilus influenzae Rd
aauguaaaaauuggaaaau

SEQ ID NO: 676485 - RNA, 21 nt, Haemophilus influenzae Rd
aauggcgaauuucacgcccaa

SEQ ID NO: 676486 - RNA, 13 nt, Haemophilus influenzae Rd
aauguauaaagca

SEQ ID NO: 676487 - RNA, 21 nt, Haemophilus influenzae Rd
aaugucaggcgauuuuacguu

SEQ ID NO: 676488 - RNA, 20 nt, Haemophilus influenzae Rd
aaugccugcauuaauaaucu

SEQ ID NO: 676489 - RNA, 15 nt, Haemophilus influenzae Rd
aauggaugaauacaa

SEQ ID NO: 676490 - RNA, 20 nt, Haemophilus influenzae Rd
aauccuuuugcacauuaaua

SEQ ID NO: 676491 - RNA, 18 nt, Haemophilus influenzae Rd
aaucgccuugugcgauaa

SEQ ID NO: 676492 - RNA, 18 nt, Haemophilus influenzae Rd
aaucgggcguucuuuaau

SEQ ID NO: 676493 - RNA, 16 nt, Haemophilus influenzae Rd
aaucguuugucguaau

SEQ ID NO: 676494 - RNA, 14 nt, Haemophilus influenzae Rd
aaucuaacaaucga

SEQ ID NO: 676495 - RNA, 22 nt, Haemophilus influenzae Rd
aaucaguugaucgcaauguuca

SEQ ID NO: 676496 - RNA, 16 nt, Haemophilus influenzae Rd
aaucacuuucauuaaa

SEQ ID NO: 676497 - RNA, 23 nt, Haemophilus influenzae Rd
aauagcaagaacaauuaauacgu

SEQ ID NO: 676498 - RNA, 23 nt, Haemophilus influenzae Rd
aauaguuauggcgauauucuccu

SEQ ID NO: 676499 - RNA, 15 nt, Haemophilus influenzae Rd
aauccccccauuaca

SEQ ID NO: 676500 - RNA, 16 nt, Haemophilus influenzae Rd
aauccccccauuacaa

SEQ ID NO: 676501 - RNA, 20 nt, Haemophilus influenzae Rd
aauccagaacgaacaauuuc

SEQ ID NO: 676502 - RNA, 16 nt, Haemophilus influenzae Rd
aauccaaaauuacuuu

SEQ ID NO: 676503 - RNA, 16 nt, Haemophilus influenzae Rd
aaucauuauauugugc

SEQ ID NO: 676504 - RNA, 13 nt, Haemophilus influenzae Rd
accacgccuucga

SEQ ID NO: 676505 - RNA, 14 nt, Haemophilus influenzae Rd
accaccgauuaaua

SEQ ID NO: 676506 - RNA, 18 nt, Haemophilus influenzae Rd
accacuucauauaaauua

SEQ ID NO: 676507 - RNA, 18 nt, Haemophilus influenzae Rd
acaucgcuucaucaucgc

SEQ ID NO: 676508 - RNA, 11 nt, Haemophilus influenzae Rd
acaucauuuuc

SEQ ID NO: 676509 - RNA, 17 nt, Haemophilus influenzae Rd
acaucauuccgcccauu

SEQ ID NO: 676510 - RNA, 15 nt, Haemophilus influenzae Rd
acaugcccuuucuca

SEQ ID NO: 676511 - RNA, 18 nt, Haemophilus influenzae Rd
acaucuugcauaaaccaa

SEQ ID NO: 676512 - RNA, 16 nt, Haemophilus influenzae Rd
accaaauacaauuuuu

SEQ ID NO: 676513 - RNA, 20 nt, Haemophilus influenzae Rd
accaaauagaugaaauuuau

SEQ ID NO: 676514 - RNA, 16 nt, Haemophilus influenzae Rd
accaaauauucuucua

SEQ ID NO: 676515 - RNA, 13 nt, Haemophilus influenzae Rd
accaacaacugca

SEQ ID NO: 676516 - RNA, 17 nt, Haemophilus influenzae Rd
accaaaaucuaaaccag

SEQ ID NO: 676517 - RNA, 14 nt, Haemophilus influenzae Rd
accaagugaaauuc

SEQ ID NO: 676518 - RNA, 22 nt, Haemophilus influenzae Rd
acauuguaaagugauugauuug

SEQ ID NO: 676519 - RNA, 12 nt, Haemophilus influenzae Rd
acauuucaucgc

SEQ ID NO: 676520 - RNA, 16 nt, Haemophilus influenzae Rd
acauuuucaaauuguc

SEQ ID NO: 676521 - RNA, 16 nt, Haemophilus influenzae Rd
acauuuuguuucuaaa

SEQ ID NO: 676522 - RNA, 16 nt, Haemophilus influenzae Rd
accaaaauucuacgcc

SEQ ID NO: 676523 - RNA, 20 nt, Haemophilus influenzae Rd
accaaaauuuguuaagugau

SEQ ID NO: 676524 - RNA, 13 nt, Haemophilus influenzae Rd
acagcgcgagcac

SEQ ID NO: 676525 - RNA, 22 nt, Haemophilus influenzae Rd
acaaacuccguccaaucuaauu

SEQ ID NO: 676526 - RNA, 22 nt, Haemophilus influenzae Rd
aauuugugcggauuaagauggc

SEQ ID NO: 676527 - RNA, 18 nt, Haemophilus influenzae Rd
aauuuguggaaauugcca

SEQ ID NO: 676528 - RNA, 23 nt, Haemophilus influenzae Rd
aauuuuacaguuucaacaaagcg

SEQ ID NO: 676529 - RNA, 16 nt, Haemophilus influenzae Rd
aauuuuacguuucauu

SEQ ID NO: 676530 - RNA, 21 nt, Haemophilus influenzae Rd
aauuuuccaauucuaguucuu

SEQ ID NO: 676531 - RNA, 23 nt, Haemophilus influenzae Rd
acaaaauggcaaacaaaauaaau

SEQ ID NO: 676532 - RNA, 17 nt, Haemophilus influenzae Rd
acagugaccgucaucgc

SEQ ID NO: 676533 - RNA, 15 nt, Haemophilus influenzae Rd
acaucaaucaaauuc

SEQ ID NO: 676534 - RNA, 18 nt, Haemophilus influenzae Rd
acaucaacgguuuucauu

SEQ ID NO: 676535 - RNA, 20 nt, Haemophilus influenzae Rd
acaucaacgguuuucauugc

SEQ ID NO: 676536 - RNA, 17 nt, Haemophilus influenzae Rd
acauaugcgucgcaaaa

SEQ ID NO: 676537 - RNA, 18 nt, Haemophilus influenzae Rd
acagggugucguagaaau

SEQ ID NO: 676538 - RNA, 12 nt, Haemophilus influenzae Rd
accauuuuugcg

SEQ ID NO: 676539 - RNA, 20 nt, Haemophilus influenzae Rd
aaaauggcuguuguuuuggc

SEQ ID NO: 676540 - RNA, 22 nt, Haemophilus influenzae Rd
aaaaugguuugacauauuuucu

SEQ ID NO: 676541 - RNA, 22 nt, Haemophilus influenzae Rd
aaaaugucagcuuggaauugca

SEQ ID NO: 676542 - RNA, 20 nt, Haemophilus influenzae Rd
acccguaauuaaaaauaacc

SEQ ID NO: 676543 - RNA, 20 nt, Haemophilus influenzae Rd
acccguaccuuuaaauucuu

SEQ ID NO: 676544 - RNA, 14 nt, Haemophilus influenzae Rd
accgcauucuucuu

SEQ ID NO: 676545 - RNA, 12 nt, Haemophilus influenzae Rd
accgcauuaaua

SEQ ID NO: 676546 - RNA, 23 nt, Haemophilus influenzae Rd
accgccguauugaauaauuacuu

SEQ ID NO: 676547 - RNA, 19 nt, Haemophilus influenzae Rd
accgcuaucgucauuaaua

SEQ ID NO: 676548 - RNA, 22 nt, Haemophilus influenzae Rd
acuggaaauucuucaauaacaa

SEQ ID NO: 676549 - RNA, 15 nt, Haemophilus influenzae Rd
acucuaauuccaccg

SEQ ID NO: 676550 - RNA, 16 nt, Haemophilus influenzae Rd
acuuuaccauuacaua

SEQ ID NO: 676551 - RNA, 19 nt, Haemophilus influenzae Rd
acuugugcaagaaauugau

SEQ ID NO: 676552 - RNA, 20 nt, Haemophilus influenzae Rd
acuugcaagggauuugaaaa

SEQ ID NO: 676553 - RNA, 14 nt, Haemophilus influenzae Rd
acuugaauugaaga

SEQ ID NO: 676554 - RNA, 23 nt, Haemophilus influenzae Rd
acuugaccagagccaaauacaau

SEQ ID NO: 676555 - RNA, 13 nt, Haemophilus influenzae Rd
acuucuucuucgc

SEQ ID NO: 676556 - RNA, 21 nt, Haemophilus influenzae Rd
acuucuguugggaauaauucu

SEQ ID NO: 676557 - RNA, 22 nt, Haemophilus influenzae Rd
acuucggggaucauuucaucug

SEQ ID NO: 676558 - RNA, 14 nt, Haemophilus influenzae Rd
acuccaaauaauac

SEQ ID NO: 676559 - RNA, 16 nt, Haemophilus influenzae Rd
acuauuaucuacuagc

SEQ ID NO: 676560 - RNA, 16 nt, Haemophilus influenzae Rd
acucaaagaaauagau

SEQ ID NO: 676561 - RNA, 20 nt, Haemophilus influenzae Rd
acucgcgcaccgucauuuuc

SEQ ID NO: 676562 - RNA, 17 nt, Haemophilus influenzae Rd
aaaccacaucauuuuuu

SEQ ID NO: 676563 - RNA, 16 nt, Haemophilus influenzae Rd
acggcgcguaaaucag

SEQ ID NO: 676564 - RNA, 18 nt, Haemophilus influenzae Rd
acggcuaaauugugccgc

SEQ ID NO: 676565 - RNA, 21 nt, Haemophilus influenzae Rd
acgucugugauaccgauaaaa

SEQ ID NO: 676566 - RNA, 13 nt, Haemophilus influenzae Rd
acgugcgauaaaa

SEQ ID NO: 676567 - RNA, 18 nt, Haemophilus influenzae Rd
acguaagcccauuccaca

SEQ ID NO: 676568 - RNA, 20 nt, Haemophilus influenzae Rd
acguaauaaguuuucaucaa

SEQ ID NO: 676569 - RNA, 21 nt, Haemophilus influenzae Rd
accugcccuugagccaguuua

SEQ ID NO: 676570 - RNA, 23 nt, Haemophilus influenzae Rd
accuucugcugcaguuucuggau

SEQ ID NO: 676571 - RNA, 21 nt, Haemophilus influenzae Rd
accuucacuuggcgaaaauca

SEQ ID NO: 676572 - RNA, 14 nt, Haemophilus influenzae Rd
accuucaaacauca

SEQ ID NO: 676573 - RNA, 14 nt, Haemophilus influenzae Rd
acgaucauaaauuu

SEQ ID NO: 676574 - RNA, 23 nt, Haemophilus influenzae Rd
acgaucuaauacaguuucugguu

SEQ ID NO: 676575 - RNA, 19 nt, Haemophilus influenzae Rd
acgagcauauuuuccauca

SEQ ID NO: 676576 - RNA, 17 nt, Haemophilus influenzae Rd
acgccagucacuucuuc

SEQ ID NO: 676577 - RNA, 23 nt, Haemophilus influenzae Rd
acgccauucacauucuuuuaaau

SEQ ID NO: 676578 - RNA, 23 nt, Haemophilus influenzae Rd
acgcauuguuacaaauuccucug

SEQ ID NO: 676579 - RNA, 15 nt, Haemophilus influenzae Rd
acgcauucuuucucu

SEQ ID NO: 676580 - RNA, 13 nt, Haemophilus influenzae Rd
acgccaauuaaua

SEQ ID NO: 676581 - RNA, 17 nt, Haemophilus influenzae Rd
acgccaauuaauaacgc

SEQ ID NO: 676582 - RNA, 19 nt, Haemophilus influenzae Rd
acgcuacccguauuaaaua

SEQ ID NO: 676583 - RNA, 16 nt, Haemophilus influenzae Rd
aaacauuguuuuguuc

SEQ ID NO: 676584 - RNA, 11 nt, Haemophilus influenzae Rd
aaaccaaccac

SEQ ID NO: 676585 - RNA, 17 nt, Haemophilus influenzae Rd
aaaccaaccacagcgac

SEQ ID NO: 676586 - RNA, 17 nt, Haemophilus influenzae Rd
acgcgaguaaaauaaaa

SEQ ID NO: 676587 - RNA, 15 nt, Haemophilus influenzae Rd
agcaauugcuaaaaa

SEQ ID NO: 676588 - RNA, 21 nt, Haemophilus influenzae Rd
agcaccaaauaucgcaaucaa

SEQ ID NO: 676589 - RNA, 23 nt, Haemophilus influenzae Rd
agcaccuaaaucggcuuuaucau

SEQ ID NO: 676590 - RNA, 20 nt, Haemophilus influenzae Rd
agcaauaauggcgguaaaaa

SEQ ID NO: 676591 - RNA, 22 nt, Haemophilus influenzae Rd
agcacaaucgcuagcgcaauca

SEQ ID NO: 676592 - RNA, 22 nt, Haemophilus influenzae Rd
agcaaccuaaacccgcaauuaa

SEQ ID NO: 676593 - RNA, 12 nt, Haemophilus influenzae Rd
agcaaccacuaa

SEQ ID NO: 676594 - RNA, 22 nt, Haemophilus influenzae Rd
agcaaauuucuguugaaaucaa

SEQ ID NO: 676595 - RNA, 13 nt, Haemophilus influenzae Rd
agcaacaauauua

SEQ ID NO: 676596 - RNA, 19 nt, Haemophilus influenzae Rd
acuuucaauuuuuccaccg

SEQ ID NO: 676597 - RNA, 21 nt, Haemophilus influenzae Rd
acuuucaacacgguggcauuu

SEQ ID NO: 676598 - RNA, 15 nt, Haemophilus influenzae Rd
agcaaacagcaauaa

SEQ ID NO: 676599 - RNA, 20 nt, Haemophilus influenzae Rd
agcaaacagcaauaaauaau

SEQ ID NO: 676600 - RNA, 13 nt, Haemophilus influenzae Rd
agcacuuuuccuu

SEQ ID NO: 676601 - RNA, 21 nt, Haemophilus influenzae Rd
aaacccacuucacaacuuuuu

SEQ ID NO: 676602 - RNA, 12 nt, Haemophilus influenzae Rd
aaaccgccaaaa

SEQ ID NO: 676603 - RNA, 16 nt, Haemophilus influenzae Rd
aaacgcaccuccgcaa

SEQ ID NO: 676604 - RNA, 11 nt, Haemophilus influenzae Rd
aaaccuugcac

SEQ ID NO: 676605 - RNA, 23 nt, Haemophilus influenzae Rd
aaacgauaugguaagaacgacca

SEQ ID NO: 676606 - RNA, 17 nt, Haemophilus influenzae Rd
agccauuuucgcaucaa

SEQ ID NO: 676607 - RNA, 22 nt, Haemophilus influenzae Rd
agcccaccaauuaaccauaaaa

SEQ ID NO: 676608 - RNA, 16 nt, Haemophilus influenzae Rd
agcccaaguaauacac

SEQ ID NO: 676609 - RNA, 16 nt, Haemophilus influenzae Rd
agcaggaaaaccacaa

SEQ ID NO: 676610 - RNA, 17 nt, Haemophilus influenzae Rd
agcagugguaaauuuua

SEQ ID NO: 676611 - RNA, 15 nt, Haemophilus influenzae Rd
agcagugccaaccac

SEQ ID NO: 676612 - RNA, 21 nt, Haemophilus influenzae Rd
agcauguggcucuguuaaaau

SEQ ID NO: 676613 - RNA, 19 nt, Haemophilus influenzae Rd
agccaaugcggcuauggca

SEQ ID NO: 676614 - RNA, 19 nt, Haemophilus influenzae Rd
agcgcguuuaucaucugca

SEQ ID NO: 676615 - RNA, 14 nt, Haemophilus influenzae Rd
agcggacuuuuaau

SEQ ID NO: 676616 - RNA, 23 nt, Haemophilus influenzae Rd
agcugaauaaauaaaccagcuaa

SEQ ID NO: 676617 - RNA, 15 nt, Haemophilus influenzae Rd
agcguucguuaucau

SEQ ID NO: 676618 - RNA, 20 nt, Haemophilus influenzae Rd
agcuauuacucuuaauuuuu

SEQ ID NO: 676619 - RNA, 15 nt, Haemophilus influenzae Rd
agcgaauuacaucau

SEQ ID NO: 676620 - RNA, 18 nt, Haemophilus influenzae Rd
aaacgcucaaauaaauug

SEQ ID NO: 676621 - RNA, 21 nt, Haemophilus influenzae Rd
aaacgcugacguacaauuuca

SEQ ID NO: 676622 - RNA, 18 nt, Haemophilus influenzae Rd
aguaaggcacugauuuuu

SEQ ID NO: 676623 - RNA, 18 nt, Haemophilus influenzae Rd
aguacugcagcauuuaaa

SEQ ID NO: 676624 - RNA, 18 nt, Haemophilus influenzae Rd
aguaaguaggcugaauac

SEQ ID NO: 676625 - RNA, 15 nt, Haemophilus influenzae Rd
aguaugaaaacgcga

SEQ ID NO: 676626 - RNA, 20 nt, Haemophilus influenzae Rd
agguuuccuuauaauaugaa

SEQ ID NO: 676627 - RNA, 23 nt, Haemophilus influenzae Rd
aguaaaaaaucuagagauuguau

SEQ ID NO: 676628 - RNA, 13 nt, Haemophilus influenzae Rd
agggcgguuaaaa

SEQ ID NO: 676629 - RNA, 19 nt, Haemophilus influenzae Rd
agggcucaaauuuucuguu

SEQ ID NO: 676630 - RNA, 16 nt, Haemophilus influenzae Rd
aggcuaucaucaucau

SEQ ID NO: 676631 - RNA, 20 nt, Haemophilus influenzae Rd
aggcuauuuuauaauuaaua

SEQ ID NO: 676632 - RNA, 18 nt, Haemophilus influenzae Rd
aguugagcuaaagugcgg

SEQ ID NO: 676633 - RNA, 14 nt, Haemophilus influenzae Rd
aguugauuuuaaaa

SEQ ID NO: 676634 - RNA, 12 nt, Haemophilus influenzae Rd
aguuuaagggcu

SEQ ID NO: 676635 - RNA, 18 nt, Haemophilus influenzae Rd
aguauuaaauauaaugaa

SEQ ID NO: 676636 - RNA, 13 nt, Haemophilus influenzae Rd
agugcgguuaaaa

SEQ ID NO: 676637 - RNA, 19 nt, Haemophilus influenzae Rd
agugcgcauauacuucuuu

SEQ ID NO: 676638 - RNA, 18 nt, Haemophilus influenzae Rd
agugcggaaaauuuuccg

SEQ ID NO: 676639 - RNA, 22 nt, Haemophilus influenzae Rd
auacaaaaagugcgguuaaaaa

SEQ ID NO: 676640 - RNA, 13 nt, Haemophilus influenzae Rd
auaauuuuuaauu

SEQ ID NO: 676641 - RNA, 20 nt, Haemophilus influenzae Rd
auacagugcagaaaauugcc

SEQ ID NO: 676642 - RNA, 22 nt, Haemophilus influenzae Rd
auaauuuccuuuuuuauuuauu

SEQ ID NO: 676643 - RNA, 15 nt, Haemophilus influenzae Rd
auacauuaaguauau

SEQ ID NO: 676644 - RNA, 21 nt, Haemophilus influenzae Rd
auaauuuuacguuucauuuuu

SEQ ID NO: 676645 - RNA, 17 nt, Haemophilus influenzae Rd
auaauuuucaauagcca

SEQ ID NO: 676646 - RNA, 21 nt, Haemophilus influenzae Rd
auaauuuuggaucauuagcaa

SEQ ID NO: 676647 - RNA, 22 nt, Haemophilus influenzae Rd
auaaguuuugucugaaauuuuu

SEQ ID NO: 676648 - RNA, 16 nt, Haemophilus influenzae Rd
auaagugcgguaaaaa

SEQ ID NO: 676649 - RNA, 21 nt, Haemophilus influenzae Rd
auaauagcguccuacuacagc

SEQ ID NO: 676650 - RNA, 16 nt, Haemophilus influenzae Rd
auaauaggcgaaucaa

SEQ ID NO: 676651 - RNA, 13 nt, Haemophilus influenzae Rd
auacgaucugcau

SEQ ID NO: 676652 - RNA, 16 nt, Haemophilus influenzae Rd
auaccgcacuuuuauu

SEQ ID NO: 676653 - RNA, 12 nt, Haemophilus influenzae Rd
auaccgcccauu

SEQ ID NO: 676654 - RNA, 13 nt, Haemophilus influenzae Rd
auaccaauugcaa

SEQ ID NO: 676655 - RNA, 17 nt, Haemophilus influenzae Rd
auacauaauuaaauuaa

SEQ ID NO: 676656 - RNA, 14 nt, Haemophilus influenzae Rd
auaccaauaaucaa

SEQ ID NO: 676657 - RNA, 15 nt, Haemophilus influenzae Rd
auaaccuagaacaaa

SEQ ID NO: 676658 - RNA, 17 nt, Haemophilus influenzae Rd
auaacccgccuuuguuu

SEQ ID NO: 676659 - RNA, 16 nt, Haemophilus influenzae Rd
auaacccaccaaauua

SEQ ID NO: 676660 - RNA, 22 nt, Haemophilus influenzae Rd
auaaccuugcgcugcuuuauuu

SEQ ID NO: 676661 - RNA, 14 nt, Haemophilus influenzae Rd
auaacuuaaaucaa

SEQ ID NO: 676662 - RNA, 20 nt, Haemophilus influenzae Rd
auaacugauuguccaaagaa

SEQ ID NO: 676663 - RNA, 15 nt, Haemophilus influenzae Rd
auaacguuaauucaa

SEQ ID NO: 676664 - RNA, 21 nt, Haemophilus influenzae Rd
auaagaaaauagaaagaauau

SEQ ID NO: 676665 - RNA, 14 nt, Haemophilus influenzae Rd
auaagcaauuucac

SEQ ID NO: 676666 - RNA, 18 nt, Haemophilus influenzae Rd
aguuuccacguuuucaac

SEQ ID NO: 676667 - RNA, 12 nt, Haemophilus influenzae Rd
aguuuauucagu

SEQ ID NO: 676668 - RNA, 14 nt, Haemophilus influenzae Rd
aguuucuaauucuu

SEQ ID NO: 676669 - RNA, 21 nt, Haemophilus influenzae Rd
aguuuuccgacaacacuugcu

SEQ ID NO: 676670 - RNA, 17 nt, Haemophilus influenzae Rd
aguuuuccuuuuucuaa

SEQ ID NO: 676671 - RNA, 22 nt, Haemophilus influenzae Rd
aguuuuccuuuuucuaacaucu

SEQ ID NO: 676672 - RNA, 20 nt, Haemophilus influenzae Rd
aguuuuacugauucuucgcc

SEQ ID NO: 676673 - RNA, 18 nt, Haemophilus influenzae Rd
auaaccacuagccauugc

SEQ ID NO: 676674 - RNA, 13 nt, Haemophilus influenzae Rd
auaaaaacauugc

SEQ ID NO: 676675 - RNA, 15 nt, Haemophilus influenzae Rd
auagaugaauuagaa

SEQ ID NO: 676676 - RNA, 15 nt, Haemophilus influenzae Rd
auagcaucugauuuu

SEQ ID NO: 676677 - RNA, 12 nt, Haemophilus influenzae Rd
auacuuuuaauu

SEQ ID NO: 676678 - RNA, 20 nt, Haemophilus influenzae Rd
auacuuuuaauuaaauacaa

SEQ ID NO: 676679 - RNA, 14 nt, Haemophilus influenzae Rd
auacguaaauucaa

SEQ ID NO: 676680 - RNA, 23 nt, Haemophilus influenzae Rd
auacgucgucuuugaaacggcga

SEQ ID NO: 676681 - RNA, 24 nt, Haemophilus influenzae Rd
auagccguucuuaucuacaaucaa

SEQ ID NO: 676682 - RNA, 23 nt, Haemophilus influenzae Rd
auagcgaucugcugguacgagca

SEQ ID NO: 676683 - RNA, 20 nt, Haemophilus influenzae Rd
auaggauuaacguaagaaau

SEQ ID NO: 676684 - RNA, 16 nt, Haemophilus influenzae Rd
auaguuggguaaucaa

SEQ ID NO: 676685 - RNA, 14 nt, Haemophilus influenzae Rd
auauaccaauaauu

SEQ ID NO: 676686 - RNA, 12 nt, Haemophilus influenzae Rd
auaucgcccauu

SEQ ID NO: 676687 - RNA, 16 nt, Haemophilus influenzae Rd
auaucuagcacagcaa

SEQ ID NO: 676688 - RNA, 16 nt, Haemophilus influenzae Rd
auauacggcuaaacga

SEQ ID NO: 676689 - RNA, 13 nt, Haemophilus influenzae Rd
auauaaucauugc

SEQ ID NO: 676690 - RNA, 18 nt, Haemophilus influenzae Rd
aucaauuaaagaaauuuc

SEQ ID NO: 676691 - RNA, 14 nt, Haemophilus influenzae Rd
aucaauguuugugc

SEQ ID NO: 676692 - RNA, 22 nt, Haemophilus influenzae Rd
aucaauggguuuaaaaaguuga

SEQ ID NO: 676693 - RNA, 22 nt, Haemophilus influenzae Rd
aucaagcacuuuuccuuuuauu

SEQ ID NO: 676694 - RNA, 15 nt, Haemophilus influenzae Rd
aucaagauaacugau

SEQ ID NO: 676695 - RNA, 19 nt, Haemophilus influenzae Rd
aucaacugcaacaauuuca

SEQ ID NO: 676696 - RNA, 19 nt, Haemophilus influenzae Rd
auauuaucuccaagaauau

SEQ ID NO: 676697 - RNA, 21 nt, Haemophilus influenzae Rd
auauguucaacaaguaaauca

SEQ ID NO: 676698 - RNA, 22 nt, Haemophilus influenzae Rd
auauguucuaagguauaaauaa

SEQ ID NO: 676699 - RNA, 23 nt, Haemophilus influenzae Rd
auauguugaauaguaaagaauau

SEQ ID NO: 676700 - RNA, 18 nt, Haemophilus influenzae Rd
aucaacacaccuauuuuu

SEQ ID NO: 676701 - RNA, 19 nt, Haemophilus influenzae Rd
aucaaauugucaaaauuga

SEQ ID NO: 676702 - RNA, 21 nt, Haemophilus influenzae Rd
aucaaagugcgguaaucuuuc

SEQ ID NO: 676703 - RNA, 16 nt, Haemophilus influenzae Rd
aucaaaucaaauuuuc

SEQ ID NO: 676704 - RNA, 13 nt, Haemophilus influenzae Rd
aucaaagaaucca

SEQ ID NO: 676705 - RNA, 19 nt, Haemophilus influenzae Rd
aucaaaguagucuauuuac

SEQ ID NO: 676706 - RNA, 15 nt, Haemophilus influenzae Rd
auauucaaauuucau

SEQ ID NO: 676707 - RNA, 16 nt, Haemophilus influenzae Rd
aucagagcgaauacug

SEQ ID NO: 676708 - RNA, 17 nt, Haemophilus influenzae Rd
aucacugccagaaccua

SEQ ID NO: 676709 - RNA, 15 nt, Haemophilus influenzae Rd
aucacugaauuucau

SEQ ID NO: 676710 - RNA, 17 nt, Haemophilus influenzae Rd
aucacguucaaaaauau

SEQ ID NO: 676711 - RNA, 20 nt, Haemophilus influenzae Rd
aucagauggaauauuugcgu

SEQ ID NO: 676712 - RNA, 17 nt, Haemophilus influenzae Rd
aucacgacaucaaucaa

SEQ ID NO: 676713 - RNA, 17 nt, Haemophilus influenzae Rd
aucaccuguaaacaaau

SEQ ID NO: 676714 - RNA, 17 nt, Haemophilus influenzae Rd
aucaccgcacuuuuauu

SEQ ID NO: 676715 - RNA, 13 nt, Haemophilus influenzae Rd
aucuauuucauau

SEQ ID NO: 676716 - RNA, 16 nt, Haemophilus influenzae Rd
aucucaaaaucagcaa

SEQ ID NO: 676717 - RNA, 13 nt, Haemophilus influenzae Rd
aucuaacauaaug

SEQ ID NO: 676718 - RNA, 22 nt, Haemophilus influenzae Rd
aucuaaugccuuuccugcauca

SEQ ID NO: 676719 - RNA, 16 nt, Haemophilus influenzae Rd
aucuacaaaacauaau

SEQ ID NO: 676720 - RNA, 17 nt, Haemophilus influenzae Rd
aucuaacguuuauauug

SEQ ID NO: 676721 - RNA, 17 nt, Haemophilus influenzae Rd
aucuaaagaaaauacaa

SEQ ID NO: 676722 - RNA, 15 nt, Haemophilus influenzae Rd
aucguucgcacaaac

SEQ ID NO: 676723 - RNA, 15 nt, Haemophilus influenzae Rd
aucggcuuuaucauc

SEQ ID NO: 676724 - RNA, 15 nt, Haemophilus influenzae Rd
aucguccaauuucau

SEQ ID NO: 676725 - RNA, 17 nt, Haemophilus influenzae Rd
aucggcuauuucagcuu

SEQ ID NO: 676726 - RNA, 12 nt, Haemophilus influenzae Rd
aucuguaaacga

SEQ ID NO: 676727 - RNA, 14 nt, Haemophilus influenzae Rd
aucuucaugauuuu

SEQ ID NO: 676728 - RNA, 17 nt, Haemophilus influenzae Rd
aucuuccaauaauucuu

SEQ ID NO: 676729 - RNA, 16 nt, Haemophilus influenzae Rd
aucuucccauuugaau

SEQ ID NO: 676730 - RNA, 16 nt, Haemophilus influenzae Rd
aucuucuggguucacg

SEQ ID NO: 676731 - RNA, 13 nt, Haemophilus influenzae Rd
aucuuuaccaaaa

SEQ ID NO: 676732 - RNA, 16 nt, Haemophilus influenzae Rd
aucuuaaaaaagauga

SEQ ID NO: 676733 - RNA, 17 nt, Haemophilus influenzae Rd
aucuuaccuuuuucuac

SEQ ID NO: 676734 - RNA, 17 nt, Haemophilus influenzae Rd
augacuggcaaaaaugu

SEQ ID NO: 676735 - RNA, 15 nt, Haemophilus influenzae Rd
augaucaccgugcaa

SEQ ID NO: 676736 - RNA, 15 nt, Haemophilus influenzae Rd
augaucgaccauugc

SEQ ID NO: 676737 - RNA, 20 nt, Haemophilus influenzae Rd
augauaaaaaucaaagagaa

SEQ ID NO: 676738 - RNA, 13 nt, Haemophilus influenzae Rd
augauaauuucau

SEQ ID NO: 676739 - RNA, 16 nt, Haemophilus influenzae Rd
augauaccuuguuaau

SEQ ID NO: 676740 - RNA, 17 nt, Haemophilus influenzae Rd
augaccauuaaucacac

SEQ ID NO: 676741 - RNA, 20 nt, Haemophilus influenzae Rd
augaauggguuaguaagugg

SEQ ID NO: 676742 - RNA, 20 nt, Haemophilus influenzae Rd
augaccgcacuuuuuauauu

SEQ ID NO: 676743 - RNA, 18 nt, Haemophilus influenzae Rd
aucuuuggauugguguuu

SEQ ID NO: 676744 - RNA, 15 nt, Haemophilus influenzae Rd
aucuuuaucauuuaa

SEQ ID NO: 676745 - RNA, 18 nt, Haemophilus influenzae Rd
aucuuucgcuugcuguuu

SEQ ID NO: 676746 - RNA, 23 nt, Haemophilus influenzae Rd
aucuuuaucuucuacaaauacac

SEQ ID NO: 676747 - RNA, 12 nt, Haemophilus influenzae Rd
aucgaucacuuc

SEQ ID NO: 676748 - RNA, 23 nt, Haemophilus influenzae Rd
aucgaugucuggcugaguaaaua

SEQ ID NO: 676749 - RNA, 12 nt, Haemophilus influenzae Rd
aucgcaauauua

SEQ ID NO: 676750 - RNA, 19 nt, Haemophilus influenzae Rd
aucgcacucacaauaccaa

SEQ ID NO: 676751 - RNA, 13 nt, Haemophilus influenzae Rd
aucgcuucaucau

SEQ ID NO: 676752 - RNA, 20 nt, Haemophilus influenzae Rd
aucgcuuguuguaaauuggu

SEQ ID NO: 676753 - RNA, 20 nt, Haemophilus influenzae Rd
aucgcuuugagaaagaauau

SEQ ID NO: 676754 - RNA, 12 nt, Haemophilus influenzae Rd
auuaauaagccc

SEQ ID NO: 676755 - RNA, 23 nt, Haemophilus influenzae Rd
auuagcuucaagcugcauuucaa

SEQ ID NO: 676756 - RNA, 21 nt, Haemophilus influenzae Rd
auuaacgcucaaaaauuucag

SEQ ID NO: 676757 - RNA, 20 nt, Haemophilus influenzae Rd
auuaacgggcuuaaacuuuu

SEQ ID NO: 676758 - RNA, 16 nt, Haemophilus influenzae Rd
auuaaccguuuuuauu

SEQ ID NO: 676759 - RNA, 22 nt, Haemophilus influenzae Rd
auuaaccguuuuuauuuguucu

SEQ ID NO: 676760 - RNA, 16 nt, Haemophilus influenzae Rd
auuaagguuucuucua

SEQ ID NO: 676761 - RNA, 18 nt, Haemophilus influenzae Rd
auuaaggacuaaacuuuu

SEQ ID NO: 676762 - RNA, 23 nt, Haemophilus influenzae Rd
auuaagaauaccgaguucaagug

SEQ ID NO: 676763 - RNA, 19 nt, Haemophilus influenzae Rd
auucaaucuuuuuguuaau

SEQ ID NO: 676764 - RNA, 17 nt, Haemophilus influenzae Rd
auucaaaucgaucacuu

SEQ ID NO: 676765 - RNA, 15 nt, Haemophilus influenzae Rd
auuauuuaauuucaa

SEQ ID NO: 676766 - RNA, 12 nt, Haemophilus influenzae Rd
auuauccaaacc

SEQ ID NO: 676767 - RNA, 14 nt, Haemophilus influenzae Rd
auguuguaaaauau

SEQ ID NO: 676768 - RNA, 13 nt, Haemophilus influenzae Rd
auuaaauaacuca

SEQ ID NO: 676769 - RNA, 21 nt, Haemophilus influenzae Rd
auuaaaacuugacguuguucu

SEQ ID NO: 676770 - RNA, 15 nt, Haemophilus influenzae Rd
auguuugcaucaauc

SEQ ID NO: 676771 - RNA, 23 nt, Haemophilus influenzae Rd
auucuuuaaauauucaauuacau

SEQ ID NO: 676772 - RNA, 17 nt, Haemophilus influenzae Rd
auugagauuuaauuuau

SEQ ID NO: 676773 - RNA, 17 nt, Haemophilus influenzae Rd
auugacuuguuuuaaaa

SEQ ID NO: 676774 - RNA, 20 nt, Haemophilus influenzae Rd
auugaguucucguugcaucu

SEQ ID NO: 676775 - RNA, 16 nt, Haemophilus influenzae Rd
auugaggauuugccuc

SEQ ID NO: 676776 - RNA, 16 nt, Haemophilus influenzae Rd
auugacauuuuacuuu

SEQ ID NO: 676777 - RNA, 23 nt, Haemophilus influenzae Rd
auugacauuuuacuuuagcaaug

SEQ ID NO: 676778 - RNA, 14 nt, Haemophilus influenzae Rd
auugaauauuuagu

SEQ ID NO: 676779 - RNA, 14 nt, Haemophilus influenzae Rd
auugaauuugguaa

SEQ ID NO: 676780 - RNA, 22 nt, Haemophilus influenzae Rd
auucgggcuucucaaaugaaau

SEQ ID NO: 676781 - RNA, 20 nt, Haemophilus influenzae Rd
auuccuuccaacaauuucac

SEQ ID NO: 676782 - RNA, 18 nt, Haemophilus influenzae Rd
auucgaaccuucgaccaa

SEQ ID NO: 676783 - RNA, 23 nt, Haemophilus influenzae Rd
auuguucagcaauuucucuggcu

SEQ ID NO: 676784 - RNA, 15 nt, Haemophilus influenzae Rd
auuguuucaauuuau

SEQ ID NO: 676785 - RNA, 18 nt, Haemophilus influenzae Rd
auuggauugaaucaauuu

SEQ ID NO: 676786 - RNA, 12 nt, Haemophilus influenzae Rd
auuguaaaaguc

SEQ ID NO: 676787 - RNA, 15 nt, Haemophilus influenzae Rd
auugguaaaauuucu

SEQ ID NO: 676788 - RNA, 19 nt, Haemophilus influenzae Rd
auugcuggugcaauuugau

SEQ ID NO: 676789 - RNA, 17 nt, Haemophilus influenzae Rd
auugauauuaauuuuau

SEQ ID NO: 676790 - RNA, 20 nt, Haemophilus influenzae Rd
auugauuucucugacguaau

SEQ ID NO: 676791 - RNA, 16 nt, Haemophilus influenzae Rd
auugauucaauucuuc

SEQ ID NO: 676792 - RNA, 18 nt, Haemophilus influenzae Rd
auugauucaauucuucua

SEQ ID NO: 676793 - RNA, 14 nt, Haemophilus influenzae Rd
augauguaauucug

SEQ ID NO: 676794 - RNA, 14 nt, Haemophilus influenzae Rd
augccuacuuuuua

SEQ ID NO: 676795 - RNA, 20 nt, Haemophilus influenzae Rd
augccucuuuuuucauugca

SEQ ID NO: 676796 - RNA, 17 nt, Haemophilus influenzae Rd
augcggugaaauuucac

SEQ ID NO: 676797 - RNA, 24 nt, Haemophilus influenzae Rd
augcguagaaagaugggugguauc

SEQ ID NO: 676798 - RNA, 16 nt, Haemophilus influenzae Rd
augcuguuuaaaucua

SEQ ID NO: 676799 - RNA, 21 nt, Haemophilus influenzae Rd
augcuguuucuaauucggcuu

SEQ ID NO: 676800 - RNA, 17 nt, Haemophilus influenzae Rd
augcguuuuauggcuug

SEQ ID NO: 676801 - RNA, 14 nt, Haemophilus influenzae Rd
augcuuuaacacca

SEQ ID NO: 676802 - RNA, 15 nt, Haemophilus influenzae Rd
augguggauaaacga

SEQ ID NO: 676803 - RNA, 20 nt, Haemophilus influenzae Rd
auggugggcuggguagaaau

SEQ ID NO: 676804 - RNA, 14 nt, Haemophilus influenzae Rd
auggcgaauuucac

SEQ ID NO: 676805 - RNA, 18 nt, Haemophilus influenzae Rd
auggcgacggcaucaaac

SEQ ID NO: 676806 - RNA, 15 nt, Haemophilus influenzae Rd
augggaaacaauaug

SEQ ID NO: 676807 - RNA, 21 nt, Haemophilus influenzae Rd
augggauuuucacuaauuugc

SEQ ID NO: 676808 - RNA, 17 nt, Haemophilus influenzae Rd
caccaaauaucgcaauc

SEQ ID NO: 676809 - RNA, 22 nt, Haemophilus influenzae Rd
cacaaagcuuaguccuuuacug

SEQ ID NO: 676810 - RNA, 18 nt, Haemophilus influenzae Rd
cacaaacuccguccaauc

SEQ ID NO: 676811 - RNA, 14 nt, Haemophilus influenzae Rd
caauuuucugcaga

SEQ ID NO: 676812 - RNA, 23 nt, Haemophilus influenzae Rd
caauuuuuucugaauaaauuuuu

SEQ ID NO: 676813 - RNA, 21 nt, Haemophilus influenzae Rd
caauuuuuugucugaaauuuu

SEQ ID NO: 676814 - RNA, 22 nt, Haemophilus influenzae Rd
caaccguacacgcgcaaauuuu

SEQ ID NO: 676815 - RNA, 11 nt, Haemophilus influenzae Rd
caacccauaau

SEQ ID NO: 676816 - RNA, 21 nt, Haemophilus influenzae Rd
caacgcguacuuuuuuaccuu

SEQ ID NO: 676817 - RNA, 16 nt, Haemophilus influenzae Rd
caacgcuuaaugaacu

SEQ ID NO: 676818 - RNA, 17 nt, Haemophilus influenzae Rd
caacgagcgagaccacu

SEQ ID NO: 676819 - RNA, 20 nt, Haemophilus influenzae Rd
caaccacccauacuuuaacu

SEQ ID NO: 676820 - RNA, 16 nt, Haemophilus influenzae Rd
caacaucgcagugauc

SEQ ID NO: 676821 - RNA, 16 nt, Haemophilus influenzae Rd
caacauuaauaacgug

SEQ ID NO: 676822 - RNA, 11 nt, Haemophilus influenzae Rd
caacauauuuu

SEQ ID NO: 676823 - RNA, 23 nt, Haemophilus influenzae Rd
caacaccuaauaucaagucaaaa

SEQ ID NO: 676824 - RNA, 16 nt, Haemophilus influenzae Rd
caacaaagucuucauc

SEQ ID NO: 676825 - RNA, 16 nt, Haemophilus influenzae Rd
caaaugggaaagcguu

SEQ ID NO: 676826 - RNA, 17 nt, Haemophilus influenzae Rd
caaaucuaacguauuua

SEQ ID NO: 676827 - RNA, 19 nt, Haemophilus influenzae Rd
auuuaguccuuaauuuuau

SEQ ID NO: 676828 - RNA, 23 nt, Haemophilus influenzae Rd
auuuaguccuucugcgauuucau

SEQ ID NO: 676829 - RNA, 17 nt, Haemophilus influenzae Rd
auuuagggaaaauuuua

SEQ ID NO: 676830 - RNA, 21 nt, Haemophilus influenzae Rd
auuguuuucugaacuaaaaua

SEQ ID NO: 676831 - RNA, 21 nt, Haemophilus influenzae Rd
auuuacucacaacaaagaugg

SEQ ID NO: 676832 - RNA, 16 nt, Haemophilus influenzae Rd
caaagcguucauuuug

SEQ ID NO: 676833 - RNA, 22 nt, Haemophilus influenzae Rd
caaaguuuccuucgccauuuuu

SEQ ID NO: 676834 - RNA, 23 nt, Haemophilus influenzae Rd
caaauaaaauagacaauauugaa

SEQ ID NO: 676835 - RNA, 11 nt, Haemophilus influenzae Rd
caaauaaauuu

SEQ ID NO: 676836 - RNA, 17 nt, Haemophilus influenzae Rd
caaauacaucuucacaa

SEQ ID NO: 676837 - RNA, 18 nt, Haemophilus influenzae Rd
caaauacaucuucacaaa

SEQ ID NO: 676838 - RNA, 21 nt, Haemophilus influenzae Rd
caaugauugagcgauagaaau

SEQ ID NO: 676839 - RNA, 23 nt, Haemophilus influenzae Rd
caaugccagcgcuugcaccaaug

SEQ ID NO: 676840 - RNA, 15 nt, Haemophilus influenzae Rd
caaugcuuuuaauuu

SEQ ID NO: 676841 - RNA, 16 nt, Haemophilus influenzae Rd
caauggaaauaccaug

SEQ ID NO: 676842 - RNA, 22 nt, Haemophilus influenzae Rd
caaucuuuaaaacuauaaaaau

SEQ ID NO: 676843 - RNA, 13 nt, Haemophilus influenzae Rd
caauuaauucgau

SEQ ID NO: 676844 - RNA, 18 nt, Haemophilus influenzae Rd
caauuccuucaaauucua

SEQ ID NO: 676845 - RNA, 14 nt, Haemophilus influenzae Rd
caauugauguaaaa

SEQ ID NO: 676846 - RNA, 15 nt, Haemophilus influenzae Rd
caauuugcggagaaa

SEQ ID NO: 676847 - RNA, 18 nt, Haemophilus influenzae Rd
caauguucgauuuuacuu

SEQ ID NO: 676848 - RNA, 19 nt, Haemophilus influenzae Rd
caauuaaaguaaacccuuu

SEQ ID NO: 676849 - RNA, 17 nt, Haemophilus influenzae Rd
caauuacguaaucaucc

SEQ ID NO: 676850 - RNA, 19 nt, Haemophilus influenzae Rd
caauuaauacgucaauugc

SEQ ID NO: 676851 - RNA, 13 nt, Haemophilus influenzae Rd
caauuaaugaacg

SEQ ID NO: 676852 - RNA, 16 nt, Haemophilus influenzae Rd
caauuaagcaauagcg

SEQ ID NO: 676853 - RNA, 20 nt, Haemophilus influenzae Rd
caauacguaaucccauuuca

SEQ ID NO: 676854 - RNA, 13 nt, Haemophilus influenzae Rd
caauagaacguaa

SEQ ID NO: 676855 - RNA, 16 nt, Haemophilus influenzae Rd
caauaucauugacuuu

SEQ ID NO: 676856 - RNA, 22 nt, Haemophilus influenzae Rd
caaucaaauucucuguuucuuu

SEQ ID NO: 676857 - RNA, 22 nt, Haemophilus influenzae Rd
caaucacgaucugcaacaucac

SEQ ID NO: 676858 - RNA, 16 nt, Haemophilus influenzae Rd
caacguauuuauacca

SEQ ID NO: 676859 - RNA, 18 nt, Haemophilus influenzae Rd
caacuaugaagacuaaac

SEQ ID NO: 676860 - RNA, 13 nt, Haemophilus influenzae Rd
caacuaugguaaa

SEQ ID NO: 676861 - RNA, 19 nt, Haemophilus influenzae Rd
caagcuuguccaugaaaaa

SEQ ID NO: 676862 - RNA, 21 nt, Haemophilus influenzae Rd
caagcuggcuaacaaauaaug

SEQ ID NO: 676863 - RNA, 15 nt, Haemophilus influenzae Rd
cagaagucagcaaua

SEQ ID NO: 676864 - RNA, 20 nt, Haemophilus influenzae Rd
cagaaaacggcuuaguuaaa

SEQ ID NO: 676865 - RNA, 23 nt, Haemophilus influenzae Rd
cacuuuuuguuuguaauaaauuu

SEQ ID NO: 676866 - RNA, 20 nt, Haemophilus influenzae Rd
cacuuuuuauucaaaucgau

SEQ ID NO: 676867 - RNA, 20 nt, Haemophilus influenzae Rd
cacugugcauuaaaucaaau

SEQ ID NO: 676868 - RNA, 12 nt, Haemophilus influenzae Rd
aaagaaauuuua

SEQ ID NO: 676869 - RNA, 14 nt, Haemophilus influenzae Rd
cagagcaagauuua

SEQ ID NO: 676870 - RNA, 15 nt, Haemophilus influenzae Rd
cacugacaucaagca

SEQ ID NO: 676871 - RNA, 20 nt, Haemophilus influenzae Rd
cacuaauugcauuaaaaguc

SEQ ID NO: 676872 - RNA, 13 nt, Haemophilus influenzae Rd
cacuaaauaaaug

SEQ ID NO: 676873 - RNA, 17 nt, Haemophilus influenzae Rd
cacuaaaaacaagugcu

SEQ ID NO: 676874 - RNA, 19 nt, Haemophilus influenzae Rd
caccuacgccugcgaugcc

SEQ ID NO: 676875 - RNA, 20 nt, Haemophilus influenzae Rd
caccuaagaacugugaggca

SEQ ID NO: 676876 - RNA, 18 nt, Haemophilus influenzae Rd
aaacuguuuuggcauuuu

SEQ ID NO: 676877 - RNA, 19 nt, Haemophilus influenzae Rd
aaacuuaccgaucauuucu

SEQ ID NO: 676878 - RNA, 16 nt, Haemophilus influenzae Rd
aaacuuauaaagauau

SEQ ID NO: 676879 - RNA, 21 nt, Haemophilus influenzae Rd
aaacuucaccagugaauuucu

SEQ ID NO: 676880 - RNA, 14 nt, Haemophilus influenzae Rd
cagcauauugaaau

SEQ ID NO: 676881 - RNA, 13 nt, Haemophilus influenzae Rd
aaagccaacuuuu

SEQ ID NO: 676882 - RNA, 22 nt, Haemophilus influenzae Rd
aaagcaauauggguucaauaua

SEQ ID NO: 676883 - RNA, 23 nt, Haemophilus influenzae Rd
cagcuugaguugucacaacagau

SEQ ID NO: 676884 - RNA, 22 nt, Haemophilus influenzae Rd
caguugcuguguugauauucaa

SEQ ID NO: 676885 - RNA, 18 nt, Haemophilus influenzae Rd
cauaacaagaaucaucgc

SEQ ID NO: 676886 - RNA, 15 nt, Haemophilus influenzae Rd
cauaagugagaaaau

SEQ ID NO: 676887 - RNA, 23 nt, Haemophilus influenzae Rd
cauaauaaaauuuauuacaaaca

SEQ ID NO: 676888 - RNA, 16 nt, Haemophilus influenzae Rd
cauaaacaucuugcau

SEQ ID NO: 676889 - RNA, 16 nt, Haemophilus influenzae Rd
cauaaacaaaauaaac

SEQ ID NO: 676890 - RNA, 16 nt, Haemophilus influenzae Rd
cauaaacaauauaacc

SEQ ID NO: 676891 - RNA, 21 nt, Haemophilus influenzae Rd
cauaaaaggcaaagcaaaauc

SEQ ID NO: 676892 - RNA, 18 nt, Haemophilus influenzae Rd
cauacagccugcgauugc

SEQ ID NO: 676893 - RNA, 22 nt, Haemophilus influenzae Rd
cauacauucagugguaaucauu

SEQ ID NO: 676894 - RNA, 13 nt, Haemophilus influenzae Rd
cauaaucuugacc

SEQ ID NO: 676895 - RNA, 11 nt, Haemophilus influenzae Rd
cauaauauuuu

SEQ ID NO: 676896 - RNA, 18 nt, Haemophilus influenzae Rd
cauaguucacuaaaaauc

SEQ ID NO: 676897 - RNA, 21 nt, Haemophilus influenzae Rd
cauaguuuggcugaaauucua

SEQ ID NO: 676898 - RNA, 12 nt, Haemophilus influenzae Rd
caucaagauuua

SEQ ID NO: 676899 - RNA, 16 nt, Haemophilus influenzae Rd
caucaaauugauuaag

SEQ ID NO: 676900 - RNA, 15 nt, Haemophilus influenzae Rd
cauaucuaaagcauu

SEQ ID NO: 676901 - RNA, 20 nt, Haemophilus influenzae Rd
cauauagggcucaaauuuuc

SEQ ID NO: 676902 - RNA, 23 nt, Haemophilus influenzae Rd
caucgccaacuugaauaccugau

SEQ ID NO: 676903 - RNA, 19 nt, Haemophilus influenzae Rd
caucauuuuucgcaaaauc

SEQ ID NO: 676904 - RNA, 20 nt, Haemophilus influenzae Rd
caucaccgauaauaugcauc

SEQ ID NO: 676905 - RNA, 15 nt, Haemophilus influenzae Rd
caucauuaauacaca

SEQ ID NO: 676906 - RNA, 19 nt, Haemophilus influenzae Rd
cagguuuacccauauugaa

SEQ ID NO: 676907 - RNA, 20 nt, Haemophilus influenzae Rd
caguaaauugguuaauguaa

SEQ ID NO: 676908 - RNA, 16 nt, Haemophilus influenzae Rd
caguaacuucugcugc

SEQ ID NO: 676909 - RNA, 15 nt, Haemophilus influenzae Rd
cagugguaaaccuaa

SEQ ID NO: 676910 - RNA, 16 nt, Haemophilus influenzae Rd
caguucaauuuaacau

SEQ ID NO: 676911 - RNA, 20 nt, Haemophilus influenzae Rd
caguuaauuagaauaacaac

SEQ ID NO: 676912 - RNA, 14 nt, Haemophilus influenzae Rd
caguucaauaaaaa

SEQ ID NO: 676913 - RNA, 15 nt, Haemophilus influenzae Rd
caguucaauaaaaau

SEQ ID NO: 676914 - RNA, 23 nt, Haemophilus influenzae Rd
cauugaaaccugaguaaauaaac

SEQ ID NO: 676915 - RNA, 19 nt, Haemophilus influenzae Rd
cauugcauccacuucaucc

SEQ ID NO: 676916 - RNA, 18 nt, Haemophilus influenzae Rd
cauugauggaauaaauuu

SEQ ID NO: 676917 - RNA, 14 nt, Haemophilus influenzae Rd
cauuauuuggcaua

SEQ ID NO: 676918 - RNA, 14 nt, Haemophilus influenzae Rd
cauucauuuugagc

SEQ ID NO: 676919 - RNA, 18 nt, Haemophilus influenzae Rd
cauuacuuagauauauua

SEQ ID NO: 676920 - RNA, 17 nt, Haemophilus influenzae Rd
cauuaccguaugcaaac

SEQ ID NO: 676921 - RNA, 18 nt, Haemophilus influenzae Rd
cauuacgugcaaauaaau

SEQ ID NO: 676922 - RNA, 18 nt, Haemophilus influenzae Rd
cauuacguucauauaaau

SEQ ID NO: 676923 - RNA, 24 nt, Haemophilus influenzae Rd
cauuaauaggaauaacacaccaac

SEQ ID NO: 676924 - RNA, 20 nt, Haemophilus influenzae Rd
cauuaaccaacauaaacauu

SEQ ID NO: 676925 - RNA, 15 nt, Haemophilus influenzae Rd
cauuaaguuuuuagc

SEQ ID NO: 676926 - RNA, 13 nt, Haemophilus influenzae Rd
cauuaauaaauuu

SEQ ID NO: 676927 - RNA, 15 nt, Haemophilus influenzae Rd
cauuaaauauugagc

SEQ ID NO: 676928 - RNA, 15 nt, Haemophilus influenzae Rd
cauuaaagcaauugc

SEQ ID NO: 676929 - RNA, 16 nt, Haemophilus influenzae Rd
cauuaaagcaauugcu

SEQ ID NO: 676930 - RNA, 19 nt, Haemophilus influenzae Rd
cauuaaagcaauugcuaaa

SEQ ID NO: 676931 - RNA, 12 nt, Haemophilus influenzae Rd
cauuaaauaaaa

SEQ ID NO: 676932 - RNA, 19 nt, Haemophilus influenzae Rd
cauuaaacuggaugaaauc

SEQ ID NO: 676933 - RNA, 20 nt, Haemophilus influenzae Rd
cauuaaacuggaugaaauca

SEQ ID NO: 676934 - RNA, 22 nt, Haemophilus influenzae Rd
caugcgaagcguaacgcccaaa

SEQ ID NO: 676935 - RNA, 13 nt, Haemophilus influenzae Rd
ccaacagaaaauu

SEQ ID NO: 676936 - RNA, 15 nt, Haemophilus influenzae Rd
ccaagcguaaaagua

SEQ ID NO: 676937 - RNA, 11 nt, Haemophilus influenzae Rd
ccaacaauauc

SEQ ID NO: 676938 - RNA, 22 nt, Haemophilus influenzae Rd
ccaaauuuuccgcauaaauaau

SEQ ID NO: 676939 - RNA, 19 nt, Haemophilus influenzae Rd
cauuuuuauuaguaaaaua

SEQ ID NO: 676940 - RNA, 19 nt, Haemophilus influenzae Rd
cauuuuuaaaaauaacaua

SEQ ID NO: 676941 - RNA, 13 nt, Haemophilus influenzae Rd
cauuuuucgcaaa

SEQ ID NO: 676942 - RNA, 20 nt, Haemophilus influenzae Rd
cauuuuugcaauuuaacaua

SEQ ID NO: 676943 - RNA, 15 nt, Haemophilus influenzae Rd
cauuucuuauguuuu

SEQ ID NO: 676944 - RNA, 14 nt, Haemophilus influenzae Rd
cauuugaugguaaa

SEQ ID NO: 676945 - RNA, 14 nt, Haemophilus influenzae Rd
cauuugcacccgcu

SEQ ID NO: 676946 - RNA, 18 nt, Haemophilus influenzae Rd
cauuuggaucuaaaaaau

SEQ ID NO: 676947 - RNA, 17 nt, Haemophilus influenzae Rd
cauuuugaggaauaaau

SEQ ID NO: 676948 - RNA, 10 nt, Haemophilus influenzae Rd
cauuuuaaaa

SEQ ID NO: 676949 - RNA, 14 nt, Haemophilus influenzae Rd
cauuuuauugaaga

SEQ ID NO: 676950 - RNA, 21 nt, Haemophilus influenzae Rd
cauuuguuagaucaguuuuac

SEQ ID NO: 676951 - RNA, 14 nt, Haemophilus influenzae Rd
cauuucaauuucac

SEQ ID NO: 676952 - RNA, 18 nt, Haemophilus influenzae Rd
cauuucaccacuucaucc

SEQ ID NO: 676953 - RNA, 22 nt, Haemophilus influenzae Rd
cauuucaguuacguaauauuua

SEQ ID NO: 676954 - RNA, 14 nt, Haemophilus influenzae Rd
cauuuagucaauuu

SEQ ID NO: 676955 - RNA, 19 nt, Haemophilus influenzae Rd
cauuuagagggauaaaaau

SEQ ID NO: 676956 - RNA, 22 nt, Haemophilus influenzae Rd
cauuguccacagcaaaagaaau

SEQ ID NO: 676957 - RNA, 21 nt, Haemophilus influenzae Rd
cauuuaaaaguaaaaauaaaa

SEQ ID NO: 676958 - RNA, 19 nt, Haemophilus influenzae Rd
cauuuaaugaugaaacuga

SEQ ID NO: 676959 - RNA, 15 nt, Haemophilus influenzae Rd
cauuuaauggcugaa

SEQ ID NO: 676960 - RNA, 14 nt, Haemophilus influenzae Rd
ccacaugauauauu

SEQ ID NO: 676961 - RNA, 18 nt, Haemophilus influenzae Rd
ccacagguuucucuagcc

SEQ ID NO: 676962 - RNA, 15 nt, Haemophilus influenzae Rd
ccaauaaaacaguua

SEQ ID NO: 676963 - RNA, 20 nt, Haemophilus influenzae Rd
ccaauacgauaauuaaaguc

SEQ ID NO: 676964 - RNA, 20 nt, Haemophilus influenzae Rd
ccaauaugaacauuaugugc

SEQ ID NO: 676965 - RNA, 18 nt, Haemophilus influenzae Rd
ccaauuauuggcaauuuc

SEQ ID NO: 676966 - RNA, 22 nt, Haemophilus influenzae Rd
ccaauucaaagauuuuaaaauu

SEQ ID NO: 676967 - RNA, 17 nt, Haemophilus influenzae Rd
ccaauuaaccauaaaaa

SEQ ID NO: 676968 - RNA, 22 nt, Haemophilus influenzae Rd
ccacuuuuccaguauagugcgc

SEQ ID NO: 676969 - RNA, 21 nt, Haemophilus influenzae Rd
ccacuaauuucacaccauuuu

SEQ ID NO: 676970 - RNA, 17 nt, Haemophilus influenzae Rd
aaagugcgguaaaauca

SEQ ID NO: 676971 - RNA, 18 nt, Haemophilus influenzae Rd
aaagugcgguaaauuuuu

SEQ ID NO: 676972 - RNA, 19 nt, Haemophilus influenzae Rd
aaaguuaaucaaacuuuua

SEQ ID NO: 676973 - RNA, 19 nt, Haemophilus influenzae Rd
aaauaauuaaaaauaaaua

SEQ ID NO: 676974 - RNA, 14 nt, Haemophilus influenzae Rd
aaauaaccaauaua

SEQ ID NO: 676975 - RNA, 18 nt, Haemophilus influenzae Rd
aaauaaccgcacuguaau

SEQ ID NO: 676976 - RNA, 18 nt, Haemophilus influenzae Rd
aaauaaccgcacuuuaau

SEQ ID NO: 676977 - RNA, 23 nt, Haemophilus influenzae Rd
aaauaaaaaauccacacuuuaau

SEQ ID NO: 676978 - RNA, 22 nt, Haemophilus influenzae Rd
aaauaaaaacauugccaaagca

SEQ ID NO: 676979 - RNA, 21 nt, Haemophilus influenzae Rd
aaauaaacgcaucaacuuuau

SEQ ID NO: 676980 - RNA, 16 nt, Haemophilus influenzae Rd
aaauaaaauagacaau

SEQ ID NO: 676981 - RNA, 14 nt, Haemophilus influenzae Rd
aaauaaauaaaaua

SEQ ID NO: 676982 - RNA, 13 nt, Haemophilus influenzae Rd
aaauaaauuuauu

SEQ ID NO: 676983 - RNA, 22 nt, Haemophilus influenzae Rd
aaaucacaucgccaacuugaau

SEQ ID NO: 676984 - RNA, 18 nt, Haemophilus influenzae Rd
aaaucaccgcacuuuuau

SEQ ID NO: 676985 - RNA, 20 nt, Haemophilus influenzae Rd
aaauauucuuggagauaaua

SEQ ID NO: 676986 - RNA, 13 nt, Haemophilus influenzae Rd
aaauaucuugcac

SEQ ID NO: 676987 - RNA, 14 nt, Haemophilus influenzae Rd
aaauauaauaaaua

SEQ ID NO: 676988 - RNA, 15 nt, Haemophilus influenzae Rd
aaauagcugauaaua

SEQ ID NO: 676989 - RNA, 23 nt, Haemophilus influenzae Rd
aaauagcguaaagggaagugaua

SEQ ID NO: 676990 - RNA, 21 nt, Haemophilus influenzae Rd
aaauaguuaaucgaaaauuua

SEQ ID NO: 676991 - RNA, 11 nt, Haemophilus influenzae Rd
cccuucauaag

SEQ ID NO: 676992 - RNA, 19 nt, Haemophilus influenzae Rd
ccaguaagcauauuugcaa

SEQ ID NO: 676993 - RNA, 21 nt, Haemophilus influenzae Rd
ccagucacuucuucaauacgu

SEQ ID NO: 676994 - RNA, 23 nt, Haemophilus influenzae Rd
ccauauccgagcucuuucauuaa

SEQ ID NO: 676995 - RNA, 18 nt, Haemophilus influenzae Rd
ccauauucgcuuucauaa

SEQ ID NO: 676996 - RNA, 12 nt, Haemophilus influenzae Rd
ccauaauaucac

SEQ ID NO: 676997 - RNA, 15 nt, Haemophilus influenzae Rd
cccacuucugcacca

SEQ ID NO: 676998 - RNA, 18 nt, Haemophilus influenzae Rd
ccuccgccaagugcgguu

SEQ ID NO: 676999 - RNA, 14 nt, Haemophilus influenzae Rd
ccucaacaucaaaa

SEQ ID NO: 677000 - RNA, 16 nt, Haemophilus influenzae Rd
ccuauucuaaauuuau

SEQ ID NO: 677001 - RNA, 23 nt, Haemophilus influenzae Rd
ccuauuagacuuaauuucacauu

SEQ ID NO: 677002 - RNA, 22 nt, Haemophilus influenzae Rd
ccuacgauacuuuuaauuaaau

SEQ ID NO: 677003 - RNA, 23 nt, Haemophilus influenzae Rd
ccuaaaauugauuucauauauug

SEQ ID NO: 677004 - RNA, 19 nt, Haemophilus influenzae Rd
ccuacaggcuuccaacaaa

SEQ ID NO: 677005 - RNA, 20 nt, Haemophilus influenzae Rd
ccuacaccacccgauaaaug

SEQ ID NO: 677006 - RNA, 14 nt, Haemophilus influenzae Rd
ccuaauuucauaaa

SEQ ID NO: 677007 - RNA, 23 nt, Haemophilus influenzae Rd
ccuaaugcauugaugacugcauc

SEQ ID NO: 677008 - RNA, 19 nt, Haemophilus influenzae Rd
aaauucguuguaauugauu

SEQ ID NO: 677009 - RNA, 14 nt, Haemophilus influenzae Rd
aaauuggcuuguug

SEQ ID NO: 677010 - RNA, 13 nt, Haemophilus influenzae Rd
aaauucuuuuauu

SEQ ID NO: 677011 - RNA, 24 nt, Haemophilus influenzae Rd
aaauugaagccgaugaaagcuauu

SEQ ID NO: 677012 - RNA, 21 nt, Haemophilus influenzae Rd
aacaaaaaagugcgguaaaaa

SEQ ID NO: 677013 - RNA, 20 nt, Haemophilus influenzae Rd
aacaaaagggcgauuaaaaa

SEQ ID NO: 677014 - RNA, 22 nt, Haemophilus influenzae Rd
aaauuuuaaaaaauaauuuagu

SEQ ID NO: 677015 - RNA, 11 nt, Haemophilus influenzae Rd
aaauuuuaauu

SEQ ID NO: 677016 - RNA, 20 nt, Haemophilus influenzae Rd
aaauuuugaugaaaguugaa

SEQ ID NO: 677017 - RNA, 17 nt, Haemophilus influenzae Rd
aaauuuuuaaaguuauu

SEQ ID NO: 677018 - RNA, 22 nt, Haemophilus influenzae Rd
aaauuuuuaauaaaguaaaaua

SEQ ID NO: 677019 - RNA, 18 nt, Haemophilus influenzae Rd
aaauuuuuaauuuucucg

SEQ ID NO: 677020 - RNA, 23 nt, Haemophilus influenzae Rd
aaauuuuuggcugcugcaccaga

SEQ ID NO: 677021 - RNA, 13 nt, Haemophilus influenzae Rd
aaauggacuaaau

SEQ ID NO: 677022 - RNA, 22 nt, Haemophilus influenzae Rd
aaauggucaaugccaaaugcgg

SEQ ID NO: 677023 - RNA, 20 nt, Haemophilus influenzae Rd
aaauguaagagugaaguuau

SEQ ID NO: 677024 - RNA, 21 nt, Haemophilus influenzae Rd
aaauucaucguaauuaaacaa

SEQ ID NO: 677025 - RNA, 21 nt, Haemophilus influenzae Rd
aaauuauauuuuuaauuuaua

SEQ ID NO: 677026 - RNA, 16 nt, Haemophilus influenzae Rd
aaauuauguacgguaa

SEQ ID NO: 677027 - RNA, 22 nt, Haemophilus influenzae Rd
aaauuauucuucaucuucuuuu

SEQ ID NO: 677028 - RNA, 15 nt, Haemophilus influenzae Rd
aaauucaaagauuau

SEQ ID NO: 677029 - RNA, 16 nt, Haemophilus influenzae Rd
aaauuaauaagaaaau

SEQ ID NO: 677030 - RNA, 16 nt, Haemophilus influenzae Rd
aaauuaauacugaaau

SEQ ID NO: 677031 - RNA, 14 nt, Haemophilus influenzae Rd
aaauuaagaguaau

SEQ ID NO: 677032 - RNA, 15 nt, Haemophilus influenzae Rd
aaauuaagcagcgaa

SEQ ID NO: 677033 - RNA, 22 nt, Haemophilus influenzae Rd
aaauuacuuggggcuaauuuuu

SEQ ID NO: 677034 - RNA, 13 nt, Haemophilus influenzae Rd
aaauuacuuuucg

SEQ ID NO: 677035 - RNA, 17 nt, Haemophilus influenzae Rd
aaauuagcguaaacauu

SEQ ID NO: 677036 - RNA, 19 nt, Haemophilus influenzae Rd
aaauuaaccgcacuuucau

SEQ ID NO: 677037 - RNA, 16 nt, Haemophilus influenzae Rd
aaauuaaaaauuuaau

SEQ ID NO: 677038 - RNA, 15 nt, Haemophilus influenzae Rd
ccgcaccaauaacag

SEQ ID NO: 677039 - RNA, 19 nt, Haemophilus influenzae Rd
cgacauuaagugcaucaac

SEQ ID NO: 677040 - RNA, 23 nt, Haemophilus influenzae Rd
cgacaucaaucaaauucaacacg

SEQ ID NO: 677041 - RNA, 13 nt, Haemophilus influenzae Rd
aacaaugaaauua

SEQ ID NO: 677042 - RNA, 20 nt, Haemophilus influenzae Rd
aacaauggcaacaaauauug

SEQ ID NO: 677043 - RNA, 22 nt, Haemophilus influenzae Rd
aacacaaacugguuaaaaucca

SEQ ID NO: 677044 - RNA, 14 nt, Haemophilus influenzae Rd
cgaaauaaaucuaa

SEQ ID NO: 677045 - RNA, 21 nt, Haemophilus influenzae Rd
cgaaccugauaaguagaaaaa

SEQ ID NO: 677046 - RNA, 14 nt, Haemophilus influenzae Rd
cgaauaauacugcu

SEQ ID NO: 677047 - RNA, 21 nt, Haemophilus influenzae Rd
cgaauaaaugcaucauuaaua

SEQ ID NO: 677048 - RNA, 12 nt, Haemophilus influenzae Rd
cgaaucaaaauc

SEQ ID NO: 677049 - RNA, 13 nt, Haemophilus influenzae Rd
ccuuuuucuucuu

SEQ ID NO: 677050 - RNA, 22 nt, Haemophilus influenzae Rd
cgaaaaaacgcggucuaaauag

SEQ ID NO: 677051 - RNA, 19 nt, Haemophilus influenzae Rd
ccuuuucauaaaaauugau

SEQ ID NO: 677052 - RNA, 15 nt, Haemophilus influenzae Rd
ccuuuuaauaaauug

SEQ ID NO: 677053 - RNA, 17 nt, Haemophilus influenzae Rd
ccuuugguaaaagaaau

SEQ ID NO: 677054 - RNA, 18 nt, Haemophilus influenzae Rd
cgaaagcuucauugcuaa

SEQ ID NO: 677055 - RNA, 16 nt, Haemophilus influenzae Rd
ccuugcugauaaauuc

SEQ ID NO: 677056 - RNA, 15 nt, Haemophilus influenzae Rd
ccuugugucuaccga

SEQ ID NO: 677057 - RNA, 18 nt, Haemophilus influenzae Rd
ccuugugcauaaacaaau

SEQ ID NO: 677058 - RNA, 19 nt, Haemophilus influenzae Rd
ccuuguaacguauuuaaaa

SEQ ID NO: 677059 - RNA, 20 nt, Haemophilus influenzae Rd
ccuugacauauucuguugaa

SEQ ID NO: 677060 - RNA, 17 nt, Haemophilus influenzae Rd
ccuucauauaauaaacg

SEQ ID NO: 677061 - RNA, 12 nt, Haemophilus influenzae Rd
ccuguuucacaa

SEQ ID NO: 677062 - RNA, 15 nt, Haemophilus influenzae Rd
ccuuaucuucacgau

SEQ ID NO: 677063 - RNA, 19 nt, Haemophilus influenzae Rd
ccuuaaucauugcaagugc

SEQ ID NO: 677064 - RNA, 13 nt, Haemophilus influenzae Rd
cgaucacugcacc

SEQ ID NO: 677065 - RNA, 23 nt, Haemophilus influenzae Rd
cgauaguggcaccgaauguggca

SEQ ID NO: 677066 - RNA, 21 nt, Haemophilus influenzae Rd
cgauagucaccaucacaagca

SEQ ID NO: 677067 - RNA, 19 nt, Haemophilus influenzae Rd
cgaugcggucggcgaguug

SEQ ID NO: 677068 - RNA, 19 nt, Haemophilus influenzae Rd
cgaugacuaaacaaauaaa

SEQ ID NO: 677069 - RNA, 19 nt, Haemophilus influenzae Rd
cgcaccuuuacguuuaacu

SEQ ID NO: 677070 - RNA, 13 nt, Haemophilus influenzae Rd
cgcaaugaaauuu

SEQ ID NO: 677071 - RNA, 15 nt, Haemophilus influenzae Rd
cgcaauaacaccgau

SEQ ID NO: 677072 - RNA, 18 nt, Haemophilus influenzae Rd
cgcaaauuuucguuuacc

SEQ ID NO: 677073 - RNA, 17 nt, Haemophilus influenzae Rd
cgauuuugacuuuugcc

SEQ ID NO: 677074 - RNA, 15 nt, Haemophilus influenzae Rd
cgcauaaauaauaaa

SEQ ID NO: 677075 - RNA, 17 nt, Haemophilus influenzae Rd
cgccaacguaagcacca

SEQ ID NO: 677076 - RNA, 15 nt, Haemophilus influenzae Rd
cgcaucgucuuuacc

SEQ ID NO: 677077 - RNA, 15 nt, Haemophilus influenzae Rd
cggggaucggaacag

SEQ ID NO: 677078 - RNA, 15 nt, Haemophilus influenzae Rd
aacauuaaucgauca

SEQ ID NO: 677079 - RNA, 18 nt, Haemophilus influenzae Rd
cggcaucaaaccaaccac

SEQ ID NO: 677080 - RNA, 22 nt, Haemophilus influenzae Rd
cggcaaagguuuuauuuugaac

SEQ ID NO: 677081 - RNA, 19 nt, Haemophilus influenzae Rd
cggcaaugguuaauacaaa

SEQ ID NO: 677082 - RNA, 13 nt, Haemophilus influenzae Rd
cggcaagcaaaca

SEQ ID NO: 677083 - RNA, 15 nt, Haemophilus influenzae Rd
aacagaaguugaaaa

SEQ ID NO: 677084 - RNA, 19 nt, Haemophilus influenzae Rd
cgcucuaacaauauuucac

SEQ ID NO: 677085 - RNA, 17 nt, Haemophilus influenzae Rd
aacaggaauuugcucaa

SEQ ID NO: 677086 - RNA, 15 nt, Haemophilus influenzae Rd
ggcaaucauaaucgc

SEQ ID NO: 677087 - RNA, 17 nt, Haemophilus influenzae Rd
ggcaauacuacggcgua

SEQ ID NO: 677088 - RNA, 10 nt, Haemophilus influenzae Rd
ggcaauaauu

SEQ ID NO: 677089 - RNA, 15 nt, Haemophilus influenzae Rd
ggauaucuuguugau

SEQ ID NO: 677090 - RNA, 15 nt, Haemophilus influenzae Rd
ggauauagaaaucau

SEQ ID NO: 677091 - RNA, 21 nt, Haemophilus influenzae Rd
aaggccuccgccaagugcggu

SEQ ID NO: 677092 - RNA, 17 nt, Haemophilus influenzae Rd
aaggcaucggcagaauu

SEQ ID NO: 677093 - RNA, 21 nt, Haemophilus influenzae Rd
aaggcacagggcugauaaauu

SEQ ID NO: 677094 - RNA, 22 nt, Haemophilus influenzae Rd
aaggcacagggcugauaaauuu

SEQ ID NO: 677095 - RNA, 21 nt, Haemophilus influenzae Rd
aaggacuaagcuuuuuuuaau

SEQ ID NO: 677096 - RNA, 14 nt, Haemophilus influenzae Rd
ggagccaaauuuaa

SEQ ID NO: 677097 - RNA, 18 nt, Haemophilus influenzae Rd
ggaauaacacaccaacaa

SEQ ID NO: 677098 - RNA, 18 nt, Haemophilus influenzae Rd
ggaauaagauaacaucac

SEQ ID NO: 677099 - RNA, 11 nt, Haemophilus influenzae Rd
ggaauauucaa

SEQ ID NO: 677100 - RNA, 19 nt, Haemophilus influenzae Rd
ggaauggauguaaugagca

SEQ ID NO: 677101 - RNA, 20 nt, Haemophilus influenzae Rd
ggaacaauuucuagcgguaa

SEQ ID NO: 677102 - RNA, 16 nt, Haemophilus influenzae Rd
ggaacaguaaauuuaa

SEQ ID NO: 677103 - RNA, 13 nt, Haemophilus influenzae Rd
aaggcuaaguucu

SEQ ID NO: 677104 - RNA, 15 nt, Haemophilus influenzae Rd
aagggaaauaacaaa

SEQ ID NO: 677105 - RNA, 14 nt, Haemophilus influenzae Rd
aagggauuuaaaau

SEQ ID NO: 677106 - RNA, 16 nt, Haemophilus influenzae Rd
aagggauuuaaaaucc

SEQ ID NO: 677107 - RNA, 14 nt, Haemophilus influenzae Rd
ggugcagauuaauu

SEQ ID NO: 677108 - RNA, 17 nt, Haemophilus influenzae Rd
ggugcaaccauaucgua

SEQ ID NO: 677109 - RNA, 16 nt, Haemophilus influenzae Rd
ggugcuauuuuauuua

SEQ ID NO: 677110 - RNA, 16 nt, Haemophilus influenzae Rd
gguaucggucuugcua

SEQ ID NO: 677111 - RNA, 12 nt, Haemophilus influenzae Rd
gguauuuauuau

SEQ ID NO: 677112 - RNA, 22 nt, Haemophilus influenzae Rd
aagguuuggacaccuuuuuccu

SEQ ID NO: 677113 - RNA, 18 nt, Haemophilus influenzae Rd
aaguaacaauguagaaau

SEQ ID NO: 677114 - RNA, 20 nt, Haemophilus influenzae Rd
gggccaaauaauacaucugc

SEQ ID NO: 677115 - RNA, 15 nt, Haemophilus influenzae Rd
gggauucgguuuuuc

SEQ ID NO: 677116 - RNA, 17 nt, Haemophilus influenzae Rd
guacauccgauggcaau

SEQ ID NO: 677117 - RNA, 20 nt, Haemophilus influenzae Rd
guacaucuaaguauucauga

SEQ ID NO: 677118 - RNA, 18 nt, Haemophilus influenzae Rd
guaacuuguguauaacug

SEQ ID NO: 677119 - RNA, 17 nt, Haemophilus influenzae Rd
guaaggguaucacaaag

SEQ ID NO: 677120 - RNA, 17 nt, Haemophilus influenzae Rd
guaaguacgauaaacac

SEQ ID NO: 677121 - RNA, 12 nt, Haemophilus influenzae Rd
guaauaaaucaa

SEQ ID NO: 677122 - RNA, 15 nt, Haemophilus influenzae Rd
guaaauuaugcccaa

SEQ ID NO: 677123 - RNA, 22 nt, Haemophilus influenzae Rd
guaaaucuacuuggacauuguu

SEQ ID NO: 677124 - RNA, 20 nt, Haemophilus influenzae Rd
gguuuuccacuucuucuuua

SEQ ID NO: 677125 - RNA, 21 nt, Haemophilus influenzae Rd
guaaauaaaaaaauaccgcac

SEQ ID NO: 677126 - RNA, 12 nt, Haemophilus influenzae Rd
guaaauaagcca

SEQ ID NO: 677127 - RNA, 14 nt, Haemophilus influenzae Rd
gguuuucuugccaa

SEQ ID NO: 677128 - RNA, 17 nt, Haemophilus influenzae Rd
guaaaaaaaugaaauau

SEQ ID NO: 677129 - RNA, 17 nt, Haemophilus influenzae Rd
guaaaaagugcggugaa

SEQ ID NO: 677130 - RNA, 23 nt, Haemophilus influenzae Rd
guaaaaagugcggugaaauuuua

SEQ ID NO: 677131 - RNA, 13 nt, Haemophilus influenzae Rd
guagcaauaacca

SEQ ID NO: 677132 - RNA, 21 nt, Haemophilus influenzae Rd
guacgucuuuuggcguuaaag

SEQ ID NO: 677133 - RNA, 12 nt, Haemophilus influenzae Rd
aaguauuuuccu

SEQ ID NO: 677134 - RNA, 18 nt, Haemophilus influenzae Rd
aaguauugagcgauaaaa

SEQ ID NO: 677135 - RNA, 21 nt, Haemophilus influenzae Rd
aaguauaauauagaugaagug

SEQ ID NO: 677136 - RNA, 19 nt, Haemophilus influenzae Rd
guaucacgcacaccaccug

SEQ ID NO: 677137 - RNA, 17 nt, Haemophilus influenzae Rd
aagucgguucauuuggg

SEQ ID NO: 677138 - RNA, 14 nt, Haemophilus influenzae Rd
gucagaaagcggau

SEQ ID NO: 677139 - RNA, 14 nt, Haemophilus influenzae Rd
gucacuucuucaau

SEQ ID NO: 677140 - RNA, 15 nt, Haemophilus influenzae Rd
gucaauaaaucccaa

SEQ ID NO: 677141 - RNA, 20 nt, Haemophilus influenzae Rd
gucacaaugauuaauaucac

SEQ ID NO: 677142 - RNA, 15 nt, Haemophilus influenzae Rd
guauuuuauuuauag

SEQ ID NO: 677143 - RNA, 12 nt, Haemophilus influenzae Rd
guauuuucucau

SEQ ID NO: 677144 - RNA, 23 nt, Haemophilus influenzae Rd
guauuuuuuuauuuacuuuauuu

SEQ ID NO: 677145 - RNA, 13 nt, Haemophilus influenzae Rd
guauuuacuaaau

SEQ ID NO: 677146 - RNA, 12 nt, Haemophilus influenzae Rd
guauuaaguaaa

SEQ ID NO: 677147 - RNA, 21 nt, Haemophilus influenzae Rd
guccaucaaaaaaauaagugu

SEQ ID NO: 677148 - RNA, 14 nt, Haemophilus influenzae Rd
gucgcuuuuuccuc

SEQ ID NO: 677149 - RNA, 16 nt, Haemophilus influenzae Rd
gcguuuaauaucgcca

SEQ ID NO: 677150 - RNA, 20 nt, Haemophilus influenzae Rd
gcguuuaacugcuuuuuucc

SEQ ID NO: 677151 - RNA, 15 nt, Haemophilus influenzae Rd
gcguugucaucagaa

SEQ ID NO: 677152 - RNA, 15 nt, Haemophilus influenzae Rd
gcuaacucaucaaca

SEQ ID NO: 677153 - RNA, 24 nt, Haemophilus influenzae Rd
gcuaauaaugccaagaaagucauu

SEQ ID NO: 677154 - RNA, 20 nt, Haemophilus influenzae Rd
gcuaaaucuguuucauuugu

SEQ ID NO: 677155 - RNA, 16 nt, Haemophilus influenzae Rd
gcuaaauaaauuccua

SEQ ID NO: 677156 - RNA, 14 nt, Haemophilus influenzae Rd
gcuaaaucaccuaa

SEQ ID NO: 677157 - RNA, 19 nt, Haemophilus influenzae Rd
gcuaaaauaaaaccuucug

SEQ ID NO: 677158 - RNA, 15 nt, Haemophilus influenzae Rd
gcguugaaaauaaau

SEQ ID NO: 677159 - RNA, 18 nt, Haemophilus influenzae Rd
gcuaugauuuuaaagcca

SEQ ID NO: 677160 - RNA, 19 nt, Haemophilus influenzae Rd
gcuauucccgcauuuauca

SEQ ID NO: 677161 - RNA, 23 nt, Haemophilus influenzae Rd
gcuauuuaauaauuuaaauuuau

SEQ ID NO: 677162 - RNA, 17 nt, Haemophilus influenzae Rd
gcuaucgucaaauuuaa

SEQ ID NO: 677163 - RNA, 18 nt, Haemophilus influenzae Rd
gcuaucgucaaauuuaaa

SEQ ID NO: 677164 - RNA, 14 nt, Haemophilus influenzae Rd
gcuagccaauaauc

SEQ ID NO: 677165 - RNA, 22 nt, Haemophilus influenzae Rd
gcuauaaguaacuuuagaacau

SEQ ID NO: 677166 - RNA, 22 nt, Haemophilus influenzae Rd
gcuaguucuuccuugguuaauc

SEQ ID NO: 677167 - RNA, 18 nt, Haemophilus influenzae Rd
gcuaauuuuucagguaaa

SEQ ID NO: 677168 - RNA, 22 nt, Haemophilus influenzae Rd
gcucgcuccccuucauaagccc

SEQ ID NO: 677169 - RNA, 18 nt, Haemophilus influenzae Rd
gcucuuguagcacauaaa

SEQ ID NO: 677170 - RNA, 19 nt, Haemophilus influenzae Rd
gcugauuuuuuaaaguaau

SEQ ID NO: 677171 - RNA, 14 nt, Haemophilus influenzae Rd
aagcugcuuuuaau

SEQ ID NO: 677172 - RNA, 20 nt, Haemophilus influenzae Rd
aagcucagguucaaaacgcu

SEQ ID NO: 677173 - RNA, 15 nt, Haemophilus influenzae Rd
gcgcugauuuuucac

SEQ ID NO: 677174 - RNA, 11 nt, Haemophilus influenzae Rd
gcggcaaaaaa

SEQ ID NO: 677175 - RNA, 16 nt, Haemophilus influenzae Rd
aagccuaaaccaaaua

SEQ ID NO: 677176 - RNA, 20 nt, Haemophilus influenzae Rd
aagccuucaccuaauccuac

SEQ ID NO: 677177 - RNA, 21 nt, Haemophilus influenzae Rd
aagcagcuggcgguuugaaau

SEQ ID NO: 677178 - RNA, 20 nt, Haemophilus influenzae Rd
aagcaucgcuggauaaaugc

SEQ ID NO: 677179 - RNA, 14 nt, Haemophilus influenzae Rd
aagcaugaauaaaa

SEQ ID NO: 677180 - RNA, 14 nt, Haemophilus influenzae Rd
aagcauauuugcaa

SEQ ID NO: 677181 - RNA, 17 nt, Haemophilus influenzae Rd
aagcauauuugcugcac

SEQ ID NO: 677182 - RNA, 21 nt, Haemophilus influenzae Rd
aagcauccaucgacauacaaa

SEQ ID NO: 677183 - RNA, 13 nt, Haemophilus influenzae Rd
gccugacauuuuu

SEQ ID NO: 677184 - RNA, 15 nt, Haemophilus influenzae Rd
gccuaauagaaaaau

SEQ ID NO: 677185 - RNA, 16 nt, Haemophilus influenzae Rd
gccuaauucuugccag

SEQ ID NO: 677186 - RNA, 20 nt, Haemophilus influenzae Rd
aagccauauucuuucgccaa

SEQ ID NO: 677187 - RNA, 19 nt, Haemophilus influenzae Rd
gcgaucaccgcccuuuuua

SEQ ID NO: 677188 - RNA, 12 nt, Haemophilus influenzae Rd
gcgauguuuucc

SEQ ID NO: 677189 - RNA, 17 nt, Haemophilus influenzae Rd
gcgaccauuacagcaag

SEQ ID NO: 677190 - RNA, 16 nt, Haemophilus influenzae Rd
gcgacggcaucaaacc

SEQ ID NO: 677191 - RNA, 14 nt, Haemophilus influenzae Rd
aagauuugcugcug

SEQ ID NO: 677192 - RNA, 23 nt, Haemophilus influenzae Rd
aagaugaggcguuuuucuuaaau

SEQ ID NO: 677193 - RNA, 14 nt, Haemophilus influenzae Rd
aagaugauaaauuc

SEQ ID NO: 677194 - RNA, 16 nt, Haemophilus influenzae Rd
aagacuaaaaccacau

SEQ ID NO: 677195 - RNA, 15 nt, Haemophilus influenzae Rd
aagaggagguagaaa

SEQ ID NO: 677196 - RNA, 15 nt, Haemophilus influenzae Rd
aagauaaaagugcgg

SEQ ID NO: 677197 - RNA, 15 nt, Haemophilus influenzae Rd
aagaauaccacgcgu

SEQ ID NO: 677198 - RNA, 21 nt, Haemophilus influenzae Rd
aagaaugacuggcuugugaaa

SEQ ID NO: 677199 - RNA, 16 nt, Haemophilus influenzae Rd
aagaauuaaaaauggc

SEQ ID NO: 677200 - RNA, 21 nt, Haemophilus influenzae Rd
gccauaauaacgccacccgca

SEQ ID NO: 677201 - RNA, 15 nt, Haemophilus influenzae Rd
gccauaaaaaauuaa

SEQ ID NO: 677202 - RNA, 20 nt, Haemophilus influenzae Rd
gccaguugaaagaauaucaa

SEQ ID NO: 677203 - RNA, 19 nt, Haemophilus influenzae Rd
gccagauacaaauaacaca

SEQ ID NO: 677204 - RNA, 18 nt, Haemophilus influenzae Rd
gccacugcccuauuugug

SEQ ID NO: 677205 - RNA, 12 nt, Haemophilus influenzae Rd
gccaacaacuua

SEQ ID NO: 677206 - RNA, 12 nt, Haemophilus influenzae Rd
gccaaaauucug

SEQ ID NO: 677207 - RNA, 15 nt, Haemophilus influenzae Rd
gccaaaaccauucag

SEQ ID NO: 677208 - RNA, 13 nt, Haemophilus influenzae Rd
gccaaaaauugca

SEQ ID NO: 677209 - RNA, 17 nt, Haemophilus influenzae Rd
gcauuuagagcaagcaa

SEQ ID NO: 677210 - RNA, 23 nt, Haemophilus influenzae Rd
gcauuuacauaaacggcugccgc

SEQ ID NO: 677211 - RNA, 15 nt, Haemophilus influenzae Rd
gcauugcugugcgac

SEQ ID NO: 677212 - RNA, 20 nt, Haemophilus influenzae Rd
gcauuggaaugguauaaaaa

SEQ ID NO: 677213 - RNA, 16 nt, Haemophilus influenzae Rd
gcauugauugcuaaau

SEQ ID NO: 677214 - RNA, 20 nt, Haemophilus influenzae Rd
gcauugauugcuaaauaaau

SEQ ID NO: 677215 - RNA, 23 nt, Haemophilus influenzae Rd
gccaauacuuagcgugcuaauuc

SEQ ID NO: 677216 - RNA, 15 nt, Haemophilus influenzae Rd
gcauuaauaaucuaa

SEQ ID NO: 677217 - RNA, 20 nt, Haemophilus influenzae Rd
gcauuaaaaauuuaaaagca

SEQ ID NO: 677218 - RNA, 18 nt, Haemophilus influenzae Rd
gcauuaaaucaaauuuag

SEQ ID NO: 677219 - RNA, 18 nt, Haemophilus influenzae Rd
gcaguggugacuugcgca

SEQ ID NO: 677220 - RNA, 20 nt, Haemophilus influenzae Rd
gcaguuacugccucugccac

SEQ ID NO: 677221 - RNA, 16 nt, Haemophilus influenzae Rd
gcaguugcuaaaucac

SEQ ID NO: 677222 - RNA, 16 nt, Haemophilus influenzae Rd
gcauaauacuugacaa

SEQ ID NO: 677223 - RNA, 18 nt, Haemophilus influenzae Rd
gcauaauacuugacaacg

SEQ ID NO: 677224 - RNA, 14 nt, Haemophilus influenzae Rd
gcaucagauccgcg

SEQ ID NO: 677225 - RNA, 12 nt, Haemophilus influenzae Rd
gcauauuuucca

SEQ ID NO: 677226 - RNA, 21 nt, Haemophilus influenzae Rd
gcauauugcuugcauucacaa

SEQ ID NO: 677227 - RNA, 12 nt, Haemophilus influenzae Rd
gcaucaauaauu

SEQ ID NO: 677228 - RNA, 18 nt, Haemophilus influenzae Rd
gcauaucacgauaagcaa

SEQ ID NO: 677229 - RNA, 15 nt, Haemophilus influenzae Rd
gcauauaaaauaaag

SEQ ID NO: 677230 - RNA, 20 nt, Haemophilus influenzae Rd
gcauagccaagugcuuuacc

SEQ ID NO: 677231 - RNA, 18 nt, Haemophilus influenzae Rd
gcaucgguauuaaugaca

SEQ ID NO: 677232 - RNA, 21 nt, Haemophilus influenzae Rd
gcaucguuuacaucacguaag

SEQ ID NO: 677233 - RNA, 16 nt, Haemophilus influenzae Rd
gcaucuaaaaauaauu

SEQ ID NO: 677234 - RNA, 16 nt, Haemophilus influenzae Rd
gagcauuuuuuauuaa

SEQ ID NO: 677235 - RNA, 16 nt, Haemophilus influenzae Rd
gagauaaauaaauuca

SEQ ID NO: 677236 - RNA, 20 nt, Haemophilus influenzae Rd
gagauuuauuuugguauuuu

SEQ ID NO: 677237 - RNA, 13 nt, Haemophilus influenzae Rd
gacgugcuaauuc

SEQ ID NO: 677238 - RNA, 18 nt, Haemophilus influenzae Rd
gacuauuuagaaauucug

SEQ ID NO: 677239 - RNA, 13 nt, Haemophilus influenzae Rd
gacuggcaaaaau

SEQ ID NO: 677240 - RNA, 23 nt, Haemophilus influenzae Rd
aacuauuacgcuguccaauaauu

SEQ ID NO: 677241 - RNA, 13 nt, Haemophilus influenzae Rd
aacuaccgcacuu

SEQ ID NO: 677242 - RNA, 15 nt, Haemophilus influenzae Rd
aacuaccacagguuu

SEQ ID NO: 677243 - RNA, 16 nt, Haemophilus influenzae Rd
aacuacggacuaaaua

SEQ ID NO: 677244 - RNA, 16 nt, Haemophilus influenzae Rd
aacuaaaugaaguuca

SEQ ID NO: 677245 - RNA, 14 nt, Haemophilus influenzae Rd
aacuaauaaaccaa

SEQ ID NO: 677246 - RNA, 21 nt, Haemophilus influenzae Rd
gaggauuuuugccguuuucua

SEQ ID NO: 677247 - RNA, 14 nt, Haemophilus influenzae Rd
gaguuauaaaccca

SEQ ID NO: 677248 - RNA, 16 nt, Haemophilus influenzae Rd
gauaaucgcaagguca

SEQ ID NO: 677249 - RNA, 16 nt, Haemophilus influenzae Rd
gauaauaguaucagcu

SEQ ID NO: 677250 - RNA, 20 nt, Haemophilus influenzae Rd
gauaagccauuaacauuuaa

SEQ ID NO: 677251 - RNA, 20 nt, Haemophilus influenzae Rd
gauaauauuuuugccaauuu

SEQ ID NO: 677252 - RNA, 15 nt, Haemophilus influenzae Rd
gauaauuaaagucag

SEQ ID NO: 677253 - RNA, 18 nt, Haemophilus influenzae Rd
gauacgaaauagcguuuu

SEQ ID NO: 677254 - RNA, 19 nt, Haemophilus influenzae Rd
gaguugucccgcauauaaa

SEQ ID NO: 677255 - RNA, 20 nt, Haemophilus influenzae Rd
gaguucuugcaacuuuuuua

SEQ ID NO: 677256 - RNA, 22 nt, Haemophilus influenzae Rd
gaguucuguaauucacagggcu

SEQ ID NO: 677257 - RNA, 17 nt, Haemophilus influenzae Rd
gauaacuucuucauucc

SEQ ID NO: 677258 - RNA, 16 nt, Haemophilus influenzae Rd
gauaaaguccauaaua

SEQ ID NO: 677259 - RNA, 11 nt, Haemophilus influenzae Rd
gauaaauaaac

SEQ ID NO: 677260 - RNA, 13 nt, Haemophilus influenzae Rd
gauaaaaauaaaa

SEQ ID NO: 677261 - RNA, 16 nt, Haemophilus influenzae Rd
gauagaaacgaguugu

SEQ ID NO: 677262 - RNA, 21 nt, Haemophilus influenzae Rd
gauagccaaagguugcggcga

SEQ ID NO: 677263 - RNA, 11 nt, Haemophilus influenzae Rd
gauaugccacc

SEQ ID NO: 677264 - RNA, 15 nt, Haemophilus influenzae Rd
gaucgguuuuauuau

SEQ ID NO: 677265 - RNA, 22 nt, Haemophilus influenzae Rd
gaucacgcaaaggaacaauuuc

SEQ ID NO: 677266 - RNA, 13 nt, Haemophilus influenzae Rd
gauccauuaauaa

SEQ ID NO: 677267 - RNA, 13 nt, Haemophilus influenzae Rd
gauccauuacaaa

SEQ ID NO: 677268 - RNA, 13 nt, Haemophilus influenzae Rd
gcacgagcaauaa

SEQ ID NO: 677269 - RNA, 18 nt, Haemophilus influenzae Rd
gcaccuuuugcaagcauu

SEQ ID NO: 677270 - RNA, 21 nt, Haemophilus influenzae Rd
gcaccuaaaauuuuuaggugc

SEQ ID NO: 677271 - RNA, 14 nt, Haemophilus influenzae Rd
gcaccaucacguaa

SEQ ID NO: 677272 - RNA, 21 nt, Haemophilus influenzae Rd
gcagaucgcuauuuaauaauu

SEQ ID NO: 677273 - RNA, 13 nt, Haemophilus influenzae Rd
gcaacuucugcgc

SEQ ID NO: 677274 - RNA, 13 nt, Haemophilus influenzae Rd
gcaacuaaauuca

SEQ ID NO: 677275 - RNA, 20 nt, Haemophilus influenzae Rd
gcaagcaguuuacgguuaag

SEQ ID NO: 677276 - RNA, 23 nt, Haemophilus influenzae Rd
gcaaugguuaauacaaagcgauu

SEQ ID NO: 677277 - RNA, 13 nt, Haemophilus influenzae Rd
gcaaucuucacaa

SEQ ID NO: 677278 - RNA, 14 nt, Haemophilus influenzae Rd
gcaaucgucaaaua

SEQ ID NO: 677279 - RNA, 13 nt, Haemophilus influenzae Rd
gcacaacgguuga

SEQ ID NO: 677280 - RNA, 17 nt, Haemophilus influenzae Rd
gcacaagauuugccaaa

SEQ ID NO: 677281 - RNA, 18 nt, Haemophilus influenzae Rd
gcaauuaagccugcaaag

SEQ ID NO: 677282 - RNA, 22 nt, Haemophilus influenzae Rd
gcaauuaagccugcaaagccuu

SEQ ID NO: 677283 - RNA, 20 nt, Haemophilus influenzae Rd
gcaauagcgaccaacaguua

SEQ ID NO: 677284 - RNA, 15 nt, Haemophilus influenzae Rd
gcaaggcucacaaag

SEQ ID NO: 677285 - RNA, 13 nt, Haemophilus influenzae Rd
gcaauaaauuuau

SEQ ID NO: 677286 - RNA, 15 nt, Haemophilus influenzae Rd
gcaaacaaaauaaau

SEQ ID NO: 677287 - RNA, 19 nt, Haemophilus influenzae Rd
gcaaaauuuaguccuucug

SEQ ID NO: 677288 - RNA, 17 nt, Haemophilus influenzae Rd
gauuuuuuuaugagcaa

SEQ ID NO: 677289 - RNA, 17 nt, Haemophilus influenzae Rd
gcaaaaucgcaauauua

SEQ ID NO: 677290 - RNA, 15 nt, Haemophilus influenzae Rd
gcaaaaucauauuga

SEQ ID NO: 677291 - RNA, 23 nt, Haemophilus influenzae Rd
gcaaagguuuuauuuugaacaau

SEQ ID NO: 677292 - RNA, 18 nt, Haemophilus influenzae Rd
gcaaaggaacaauuucua

SEQ ID NO: 677293 - RNA, 21 nt, Haemophilus influenzae Rd
gauugagaaaauguauaaagc

SEQ ID NO: 677294 - RNA, 23 nt, Haemophilus influenzae Rd
gauucuuccaauuacuaaugccg

SEQ ID NO: 677295 - RNA, 18 nt, Haemophilus influenzae Rd
gauuaucuaaauuucgcu

SEQ ID NO: 677296 - RNA, 17 nt, Haemophilus influenzae Rd
cuguaaugacagaaucu

SEQ ID NO: 677297 - RNA, 23 nt, Haemophilus influenzae Rd
cuguugagcaucuacccaauaaa

SEQ ID NO: 677298 - RNA, 16 nt, Haemophilus influenzae Rd
cuuaauuaagauaauu

SEQ ID NO: 677299 - RNA, 14 nt, Haemophilus influenzae Rd
cuuaaugcaaaauc

SEQ ID NO: 677300 - RNA, 15 nt, Haemophilus influenzae Rd
cuuaccccaacaaac

SEQ ID NO: 677301 - RNA, 20 nt, Haemophilus influenzae Rd
cuugauaaguaggcaaaauc

SEQ ID NO: 677302 - RNA, 23 nt, Haemophilus influenzae Rd
cuugauuauuuaauuucaaaauc

SEQ ID NO: 677303 - RNA, 18 nt, Haemophilus influenzae Rd
cuugcaagggauuugaaa

SEQ ID NO: 677304 - RNA, 18 nt, Haemophilus influenzae Rd
cuugaauggcuaucugcu

SEQ ID NO: 677305 - RNA, 22 nt, Haemophilus influenzae Rd
cuugaauugcauuuucuuccaa

SEQ ID NO: 677306 - RNA, 22 nt, Haemophilus influenzae Rd
cuugaaaccucccaaaaacuaa

SEQ ID NO: 677307 - RNA, 12 nt, Haemophilus influenzae Rd
cuucuucaucgc

SEQ ID NO: 677308 - RNA, 22 nt, Haemophilus influenzae Rd
cuucuucggcgaggcauucauu

SEQ ID NO: 677309 - RNA, 20 nt, Haemophilus influenzae Rd
cuucuucuuggcaauauuua

SEQ ID NO: 677310 - RNA, 12 nt, Haemophilus influenzae Rd
cuucuaauucuu

SEQ ID NO: 677311 - RNA, 23 nt, Haemophilus influenzae Rd
cugaaagacccaccgcaaaagcc

SEQ ID NO: 677312 - RNA, 19 nt, Haemophilus influenzae Rd
cucuucuuguucaaauaau

SEQ ID NO: 677313 - RNA, 15 nt, Haemophilus influenzae Rd
aaccgcuuuaucaaa

SEQ ID NO: 677314 - RNA, 19 nt, Haemophilus influenzae Rd
cugcuuuaauucgugcaaa

SEQ ID NO: 677315 - RNA, 15 nt, Haemophilus influenzae Rd
cugcuugaaugcgag

SEQ ID NO: 677316 - RNA, 19 nt, Haemophilus influenzae Rd
gaaaccugaguaaauaaac

SEQ ID NO: 677317 - RNA, 16 nt, Haemophilus influenzae Rd
cuugugggaauuuuug

SEQ ID NO: 677318 - RNA, 23 nt, Haemophilus influenzae Rd
cuuguuuuaauuguucaauaucu

SEQ ID NO: 677319 - RNA, 11 nt, Haemophilus influenzae Rd
cuuguuuuuca

SEQ ID NO: 677320 - RNA, 20 nt, Haemophilus influenzae Rd
cuuguugauuaauacgcucu

SEQ ID NO: 677321 - RNA, 14 nt, Haemophilus influenzae Rd
gaaagcguaagcac

SEQ ID NO: 677322 - RNA, 22 nt, Haemophilus influenzae Rd
gaaaguuaagccugauagcauu

SEQ ID NO: 677323 - RNA, 15 nt, Haemophilus influenzae Rd
gaaccgucuuuaaau

SEQ ID NO: 677324 - RNA, 12 nt, Haemophilus influenzae Rd
gaacaugcguuu

SEQ ID NO: 677325 - RNA, 21 nt, Haemophilus influenzae Rd
gaaggcuuuucccuuuucuua

SEQ ID NO: 677326 - RNA, 22 nt, Haemophilus influenzae Rd
gaauacauccauaacuaaaagg

SEQ ID NO: 677327 - RNA, 14 nt, Haemophilus influenzae Rd
gaagauugaaauag

SEQ ID NO: 677328 - RNA, 15 nt, Haemophilus influenzae Rd
gaagcacugaaauau

SEQ ID NO: 677329 - RNA, 19 nt, Haemophilus influenzae Rd
gaccaccaauguuggcaag

SEQ ID NO: 677330 - RNA, 18 nt, Haemophilus influenzae Rd
aacgcacguaacaaaugc

SEQ ID NO: 677331 - RNA, 21 nt, Haemophilus influenzae Rd
aacgcacuucaaaugaagugc

SEQ ID NO: 677332 - RNA, 20 nt, Haemophilus influenzae Rd
aacgcaagcugugcaagcau

SEQ ID NO: 677333 - RNA, 22 nt, Haemophilus influenzae Rd
aacgacgguauaaaccuugcau

SEQ ID NO: 677334 - RNA, 18 nt, Haemophilus influenzae Rd
gacauuauuuuuacaaau

SEQ ID NO: 677335 - RNA, 12 nt, Haemophilus influenzae Rd
gacaguuucgcc

SEQ ID NO: 677336 - RNA, 13 nt, Haemophilus influenzae Rd
aacgaacaauuuc

SEQ ID NO: 677337 - RNA, 17 nt, Haemophilus influenzae Rd
gaauguagauaaugaua

SEQ ID NO: 677338 - RNA, 15 nt, Haemophilus influenzae Rd
gaauuaguauaaaca

SEQ ID NO: 677339 - RNA, 20 nt, Haemophilus influenzae Rd
aacggugggcugaagcccac

SEQ ID NO: 677340 - RNA, 18 nt, Haemophilus influenzae Rd
aacgggcuuaaacuuuuu

SEQ ID NO: 677341 - RNA, 14 nt, Haemophilus influenzae Rd
aacgguauuuucuc

SEQ ID NO: 677342 - RNA, 22 nt, Haemophilus influenzae Rd
aacgcugcuuaaagcaaucaaa

SEQ ID NO: 677343 - RNA, 20 nt, Haemophilus influenzae Rd
aacgcuggaauauuuuucuc

SEQ ID NO: 677344 - RNA, 22 nt, Haemophilus influenzae Rd
aacgcuuaggcguucuaaagca

SEQ ID NO: 677345 - RNA, 17 nt, Haemophilus influenzae Rd
cucgcaaaagugcgguc

SEQ ID NO: 677346 - RNA, 17 nt, Haemophilus influenzae Rd
cucagucgguagagcag

SEQ ID NO: 677347 - RNA, 17 nt, Haemophilus influenzae Rd
cucaguugguagagcac

SEQ ID NO: 677348 - RNA, 21 nt, Haemophilus influenzae Rd
cucauaagcauuuugauaauu

SEQ ID NO: 677349 - RNA, 20 nt, Haemophilus influenzae Rd
cuacauaaacuuuacggaua

SEQ ID NO: 677350 - RNA, 16 nt, Haemophilus influenzae Rd
cuaauugugguaaagc

SEQ ID NO: 677351 - RNA, 14 nt, Haemophilus influenzae Rd
cuacacccacugau

SEQ ID NO: 677352 - RNA, 17 nt, Haemophilus influenzae Rd
cuacaccuucuuuaccu

SEQ ID NO: 677353 - RNA, 13 nt, Haemophilus influenzae Rd
cuaaugcaaaauu

SEQ ID NO: 677354 - RNA, 23 nt, Haemophilus influenzae Rd
cuaaugcauugaugacugcauca

SEQ ID NO: 677355 - RNA, 23 nt, Haemophilus influenzae Rd
cuaaugcccacguccacuucauc

SEQ ID NO: 677356 - RNA, 15 nt, Haemophilus influenzae Rd
cuaauacgcggucag

SEQ ID NO: 677357 - RNA, 15 nt, Haemophilus influenzae Rd
cuaauauaauaaauu

SEQ ID NO: 677358 - RNA, 14 nt, Haemophilus influenzae Rd
cuaauaugauuaau

SEQ ID NO: 677359 - RNA, 19 nt, Haemophilus influenzae Rd
cuaauaugauuucuucaaa

SEQ ID NO: 677360 - RNA, 18 nt, Haemophilus influenzae Rd
cuaauauugcgccuuguu

SEQ ID NO: 677361 - RNA, 15 nt, Haemophilus influenzae Rd
cuaauggggauuuac

SEQ ID NO: 677362 - RNA, 13 nt, Haemophilus influenzae Rd
cuaauucugcuaa

SEQ ID NO: 677363 - RNA, 16 nt, Haemophilus influenzae Rd
cuaauucugcuaaauc

SEQ ID NO: 677364 - RNA, 17 nt, Haemophilus influenzae Rd
cuaauuaacugaaaauu

SEQ ID NO: 677365 - RNA, 12 nt, Haemophilus influenzae Rd
cuaagauaaauu

SEQ ID NO: 677366 - RNA, 14 nt, Haemophilus influenzae Rd
cuaagaaaauccaa

SEQ ID NO: 677367 - RNA, 17 nt, Haemophilus influenzae Rd
cuaauaauaaaaagugc

SEQ ID NO: 677368 - RNA, 14 nt, Haemophilus influenzae Rd
cuaaggcgacaaaa

SEQ ID NO: 677369 - RNA, 20 nt, Haemophilus influenzae Rd
cuaagguauccacuuuucca

SEQ ID NO: 677370 - RNA, 15 nt, Haemophilus influenzae Rd
cuaagguuaauuuuu

SEQ ID NO: 677371 - RNA, 14 nt, Haemophilus influenzae Rd
cuacuucuaaacga

SEQ ID NO: 677372 - RNA, 14 nt, Haemophilus influenzae Rd
cuacuugacgguuu

SEQ ID NO: 677373 - RNA, 15 nt, Haemophilus influenzae Rd
cuacugcuucauaaa

SEQ ID NO: 677374 - RNA, 14 nt, Haemophilus influenzae Rd
cguuguucaauaau

SEQ ID NO: 677375 - RNA, 13 nt, Haemophilus influenzae Rd
cguuuauucgcac

SEQ ID NO: 677376 - RNA, 12 nt, Haemophilus influenzae Rd
cguuuaucaucu

SEQ ID NO: 677377 - RNA, 17 nt, Haemophilus influenzae Rd
cuaacgcuuuuaaacgu

SEQ ID NO: 677378 - RNA, 14 nt, Haemophilus influenzae Rd
cuaacgcauucaaa

SEQ ID NO: 677379 - RNA, 19 nt, Haemophilus influenzae Rd
cuaaaucuucuuuaccaac

SEQ ID NO: 677380 - RNA, 14 nt, Haemophilus influenzae Rd
cuaaauauuuauac

SEQ ID NO: 677381 - RNA, 22 nt, Haemophilus influenzae Rd
cuaaaucaucggguaaauuuag

SEQ ID NO: 677382 - RNA, 23 nt, Haemophilus influenzae Rd
cuaaaucaucggguaaauuuagc

SEQ ID NO: 677383 - RNA, 20 nt, Haemophilus influenzae Rd
cuaaauccccugucaauuuu

SEQ ID NO: 677384 - RNA, 20 nt, Haemophilus influenzae Rd
cuaaaugugcccagcgauau

SEQ ID NO: 677385 - RNA, 19 nt, Haemophilus influenzae Rd
cuaaauucuuuugccauau

SEQ ID NO: 677386 - RNA, 23 nt, Haemophilus influenzae Rd
cuaaauuucagcuuaaauacuaa

SEQ ID NO: 677387 - RNA, 21 nt, Haemophilus influenzae Rd
cuaaaaagaaguauuauuugc

SEQ ID NO: 677388 - RNA, 15 nt, Haemophilus influenzae Rd
cuaaaagugcggcuu

SEQ ID NO: 677389 - RNA, 13 nt, Haemophilus influenzae Rd
cuaaaauauuuac

SEQ ID NO: 677390 - RNA, 16 nt, Haemophilus influenzae Rd
cuaaaaucugugcaaa

SEQ ID NO: 677391 - RNA, 18 nt, Haemophilus influenzae Rd
cuaaaauucgacgauaac

SEQ ID NO: 677392 - RNA, 19 nt, Haemophilus influenzae Rd
cuaaaauugauuucauaua

SEQ ID NO: 677393 - RNA, 16 nt, Haemophilus influenzae Rd
cuaaacuuuucgcaaa

SEQ ID NO: 677394 - RNA, 20 nt, Haemophilus influenzae Rd
cuaaagagauuuagcggcuu

SEQ ID NO: 677395 - RNA, 19 nt, Haemophilus influenzae Rd
cuaaaggaguaaguuuuac

SEQ ID NO: 677396 - RNA, 19 nt, Haemophilus influenzae Rd
cuaaauagcuaacaauauc

SEQ ID NO: 677397 - RNA, 15 nt, Haemophilus influenzae Rd
cguuuuuuuaucaua

SEQ ID NO: 677398 - RNA, 12 nt, Haemophilus influenzae Rd
cuaaaaauuuaa

SEQ ID NO: 677399 - RNA, 19 nt, Haemophilus influenzae Rd
cguuuucgcaauaucauca

SEQ ID NO: 677400 - RNA, 14 nt, Haemophilus influenzae Rd
cguuugugcuaaau

SEQ ID NO: 677401 - RNA, 16 nt, Haemophilus influenzae Rd
cgugggugugaaauau

SEQ ID NO: 677402 - RNA, 13 nt, Haemophilus influenzae Rd
cguucuaaagauu

SEQ ID NO: 677403 - RNA, 14 nt, Haemophilus influenzae Rd
cguucguuaucauu

SEQ ID NO: 677404 - RNA, 15 nt, Haemophilus influenzae Rd
cguugaucagcaauc

SEQ ID NO: 677405 - RNA, 18 nt, Haemophilus influenzae Rd
cggugauuuuaccgcacu

SEQ ID NO: 677406 - RNA, 17 nt, Haemophilus influenzae Rd
cgguuaagucauuugag

SEQ ID NO: 677407 - RNA, 15 nt, Haemophilus influenzae Rd
cgguuguaauuguug

SEQ ID NO: 677408 - RNA, 19 nt, Haemophilus influenzae Rd
cguaaaucagaacuggcuu

SEQ ID NO: 677409 - RNA, 17 nt, Haemophilus influenzae Rd
cguaaucccauuucauc

SEQ ID NO: 677410 - RNA, 20 nt, Haemophilus influenzae Rd
cguauaagcuaaagcaauug

SEQ ID NO: 677411 - RNA, 22 nt, Haemophilus influenzae Rd
cguauuaaaagugcggugauuu

SEQ ID NO: 677412 - RNA, 14 nt, Haemophilus influenzae Rd
cgucaauugcuaaa

SEQ ID NO: 677413 - RNA, 17 nt, Haemophilus influenzae Rd
uuuuuacggauacgaau

SEQ ID NO: 677414 - RNA, 16 nt, Haemophilus influenzae Rd
uuuuguugguugaguu

SEQ ID NO: 677415 - RNA, 12 nt, Haemophilus influenzae Rd
uuuuuaaaucaa

SEQ ID NO: 677416 - RNA, 17 nt, Haemophilus influenzae Rd
uuuugucugaaauuuug

SEQ ID NO: 677417 - RNA, 17 nt, Haemophilus influenzae Rd
uuuuucauugcaucagg

SEQ ID NO: 677418 - RNA, 18 nt, Haemophilus influenzae Rd
uuuuuccugaucauaagu

SEQ ID NO: 677419 - RNA, 13 nt, Haemophilus influenzae Rd
uuuuuauaaagua

SEQ ID NO: 677420 - RNA, 19 nt, Haemophilus influenzae Rd
uuuuuauuuagaacaauac

SEQ ID NO: 677421 - RNA, 18 nt, Haemophilus influenzae Rd
uuuuuagacggucaaauu

SEQ ID NO: 677422 - RNA, 13 nt, Haemophilus influenzae Rd
uuuuuaucuaauu

SEQ ID NO: 677423 - RNA, 15 nt, Haemophilus influenzae Rd
uuuucgcaauaucau

SEQ ID NO: 677424 - RNA, 16 nt, Haemophilus influenzae Rd
uuuucgcaaaauauca

SEQ ID NO: 677425 - RNA, 17 nt, Haemophilus influenzae Rd
uuuucgcaaaauaucac

SEQ ID NO: 677426 - RNA, 13 nt, Haemophilus influenzae Rd
uuuuccaauucuu

SEQ ID NO: 677427 - RNA, 13 nt, Haemophilus influenzae Rd
uuuucgugauuuu

SEQ ID NO: 677428 - RNA, 13 nt, Haemophilus influenzae Rd
uuuucuaaaauca

SEQ ID NO: 677429 - RNA, 13 nt, Haemophilus influenzae Rd
uuuuguaauuucu

SEQ ID NO: 677430 - RNA, 15 nt, Haemophilus influenzae Rd
uuuuguagauuaucu

SEQ ID NO: 677431 - RNA, 16 nt, Haemophilus influenzae Rd
uuuguuagaucaaauu

SEQ ID NO: 677432 - RNA, 18 nt, Haemophilus influenzae Rd
uuuguucacaucaaaauu

SEQ ID NO: 677433 - RNA, 20 nt, Haemophilus influenzae Rd
uuuuaaaagaccacauucua

SEQ ID NO: 677434 - RNA, 21 nt, Haemophilus influenzae Rd
uuuguuuaauuggaaauaaua

SEQ ID NO: 677435 - RNA, 15 nt, Haemophilus influenzae Rd
uuuucauuaucuuua

SEQ ID NO: 677436 - RNA, 13 nt, Haemophilus influenzae Rd
uuuucaucaauuu

SEQ ID NO: 677437 - RNA, 14 nt, Haemophilus influenzae Rd
uuuuaaaauuuauu

SEQ ID NO: 677438 - RNA, 16 nt, Haemophilus influenzae Rd
uuucuuaauuaagaua

SEQ ID NO: 677439 - RNA, 17 nt, Haemophilus influenzae Rd
uuucugguacaaauuua

SEQ ID NO: 677440 - RNA, 12 nt, Haemophilus influenzae Rd
uuucuaauaaag

SEQ ID NO: 677441 - RNA, 15 nt, Haemophilus influenzae Rd
uuucuaaaauaaacg

SEQ ID NO: 677442 - RNA, 12 nt, Haemophilus influenzae Rd
uuucuaauucuu

SEQ ID NO: 677443 - RNA, 15 nt, Haemophilus influenzae Rd
uuucuacgacauuuu

SEQ ID NO: 677444 - RNA, 18 nt, Haemophilus influenzae Rd
uuucuagcgguaaaccaa

SEQ ID NO: 677445 - RNA, 21 nt, Haemophilus influenzae Rd
uuucucaauuuuuucaaauaa

SEQ ID NO: 677446 - RNA, 22 nt, Haemophilus influenzae Rd
uuucguuugacagcaauauaua

SEQ ID NO: 677447 - RNA, 20 nt, Haemophilus influenzae Rd
uuuccgcauaaauaauaaag

SEQ ID NO: 677448 - RNA, 17 nt, Haemophilus influenzae Rd
uuuccgcaaaugcuaaa

SEQ ID NO: 677449 - RNA, 19 nt, Haemophilus influenzae Rd
uuuccccuuguucuucaua

SEQ ID NO: 677450 - RNA, 18 nt, Haemophilus influenzae Rd
uuucaguaacuuuaauaa

SEQ ID NO: 677451 - RNA, 15 nt, Haemophilus influenzae Rd
uuugagccaauaacu

SEQ ID NO: 677452 - RNA, 17 nt, Haemophilus influenzae Rd
uuugacgauaauauuuu

SEQ ID NO: 677453 - RNA, 17 nt, Haemophilus influenzae Rd
uuugagauaaauuuuua

SEQ ID NO: 677454 - RNA, 20 nt, Haemophilus influenzae Rd
uuugaaggcaaaauugaagc

SEQ ID NO: 677455 - RNA, 18 nt, Haemophilus influenzae Rd
uuugaaguacauucaagc

SEQ ID NO: 677456 - RNA, 20 nt, Haemophilus influenzae Rd
uuucuuccuaugaauaagcg

SEQ ID NO: 677457 - RNA, 13 nt, Haemophilus influenzae Rd
uuucuuauagaua

SEQ ID NO: 677458 - RNA, 13 nt, Haemophilus influenzae Rd
uuucuuuaaaauu

SEQ ID NO: 677459 - RNA, 23 nt, Haemophilus influenzae Rd
uuucuuuaaaauuauaauauuua

SEQ ID NO: 677460 - RNA, 21 nt, Haemophilus influenzae Rd
uuugcuuuucccuuuacacga

SEQ ID NO: 677461 - RNA, 21 nt, Haemophilus influenzae Rd
uuuggacuuuauuugauuguu

SEQ ID NO: 677462 - RNA, 15 nt, Haemophilus influenzae Rd
uuuggcacaacauca

SEQ ID NO: 677463 - RNA, 18 nt, Haemophilus influenzae Rd
uuugcucuuuaacaauau

SEQ ID NO: 677464 - RNA, 20 nt, Haemophilus influenzae Rd
uuugcugcacgaguuugauu

SEQ ID NO: 677465 - RNA, 13 nt, Haemophilus influenzae Rd
uuugcuaccacgu

SEQ ID NO: 677466 - RNA, 12 nt, Haemophilus influenzae Rd
uuugauuuauac

SEQ ID NO: 677467 - RNA, 15 nt, Haemophilus influenzae Rd
uuugcgccaacgcau

SEQ ID NO: 677468 - RNA, 19 nt, Haemophilus influenzae Rd
uuugaucguauugcauaaa

SEQ ID NO: 677469 - RNA, 14 nt, Haemophilus influenzae Rd
uuuaucaaauaacg

SEQ ID NO: 677470 - RNA, 23 nt, Haemophilus influenzae Rd
uuuaucgguuauuacuucaccaa

SEQ ID NO: 677471 - RNA, 20 nt, Haemophilus influenzae Rd
uuuaucuaccacaucaaauu

SEQ ID NO: 677472 - RNA, 22 nt, Haemophilus influenzae Rd
uuuaucuaccacaucaaauuua

SEQ ID NO: 677473 - RNA, 22 nt, Haemophilus influenzae Rd
uuuaucucggcuaaaaucugug

SEQ ID NO: 677474 - RNA, 21 nt, Haemophilus influenzae Rd
uuuacuuuuuccauaauaacg

SEQ ID NO: 677475 - RNA, 22 nt, Haemophilus influenzae Rd
uuuacuuggcauuucaagcugg

SEQ ID NO: 677476 - RNA, 16 nt, Haemophilus influenzae Rd
uuuacuauucuucaau

SEQ ID NO: 677477 - RNA, 18 nt, Haemophilus influenzae Rd
uuucacggauuucggcuu

SEQ ID NO: 677478 - RNA, 18 nt, Haemophilus influenzae Rd
uuucaauuugaaaauuua

SEQ ID NO: 677479 - RNA, 18 nt, Haemophilus influenzae Rd
uuucaauuugaacaaacg

SEQ ID NO: 677480 - RNA, 16 nt, Haemophilus influenzae Rd
uuucaaugaaauauua

SEQ ID NO: 677481 - RNA, 19 nt, Haemophilus influenzae Rd
uuucaaugacugauauuua

SEQ ID NO: 677482 - RNA, 20 nt, Haemophilus influenzae Rd
uuucaaugcagaaauaaacg

SEQ ID NO: 677483 - RNA, 14 nt, Haemophilus influenzae Rd
uuucaaugcuuuuu

SEQ ID NO: 677484 - RNA, 18 nt, Haemophilus influenzae Rd
uuucaauggcaucaauaa

SEQ ID NO: 677485 - RNA, 14 nt, Haemophilus influenzae Rd
uuguuacuaaaaua

SEQ ID NO: 677486 - RNA, 13 nt, Haemophilus influenzae Rd
uuguuacuuucca

SEQ ID NO: 677487 - RNA, 22 nt, Haemophilus influenzae Rd
uuguucaaauaauguguugauu

SEQ ID NO: 677488 - RNA, 23 nt, Haemophilus influenzae Rd
uuguucuucggguuuauguaaau

SEQ ID NO: 677489 - RNA, 19 nt, Haemophilus influenzae Rd
uuguucagccaauuuuuca

SEQ ID NO: 677490 - RNA, 13 nt, Haemophilus influenzae Rd
uuguuguaaaaua

SEQ ID NO: 677491 - RNA, 22 nt, Haemophilus influenzae Rd
uuuaauaucuucuaauaaaaua

SEQ ID NO: 677492 - RNA, 16 nt, Haemophilus influenzae Rd
uuuaccgucaauaaag

SEQ ID NO: 677493 - RNA, 23 nt, Haemophilus influenzae Rd
uuuaccugaacguucacguaagu

SEQ ID NO: 677494 - RNA, 18 nt, Haemophilus influenzae Rd
uuuacgaagugcgguaaa

SEQ ID NO: 677495 - RNA, 23 nt, Haemophilus influenzae Rd
uuuacgacuaaaacgaacaaucg

SEQ ID NO: 677496 - RNA, 18 nt, Haemophilus influenzae Rd
uuuacaaguuaaagcacc

SEQ ID NO: 677497 - RNA, 16 nt, Haemophilus influenzae Rd
uuuacgguuaagucau

SEQ ID NO: 677498 - RNA, 13 nt, Haemophilus influenzae Rd
uuuacguaauaag

SEQ ID NO: 677499 - RNA, 19 nt, Haemophilus influenzae Rd
uuuacguaauguaccacgg

SEQ ID NO: 677500 - RNA, 17 nt, Haemophilus influenzae Rd
uuuacaucuugcguuaa

SEQ ID NO: 677501 - RNA, 19 nt, Haemophilus influenzae Rd
uuuaauucgcugauuuauu

SEQ ID NO: 677502 - RNA, 17 nt, Haemophilus influenzae Rd
uuuaaucaaauaaaaua

SEQ ID NO: 677503 - RNA, 19 nt, Haemophilus influenzae Rd
uuuaaucgcacuuaaaaga

SEQ ID NO: 677504 - RNA, 15 nt, Haemophilus influenzae Rd
uuuaauccguuaauu

SEQ ID NO: 677505 - RNA, 13 nt, Haemophilus influenzae Rd
uuggcguuaaagu

SEQ ID NO: 677506 - RNA, 18 nt, Haemophilus influenzae Rd
uugaaauugacaauguuu

SEQ ID NO: 677507 - RNA, 16 nt, Haemophilus influenzae Rd
uucuugcuaaaauauc

SEQ ID NO: 677508 - RNA, 17 nt, Haemophilus influenzae Rd
uucuuggauaauuucgu

SEQ ID NO: 677509 - RNA, 16 nt, Haemophilus influenzae Rd
uucuuguuuaauauuu

SEQ ID NO: 677510 - RNA, 14 nt, Haemophilus influenzae Rd
uucuuuacaaauuu

SEQ ID NO: 677511 - RNA, 16 nt, Haemophilus influenzae Rd
uucuuuuaaauacagc

SEQ ID NO: 677512 - RNA, 15 nt, Haemophilus influenzae Rd
uugaaagaauaucaa

SEQ ID NO: 677513 - RNA, 18 nt, Haemophilus influenzae Rd
uugaaagacugcuacuuu

SEQ ID NO: 677514 - RNA, 16 nt, Haemophilus influenzae Rd
uuguaagauuuugccu

SEQ ID NO: 677515 - RNA, 20 nt, Haemophilus influenzae Rd
uuguaauuguugaauggugu

SEQ ID NO: 677516 - RNA, 23 nt, Haemophilus influenzae Rd
uuguacaguaauuguugguuacu

SEQ ID NO: 677517 - RNA, 21 nt, Haemophilus influenzae Rd
ugucgcagucuguuuggcuaa

SEQ ID NO: 677518 - RNA, 17 nt, Haemophilus influenzae Rd
uguaaacugcuuucaaa

SEQ ID NO: 677519 - RNA, 15 nt, Haemophilus influenzae Rd
uguaaaucuaaaaua

SEQ ID NO: 677520 - RNA, 16 nt, Haemophilus influenzae Rd
uguaacgcuuaaccau

SEQ ID NO: 677521 - RNA, 18 nt, Haemophilus influenzae Rd
uguauuuuaugcuggauu

SEQ ID NO: 677522 - RNA, 18 nt, Haemophilus influenzae Rd
uguauuaaguaaauauuu

SEQ ID NO: 677523 - RNA, 14 nt, Haemophilus influenzae Rd
uguauuaucuaauu

SEQ ID NO: 677524 - RNA, 18 nt, Haemophilus influenzae Rd
uguaucaauuccuucaaa

SEQ ID NO: 677525 - RNA, 12 nt, Haemophilus influenzae Rd
ugucguaauaac

SEQ ID NO: 677526 - RNA, 23 nt, Haemophilus influenzae Rd
ugucgcuuuuuccucagcaaaag

SEQ ID NO: 677527 - RNA, 22 nt, Haemophilus influenzae Rd
uggugacuugcgcauccguacu

SEQ ID NO: 677528 - RNA, 11 nt, Haemophilus influenzae Rd
ugguucacgau

SEQ ID NO: 677529 - RNA, 16 nt, Haemophilus influenzae Rd
uguaaaaccgcaucca

SEQ ID NO: 677530 - RNA, 16 nt, Haemophilus influenzae Rd
uguaaaaaaccuugug

SEQ ID NO: 677531 - RNA, 14 nt, Haemophilus influenzae Rd
ugcuuuauuuagaa

SEQ ID NO: 677532 - RNA, 20 nt, Haemophilus influenzae Rd
ugcuuuauuuggcauuugaa

SEQ ID NO: 677533 - RNA, 14 nt, Haemophilus influenzae Rd
ugcuuucagauuca

SEQ ID NO: 677534 - RNA, 17 nt, Haemophilus influenzae Rd
ugcuuucuuauauauaa

SEQ ID NO: 677535 - RNA, 13 nt, Haemophilus influenzae Rd
ugcuuuuuuaauu

SEQ ID NO: 677536 - RNA, 15 nt, Haemophilus influenzae Rd
ugggcugaagcccac

SEQ ID NO: 677537 - RNA, 17 nt, Haemophilus influenzae Rd
uggcucuucuuguucaa

SEQ ID NO: 677538 - RNA, 17 nt, Haemophilus influenzae Rd
ugggauuaaccgcacuu

SEQ ID NO: 677539 - RNA, 22 nt, Haemophilus influenzae Rd
uucaugagcugggcaaacaauc

SEQ ID NO: 677540 - RNA, 19 nt, Haemophilus influenzae Rd
uucauccuaaaaaaauaac

SEQ ID NO: 677541 - RNA, 17 nt, Haemophilus influenzae Rd
uucaucccauuuuugcg

SEQ ID NO: 677542 - RNA, 16 nt, Haemophilus influenzae Rd
uucaucgcgcaaaaua

SEQ ID NO: 677543 - RNA, 14 nt, Haemophilus influenzae Rd
uucagcuaauaaag

SEQ ID NO: 677544 - RNA, 14 nt, Haemophilus influenzae Rd
uucagcuucuucau

SEQ ID NO: 677545 - RNA, 16 nt, Haemophilus influenzae Rd
uucagcugcaauauca

SEQ ID NO: 677546 - RNA, 16 nt, Haemophilus influenzae Rd
uuccauuuuuuuugca

SEQ ID NO: 677547 - RNA, 17 nt, Haemophilus influenzae Rd
uuccauaauagaaacua

SEQ ID NO: 677548 - RNA, 14 nt, Haemophilus influenzae Rd
uuccaguucuccuu

SEQ ID NO: 677549 - RNA, 17 nt, Haemophilus influenzae Rd
uucauucaacaauucau

SEQ ID NO: 677550 - RNA, 18 nt, Haemophilus influenzae Rd
uucauuaaaaccaauuuu

SEQ ID NO: 677551 - RNA, 16 nt, Haemophilus influenzae Rd
uucauuccauuuugca

SEQ ID NO: 677552 - RNA, 17 nt, Haemophilus influenzae Rd
uucauuuaaaauauaua

SEQ ID NO: 677553 - RNA, 22 nt, Haemophilus influenzae Rd
uuauccugccuugcauucgguu

SEQ ID NO: 677554 - RNA, 23 nt, Haemophilus influenzae Rd
uuaucguguaaaaguuguuuugc

SEQ ID NO: 677555 - RNA, 19 nt, Haemophilus influenzae Rd
uuaucguuuacuuaaaauc

SEQ ID NO: 677556 - RNA, 22 nt, Haemophilus influenzae Rd
uuaucgccaucacgccauaaac

SEQ ID NO: 677557 - RNA, 20 nt, Haemophilus influenzae Rd
uuaucgguuggauuuuaacc

SEQ ID NO: 677558 - RNA, 18 nt, Haemophilus influenzae Rd
uuauucuauaucugauac

SEQ ID NO: 677559 - RNA, 17 nt, Haemophilus influenzae Rd
uuauucuccaaauauaa

SEQ ID NO: 677560 - RNA, 16 nt, Haemophilus influenzae Rd
uuauuggaaaauucaa

SEQ ID NO: 677561 - RNA, 21 nt, Haemophilus influenzae Rd
uuauuggauugaaucaauuuu

SEQ ID NO: 677562 - RNA, 16 nt, Haemophilus influenzae Rd
uuauuucucuauaauu

SEQ ID NO: 677563 - RNA, 13 nt, Haemophilus influenzae Rd
uuauuucuguuac

SEQ ID NO: 677564 - RNA, 21 nt, Haemophilus influenzae Rd
uuauuucuguuacuaaaucgc

SEQ ID NO: 677565 - RNA, 12 nt, Haemophilus influenzae Rd
uuauuuuuauca

SEQ ID NO: 677566 - RNA, 12 nt, Haemophilus influenzae Rd
uuauuuuuugcu

SEQ ID NO: 677567 - RNA, 22 nt, Haemophilus influenzae Rd
uuauugccauauaccaauaauu

SEQ ID NO: 677568 - RNA, 20 nt, Haemophilus influenzae Rd
uuauugucuuuucuauaauu

SEQ ID NO: 677569 - RNA, 22 nt, Haemophilus influenzae Rd
uuauuuaacaaugaaauuauug

SEQ ID NO: 677570 - RNA, 14 nt, Haemophilus influenzae Rd
uuauuuaauaacaa

SEQ ID NO: 677571 - RNA, 14 nt, Haemophilus influenzae Rd
uuauuuaauuucaa

SEQ ID NO: 677572 - RNA, 15 nt, Haemophilus influenzae Rd
uuauuuauuaagaua

SEQ ID NO: 677573 - RNA, 21 nt, Haemophilus influenzae Rd
uuauuuauuccaucaauaccu

SEQ ID NO: 677574 - RNA, 14 nt, Haemophilus influenzae Rd
uuauuucaauauaa

SEQ ID NO: 677575 - RNA, 14 nt, Haemophilus influenzae Rd
uucaaaauuuggcc

SEQ ID NO: 677576 - RNA, 20 nt, Haemophilus influenzae Rd
uucaaaaucagcuaauaaca

SEQ ID NO: 677577 - RNA, 15 nt, Haemophilus influenzae Rd
uuauuuuccaucauc

SEQ ID NO: 677578 - RNA, 24 nt, Haemophilus influenzae Rd
uucaaaaauauuauguucucucac

SEQ ID NO: 677579 - RNA, 13 nt, Haemophilus influenzae Rd
uucaaauauaacg

SEQ ID NO: 677580 - RNA, 20 nt, Haemophilus influenzae Rd
uucaaaucguuugccguaau

SEQ ID NO: 677581 - RNA, 23 nt, Haemophilus influenzae Rd
uucaaaucguuugccguaauaac

SEQ ID NO: 677582 - RNA, 17 nt, Haemophilus influenzae Rd
uucacgauuucuaucac

SEQ ID NO: 677583 - RNA, 14 nt, Haemophilus influenzae Rd
uucagccacuaauu

SEQ ID NO: 677584 - RNA, 18 nt, Haemophilus influenzae Rd
uucagccacuaauuucac

SEQ ID NO: 677585 - RNA, 19 nt, Haemophilus influenzae Rd
uucaaugcaccuaagucag

SEQ ID NO: 677586 - RNA, 16 nt, Haemophilus influenzae Rd
uucaaugcuuuuugcg

SEQ ID NO: 677587 - RNA, 17 nt, Haemophilus influenzae Rd
uucaccgcacuuuuauc

SEQ ID NO: 677588 - RNA, 13 nt, Haemophilus influenzae Rd
uucaauaauauua

SEQ ID NO: 677589 - RNA, 18 nt, Haemophilus influenzae Rd
uucaagugauuauuucuc

SEQ ID NO: 677590 - RNA, 23 nt, Haemophilus influenzae Rd
uucaagccaccagagaaaucauc

SEQ ID NO: 677591 - RNA, 14 nt, Haemophilus influenzae Rd
uucaaguaagucac

SEQ ID NO: 677592 - RNA, 12 nt, Haemophilus influenzae Rd
uuaaaugaaguu

SEQ ID NO: 677593 - RNA, 17 nt, Haemophilus influenzae Rd
uuaauaaaaaaucugug

SEQ ID NO: 677594 - RNA, 22 nt, Haemophilus influenzae Rd
uuaauacgccaagauaacucac

SEQ ID NO: 677595 - RNA, 21 nt, Haemophilus influenzae Rd
uuaauaaggcaccuuuuugcu

SEQ ID NO: 677596 - RNA, 20 nt, Haemophilus influenzae Rd
uuaauauguucuuuguugau

SEQ ID NO: 677597 - RNA, 18 nt, Haemophilus influenzae Rd
uuaauguucccacaaaga

SEQ ID NO: 677598 - RNA, 23 nt, Haemophilus influenzae Rd
uuaauaucuuccguuuuuuucac

SEQ ID NO: 677599 - RNA, 12 nt, Haemophilus influenzae Rd
uuaaauaaacac

SEQ ID NO: 677600 - RNA, 17 nt, Haemophilus influenzae Rd
uuaaauauucaauuaca

SEQ ID NO: 677601 - RNA, 15 nt, Haemophilus influenzae Rd
uuaaaccaaauaaug

SEQ ID NO: 677602 - RNA, 18 nt, Haemophilus influenzae Rd
uuaaaccgucauuuauaa

SEQ ID NO: 677603 - RNA, 17 nt, Haemophilus influenzae Rd
uuaaaagcaaggcgaau

SEQ ID NO: 677604 - RNA, 15 nt, Haemophilus influenzae Rd
uuaaaagcaccuaaa

SEQ ID NO: 677605 - RNA, 19 nt, Haemophilus influenzae Rd
uguuuaaauuuuuaauaaa

SEQ ID NO: 677606 - RNA, 21 nt, Haemophilus influenzae Rd
uguuguuccaccuugaauaau

SEQ ID NO: 677607 - RNA, 22 nt, Haemophilus influenzae Rd
uguuguggcaucucaaggcgau

SEQ ID NO: 677608 - RNA, 12 nt, Haemophilus influenzae Rd
uguuuaaauggu

SEQ ID NO: 677609 - RNA, 18 nt, Haemophilus influenzae Rd
uguuuuucuaccgcacuu

SEQ ID NO: 677610 - RNA, 19 nt, Haemophilus influenzae Rd
uuaaaaaccccgcuaauuu

SEQ ID NO: 677611 - RNA, 17 nt, Haemophilus influenzae Rd
uuaauuuuaucuugcug

SEQ ID NO: 677612 - RNA, 15 nt, Haemophilus influenzae Rd
uuaauuuguugaauu

SEQ ID NO: 677613 - RNA, 18 nt, Haemophilus influenzae Rd
uuaauuuuauuuuuugcg

SEQ ID NO: 677614 - RNA, 23 nt, Haemophilus influenzae Rd
uuaauucuucgaugcuuuuucau

SEQ ID NO: 677615 - RNA, 18 nt, Haemophilus influenzae Rd
uuaauuaucuaaauuaca

SEQ ID NO: 677616 - RNA, 22 nt, Haemophilus influenzae Rd
uuaauuggcgaaggcaaaucac

SEQ ID NO: 677617 - RNA, 22 nt, Haemophilus influenzae Rd
uuaauuuaacagguacuuuuac

SEQ ID NO: 677618 - RNA, 14 nt, Haemophilus influenzae Rd
uuaauuucaaaauc

SEQ ID NO: 677619 - RNA, 14 nt, Haemophilus influenzae Rd
uuacuauucuucaa

SEQ ID NO: 677620 - RNA, 16 nt, Haemophilus influenzae Rd
uuacguucauaaggug

SEQ ID NO: 677621 - RNA, 18 nt, Haemophilus influenzae Rd
uuacguuucauuuuugca

SEQ ID NO: 677622 - RNA, 17 nt, Haemophilus influenzae Rd
uuagcguaaacauuuug

SEQ ID NO: 677623 - RNA, 20 nt, Haemophilus influenzae Rd
uuagccuguucuuccaccgc

SEQ ID NO: 677624 - RNA, 16 nt, Haemophilus influenzae Rd
uuauccacuaaaaaac

SEQ ID NO: 677625 - RNA, 17 nt, Haemophilus influenzae Rd
uuauagauaaauaucaa

SEQ ID NO: 677626 - RNA, 15 nt, Haemophilus influenzae Rd
uuaucauuaaauaua

SEQ ID NO: 677627 - RNA, 14 nt, Haemophilus influenzae Rd
uuaguuaaauaauc

SEQ ID NO: 677628 - RNA, 16 nt, Haemophilus influenzae Rd
uuauaaguuuuuugcc

SEQ ID NO: 677629 - RNA, 17 nt, Haemophilus influenzae Rd
uuauaaucuuuaaaaug

SEQ ID NO: 677630 - RNA, 13 nt, Haemophilus influenzae Rd
uuauaauuaauaa

SEQ ID NO: 677631 - RNA, 15 nt, Haemophilus influenzae Rd
uucgcguaauaacaa

SEQ ID NO: 677632 - RNA, 14 nt, Haemophilus influenzae Rd
uucgcuauuuucua

SEQ ID NO: 677633 - RNA, 18 nt, Haemophilus influenzae Rd
uucgcucaauaauuuuca

SEQ ID NO: 677634 - RNA, 19 nt, Haemophilus influenzae Rd
uucgcauaaaaauuccagu

SEQ ID NO: 677635 - RNA, 13 nt, Haemophilus influenzae Rd
uucgcacaaacuc

SEQ ID NO: 677636 - RNA, 19 nt, Haemophilus influenzae Rd
uucgauggaaaugaguaaa

SEQ ID NO: 677637 - RNA, 12 nt, Haemophilus influenzae Rd
uucgcaaauaac

SEQ ID NO: 677638 - RNA, 18 nt, Haemophilus influenzae Rd
uucgaugugcauuuuuca

SEQ ID NO: 677639 - RNA, 19 nt, Haemophilus influenzae Rd
uucgauaacaauuuuugca

SEQ ID NO: 677640 - RNA, 15 nt, Haemophilus influenzae Rd
uucgaccaacggauu

SEQ ID NO: 677641 - RNA, 13 nt, Haemophilus influenzae Rd
uucgaacccguau

SEQ ID NO: 677642 - RNA, 14 nt, Haemophilus influenzae Rd
uuccugcuuuuuuc

SEQ ID NO: 677643 - RNA, 22 nt, Haemophilus influenzae Rd
uuccuuauucaaauaacguaac

SEQ ID NO: 677644 - RNA, 20 nt, Haemophilus influenzae Rd
uuccuuauucgcugcaaaau

SEQ ID NO: 677645 - RNA, 17 nt, Haemophilus influenzae Rd
uucccuauaaauaaacg

SEQ ID NO: 677646 - RNA, 21 nt, Haemophilus influenzae Rd
uucuaccccucuuuucucaaa

SEQ ID NO: 677647 - RNA, 13 nt, Haemophilus influenzae Rd
uucuaaaauaaua

SEQ ID NO: 677648 - RNA, 13 nt, Haemophilus influenzae Rd
uucuaauucagug

SEQ ID NO: 677649 - RNA, 14 nt, Haemophilus influenzae Rd
uucuaauucugcac

SEQ ID NO: 677650 - RNA, 16 nt, Haemophilus influenzae Rd
uucuaauuuuaaaaca

SEQ ID NO: 677651 - RNA, 14 nt, Haemophilus influenzae Rd
uucuaauuuuugca

SEQ ID NO: 677652 - RNA, 15 nt, Haemophilus influenzae Rd
uucuacgacauuuuu

SEQ ID NO: 677653 - RNA, 22 nt, Haemophilus influenzae Rd
uucuacguaauuuaauuuauca

SEQ ID NO: 677654 - RNA, 23 nt, Haemophilus influenzae Rd
uucuaauaauccucuuuaaaauu

SEQ ID NO: 677655 - RNA, 13 nt, Haemophilus influenzae Rd
uucuaaauaaacu

SEQ ID NO: 677656 - RNA, 13 nt, Haemophilus influenzae Rd
uucuaaauauuuu

SEQ ID NO: 677657 - RNA, 15 nt, Haemophilus influenzae Rd
uucguuuaaauuaaa

SEQ ID NO: 677658 - RNA, 20 nt, Haemophilus influenzae Rd
uucguuugacagcaauauau

SEQ ID NO: 677659 - RNA, 21 nt, Haemophilus influenzae Rd
uucgggaugugaauauccaaa

SEQ ID NO: 677660 - RNA, 17 nt, Haemophilus influenzae Rd
uucugcagcaagaucaa

SEQ ID NO: 677661 - RNA, 17 nt, Haemophilus influenzae Rd
uucugauaauuuuucac

SEQ ID NO: 677662 - RNA, 14 nt, Haemophilus influenzae Rd
uucucuguuuuauc

SEQ ID NO: 677663 - RNA, 19 nt, Haemophilus influenzae Rd
uucucguucguuuaaauua

SEQ ID NO: 677664 - RNA, 15 nt, Haemophilus influenzae Rd
uucuccguaaaaauc

SEQ ID NO: 677665 - RNA, 20 nt, Haemophilus influenzae Rd
uucuauuaaaaaaucaucaa

SEQ ID NO: 677666 - RNA, 13 nt, Haemophilus influenzae Rd
uucuucaauaauu

SEQ ID NO: 677667 - RNA, 16 nt, Haemophilus influenzae Rd
uucuucaauacguuua

SEQ ID NO: 677668 - RNA, 17 nt, Haemophilus influenzae Rd
uucuguauaccaaccau

SEQ ID NO: 677669 - RNA, 22 nt, Haemophilus influenzae Rd
uucuguugaaugcuauucucuc

SEQ ID NO: 677670 - RNA, 16 nt, Haemophilus influenzae Rd
uucuguugauuuauca

SEQ ID NO: 677671 - RNA, 18 nt, Haemophilus influenzae Rd
uucuguuugauaaauauc

SEQ ID NO: 677672 - RNA, 19 nt, Haemophilus influenzae Rd
guuucauuuuugcaccaaa

SEQ ID NO: 677673 - RNA, 20 nt, Haemophilus influenzae Rd
guuuccaaauuccgcaauau

SEQ ID NO: 677674 - RNA, 20 nt, Haemophilus influenzae Rd
guuuaucacuaauauaaaga

SEQ ID NO: 677675 - RNA, 22 nt, Haemophilus influenzae Rd
guuuacgcuaauuuaagaaaaa

SEQ ID NO: 677676 - RNA, 21 nt, Haemophilus influenzae Rd
guuucgauaaaaaagccacca

SEQ ID NO: 677677 - RNA, 14 nt, Haemophilus influenzae Rd
guuucuugggauuu

SEQ ID NO: 677678 - RNA, 15 nt, Haemophilus influenzae Rd
guuugaaaagaaaua

SEQ ID NO: 677679 - RNA, 18 nt, Haemophilus influenzae Rd
guuugguucgauaaacau

SEQ ID NO: 677680 - RNA, 22 nt, Haemophilus influenzae Rd
guuuucgauuuaacacuuuuuc

SEQ ID NO: 677681 - RNA, 18 nt, Haemophilus influenzae Rd
guuuuuacgugcgaauuu

SEQ ID NO: 677682 - RNA, 18 nt, Haemophilus influenzae Rd
guuuuaaccgcuccuuua

SEQ ID NO: 677683 - RNA, 14 nt, Haemophilus influenzae Rd
guuuuaagguuuuu

SEQ ID NO: 677684 - RNA, 20 nt, Haemophilus influenzae Rd
guuuuaaguucaacaccuaa

SEQ ID NO: 677685 - RNA, 15 nt, Haemophilus influenzae Rd
guuuuaaguuuucac

SEQ ID NO: 677686 - RNA, 18 nt, Haemophilus influenzae Rd
guuuuaugaauaacuuua

SEQ ID NO: 677687 - RNA, 16 nt, Haemophilus influenzae Rd
guuuucaauacgccaa

SEQ ID NO: 677688 - RNA, 21 nt, Haemophilus influenzae Rd
guuuucaauaucaaagaaaaa

SEQ ID NO: 677689 - RNA, 16 nt, Haemophilus influenzae Rd
guuuuacauauaaaga

SEQ ID NO: 677690 - RNA, 14 nt, Haemophilus influenzae Rd
guuggaucauuauc

SEQ ID NO: 677691 - RNA, 20 nt, Haemophilus influenzae Rd
guugcuguguugauauucaa

SEQ ID NO: 677692 - RNA, 19 nt, Haemophilus influenzae Rd
guugcauaacuucaccaau

SEQ ID NO: 677693 - RNA, 20 nt, Haemophilus influenzae Rd
guucguuugguucgauaaac

SEQ ID NO: 677694 - RNA, 14 nt, Haemophilus influenzae Rd
guucuacuuuuuuu

SEQ ID NO: 677695 - RNA, 13 nt, Haemophilus influenzae Rd
guucuaaauaaac

SEQ ID NO: 677696 - RNA, 15 nt, Haemophilus influenzae Rd
guugagccaauuuuc

SEQ ID NO: 677697 - RNA, 13 nt, Haemophilus influenzae Rd
guugaagcuaauu

SEQ ID NO: 677698 - RNA, 22 nt, Haemophilus influenzae Rd
uaagguggauuggucacgauaa

SEQ ID NO: 677699 - RNA, 19 nt, Haemophilus influenzae Rd
uaauaaaccaacauacauu

SEQ ID NO: 677700 - RNA, 15 nt, Haemophilus influenzae Rd
uaaguacgauaaaca

SEQ ID NO: 677701 - RNA, 16 nt, Haemophilus influenzae Rd
uaagcaauuucacgau

SEQ ID NO: 677702 - RNA, 23 nt, Haemophilus influenzae Rd
uaagcuuaauauguucuuuguug

SEQ ID NO: 677703 - RNA, 19 nt, Haemophilus influenzae Rd
uaagaauaccgaguucaag

SEQ ID NO: 677704 - RNA, 21 nt, Haemophilus influenzae Rd
uaagacaccugcaagugcggu

SEQ ID NO: 677705 - RNA, 18 nt, Haemophilus influenzae Rd
uaagcaccgaaagguguu

SEQ ID NO: 677706 - RNA, 14 nt, Haemophilus influenzae Rd
uaauaagaaaauca

SEQ ID NO: 677707 - RNA, 17 nt, Haemophilus influenzae Rd
uaauaagcuaucgucaa

SEQ ID NO: 677708 - RNA, 23 nt, Haemophilus influenzae Rd
uaauaaucgcaaugccagcgcuu

SEQ ID NO: 677709 - RNA, 19 nt, Haemophilus influenzae Rd
uaauaucgugagcuuguug

SEQ ID NO: 677710 - RNA, 20 nt, Haemophilus influenzae Rd
uaaucaaaguagucuauuua

SEQ ID NO: 677711 - RNA, 13 nt, Haemophilus influenzae Rd
uaaucaauauuua

SEQ ID NO: 677712 - RNA, 13 nt, Haemophilus influenzae Rd
uaaucaauuugau

SEQ ID NO: 677713 - RNA, 21 nt, Haemophilus influenzae Rd
uaaucuggcaagccaaguugu

SEQ ID NO: 677714 - RNA, 15 nt, Haemophilus influenzae Rd
uaaucuucauacuua

SEQ ID NO: 677715 - RNA, 22 nt, Haemophilus influenzae Rd
uaaucguugccccaucauuuua

SEQ ID NO: 677716 - RNA, 21 nt, Haemophilus influenzae Rd
uacacggauuggguuguuacg

SEQ ID NO: 677717 - RNA, 23 nt, Haemophilus influenzae Rd
uacaacuaaucccacuuguugga

SEQ ID NO: 677718 - RNA, 17 nt, Haemophilus influenzae Rd
uacagaaucauuuucac

SEQ ID NO: 677719 - RNA, 19 nt, Haemophilus influenzae Rd
uacagaaucauuuucacca

SEQ ID NO: 677720 - RNA, 17 nt, Haemophilus influenzae Rd
uacagcugcauaaagcu

SEQ ID NO: 677721 - RNA, 13 nt, Haemophilus influenzae Rd
uaaucuuuuaauu

SEQ ID NO: 677722 - RNA, 16 nt, Haemophilus influenzae Rd
uaaugcggcgaauagc

SEQ ID NO: 677723 - RNA, 12 nt, Haemophilus influenzae Rd
uaaucuuuuuuc

SEQ ID NO: 677724 - RNA, 14 nt, Haemophilus influenzae Rd
uaauugaugcuaaa

SEQ ID NO: 677725 - RNA, 12 nt, Haemophilus influenzae Rd
uaauugauuaaa

SEQ ID NO: 677726 - RNA, 18 nt, Haemophilus influenzae Rd
uaauugauucgauaaauu

SEQ ID NO: 677727 - RNA, 20 nt, Haemophilus influenzae Rd
uaaugguuggaagaaaagca

SEQ ID NO: 677728 - RNA, 19 nt, Haemophilus influenzae Rd
uaauggauauagaaaucau

SEQ ID NO: 677729 - RNA, 21 nt, Haemophilus influenzae Rd
uaauuucucaccaaauuguuc

SEQ ID NO: 677730 - RNA, 21 nt, Haemophilus influenzae Rd
uaauuucucagcuuucuaacg

SEQ ID NO: 677731 - RNA, 15 nt, Haemophilus influenzae Rd
uaauuucacaauuuu

SEQ ID NO: 677732 - RNA, 18 nt, Haemophilus influenzae Rd
uaauuggcaauaauguug

SEQ ID NO: 677733 - RNA, 16 nt, Haemophilus influenzae Rd
uaauuggacaagaaau

SEQ ID NO: 677734 - RNA, 16 nt, Haemophilus influenzae Rd
uaauuggugugcaaua

SEQ ID NO: 677735 - RNA, 15 nt, Haemophilus influenzae Rd
uaauugugauaaaug

SEQ ID NO: 677736 - RNA, 23 nt, Haemophilus influenzae Rd
uaauuuaaaaaaucaccgcacuu

SEQ ID NO: 677737 - RNA, 13 nt, Haemophilus influenzae Rd
uaauuucauuuua

SEQ ID NO: 677738 - RNA, 19 nt, Haemophilus influenzae Rd
uaacguaagaaauaacgau

SEQ ID NO: 677739 - RNA, 22 nt, Haemophilus influenzae Rd
uaacuuuucaaguuacuuaauu

SEQ ID NO: 677740 - RNA, 19 nt, Haemophilus influenzae Rd
uaacuucauccauuuucga

SEQ ID NO: 677741 - RNA, 11 nt, Haemophilus influenzae Rd
uaaccgcacuu

SEQ ID NO: 677742 - RNA, 16 nt, Haemophilus influenzae Rd
uaaccgcacuuuaaau

SEQ ID NO: 677743 - RNA, 21 nt, Haemophilus influenzae Rd
uaaauuggggaaguaauauuu

SEQ ID NO: 677744 - RNA, 22 nt, Haemophilus influenzae Rd
uaaauucuucaaguguuuuugc

SEQ ID NO: 677745 - RNA, 16 nt, Haemophilus influenzae Rd
uaaauugaaaaaaucu

SEQ ID NO: 677746 - RNA, 23 nt, Haemophilus influenzae Rd
uaaauuuauauaugauaaaaaua

SEQ ID NO: 677747 - RNA, 18 nt, Haemophilus influenzae Rd
uaaauuucuaaccgcacu

SEQ ID NO: 677748 - RNA, 23 nt, Haemophilus influenzae Rd
uaaaucaaauaauucaagaugau

SEQ ID NO: 677749 - RNA, 17 nt, Haemophilus influenzae Rd
uaaaucccaauagguuu

SEQ ID NO: 677750 - RNA, 12 nt, Haemophilus influenzae Rd
uaaauccaucaa

SEQ ID NO: 677751 - RNA, 15 nt, Haemophilus influenzae Rd
uaaauuauuuuaaua

SEQ ID NO: 677752 - RNA, 14 nt, Haemophilus influenzae Rd
uaaauucaauacuu

SEQ ID NO: 677753 - RNA, 13 nt, Haemophilus influenzae Rd
uaaauucaauuuu

SEQ ID NO: 677754 - RNA, 17 nt, Haemophilus influenzae Rd
uaaauucuauaucugua

SEQ ID NO: 677755 - RNA, 17 nt, Haemophilus influenzae Rd
uaaaccuuauuuuaaau

SEQ ID NO: 677756 - RNA, 17 nt, Haemophilus influenzae Rd
uaaaccuuguaaagcac

SEQ ID NO: 677757 - RNA, 16 nt, Haemophilus influenzae Rd
uaaacgccaucaacca

SEQ ID NO: 677758 - RNA, 17 nt, Haemophilus influenzae Rd
uaaacaaaccuaaaccu

SEQ ID NO: 677759 - RNA, 15 nt, Haemophilus influenzae Rd
uaaaauuggugcaaa

SEQ ID NO: 677760 - RNA, 22 nt, Haemophilus influenzae Rd
uaaacaccaauucaaagauuuu

SEQ ID NO: 677761 - RNA, 12 nt, Haemophilus influenzae Rd
uaaaguaaaaua

SEQ ID NO: 677762 - RNA, 16 nt, Haemophilus influenzae Rd
guuuuuuacuugcgau

SEQ ID NO: 677763 - RNA, 16 nt, Haemophilus influenzae Rd
guuuuuuuauagccaa

SEQ ID NO: 677764 - RNA, 18 nt, Haemophilus influenzae Rd
guuuuuucccuaaugcua

SEQ ID NO: 677765 - RNA, 18 nt, Haemophilus influenzae Rd
uaaaacuugacguuguuc

SEQ ID NO: 677766 - RNA, 19 nt, Haemophilus influenzae Rd
uacgccuccauuaguuguu

SEQ ID NO: 677767 - RNA, 18 nt, Haemophilus influenzae Rd
uacggauacgaaucgacu

SEQ ID NO: 677768 - RNA, 17 nt, Haemophilus influenzae Rd
uacauucuuccgcaauu

SEQ ID NO: 677769 - RNA, 20 nt, Haemophilus influenzae Rd
uacaucuugcguuaaaucaa

SEQ ID NO: 677770 - RNA, 13 nt, Haemophilus influenzae Rd
uacaucuaaaccg

SEQ ID NO: 677771 - RNA, 23 nt, Haemophilus influenzae Rd
uacaucuacuguggcaaguugaa

SEQ ID NO: 677772 - RNA, 13 nt, Haemophilus influenzae Rd
uacgaaauacgca

SEQ ID NO: 677773 - RNA, 18 nt, Haemophilus influenzae Rd
uaccuuuaaauucuucga

SEQ ID NO: 677774 - RNA, 13 nt, Haemophilus influenzae Rd
uaccuuuaagcau

SEQ ID NO: 677775 - RNA, 20 nt, Haemophilus influenzae Rd
uaccuuuaauuaaagccaca

SEQ ID NO: 677776 - RNA, 12 nt, Haemophilus influenzae Rd
uacgaauaaacg

SEQ ID NO: 677777 - RNA, 20 nt, Haemophilus influenzae Rd
uagaaaucauaaacugauaa

SEQ ID NO: 677778 - RNA, 14 nt, Haemophilus influenzae Rd
uacuucuaaacuua

SEQ ID NO: 677779 - RNA, 20 nt, Haemophilus influenzae Rd
uacuucuagaaaauaaccaa

SEQ ID NO: 677780 - RNA, 17 nt, Haemophilus influenzae Rd
uacuuaauugauuuuaa

SEQ ID NO: 677781 - RNA, 13 nt, Haemophilus influenzae Rd
uacggcguagaau

SEQ ID NO: 677782 - RNA, 15 nt, Haemophilus influenzae Rd
uacuaacucaaaaua

SEQ ID NO: 677783 - RNA, 17 nt, Haemophilus influenzae Rd
uacguuuuguuuuaauu

SEQ ID NO: 677784 - RNA, 14 nt, Haemophilus influenzae Rd
uagcuugaauauuu

SEQ ID NO: 677785 - RNA, 18 nt, Haemophilus influenzae Rd
uagcuugaauugcuccuc

SEQ ID NO: 677786 - RNA, 20 nt, Haemophilus influenzae Rd
uagauuuaagcaauaaacaa

SEQ ID NO: 677787 - RNA, 16 nt, Haemophilus influenzae Rd
uagauuugaaucaauu

SEQ ID NO: 677788 - RNA, 16 nt, Haemophilus influenzae Rd
uagcgaagcguaaaag

SEQ ID NO: 677789 - RNA, 17 nt, Haemophilus influenzae Rd
uagcgaccaacaguuaa

SEQ ID NO: 677790 - RNA, 21 nt, Haemophilus influenzae Rd
uagcguaguauggcaagugca

SEQ ID NO: 677791 - RNA, 21 nt, Haemophilus influenzae Rd
uagcguccuacuacagcccaa

SEQ ID NO: 677792 - RNA, 17 nt, Haemophilus influenzae Rd
uagcuaaauacuugcuu

SEQ ID NO: 677793 - RNA, 15 nt, Haemophilus influenzae Rd
uagcgucuuuuugca

SEQ ID NO: 677794 - RNA, 17 nt, Haemophilus influenzae Rd
uaucaaucgguuucaca

SEQ ID NO: 677795 - RNA, 18 nt, Haemophilus influenzae Rd
uaucaagaacaguauaac

SEQ ID NO: 677796 - RNA, 22 nt, Haemophilus influenzae Rd
uaucaaaaaguugaauuuucaa

SEQ ID NO: 677797 - RNA, 13 nt, Haemophilus influenzae Rd
uaucaauuugcca

SEQ ID NO: 677798 - RNA, 13 nt, Haemophilus influenzae Rd
uaucaauuuggcu

SEQ ID NO: 677799 - RNA, 22 nt, Haemophilus influenzae Rd
uaucacuucuguaagcagcuaa

SEQ ID NO: 677800 - RNA, 14 nt, Haemophilus influenzae Rd
uaucuaaauuugcu

SEQ ID NO: 677801 - RNA, 14 nt, Haemophilus influenzae Rd
uaucgucaaauuua

SEQ ID NO: 677802 - RNA, 18 nt, Haemophilus influenzae Rd
uaucguguaaaaguuguu

SEQ ID NO: 677803 - RNA, 16 nt, Haemophilus influenzae Rd
uauuaaaauuaauaaa

SEQ ID NO: 677804 - RNA, 16 nt, Haemophilus influenzae Rd
uauuaaucgcaauaac

SEQ ID NO: 677805 - RNA, 18 nt, Haemophilus influenzae Rd
uauguucaacaaguaaau

SEQ ID NO: 677806 - RNA, 22 nt, Haemophilus influenzae Rd
uaugaccaaauaccacacccuu

SEQ ID NO: 677807 - RNA, 13 nt, Haemophilus influenzae Rd
uaugacuaauuaa

SEQ ID NO: 677808 - RNA, 14 nt, Haemophilus influenzae Rd
uaugacuaauuaau

SEQ ID NO: 677809 - RNA, 20 nt, Haemophilus influenzae Rd
uaugauaaccaucuauauuu

SEQ ID NO: 677810 - RNA, 22 nt, Haemophilus influenzae Rd
uauggcaagugcaagccccuga

SEQ ID NO: 677811 - RNA, 16 nt, Haemophilus influenzae Rd
uauguaauauuuuccc

SEQ ID NO: 677812 - RNA, 13 nt, Haemophilus influenzae Rd
uauucucauuuua

SEQ ID NO: 677813 - RNA, 18 nt, Haemophilus influenzae Rd
uauucuaccgcauuuuua

SEQ ID NO: 677814 - RNA, 13 nt, Haemophilus influenzae Rd
uauuguacucaau

SEQ ID NO: 677815 - RNA, 17 nt, Haemophilus influenzae Rd
uauucgggcuucucaaa

SEQ ID NO: 677816 - RNA, 23 nt, Haemophilus influenzae Rd
uauucgucuaaucgccaaucuaa

SEQ ID NO: 677817 - RNA, 15 nt, Haemophilus influenzae Rd
uauuccuuauucaaa

SEQ ID NO: 677818 - RNA, 14 nt, Haemophilus influenzae Rd
uauuccaaaaaaua

SEQ ID NO: 677819 - RNA, 14 nt, Haemophilus influenzae Rd
uauuccaagguuuu

SEQ ID NO: 677820 - RNA, 19 nt, Haemophilus influenzae Rd
uauucagcaaaaucacucg

SEQ ID NO: 677821 - RNA, 18 nt, Haemophilus influenzae Rd
uauucaauaauauauuua

SEQ ID NO: 677822 - RNA, 12 nt, Haemophilus influenzae Rd
uaguuaaagccu

SEQ ID NO: 677823 - RNA, 15 nt, Haemophilus influenzae Rd
uaguugguaaagauu

SEQ ID NO: 677824 - RNA, 21 nt, Haemophilus influenzae Rd
uagucucuuuugaggcuaaua

SEQ ID NO: 677825 - RNA, 14 nt, Haemophilus influenzae Rd
uaguaauuggcaaa

SEQ ID NO: 677826 - RNA, 13 nt, Haemophilus influenzae Rd
uaguaauaaauuc

SEQ ID NO: 677827 - RNA, 16 nt, Haemophilus influenzae Rd
uagguuaauaguuguu

SEQ ID NO: 677828 - RNA, 19 nt, Haemophilus influenzae Rd
uaggugggcuuuagcccac

SEQ ID NO: 677829 - RNA, 16 nt, Haemophilus influenzae Rd
uaguaaagaauauuuu

SEQ ID NO: 677830 - RNA, 22 nt, Haemophilus influenzae Rd
uaguaagugguaucaaucggca

SEQ ID NO: 677831 - RNA, 13 nt, Haemophilus influenzae Rd
uaguaaaaaauca

SEQ ID NO: 677832 - RNA, 15 nt, Haemophilus influenzae Rd
uaguaaaaauuguug

SEQ ID NO: 677833 - RNA, 15 nt, Haemophilus influenzae Rd
uauaugccaagauuu

SEQ ID NO: 677834 - RNA, 21 nt, Haemophilus influenzae Rd
uauaugccaagauuucgccca

SEQ ID NO: 677835 - RNA, 17 nt, Haemophilus influenzae Rd
uauauugcauaaucaua

SEQ ID NO: 677836 - RNA, 13 nt, Haemophilus influenzae Rd
uauauauaaaaua

SEQ ID NO: 677837 - RNA, 19 nt, Haemophilus influenzae Rd
uauacaguuagaacaacaa

SEQ ID NO: 677838 - RNA, 13 nt, Haemophilus influenzae Rd
uauaccaaccauu

SEQ ID NO: 677839 - RNA, 16 nt, Haemophilus influenzae Rd
uaguuuuucacccauc

SEQ ID NO: 677840 - RNA, 12 nt, Haemophilus influenzae Rd
uauaaaaaaucg

SEQ ID NO: 677841 - RNA, 22 nt, Haemophilus influenzae Rd
uaguuuguauuugagcauuuaa

SEQ ID NO: 677842 - RNA, 17 nt, Haemophilus influenzae Rd
uaguuuuaagguuguug

SEQ ID NO: 677843 - RNA, 18 nt, Haemophilus influenzae Rd
uaguuuauaaaaaaaucu

SEQ ID NO: 677844 - RNA, 16 nt, Haemophilus influenzae Rd
uauaauuccuaaaaua

SEQ ID NO: 677845 - RNA, 20 nt, Haemophilus influenzae Rd
uauaaucuuuaaauuuugcu

SEQ ID NO: 677846 - RNA, 16 nt, Haemophilus influenzae Rd
uauaagauuuuugcca

SEQ ID NO: 677847 - RNA, 16 nt, Haemophilus influenzae Rd
uauaaguuuuuugcca

SEQ ID NO: 677848 - RNA, 18 nt, Haemophilus influenzae Rd
ucaucaauuugugcauaa

SEQ ID NO: 677849 - RNA, 18 nt, Haemophilus influenzae Rd
ucaucaaugccauuuuuu

SEQ ID NO: 677850 - RNA, 15 nt, Haemophilus influenzae Rd
ucaguuuuuacgccu

SEQ ID NO: 677851 - RNA, 17 nt, Haemophilus influenzae Rd
ucauccaaugcugaagu

SEQ ID NO: 677852 - RNA, 11 nt, Haemophilus influenzae Rd
uccaacauuaa

SEQ ID NO: 677853 - RNA, 19 nt, Haemophilus influenzae Rd
uccaaccccauuugccaaa

SEQ ID NO: 677854 - RNA, 19 nt, Haemophilus influenzae Rd
uccaaccgauaaggaaaau

SEQ ID NO: 677855 - RNA, 16 nt, Haemophilus influenzae Rd
uccaacgcacguaaca

SEQ ID NO: 677856 - RNA, 17 nt, Haemophilus influenzae Rd
uccacuuuuuucacgau

SEQ ID NO: 677857 - RNA, 23 nt, Haemophilus influenzae Rd
ucagcccuuauuuuuuggaauau

SEQ ID NO: 677858 - RNA, 21 nt, Haemophilus influenzae Rd
ucagcuaagccaauaauuucu

SEQ ID NO: 677859 - RNA, 16 nt, Haemophilus influenzae Rd
uauuuuaaccgcacuu

SEQ ID NO: 677860 - RNA, 16 nt, Haemophilus influenzae Rd
uauuuuauugccaaua

SEQ ID NO: 677861 - RNA, 13 nt, Haemophilus influenzae Rd
uauugucugcaac

SEQ ID NO: 677862 - RNA, 20 nt, Haemophilus influenzae Rd
uauuguucuaaaucauauuu

SEQ ID NO: 677863 - RNA, 23 nt, Haemophilus influenzae Rd
uauuucuguuacuaaaucgccca

SEQ ID NO: 677864 - RNA, 18 nt, Haemophilus influenzae Rd
uauuucuaggcuauauuu

SEQ ID NO: 677865 - RNA, 15 nt, Haemophilus influenzae Rd
uauuuaauaaggcaa

SEQ ID NO: 677866 - RNA, 21 nt, Haemophilus influenzae Rd
uauuugagaaaaauguuaaua

SEQ ID NO: 677867 - RNA, 17 nt, Haemophilus influenzae Rd
ucacguaauacaaaaua

SEQ ID NO: 677868 - RNA, 22 nt, Haemophilus influenzae Rd
ucacugauauagcuagaaagca

SEQ ID NO: 677869 - RNA, 12 nt, Haemophilus influenzae Rd
ucacugauuucc

SEQ ID NO: 677870 - RNA, 12 nt, Haemophilus influenzae Rd
ucacuucuucaa

SEQ ID NO: 677871 - RNA, 21 nt, Haemophilus influenzae Rd
ucagcaacgguguggaaagau

SEQ ID NO: 677872 - RNA, 23 nt, Haemophilus influenzae Rd
uccgugaacugaguuuucacgcu

SEQ ID NO: 677873 - RNA, 14 nt, Haemophilus influenzae Rd
uccgguuggaaaag

SEQ ID NO: 677874 - RNA, 16 nt, Haemophilus influenzae Rd
uccguaaauucaaaua

SEQ ID NO: 677875 - RNA, 16 nt, Haemophilus influenzae Rd
uccguuaagaaacgau

SEQ ID NO: 677876 - RNA, 14 nt, Haemophilus influenzae Rd
uccguguuuacgau

SEQ ID NO: 677877 - RNA, 15 nt, Haemophilus influenzae Rd
uccuaaauaaagauu

SEQ ID NO: 677878 - RNA, 22 nt, Haemophilus influenzae Rd
uccuaaauaaagauuauuuaua

SEQ ID NO: 677879 - RNA, 12 nt, Haemophilus influenzae Rd
ucccucaaaauu

SEQ ID NO: 677880 - RNA, 17 nt, Haemophilus influenzae Rd
uccauuucaaucacuga

SEQ ID NO: 677881 - RNA, 17 nt, Haemophilus influenzae Rd
uccauuggugaaaucaa

SEQ ID NO: 677882 - RNA, 13 nt, Haemophilus influenzae Rd
uccgcaauuaauc

SEQ ID NO: 677883 - RNA, 23 nt, Haemophilus influenzae Rd
uccgcacgcgugaugaaacaauc

SEQ ID NO: 677884 - RNA, 14 nt, Haemophilus influenzae Rd
uccgcgacauuaag

SEQ ID NO: 677885 - RNA, 18 nt, Haemophilus influenzae Rd
ucgaauucguuuuucaaa

SEQ ID NO: 677886 - RNA, 23 nt, Haemophilus influenzae Rd
uccuucaaacgccguucaaaauc

SEQ ID NO: 677887 - RNA, 18 nt, Haemophilus influenzae Rd
uccuuugccuuuauggug

SEQ ID NO: 677888 - RNA, 21 nt, Haemophilus influenzae Rd
ucgaaaaaagagguuauauua

SEQ ID NO: 677889 - RNA, 16 nt, Haemophilus influenzae Rd
ucgccauuuuuaaaaa

SEQ ID NO: 677890 - RNA, 18 nt, Haemophilus influenzae Rd
ucgccauuuuucaaaauu

SEQ ID NO: 677891 - RNA, 21 nt, Haemophilus influenzae Rd
ucggcaagccacauacgcaaa

SEQ ID NO: 677892 - RNA, 13 nt, Haemophilus influenzae Rd
ucgcuuuucccuc

SEQ ID NO: 677893 - RNA, 16 nt, Haemophilus influenzae Rd
ucggauuaagugcggu

SEQ ID NO: 677894 - RNA, 12 nt, Haemophilus influenzae Rd
ucgcuucugcuu

SEQ ID NO: 677895 - RNA, 13 nt, Haemophilus influenzae Rd
ucguaaagaucau

SEQ ID NO: 677896 - RNA, 15 nt, Haemophilus influenzae Rd
ucuacccaauaaaca

SEQ ID NO: 677897 - RNA, 21 nt, Haemophilus influenzae Rd
ucuaccacaucaaauuuaucg

SEQ ID NO: 677898 - RNA, 14 nt, Haemophilus influenzae Rd
ucuaucccaacaga

SEQ ID NO: 677899 - RNA, 16 nt, Haemophilus influenzae Rd
ucuaauucaaagcgau

SEQ ID NO: 677900 - RNA, 21 nt, Haemophilus influenzae Rd
ucuaauuuuuuauucaaaauu

SEQ ID NO: 677901 - RNA, 15 nt, Haemophilus influenzae Rd
ucguuaaaguugcug

SEQ ID NO: 677902 - RNA, 13 nt, Haemophilus influenzae Rd
ucucaaaaucagc

SEQ ID NO: 677903 - RNA, 15 nt, Haemophilus influenzae Rd
ucucaauugcaaaau

SEQ ID NO: 677904 - RNA, 14 nt, Haemophilus influenzae Rd
ucucucaaaaauca

SEQ ID NO: 677905 - RNA, 18 nt, Haemophilus influenzae Rd
ucucgguuugcuuuacca

SEQ ID NO: 677906 - RNA, 23 nt, Haemophilus influenzae Rd
ucuguaauauaugaaaaauaauc

SEQ ID NO: 677907 - RNA, 22 nt, Haemophilus influenzae Rd
ucugucacgagcuaaaaaaucu

SEQ ID NO: 677908 - RNA, 15 nt, Haemophilus influenzae Rd
ucuuaauuuuauuaa

SEQ ID NO: 677909 - RNA, 22 nt, Haemophilus influenzae Rd
ucuuaauuuuauuaauucuacu

SEQ ID NO: 677910 - RNA, 13 nt, Haemophilus influenzae Rd
ucugcauaacgau

SEQ ID NO: 677911 - RNA, 16 nt, Haemophilus influenzae Rd
ucugcauuugauuuca

SEQ ID NO: 677912 - RNA, 14 nt, Haemophilus influenzae Rd
ucugcaauuuuacg

SEQ ID NO: 677913 - RNA, 15 nt, Haemophilus influenzae Rd
ucugcaacaucaccg

SEQ ID NO: 677914 - RNA, 20 nt, Haemophilus influenzae Rd
ucugacacuaaccaagcguu

SEQ ID NO: 677915 - RNA, 16 nt, Haemophilus influenzae Rd
ucucuuucuauuugaa

SEQ ID NO: 677916 - RNA, 16 nt, Haemophilus influenzae Rd
ucucuuucuuaaaaua

SEQ ID NO: 677917 - RNA, 14 nt, Haemophilus influenzae Rd
ucuucaucaaaaug

SEQ ID NO: 677918 - RNA, 20 nt, Haemophilus influenzae Rd
ucuucaucuucuuuugccca

SEQ ID NO: 677919 - RNA, 22 nt, Haemophilus influenzae Rd
ucuuaugaaaaaaaauuuauag

SEQ ID NO: 677920 - RNA, 20 nt, Haemophilus influenzae Rd
ucuuaugaacuuuuuuauaa

SEQ ID NO: 677921 - RNA, 22 nt, Haemophilus influenzae Rd
ucuuccccucauguuuucgguu

SEQ ID NO: 677922 - RNA, 20 nt, Haemophilus influenzae Rd
ucuuccgcaucggcuaacgg

SEQ ID NO: 677923 - RNA, 19 nt, Haemophilus influenzae Rd
ucuucucauucgaauauug

SEQ ID NO: 677924 - RNA, 16 nt, Haemophilus influenzae Rd
ucuucuaaagcgauaa

SEQ ID NO: 677925 - RNA, 13 nt, Haemophilus influenzae Rd
ucuucuuuaccaa

SEQ ID NO: 677926 - RNA, 21 nt, Haemophilus influenzae Rd
ucuugcuguugguuaaaaaua

SEQ ID NO: 677927 - RNA, 15 nt, Haemophilus influenzae Rd
ucuuuaauuaaaaua

SEQ ID NO: 677928 - RNA, 15 nt, Haemophilus influenzae Rd
ucuuuaacaaaauca

SEQ ID NO: 677929 - RNA, 19 nt, Haemophilus influenzae Rd
ucuuuaacaggaauuugcu

SEQ ID NO: 677930 - RNA, 15 nt, Haemophilus influenzae Rd
ucuuuuuauuuuacu

SEQ ID NO: 677931 - RNA, 14 nt, Haemophilus influenzae Rd
ucuuuagcugcaau

SEQ ID NO: 677932 - RNA, 13 nt, Haemophilus influenzae Rd
ucuuuaggaucac

SEQ ID NO: 677933 - RNA, 20 nt, Haemophilus influenzae Rd
ucuuuaggauuguugauuuu

SEQ ID NO: 677934 - RNA, 17 nt, Haemophilus influenzae Rd
ucuuuacccauugucau

SEQ ID NO: 677935 - RNA, 19 nt, Haemophilus influenzae Rd
ucuuuacgacuaaaacgaa

SEQ ID NO: 677936 - RNA, 14 nt, Haemophilus influenzae Rd
ucuuuaucauuuaa

SEQ ID NO: 677937 - RNA, 20 nt, Haemophilus influenzae Rd
ugaaaacagcggucaaaaua

SEQ ID NO: 677938 - RNA, 13 nt, Haemophilus influenzae Rd
ugaaaaauaucac

SEQ ID NO: 677939 - RNA, 23 nt, Haemophilus influenzae Rd
ugauauauaucacagauuuuuaa

SEQ ID NO: 677940 - RNA, 12 nt, Haemophilus influenzae Rd
ugauaaguagaa

SEQ ID NO: 677941 - RNA, 16 nt, Haemophilus influenzae Rd
ugauaaguagaaaaau

SEQ ID NO: 677942 - RNA, 22 nt, Haemophilus influenzae Rd
ugauaagccacucuaaguuuaa

SEQ ID NO: 677943 - RNA, 13 nt, Haemophilus influenzae Rd
ugauacaaucggu

SEQ ID NO: 677944 - RNA, 19 nt, Haemophilus influenzae Rd
ugaguacccgugccuaauu

SEQ ID NO: 677945 - RNA, 19 nt, Haemophilus influenzae Rd
ugagguuccccuaaaaaau

SEQ ID NO: 677946 - RNA, 21 nt, Haemophilus influenzae Rd
ugauaaaugguuucaguugcu

SEQ ID NO: 677947 - RNA, 20 nt, Haemophilus influenzae Rd
ugauaaauguguuaaauaac

SEQ ID NO: 677948 - RNA, 14 nt, Haemophilus influenzae Rd
ugauaaauuucuaa

SEQ ID NO: 677949 - RNA, 20 nt, Haemophilus influenzae Rd
ugauaacaacucacaauaau

SEQ ID NO: 677950 - RNA, 19 nt, Haemophilus influenzae Rd
ugagucuugcuuuuuaauu

SEQ ID NO: 677951 - RNA, 13 nt, Haemophilus influenzae Rd
ugagaugccauuu

SEQ ID NO: 677952 - RNA, 19 nt, Haemophilus influenzae Rd
ugagaaugggcauaaagcc

SEQ ID NO: 677953 - RNA, 20 nt, Haemophilus influenzae Rd
ugacuugcgcauccguacuu

SEQ ID NO: 677954 - RNA, 21 nt, Haemophilus influenzae Rd
ugagaauuuucaaccgcacuu

SEQ ID NO: 677955 - RNA, 13 nt, Haemophilus influenzae Rd
ugacuauuacaau

SEQ ID NO: 677956 - RNA, 19 nt, Haemophilus influenzae Rd
ugacguguaaaucuaaaau

SEQ ID NO: 677957 - RNA, 18 nt, Haemophilus influenzae Rd
ugcacguaaaguuggcaa

SEQ ID NO: 677958 - RNA, 22 nt, Haemophilus influenzae Rd
ugcacucgcucuaacaauauuu

SEQ ID NO: 677959 - RNA, 14 nt, Haemophilus influenzae Rd
ugcacguucuucag

SEQ ID NO: 677960 - RNA, 16 nt, Haemophilus influenzae Rd
ugcacguuaauuacca

SEQ ID NO: 677961 - RNA, 12 nt, Haemophilus influenzae Rd
ugcacuuucucg

SEQ ID NO: 677962 - RNA, 16 nt, Haemophilus influenzae Rd
ugcaaauuaacgguuu

SEQ ID NO: 677963 - RNA, 15 nt, Haemophilus influenzae Rd
ugauuucuaaacucg

SEQ ID NO: 677964 - RNA, 16 nt, Haemophilus influenzae Rd
ugcaaauuuuuucaaa

SEQ ID NO: 677965 - RNA, 11 nt, Haemophilus influenzae Rd
ugcacauuuuu

SEQ ID NO: 677966 - RNA, 15 nt, Haemophilus influenzae Rd
ugcaacgcugccaau

SEQ ID NO: 677967 - RNA, 19 nt, Haemophilus influenzae Rd
ugauguaggcaaaaacacu

SEQ ID NO: 677968 - RNA, 17 nt, Haemophilus influenzae Rd
ugauucuucauaaauac

SEQ ID NO: 677969 - RNA, 20 nt, Haemophilus influenzae Rd
ugaucaaaucaaauuuuccu

SEQ ID NO: 677970 - RNA, 15 nt, Haemophilus influenzae Rd
ugccauauuuaauaa

SEQ ID NO: 677971 - RNA, 13 nt, Haemophilus influenzae Rd
ugccacuaauaag

SEQ ID NO: 677972 - RNA, 17 nt, Haemophilus influenzae Rd
ugcauuaaaucaaauuu

SEQ ID NO: 677973 - RNA, 15 nt, Haemophilus influenzae Rd
ugcauuagaaaucaa

SEQ ID NO: 677974 - RNA, 13 nt, Haemophilus influenzae Rd
ugcauuucuucag

SEQ ID NO: 677975 - RNA, 15 nt, Haemophilus influenzae Rd
ugcauuuaaugguuu

SEQ ID NO: 677976 - RNA, 21 nt, Haemophilus influenzae Rd
ugcauuuaugccguguaauac

SEQ ID NO: 677977 - RNA, 21 nt, Haemophilus influenzae Rd
ugcauuccuaaaaucgcacuu

SEQ ID NO: 677978 - RNA, 12 nt, Haemophilus influenzae Rd
ugcauuggcaag

SEQ ID NO: 677979 - RNA, 18 nt, Haemophilus influenzae Rd
ugccaauaugaacauuau

SEQ ID NO: 677980 - RNA, 17 nt, Haemophilus influenzae Rd
ugccaauuuuucggauu

SEQ ID NO: 677981 - RNA, 22 nt, Haemophilus influenzae Rd
ugcauuuuuauaaaguaagcca

SEQ ID NO: 677982 - RNA, 11 nt, Haemophilus influenzae Rd
ugccaaauaaa

SEQ ID NO: 677983 - RNA, 20 nt, Haemophilus influenzae Rd
ugcagaucgcuauuuaauaa

SEQ ID NO: 677984 - RNA, 17 nt, Haemophilus influenzae Rd
ugcagccauaauauuua

SEQ ID NO: 677985 - RNA, 21 nt, Haemophilus influenzae Rd
ugccguuuaccauaucuucca

SEQ ID NO: 677986 - RNA, 12 nt, Haemophilus influenzae Rd
ugccuuuuaaua

SEQ ID NO: 677987 - RNA, 19 nt, Haemophilus influenzae Rd
ugccuugguaagaaagaua

SEQ ID NO: 677988 - RNA, 18 nt, Haemophilus influenzae Rd
ugccuucgccaacguaag

SEQ ID NO: 677989 - RNA, 20 nt, Haemophilus influenzae Rd
ugcgccaccuuuuguagaaa

SEQ ID NO: 677990 - RNA, 13 nt, Haemophilus influenzae Rd
ugcgauaaaauca

SEQ ID NO: 677991 - RNA, 18 nt, Haemophilus influenzae Rd
ugcgauaauuugcaucau

SEQ ID NO: 677992 - RNA, 22 nt, Haemophilus influenzae Rd
ugcgauauugaccauuucaucu

SEQ ID NO: 677993 - RNA, 19 nt, Haemophilus influenzae Rd
ugcgguagauuuucaucgu

SEQ ID NO: 677994 - RNA, 16 nt, Haemophilus influenzae Rd
ugcgguaaauuuuuaa

SEQ ID NO: 677995 - RNA, 19 nt, Haemophilus influenzae Rd
ugcgguauuuuuauuuaua

SEQ ID NO: 677996 - RNA, 23 nt, Haemophilus influenzae Rd
ugcgguauuuuuuuauuuacuuu

SEQ ID NO: 677997 - RNA, 20 nt, Haemophilus influenzae Rd
ugcggucaauaaaaauaaug

SEQ ID NO: 677998 - RNA, 15 nt, Haemophilus influenzae Rd
ugcggucaauuuuca

SEQ ID NO: 677999 - RNA, 23 nt, Haemophilus influenzae Rd
ugcggucuguugcaaauuuuuca

SEQ ID NO: 678000 - RNA, 23 nt, Haemophilus influenzae Rd
ugcggucaucucuuguuuuucca

SEQ ID NO: 678001 - RNA, 11 nt, Haemophilus influenzae Rd
ugcgguuaaaa

SEQ ID NO: 678002 - RNA, 18 nt, Haemophilus influenzae Rd
ugcguauccgcugcuaau

SEQ ID NO: 678003 - RNA, 22 nt, Haemophilus influenzae Rd
ugcguagccuggcacuaagaaa

SEQ ID NO: 678004 - RNA, 18 nt, Haemophilus influenzae Rd
ugcuccuacuuuuacaaa

SEQ ID NO: 678005 - RNA, 14 nt, Haemophilus influenzae Rd
ugcuaccauuuauc

SEQ ID NO: 678006 - RNA, 14 nt, Haemophilus influenzae Rd
ugcguuuuuuaauu

SEQ ID NO: 678007 - RNA, 17 nt, Haemophilus influenzae Rd
ugcuauuuuauuuagaa

SEQ ID NO: 678008 - RNA, 20 nt, Haemophilus influenzae Rd
ugcuaccgaaagauauauaa

SEQ ID NO: 678009 - RNA, 21 nt, Haemophilus influenzae Rd
ugcuaguucuucaaauugcaa

SEQ ID NO: 678010 - RNA, 15 nt, Haemophilus influenzae Rd
ugcucaugauuauaa

SEQ ID NO: 678011 - RNA, 18 nt, Haemophilus influenzae Rd
ugcucacgccgugauaac

SEQ ID NO: 678012 - RNA, 16 nt, Haemophilus influenzae Rd
ugcucacguucagcuu

SEQ ID NO: 678013 - RNA, 13 nt, Haemophilus influenzae Rd
ugcuguagaaauu

SEQ ID NO: 678014 - RNA, 13 nt, Haemophilus influenzae Rd
ugcuuuaacccau

SEQ ID NO: 678015 - RNA, 22 nt, Haemophilus influenzae Rd
ugcuuuaacccauuuauuuaaa

SEQ ID NO: 678016 - RNA, 17 nt, Haemophilus influenzae Rd
ugcuuaacauuaauaaa

SEQ ID NO: 678017 - RNA, 18 nt, Haemophilus influenzae Rd
ugcuuacuuuauuuuuaa

SEQ ID NO: 678018 - RNA, 23 nt, Haemophilus influenzae Rd
ugcuuacuuuauuuuuaaguggu

SEQ ID NO: 678019 - RNA, 21 nt, Haemophilus influenzae Rd
ugcucuugauauucuucgcuu

SEQ ID NO: 678020 - RNA, 21 nt, Haemophilus influenzae Rd
ugcucuugcgccccuuuuuua

SEQ ID NO: 678021 - RNA, 22 nt, Haemophilus influenzae Rd
ugcucuugaaauaguuaaagaa

SEQ ID NO: 678022 - RNA, 19 nt, Haemophilus influenzae Rd
ugcucgugugccaucaguu

SEQ ID NO: 678023 - RNA, 13 nt, Haemophilus influenzae Rd
ugcucuaaaagcu

SEQ ID NO: 678024 - RNA, 22 nt, Haemophilus influenzae Rd
ugcugccacuucagcuaauaaa

SEQ ID NO: 678025 - RNA, 13 nt, Haemophilus influenzae Rd
gcugcuuaaagca

SEQ ID NO: 678026 - RNA, 14 nt, Haemophilus influenzae Rd
gcucuucaucaaaa

SEQ ID NO: 678027 - RNA, 23 nt, Haemophilus influenzae Rd
gcucuuuaacaauauaucagaca

SEQ ID NO: 678028 - RNA, 15 nt, Haemophilus influenzae Rd
gcucuuuuuguugau

SEQ ID NO: 678029 - RNA, 18 nt, Haemophilus influenzae Rd
gcugaauaucagaagaau

SEQ ID NO: 678030 - RNA, 16 nt, Haemophilus influenzae Rd
gcugacguacaauuuc

SEQ ID NO: 678031 - RNA, 16 nt, Haemophilus influenzae Rd
gcugauucuaaugcca

SEQ ID NO: 678032 - RNA, 15 nt, Haemophilus influenzae Rd
gcuguugguuaaaaa

SEQ ID NO: 678033 - RNA, 19 nt, Haemophilus influenzae Rd
gcuuuucuagcaauaaaga

SEQ ID NO: 678034 - RNA, 21 nt, Haemophilus influenzae Rd
gcuuuauuuaaauuaaaaaga

SEQ ID NO: 678035 - RNA, 13 nt, Haemophilus influenzae Rd
gcuugggcuuuuu

SEQ ID NO: 678036 - RNA, 18 nt, Haemophilus influenzae Rd
gcuuggaauaaauuaauu

SEQ ID NO: 678037 - RNA, 12 nt, Haemophilus influenzae Rd
ggaugaaaucaa

SEQ ID NO: 678038 - RNA, 17 nt, Haemophilus influenzae Rd
ggaucaaaaauauccac

SEQ ID NO: 678039 - RNA, 15 nt, Haemophilus influenzae Rd
ggaucaacauaacgu

SEQ ID NO: 678040 - RNA, 18 nt, Haemophilus influenzae Rd
ggagugagcgguuuuucc

SEQ ID NO: 678041 - RNA, 19 nt, Haemophilus influenzae Rd
ggaguuagcucucuuuuua

SEQ ID NO: 678042 - RNA, 15 nt, Haemophilus influenzae Rd
gcucauuuuuucucu

SEQ ID NO: 678043 - RNA, 20 nt, Haemophilus influenzae Rd
gcuauggcaaugaauaaaca

SEQ ID NO: 678044 - RNA, 13 nt, Haemophilus influenzae Rd
gcuaugauuuuaa

SEQ ID NO: 678045 - RNA, 16 nt, Haemophilus influenzae Rd
gcucacauccauuccu

SEQ ID NO: 678046 - RNA, 15 nt, Haemophilus influenzae Rd
gcucaagccuuuggu

SEQ ID NO: 678047 - RNA, 14 nt, Haemophilus influenzae Rd
gcuauuaaaaaaag

SEQ ID NO: 678048 - RNA, 15 nt, Haemophilus influenzae Rd
gcguuaaguaauuuu

SEQ ID NO: 678049 - RNA, 18 nt, Haemophilus influenzae Rd
gcguuaaguaauuuuuca

SEQ ID NO: 678050 - RNA, 23 nt, Haemophilus influenzae Rd
gcgguuauuuaguuuaacuuuuu

SEQ ID NO: 678051 - RNA, 22 nt, Haemophilus influenzae Rd
gcgguaaaauuuuuagugauuu

SEQ ID NO: 678052 - RNA, 20 nt, Haemophilus influenzae Rd
gcgguaaaucuacuuuauug

SEQ ID NO: 678053 - RNA, 14 nt, Haemophilus influenzae Rd
gccguuaguuugua

SEQ ID NO: 678054 - RNA, 20 nt, Haemophilus influenzae Rd
gccguacugcucaaucgcuu

SEQ ID NO: 678055 - RNA, 16 nt, Haemophilus influenzae Rd
gccugcuacauuugcc

SEQ ID NO: 678056 - RNA, 15 nt, Haemophilus influenzae Rd
gccuucuaaaauaag

SEQ ID NO: 678057 - RNA, 15 nt, Haemophilus influenzae Rd
gcgauguuauuuguu

SEQ ID NO: 678058 - RNA, 20 nt, Haemophilus influenzae Rd
gcgcaaaacgugcugcagcu

SEQ ID NO: 678059 - RNA, 18 nt, Haemophilus influenzae Rd
gccuugggcuaacauugc

SEQ ID NO: 678060 - RNA, 17 nt, Haemophilus influenzae Rd
gcgaauuaaagugcaga

SEQ ID NO: 678061 - RNA, 22 nt, Haemophilus influenzae Rd
gcggcagaauuucgucaaaaau

SEQ ID NO: 678062 - RNA, 20 nt, Haemophilus influenzae Rd
gugcacccgccgcaccuaaa

SEQ ID NO: 678063 - RNA, 16 nt, Haemophilus influenzae Rd
gugauauuucacuaaa

SEQ ID NO: 678064 - RNA, 13 nt, Haemophilus influenzae Rd
gugaucauuugga

SEQ ID NO: 678065 - RNA, 21 nt, Haemophilus influenzae Rd
gugaugcgugucaaauuaauu

SEQ ID NO: 678066 - RNA, 18 nt, Haemophilus influenzae Rd
guggaacaaagguuaaac

SEQ ID NO: 678067 - RNA, 14 nt, Haemophilus influenzae Rd
guggaagguaauuu

SEQ ID NO: 678068 - RNA, 19 nt, Haemophilus influenzae Rd
guggaauuucauaaacggu

SEQ ID NO: 678069 - RNA, 22 nt, Haemophilus influenzae Rd
gucuaaagagcggucgguuuuu

SEQ ID NO: 678070 - RNA, 22 nt, Haemophilus influenzae Rd
gucuaaugaugcuucagcguug

SEQ ID NO: 678071 - RNA, 19 nt, Haemophilus influenzae Rd
gucaauuuacccacaacuc

SEQ ID NO: 678072 - RNA, 21 nt, Haemophilus influenzae Rd
guauugggcggaucgcuuguu

SEQ ID NO: 678073 - RNA, 20 nt, Haemophilus influenzae Rd
guauuuuugugagugauuuc

SEQ ID NO: 678074 - RNA, 22 nt, Haemophilus influenzae Rd
guauucauauaauucauuagcc

SEQ ID NO: 678075 - RNA, 10 nt, Haemophilus influenzae Rd
guauuaagua

SEQ ID NO: 678076 - RNA, 15 nt, Haemophilus influenzae Rd
guaggcauaaugccu

SEQ ID NO: 678077 - RNA, 23 nt, Haemophilus influenzae Rd
guaauaaggcuugcacaauaauc

SEQ ID NO: 678078 - RNA, 18 nt, Haemophilus influenzae Rd
guaagguuucuaaaugaa

SEQ ID NO: 678079 - RNA, 18 nt, Haemophilus influenzae Rd
gucauauaaccacguaau

SEQ ID NO: 678080 - RNA, 11 nt, Haemophilus influenzae Rd
gucauauucau

SEQ ID NO: 678081 - RNA, 13 nt, Haemophilus influenzae Rd
guaaacaauuuuc

SEQ ID NO: 678082 - RNA, 19 nt, Haemophilus influenzae Rd
gguuuaucuuuauugccau

SEQ ID NO: 678083 - RNA, 14 nt, Haemophilus influenzae Rd
gguuucuugcccaa

SEQ ID NO: 678084 - RNA, 19 nt, Haemophilus influenzae Rd
guaaaaggacuaaauucug

SEQ ID NO: 678085 - RNA, 19 nt, Haemophilus influenzae Rd
guaaaaaaucuuuaagugu

SEQ ID NO: 678086 - RNA, 20 nt, Haemophilus influenzae Rd
gguuauuuaaaccauuuuaa

SEQ ID NO: 678087 - RNA, 23 nt, Haemophilus influenzae Rd
gguuauuuaguuuaacuuuuuua

SEQ ID NO: 678088 - RNA, 18 nt, Haemophilus influenzae Rd
gguugcacccacuaaaau

SEQ ID NO: 678089 - RNA, 20 nt, Haemophilus influenzae Rd
gguucgcuucauuauauucc

SEQ ID NO: 678090 - RNA, 20 nt, Haemophilus influenzae Rd
ggugcuuacuuuauuuuuaa

SEQ ID NO: 678091 - RNA, 20 nt, Haemophilus influenzae Rd
gguggaagucugcuacaagu

SEQ ID NO: 678092 - RNA, 21 nt, Haemophilus influenzae Rd
ggcgauaaaaucgcuugccag

SEQ ID NO: 678093 - RNA, 23 nt, Haemophilus influenzae Rd
ggcgaacauaacuuuuuggcaua

SEQ ID NO: 678094 - RNA, 17 nt, Haemophilus influenzae Rd
ggcccaaggauaaucgg

SEQ ID NO: 678095 - RNA, 13 nt, Haemophilus influenzae Rd
ggcaucaauaaua

SEQ ID NO: 678096 - RNA, 16 nt, Haemophilus influenzae Rd
ggcaucaauaauacgu

SEQ ID NO: 678097 - RNA, 15 nt, Haemophilus influenzae Rd
ggcaucaaaauucaa

SEQ ID NO: 678098 - RNA, 23 nt, Haemophilus influenzae Rd
ggcguaucauacuaaaaaauuaa

SEQ ID NO: 678099 - RNA, 22 nt, Haemophilus influenzae Rd
gggucaagauuaaucuuuuuuc

SEQ ID NO: 678100 - RNA, 20 nt, Haemophilus influenzae Rd
ccugcaaacgagacauuauu

SEQ ID NO: 678101 - RNA, 21 nt, Haemophilus influenzae Rd
ccugcuucguuuucugcuuca

SEQ ID NO: 678102 - RNA, 18 nt, Haemophilus influenzae Rd
ccuacaacuaaucccacu

SEQ ID NO: 678103 - RNA, 16 nt, Haemophilus influenzae Rd
ccuaaguuuuggucaa

SEQ ID NO: 678104 - RNA, 23 nt, Haemophilus influenzae Rd
ccuaaauacaucacuaauacgcg

SEQ ID NO: 678105 - RNA, 15 nt, Haemophilus influenzae Rd
ccguuuuuauuuguu

SEQ ID NO: 678106 - RNA, 23 nt, Haemophilus influenzae Rd
ccguuuucuacugaaccauagaa

SEQ ID NO: 678107 - RNA, 18 nt, Haemophilus influenzae Rd
ccgcuucguuguaaucuu

SEQ ID NO: 678108 - RNA, 21 nt, Haemophilus influenzae Rd
ccgcuguugugaguaagucuu

SEQ ID NO: 678109 - RNA, 19 nt, Haemophilus influenzae Rd
ccgccaauauguuuaccac

SEQ ID NO: 678110 - RNA, 18 nt, Haemophilus influenzae Rd
ccgauuucuuuacaaauu

SEQ ID NO: 678111 - RNA, 13 nt, Haemophilus influenzae Rd
ccgauuuuaaauu

SEQ ID NO: 678112 - RNA, 14 nt, Haemophilus influenzae Rd
cgaucgcuccacca

SEQ ID NO: 678113 - RNA, 13 nt, Haemophilus influenzae Rd
cgaugaagaaaau

SEQ ID NO: 678114 - RNA, 12 nt, Haemophilus influenzae Rd
cgaugaauaauu

SEQ ID NO: 678115 - RNA, 16 nt, Haemophilus influenzae Rd
cgauaagcgguuguac

SEQ ID NO: 678116 - RNA, 18 nt, Haemophilus influenzae Rd
cgauaaguccaucacuuu

SEQ ID NO: 678117 - RNA, 23 nt, Haemophilus influenzae Rd
cgauaauuggauacauuccauca

SEQ ID NO: 678118 - RNA, 17 nt, Haemophilus influenzae Rd
cgauaaugccauuugcu

SEQ ID NO: 678119 - RNA, 20 nt, Haemophilus influenzae Rd
cgauaguaaaaaaucaagcc

SEQ ID NO: 678120 - RNA, 20 nt, Haemophilus influenzae Rd
cgauagcggcgaauguggcu

SEQ ID NO: 678121 - RNA, 23 nt, Haemophilus influenzae Rd
cgcaacuguuuuuuguccgccac

SEQ ID NO: 678122 - RNA, 22 nt, Haemophilus influenzae Rd
cgcaaucacaaaauggcaaaca

SEQ ID NO: 678123 - RNA, 17 nt, Haemophilus influenzae Rd
cgcaauauagucaaaua

SEQ ID NO: 678124 - RNA, 19 nt, Haemophilus influenzae Rd
cgccaucaaccauaacaag

SEQ ID NO: 678125 - RNA, 16 nt, Haemophilus influenzae Rd
cgccauaaacgcacca

SEQ ID NO: 678126 - RNA, 23 nt, Haemophilus influenzae Rd
cgcauauuaguuaguuuuuuacc

SEQ ID NO: 678127 - RNA, 18 nt, Haemophilus influenzae Rd
cgagcuuagauaagaaaa

SEQ ID NO: 678128 - RNA, 19 nt, Haemophilus influenzae Rd
cgaagauuacuuucauaaa

SEQ ID NO: 678129 - RNA, 22 nt, Haemophilus influenzae Rd
cgaaguugcauaacuucaccaa

SEQ ID NO: 678130 - RNA, 19 nt, Haemophilus influenzae Rd
cgaccauuaaauccugaca

SEQ ID NO: 678131 - RNA, 12 nt, Haemophilus influenzae Rd
cgaccaccaaug

SEQ ID NO: 678132 - RNA, 18 nt, Haemophilus influenzae Rd
ccuuuuuacauuauugaa

SEQ ID NO: 678133 - RNA, 17 nt, Haemophilus influenzae Rd
ccuuauuuuaaauaaaa

SEQ ID NO: 678134 - RNA, 12 nt, Haemophilus influenzae Rd
ccuucaaucgca

SEQ ID NO: 678135 - RNA, 22 nt, Haemophilus influenzae Rd
ccuucacagauuucaauuaaau

SEQ ID NO: 678136 - RNA, 13 nt, Haemophilus influenzae Rd
cgcuaauuugcgg

SEQ ID NO: 678137 - RNA, 19 nt, Haemophilus influenzae Rd
cgcuucuuuaacuugcucu

SEQ ID NO: 678138 - RNA, 20 nt, Haemophilus influenzae Rd
cgcuuguaauuucauuuuaa

SEQ ID NO: 678139 - RNA, 19 nt, Haemophilus influenzae Rd
cgcuuuuuucgcaccaaug

SEQ ID NO: 678140 - RNA, 18 nt, Haemophilus influenzae Rd
cgcuuuugccauauuuaa

SEQ ID NO: 678141 - RNA, 22 nt, Haemophilus influenzae Rd
cgcuuaagucagcauaaacaaa

SEQ ID NO: 678142 - RNA, 16 nt, Haemophilus influenzae Rd
cgcgagauacuauauu

SEQ ID NO: 678143 - RNA, 11 nt, Haemophilus influenzae Rd
cgccuuuauug

SEQ ID NO: 678144 - RNA, 15 nt, Haemophilus influenzae Rd
cgccgugauaacaac

SEQ ID NO: 678145 - RNA, 15 nt, Haemophilus influenzae Rd
cggucuauuuugacc

SEQ ID NO: 678146 - RNA, 22 nt, Haemophilus influenzae Rd
cgguaaaaaaaugaaauauuuu

SEQ ID NO: 678147 - RNA, 16 nt, Haemophilus influenzae Rd
cggauuaagugcgguc

SEQ ID NO: 678148 - RNA, 15 nt, Haemophilus influenzae Rd
cggauuucuuuauuc

SEQ ID NO: 678149 - RNA, 20 nt, Haemophilus influenzae Rd
gauuugcuuggaauaaauua

SEQ ID NO: 678150 - RNA, 24 nt, Haemophilus influenzae Rd
gauuucgugcaauaacaagcacaa

SEQ ID NO: 678151 - RNA, 18 nt, Haemophilus influenzae Rd
gauuucaguaucaauacc

SEQ ID NO: 678152 - RNA, 15 nt, Haemophilus influenzae Rd
gauuuccacuuuuuc

SEQ ID NO: 678153 - RNA, 16 nt, Haemophilus influenzae Rd
gcaaauccuacaacac

SEQ ID NO: 678154 - RNA, 16 nt, Haemophilus influenzae Rd
gcaacaaauaaaucau

SEQ ID NO: 678155 - RNA, 19 nt, Haemophilus influenzae Rd
gcaaauggacuaaauuuag

SEQ ID NO: 678156 - RNA, 14 nt, Haemophilus influenzae Rd
gcaaauuaaaucac

SEQ ID NO: 678157 - RNA, 21 nt, Haemophilus influenzae Rd
gauuccucugcaggcauuuuc

SEQ ID NO: 678158 - RNA, 19 nt, Haemophilus influenzae Rd
gauugaacuugaauugaag

SEQ ID NO: 678159 - RNA, 14 nt, Haemophilus influenzae Rd
gauuauugcacuaa

SEQ ID NO: 678160 - RNA, 16 nt, Haemophilus influenzae Rd
gauuauugcacuaaua

SEQ ID NO: 678161 - RNA, 22 nt, Haemophilus influenzae Rd
gauuacuuaaaguuaucaaaca

SEQ ID NO: 678162 - RNA, 15 nt, Haemophilus influenzae Rd
gauuagugugauuuu

SEQ ID NO: 678163 - RNA, 15 nt, Haemophilus influenzae Rd
gcaagcauuaaauau

SEQ ID NO: 678164 - RNA, 20 nt, Haemophilus influenzae Rd
gcaacuuuugcaaaauugcu

SEQ ID NO: 678165 - RNA, 16 nt, Haemophilus influenzae Rd
gcaauuaauccaucau

SEQ ID NO: 678166 - RNA, 14 nt, Haemophilus influenzae Rd
gcaauugaauaaag

SEQ ID NO: 678167 - RNA, 21 nt, Haemophilus influenzae Rd
gcaauuggcaauauuaagcca

SEQ ID NO: 678168 - RNA, 12 nt, Haemophilus influenzae Rd
gcaauugggauu

SEQ ID NO: 678169 - RNA, 14 nt, Haemophilus influenzae Rd
gcacaauccuucau

SEQ ID NO: 678170 - RNA, 14 nt, Haemophilus influenzae Rd
gcaauccaacguuu

SEQ ID NO: 678171 - RNA, 16 nt, Haemophilus influenzae Rd
gcaauccaaucagcaa

SEQ ID NO: 678172 - RNA, 12 nt, Haemophilus influenzae Rd
gcaauaaagcuu

SEQ ID NO: 678173 - RNA, 19 nt, Haemophilus influenzae Rd
gcaauaaauucguacaaau

SEQ ID NO: 678174 - RNA, 16 nt, Haemophilus influenzae Rd
gcaaccagcagaaaau

SEQ ID NO: 678175 - RNA, 13 nt, Haemophilus influenzae Rd
gcaaccacacaag

SEQ ID NO: 678176 - RNA, 20 nt, Haemophilus influenzae Rd
gcaaccacacaagcaccagu

SEQ ID NO: 678177 - RNA, 14 nt, Haemophilus influenzae Rd
gaugaaaucauuac

SEQ ID NO: 678178 - RNA, 17 nt, Haemophilus influenzae Rd
gaucauaauccacuaaa

SEQ ID NO: 678179 - RNA, 23 nt, Haemophilus influenzae Rd
gaguuuagucuuuuuaauuuaaa

SEQ ID NO: 678180 - RNA, 17 nt, Haemophilus influenzae Rd
gaguuugauccacacuu

SEQ ID NO: 678181 - RNA, 22 nt, Haemophilus influenzae Rd
gauaaaaucgcuugccagucau

SEQ ID NO: 678182 - RNA, 15 nt, Haemophilus influenzae Rd
gauaaaaccuaaaau

SEQ ID NO: 678183 - RNA, 19 nt, Haemophilus influenzae Rd
gauaaaccguacaaaccca

SEQ ID NO: 678184 - RNA, 11 nt, Haemophilus influenzae Rd
gauauaaauug

SEQ ID NO: 678185 - RNA, 16 nt, Haemophilus influenzae Rd
gauauaaguucuaaau

SEQ ID NO: 678186 - RNA, 19 nt, Haemophilus influenzae Rd
gauauaauacguaaauuca

SEQ ID NO: 678187 - RNA, 15 nt, Haemophilus influenzae Rd
gcaugcggaauaauu

SEQ ID NO: 678188 - RNA, 19 nt, Haemophilus influenzae Rd
gcaugauguuuuucagcaa

SEQ ID NO: 678189 - RNA, 19 nt, Haemophilus influenzae Rd
gccaaauucauucuugcuu

SEQ ID NO: 678190 - RNA, 16 nt, Haemophilus influenzae Rd
gcauuuagagcaagca

SEQ ID NO: 678191 - RNA, 15 nt, Haemophilus influenzae Rd
gcauugucuuuuacg

SEQ ID NO: 678192 - RNA, 17 nt, Haemophilus influenzae Rd
gcauuugcauaaagcau

SEQ ID NO: 678193 - RNA, 14 nt, Haemophilus influenzae Rd
gcauuuaaauaaaa

SEQ ID NO: 678194 - RNA, 19 nt, Haemophilus influenzae Rd
gcauuggaaugguauaaaa

SEQ ID NO: 678195 - RNA, 23 nt, Haemophilus influenzae Rd
gccaaagcauuuagagcaagcaa

SEQ ID NO: 678196 - RNA, 14 nt, Haemophilus influenzae Rd
gcauugaguuuuuc

SEQ ID NO: 678197 - RNA, 14 nt, Haemophilus influenzae Rd
gcauuaaaaauuua

SEQ ID NO: 678198 - RNA, 13 nt, Haemophilus influenzae Rd
gcauagccacuau

SEQ ID NO: 678199 - RNA, 22 nt, Haemophilus influenzae Rd
gcauaaacagccauggcuuuuu

SEQ ID NO: 678200 - RNA, 14 nt, Haemophilus influenzae Rd
gcauaaaaauucca

SEQ ID NO: 678201 - RNA, 17 nt, Haemophilus influenzae Rd
gcauaaaacaguauuuu

SEQ ID NO: 678202 - RNA, 23 nt, Haemophilus influenzae Rd
gcacuuauuugacuuaaaugaag

SEQ ID NO: 678203 - RNA, 14 nt, Haemophilus influenzae Rd
gcacuguugugaag

SEQ ID NO: 678204 - RNA, 20 nt, Haemophilus influenzae Rd
gcacgaccuguggucacuac

SEQ ID NO: 678205 - RNA, 13 nt, Haemophilus influenzae Rd
gcaccuaaaaguu

SEQ ID NO: 678206 - RNA, 22 nt, Haemophilus influenzae Rd
gcacccuaauucauuaaggugc

SEQ ID NO: 678207 - RNA, 22 nt, Haemophilus influenzae Rd
gcacuuuuuguuuuauaagacu

SEQ ID NO: 678208 - RNA, 14 nt, Haemophilus influenzae Rd
gcagauuauugcac

SEQ ID NO: 678209 - RNA, 19 nt, Haemophilus influenzae Rd
gcagauuauugcacuaaua

SEQ ID NO: 678210 - RNA, 15 nt, Haemophilus influenzae Rd
gcagcccaaauaaag

SEQ ID NO: 678211 - RNA, 12 nt, Haemophilus influenzae Rd
gccgcuucgcua

SEQ ID NO: 678212 - RNA, 14 nt, Haemophilus influenzae Rd
gccgacuuuuacau

SEQ ID NO: 678213 - RNA, 22 nt, Haemophilus influenzae Rd
gcccauuccagcagcaccuaaa

SEQ ID NO: 678214 - RNA, 21 nt, Haemophilus influenzae Rd
gccauugcaccaucguuaaac

SEQ ID NO: 678215 - RNA, 13 nt, Haemophilus influenzae Rd
gccauuauccaca

SEQ ID NO: 678216 - RNA, 22 nt, Haemophilus influenzae Rd
gccaucacagucuuuuaacaca

SEQ ID NO: 678217 - RNA, 23 nt, Haemophilus influenzae Rd
gccauauaagcaaagaaauuuaa

SEQ ID NO: 678218 - RNA, 19 nt, Haemophilus influenzae Rd
gccagacagcguuauugua

SEQ ID NO: 678219 - RNA, 22 nt, Haemophilus influenzae Rd
cugcgagcaguuuucgugauuu

SEQ ID NO: 678220 - RNA, 13 nt, Haemophilus influenzae Rd
cuguucaaauaag

SEQ ID NO: 678221 - RNA, 19 nt, Haemophilus influenzae Rd
cugugccaagcauacgacg

SEQ ID NO: 678222 - RNA, 18 nt, Haemophilus influenzae Rd
cuuaaauuuuuauaaagu

SEQ ID NO: 678223 - RNA, 13 nt, Haemophilus influenzae Rd
cuuagauaaauuc

SEQ ID NO: 678224 - RNA, 18 nt, Haemophilus influenzae Rd
cuucacuuggcgaaaauc

SEQ ID NO: 678225 - RNA, 15 nt, Haemophilus influenzae Rd
cuucaucuaacaaua

SEQ ID NO: 678226 - RNA, 18 nt, Haemophilus influenzae Rd
cuucgauaaaaucuugcu

SEQ ID NO: 678227 - RNA, 15 nt, Haemophilus influenzae Rd
cuuguuacaccuugg

SEQ ID NO: 678228 - RNA, 18 nt, Haemophilus influenzae Rd
cuugugauguaccaauuu

SEQ ID NO: 678229 - RNA, 17 nt, Haemophilus influenzae Rd
cuuguuucauaaaaaau

SEQ ID NO: 678230 - RNA, 12 nt, Haemophilus influenzae Rd
cuuguuccaaca

SEQ ID NO: 678231 - RNA, 18 nt, Haemophilus influenzae Rd
cuuuaauaguaaacuuuu

SEQ ID NO: 678232 - RNA, 19 nt, Haemophilus influenzae Rd
cuuuaaagagcaaauuuaa

SEQ ID NO: 678233 - RNA, 15 nt, Haemophilus influenzae Rd
cuuguuuucaauagu

SEQ ID NO: 678234 - RNA, 15 nt, Haemophilus influenzae Rd
cuuuagacaacaacu

SEQ ID NO: 678235 - RNA, 22 nt, Haemophilus influenzae Rd
cuuuagacaacaacuuuucuaa

SEQ ID NO: 678236 - RNA, 16 nt, Haemophilus influenzae Rd
cuuuaucauaacuaua

SEQ ID NO: 678237 - RNA, 14 nt, Haemophilus influenzae Rd
cuuuaggauuguug

SEQ ID NO: 678238 - RNA, 20 nt, Haemophilus influenzae Rd
cuuuaauuccaacuacaagu

SEQ ID NO: 678239 - RNA, 17 nt, Haemophilus influenzae Rd
cuuuaauuucuucaacu

SEQ ID NO: 678240 - RNA, 20 nt, Haemophilus influenzae Rd
cuugcuaaaaagaaauaaaa

SEQ ID NO: 678241 - RNA, 15 nt, Haemophilus influenzae Rd
cuugccguuuaguuu

SEQ ID NO: 678242 - RNA, 22 nt, Haemophilus influenzae Rd
cuuuuuguuaauaaaagaauau

SEQ ID NO: 678243 - RNA, 20 nt, Haemophilus influenzae Rd
cuuuuuguuacaucuucaaa

SEQ ID NO: 678244 - RNA, 17 nt, Haemophilus influenzae Rd
cuuuuuauuagacaaua

SEQ ID NO: 678245 - RNA, 19 nt, Haemophilus influenzae Rd
cuuuuuauuuagaacaaua

SEQ ID NO: 678246 - RNA, 20 nt, Haemophilus influenzae Rd
cuuuuugauaauuaacaaua

SEQ ID NO: 678247 - RNA, 13 nt, Haemophilus influenzae Rd
gaaaagaauaaua

SEQ ID NO: 678248 - RNA, 17 nt, Haemophilus influenzae Rd
gaaaauguugguuaaaa

SEQ ID NO: 678249 - RNA, 16 nt, Haemophilus influenzae Rd
gaaaauuaaaaauuua

SEQ ID NO: 678250 - RNA, 19 nt, Haemophilus influenzae Rd
gaaaauuaagaaaauaaua

SEQ ID NO: 678251 - RNA, 15 nt, Haemophilus influenzae Rd
cuuuucaaacaacaa

SEQ ID NO: 678252 - RNA, 22 nt, Haemophilus influenzae Rd
cuuuucaaguuacuuaauuuug

SEQ ID NO: 678253 - RNA, 17 nt, Haemophilus influenzae Rd
cuuuucaauuugaaaau

SEQ ID NO: 678254 - RNA, 20 nt, Haemophilus influenzae Rd
cuuuuauccacaugauauau

SEQ ID NO: 678255 - RNA, 20 nt, Haemophilus influenzae Rd
cuuuuaucucggcuaaaauc

SEQ ID NO: 678256 - RNA, 14 nt, Haemophilus influenzae Rd
cuuuagcuaaugca

SEQ ID NO: 678257 - RNA, 14 nt, Haemophilus influenzae Rd
cuuuugcaagcauu

SEQ ID NO: 678258 - RNA, 15 nt, Haemophilus influenzae Rd
cuuuugccauauuua

SEQ ID NO: 678259 - RNA, 14 nt, Haemophilus influenzae Rd
cuuuugguuuucug

SEQ ID NO: 678260 - RNA, 11 nt, Haemophilus influenzae Rd
cuuuuggcauu

SEQ ID NO: 678261 - RNA, 17 nt, Haemophilus influenzae Rd
cuuuuggguuaaauaau

SEQ ID NO: 678262 - RNA, 18 nt, Haemophilus influenzae Rd
cuuuuguuuuaucagaau

SEQ ID NO: 678263 - RNA, 18 nt, Haemophilus influenzae Rd
gaaagauuaauuuuccua

SEQ ID NO: 678264 - RNA, 14 nt, Haemophilus influenzae Rd
gaaaauuuugccaa

SEQ ID NO: 678265 - RNA, 21 nt, Haemophilus influenzae Rd
gaaacuaaagaaucaaauuca

SEQ ID NO: 678266 - RNA, 21 nt, Haemophilus influenzae Rd
gaaaauuaucuggcaaucgcc

SEQ ID NO: 678267 - RNA, 12 nt, Haemophilus influenzae Rd
gaaauaaaugau

SEQ ID NO: 678268 - RNA, 15 nt, Haemophilus influenzae Rd
gaaaucaccgcacuu

SEQ ID NO: 678269 - RNA, 15 nt, Haemophilus influenzae Rd
gaaauaccgauaaua

SEQ ID NO: 678270 - RNA, 18 nt, Haemophilus influenzae Rd
gaaauuucaaccgcacuu

SEQ ID NO: 678271 - RNA, 21 nt, Haemophilus influenzae Rd
gaaaucgcacucacaauacca

SEQ ID NO: 678272 - RNA, 17 nt, Haemophilus influenzae Rd
gaaaucccaccuuuuag

SEQ ID NO: 678273 - RNA, 18 nt, Haemophilus influenzae Rd
gaaaucauuucaauguuu

SEQ ID NO: 678274 - RNA, 16 nt, Haemophilus influenzae Rd
gaaauggcuugcucaa

SEQ ID NO: 678275 - RNA, 14 nt, Haemophilus influenzae Rd
gaaauuacugucac

SEQ ID NO: 678276 - RNA, 20 nt, Haemophilus influenzae Rd
gaaccuuucauauaaauaag

SEQ ID NO: 678277 - RNA, 22 nt, Haemophilus influenzae Rd
gaacgccgcaacuaauaaacca

SEQ ID NO: 678278 - RNA, 16 nt, Haemophilus influenzae Rd
gacguucacguuuuuc

SEQ ID NO: 678279 - RNA, 16 nt, Haemophilus influenzae Rd
gagauuguaugaaaaa

SEQ ID NO: 678280 - RNA, 14 nt, Haemophilus influenzae Rd
gacuacauaaccca

SEQ ID NO: 678281 - RNA, 19 nt, Haemophilus influenzae Rd
gacuaaacaacuaacuaag

SEQ ID NO: 678282 - RNA, 15 nt, Haemophilus influenzae Rd
gacuuauaaauuuaa

SEQ ID NO: 678283 - RNA, 16 nt, Haemophilus influenzae Rd
gacuuauaaauuuaaa

SEQ ID NO: 678284 - RNA, 11 nt, Haemophilus influenzae Rd
gacaauuaaua

SEQ ID NO: 678285 - RNA, 21 nt, Haemophilus influenzae Rd
gacaauaacugcgccaauaua

SEQ ID NO: 678286 - RNA, 16 nt, Haemophilus influenzae Rd
gaauuuugcaagccaa

SEQ ID NO: 678287 - RNA, 16 nt, Haemophilus influenzae Rd
gaauuuuugugauuuc

SEQ ID NO: 678288 - RNA, 22 nt, Haemophilus influenzae Rd
gaauacacuuuaaauuuuccug

SEQ ID NO: 678289 - RNA, 22 nt, Haemophilus influenzae Rd
gaauacaucacgaacuucagcu

SEQ ID NO: 678290 - RNA, 16 nt, Haemophilus influenzae Rd
gaaugaagaaauggcg

SEQ ID NO: 678291 - RNA, 17 nt, Haemophilus influenzae Rd
gaaucauuuucaccaau

SEQ ID NO: 678292 - RNA, 15 nt, Haemophilus influenzae Rd
cguaauagauaaagu

SEQ ID NO: 678293 - RNA, 15 nt, Haemophilus influenzae Rd
cggugaauuuuaacc

SEQ ID NO: 678294 - RNA, 16 nt, Haemophilus influenzae Rd
cguaacuaaaaaaguu

SEQ ID NO: 678295 - RNA, 13 nt, Haemophilus influenzae Rd
cguaaagccauac

SEQ ID NO: 678296 - RNA, 21 nt, Haemophilus influenzae Rd
cgugcauuuuuaugauuaauu

SEQ ID NO: 678297 - RNA, 14 nt, Haemophilus influenzae Rd
cgugcaaauaaauu

SEQ ID NO: 678298 - RNA, 11 nt, Haemophilus influenzae Rd
cgucuaaacgg

SEQ ID NO: 678299 - RNA, 20 nt, Haemophilus influenzae Rd
cguucacguaauggaauaug

SEQ ID NO: 678300 - RNA, 14 nt, Haemophilus influenzae Rd
cguucgauaacaau

SEQ ID NO: 678301 - RNA, 18 nt, Haemophilus influenzae Rd
cguuaagaaagaaacuga

SEQ ID NO: 678302 - RNA, 13 nt, Haemophilus influenzae Rd
cguuaaaugaacg

SEQ ID NO: 678303 - RNA, 21 nt, Haemophilus influenzae Rd
cguguuuuucacgauauugca

SEQ ID NO: 678304 - RNA, 17 nt, Haemophilus influenzae Rd
cguuauuuuuuaagcuu

SEQ ID NO: 678305 - RNA, 14 nt, Haemophilus influenzae Rd
cguuaucauuggcu

SEQ ID NO: 678306 - RNA, 15 nt, Haemophilus influenzae Rd
cuagaugaugaaauu

SEQ ID NO: 678307 - RNA, 11 nt, Haemophilus influenzae Rd
cuacuuuauuc

SEQ ID NO: 678308 - RNA, 15 nt, Haemophilus influenzae Rd
cuacauucaucaaaa

SEQ ID NO: 678309 - RNA, 20 nt, Haemophilus influenzae Rd
cuacauuugccccaacaaca

SEQ ID NO: 678310 - RNA, 22 nt, Haemophilus influenzae Rd
cuacagugacuaaaacaacagu

SEQ ID NO: 678311 - RNA, 16 nt, Haemophilus influenzae Rd
cucaaaugaaaugcaa

SEQ ID NO: 678312 - RNA, 21 nt, Haemophilus influenzae Rd
cucaaagaggagguagaaaau

SEQ ID NO: 678313 - RNA, 23 nt, Haemophilus influenzae Rd
cuaugccuucuucacuacuugaa

SEQ ID NO: 678314 - RNA, 21 nt, Haemophilus influenzae Rd
cuauauuuugaauaauaaauu

SEQ ID NO: 678315 - RNA, 22 nt, Haemophilus influenzae Rd
cuauauuuugaauaauaaauug

SEQ ID NO: 678316 - RNA, 22 nt, Haemophilus influenzae Rd
cucacucguggaauuucauaaa

SEQ ID NO: 678317 - RNA, 13 nt, Haemophilus influenzae Rd
cucacgccgugau

SEQ ID NO: 678318 - RNA, 15 nt, Haemophilus influenzae Rd
cucacauugccauuu

SEQ ID NO: 678319 - RNA, 15 nt, Haemophilus influenzae Rd
cucaauugcaaaauc

SEQ ID NO: 678320 - RNA, 20 nt, Haemophilus influenzae Rd
cucagucgguagagcagcgg

SEQ ID NO: 678321 - RNA, 17 nt, Haemophilus influenzae Rd
cugcacgggaaauccag

SEQ ID NO: 678322 - RNA, 13 nt, Haemophilus influenzae Rd
cugcacuuuaaca

SEQ ID NO: 678323 - RNA, 18 nt, Haemophilus influenzae Rd
cugauauuuaacaucaug

SEQ ID NO: 678324 - RNA, 20 nt, Haemophilus influenzae Rd
cucguaaaaucgccugauaa

SEQ ID NO: 678325 - RNA, 19 nt, Haemophilus influenzae Rd
cucguugccauaaaaaauu

SEQ ID NO: 678326 - RNA, 21 nt, Haemophilus influenzae Rd
cucuaauugauggcgugaaau

SEQ ID NO: 678327 - RNA, 20 nt, Haemophilus influenzae Rd
cugaauauccagugccauuu

SEQ ID NO: 678328 - RNA, 16 nt, Haemophilus influenzae Rd
cugaauuuuguaccaa

SEQ ID NO: 678329 - RNA, 15 nt, Haemophilus influenzae Rd
cucuaucuaaaauau

SEQ ID NO: 678330 - RNA, 13 nt, Haemophilus influenzae Rd
cugaaaaagcuaa

SEQ ID NO: 678331 - RNA, 13 nt, Haemophilus influenzae Rd
cagcaaauuguuu

SEQ ID NO: 678332 - RNA, 17 nt, Haemophilus influenzae Rd
cagauuuuauaucaagc

SEQ ID NO: 678333 - RNA, 11 nt, Haemophilus influenzae Rd
cagcaaaagca

SEQ ID NO: 678334 - RNA, 19 nt, Haemophilus influenzae Rd
cagaggggauaaaauaaac

SEQ ID NO: 678335 - RNA, 23 nt, Haemophilus influenzae Rd
cagacuagugaaauauuuacuuc

SEQ ID NO: 678336 - RNA, 23 nt, Haemophilus influenzae Rd
cacucgcuguauuagaaguaaau

SEQ ID NO: 678337 - RNA, 21 nt, Haemophilus influenzae Rd
cacuccaaaaguuggauuaaa

SEQ ID NO: 678338 - RNA, 20 nt, Haemophilus influenzae Rd
cacuugcaucuaaaaauaau

SEQ ID NO: 678339 - RNA, 20 nt, Haemophilus influenzae Rd
cagaagauaaaagugcgguu

SEQ ID NO: 678340 - RNA, 19 nt, Haemophilus influenzae Rd
cagaacugcuuucuuccaa

SEQ ID NO: 678341 - RNA, 17 nt, Haemophilus influenzae Rd
cagaaauauguuuuacc

SEQ ID NO: 678342 - RNA, 14 nt, Haemophilus influenzae Rd
cagaaaacucgacu

SEQ ID NO: 678343 - RNA, 21 nt, Haemophilus influenzae Rd
cacuuuuuguuuguaauaaau

SEQ ID NO: 678344 - RNA, 20 nt, Haemophilus influenzae Rd
cacuuuuuuguauaaaaauu

SEQ ID NO: 678345 - RNA, 15 nt, Haemophilus influenzae Rd
cacguaauacaaaau

SEQ ID NO: 678346 - RNA, 16 nt, Haemophilus influenzae Rd
cacuaauugugguaaa

SEQ ID NO: 678347 - RNA, 12 nt, Haemophilus influenzae Rd
cacuauuaauua

SEQ ID NO: 678348 - RNA, 19 nt, Haemophilus influenzae Rd
cacuauuaccgcguaaaaa

SEQ ID NO: 678349 - RNA, 18 nt, Haemophilus influenzae Rd
cacuacgauuuaauguau

SEQ ID NO: 678350 - RNA, 18 nt, Haemophilus influenzae Rd
cacuagccauaaauaaau

SEQ ID NO: 678351 - RNA, 17 nt, Haemophilus influenzae Rd
cagcgcaccacacaaua

SEQ ID NO: 678352 - RNA, 21 nt, Haemophilus influenzae Rd
cagcaagcaucgcuggauaaa

SEQ ID NO: 678353 - RNA, 17 nt, Haemophilus influenzae Rd
cagcaacuguuauauug

SEQ ID NO: 678354 - RNA, 16 nt, Haemophilus influenzae Rd
caguuacuuauuuagc

SEQ ID NO: 678355 - RNA, 13 nt, Haemophilus influenzae Rd
caguuaaauuuuc

SEQ ID NO: 678356 - RNA, 21 nt, Haemophilus influenzae Rd
cauaauggcaauuuuauauuc

SEQ ID NO: 678357 - RNA, 15 nt, Haemophilus influenzae Rd
caguugauagacaau

SEQ ID NO: 678358 - RNA, 15 nt, Haemophilus influenzae Rd
cauaaggaccaagca

SEQ ID NO: 678359 - RNA, 16 nt, Haemophilus influenzae Rd
caucgcugaaauuaau

SEQ ID NO: 678360 - RNA, 23 nt, Haemophilus influenzae Rd
caucaauggcaucgcuggcuaaa

SEQ ID NO: 678361 - RNA, 18 nt, Haemophilus influenzae Rd
cauagcugaaaaauaaaa

SEQ ID NO: 678362 - RNA, 21 nt, Haemophilus influenzae Rd
caucaauaacugaucgccauc

SEQ ID NO: 678363 - RNA, 13 nt, Haemophilus influenzae Rd
ccacggauaaaug

SEQ ID NO: 678364 - RNA, 16 nt, Haemophilus influenzae Rd
ccacuucauauaaauu

SEQ ID NO: 678365 - RNA, 18 nt, Haemophilus influenzae Rd
ccacuuggugaucaccga

SEQ ID NO: 678366 - RNA, 15 nt, Haemophilus influenzae Rd
ccagaagcccguugc

SEQ ID NO: 678367 - RNA, 12 nt, Haemophilus influenzae Rd
ccagcaaguuca

SEQ ID NO: 678368 - RNA, 20 nt, Haemophilus influenzae Rd
caugauguuuuucagcaaaa

SEQ ID NO: 678369 - RNA, 18 nt, Haemophilus influenzae Rd
caugguuguaauaaugaa

SEQ ID NO: 678370 - RNA, 14 nt, Haemophilus influenzae Rd
caugggcacgauag

SEQ ID NO: 678371 - RNA, 18 nt, Haemophilus influenzae Rd
cauuauaaccaaaguuuc

SEQ ID NO: 678372 - RNA, 23 nt, Haemophilus influenzae Rd
cauuaggaauaucuuugacuaaa

SEQ ID NO: 678373 - RNA, 13 nt, Haemophilus influenzae Rd
cauuauuaaaagc

SEQ ID NO: 678374 - RNA, 20 nt, Haemophilus influenzae Rd
cauuauuuggcauagaaaag

SEQ ID NO: 678375 - RNA, 12 nt, Haemophilus influenzae Rd
cauuaaacugau

SEQ ID NO: 678376 - RNA, 14 nt, Haemophilus influenzae Rd
cauuaaagcaauug

SEQ ID NO: 678377 - RNA, 18 nt, Haemophilus influenzae Rd
cauuaagaaguuauuguu

SEQ ID NO: 678378 - RNA, 19 nt, Haemophilus influenzae Rd
cauuaauacuuuugcacug

SEQ ID NO: 678379 - RNA, 22 nt, Haemophilus influenzae Rd
cauuaaugcauugauugcuaaa

SEQ ID NO: 678380 - RNA, 23 nt, Haemophilus influenzae Rd
cauuaaugcauugauugcuaaau

SEQ ID NO: 678381 - RNA, 18 nt, Haemophilus influenzae Rd
cauuaaugguauugugau

SEQ ID NO: 678382 - RNA, 21 nt, Haemophilus influenzae Rd
cauuacacgagcaauggcaau

SEQ ID NO: 678383 - RNA, 16 nt, Haemophilus influenzae Rd
ccaacagaaaucauuu

SEQ ID NO: 678384 - RNA, 23 nt, Haemophilus influenzae Rd
ccaaaaaagcguugaaaauaaau

SEQ ID NO: 678385 - RNA, 15 nt, Haemophilus influenzae Rd
cauuuuuuauuaaaa

SEQ ID NO: 678386 - RNA, 15 nt, Haemophilus influenzae Rd
cauuucuaaaauaau

SEQ ID NO: 678387 - RNA, 19 nt, Haemophilus influenzae Rd
cauuugaugguaaaaacuu

SEQ ID NO: 678388 - RNA, 18 nt, Haemophilus influenzae Rd
cauuugaagaauuuguug

SEQ ID NO: 678389 - RNA, 21 nt, Haemophilus influenzae Rd
cauuuuucgugaggucugcaa

SEQ ID NO: 678390 - RNA, 19 nt, Haemophilus influenzae Rd
cauugauugcuaaauaaau

SEQ ID NO: 678391 - RNA, 16 nt, Haemophilus influenzae Rd
cauugauggaauaaau

SEQ ID NO: 678392 - RNA, 18 nt, Haemophilus influenzae Rd
cauuuaaaauauauauua

SEQ ID NO: 678393 - RNA, 18 nt, Haemophilus influenzae Rd
cauuguuucucaauaaau

SEQ ID NO: 678394 - RNA, 13 nt, Haemophilus influenzae Rd
cauuuaaauaaaa

SEQ ID NO: 678395 - RNA, 13 nt, Haemophilus influenzae Rd
cauuuaauacuga

SEQ ID NO: 678396 - RNA, 14 nt, Haemophilus influenzae Rd
cauuuauaaacuuc

SEQ ID NO: 678397 - RNA, 17 nt, Haemophilus influenzae Rd
cauuuauggaaauaaau

SEQ ID NO: 678398 - RNA, 16 nt, Haemophilus influenzae Rd
cauuucaauaucaauc

SEQ ID NO: 678399 - RNA, 19 nt, Haemophilus influenzae Rd
cauuuccugugcauuggcu

SEQ ID NO: 678400 - RNA, 23 nt, Haemophilus influenzae Rd
ccacaguccccauaucucugcca

SEQ ID NO: 678401 - RNA, 15 nt, Haemophilus influenzae Rd
ccacaagcaacaaua

SEQ ID NO: 678402 - RNA, 16 nt, Haemophilus influenzae Rd
ccacaauaaaauaaua

SEQ ID NO: 678403 - RNA, 20 nt, Haemophilus influenzae Rd
ccaauuucaucccaauuauu

SEQ ID NO: 678404 - RNA, 16 nt, Haemophilus influenzae Rd
ccaauuuuuucauaca

SEQ ID NO: 678405 - RNA, 21 nt, Haemophilus influenzae Rd
ccaauuuuuucugaauaaauu

SEQ ID NO: 678406 - RNA, 21 nt, Haemophilus influenzae Rd
ccacaaacuuaccgaucauuu

SEQ ID NO: 678407 - RNA, 16 nt, Haemophilus influenzae Rd
ccaauuaagcaauagc

SEQ ID NO: 678408 - RNA, 17 nt, Haemophilus influenzae Rd
ccaauuaaggauuuauu

SEQ ID NO: 678409 - RNA, 21 nt, Haemophilus influenzae Rd
ccaauggggguuagguaaaaa

SEQ ID NO: 678410 - RNA, 14 nt, Haemophilus influenzae Rd
ccaaugcaacuugc

SEQ ID NO: 678411 - RNA, 20 nt, Haemophilus influenzae Rd
ccaaugcaauuggcaauauu

SEQ ID NO: 678412 - RNA, 22 nt, Haemophilus influenzae Rd
ccaaugcacuuguggcuucauc

SEQ ID NO: 678413 - RNA, 19 nt, Haemophilus influenzae Rd
ccaaugccuugugcauaaa

SEQ ID NO: 678414 - RNA, 15 nt, Haemophilus influenzae Rd
ccaagcuguaccagc

SEQ ID NO: 678415 - RNA, 17 nt, Haemophilus influenzae Rd
ccaauauagcgagauac

SEQ ID NO: 678416 - RNA, 16 nt, Haemophilus influenzae Rd
ccaucccagucaaaaa

SEQ ID NO: 678417 - RNA, 21 nt, Haemophilus influenzae Rd
ccauuacguucauauaaauuu

SEQ ID NO: 678418 - RNA, 20 nt, Haemophilus influenzae Rd
ccauuagucgucuauuuauu

SEQ ID NO: 678419 - RNA, 21 nt, Haemophilus influenzae Rd
cccauuugucucaaaauccaa

SEQ ID NO: 678420 - RNA, 20 nt, Haemophilus influenzae Rd
ccccaaucccucaaauacac

SEQ ID NO: 678421 - RNA, 15 nt, Haemophilus influenzae Rd
agcguuguucaucug

SEQ ID NO: 678422 - RNA, 13 nt, Haemophilus influenzae Rd
agcguuuuucuac

SEQ ID NO: 678423 - RNA, 21 nt, Haemophilus influenzae Rd
agcuaauccaaaucaagcuaa

SEQ ID NO: 678424 - RNA, 15 nt, Haemophilus influenzae Rd
agcuaauugguaaaa

SEQ ID NO: 678425 - RNA, 17 nt, Haemophilus influenzae Rd
agcuacuaaaaauugcu

SEQ ID NO: 678426 - RNA, 12 nt, Haemophilus influenzae Rd
agcguucaucaa

SEQ ID NO: 678427 - RNA, 16 nt, Haemophilus influenzae Rd
agcgcauauuaucucg

SEQ ID NO: 678428 - RNA, 21 nt, Haemophilus influenzae Rd
agccuuuaaggugcagauuaa

SEQ ID NO: 678429 - RNA, 13 nt, Haemophilus influenzae Rd
agccuuuuucuaa

SEQ ID NO: 678430 - RNA, 17 nt, Haemophilus influenzae Rd
agccuuuuucuaauggu

SEQ ID NO: 678431 - RNA, 17 nt, Haemophilus influenzae Rd
agccauuuuuaaacgaa

SEQ ID NO: 678432 - RNA, 16 nt, Haemophilus influenzae Rd
agcccaaaugcaacaa

SEQ ID NO: 678433 - RNA, 15 nt, Haemophilus influenzae Rd
agccauuaacauuua

SEQ ID NO: 678434 - RNA, 23 nt, Haemophilus influenzae Rd
agccaauaauuucuuguuuaaau

SEQ ID NO: 678435 - RNA, 17 nt, Haemophilus influenzae Rd
agccauaaauaaaucaa

SEQ ID NO: 678436 - RNA, 22 nt, Haemophilus influenzae Rd
agcaauguaguuggcauaucaa

SEQ ID NO: 678437 - RNA, 13 nt, Haemophilus influenzae Rd
agauuacuuucau

SEQ ID NO: 678438 - RNA, 17 nt, Haemophilus influenzae Rd
agauuauugcacuaaua

SEQ ID NO: 678439 - RNA, 18 nt, Haemophilus influenzae Rd
agcaaauuguuugaaauc

SEQ ID NO: 678440 - RNA, 16 nt, Haemophilus influenzae Rd
agcaaauuuaaauaau

SEQ ID NO: 678441 - RNA, 14 nt, Haemophilus influenzae Rd
agaugauuuuaaaa

SEQ ID NO: 678442 - RNA, 19 nt, Haemophilus influenzae Rd
agaugacuuguuucauaaa

SEQ ID NO: 678443 - RNA, 18 nt, Haemophilus influenzae Rd
agagucauuuacagguug

SEQ ID NO: 678444 - RNA, 23 nt, Haemophilus influenzae Rd
agaggggauaaaauaaacauuuu

SEQ ID NO: 678445 - RNA, 22 nt, Haemophilus influenzae Rd
agaggaaguuaauggguuaaaa

SEQ ID NO: 678446 - RNA, 20 nt, Haemophilus influenzae Rd
agaggaaaaucgaucuaauc

SEQ ID NO: 678447 - RNA, 17 nt, Haemophilus influenzae Rd
agaaagggauuuuaauu

SEQ ID NO: 678448 - RNA, 20 nt, Haemophilus influenzae Rd
agaaaguucuaauucauuuu

SEQ ID NO: 678449 - RNA, 17 nt, Haemophilus influenzae Rd
agaaaauagaauuugca

SEQ ID NO: 678450 - RNA, 15 nt, Haemophilus influenzae Rd
agaaaaucgcaauaa

SEQ ID NO: 678451 - RNA, 14 nt, Haemophilus influenzae Rd
agguagauugauac

SEQ ID NO: 678452 - RNA, 11 nt, Haemophilus influenzae Rd
aguaauauuuc

SEQ ID NO: 678453 - RNA, 11 nt, Haemophilus influenzae Rd
aguaauacacc

SEQ ID NO: 678454 - RNA, 13 nt, Haemophilus influenzae Rd
aguaaugcuaaau

SEQ ID NO: 678455 - RNA, 17 nt, Haemophilus influenzae Rd
aguaauucuuuuuguuc

SEQ ID NO: 678456 - RNA, 22 nt, Haemophilus influenzae Rd
agguucgucaucuucauuaaac

SEQ ID NO: 678457 - RNA, 13 nt, Haemophilus influenzae Rd
aguaaauauuuuu

SEQ ID NO: 678458 - RNA, 18 nt, Haemophilus influenzae Rd
aguaaaccgugguuuaaa

SEQ ID NO: 678459 - RNA, 20 nt, Haemophilus influenzae Rd
agguuuaguggguaaaccaa

SEQ ID NO: 678460 - RNA, 15 nt, Haemophilus influenzae Rd
aggugggcuuuagcc

SEQ ID NO: 678461 - RNA, 18 nt, Haemophilus influenzae Rd
aggugggcuuuagcccac

SEQ ID NO: 678462 - RNA, 21 nt, Haemophilus influenzae Rd
aggauuaauuacgccugccca

SEQ ID NO: 678463 - RNA, 14 nt, Haemophilus influenzae Rd
aggcauuucaucag

SEQ ID NO: 678464 - RNA, 17 nt, Haemophilus influenzae Rd
aggcauuagauuugaau

SEQ ID NO: 678465 - RNA, 21 nt, Haemophilus influenzae Rd
aggcuuuaauuuuaucuaauc

SEQ ID NO: 678466 - RNA, 14 nt, Haemophilus influenzae Rd
aguucuaaauaaac

SEQ ID NO: 678467 - RNA, 20 nt, Haemophilus influenzae Rd
aguugagcuaaagugcgguu

SEQ ID NO: 678468 - RNA, 19 nt, Haemophilus influenzae Rd
aguucuuccuugguuaauc

SEQ ID NO: 678469 - RNA, 19 nt, Haemophilus influenzae Rd
aguugaagagaauuuucau

SEQ ID NO: 678470 - RNA, 23 nt, Haemophilus influenzae Rd
aguguauaacaaauaggauaaaa

SEQ ID NO: 678471 - RNA, 15 nt, Haemophilus influenzae Rd
auaaacgcaccacaa

SEQ ID NO: 678472 - RNA, 18 nt, Haemophilus influenzae Rd
auaaaagugcgguaaaaa

SEQ ID NO: 678473 - RNA, 17 nt, Haemophilus influenzae Rd
auaaaauaaacauuuuu

SEQ ID NO: 678474 - RNA, 23 nt, Haemophilus influenzae Rd
auaaaauauaugggaaacaauau

SEQ ID NO: 678475 - RNA, 13 nt, Haemophilus influenzae Rd
auaaaauauuuuu

SEQ ID NO: 678476 - RNA, 17 nt, Haemophilus influenzae Rd
auaaaauauuuuuuauu

SEQ ID NO: 678477 - RNA, 13 nt, Haemophilus influenzae Rd
auaaacaauuuca

SEQ ID NO: 678478 - RNA, 14 nt, Haemophilus influenzae Rd
auaaacaaauugca

SEQ ID NO: 678479 - RNA, 11 nt, Haemophilus influenzae Rd
auaaauaacau

SEQ ID NO: 678480 - RNA, 12 nt, Haemophilus influenzae Rd
auaaaucauuuu

SEQ ID NO: 678481 - RNA, 19 nt, Haemophilus influenzae Rd
auaaagugcgguuauuuuu

SEQ ID NO: 678482 - RNA, 17 nt, Haemophilus influenzae Rd
auaaaaccuaaaauuga

SEQ ID NO: 678483 - RNA, 20 nt, Haemophilus influenzae Rd
auaaaacuuuucuuauaauu

SEQ ID NO: 678484 - RNA, 17 nt, Haemophilus influenzae Rd
auaaaaauauuuuaaua

SEQ ID NO: 678485 - RNA, 21 nt, Haemophilus influenzae Rd
auaaaaaugaugauaauuuuu

SEQ ID NO: 678486 - RNA, 20 nt, Haemophilus influenzae Rd
auaaaacaaugcaaauacaa

SEQ ID NO: 678487 - RNA, 23 nt, Haemophilus influenzae Rd
aguugugauuuucagcaaaaugc

SEQ ID NO: 678488 - RNA, 16 nt, Haemophilus influenzae Rd
aguuucacucuaccau

SEQ ID NO: 678489 - RNA, 16 nt, Haemophilus influenzae Rd
aguuuaucucuuucuu

SEQ ID NO: 678490 - RNA, 14 nt, Haemophilus influenzae Rd
auaauccuuuuuuu

SEQ ID NO: 678491 - RNA, 14 nt, Haemophilus influenzae Rd
auaaggaaauugca

SEQ ID NO: 678492 - RNA, 19 nt, Haemophilus influenzae Rd
auaaauggaaaccauugau

SEQ ID NO: 678493 - RNA, 16 nt, Haemophilus influenzae Rd
auaaaugcacauuuuu

SEQ ID NO: 678494 - RNA, 13 nt, Haemophilus influenzae Rd
auaaauuauauuu

SEQ ID NO: 678495 - RNA, 14 nt, Haemophilus influenzae Rd
auaaauuccuuuuu

SEQ ID NO: 678496 - RNA, 19 nt, Haemophilus influenzae Rd
auaaauuauauuuuuaauu

SEQ ID NO: 678497 - RNA, 21 nt, Haemophilus influenzae Rd
auaaauuuuuagcugauuuuu

SEQ ID NO: 678498 - RNA, 15 nt, Haemophilus influenzae Rd
auaacaaaagggcga

SEQ ID NO: 678499 - RNA, 19 nt, Haemophilus influenzae Rd
auaacaaaauggcuuuuuu

SEQ ID NO: 678500 - RNA, 15 nt, Haemophilus influenzae Rd
auaauuccuuuuucu

SEQ ID NO: 678501 - RNA, 17 nt, Haemophilus influenzae Rd
auacagcgaacauuuuu

SEQ ID NO: 678502 - RNA, 20 nt, Haemophilus influenzae Rd
auaauucagcgagagaauau

SEQ ID NO: 678503 - RNA, 14 nt, Haemophilus influenzae Rd
auaaugccucuuua

SEQ ID NO: 678504 - RNA, 17 nt, Haemophilus influenzae Rd
auaaugcaaccaaacaa

SEQ ID NO: 678505 - RNA, 23 nt, Haemophilus influenzae Rd
auaaugucccugcccuugauauu

SEQ ID NO: 678506 - RNA, 20 nt, Haemophilus influenzae Rd
auaauguucccuauaaauaa

SEQ ID NO: 678507 - RNA, 15 nt, Haemophilus influenzae Rd
auaauuaaacauuuc

SEQ ID NO: 678508 - RNA, 14 nt, Haemophilus influenzae Rd
auaauuaagaaaau

SEQ ID NO: 678509 - RNA, 13 nt, Haemophilus influenzae Rd
auacguuucauau

SEQ ID NO: 678510 - RNA, 21 nt, Haemophilus influenzae Rd
auacucacagagccuuuuucu

SEQ ID NO: 678511 - RNA, 21 nt, Haemophilus influenzae Rd
auacuaaggguauacuuuauu

SEQ ID NO: 678512 - RNA, 18 nt, Haemophilus influenzae Rd
auaccccaauuaagucaa

SEQ ID NO: 678513 - RNA, 21 nt, Haemophilus influenzae Rd
auacagugcagaaaauugcca

SEQ ID NO: 678514 - RNA, 18 nt, Haemophilus influenzae Rd
auacaucuaauuuuaguu

SEQ ID NO: 678515 - RNA, 18 nt, Haemophilus influenzae Rd
auacauggaacguuuuuu

SEQ ID NO: 678516 - RNA, 23 nt, Haemophilus influenzae Rd
auacucucccgaaaauuguucag

SEQ ID NO: 678517 - RNA, 21 nt, Haemophilus influenzae Rd
auacuuaauagcugggcaaaa

SEQ ID NO: 678518 - RNA, 17 nt, Haemophilus influenzae Rd
auacuguuuggcaaaua

SEQ ID NO: 678519 - RNA, 14 nt, Haemophilus influenzae Rd
auagaguacgccca

SEQ ID NO: 678520 - RNA, 17 nt, Haemophilus influenzae Rd
auagauuacguagaaaa

SEQ ID NO: 678521 - RNA, 15 nt, Haemophilus influenzae Rd
auagaugaaauuuau

SEQ ID NO: 678522 - RNA, 19 nt, Haemophilus influenzae Rd
aucagcccuuuguuuuaau

SEQ ID NO: 678523 - RNA, 19 nt, Haemophilus influenzae Rd
aucagaauagccgcaauca

SEQ ID NO: 678524 - RNA, 20 nt, Haemophilus influenzae Rd
aucacuuaauuucuuaauua

SEQ ID NO: 678525 - RNA, 16 nt, Haemophilus influenzae Rd
aucacuaauauaaaga

SEQ ID NO: 678526 - RNA, 21 nt, Haemophilus influenzae Rd
auauuugaguuauuuuuaauc

SEQ ID NO: 678527 - RNA, 23 nt, Haemophilus influenzae Rd
auauuuauaauguggugcuguuu

SEQ ID NO: 678528 - RNA, 21 nt, Haemophilus influenzae Rd
auauuuugcauguuauucucc

SEQ ID NO: 678529 - RNA, 11 nt, Haemophilus influenzae Rd
aucaaauaaaa

SEQ ID NO: 678530 - RNA, 17 nt, Haemophilus influenzae Rd
aucaaagaaaaauugug

SEQ ID NO: 678531 - RNA, 17 nt, Haemophilus influenzae Rd
aucaaaagaaaagauga

SEQ ID NO: 678532 - RNA, 23 nt, Haemophilus influenzae Rd
aucaaaaaacgaaauuuuucacc

SEQ ID NO: 678533 - RNA, 13 nt, Haemophilus influenzae Rd
aucaaaagaauua

SEQ ID NO: 678534 - RNA, 12 nt, Haemophilus influenzae Rd
aucaaucacuuc

SEQ ID NO: 678535 - RNA, 15 nt, Haemophilus influenzae Rd
aucaauauuaugugc

SEQ ID NO: 678536 - RNA, 17 nt, Haemophilus influenzae Rd
aucaauauaaccuuguc

SEQ ID NO: 678537 - RNA, 23 nt, Haemophilus influenzae Rd
aucaauuagaugacuggcaaaaa

SEQ ID NO: 678538 - RNA, 21 nt, Haemophilus influenzae Rd
aucacaaaauggcaaacaaaa

SEQ ID NO: 678539 - RNA, 21 nt, Haemophilus influenzae Rd
aucaaggguacaacaaauuuc

SEQ ID NO: 678540 - RNA, 14 nt, Haemophilus influenzae Rd
auauccaaacuuuc

SEQ ID NO: 678541 - RNA, 22 nt, Haemophilus influenzae Rd
auaucccaagguuuuuuagauu

SEQ ID NO: 678542 - RNA, 19 nt, Haemophilus influenzae Rd
auauccgagcucuuucauu

SEQ ID NO: 678543 - RNA, 20 nt, Haemophilus influenzae Rd
auaucaaucccacuuguuuu

SEQ ID NO: 678544 - RNA, 13 nt, Haemophilus influenzae Rd
auaucacuuuuuu

SEQ ID NO: 678545 - RNA, 15 nt, Haemophilus influenzae Rd
auaucagacaaucug

SEQ ID NO: 678546 - RNA, 16 nt, Haemophilus influenzae Rd
auagccuucaucacaa

SEQ ID NO: 678547 - RNA, 22 nt, Haemophilus influenzae Rd
auagccuucgcuauuuuucgcu

SEQ ID NO: 678548 - RNA, 16 nt, Haemophilus influenzae Rd
auauuauacuuucaau

SEQ ID NO: 678549 - RNA, 15 nt, Haemophilus influenzae Rd
auauguaaaauuuuu

SEQ ID NO: 678550 - RNA, 15 nt, Haemophilus influenzae Rd
auaugccuuauauuu

SEQ ID NO: 678551 - RNA, 14 nt, Haemophilus influenzae Rd
auaugauaaaugca

SEQ ID NO: 678552 - RNA, 20 nt, Haemophilus influenzae Rd
cacccgccuuaaucauugca

SEQ ID NO: 678553 - RNA, 15 nt, Haemophilus influenzae Rd
cacacuuuaaaaguu

SEQ ID NO: 678554 - RNA, 23 nt, Haemophilus influenzae Rd
caccgcuaaaccuugcacuaauu

SEQ ID NO: 678555 - RNA, 22 nt, Haemophilus influenzae Rd
caccuaacagggcauaaaucau

SEQ ID NO: 678556 - RNA, 14 nt, Haemophilus influenzae Rd
caaacugccaaaca

SEQ ID NO: 678557 - RNA, 15 nt, Haemophilus influenzae Rd
caaacuggaauaaag

SEQ ID NO: 678558 - RNA, 21 nt, Haemophilus influenzae Rd
caaaauucuacgccauuuucu

SEQ ID NO: 678559 - RNA, 14 nt, Haemophilus influenzae Rd
caaaauuuaaaauc

SEQ ID NO: 678560 - RNA, 21 nt, Haemophilus influenzae Rd
caaaauggcuuuuuugccuuu

SEQ ID NO: 678561 - RNA, 12 nt, Haemophilus influenzae Rd
auuuaaauaaag

SEQ ID NO: 678562 - RNA, 23 nt, Haemophilus influenzae Rd
auuuaaauauaauuuagcaucua

SEQ ID NO: 678563 - RNA, 11 nt, Haemophilus influenzae Rd
caaaaugaaca

SEQ ID NO: 678564 - RNA, 19 nt, Haemophilus influenzae Rd
auuguugguuacuaaaugu

SEQ ID NO: 678565 - RNA, 16 nt, Haemophilus influenzae Rd
auugugcaauuucguu

SEQ ID NO: 678566 - RNA, 15 nt, Haemophilus influenzae Rd
auugugcauuguuac

SEQ ID NO: 678567 - RNA, 21 nt, Haemophilus influenzae Rd
auugugucacauaaucaggcu

SEQ ID NO: 678568 - RNA, 23 nt, Haemophilus influenzae Rd
auuguucacgauaacggcaaaau

SEQ ID NO: 678569 - RNA, 22 nt, Haemophilus influenzae Rd
caaauccacccucguuaauauu

SEQ ID NO: 678570 - RNA, 17 nt, Haemophilus influenzae Rd
caaauacaccaagcauu

SEQ ID NO: 678571 - RNA, 20 nt, Haemophilus influenzae Rd
caaauacagugacaaauuuu

SEQ ID NO: 678572 - RNA, 15 nt, Haemophilus influenzae Rd
caaaucgaucacuua

SEQ ID NO: 678573 - RNA, 15 nt, Haemophilus influenzae Rd
caaaugccuaacaca

SEQ ID NO: 678574 - RNA, 18 nt, Haemophilus influenzae Rd
caaaugaggaaaauaaag

SEQ ID NO: 678575 - RNA, 19 nt, Haemophilus influenzae Rd
caaauugcaaaaaacuuug

SEQ ID NO: 678576 - RNA, 18 nt, Haemophilus influenzae Rd
caacaaacauuaaucgau

SEQ ID NO: 678577 - RNA, 18 nt, Haemophilus influenzae Rd
caaauuccgcaauauuua

SEQ ID NO: 678578 - RNA, 19 nt, Haemophilus influenzae Rd
caacaaagugcggcaaaaa

SEQ ID NO: 678579 - RNA, 12 nt, Haemophilus influenzae Rd
caacaaauucua

SEQ ID NO: 678580 - RNA, 19 nt, Haemophilus influenzae Rd
caacaacgcccucgccuug

SEQ ID NO: 678581 - RNA, 17 nt, Haemophilus influenzae Rd
caacacagcagcuaaaa

SEQ ID NO: 678582 - RNA, 22 nt, Haemophilus influenzae Rd
caacaauaacugccacaucauc

SEQ ID NO: 678583 - RNA, 12 nt, Haemophilus influenzae Rd
caacaauaucac

SEQ ID NO: 678584 - RNA, 18 nt, Haemophilus influenzae Rd
caacaauauuaggaauag

SEQ ID NO: 678585 - RNA, 16 nt, Haemophilus influenzae Rd
caacaauccauuucgu

SEQ ID NO: 678586 - RNA, 18 nt, Haemophilus influenzae Rd
caaccgcucuuuuuauuu

SEQ ID NO: 678587 - RNA, 14 nt, Haemophilus influenzae Rd
caacacgccuaaca

SEQ ID NO: 678588 - RNA, 21 nt, Haemophilus influenzae Rd
caacuaaaggcacaaaaaauu

SEQ ID NO: 678589 - RNA, 17 nt, Haemophilus influenzae Rd
caaggcucgcgauuaau

SEQ ID NO: 678590 - RNA, 21 nt, Haemophilus influenzae Rd
caagugcaugagcuuugcuuu

SEQ ID NO: 678591 - RNA, 19 nt, Haemophilus influenzae Rd
caagugcgguugaaaaauu

SEQ ID NO: 678592 - RNA, 14 nt, Haemophilus influenzae Rd
caaguauaaaaaau

SEQ ID NO: 678593 - RNA, 14 nt, Haemophilus influenzae Rd
caaguaucuaccau

SEQ ID NO: 678594 - RNA, 14 nt, Haemophilus influenzae Rd
caaguccaaguuuu

SEQ ID NO: 678595 - RNA, 22 nt, Haemophilus influenzae Rd
caaguccaaguuuuuuaucuuu

SEQ ID NO: 678596 - RNA, 20 nt, Haemophilus influenzae Rd
caagugguggaauaaaaguc

SEQ ID NO: 678597 - RNA, 21 nt, Haemophilus influenzae Rd
caaguucacaaaucuaaaaau

SEQ ID NO: 678598 - RNA, 15 nt, Haemophilus influenzae Rd
caaguuguaaaagug

SEQ ID NO: 678599 - RNA, 11 nt, Haemophilus influenzae Rd
caauaaacauu

SEQ ID NO: 678600 - RNA, 17 nt, Haemophilus influenzae Rd
caauaacuggaauggau

SEQ ID NO: 678601 - RNA, 19 nt, Haemophilus influenzae Rd
caauaucaaucgguuucac

SEQ ID NO: 678602 - RNA, 17 nt, Haemophilus influenzae Rd
caauauagucaaauaac

SEQ ID NO: 678603 - RNA, 15 nt, Haemophilus influenzae Rd
caauagcgaccaaca

SEQ ID NO: 678604 - RNA, 21 nt, Haemophilus influenzae Rd
caauaucuaagaaaauagaag

SEQ ID NO: 678605 - RNA, 19 nt, Haemophilus influenzae Rd
caauaucuaagauuuuagu

SEQ ID NO: 678606 - RNA, 12 nt, Haemophilus influenzae Rd
caauauugaaau

SEQ ID NO: 678607 - RNA, 14 nt, Haemophilus influenzae Rd
caauauugaaauaa

SEQ ID NO: 678608 - RNA, 21 nt, Haemophilus influenzae Rd
caauauguauaauuccuaaaa

SEQ ID NO: 678609 - RNA, 18 nt, Haemophilus influenzae Rd
caaucuguggcguauuua

SEQ ID NO: 678610 - RNA, 15 nt, Haemophilus influenzae Rd
caaucauaucaucaa

SEQ ID NO: 678611 - RNA, 17 nt, Haemophilus influenzae Rd
caauccauaaaauacag

SEQ ID NO: 678612 - RNA, 23 nt, Haemophilus influenzae Rd
cacaauuacuucuuacaacaaau

SEQ ID NO: 678613 - RNA, 14 nt, Haemophilus influenzae Rd
cacaaguuacaagu

SEQ ID NO: 678614 - RNA, 15 nt, Haemophilus influenzae Rd
cacaagccacaucac

SEQ ID NO: 678615 - RNA, 20 nt, Haemophilus influenzae Rd
cacaagauuugccaaaauca

SEQ ID NO: 678616 - RNA, 13 nt, Haemophilus influenzae Rd
cacaagcaaguuu

SEQ ID NO: 678617 - RNA, 13 nt, Haemophilus influenzae Rd
cacaagcaccagu

SEQ ID NO: 678618 - RNA, 13 nt, Haemophilus influenzae Rd
caauuuuaaaauu

SEQ ID NO: 678619 - RNA, 21 nt, Haemophilus influenzae Rd
caauugcagcccaaauuguug

SEQ ID NO: 678620 - RNA, 14 nt, Haemophilus influenzae Rd
caauggcugaaaaa

SEQ ID NO: 678621 - RNA, 18 nt, Haemophilus influenzae Rd
caaugguucgagaaacuu

SEQ ID NO: 678622 - RNA, 12 nt, Haemophilus influenzae Rd
caauguagaaau

SEQ ID NO: 678623 - RNA, 18 nt, Haemophilus influenzae Rd
caaugucagaaaagauuu

SEQ ID NO: 678624 - RNA, 17 nt, Haemophilus influenzae Rd
auggccaauuucaucgc

SEQ ID NO: 678625 - RNA, 13 nt, Haemophilus influenzae Rd
auggaauaaauuu

SEQ ID NO: 678626 - RNA, 22 nt, Haemophilus influenzae Rd
auggacagaauaacuagcaauc

SEQ ID NO: 678627 - RNA, 13 nt, Haemophilus influenzae Rd
augcuguagaaau

SEQ ID NO: 678628 - RNA, 20 nt, Haemophilus influenzae Rd
augcuuuugccgaaaauggu

SEQ ID NO: 678629 - RNA, 14 nt, Haemophilus influenzae Rd
auguaucugauuuu

SEQ ID NO: 678630 - RNA, 17 nt, Haemophilus influenzae Rd
auggguuaguaaguggu

SEQ ID NO: 678631 - RNA, 17 nt, Haemophilus influenzae Rd
auggcuuucaauuucac

SEQ ID NO: 678632 - RNA, 14 nt, Haemophilus influenzae Rd
auggcuuuuuccug

SEQ ID NO: 678633 - RNA, 19 nt, Haemophilus influenzae Rd
auguucuacguaauuuaau

SEQ ID NO: 678634 - RNA, 22 nt, Haemophilus influenzae Rd
auguuauucuccuuaauuucau

SEQ ID NO: 678635 - RNA, 13 nt, Haemophilus influenzae Rd
auguuaaguucau

SEQ ID NO: 678636 - RNA, 17 nt, Haemophilus influenzae Rd
augucgugaaagaauaa

SEQ ID NO: 678637 - RNA, 18 nt, Haemophilus influenzae Rd
auucuggcaauauuucaa

SEQ ID NO: 678638 - RNA, 19 nt, Haemophilus influenzae Rd
auucugauuuagguuucaa

SEQ ID NO: 678639 - RNA, 22 nt, Haemophilus influenzae Rd
auucuccaaauauaaaauaaaa

SEQ ID NO: 678640 - RNA, 18 nt, Haemophilus influenzae Rd
auucuccagacugcauug

SEQ ID NO: 678641 - RNA, 14 nt, Haemophilus influenzae Rd
auucuauuuuaaaa

SEQ ID NO: 678642 - RNA, 18 nt, Haemophilus influenzae Rd
auucuccccgaugauuuu

SEQ ID NO: 678643 - RNA, 13 nt, Haemophilus influenzae Rd
auucucugcaucg

SEQ ID NO: 678644 - RNA, 13 nt, Haemophilus influenzae Rd
auucguuaaauaa

SEQ ID NO: 678645 - RNA, 20 nt, Haemophilus influenzae Rd
auucguaaugccucgauauu

SEQ ID NO: 678646 - RNA, 20 nt, Haemophilus influenzae Rd
auucgccacgauaggaucua

SEQ ID NO: 678647 - RNA, 13 nt, Haemophilus influenzae Rd
auucgacaauuuc

SEQ ID NO: 678648 - RNA, 17 nt, Haemophilus influenzae Rd
auucgaauauugaucau

SEQ ID NO: 678649 - RNA, 15 nt, Haemophilus influenzae Rd
auuccugcuuuuuuc

SEQ ID NO: 678650 - RNA, 13 nt, Haemophilus influenzae Rd
auucgcuuuuuua

SEQ ID NO: 678651 - RNA, 22 nt, Haemophilus influenzae Rd
auuaacaucuuaguauuuuauu

SEQ ID NO: 678652 - RNA, 18 nt, Haemophilus influenzae Rd
auuaaauauaaugaaaac

SEQ ID NO: 678653 - RNA, 14 nt, Haemophilus influenzae Rd
auuaaaauauuuuu

SEQ ID NO: 678654 - RNA, 12 nt, Haemophilus influenzae Rd
auuaaacugaau

SEQ ID NO: 678655 - RNA, 20 nt, Haemophilus influenzae Rd
auucaccgcacuuuuuacuu

SEQ ID NO: 678656 - RNA, 14 nt, Haemophilus influenzae Rd
auucacuaacaaau

SEQ ID NO: 678657 - RNA, 23 nt, Haemophilus influenzae Rd
auuaugcuccauugcaauuucag

SEQ ID NO: 678658 - RNA, 23 nt, Haemophilus influenzae Rd
auuauuaaguaauacauuuucau

SEQ ID NO: 678659 - RNA, 19 nt, Haemophilus influenzae Rd
auucauaccgauaacacga

SEQ ID NO: 678660 - RNA, 13 nt, Haemophilus influenzae Rd
auucagucuuaau

SEQ ID NO: 678661 - RNA, 14 nt, Haemophilus influenzae Rd
auuggacugcauau

SEQ ID NO: 678662 - RNA, 22 nt, Haemophilus influenzae Rd
auugcuuugagccguuauauuu

SEQ ID NO: 678663 - RNA, 20 nt, Haemophilus influenzae Rd
auuggggcgaccauuacagc

SEQ ID NO: 678664 - RNA, 20 nt, Haemophilus influenzae Rd
auugggcguaauguuggauc

SEQ ID NO: 678665 - RNA, 13 nt, Haemophilus influenzae Rd
auugguaaaauuu

SEQ ID NO: 678666 - RNA, 18 nt, Haemophilus influenzae Rd
auugucugcuccaaauaa

SEQ ID NO: 678667 - RNA, 13 nt, Haemophilus influenzae Rd
auugccuuuuuuc

SEQ ID NO: 678668 - RNA, 18 nt, Haemophilus influenzae Rd
auugcuuaugauuuagug

SEQ ID NO: 678669 - RNA, 19 nt, Haemophilus influenzae Rd
auugcugcuuuaauuucau

SEQ ID NO: 678670 - RNA, 15 nt, Haemophilus influenzae Rd
auucuugcguuucaa

SEQ ID NO: 678671 - RNA, 13 nt, Haemophilus influenzae Rd
auucuuaaaucau

SEQ ID NO: 678672 - RNA, 22 nt, Haemophilus influenzae Rd
auugaagaguuugaucauggcu

SEQ ID NO: 678673 - RNA, 16 nt, Haemophilus influenzae Rd
auugaauguuuuucau

SEQ ID NO: 678674 - RNA, 22 nt, Haemophilus influenzae Rd
auugaauuagauucggcuaaaa

SEQ ID NO: 678675 - RNA, 18 nt, Haemophilus influenzae Rd
auugaaagauuaauuuuc

SEQ ID NO: 678676 - RNA, 19 nt, Haemophilus influenzae Rd
auugauacaggaaugcguu

SEQ ID NO: 678677 - RNA, 20 nt, Haemophilus influenzae Rd
auugagcgauagaaauaaag

SEQ ID NO: 678678 - RNA, 13 nt, Haemophilus influenzae Rd
auugaauuuggua

SEQ ID NO: 678679 - RNA, 14 nt, Haemophilus influenzae Rd
auugaccuuuuaau

SEQ ID NO: 678680 - RNA, 19 nt, Haemophilus influenzae Rd
auugaccucguggcaaaag

SEQ ID NO: 678681 - RNA, 19 nt, Haemophilus influenzae Rd
auugauuuuucaacuggcu

SEQ ID NO: 678682 - RNA, 16 nt, Haemophilus influenzae Rd
auugauucgauaaauu

SEQ ID NO: 678683 - RNA, 18 nt, Haemophilus influenzae Rd
auugcaccaucguuaaac

SEQ ID NO: 678684 - RNA, 15 nt, Haemophilus influenzae Rd
auugauggaauuuau

SEQ ID NO: 678685 - RNA, 16 nt, Haemophilus influenzae Rd
auugaugacugcauca

SEQ ID NO: 678686 - RNA, 21 nt, Haemophilus influenzae Rd
auugaucgccuaaauacauuu

SEQ ID NO: 678687 - RNA, 16 nt, Haemophilus influenzae Rd
auugccauuucugcau

SEQ ID NO: 678688 - RNA, 18 nt, Haemophilus influenzae Rd
aucuucauaucuuugaau

SEQ ID NO: 678689 - RNA, 14 nt, Haemophilus influenzae Rd
aucuuccaauaauu

SEQ ID NO: 678690 - RNA, 20 nt, Haemophilus influenzae Rd
aucuuaccuuuuucuaccga

SEQ ID NO: 678691 - RNA, 24 nt, Haemophilus influenzae Rd
aucuugauccccauacaaguauuu

SEQ ID NO: 678692 - RNA, 20 nt, Haemophilus influenzae Rd
aucuugccaaugccaaauuu

SEQ ID NO: 678693 - RNA, 17 nt, Haemophilus influenzae Rd
aucuuggcucauuuuaa

SEQ ID NO: 678694 - RNA, 21 nt, Haemophilus influenzae Rd
aucuggugagugagcauuucg

SEQ ID NO: 678695 - RNA, 22 nt, Haemophilus influenzae Rd
aucuguaaaccuuuuggcauua

SEQ ID NO: 678696 - RNA, 22 nt, Haemophilus influenzae Rd
aucuauugagauuuaauuuauu

SEQ ID NO: 678697 - RNA, 16 nt, Haemophilus influenzae Rd
aucuauugauucuaaa

SEQ ID NO: 678698 - RNA, 19 nt, Haemophilus influenzae Rd
aucuauuggauaaauuauu

SEQ ID NO: 678699 - RNA, 22 nt, Haemophilus influenzae Rd
aucuauuggauaaauuauucug

SEQ ID NO: 678700 - RNA, 15 nt, Haemophilus influenzae Rd
aucuaauucuugccc

SEQ ID NO: 678701 - RNA, 15 nt, Haemophilus influenzae Rd
aucuaaugccuuucc

SEQ ID NO: 678702 - RNA, 16 nt, Haemophilus influenzae Rd
aucuaccacaucaaau

SEQ ID NO: 678703 - RNA, 18 nt, Haemophilus influenzae Rd
aucuacuuaauugauuuu

SEQ ID NO: 678704 - RNA, 22 nt, Haemophilus influenzae Rd
aucuacuuggacauuguuguuu

SEQ ID NO: 678705 - RNA, 16 nt, Haemophilus influenzae Rd
aucgugaccaaguuca

SEQ ID NO: 678706 - RNA, 17 nt, Haemophilus influenzae Rd
aucgugaugauuuucau

SEQ ID NO: 678707 - RNA, 18 nt, Haemophilus influenzae Rd
aucuaaagcgaucaucau

SEQ ID NO: 678708 - RNA, 24 nt, Haemophilus influenzae Rd
aucuaagauacccauuucgaucau

SEQ ID NO: 678709 - RNA, 16 nt, Haemophilus influenzae Rd
augauguaggcaaaaa

SEQ ID NO: 678710 - RNA, 14 nt, Haemophilus influenzae Rd
augcauagccaagu

SEQ ID NO: 678711 - RNA, 20 nt, Haemophilus influenzae Rd
augcaguaacgcgauaaauc

SEQ ID NO: 678712 - RNA, 17 nt, Haemophilus influenzae Rd
augaucacuucauaaau

SEQ ID NO: 678713 - RNA, 23 nt, Haemophilus influenzae Rd
augauaaguuuugucugaaauuu

SEQ ID NO: 678714 - RNA, 20 nt, Haemophilus influenzae Rd
augaguaaaccgauuaauuc

SEQ ID NO: 678715 - RNA, 17 nt, Haemophilus influenzae Rd
augaccaaauacaauuu

SEQ ID NO: 678716 - RNA, 15 nt, Haemophilus influenzae Rd
augaauaaaaauggu

SEQ ID NO: 678717 - RNA, 18 nt, Haemophilus influenzae Rd
augaaguucacuucaucu

SEQ ID NO: 678718 - RNA, 16 nt, Haemophilus influenzae Rd
aucuuuaauuaaaaua

SEQ ID NO: 678719 - RNA, 22 nt, Haemophilus influenzae Rd
aucuuuauuugucagauuuacc

SEQ ID NO: 678720 - RNA, 18 nt, Haemophilus influenzae Rd
augaaaaaugcuuguucu

SEQ ID NO: 678721 - RNA, 24 nt, Haemophilus influenzae Rd
aucuuuuucuguaauauaugaaaa

SEQ ID NO: 678722 - RNA, 18 nt, Haemophilus influenzae Rd
aucuuugaauugguguuu

SEQ ID NO: 678723 - RNA, 23 nt, Haemophilus influenzae Rd
augaaaucauuuguaaguuguaa

SEQ ID NO: 678724 - RNA, 15 nt, Haemophilus influenzae Rd
augaaauuuguugau

SEQ ID NO: 678725 - RNA, 15 nt, Haemophilus influenzae Rd
aucgaccuucugcau

SEQ ID NO: 678726 - RNA, 21 nt, Haemophilus influenzae Rd
aucgaauaagguaacugcacu

SEQ ID NO: 678727 - RNA, 21 nt, Haemophilus influenzae Rd
auccuuaauuggggauaaaua

SEQ ID NO: 678728 - RNA, 17 nt, Haemophilus influenzae Rd
aucgaaauuaaaauaau

SEQ ID NO: 678729 - RNA, 15 nt, Haemophilus influenzae Rd
auccguuaauuucau

SEQ ID NO: 678730 - RNA, 15 nt, Haemophilus influenzae Rd
aucgcuggauaaaug

SEQ ID NO: 678731 - RNA, 18 nt, Haemophilus influenzae Rd
aucgcugccuaauuccau

SEQ ID NO: 678732 - RNA, 17 nt, Haemophilus influenzae Rd
aucgacuuuuucaccau

SEQ ID NO: 678733 - RNA, 19 nt, Haemophilus influenzae Rd
aucgccguacuguucuguu

SEQ ID NO: 678734 - RNA, 12 nt, Haemophilus influenzae Rd
accaucuucaac

SEQ ID NO: 678735 - RNA, 16 nt, Haemophilus influenzae Rd
accaucuucaacgaua

SEQ ID NO: 678736 - RNA, 14 nt, Haemophilus influenzae Rd
accauucguuucaa

SEQ ID NO: 678737 - RNA, 17 nt, Haemophilus influenzae Rd
accauuaauaaauuuuu

SEQ ID NO: 678738 - RNA, 22 nt, Haemophilus influenzae Rd
accauauuaaucgcaauaacac

SEQ ID NO: 678739 - RNA, 14 nt, Haemophilus influenzae Rd
accacguaauucuu

SEQ ID NO: 678740 - RNA, 18 nt, Haemophilus influenzae Rd
acauuaguaucuuccauu

SEQ ID NO: 678741 - RNA, 22 nt, Haemophilus influenzae Rd
acauuaagugcaucaaccgaua

SEQ ID NO: 678742 - RNA, 20 nt, Haemophilus influenzae Rd
accaauugguaaaauuucuu

SEQ ID NO: 678743 - RNA, 15 nt, Haemophilus influenzae Rd
acaccuuggcuuucu

SEQ ID NO: 678744 - RNA, 19 nt, Haemophilus influenzae Rd
acagaaacagaaauaacac

SEQ ID NO: 678745 - RNA, 20 nt, Haemophilus influenzae Rd
acagaagugcguucauauuu

SEQ ID NO: 678746 - RNA, 12 nt, Haemophilus influenzae Rd
acagaaucuaaa

SEQ ID NO: 678747 - RNA, 19 nt, Haemophilus influenzae Rd
acagcaauuugaauuaaua

SEQ ID NO: 678748 - RNA, 20 nt, Haemophilus influenzae Rd
acaccaauauugccgaccgu

SEQ ID NO: 678749 - RNA, 21 nt, Haemophilus influenzae Rd
acaccauuuuugcgcugacca

SEQ ID NO: 678750 - RNA, 14 nt, Haemophilus influenzae Rd
acaccaaaauaacc

SEQ ID NO: 678751 - RNA, 14 nt, Haemophilus influenzae Rd
acacaguuauuuuu

SEQ ID NO: 678752 - RNA, 20 nt, Haemophilus influenzae Rd
aauuuuuaauucuuuuucac

SEQ ID NO: 678753 - RNA, 17 nt, Haemophilus influenzae Rd
acacauggccaauuuca

SEQ ID NO: 678754 - RNA, 21 nt, Haemophilus influenzae Rd
aauuuucggcaagaaauucac

SEQ ID NO: 678755 - RNA, 22 nt, Haemophilus influenzae Rd
aauuugcuguggugaagugcgg

SEQ ID NO: 678756 - RNA, 20 nt, Haemophilus influenzae Rd
aauuuggcaaaaguaagcaa

SEQ ID NO: 678757 - RNA, 18 nt, Haemophilus influenzae Rd
acaggcuugaguuucgcc

SEQ ID NO: 678758 - RNA, 14 nt, Haemophilus influenzae Rd
acagcucaaaaugc

SEQ ID NO: 678759 - RNA, 22 nt, Haemophilus influenzae Rd
acagguacuuggauugcaugaa

SEQ ID NO: 678760 - RNA, 13 nt, Haemophilus influenzae Rd
acaucaucaucgc

SEQ ID NO: 678761 - RNA, 18 nt, Haemophilus influenzae Rd
acaucaucuggcauaucu

SEQ ID NO: 678762 - RNA, 23 nt, Haemophilus influenzae Rd
acaucaucuggcauaucugcugc

SEQ ID NO: 678763 - RNA, 19 nt, Haemophilus influenzae Rd
acauggccaauuucaucgc

SEQ ID NO: 678764 - RNA, 13 nt, Haemophilus influenzae Rd
accguuaauacuu

SEQ ID NO: 678765 - RNA, 21 nt, Haemophilus influenzae Rd
accguccaagguuuuaauuuu

SEQ ID NO: 678766 - RNA, 18 nt, Haemophilus influenzae Rd
accgucagugcuuucaua

SEQ ID NO: 678767 - RNA, 20 nt, Haemophilus influenzae Rd
accguauuuuuuuaauuuuu

SEQ ID NO: 678768 - RNA, 16 nt, Haemophilus influenzae Rd
accgauaaggaaaaua

SEQ ID NO: 678769 - RNA, 22 nt, Haemophilus influenzae Rd
accgaaugacgcguuaauuuuu

SEQ ID NO: 678770 - RNA, 14 nt, Haemophilus influenzae Rd
accgacuuugucaa

SEQ ID NO: 678771 - RNA, 20 nt, Haemophilus influenzae Rd
accgagaugcauuuuuuaau

SEQ ID NO: 678772 - RNA, 14 nt, Haemophilus influenzae Rd
accgcaaaaauacu

SEQ ID NO: 678773 - RNA, 15 nt, Haemophilus influenzae Rd
acgaaggauaaauug

SEQ ID NO: 678774 - RNA, 15 nt, Haemophilus influenzae Rd
acgacaucaaucaaa

SEQ ID NO: 678775 - RNA, 17 nt, Haemophilus influenzae Rd
accuaaaucuuuaucaa

SEQ ID NO: 678776 - RNA, 21 nt, Haemophilus influenzae Rd
accuaaacgaucaucuauacc

SEQ ID NO: 678777 - RNA, 13 nt, Haemophilus influenzae Rd
accuguaauccuu

SEQ ID NO: 678778 - RNA, 14 nt, Haemophilus influenzae Rd
accuugcacuaauu

SEQ ID NO: 678779 - RNA, 15 nt, Haemophilus influenzae Rd
accuuuuucuaccga

SEQ ID NO: 678780 - RNA, 13 nt, Haemophilus influenzae Rd
acgauauuuuccu

SEQ ID NO: 678781 - RNA, 16 nt, Haemophilus influenzae Rd
acgauauugcacaaua

SEQ ID NO: 678782 - RNA, 18 nt, Haemophilus influenzae Rd
acggaaguggauauuuuu

SEQ ID NO: 678783 - RNA, 11 nt, Haemophilus influenzae Rd
acgcguuaaau

SEQ ID NO: 678784 - RNA, 13 nt, Haemophilus influenzae Rd
acgcguuaauuuu

SEQ ID NO: 678785 - RNA, 17 nt, Haemophilus influenzae Rd
acgcucaacgccuacgc

SEQ ID NO: 678786 - RNA, 20 nt, Haemophilus influenzae Rd
acgcguuuuuacauauucga

SEQ ID NO: 678787 - RNA, 23 nt, Haemophilus influenzae Rd
acgcguuuuucuggguuuuaaaa

SEQ ID NO: 678788 - RNA, 12 nt, Haemophilus influenzae Rd
acuucuuugaau

SEQ ID NO: 678789 - RNA, 14 nt, Haemophilus influenzae Rd
acuugauaaucauu

SEQ ID NO: 678790 - RNA, 15 nt, Haemophilus influenzae Rd
acuucuuccacuuuu

SEQ ID NO: 678791 - RNA, 17 nt, Haemophilus influenzae Rd
acuuguuccgcaguuaa

SEQ ID NO: 678792 - RNA, 19 nt, Haemophilus influenzae Rd
acuugcuccgccuacacga

SEQ ID NO: 678793 - RNA, 17 nt, Haemophilus influenzae Rd
acuugcaucuaaaaaua

SEQ ID NO: 678794 - RNA, 21 nt, Haemophilus influenzae Rd
acuuuggauuggauuuugaaa

SEQ ID NO: 678795 - RNA, 18 nt, Haemophilus influenzae Rd
acuuuuuauuaguuacaa

SEQ ID NO: 678796 - RNA, 15 nt, Haemophilus influenzae Rd
acuuuuuauuuucug

SEQ ID NO: 678797 - RNA, 15 nt, Haemophilus influenzae Rd
acuuuuuuuauaucu

SEQ ID NO: 678798 - RNA, 16 nt, Haemophilus influenzae Rd
acuuuuuuucaucuca

SEQ ID NO: 678799 - RNA, 19 nt, Haemophilus influenzae Rd
acuuucaacuguucuucug

SEQ ID NO: 678800 - RNA, 20 nt, Haemophilus influenzae Rd
acuuuaucuagacaaaaccu

SEQ ID NO: 678801 - RNA, 21 nt, Haemophilus influenzae Rd
acuuuacgccccuacuuuaaa

SEQ ID NO: 678802 - RNA, 19 nt, Haemophilus influenzae Rd
acuuucuuuucaauuugaa

SEQ ID NO: 678803 - RNA, 20 nt, Haemophilus influenzae Rd
acuuucaguuaaauuuucaa

SEQ ID NO: 678804 - RNA, 22 nt, Haemophilus influenzae Rd
acuuuccauacccuugcuucug

SEQ ID NO: 678805 - RNA, 22 nt, Haemophilus influenzae Rd
acuuucgccuucauaaguccaa

SEQ ID NO: 678806 - RNA, 16 nt, Haemophilus influenzae Rd
acuuuccguuuacuac

SEQ ID NO: 678807 - RNA, 18 nt, Haemophilus influenzae Rd
acuucagcagcaaaaucu

SEQ ID NO: 678808 - RNA, 17 nt, Haemophilus influenzae Rd
acuucaccgauauguuu

SEQ ID NO: 678809 - RNA, 20 nt, Haemophilus influenzae Rd
acuuccacaggcuugaguuu

SEQ ID NO: 678810 - RNA, 19 nt, Haemophilus influenzae Rd
acuucaucacccaucaaau

SEQ ID NO: 678811 - RNA, 21 nt, Haemophilus influenzae Rd
acuucgcaggaauaucggcaa

SEQ ID NO: 678812 - RNA, 13 nt, Haemophilus influenzae Rd
acuuaaucauuuu

SEQ ID NO: 678813 - RNA, 15 nt, Haemophilus influenzae Rd
acuuaauuaaagaua

SEQ ID NO: 678814 - RNA, 17 nt, Haemophilus influenzae Rd
acugcaucugcauuucc

SEQ ID NO: 678815 - RNA, 19 nt, Haemophilus influenzae Rd
acuggacuccaaggcaauu

SEQ ID NO: 678816 - RNA, 19 nt, Haemophilus influenzae Rd
acucguccaucaaaaaaau

SEQ ID NO: 678817 - RNA, 16 nt, Haemophilus influenzae Rd
acugcaacaauuucau

SEQ ID NO: 678818 - RNA, 23 nt, Haemophilus influenzae Rd
acugauauagcuagaaagcaaug

SEQ ID NO: 678819 - RNA, 20 nt, Haemophilus influenzae Rd
acucacggcaacuucugcgc

SEQ ID NO: 678820 - RNA, 13 nt, Haemophilus influenzae Rd
acuauucuucaau

SEQ ID NO: 678821 - RNA, 15 nt, Haemophilus influenzae Rd
acggcuaaacgaucu

SEQ ID NO: 678822 - RNA, 23 nt, Haemophilus influenzae Rd
acggcuaaguuugcuaucuuacc

SEQ ID NO: 678823 - RNA, 18 nt, Haemophilus influenzae Rd
acggcuuagauaauaaaa

SEQ ID NO: 678824 - RNA, 17 nt, Haemophilus influenzae Rd
acggcguagaaugcaaa

SEQ ID NO: 678825 - RNA, 21 nt, Haemophilus influenzae Rd
acgugugcgauucaucacuuc

SEQ ID NO: 678826 - RNA, 14 nt, Haemophilus influenzae Rd
acuaauagcgugaa

SEQ ID NO: 678827 - RNA, 18 nt, Haemophilus influenzae Rd
acuacggacuaaauaaau

SEQ ID NO: 678828 - RNA, 18 nt, Haemophilus influenzae Rd
acuaauuuuuuaauuuuu

SEQ ID NO: 678829 - RNA, 21 nt, Haemophilus influenzae Rd
acuauuaaguucaaauuucuu

SEQ ID NO: 678830 - RNA, 15 nt, Haemophilus influenzae Rd
acuauuaauguuauu

SEQ ID NO: 678831 - RNA, 22 nt, Haemophilus influenzae Rd
acuauuaauguuauuaaauaua

SEQ ID NO: 678832 - RNA, 21 nt, Haemophilus influenzae Rd
acguauuuuuuaauacgaaaa

SEQ ID NO: 678833 - RNA, 20 nt, Haemophilus influenzae Rd
acgguuuuccacuucuucuu

SEQ ID NO: 678834 - RNA, 23 nt, Haemophilus influenzae Rd
acguaaaaucgccugacauuuuu

SEQ ID NO: 678835 - RNA, 19 nt, Haemophilus influenzae Rd
acguaauuuaauuuaucau

SEQ ID NO: 678836 - RNA, 16 nt, Haemophilus influenzae Rd
acguaaggaucuuuuu

SEQ ID NO: 678837 - RNA, 19 nt, Haemophilus influenzae Rd
acguaaucauccacuaauu

SEQ ID NO: 678838 - RNA, 15 nt, Haemophilus influenzae Rd
uuaaguaaauauuuu

SEQ ID NO: 678839 - RNA, 20 nt, Haemophilus influenzae Rd
uuaagugcaucaaccgauaa

SEQ ID NO: 678840 - RNA, 15 nt, Haemophilus influenzae Rd
uuaacuucuaaagua

SEQ ID NO: 678841 - RNA, 16 nt, Haemophilus influenzae Rd
uuaacugaaaauuagu

SEQ ID NO: 678842 - RNA, 16 nt, Haemophilus influenzae Rd
uuacaaguuaaagcac

SEQ ID NO: 678843 - RNA, 23 nt, Haemophilus influenzae Rd
uuaauuuuuucuaaauuuuagcg

SEQ ID NO: 678844 - RNA, 15 nt, Haemophilus influenzae Rd
uuaauucgaucagca

SEQ ID NO: 678845 - RNA, 20 nt, Haemophilus influenzae Rd
uuaauugacaauuaauauaa

SEQ ID NO: 678846 - RNA, 21 nt, Haemophilus influenzae Rd
uuaauuggaaauaauauucaa

SEQ ID NO: 678847 - RNA, 23 nt, Haemophilus influenzae Rd
uuaauuuacuggaaauucuucaa

SEQ ID NO: 678848 - RNA, 19 nt, Haemophilus influenzae Rd
uuaauaacauagaaaucac

SEQ ID NO: 678849 - RNA, 15 nt, Haemophilus influenzae Rd
uuaauaaggcaaaac

SEQ ID NO: 678850 - RNA, 15 nt, Haemophilus influenzae Rd
uuaauaaucacaauu

SEQ ID NO: 678851 - RNA, 18 nt, Haemophilus influenzae Rd
uuaauggcgugccauuac

SEQ ID NO: 678852 - RNA, 16 nt, Haemophilus influenzae Rd
uuaauguaguaaaucc

SEQ ID NO: 678853 - RNA, 17 nt, Haemophilus influenzae Rd
uuaauggaugaauacaa

SEQ ID NO: 678854 - RNA, 12 nt, Haemophilus influenzae Rd
uuaauuaaauac

SEQ ID NO: 678855 - RNA, 14 nt, Haemophilus influenzae Rd
uuaauuaaauacaa

SEQ ID NO: 678856 - RNA, 16 nt, Haemophilus influenzae Rd
uuaauuaacgcucaaa

SEQ ID NO: 678857 - RNA, 16 nt, Haemophilus influenzae Rd
uuaauuaccugccaaa

SEQ ID NO: 678858 - RNA, 16 nt, Haemophilus influenzae Rd
uuaauuagaauaacaa

SEQ ID NO: 678859 - RNA, 19 nt, Haemophilus influenzae Rd
uuaaaagugcggugcaauu

SEQ ID NO: 678860 - RNA, 14 nt, Haemophilus influenzae Rd
uguuuuauuuauag

SEQ ID NO: 678861 - RNA, 16 nt, Haemophilus influenzae Rd
uguuucacuaaaaaua

SEQ ID NO: 678862 - RNA, 16 nt, Haemophilus influenzae Rd
uguuucaacaaaaaua

SEQ ID NO: 678863 - RNA, 20 nt, Haemophilus influenzae Rd
uguuuuaaaacuauuuuuaa

SEQ ID NO: 678864 - RNA, 12 nt, Haemophilus influenzae Rd
uguguggaaaaa

SEQ ID NO: 678865 - RNA, 15 nt, Haemophilus influenzae Rd
uguuaagcaccauca

SEQ ID NO: 678866 - RNA, 14 nt, Haemophilus influenzae Rd
uguuaaaugaaaag

SEQ ID NO: 678867 - RNA, 21 nt, Haemophilus influenzae Rd
uguuaaaugcaguauaaaccg

SEQ ID NO: 678868 - RNA, 20 nt, Haemophilus influenzae Rd
ugucgcuacaucaacacaac

SEQ ID NO: 678869 - RNA, 15 nt, Haemophilus influenzae Rd
uguuguuuuggcugg

SEQ ID NO: 678870 - RNA, 21 nt, Haemophilus influenzae Rd
uguuguggcaucucaaggcga

SEQ ID NO: 678871 - RNA, 17 nt, Haemophilus influenzae Rd
uguuguggaucguaaau

SEQ ID NO: 678872 - RNA, 20 nt, Haemophilus influenzae Rd
uguuuaccaccgauaaacac

SEQ ID NO: 678873 - RNA, 18 nt, Haemophilus influenzae Rd
uguugcuugaauggcuau

SEQ ID NO: 678874 - RNA, 17 nt, Haemophilus influenzae Rd
uuaugaggaauuuguug

SEQ ID NO: 678875 - RNA, 16 nt, Haemophilus influenzae Rd
uuaucucgaauaucga

SEQ ID NO: 678876 - RNA, 19 nt, Haemophilus influenzae Rd
uuaucucuuucuuaaaaua

SEQ ID NO: 678877 - RNA, 18 nt, Haemophilus influenzae Rd
uuauauuuuuaauuuaua

SEQ ID NO: 678878 - RNA, 15 nt, Haemophilus influenzae Rd
uuaucaaaagaaaag

SEQ ID NO: 678879 - RNA, 20 nt, Haemophilus influenzae Rd
uuauauucagcaaaaucacu

SEQ ID NO: 678880 - RNA, 20 nt, Haemophilus influenzae Rd
uuauguauuaccauuuaucu

SEQ ID NO: 678881 - RNA, 20 nt, Haemophilus influenzae Rd
uuauguaaauuuaucugauc

SEQ ID NO: 678882 - RNA, 20 nt, Haemophilus influenzae Rd
uuauuaagugaccauuggug

SEQ ID NO: 678883 - RNA, 18 nt, Haemophilus influenzae Rd
uuauguucuggauuguug

SEQ ID NO: 678884 - RNA, 22 nt, Haemophilus influenzae Rd
uuauguuucucucuauucaucu

SEQ ID NO: 678885 - RNA, 20 nt, Haemophilus influenzae Rd
uuauucgcaccacgauauuu

SEQ ID NO: 678886 - RNA, 14 nt, Haemophilus influenzae Rd
uuauauauaaaaua

SEQ ID NO: 678887 - RNA, 18 nt, Haemophilus influenzae Rd
uuauaggauuaacguaag

SEQ ID NO: 678888 - RNA, 19 nt, Haemophilus influenzae Rd
uuauagugauuauuuacaa

SEQ ID NO: 678889 - RNA, 21 nt, Haemophilus influenzae Rd
uuauagauaaauaucaaaauu

SEQ ID NO: 678890 - RNA, 18 nt, Haemophilus influenzae Rd
uuacuguuuuuauauuua

SEQ ID NO: 678891 - RNA, 13 nt, Haemophilus influenzae Rd
uuauaagcuauuu

SEQ ID NO: 678892 - RNA, 21 nt, Haemophilus influenzae Rd
uuauaauuaaauucauuuaaa

SEQ ID NO: 678893 - RNA, 22 nt, Haemophilus influenzae Rd
uuacuugguaauuuggcguaaa

SEQ ID NO: 678894 - RNA, 14 nt, Haemophilus influenzae Rd
uuacuuuucuucac

SEQ ID NO: 678895 - RNA, 22 nt, Haemophilus influenzae Rd
uuacuuuuuaauaaaucaagca

SEQ ID NO: 678896 - RNA, 16 nt, Haemophilus influenzae Rd
uuaccugugaaaacac

SEQ ID NO: 678897 - RNA, 17 nt, Haemophilus influenzae Rd
uuacgaagaauccacau

SEQ ID NO: 678898 - RNA, 18 nt, Haemophilus influenzae Rd
uucaaagauuuuaaaauu

SEQ ID NO: 678899 - RNA, 16 nt, Haemophilus influenzae Rd
uucaaaaauuuuugca

SEQ ID NO: 678900 - RNA, 23 nt, Haemophilus influenzae Rd
uucaaaacguucuacuuguucaa

SEQ ID NO: 678901 - RNA, 22 nt, Haemophilus influenzae Rd
uuauuucucauuuaaccguaau

SEQ ID NO: 678902 - RNA, 16 nt, Haemophilus influenzae Rd
uuauuuuuaacguaaa

SEQ ID NO: 678903 - RNA, 13 nt, Haemophilus influenzae Rd
uuauuuuuuaucc

SEQ ID NO: 678904 - RNA, 15 nt, Haemophilus influenzae Rd
uuauugccaauuauc

SEQ ID NO: 678905 - RNA, 19 nt, Haemophilus influenzae Rd
uuauugccuuucaucauug

SEQ ID NO: 678906 - RNA, 16 nt, Haemophilus influenzae Rd
uuauuuaauaauauca

SEQ ID NO: 678907 - RNA, 15 nt, Haemophilus influenzae Rd
uuauuuaauacgaac

SEQ ID NO: 678908 - RNA, 23 nt, Haemophilus influenzae Rd
uuauuuaggggccuuuuuuaucu

SEQ ID NO: 678909 - RNA, 16 nt, Haemophilus influenzae Rd
uucaaaugaaauguuu

SEQ ID NO: 678910 - RNA, 15 nt, Haemophilus influenzae Rd
uucaaauugcaaaaa

SEQ ID NO: 678911 - RNA, 15 nt, Haemophilus influenzae Rd
uucaaauuucuucac

SEQ ID NO: 678912 - RNA, 16 nt, Haemophilus influenzae Rd
uucaaccauuuucucu

SEQ ID NO: 678913 - RNA, 19 nt, Haemophilus influenzae Rd
uucaagaucuuucacgaua

SEQ ID NO: 678914 - RNA, 16 nt, Haemophilus influenzae Rd
uucaagcaaauauuua

SEQ ID NO: 678915 - RNA, 21 nt, Haemophilus influenzae Rd
uucaacuacgccguuuuucac

SEQ ID NO: 678916 - RNA, 18 nt, Haemophilus influenzae Rd
uucacauucuuuuaaaua

SEQ ID NO: 678917 - RNA, 14 nt, Haemophilus influenzae Rd
uucaccaaauaaug

SEQ ID NO: 678918 - RNA, 14 nt, Haemophilus influenzae Rd
uucaauauugucua

SEQ ID NO: 678919 - RNA, 18 nt, Haemophilus influenzae Rd
uucaagucguuauuuucu

SEQ ID NO: 678920 - RNA, 15 nt, Haemophilus influenzae Rd
uucaagucuuuuuuu

SEQ ID NO: 678921 - RNA, 20 nt, Haemophilus influenzae Rd
uucaauucuucuaauucagu

SEQ ID NO: 678922 - RNA, 12 nt, Haemophilus influenzae Rd
uucaauuuuccc

SEQ ID NO: 678923 - RNA, 23 nt, Haemophilus influenzae Rd
uuccugcaaacauaccacuucag

SEQ ID NO: 678924 - RNA, 21 nt, Haemophilus influenzae Rd
uuccguuaaaaguuuuuuacg

SEQ ID NO: 678925 - RNA, 18 nt, Haemophilus influenzae Rd
uuccguucuaaagauuua

SEQ ID NO: 678926 - RNA, 14 nt, Haemophilus influenzae Rd
uuccguagccguuu

SEQ ID NO: 678927 - RNA, 15 nt, Haemophilus influenzae Rd
uuccguuguuuuugg

SEQ ID NO: 678928 - RNA, 21 nt, Haemophilus influenzae Rd
uuccuacuauaggaauaucau

SEQ ID NO: 678929 - RNA, 18 nt, Haemophilus influenzae Rd
uucaggugggaaauaauu

SEQ ID NO: 678930 - RNA, 12 nt, Haemophilus influenzae Rd
uucaguaauaag

SEQ ID NO: 678931 - RNA, 21 nt, Haemophilus influenzae Rd
uucaguugauagacaauauaa

SEQ ID NO: 678932 - RNA, 18 nt, Haemophilus influenzae Rd
uucaguuacguaauauuu

SEQ ID NO: 678933 - RNA, 20 nt, Haemophilus influenzae Rd
uucaguaucuggcucaaugu

SEQ ID NO: 678934 - RNA, 19 nt, Haemophilus influenzae Rd
uucaguccgccuuuuugcu

SEQ ID NO: 678935 - RNA, 17 nt, Haemophilus influenzae Rd
uucauaucucacaauaa

SEQ ID NO: 678936 - RNA, 21 nt, Haemophilus influenzae Rd
uucauauaauucauuagccaa

SEQ ID NO: 678937 - RNA, 22 nt, Haemophilus influenzae Rd
uucauagaaggcuaguucuucc

SEQ ID NO: 678938 - RNA, 18 nt, Haemophilus influenzae Rd
uucauaauccguuaaauu

SEQ ID NO: 678939 - RNA, 17 nt, Haemophilus influenzae Rd
uuccccuuguucuucau

SEQ ID NO: 678940 - RNA, 18 nt, Haemophilus influenzae Rd
uucccccauuaaaagaag

SEQ ID NO: 678941 - RNA, 12 nt, Haemophilus influenzae Rd
uucgagcgugaa

SEQ ID NO: 678942 - RNA, 13 nt, Haemophilus influenzae Rd
uuccuuacaacaa

SEQ ID NO: 678943 - RNA, 18 nt, Haemophilus influenzae Rd
uucgauggauuuauugcg

SEQ ID NO: 678944 - RNA, 20 nt, Haemophilus influenzae Rd
uucgccaacguaagcaccaa

SEQ ID NO: 678945 - RNA, 14 nt, Haemophilus influenzae Rd
uucgcuccaaucau

SEQ ID NO: 678946 - RNA, 18 nt, Haemophilus influenzae Rd
uucgcguuuauuuaacaa

SEQ ID NO: 678947 - RNA, 20 nt, Haemophilus influenzae Rd
uugaacaaauucagcuaauu

SEQ ID NO: 678948 - RNA, 18 nt, Haemophilus influenzae Rd
uugaaaauuuaauuguuu

SEQ ID NO: 678949 - RNA, 22 nt, Haemophilus influenzae Rd
uugaaaccugaguaaauaaacg

SEQ ID NO: 678950 - RNA, 16 nt, Haemophilus influenzae Rd
uucuuuuuaaauauuu

SEQ ID NO: 678951 - RNA, 14 nt, Haemophilus influenzae Rd
uucuuuccaaccag

SEQ ID NO: 678952 - RNA, 19 nt, Haemophilus influenzae Rd
uucugauuacuuaaaguua

SEQ ID NO: 678953 - RNA, 20 nt, Haemophilus influenzae Rd
uucugcagcaaacgaaccau

SEQ ID NO: 678954 - RNA, 18 nt, Haemophilus influenzae Rd
uucuuguuuaaauucagg

SEQ ID NO: 678955 - RNA, 16 nt, Haemophilus influenzae Rd
uucuuuaaauauucaa

SEQ ID NO: 678956 - RNA, 13 nt, Haemophilus influenzae Rd
uucuugaauacaa

SEQ ID NO: 678957 - RNA, 21 nt, Haemophilus influenzae Rd
uucuugaaugucuuaaagaua

SEQ ID NO: 678958 - RNA, 19 nt, Haemophilus influenzae Rd
uucuugaccuucaauugug

SEQ ID NO: 678959 - RNA, 20 nt, Haemophilus influenzae Rd
uucuugaccuuucaauaauu

SEQ ID NO: 678960 - RNA, 13 nt, Haemophilus influenzae Rd
uucuugacguaau

SEQ ID NO: 678961 - RNA, 17 nt, Haemophilus influenzae Rd
uucuugccaaaauucau

SEQ ID NO: 678962 - RNA, 18 nt, Haemophilus influenzae Rd
uucuugcucauuugucgu

SEQ ID NO: 678963 - RNA, 23 nt, Haemophilus influenzae Rd
uucguaguaagcugauucuucau

SEQ ID NO: 678964 - RNA, 22 nt, Haemophilus influenzae Rd
uucuagcuuaccuuaauuaauc

SEQ ID NO: 678965 - RNA, 22 nt, Haemophilus influenzae Rd
uucucaagaauauauuuuauca

SEQ ID NO: 678966 - RNA, 23 nt, Haemophilus influenzae Rd
uucuauugauauuaauuuuaucu

SEQ ID NO: 678967 - RNA, 13 nt, Haemophilus influenzae Rd
uucuauccauuuc

SEQ ID NO: 678968 - RNA, 13 nt, Haemophilus influenzae Rd
uucuauaauuaaa

SEQ ID NO: 678969 - RNA, 15 nt, Haemophilus influenzae Rd
uucuauagauuuauu

SEQ ID NO: 678970 - RNA, 17 nt, Haemophilus influenzae Rd
uucuaguucuuccccuc

SEQ ID NO: 678971 - RNA, 19 nt, Haemophilus influenzae Rd
uucucggcaaugguucauu

SEQ ID NO: 678972 - RNA, 17 nt, Haemophilus influenzae Rd
uucugaacuaaaauaac

SEQ ID NO: 678973 - RNA, 21 nt, Haemophilus influenzae Rd
uugagcauuuuuuauuaaaaa

SEQ ID NO: 678974 - RNA, 19 nt, Haemophilus influenzae Rd
uugagaauuuuuucuucaa

SEQ ID NO: 678975 - RNA, 15 nt, Haemophilus influenzae Rd
uugacuuaaaugaag

SEQ ID NO: 678976 - RNA, 19 nt, Haemophilus influenzae Rd
uugauacauuucuaaaaua

SEQ ID NO: 678977 - RNA, 22 nt, Haemophilus influenzae Rd
uugauaagcuugcguaauguuu

SEQ ID NO: 678978 - RNA, 19 nt, Haemophilus influenzae Rd
uugauauauucuucuucaa

SEQ ID NO: 678979 - RNA, 17 nt, Haemophilus influenzae Rd
uugagguaaaagugcgg

SEQ ID NO: 678980 - RNA, 13 nt, Haemophilus influenzae Rd
uugaguauuuacu

SEQ ID NO: 678981 - RNA, 19 nt, Haemophilus influenzae Rd
uugagucucaaauuuuuca

SEQ ID NO: 678982 - RNA, 22 nt, Haemophilus influenzae Rd
uugacauaauuucacaauuuuu

SEQ ID NO: 678983 - RNA, 15 nt, Haemophilus influenzae Rd
uugacaauuaauaua

SEQ ID NO: 678984 - RNA, 13 nt, Haemophilus influenzae Rd
uugaacaauguuu

SEQ ID NO: 678985 - RNA, 22 nt, Haemophilus influenzae Rd
uugaacgccuagauauuguucu

SEQ ID NO: 678986 - RNA, 13 nt, Haemophilus influenzae Rd
uugaaauugcgug

SEQ ID NO: 678987 - RNA, 19 nt, Haemophilus influenzae Rd
uugaauuuuacuucuucag

SEQ ID NO: 678988 - RNA, 18 nt, Haemophilus influenzae Rd
uugaauuuucaaugguuu

SEQ ID NO: 678989 - RNA, 19 nt, Haemophilus influenzae Rd
uugaauugcauuuucuucc

SEQ ID NO: 678990 - RNA, 21 nt, Haemophilus influenzae Rd
uugaauaugauguggcuuuug

SEQ ID NO: 678991 - RNA, 11 nt, Haemophilus influenzae Rd
uugaaugguug

SEQ ID NO: 678992 - RNA, 22 nt, Haemophilus influenzae Rd
uugcugacaauuucuaaaaauc

SEQ ID NO: 678993 - RNA, 21 nt, Haemophilus influenzae Rd
uugcucuaaaugugauuucca

SEQ ID NO: 678994 - RNA, 16 nt, Haemophilus influenzae Rd
uugcucuuuaacaaua

SEQ ID NO: 678995 - RNA, 16 nt, Haemophilus influenzae Rd
uugcuauccaaccuaa

SEQ ID NO: 678996 - RNA, 22 nt, Haemophilus influenzae Rd
uugcuaugcccaagcaauucuu

SEQ ID NO: 678997 - RNA, 14 nt, Haemophilus influenzae Rd
uugcguaauguuua

SEQ ID NO: 678998 - RNA, 13 nt, Haemophilus influenzae Rd
uugcguucuccgc

SEQ ID NO: 678999 - RNA, 18 nt, Haemophilus influenzae Rd
uugaucugcaaauggugu

SEQ ID NO: 679000 - RNA, 12 nt, Haemophilus influenzae Rd
uugaucugcacu

SEQ ID NO: 679001 - RNA, 16 nt, Haemophilus influenzae Rd
uugaucguuaauauca

SEQ ID NO: 679002 - RNA, 22 nt, Haemophilus influenzae Rd
uugcggaaacauaucaaaaagu

SEQ ID NO: 679003 - RNA, 20 nt, Haemophilus influenzae Rd
uugcgcugcuuuauuuggca

SEQ ID NO: 679004 - RNA, 17 nt, Haemophilus influenzae Rd
uugcgcuuucaauuuuc

SEQ ID NO: 679005 - RNA, 22 nt, Haemophilus influenzae Rd
uuggaaauaauauucaaaacau

SEQ ID NO: 679006 - RNA, 16 nt, Haemophilus influenzae Rd
uuggaacaguaaauuu

SEQ ID NO: 679007 - RNA, 21 nt, Haemophilus influenzae Rd
uuggaaaagccuuaaccugca

SEQ ID NO: 679008 - RNA, 14 nt, Haemophilus influenzae Rd
uuggauaucuuguu

SEQ ID NO: 679009 - RNA, 17 nt, Haemophilus influenzae Rd
uuggauaucuuguugau

SEQ ID NO: 679010 - RNA, 23 nt, Haemophilus influenzae Rd
uuggccgcacuuuugaucugcac

SEQ ID NO: 679011 - RNA, 15 nt, Haemophilus influenzae Rd
uuggauuuuaaccag

SEQ ID NO: 679012 - RNA, 12 nt, Haemophilus influenzae Rd
uuguaauuucau

SEQ ID NO: 679013 - RNA, 19 nt, Haemophilus influenzae Rd
uuuaguaauuuuaauucuu

SEQ ID NO: 679014 - RNA, 19 nt, Haemophilus influenzae Rd
uuuaggaaguaaauaguua

SEQ ID NO: 679015 - RNA, 17 nt, Haemophilus influenzae Rd
uuuagccaguaauuuua

SEQ ID NO: 679016 - RNA, 13 nt, Haemophilus influenzae Rd
uuuagccauuuuc

SEQ ID NO: 679017 - RNA, 16 nt, Haemophilus influenzae Rd
uuuagaacaauauuua

SEQ ID NO: 679018 - RNA, 13 nt, Haemophilus influenzae Rd
uuuagaauuuuua

SEQ ID NO: 679019 - RNA, 14 nt, Haemophilus influenzae Rd
uuuacuucaucaaa

SEQ ID NO: 679020 - RNA, 21 nt, Haemophilus influenzae Rd
uuuacguaucgcuaagaauaa

SEQ ID NO: 679021 - RNA, 14 nt, Haemophilus influenzae Rd
uuuacuacguaaag

SEQ ID NO: 679022 - RNA, 15 nt, Haemophilus influenzae Rd
uuuacggauuuauau

SEQ ID NO: 679023 - RNA, 16 nt, Haemophilus influenzae Rd
uuuacgaacuaauaag

SEQ ID NO: 679024 - RNA, 15 nt, Haemophilus influenzae Rd
uuuaauaauagaacg

SEQ ID NO: 679025 - RNA, 19 nt, Haemophilus influenzae Rd
uuuaauaaucaaaucuuug

SEQ ID NO: 679026 - RNA, 18 nt, Haemophilus influenzae Rd
uuuaauaauuuaaauuua

SEQ ID NO: 679027 - RNA, 11 nt, Haemophilus influenzae Rd
uuuaauauuuc

SEQ ID NO: 679028 - RNA, 21 nt, Haemophilus influenzae Rd
uuuaaucaaauaaaauauuuu

SEQ ID NO: 679029 - RNA, 17 nt, Haemophilus influenzae Rd
uuuaaugauaaauuuua

SEQ ID NO: 679030 - RNA, 21 nt, Haemophilus influenzae Rd
uuuaaugccccuaauuauuua

SEQ ID NO: 679031 - RNA, 22 nt, Haemophilus influenzae Rd
uuuaauggauuccaucauugug

SEQ ID NO: 679032 - RNA, 16 nt, Haemophilus influenzae Rd
uuuaauaaaauguuua

SEQ ID NO: 679033 - RNA, 16 nt, Haemophilus influenzae Rd
uuuaauaagaauuuua

SEQ ID NO: 679034 - RNA, 19 nt, Haemophilus influenzae Rd
uuuaauaagauaauaaaug

SEQ ID NO: 679035 - RNA, 16 nt, Haemophilus influenzae Rd
uuuaagcugaaauuua

SEQ ID NO: 679036 - RNA, 20 nt, Haemophilus influenzae Rd
uuguuccaggaaaauuuuau

SEQ ID NO: 679037 - RNA, 17 nt, Haemophilus influenzae Rd
uuguugaaauuccucac

SEQ ID NO: 679038 - RNA, 20 nt, Haemophilus influenzae Rd
uuguuucgcacaauucucau

SEQ ID NO: 679039 - RNA, 15 nt, Haemophilus influenzae Rd
uuguuugauccuuua

SEQ ID NO: 679040 - RNA, 14 nt, Haemophilus influenzae Rd
uuguuuaauauuuu

SEQ ID NO: 679041 - RNA, 21 nt, Haemophilus influenzae Rd
uuuaacgcgcuacaauauuua

SEQ ID NO: 679042 - RNA, 20 nt, Haemophilus influenzae Rd
uuguuuguaauaaauuuuau

SEQ ID NO: 679043 - RNA, 16 nt, Haemophilus influenzae Rd
uuuaaccguuauaacg

SEQ ID NO: 679044 - RNA, 16 nt, Haemophilus influenzae Rd
aauccuagaguaagua

SEQ ID NO: 679045 - RNA, 14 nt, Haemophilus influenzae Rd
uuucacuuugcccg

SEQ ID NO: 679046 - RNA, 16 nt, Haemophilus influenzae Rd
uuucacauaauaaaca

SEQ ID NO: 679047 - RNA, 16 nt, Haemophilus influenzae Rd
uuucacuaaauaaaug

SEQ ID NO: 679048 - RNA, 16 nt, Haemophilus influenzae Rd
uuucaauuuuaaaauu

SEQ ID NO: 679049 - RNA, 15 nt, Haemophilus influenzae Rd
uuucacaaaauauua

SEQ ID NO: 679050 - RNA, 13 nt, Haemophilus influenzae Rd
uuucaccgcacuu

SEQ ID NO: 679051 - RNA, 19 nt, Haemophilus influenzae Rd
uuucaaccgcacuuaauaa

SEQ ID NO: 679052 - RNA, 14 nt, Haemophilus influenzae Rd
uuucaaauuaaccg

SEQ ID NO: 679053 - RNA, 12 nt, Haemophilus influenzae Rd
uuucaacacaac

SEQ ID NO: 679054 - RNA, 20 nt, Haemophilus influenzae Rd
uuucaaagcguuuuaaaauc

SEQ ID NO: 679055 - RNA, 13 nt, Haemophilus influenzae Rd
uuucaaauaaaca

SEQ ID NO: 679056 - RNA, 15 nt, Haemophilus influenzae Rd
uuuauuuucuuaauu

SEQ ID NO: 679057 - RNA, 18 nt, Haemophilus influenzae Rd
uuucaaacaacaagucau

SEQ ID NO: 679058 - RNA, 15 nt, Haemophilus influenzae Rd
uuuauugaaauuuua

SEQ ID NO: 679059 - RNA, 18 nt, Haemophilus influenzae Rd
uuuauuuguuaauaaacg

SEQ ID NO: 679060 - RNA, 18 nt, Haemophilus influenzae Rd
uuuauuuuguauauugug

SEQ ID NO: 679061 - RNA, 18 nt, Haemophilus influenzae Rd
uuuauuuuuucuaaaaua

SEQ ID NO: 679062 - RNA, 12 nt, Haemophilus influenzae Rd
uuuauuuaacaa

SEQ ID NO: 679063 - RNA, 16 nt, Haemophilus influenzae Rd
uuuauuuauuaagaua

SEQ ID NO: 679064 - RNA, 20 nt, Haemophilus influenzae Rd
uuuauuugaagcaagaaacg

SEQ ID NO: 679065 - RNA, 13 nt, Haemophilus influenzae Rd
uuuauucaaaaua

SEQ ID NO: 679066 - RNA, 14 nt, Haemophilus influenzae Rd
uuuauuaauaaacu

SEQ ID NO: 679067 - RNA, 18 nt, Haemophilus influenzae Rd
uuuauuaauuauaaaaua

SEQ ID NO: 679068 - RNA, 15 nt, Haemophilus influenzae Rd
uuuauuauaaaaaua

SEQ ID NO: 679069 - RNA, 19 nt, Haemophilus influenzae Rd
uuuauuauaaaaauauuuu

SEQ ID NO: 679070 - RNA, 17 nt, Haemophilus influenzae Rd
uuuauagcauuuaaaua

SEQ ID NO: 679071 - RNA, 20 nt, Haemophilus influenzae Rd
uuuauagcauuuaaauauua

SEQ ID NO: 679072 - RNA, 16 nt, Haemophilus influenzae Rd
uuuauagccuauaauu

SEQ ID NO: 679073 - RNA, 14 nt, Haemophilus influenzae Rd
uuuaguuucuaauu

SEQ ID NO: 679074 - RNA, 17 nt, Haemophilus influenzae Rd
uuuauaaaccaauuuua

SEQ ID NO: 679075 - RNA, 20 nt, Haemophilus influenzae Rd
uuuauaccagaagucagcaa

SEQ ID NO: 679076 - RNA, 22 nt, Haemophilus influenzae Rd
uuuaucaacuaaaaaauaguua

SEQ ID NO: 679077 - RNA, 18 nt, Haemophilus influenzae Rd
uuuaucauaacuauaauu

SEQ ID NO: 679078 - RNA, 20 nt, Haemophilus influenzae Rd
uuuaucauuuaacuugcaau

SEQ ID NO: 679079 - RNA, 19 nt, Haemophilus influenzae Rd
uuuaucuaaucauuaacaa

SEQ ID NO: 679080 - RNA, 17 nt, Haemophilus influenzae Rd
uuuaucucuuucuuaaa

SEQ ID NO: 679081 - RNA, 15 nt, Haemophilus influenzae Rd
uuuaugauuaaaaug

SEQ ID NO: 679082 - RNA, 15 nt, Haemophilus influenzae Rd
uuuaucuucuacaaa

SEQ ID NO: 679083 - RNA, 14 nt, Haemophilus influenzae Rd
uuucauuaauuuua

SEQ ID NO: 679084 - RNA, 14 nt, Haemophilus influenzae Rd
uuucauuauauuua

SEQ ID NO: 679085 - RNA, 13 nt, Haemophilus influenzae Rd
uuucagaauaaag

SEQ ID NO: 679086 - RNA, 20 nt, Haemophilus influenzae Rd
uuucagauacuuucuaauua

SEQ ID NO: 679087 - RNA, 16 nt, Haemophilus influenzae Rd
uuucaguaucaauacc

SEQ ID NO: 679088 - RNA, 20 nt, Haemophilus influenzae Rd
uuucaguuacguaauauuua

SEQ ID NO: 679089 - RNA, 17 nt, Haemophilus influenzae Rd
uuucaguuuugcuuuuu

SEQ ID NO: 679090 - RNA, 18 nt, Haemophilus influenzae Rd
uuucauaaaaauugaucu

SEQ ID NO: 679091 - RNA, 14 nt, Haemophilus influenzae Rd
uuucgccagcacca

SEQ ID NO: 679092 - RNA, 17 nt, Haemophilus influenzae Rd
uuucgcaggaucacaau

SEQ ID NO: 679093 - RNA, 22 nt, Haemophilus influenzae Rd
uuucgcaucaaagaauccaccc

SEQ ID NO: 679094 - RNA, 18 nt, Haemophilus influenzae Rd
uuuccuauuuacguaaaa

SEQ ID NO: 679095 - RNA, 14 nt, Haemophilus influenzae Rd
uuuucucaccacca

SEQ ID NO: 679096 - RNA, 23 nt, Haemophilus influenzae Rd
uuuucuaaugguuguaaauuuuc

SEQ ID NO: 679097 - RNA, 22 nt, Haemophilus influenzae Rd
uuuucuaccccucuuuucucaa

SEQ ID NO: 679098 - RNA, 18 nt, Haemophilus influenzae Rd
uuuucuuagauaaaaacc

SEQ ID NO: 679099 - RNA, 17 nt, Haemophilus influenzae Rd
uuuucuucagcaucaac

SEQ ID NO: 679100 - RNA, 12 nt, Haemophilus influenzae Rd
uuuucaauaacg

SEQ ID NO: 679101 - RNA, 12 nt, Haemophilus influenzae Rd
uuuucaauauca

SEQ ID NO: 679102 - RNA, 13 nt, Haemophilus influenzae Rd
uuuucaauaucga

SEQ ID NO: 679103 - RNA, 21 nt, Haemophilus influenzae Rd
uuuucaaucauuucuaagccu

SEQ ID NO: 679104 - RNA, 16 nt, Haemophilus influenzae Rd
uuuucuaacaucucuu

SEQ ID NO: 679105 - RNA, 23 nt, Haemophilus influenzae Rd
uuuucgcaauaucaucaucagac

SEQ ID NO: 679106 - RNA, 14 nt, Haemophilus influenzae Rd
uuuuccuguuaauu

SEQ ID NO: 679107 - RNA, 23 nt, Haemophilus influenzae Rd
uuuucccaaugcaccaaaaaucc

SEQ ID NO: 679108 - RNA, 13 nt, Haemophilus influenzae Rd
uuuuccacauuuu

SEQ ID NO: 679109 - RNA, 14 nt, Haemophilus influenzae Rd
uuuuccacauuuug

SEQ ID NO: 679110 - RNA, 17 nt, Haemophilus influenzae Rd
uuucguucccaaggugg

SEQ ID NO: 679111 - RNA, 13 nt, Haemophilus influenzae Rd
uuucuaacacaac

SEQ ID NO: 679112 - RNA, 15 nt, Haemophilus influenzae Rd
uuucuaaggcuuguu

SEQ ID NO: 679113 - RNA, 17 nt, Haemophilus influenzae Rd
uuucuaauaacaaucuu

SEQ ID NO: 679114 - RNA, 13 nt, Haemophilus influenzae Rd
uuucuaaaaaacg

SEQ ID NO: 679115 - RNA, 15 nt, Haemophilus influenzae Rd
uuucuacacuuaaau

SEQ ID NO: 679116 - RNA, 19 nt, Haemophilus influenzae Rd
uuuguuccacuucauaaau

SEQ ID NO: 679117 - RNA, 13 nt, Haemophilus influenzae Rd
uuucuauuaaaaa

SEQ ID NO: 679118 - RNA, 15 nt, Haemophilus influenzae Rd
uuuguuacuaaaaua

SEQ ID NO: 679119 - RNA, 14 nt, Haemophilus influenzae Rd
uuuuaaccauucuu

SEQ ID NO: 679120 - RNA, 17 nt, Haemophilus influenzae Rd
uuuuaaggaaacguaaa

SEQ ID NO: 679121 - RNA, 18 nt, Haemophilus influenzae Rd
uuuuaaggaaacguaaaa

SEQ ID NO: 679122 - RNA, 13 nt, Haemophilus influenzae Rd
uuuuaaauuuucu

SEQ ID NO: 679123 - RNA, 18 nt, Haemophilus influenzae Rd
uuuuauaagcuauuuacu

SEQ ID NO: 679124 - RNA, 21 nt, Haemophilus influenzae Rd
uuuuaaaauacugcacaauca

SEQ ID NO: 679125 - RNA, 15 nt, Haemophilus influenzae Rd
uuuuaaagaauauug

SEQ ID NO: 679126 - RNA, 14 nt, Haemophilus influenzae Rd
uuuuaucaauaacu

SEQ ID NO: 679127 - RNA, 12 nt, Haemophilus influenzae Rd
uuuuauuuauca

SEQ ID NO: 679128 - RNA, 21 nt, Haemophilus influenzae Rd
aaugccacaaauaaacaaacu

SEQ ID NO: 679129 - RNA, 12 nt, Haemophilus influenzae Rd
aaugcaauuuca

SEQ ID NO: 679130 - RNA, 14 nt, Haemophilus influenzae Rd
aaugcaaacauuug

SEQ ID NO: 679131 - RNA, 18 nt, Haemophilus influenzae Rd
aaugcaguaacgcgauaa

SEQ ID NO: 679132 - RNA, 19 nt, Haemophilus influenzae Rd
aaugcaguauaaaccgcau

SEQ ID NO: 679133 - RNA, 21 nt, Haemophilus influenzae Rd
aaucuugcugaaguuguaaua

SEQ ID NO: 679134 - RNA, 14 nt, Haemophilus influenzae Rd
aaucuuuacgaauu

SEQ ID NO: 679135 - RNA, 14 nt, Haemophilus influenzae Rd
aaugcaaauacaag

SEQ ID NO: 679136 - RNA, 15 nt, Haemophilus influenzae Rd
aaucgccccaaaagc

SEQ ID NO: 679137 - RNA, 22 nt, Haemophilus influenzae Rd
uuuuucuaaauagcuaacaaua

SEQ ID NO: 679138 - RNA, 22 nt, Haemophilus influenzae Rd
uuuugucaccaaauacauuuuu

SEQ ID NO: 679139 - RNA, 16 nt, Haemophilus influenzae Rd
uuuuggaauauuaucu

SEQ ID NO: 679140 - RNA, 19 nt, Haemophilus influenzae Rd
aaucucuucuaaaaauuac

SEQ ID NO: 679141 - RNA, 19 nt, Haemophilus influenzae Rd
aaucucuggagaaaauugc

SEQ ID NO: 679142 - RNA, 13 nt, Haemophilus influenzae Rd
uuuuuguuuaauu

SEQ ID NO: 679143 - RNA, 12 nt, Haemophilus influenzae Rd
uuuuuuaaagua

SEQ ID NO: 679144 - RNA, 12 nt, Haemophilus influenzae Rd
uuuuuucauaau

SEQ ID NO: 679145 - RNA, 17 nt, Haemophilus influenzae Rd
aauuauuggcaauuucc

SEQ ID NO: 679146 - RNA, 18 nt, Haemophilus influenzae Rd
aauuagucggcgcauugc

SEQ ID NO: 679147 - RNA, 17 nt, Haemophilus influenzae Rd
aauuaucaacaucaacu

SEQ ID NO: 679148 - RNA, 22 nt, Haemophilus influenzae Rd
aauucaauagguuauaaguuuu

SEQ ID NO: 679149 - RNA, 23 nt, Haemophilus influenzae Rd
aauucaaagcgaugacguuguuc

SEQ ID NO: 679150 - RNA, 16 nt, Haemophilus influenzae Rd
aauucaacacgccuaa

SEQ ID NO: 679151 - RNA, 14 nt, Haemophilus influenzae Rd
aauuccuucaucgu

SEQ ID NO: 679152 - RNA, 15 nt, Haemophilus influenzae Rd
aauuccgcaauauuu

SEQ ID NO: 679153 - RNA, 17 nt, Haemophilus influenzae Rd
aauucagcggcuuucuu

SEQ ID NO: 679154 - RNA, 18 nt, Haemophilus influenzae Rd
aauucaucaagcucaaaa

SEQ ID NO: 679155 - RNA, 22 nt, Haemophilus influenzae Rd
aauuccauauuguuucaauuua

SEQ ID NO: 679156 - RNA, 23 nt, Haemophilus influenzae Rd
aauuccauugcauccacuucauc

SEQ ID NO: 679157 - RNA, 15 nt, Haemophilus influenzae Rd
aaugcguucagaauu

SEQ ID NO: 679158 - RNA, 14 nt, Haemophilus influenzae Rd
aauggaauauggcg

SEQ ID NO: 679159 - RNA, 15 nt, Haemophilus influenzae Rd
aaugcuugguuuuau

SEQ ID NO: 679160 - RNA, 13 nt, Haemophilus influenzae Rd
aaugcuuuaauuu

SEQ ID NO: 679161 - RNA, 12 nt, Haemophilus influenzae Rd
aauuacgccuaa

SEQ ID NO: 679162 - RNA, 23 nt, Haemophilus influenzae Rd
aauuacucacuauaacuuuucaa

SEQ ID NO: 679163 - RNA, 16 nt, Haemophilus influenzae Rd
aauuagauaauacaga

SEQ ID NO: 679164 - RNA, 14 nt, Haemophilus influenzae Rd
aauuagaugauuuu

SEQ ID NO: 679165 - RNA, 15 nt, Haemophilus influenzae Rd
aauuaaacuuucaau

SEQ ID NO: 679166 - RNA, 20 nt, Haemophilus influenzae Rd
aauuaaaagugcgguuaaaa

SEQ ID NO: 679167 - RNA, 13 nt, Haemophilus influenzae Rd
aauuaaauacaaa

SEQ ID NO: 679168 - RNA, 20 nt, Haemophilus influenzae Rd
aauuaaaucaaaaauuaaga

SEQ ID NO: 679169 - RNA, 17 nt, Haemophilus influenzae Rd
aauuaccgcacuuuaaa

SEQ ID NO: 679170 - RNA, 16 nt, Haemophilus influenzae Rd
aauucgugcaaauuuu

SEQ ID NO: 679171 - RNA, 17 nt, Haemophilus influenzae Rd
aauucgugcaaauuuuu

SEQ ID NO: 679172 - RNA, 18 nt, Haemophilus influenzae Rd
aauucguuaauaaaucca

SEQ ID NO: 679173 - RNA, 16 nt, Haemophilus influenzae Rd
aauucucaauugcaga

SEQ ID NO: 679174 - RNA, 20 nt, Haemophilus influenzae Rd
aauucucgguuguuucaucc

SEQ ID NO: 679175 - RNA, 14 nt, Haemophilus influenzae Rd
aauugaaauuuauc

SEQ ID NO: 679176 - RNA, 13 nt, Haemophilus influenzae Rd
aauucuuuuaaau

SEQ ID NO: 679177 - RNA, 15 nt, Haemophilus influenzae Rd
aauugauauaaaugg

SEQ ID NO: 679178 - RNA, 14 nt, Haemophilus influenzae Rd
aauugauuuuaaag

SEQ ID NO: 679179 - RNA, 13 nt, Haemophilus influenzae Rd
aauugaucuaaau

SEQ ID NO: 679180 - RNA, 14 nt, Haemophilus influenzae Rd
aauugaugcuaaau

SEQ ID NO: 679181 - RNA, 21 nt, Haemophilus influenzae Rd
aauugcucugacacuucucgc

SEQ ID NO: 679182 - RNA, 22 nt, Haemophilus influenzae Rd
aauugcuuuaauuucuuuuccu

SEQ ID NO: 679183 - RNA, 21 nt, Haemophilus influenzae Rd
aauuggcgcgccgauauggcg

SEQ ID NO: 679184 - RNA, 13 nt, Haemophilus influenzae Rd
aauuuaaauaaag

SEQ ID NO: 679185 - RNA, 19 nt, Haemophilus influenzae Rd
aauuuacccacaacucauu

SEQ ID NO: 679186 - RNA, 18 nt, Haemophilus influenzae Rd
aauuuaccgcacuuugau

SEQ ID NO: 679187 - RNA, 22 nt, Haemophilus influenzae Rd
aauuucgcucaauaauuuucac

SEQ ID NO: 679188 - RNA, 18 nt, Haemophilus influenzae Rd
aauuucaucuaagguuuu

SEQ ID NO: 679189 - RNA, 18 nt, Haemophilus influenzae Rd
aauuuauucaaaauaaaa

SEQ ID NO: 679190 - RNA, 23 nt, Haemophilus influenzae Rd
aauuucagacaaaacuuaucauu

SEQ ID NO: 679191 - RNA, 19 nt, Haemophilus influenzae Rd
aauuuauguuacaaauugc

SEQ ID NO: 679192 - RNA, 21 nt, Haemophilus influenzae Rd
aauuuagauaaaaauuucaga

SEQ ID NO: 679193 - RNA, 12 nt, Haemophilus influenzae Rd
uggcauacuuaa

SEQ ID NO: 679194 - RNA, 14 nt, Haemophilus influenzae Rd
uggcaucaauauua

SEQ ID NO: 679195 - RNA, 17 nt, Haemophilus influenzae Rd
ugggauuuucacuaauu

SEQ ID NO: 679196 - RNA, 19 nt, Haemophilus influenzae Rd
aauaugccuguggaaacua

SEQ ID NO: 679197 - RNA, 19 nt, Haemophilus influenzae Rd
uggcgucugcaauuagaaa

SEQ ID NO: 679198 - RNA, 18 nt, Haemophilus influenzae Rd
uggcguaaucguagaaau

SEQ ID NO: 679199 - RNA, 15 nt, Haemophilus influenzae Rd
uggcgguuuugccaa

SEQ ID NO: 679200 - RNA, 21 nt, Haemophilus influenzae Rd
ugguacauguugggcuaaaaa

SEQ ID NO: 679201 - RNA, 18 nt, Haemophilus influenzae Rd
ugguaauugcccaauaaa

SEQ ID NO: 679202 - RNA, 13 nt, Haemophilus influenzae Rd
ugguaaauuuuaa

SEQ ID NO: 679203 - RNA, 13 nt, Haemophilus influenzae Rd
ugguaaaauccgc

SEQ ID NO: 679204 - RNA, 22 nt, Haemophilus influenzae Rd
ugguuaauccuaguuuuuuccc

SEQ ID NO: 679205 - RNA, 13 nt, Haemophilus influenzae Rd
aaucaaaaucugc

SEQ ID NO: 679206 - RNA, 19 nt, Haemophilus influenzae Rd
aaucaaccauuuguuggcg

SEQ ID NO: 679207 - RNA, 16 nt, Haemophilus influenzae Rd
uguccacuuuuggaaa

SEQ ID NO: 679208 - RNA, 21 nt, Haemophilus influenzae Rd
ugucaucagaaauaucuucaa

SEQ ID NO: 679209 - RNA, 16 nt, Haemophilus influenzae Rd
aaucacacuugcacca

SEQ ID NO: 679210 - RNA, 14 nt, Haemophilus influenzae Rd
uguauaaauauuua

SEQ ID NO: 679211 - RNA, 18 nt, Haemophilus influenzae Rd
uguauaauuccuaaaaua

SEQ ID NO: 679212 - RNA, 15 nt, Haemophilus influenzae Rd
uguauuaaagguuau

SEQ ID NO: 679213 - RNA, 13 nt, Haemophilus influenzae Rd
uguaaacaaaaau

SEQ ID NO: 679214 - RNA, 15 nt, Haemophilus influenzae Rd
uguaaacgccaucaa

SEQ ID NO: 679215 - RNA, 23 nt, Haemophilus influenzae Rd
uguaaauggcguuuugcgugauu

SEQ ID NO: 679216 - RNA, 16 nt, Haemophilus influenzae Rd
uggaccaauugguaaa

SEQ ID NO: 679217 - RNA, 19 nt, Haemophilus influenzae Rd
ugcuguacacacaccaucc

SEQ ID NO: 679218 - RNA, 16 nt, Haemophilus influenzae Rd
ugcuguaacguuaaau

SEQ ID NO: 679219 - RNA, 19 nt, Haemophilus influenzae Rd
uggauaauucaucaaaauu

SEQ ID NO: 679220 - RNA, 19 nt, Haemophilus influenzae Rd
uggaggauuaauuacgccu

SEQ ID NO: 679221 - RNA, 20 nt, Haemophilus influenzae Rd
uggcacuaaagcaauauuua

SEQ ID NO: 679222 - RNA, 14 nt, Haemophilus influenzae Rd
ugcguaauucucca

SEQ ID NO: 679223 - RNA, 19 nt, Haemophilus influenzae Rd
ugcgugagcuugauuuuca

SEQ ID NO: 679224 - RNA, 13 nt, Haemophilus influenzae Rd
ugcguauccgcug

SEQ ID NO: 679225 - RNA, 17 nt, Haemophilus influenzae Rd
ugcguuugguucaucau

SEQ ID NO: 679226 - RNA, 16 nt, Haemophilus influenzae Rd
ugcuaauucugcuaaa

SEQ ID NO: 679227 - RNA, 20 nt, Haemophilus influenzae Rd
ugcuauccaguaaagaauca

SEQ ID NO: 679228 - RNA, 19 nt, Haemophilus influenzae Rd
ugcguguauauauuuuccu

SEQ ID NO: 679229 - RNA, 20 nt, Haemophilus influenzae Rd
ugcugccacuucagcuaaua

SEQ ID NO: 679230 - RNA, 17 nt, Haemophilus influenzae Rd
ugcucugcauaaaagcc

SEQ ID NO: 679231 - RNA, 16 nt, Haemophilus influenzae Rd
ugcgaccucgccauuu

SEQ ID NO: 679232 - RNA, 17 nt, Haemophilus influenzae Rd
ugccugcauuaauaauc

SEQ ID NO: 679233 - RNA, 21 nt, Haemophilus influenzae Rd
aauagguuauaaguuuuuugc

SEQ ID NO: 679234 - RNA, 22 nt, Haemophilus influenzae Rd
aauaguuggguaaucaaauuca

SEQ ID NO: 679235 - RNA, 17 nt, Haemophilus influenzae Rd
aauaguuaugguaacua

SEQ ID NO: 679236 - RNA, 22 nt, Haemophilus influenzae Rd
aauagauuuauacuuaauuucu

SEQ ID NO: 679237 - RNA, 16 nt, Haemophilus influenzae Rd
aauagcaaaaccgaua

SEQ ID NO: 679238 - RNA, 22 nt, Haemophilus influenzae Rd
guucacggcgggugucgugaaa

SEQ ID NO: 679239 - RNA, 14 nt, Haemophilus influenzae Rd
guuaugaaauugcu

SEQ ID NO: 679240 - RNA, 21 nt, Haemophilus influenzae Rd
guuaguacgcuuaacuaauuu

SEQ ID NO: 679241 - RNA, 22 nt, Haemophilus influenzae Rd
guuacuuggaugaaaucaaaca

SEQ ID NO: 679242 - RNA, 15 nt, Haemophilus influenzae Rd
guuagaacaacaaua

SEQ ID NO: 679243 - RNA, 18 nt, Haemophilus influenzae Rd
guucaucaacugcaacaa

SEQ ID NO: 679244 - RNA, 14 nt, Haemophilus influenzae Rd
guucauauuguuuc

SEQ ID NO: 679245 - RNA, 22 nt, Haemophilus influenzae Rd
gugguaaaaaucucuugcucac

SEQ ID NO: 679246 - RNA, 19 nt, Haemophilus influenzae Rd
guugaaauuuaauaagaau

SEQ ID NO: 679247 - RNA, 23 nt, Haemophilus influenzae Rd
guugcacccacuucgauauuuuc

SEQ ID NO: 679248 - RNA, 12 nt, Haemophilus influenzae Rd
guugauauucac

SEQ ID NO: 679249 - RNA, 12 nt, Haemophilus influenzae Rd
guugaucagcaa

SEQ ID NO: 679250 - RNA, 19 nt, Haemophilus influenzae Rd
guugaucuacaucaguacc

SEQ ID NO: 679251 - RNA, 23 nt, Haemophilus influenzae Rd
guugaucuacaucaguaccuuua

SEQ ID NO: 679252 - RNA, 16 nt, Haemophilus influenzae Rd
guugaucgcaauguuc

SEQ ID NO: 679253 - RNA, 13 nt, Haemophilus influenzae Rd
guuuuauaagcaa

SEQ ID NO: 679254 - RNA, 22 nt, Haemophilus influenzae Rd
guuuucacgcugacuuaaugca

SEQ ID NO: 679255 - RNA, 17 nt, Haemophilus influenzae Rd
guuuuccguauuuucac

SEQ ID NO: 679256 - RNA, 11 nt, Haemophilus influenzae Rd
guuuuuauuau

SEQ ID NO: 679257 - RNA, 22 nt, Haemophilus influenzae Rd
guuuuuccacuuaauauugcca

SEQ ID NO: 679258 - RNA, 18 nt, Haemophilus influenzae Rd
guuuuucacccaucuaaa

SEQ ID NO: 679259 - RNA, 14 nt, Haemophilus influenzae Rd
guuuuggcauuuuc

SEQ ID NO: 679260 - RNA, 14 nt, Haemophilus influenzae Rd
uaaaauaucuuguu

SEQ ID NO: 679261 - RNA, 14 nt, Haemophilus influenzae Rd
uaaaaucaaccgca

SEQ ID NO: 679262 - RNA, 22 nt, Haemophilus influenzae Rd
uaaaauaaagaaacguaaacaa

SEQ ID NO: 679263 - RNA, 18 nt, Haemophilus influenzae Rd
uaaaauaaccuuaaauca

SEQ ID NO: 679264 - RNA, 17 nt, Haemophilus influenzae Rd
uaaaacacguuugccag

SEQ ID NO: 679265 - RNA, 17 nt, Haemophilus influenzae Rd
uaaaaaaacuaaaaaca

SEQ ID NO: 679266 - RNA, 20 nt, Haemophilus influenzae Rd
uaaaaaagccuuauuguacu

SEQ ID NO: 679267 - RNA, 15 nt, Haemophilus influenzae Rd
uaaaaacugugcggu

SEQ ID NO: 679268 - RNA, 19 nt, Haemophilus influenzae Rd
uaaaaauuagguaacuaaa

SEQ ID NO: 679269 - RNA, 19 nt, Haemophilus influenzae Rd
uaaaaauuguaaaaccgca

SEQ ID NO: 679270 - RNA, 15 nt, Haemophilus influenzae Rd
uaaaaauauuaagca

SEQ ID NO: 679271 - RNA, 15 nt, Haemophilus influenzae Rd
uaaaaauauuuuaau

SEQ ID NO: 679272 - RNA, 14 nt, Haemophilus influenzae Rd
guuugcuaccuuca

SEQ ID NO: 679273 - RNA, 20 nt, Haemophilus influenzae Rd
guuuguaauccugcauuuuc

SEQ ID NO: 679274 - RNA, 14 nt, Haemophilus influenzae Rd
guuuguauaagcca

SEQ ID NO: 679275 - RNA, 22 nt, Haemophilus influenzae Rd
guuuggcuaauugugcauuguu

SEQ ID NO: 679276 - RNA, 17 nt, Haemophilus influenzae Rd
guuuuaaguucaacacc

SEQ ID NO: 679277 - RNA, 18 nt, Haemophilus influenzae Rd
guugguuuugcaauuuuu

SEQ ID NO: 679278 - RNA, 22 nt, Haemophilus influenzae Rd
guuuccuucgccauuuuuaacc

SEQ ID NO: 679279 - RNA, 16 nt, Haemophilus influenzae Rd
uaaccgcacuuuuaau

SEQ ID NO: 679280 - RNA, 18 nt, Haemophilus influenzae Rd
uaaccgcacuuuuuaaua

SEQ ID NO: 679281 - RNA, 13 nt, Haemophilus influenzae Rd
uaacuaagaugau

SEQ ID NO: 679282 - RNA, 23 nt, Haemophilus influenzae Rd
uaaaccaccgauuaauaaaauca

SEQ ID NO: 679283 - RNA, 19 nt, Haemophilus influenzae Rd
uaaaccucgccuuguaauu

SEQ ID NO: 679284 - RNA, 17 nt, Haemophilus influenzae Rd
uaaaccaacauacauua

SEQ ID NO: 679285 - RNA, 21 nt, Haemophilus influenzae Rd
uaaaccacguugugcagcuag

SEQ ID NO: 679286 - RNA, 23 nt, Haemophilus influenzae Rd
uaaacggcgugccauugcuaaau

SEQ ID NO: 679287 - RNA, 19 nt, Haemophilus influenzae Rd
uaaacgauuucgugcaaua

SEQ ID NO: 679288 - RNA, 18 nt, Haemophilus influenzae Rd
uaaccaucccagucaaaa

SEQ ID NO: 679289 - RNA, 19 nt, Haemophilus influenzae Rd
uaaccaagccaaacuauua

SEQ ID NO: 679290 - RNA, 19 nt, Haemophilus influenzae Rd
uaaccacuacguguagaag

SEQ ID NO: 679291 - RNA, 16 nt, Haemophilus influenzae Rd
uaacaucaacgguuuu

SEQ ID NO: 679292 - RNA, 16 nt, Haemophilus influenzae Rd
uaacauuaauaaacca

SEQ ID NO: 679293 - RNA, 17 nt, Haemophilus influenzae Rd
uaacagggcauaaauca

SEQ ID NO: 679294 - RNA, 13 nt, Haemophilus influenzae Rd
uaaguaugccaua

SEQ ID NO: 679295 - RNA, 14 nt, Haemophilus influenzae Rd
uaagucgauaaaga

SEQ ID NO: 679296 - RNA, 18 nt, Haemophilus influenzae Rd
uaaguauagcuuuuugca

SEQ ID NO: 679297 - RNA, 18 nt, Haemophilus influenzae Rd
uaaguucuaaauaaacua

SEQ ID NO: 679298 - RNA, 13 nt, Haemophilus influenzae Rd
uaagguacaacag

SEQ ID NO: 679299 - RNA, 16 nt, Haemophilus influenzae Rd
uaagguuauacugccu

SEQ ID NO: 679300 - RNA, 13 nt, Haemophilus influenzae Rd
uaaguaaugcuaa

SEQ ID NO: 679301 - RNA, 23 nt, Haemophilus influenzae Rd
uaauaguugagcuaaagugcggu

SEQ ID NO: 679302 - RNA, 22 nt, Haemophilus influenzae Rd
uaauaucauggcgaccauucuc

SEQ ID NO: 679303 - RNA, 15 nt, Haemophilus influenzae Rd
uaauauugcaccaua

SEQ ID NO: 679304 - RNA, 15 nt, Haemophilus influenzae Rd
uaauauuuuugccaa

SEQ ID NO: 679305 - RNA, 17 nt, Haemophilus influenzae Rd
uaauaugauuucuucaa

SEQ ID NO: 679306 - RNA, 15 nt, Haemophilus influenzae Rd
uaauauucaaaacau

SEQ ID NO: 679307 - RNA, 12 nt, Haemophilus influenzae Rd
uaagggcaaaaa

SEQ ID NO: 679308 - RNA, 16 nt, Haemophilus influenzae Rd
uaagggcaaaaaaucu

SEQ ID NO: 679309 - RNA, 23 nt, Haemophilus influenzae Rd
uaacucuaaagcggaugguaaua

SEQ ID NO: 679310 - RNA, 20 nt, Haemophilus influenzae Rd
uaaucacuugugcgauuaac

SEQ ID NO: 679311 - RNA, 13 nt, Haemophilus influenzae Rd
uaaucaaacuuuu

SEQ ID NO: 679312 - RNA, 17 nt, Haemophilus influenzae Rd
uaaucauaaaaaaaucu

SEQ ID NO: 679313 - RNA, 16 nt, Haemophilus influenzae Rd
uaauguucccuauaaa

SEQ ID NO: 679314 - RNA, 22 nt, Haemophilus influenzae Rd
uaaugguugcauuugcucaaua

SEQ ID NO: 679315 - RNA, 13 nt, Haemophilus influenzae Rd
uaauguaauaacg

SEQ ID NO: 679316 - RNA, 13 nt, Haemophilus influenzae Rd
uaauugugcuaaa

SEQ ID NO: 679317 - RNA, 19 nt, Haemophilus influenzae Rd
uaauuuaguuauaugccua

SEQ ID NO: 679318 - RNA, 15 nt, Haemophilus influenzae Rd
uaauuuagcgacagc

SEQ ID NO: 679319 - RNA, 20 nt, Haemophilus influenzae Rd
uaauuaaaaggacuaaaccu

SEQ ID NO: 679320 - RNA, 17 nt, Haemophilus influenzae Rd
uaauuaaaagugcgguu

SEQ ID NO: 679321 - RNA, 14 nt, Haemophilus influenzae Rd
uaauucugguaaua

SEQ ID NO: 679322 - RNA, 19 nt, Haemophilus influenzae Rd
uaauuaacgugcauuuuua

SEQ ID NO: 679323 - RNA, 17 nt, Haemophilus influenzae Rd
uaauucuuuugcuagua

SEQ ID NO: 679324 - RNA, 20 nt, Haemophilus influenzae Rd
uaauugauuuuaaagaaugu

SEQ ID NO: 679325 - RNA, 16 nt, Haemophilus influenzae Rd
uacaaucaaaaaaucu

SEQ ID NO: 679326 - RNA, 17 nt, Haemophilus influenzae Rd
uacaacgcucugcaccu

SEQ ID NO: 679327 - RNA, 16 nt, Haemophilus influenzae Rd
uacaaauugcuggauu

SEQ ID NO: 679328 - RNA, 21 nt, Haemophilus influenzae Rd
uacaccguccaagguuuuaau

SEQ ID NO: 679329 - RNA, 18 nt, Haemophilus influenzae Rd
uacaccucgauaaagaau

SEQ ID NO: 679330 - RNA, 14 nt, Haemophilus influenzae Rd
uacacggccguaau

SEQ ID NO: 679331 - RNA, 20 nt, Haemophilus influenzae Rd
uacaccgauuucuuuacaaa

SEQ ID NO: 679332 - RNA, 20 nt, Haemophilus influenzae Rd
uacaauuucaaauaaacaua

SEQ ID NO: 679333 - RNA, 18 nt, Haemophilus influenzae Rd
uacaauuuucuuuucaaa

SEQ ID NO: 679334 - RNA, 17 nt, Haemophilus influenzae Rd
uaccaccacagaaccag

SEQ ID NO: 679335 - RNA, 22 nt, Haemophilus influenzae Rd
uaccacguucuuguaagccaaa

SEQ ID NO: 679336 - RNA, 21 nt, Haemophilus influenzae Rd
uaccaauaauaauaucgcccg

SEQ ID NO: 679337 - RNA, 17 nt, Haemophilus influenzae Rd
uacauuuucauaaccaa

SEQ ID NO: 679338 - RNA, 22 nt, Haemophilus influenzae Rd
uacauuauugaauuugguaaua

SEQ ID NO: 679339 - RNA, 13 nt, Haemophilus influenzae Rd
uacauuuaaccaa

SEQ ID NO: 679340 - RNA, 14 nt, Haemophilus influenzae Rd
uacauuaaaaucaa

SEQ ID NO: 679341 - RNA, 15 nt, Haemophilus influenzae Rd
uacagcacuaaaagc

SEQ ID NO: 679342 - RNA, 21 nt, Haemophilus influenzae Rd
uacagcgaacauuuuugguuu

SEQ ID NO: 679343 - RNA, 15 nt, Haemophilus influenzae Rd
uacacuucuaaaaua

SEQ ID NO: 679344 - RNA, 15 nt, Haemophilus influenzae Rd
uacaguuucaacaaa

SEQ ID NO: 679345 - RNA, 21 nt, Haemophilus influenzae Rd
uagccuguuucacaaguucuu

SEQ ID NO: 679346 - RNA, 20 nt, Haemophilus influenzae Rd
uagcaaggcguucaauauua

SEQ ID NO: 679347 - RNA, 17 nt, Haemophilus influenzae Rd
uagcugaauaucagaag

SEQ ID NO: 679348 - RNA, 17 nt, Haemophilus influenzae Rd
uagcugauaauaaagcu

SEQ ID NO: 679349 - RNA, 15 nt, Haemophilus influenzae Rd
uagcucucguuguuc

SEQ ID NO: 679350 - RNA, 15 nt, Haemophilus influenzae Rd
aaguuugacuauucu

SEQ ID NO: 679351 - RNA, 14 nt, Haemophilus influenzae Rd
aaguuugcuaucuu

SEQ ID NO: 679352 - RNA, 17 nt, Haemophilus influenzae Rd
aaguuugcuaucuuacc

SEQ ID NO: 679353 - RNA, 20 nt, Haemophilus influenzae Rd
aaguuuguagcgauauucuu

SEQ ID NO: 679354 - RNA, 17 nt, Haemophilus influenzae Rd
aaguuuuacugauucuu

SEQ ID NO: 679355 - RNA, 20 nt, Haemophilus influenzae Rd
uaggauuuggcacuaaagca

SEQ ID NO: 679356 - RNA, 15 nt, Haemophilus influenzae Rd
uaggaucguugaaug

SEQ ID NO: 679357 - RNA, 12 nt, Haemophilus influenzae Rd
aauaacaauccu

SEQ ID NO: 679358 - RNA, 18 nt, Haemophilus influenzae Rd
aauaacaacaaaagugcg

SEQ ID NO: 679359 - RNA, 18 nt, Haemophilus influenzae Rd
uaggaaugaucugcaccc

SEQ ID NO: 679360 - RNA, 21 nt, Haemophilus influenzae Rd
aauaaauccuucaggauaaaa

SEQ ID NO: 679361 - RNA, 15 nt, Haemophilus influenzae Rd
aauaaauccuugcga

SEQ ID NO: 679362 - RNA, 21 nt, Haemophilus influenzae Rd
aauaaauuaacuuaucuaaaa

SEQ ID NO: 679363 - RNA, 15 nt, Haemophilus influenzae Rd
aauaaagcugaccgc

SEQ ID NO: 679364 - RNA, 17 nt, Haemophilus influenzae Rd
aauaaacacaaacuggu

SEQ ID NO: 679365 - RNA, 20 nt, Haemophilus influenzae Rd
aauaaaccguuagguuuaaa

SEQ ID NO: 679366 - RNA, 20 nt, Haemophilus influenzae Rd
uaggcuauuuuauaauuaau

SEQ ID NO: 679367 - RNA, 20 nt, Haemophilus influenzae Rd
uacuuucuauuaaaaaauca

SEQ ID NO: 679368 - RNA, 16 nt, Haemophilus influenzae Rd
uacuugugcauuuggg

SEQ ID NO: 679369 - RNA, 16 nt, Haemophilus influenzae Rd
uacuuuacguaaagua

SEQ ID NO: 679370 - RNA, 19 nt, Haemophilus influenzae Rd
uacuuucagaauguugcgu

SEQ ID NO: 679371 - RNA, 16 nt, Haemophilus influenzae Rd
uacuuuuauaaagauc

SEQ ID NO: 679372 - RNA, 23 nt, Haemophilus influenzae Rd
uacuuuugauuuauuaauagaua

SEQ ID NO: 679373 - RNA, 17 nt, Haemophilus influenzae Rd
uacuuuuuaauaaauca

SEQ ID NO: 679374 - RNA, 23 nt, Haemophilus influenzae Rd
uacuuuuuauuuuugauuuaguc

SEQ ID NO: 679375 - RNA, 15 nt, Haemophilus influenzae Rd
uagaaagaauauuua

SEQ ID NO: 679376 - RNA, 22 nt, Haemophilus influenzae Rd
uacuugaaucuaauccuaaaau

SEQ ID NO: 679377 - RNA, 19 nt, Haemophilus influenzae Rd
uacuagcucguaaagauca

SEQ ID NO: 679378 - RNA, 18 nt, Haemophilus influenzae Rd
uacuaaauucuuuugcca

SEQ ID NO: 679379 - RNA, 12 nt, Haemophilus influenzae Rd
uacuaauuguug

SEQ ID NO: 679380 - RNA, 12 nt, Haemophilus influenzae Rd
uacuacguaaag

SEQ ID NO: 679381 - RNA, 15 nt, Haemophilus influenzae Rd
uacguucaacaauca

SEQ ID NO: 679382 - RNA, 13 nt, Haemophilus influenzae Rd
uacgguuuuaaua

SEQ ID NO: 679383 - RNA, 19 nt, Haemophilus influenzae Rd
uacguauugaacuaaaaua

SEQ ID NO: 679384 - RNA, 14 nt, Haemophilus influenzae Rd
uacgaacagccgca

SEQ ID NO: 679385 - RNA, 22 nt, Haemophilus influenzae Rd
uacggcauaauccgcugcagcu

SEQ ID NO: 679386 - RNA, 22 nt, Haemophilus influenzae Rd
uacgccaagacaguauuuagcg

SEQ ID NO: 679387 - RNA, 11 nt, Haemophilus influenzae Rd
uagggauuaag

SEQ ID NO: 679388 - RNA, 14 nt, Haemophilus influenzae Rd
uauauucaacuaaa

SEQ ID NO: 679389 - RNA, 23 nt, Haemophilus influenzae Rd
uauaucagaaaagacaucacugg

SEQ ID NO: 679390 - RNA, 18 nt, Haemophilus influenzae Rd
uauaucaagcugugcaaa

SEQ ID NO: 679391 - RNA, 18 nt, Haemophilus influenzae Rd
uauagaaaagacaauaau

SEQ ID NO: 679392 - RNA, 20 nt, Haemophilus influenzae Rd
uauacgugaaccaacccaau

SEQ ID NO: 679393 - RNA, 14 nt, Haemophilus influenzae Rd
uaucacuaauauuu

SEQ ID NO: 679394 - RNA, 18 nt, Haemophilus influenzae Rd
uauauucuggcaauauuu

SEQ ID NO: 679395 - RNA, 14 nt, Haemophilus influenzae Rd
uaucauaacuauaa

SEQ ID NO: 679396 - RNA, 18 nt, Haemophilus influenzae Rd
uauccguuacauuauuua

SEQ ID NO: 679397 - RNA, 21 nt, Haemophilus influenzae Rd
uaucucccaaauccccccauu

SEQ ID NO: 679398 - RNA, 21 nt, Haemophilus influenzae Rd
uaucuaaaugacgugcuaauu

SEQ ID NO: 679399 - RNA, 19 nt, Haemophilus influenzae Rd
uaucuaccacaucaaauuu

SEQ ID NO: 679400 - RNA, 18 nt, Haemophilus influenzae Rd
uaucguauucccaaauuu

SEQ ID NO: 679401 - RNA, 22 nt, Haemophilus influenzae Rd
uaucuucuucuuggcaauauuu

SEQ ID NO: 679402 - RNA, 15 nt, Haemophilus influenzae Rd
uaucuuccguuguuu

SEQ ID NO: 679403 - RNA, 19 nt, Haemophilus influenzae Rd
uaugaccauuaaucacacu

SEQ ID NO: 679404 - RNA, 16 nt, Haemophilus influenzae Rd
uauguucaacaaguaa

SEQ ID NO: 679405 - RNA, 19 nt, Haemophilus influenzae Rd
uaugauuuagaacaauauu

SEQ ID NO: 679406 - RNA, 20 nt, Haemophilus influenzae Rd
uaugauucugugcaauauuu

SEQ ID NO: 679407 - RNA, 22 nt, Haemophilus influenzae Rd
uauuaaguauagcuuuuugcac

SEQ ID NO: 679408 - RNA, 16 nt, Haemophilus influenzae Rd
uauuacaaacaaaaag

SEQ ID NO: 679409 - RNA, 16 nt, Haemophilus influenzae Rd
uauuacauuaaaauca

SEQ ID NO: 679410 - RNA, 14 nt, Haemophilus influenzae Rd
uauuagacaauaaa

SEQ ID NO: 679411 - RNA, 19 nt, Haemophilus influenzae Rd
uauuagaaguaaauucagu

SEQ ID NO: 679412 - RNA, 14 nt, Haemophilus influenzae Rd
uauuaucaauaauu

SEQ ID NO: 679413 - RNA, 19 nt, Haemophilus influenzae Rd
ucaaaguagucuauuuacu

SEQ ID NO: 679414 - RNA, 14 nt, Haemophilus influenzae Rd
ucaaaggcuaauuc

SEQ ID NO: 679415 - RNA, 17 nt, Haemophilus influenzae Rd
ucaaagaauuuuuucac

SEQ ID NO: 679416 - RNA, 19 nt, Haemophilus influenzae Rd
ucaaagcgagaaaaacgaa

SEQ ID NO: 679417 - RNA, 16 nt, Haemophilus influenzae Rd
ucaaacagguguguuu

SEQ ID NO: 679418 - RNA, 13 nt, Haemophilus influenzae Rd
ucaaaccaaccac

SEQ ID NO: 679419 - RNA, 17 nt, Haemophilus influenzae Rd
ucaaacgccguucaaaa

SEQ ID NO: 679420 - RNA, 19 nt, Haemophilus influenzae Rd
uauugccuaauaaaaaaua

SEQ ID NO: 679421 - RNA, 21 nt, Haemophilus influenzae Rd
uauucaaacucuaauuccacc

SEQ ID NO: 679422 - RNA, 20 nt, Haemophilus influenzae Rd
ucaaaguuccuagaauuaaa

SEQ ID NO: 679423 - RNA, 15 nt, Haemophilus influenzae Rd
ucaaauaacgcauaa

SEQ ID NO: 679424 - RNA, 14 nt, Haemophilus influenzae Rd
ucaaauauuuuccu

SEQ ID NO: 679425 - RNA, 21 nt, Haemophilus influenzae Rd
ucaaggacugaguucugucau

SEQ ID NO: 679426 - RNA, 17 nt, Haemophilus influenzae Rd
ucaagaucuuucacgau

SEQ ID NO: 679427 - RNA, 21 nt, Haemophilus influenzae Rd
ucaauaaaaaauaccgcacuu

SEQ ID NO: 679428 - RNA, 14 nt, Haemophilus influenzae Rd
ucaauaauuuuucu

SEQ ID NO: 679429 - RNA, 18 nt, Haemophilus influenzae Rd
ucaauaacugaucgccau

SEQ ID NO: 679430 - RNA, 17 nt, Haemophilus influenzae Rd
ucaauuaccuuagccaa

SEQ ID NO: 679431 - RNA, 16 nt, Haemophilus influenzae Rd
ucaauguuaaguucau

SEQ ID NO: 679432 - RNA, 22 nt, Haemophilus influenzae Rd
ucaauuaaagaaauuucauauu

SEQ ID NO: 679433 - RNA, 23 nt, Haemophilus influenzae Rd
ucaaugucuuuuucuuacggauu

SEQ ID NO: 679434 - RNA, 20 nt, Haemophilus influenzae Rd
ucaaugccuuuuguauccaa

SEQ ID NO: 679435 - RNA, 16 nt, Haemophilus influenzae Rd
ucaauuuuuucuccac

SEQ ID NO: 679436 - RNA, 19 nt, Haemophilus influenzae Rd
ucaauuuggucgccgacuu

SEQ ID NO: 679437 - RNA, 19 nt, Haemophilus influenzae Rd
ucaauuuugacaauuugau

SEQ ID NO: 679438 - RNA, 18 nt, Haemophilus influenzae Rd
ucaauuucuaccgcacuu

SEQ ID NO: 679439 - RNA, 23 nt, Haemophilus influenzae Rd
ucaauuugaccuugaaguuugau

SEQ ID NO: 679440 - RNA, 15 nt, Haemophilus influenzae Rd
ucaauccaugccaua

SEQ ID NO: 679441 - RNA, 16 nt, Haemophilus influenzae Rd
ucaauacuuuucccaa

SEQ ID NO: 679442 - RNA, 18 nt, Haemophilus influenzae Rd
ucauaaacgguauuuucu

SEQ ID NO: 679443 - RNA, 21 nt, Haemophilus influenzae Rd
ucauauauucaacuaaaggca

SEQ ID NO: 679444 - RNA, 22 nt, Haemophilus influenzae Rd
ucauauagggcucaaauuuucu

SEQ ID NO: 679445 - RNA, 19 nt, Haemophilus influenzae Rd
ucauaauuuauucaaaaua

SEQ ID NO: 679446 - RNA, 20 nt, Haemophilus influenzae Rd
ucauccaauccuuuacggga

SEQ ID NO: 679447 - RNA, 13 nt, Haemophilus influenzae Rd
ucauuaauacaca

SEQ ID NO: 679448 - RNA, 20 nt, Haemophilus influenzae Rd
ucauucuaauggcuuccgca

SEQ ID NO: 679449 - RNA, 15 nt, Haemophilus influenzae Rd
ucauuauccaacauu

SEQ ID NO: 679450 - RNA, 18 nt, Haemophilus influenzae Rd
ucauuacgugcaaauaaa

SEQ ID NO: 679451 - RNA, 14 nt, Haemophilus influenzae Rd
ucaucuuuaaacau

SEQ ID NO: 679452 - RNA, 13 nt, Haemophilus influenzae Rd
ucaucuucugcug

SEQ ID NO: 679453 - RNA, 17 nt, Haemophilus influenzae Rd
uccaaucuaauucuucc

SEQ ID NO: 679454 - RNA, 23 nt, Haemophilus influenzae Rd
uccaagcuggcuaacaaauaaug

SEQ ID NO: 679455 - RNA, 15 nt, Haemophilus influenzae Rd
ucauuuucaccaauu

SEQ ID NO: 679456 - RNA, 20 nt, Haemophilus influenzae Rd
ucauuuaaccguaauuucaa

SEQ ID NO: 679457 - RNA, 23 nt, Haemophilus influenzae Rd
ucauuugagaagcccgaauacug

SEQ ID NO: 679458 - RNA, 16 nt, Haemophilus influenzae Rd
ucauuugcaauaucua

SEQ ID NO: 679459 - RNA, 19 nt, Haemophilus influenzae Rd
ucauuuccagcaucuaacg

SEQ ID NO: 679460 - RNA, 14 nt, Haemophilus influenzae Rd
uccaucauuuuucg

SEQ ID NO: 679461 - RNA, 14 nt, Haemophilus influenzae Rd
uccaucaaauccgc

SEQ ID NO: 679462 - RNA, 13 nt, Haemophilus influenzae Rd
uccaguuguucga

SEQ ID NO: 679463 - RNA, 18 nt, Haemophilus influenzae Rd
uccaucaauucuucccaa

SEQ ID NO: 679464 - RNA, 15 nt, Haemophilus influenzae Rd
uccauuucaauaucu

SEQ ID NO: 679465 - RNA, 13 nt, Haemophilus influenzae Rd
uccaugccuaauu

SEQ ID NO: 679466 - RNA, 15 nt, Haemophilus influenzae Rd
uccacuuugcucuaa

SEQ ID NO: 679467 - RNA, 21 nt, Haemophilus influenzae Rd
uccacaucagguauaaagaug

SEQ ID NO: 679468 - RNA, 13 nt, Haemophilus influenzae Rd
uccacaaauaaua

SEQ ID NO: 679469 - RNA, 14 nt, Haemophilus influenzae Rd
ucaccgcaauaaua

SEQ ID NO: 679470 - RNA, 20 nt, Haemophilus influenzae Rd
ucacaauaauuuucaauagc

SEQ ID NO: 679471 - RNA, 16 nt, Haemophilus influenzae Rd
aauaacauuccguuuu

SEQ ID NO: 679472 - RNA, 13 nt, Haemophilus influenzae Rd
aauaacuuuaauu

SEQ ID NO: 679473 - RNA, 16 nt, Haemophilus influenzae Rd
aauaacugcgccaaua

SEQ ID NO: 679474 - RNA, 22 nt, Haemophilus influenzae Rd
aauaacgauaagauuugcuuuu

SEQ ID NO: 679475 - RNA, 21 nt, Haemophilus influenzae Rd
aauaaccuugcugauaaauuc

SEQ ID NO: 679476 - RNA, 13 nt, Haemophilus influenzae Rd
aauaagcccaacu

SEQ ID NO: 679477 - RNA, 16 nt, Haemophilus influenzae Rd
aauaagggcugauuuu

SEQ ID NO: 679478 - RNA, 23 nt, Haemophilus influenzae Rd
aauaaucaggauuaaugcuauaa

SEQ ID NO: 679479 - RNA, 23 nt, Haemophilus influenzae Rd
ucacuuuuccuuguuugcgcauu

SEQ ID NO: 679480 - RNA, 19 nt, Haemophilus influenzae Rd
ucacuugugcgauuaacaa

SEQ ID NO: 679481 - RNA, 17 nt, Haemophilus influenzae Rd
ucacuaauauaaagaua

SEQ ID NO: 679482 - RNA, 14 nt, Haemophilus influenzae Rd
aauaauucuuuaau

SEQ ID NO: 679483 - RNA, 20 nt, Haemophilus influenzae Rd
ucagccuauuuuuagaaaau

SEQ ID NO: 679484 - RNA, 15 nt, Haemophilus influenzae Rd
ucagauaaucaaaaa

SEQ ID NO: 679485 - RNA, 15 nt, Haemophilus influenzae Rd
ucguuaauaaaucca

SEQ ID NO: 679486 - RNA, 12 nt, Haemophilus influenzae Rd
ucguuaccuuua

SEQ ID NO: 679487 - RNA, 24 nt, Haemophilus influenzae Rd
ucguuucaucgagaaauacgacau

SEQ ID NO: 679488 - RNA, 14 nt, Haemophilus influenzae Rd
ucuagcgguaaacc

SEQ ID NO: 679489 - RNA, 16 nt, Haemophilus influenzae Rd
ucuaggcuuucaccaa

SEQ ID NO: 679490 - RNA, 17 nt, Haemophilus influenzae Rd
ucuaauuugcuuacauu

SEQ ID NO: 679491 - RNA, 14 nt, Haemophilus influenzae Rd
ucuaauuuugccau

SEQ ID NO: 679492 - RNA, 22 nt, Haemophilus influenzae Rd
ucuaaugccgcaaauacuucac

SEQ ID NO: 679493 - RNA, 13 nt, Haemophilus influenzae Rd
ucuaauucggcuu

SEQ ID NO: 679494 - RNA, 23 nt, Haemophilus influenzae Rd
ucuaaaaaacccgcuuuuaacaa

SEQ ID NO: 679495 - RNA, 13 nt, Haemophilus influenzae Rd
ucguuuucugcuu

SEQ ID NO: 679496 - RNA, 20 nt, Haemophilus influenzae Rd
ucguuuugauuuaggcauug

SEQ ID NO: 679497 - RNA, 12 nt, Haemophilus influenzae Rd
ucuaaaauaauc

SEQ ID NO: 679498 - RNA, 17 nt, Haemophilus influenzae Rd
ucuaacggaucaacaua

SEQ ID NO: 679499 - RNA, 15 nt, Haemophilus influenzae Rd
ucuaacguauuuaaa

SEQ ID NO: 679500 - RNA, 14 nt, Haemophilus influenzae Rd
ucuaaauaaaaacg

SEQ ID NO: 679501 - RNA, 17 nt, Haemophilus influenzae Rd
ucuaaccgcacucuuuc

SEQ ID NO: 679502 - RNA, 20 nt, Haemophilus influenzae Rd
ucuaaauaggaaacucuuac

SEQ ID NO: 679503 - RNA, 17 nt, Haemophilus influenzae Rd
ucuaagauaaauuuaaa

SEQ ID NO: 679504 - RNA, 14 nt, Haemophilus influenzae Rd
ucuccauaauauug

SEQ ID NO: 679505 - RNA, 21 nt, Haemophilus influenzae Rd
ucuauuaaaaaaucaucaauu

SEQ ID NO: 679506 - RNA, 18 nt, Haemophilus influenzae Rd
ucuauagaauuauuuaaa

SEQ ID NO: 679507 - RNA, 16 nt, Haemophilus influenzae Rd
ucuaucacgaaaauca

SEQ ID NO: 679508 - RNA, 16 nt, Haemophilus influenzae Rd
ucuaucgcauuuuaca

SEQ ID NO: 679509 - RNA, 20 nt, Haemophilus influenzae Rd
ucggugaaugcauuggcuga

SEQ ID NO: 679510 - RNA, 14 nt, Haemophilus influenzae Rd
ucguaauuaaaauc

SEQ ID NO: 679511 - RNA, 23 nt, Haemophilus influenzae Rd
ucugcguuuggcacaacaucaga

SEQ ID NO: 679512 - RNA, 21 nt, Haemophilus influenzae Rd
ucuguaacaaguaauuuaucg

SEQ ID NO: 679513 - RNA, 14 nt, Haemophilus influenzae Rd
ucuguaccugcauu

SEQ ID NO: 679514 - RNA, 22 nt, Haemophilus influenzae Rd
ucuguaugacuauuuagaaauu

SEQ ID NO: 679515 - RNA, 21 nt, Haemophilus influenzae Rd
aauacuagcucguaaagauca

SEQ ID NO: 679516 - RNA, 13 nt, Haemophilus influenzae Rd
ucuguuaaacgca

SEQ ID NO: 679517 - RNA, 15 nt, Haemophilus influenzae Rd
ucuuuguugaugauu

SEQ ID NO: 679518 - RNA, 23 nt, Haemophilus influenzae Rd
ucuuugccacaggauaaaaacca

SEQ ID NO: 679519 - RNA, 22 nt, Haemophilus influenzae Rd
ucuuuaaacaccaaauauucuu

SEQ ID NO: 679520 - RNA, 15 nt, Haemophilus influenzae Rd
ucuuuaggaucacua

SEQ ID NO: 679521 - RNA, 20 nt, Haemophilus influenzae Rd
ucuuuauuaaacaaaaacca

SEQ ID NO: 679522 - RNA, 15 nt, Haemophilus influenzae Rd
ucuuuuuucauugca

SEQ ID NO: 679523 - RNA, 15 nt, Haemophilus influenzae Rd
ucuuuuggguuaaau

SEQ ID NO: 679524 - RNA, 13 nt, Haemophilus influenzae Rd
ucuuuuuauguuu

SEQ ID NO: 679525 - RNA, 14 nt, Haemophilus influenzae Rd
ucuuuuuuaagaua

SEQ ID NO: 679526 - RNA, 19 nt, Haemophilus influenzae Rd
ugaaacaagcuguagcaag

SEQ ID NO: 679527 - RNA, 19 nt, Haemophilus influenzae Rd
ucuucgauaaaaucuugcu

SEQ ID NO: 679528 - RNA, 13 nt, Haemophilus influenzae Rd
ucuuaaaaaauca

SEQ ID NO: 679529 - RNA, 13 nt, Haemophilus influenzae Rd
ugaauauugguuu

SEQ ID NO: 679530 - RNA, 21 nt, Haemophilus influenzae Rd
ugaaucaauuuuuucuccaca

SEQ ID NO: 679531 - RNA, 22 nt, Haemophilus influenzae Rd
ugaaucacaacauauaaaucuc

SEQ ID NO: 679532 - RNA, 22 nt, Haemophilus influenzae Rd
ugaauacgcccauugaaauaac

SEQ ID NO: 679533 - RNA, 16 nt, Haemophilus influenzae Rd
ugaaguuaucaauaaa

SEQ ID NO: 679534 - RNA, 18 nt, Haemophilus influenzae Rd
ugaaaauucauuauuacu

SEQ ID NO: 679535 - RNA, 20 nt, Haemophilus influenzae Rd
ugaagauuuuggugcauguu

SEQ ID NO: 679536 - RNA, 15 nt, Haemophilus influenzae Rd
ugaagaugaagcuaa

SEQ ID NO: 679537 - RNA, 17 nt, Haemophilus influenzae Rd
ugaauugauaaaggcau

SEQ ID NO: 679538 - RNA, 16 nt, Haemophilus influenzae Rd
ugaauuaaaaguagaa

SEQ ID NO: 679539 - RNA, 18 nt, Haemophilus influenzae Rd
ugacaguaauguaauaac

SEQ ID NO: 679540 - RNA, 20 nt, Haemophilus influenzae Rd
ugacagucgauuacaaaaac

SEQ ID NO: 679541 - RNA, 17 nt, Haemophilus influenzae Rd
ugaccaaauuccaagcc

SEQ ID NO: 679542 - RNA, 13 nt, Haemophilus influenzae Rd
ugacccacaucau

SEQ ID NO: 679543 - RNA, 23 nt, Haemophilus influenzae Rd
ugagaaugaaaauaaccgcacuu

SEQ ID NO: 679544 - RNA, 19 nt, Haemophilus influenzae Rd
ugagccaacucgaacauga

SEQ ID NO: 679545 - RNA, 20 nt, Haemophilus influenzae Rd
ugauauaaguucuaaauaaa

SEQ ID NO: 679546 - RNA, 22 nt, Haemophilus influenzae Rd
ugauauaaguucuaaauaaacu

SEQ ID NO: 679547 - RNA, 20 nt, Haemophilus influenzae Rd
ugauauaauauuuuggcaau

SEQ ID NO: 679548 - RNA, 16 nt, Haemophilus influenzae Rd
ugauauaugauuauaa

SEQ ID NO: 679549 - RNA, 12 nt, Haemophilus influenzae Rd
ugagugauuuca

SEQ ID NO: 679550 - RNA, 17 nt, Haemophilus influenzae Rd
ugagguuuuauuacaaa

SEQ ID NO: 679551 - RNA, 15 nt, Haemophilus influenzae Rd
ugauuaaucaaaaau

SEQ ID NO: 679552 - RNA, 17 nt, Haemophilus influenzae Rd
ugauuauagauuuaguc

SEQ ID NO: 679553 - RNA, 14 nt, Haemophilus influenzae Rd
ugauguuaugcuua

SEQ ID NO: 679554 - RNA, 16 nt, Haemophilus influenzae Rd
ugauugagaugccauu

SEQ ID NO: 679555 - RNA, 16 nt, Haemophilus influenzae Rd
ugauucuaaugccauu

SEQ ID NO: 679556 - RNA, 21 nt, Haemophilus influenzae Rd
ugauuuagaacaauauuuaua

SEQ ID NO: 679557 - RNA, 13 nt, Haemophilus influenzae Rd
ugauuuaaaaccg

SEQ ID NO: 679558 - RNA, 17 nt, Haemophilus influenzae Rd
ugauuuaguccuaaaaa

SEQ ID NO: 679559 - RNA, 15 nt, Haemophilus influenzae Rd
ugauugcuaaauaaa

SEQ ID NO: 679560 - RNA, 19 nt, Haemophilus influenzae Rd
ugaucaugguuguaauaau

SEQ ID NO: 679561 - RNA, 20 nt, Haemophilus influenzae Rd
ugaucauaauccacuaaaaa

SEQ ID NO: 679562 - RNA, 20 nt, Haemophilus influenzae Rd
ugcaaaccaaaucacaauaa

SEQ ID NO: 679563 - RNA, 17 nt, Haemophilus influenzae Rd
ugcaacaauuucaucag

SEQ ID NO: 679564 - RNA, 13 nt, Haemophilus influenzae Rd
ugcaaaguuauaa

SEQ ID NO: 679565 - RNA, 14 nt, Haemophilus influenzae Rd
ugcaacaauaucau

SEQ ID NO: 679566 - RNA, 13 nt, Haemophilus influenzae Rd
ugcaacuuuuuua

SEQ ID NO: 679567 - RNA, 21 nt, Haemophilus influenzae Rd
ugcaagcauucucaauugcaa

SEQ ID NO: 679568 - RNA, 16 nt, Haemophilus influenzae Rd
ugcacccgccgcaccu

SEQ ID NO: 679569 - RNA, 19 nt, Haemophilus influenzae Rd
ugcaauuguugcaccaaua

SEQ ID NO: 679570 - RNA, 20 nt, Haemophilus influenzae Rd
ugcacaauuuggcgcauuaa

SEQ ID NO: 679571 - RNA, 17 nt, Haemophilus influenzae Rd
ugcaaucagcaacauua

SEQ ID NO: 679572 - RNA, 18 nt, Haemophilus influenzae Rd
ugccgcaagugguaaaau

SEQ ID NO: 679573 - RNA, 16 nt, Haemophilus influenzae Rd
ugcccgugaguaaaau

SEQ ID NO: 679574 - RNA, 15 nt, Haemophilus influenzae Rd
ugccauuuuuuauaa

SEQ ID NO: 679575 - RNA, 22 nt, Haemophilus influenzae Rd
ugcaguagguauguuuaguucu

SEQ ID NO: 679576 - RNA, 19 nt, Haemophilus influenzae Rd
ugcaguauuaguugguacu

SEQ ID NO: 679577 - RNA, 17 nt, Haemophilus influenzae Rd
ugccaauccauuuuuaa

SEQ ID NO: 679578 - RNA, 14 nt, Haemophilus influenzae Rd
ugcauuuuuuauaa

SEQ ID NO: 679579 - RNA, 13 nt, Haemophilus influenzae Rd
ugcauuuuuauaa

SEQ ID NO: 679580 - RNA, 18 nt, Haemophilus influenzae Rd
ugcauuugcauaaagcau

SEQ ID NO: 679581 - RNA, 16 nt, Haemophilus influenzae Rd
ugcauugccuaaauac

SEQ ID NO: 679582 - RNA, 21 nt, Haemophilus influenzae Rd
ugcauuaauaaucuaauccaa

SEQ ID NO: 679583 - RNA, 13 nt, Haemophilus influenzae Rd
ugcauuaaaucaa

SEQ ID NO: 679584 - RNA, 16 nt, Haemophilus influenzae Rd
ugcauuaaaucaaauu

SEQ ID NO: 679585 - RNA, 14 nt, Haemophilus influenzae Rd
ucgaggcaccauuu

SEQ ID NO: 679586 - RNA, 23 nt, Haemophilus influenzae Rd
ucgaauuaaacgugauuuaccaa

SEQ ID NO: 679587 - RNA, 15 nt, Haemophilus influenzae Rd
ucgaauuauuuuacg

SEQ ID NO: 679588 - RNA, 14 nt, Haemophilus influenzae Rd
uccuuacgcugaau

SEQ ID NO: 679589 - RNA, 21 nt, Haemophilus influenzae Rd
uccuuaucgguuggauuuuaa

SEQ ID NO: 679590 - RNA, 19 nt, Haemophilus influenzae Rd
ucgaauagauuuuuaccaa

SEQ ID NO: 679591 - RNA, 16 nt, Haemophilus influenzae Rd
uccgcaauauagucaa

SEQ ID NO: 679592 - RNA, 22 nt, Haemophilus influenzae Rd
uccgcaaccagcagaaaauaac

SEQ ID NO: 679593 - RNA, 21 nt, Haemophilus influenzae Rd
uccgaucaaauugucaaaauu

SEQ ID NO: 679594 - RNA, 18 nt, Haemophilus influenzae Rd
uccuaacuuuucuucaau

SEQ ID NO: 679595 - RNA, 21 nt, Haemophilus influenzae Rd
uccguguuuacgauaaugcca

SEQ ID NO: 679596 - RNA, 21 nt, Haemophilus influenzae Rd
ucggcauauaagauuuuugcc

SEQ ID NO: 679597 - RNA, 18 nt, Haemophilus influenzae Rd
ucgcugcagcugcugcuu

SEQ ID NO: 679598 - RNA, 18 nt, Haemophilus influenzae Rd
ucgcugugaaagaagauu

SEQ ID NO: 679599 - RNA, 22 nt, Haemophilus influenzae Rd
ucggaaaaaauuuguucaagau

SEQ ID NO: 679600 - RNA, 19 nt, Haemophilus influenzae Rd
ucggaacagcagacauuaa

SEQ ID NO: 679601 - RNA, 14 nt, Haemophilus influenzae Rd
ucgcacuuggcgaa

SEQ ID NO: 679602 - RNA, 21 nt, Haemophilus influenzae Rd
aggaauuugcucaauaauuuc

SEQ ID NO: 679603 - RNA, 21 nt, Haemophilus influenzae Rd
aggaaagccccauuucuuuuu

SEQ ID NO: 679604 - RNA, 16 nt, Haemophilus influenzae Rd
agcuugcguaauguuu

SEQ ID NO: 679605 - RNA, 18 nt, Haemophilus influenzae Rd
agcuuuccuguacucgaa

SEQ ID NO: 679606 - RNA, 13 nt, Haemophilus influenzae Rd
aggaugacguaau

SEQ ID NO: 679607 - RNA, 18 nt, Haemophilus influenzae Rd
aaacgugugauaccaaga

SEQ ID NO: 679608 - RNA, 19 nt, Haemophilus influenzae Rd
aaacguuaaaucacuuuca

SEQ ID NO: 679609 - RNA, 16 nt, Haemophilus influenzae Rd
aggcaauguuccacca

SEQ ID NO: 679610 - RNA, 23 nt, Haemophilus influenzae Rd
agcuaauucuucuauuuuaucaa

SEQ ID NO: 679611 - RNA, 14 nt, Haemophilus influenzae Rd
agcuaagcauuuca

SEQ ID NO: 679612 - RNA, 18 nt, Haemophilus influenzae Rd
agcuaauaaaguuugcaa

SEQ ID NO: 679613 - RNA, 18 nt, Haemophilus influenzae Rd
agcgauauucuuuugaau

SEQ ID NO: 679614 - RNA, 16 nt, Haemophilus influenzae Rd
agccugcuacauuugc

SEQ ID NO: 679615 - RNA, 17 nt, Haemophilus influenzae Rd
agcaguugcuaaaucac

SEQ ID NO: 679616 - RNA, 20 nt, Haemophilus influenzae Rd
agcauaaaagugcgguaaaa

SEQ ID NO: 679617 - RNA, 18 nt, Haemophilus influenzae Rd
agauuuugccuaaucgua

SEQ ID NO: 679618 - RNA, 15 nt, Haemophilus influenzae Rd
agauuaaaacagauc

SEQ ID NO: 679619 - RNA, 21 nt, Haemophilus influenzae Rd
agauuacuuuuagauaaauuu

SEQ ID NO: 679620 - RNA, 14 nt, Haemophilus influenzae Rd
agccauaauauuua

SEQ ID NO: 679621 - RNA, 16 nt, Haemophilus influenzae Rd
agccaaggcgauuaau

SEQ ID NO: 679622 - RNA, 23 nt, Haemophilus influenzae Rd
agccaauauggaacaguugaaaa

SEQ ID NO: 679623 - RNA, 13 nt, Haemophilus influenzae Rd
agccccaguuuau

SEQ ID NO: 679624 - RNA, 19 nt, Haemophilus influenzae Rd
agccauguugauguaaaaa

SEQ ID NO: 679625 - RNA, 18 nt, Haemophilus influenzae Rd
aggcuuugccuaauuggu

SEQ ID NO: 679626 - RNA, 12 nt, Haemophilus influenzae Rd
agggcacuuugc

SEQ ID NO: 679627 - RNA, 18 nt, Haemophilus influenzae Rd
agguaaauuugguucaau

SEQ ID NO: 679628 - RNA, 20 nt, Haemophilus influenzae Rd
agguggaacaaagguuaaac

SEQ ID NO: 679629 - RNA, 20 nt, Haemophilus influenzae Rd
aggugggcuuuagcccacca

SEQ ID NO: 679630 - RNA, 17 nt, Haemophilus influenzae Rd
aggucuuaauagcauug

SEQ ID NO: 679631 - RNA, 16 nt, Haemophilus influenzae Rd
aguggguaaaccaaac

SEQ ID NO: 679632 - RNA, 13 nt, Haemophilus influenzae Rd
agugguaaucauu

SEQ ID NO: 679633 - RNA, 18 nt, Haemophilus influenzae Rd
agugcagaucgcuauuua

SEQ ID NO: 679634 - RNA, 14 nt, Haemophilus influenzae Rd
agugcaugauguuu

SEQ ID NO: 679635 - RNA, 18 nt, Haemophilus influenzae Rd
auaaugugagaauaacca

SEQ ID NO: 679636 - RNA, 20 nt, Haemophilus influenzae Rd
auaaucuucccauuugaauu

SEQ ID NO: 679637 - RNA, 14 nt, Haemophilus influenzae Rd
auaaugaccauugg

SEQ ID NO: 679638 - RNA, 15 nt, Haemophilus influenzae Rd
auaauuaaauucauu

SEQ ID NO: 679639 - RNA, 14 nt, Haemophilus influenzae Rd
auaauuaaacuuuc

SEQ ID NO: 679640 - RNA, 21 nt, Haemophilus influenzae Rd
auaauuaaacuuucaauuuuu

SEQ ID NO: 679641 - RNA, 13 nt, Haemophilus influenzae Rd
auaagcugcauca

SEQ ID NO: 679642 - RNA, 22 nt, Haemophilus influenzae Rd
auaacaaucuuguuggaucuuc

SEQ ID NO: 679643 - RNA, 13 nt, Haemophilus influenzae Rd
auaaauuuuuagc

SEQ ID NO: 679644 - RNA, 17 nt, Haemophilus influenzae Rd
auaaauuccuuuuuaau

SEQ ID NO: 679645 - RNA, 12 nt, Haemophilus influenzae Rd
auaaauuuuauu

SEQ ID NO: 679646 - RNA, 23 nt, Haemophilus influenzae Rd
auaaaugcgucgcagccuuguuc

SEQ ID NO: 679647 - RNA, 18 nt, Haemophilus influenzae Rd
auaaauggaaaccauuga

SEQ ID NO: 679648 - RNA, 21 nt, Haemophilus influenzae Rd
auaaaugggcaaacauuuuuu

SEQ ID NO: 679649 - RNA, 22 nt, Haemophilus influenzae Rd
auaaucagcccaagcuuuuucu

SEQ ID NO: 679650 - RNA, 18 nt, Haemophilus influenzae Rd
auaaucaggaauaaacca

SEQ ID NO: 679651 - RNA, 19 nt, Haemophilus influenzae Rd
auaaucaggauauuuuauu

SEQ ID NO: 679652 - RNA, 22 nt, Haemophilus influenzae Rd
auaauccugguauuuacaaguc

SEQ ID NO: 679653 - RNA, 17 nt, Haemophilus influenzae Rd
auaaucgaucuuuuuuu

SEQ ID NO: 679654 - RNA, 13 nt, Haemophilus influenzae Rd
auaauauuuuggc

SEQ ID NO: 679655 - RNA, 13 nt, Haemophilus influenzae Rd
auaauauuuuugc

SEQ ID NO: 679656 - RNA, 15 nt, Haemophilus influenzae Rd
auaaggcuuauuuuu

SEQ ID NO: 679657 - RNA, 13 nt, Haemophilus influenzae Rd
aguuggguuaaau

SEQ ID NO: 679658 - RNA, 16 nt, Haemophilus influenzae Rd
aguuagaccaucuaaa

SEQ ID NO: 679659 - RNA, 21 nt, Haemophilus influenzae Rd
auaaaccuaaagccaaggcga

SEQ ID NO: 679660 - RNA, 21 nt, Haemophilus influenzae Rd
auaaacugauuuugauuuagc

SEQ ID NO: 679661 - RNA, 22 nt, Haemophilus influenzae Rd
auaaaauggcgguuuuuuaauu

SEQ ID NO: 679662 - RNA, 20 nt, Haemophilus influenzae Rd
auaaaauggcuaucauuacc

SEQ ID NO: 679663 - RNA, 23 nt, Haemophilus influenzae Rd
auaaaagugcgguauuuuuuauu

SEQ ID NO: 679664 - RNA, 16 nt, Haemophilus influenzae Rd
auaaacucacauuguu

SEQ ID NO: 679665 - RNA, 19 nt, Haemophilus influenzae Rd
auaaagagcggucaauuuu

SEQ ID NO: 679666 - RNA, 21 nt, Haemophilus influenzae Rd
auaaagugcggucaauuuuca

SEQ ID NO: 679667 - RNA, 21 nt, Haemophilus influenzae Rd
auaaagugcgguuauuuuauu

SEQ ID NO: 679668 - RNA, 23 nt, Haemophilus influenzae Rd
auaaaucacuuaauuucuuaauu

SEQ ID NO: 679669 - RNA, 19 nt, Haemophilus influenzae Rd
auaaauccuguuuauuuuu

SEQ ID NO: 679670 - RNA, 17 nt, Haemophilus influenzae Rd
auaucagcccuuuguuu

SEQ ID NO: 679671 - RNA, 16 nt, Haemophilus influenzae Rd
auaucaauuacguaau

SEQ ID NO: 679672 - RNA, 15 nt, Haemophilus influenzae Rd
auaucacaaccacca

SEQ ID NO: 679673 - RNA, 16 nt, Haemophilus influenzae Rd
auaucacgccuuuuuu

SEQ ID NO: 679674 - RNA, 13 nt, Haemophilus influenzae Rd
auauauucugcua

SEQ ID NO: 679675 - RNA, 21 nt, Haemophilus influenzae Rd
auauaucacagauuuuuaaau

SEQ ID NO: 679676 - RNA, 16 nt, Haemophilus influenzae Rd
auagucaaauaacccu

SEQ ID NO: 679677 - RNA, 22 nt, Haemophilus influenzae Rd
auauaguuuuacugcuuuauuu

SEQ ID NO: 679678 - RNA, 14 nt, Haemophilus influenzae Rd
auacacuuuaaauu

SEQ ID NO: 679679 - RNA, 14 nt, Haemophilus influenzae Rd
auacacuuuuaacu

SEQ ID NO: 679680 - RNA, 14 nt, Haemophilus influenzae Rd
auaccacuccccaa

SEQ ID NO: 679681 - RNA, 20 nt, Haemophilus influenzae Rd
auaccacuccccaaaaacca

SEQ ID NO: 679682 - RNA, 12 nt, Haemophilus influenzae Rd
auaccauuacau

SEQ ID NO: 679683 - RNA, 22 nt, Haemophilus influenzae Rd
auagcugaaaaauaaaaaauau

SEQ ID NO: 679684 - RNA, 18 nt, Haemophilus influenzae Rd
auauuuuguugaagaaag

SEQ ID NO: 679685 - RNA, 12 nt, Haemophilus influenzae Rd
auauuuuuaauu

SEQ ID NO: 679686 - RNA, 17 nt, Haemophilus influenzae Rd
aucaaccgauaaaucua

SEQ ID NO: 679687 - RNA, 21 nt, Haemophilus influenzae Rd
aucaaccgcacuuuuauauuu

SEQ ID NO: 679688 - RNA, 13 nt, Haemophilus influenzae Rd
auauucuaccgca

SEQ ID NO: 679689 - RNA, 16 nt, Haemophilus influenzae Rd
auaucuuguuuuaaua

SEQ ID NO: 679690 - RNA, 17 nt, Haemophilus influenzae Rd
aucacuucauaaauugu

SEQ ID NO: 679691 - RNA, 18 nt, Haemophilus influenzae Rd
aucaauaauucauuagaa

SEQ ID NO: 679692 - RNA, 22 nt, Haemophilus influenzae Rd
aucagcuuuuguugcacccauu

SEQ ID NO: 679693 - RNA, 17 nt, Haemophilus influenzae Rd
aucaggguuauuugcaa

SEQ ID NO: 679694 - RNA, 16 nt, Haemophilus influenzae Rd
aucaucuguaaaccau

SEQ ID NO: 679695 - RNA, 13 nt, Haemophilus influenzae Rd
aucaucuauacca

SEQ ID NO: 679696 - RNA, 23 nt, Haemophilus influenzae Rd
aucaugagguuugccaucugaaa

SEQ ID NO: 679697 - RNA, 18 nt, Haemophilus influenzae Rd
aucaucauuaaacgaucu

SEQ ID NO: 679698 - RNA, 20 nt, Haemophilus influenzae Rd
aucauaaucgccaaaaucau

SEQ ID NO: 679699 - RNA, 17 nt, Haemophilus influenzae Rd
auccauuuuuaaauggu

SEQ ID NO: 679700 - RNA, 20 nt, Haemophilus influenzae Rd
auccauaaggaaauugcagg

SEQ ID NO: 679701 - RNA, 13 nt, Haemophilus influenzae Rd
auccacuuuuuuc

SEQ ID NO: 679702 - RNA, 15 nt, Haemophilus influenzae Rd
aucauuaaauuuagu

SEQ ID NO: 679703 - RNA, 22 nt, Haemophilus influenzae Rd
aucauuucucgggcugaaauac

SEQ ID NO: 679704 - RNA, 18 nt, Haemophilus influenzae Rd
auccaacgaagaaacaca

SEQ ID NO: 679705 - RNA, 17 nt, Haemophilus influenzae Rd
auccucuuuaaaauuac

SEQ ID NO: 679706 - RNA, 18 nt, Haemophilus influenzae Rd
auccuugaaucauuucau

SEQ ID NO: 679707 - RNA, 16 nt, Haemophilus influenzae Rd
auccucaacaucaaaa

SEQ ID NO: 679708 - RNA, 18 nt, Haemophilus influenzae Rd
auccgcugcaaauugccc

SEQ ID NO: 679709 - RNA, 20 nt, Haemophilus influenzae Rd
auccgcaauaauuaagaaaa

SEQ ID NO: 679710 - RNA, 13 nt, Haemophilus influenzae Rd
aucugcacuuuaa

SEQ ID NO: 679711 - RNA, 13 nt, Haemophilus influenzae Rd
aucugauugagaa

SEQ ID NO: 679712 - RNA, 17 nt, Haemophilus influenzae Rd
aucgaacacuguaaaua

SEQ ID NO: 679713 - RNA, 19 nt, Haemophilus influenzae Rd
aucggugcaacaauaucau

SEQ ID NO: 679714 - RNA, 19 nt, Haemophilus influenzae Rd
aucguauucccaaauuuuu

SEQ ID NO: 679715 - RNA, 14 nt, Haemophilus influenzae Rd
augauuauaaauua

SEQ ID NO: 679716 - RNA, 15 nt, Haemophilus influenzae Rd
augcaguauaaaccg

SEQ ID NO: 679717 - RNA, 20 nt, Haemophilus influenzae Rd
augcacgagcaggaaaacca

SEQ ID NO: 679718 - RNA, 17 nt, Haemophilus influenzae Rd
augcaccagaugcaaua

SEQ ID NO: 679719 - RNA, 21 nt, Haemophilus influenzae Rd
augaacuuguucgucaccgua

SEQ ID NO: 679720 - RNA, 15 nt, Haemophilus influenzae Rd
augaagugaaagaua

SEQ ID NO: 679721 - RNA, 19 nt, Haemophilus influenzae Rd
augaccaaauacaauuuuu

SEQ ID NO: 679722 - RNA, 15 nt, Haemophilus influenzae Rd
augaccaaauaccac

SEQ ID NO: 679723 - RNA, 18 nt, Haemophilus influenzae Rd
aucuugacauaauuucac

SEQ ID NO: 679724 - RNA, 19 nt, Haemophilus influenzae Rd
aucuucuucuuuuuucuca

SEQ ID NO: 679725 - RNA, 23 nt, Haemophilus influenzae Rd
aucuugcacggguuuugcuaaug

SEQ ID NO: 679726 - RNA, 22 nt, Haemophilus influenzae Rd
aucuugcauaaaccaacuauuu

SEQ ID NO: 679727 - RNA, 22 nt, Haemophilus influenzae Rd
aucuugccaaugccaaauuucu

SEQ ID NO: 679728 - RNA, 14 nt, Haemophilus influenzae Rd
aucuuguuuuaauu

SEQ ID NO: 679729 - RNA, 12 nt, Haemophilus influenzae Rd
augaacaaaaaa

SEQ ID NO: 679730 - RNA, 17 nt, Haemophilus influenzae Rd
augaacaagcacccauu

SEQ ID NO: 679731 - RNA, 16 nt, Haemophilus influenzae Rd
augggggaauaaauuc

SEQ ID NO: 679732 - RNA, 15 nt, Haemophilus influenzae Rd
augguugcauuugcu

SEQ ID NO: 679733 - RNA, 15 nt, Haemophilus influenzae Rd
augguucgauuucau

SEQ ID NO: 679734 - RNA, 13 nt, Haemophilus influenzae Rd
augcccagcaauu

SEQ ID NO: 679735 - RNA, 14 nt, Haemophilus influenzae Rd
auucauucauuuug

SEQ ID NO: 679736 - RNA, 23 nt, Haemophilus influenzae Rd
auucacuuaauugugugcguuuu

SEQ ID NO: 679737 - RNA, 14 nt, Haemophilus influenzae Rd
auucacgaucacuu

SEQ ID NO: 679738 - RNA, 14 nt, Haemophilus influenzae Rd
auuccaacgauuuu

SEQ ID NO: 679739 - RNA, 18 nt, Haemophilus influenzae Rd
aaacuacggacuaaauaa

SEQ ID NO: 679740 - RNA, 22 nt, Haemophilus influenzae Rd
aaacuacggacuaaauaaauca

SEQ ID NO: 679741 - RNA, 15 nt, Haemophilus influenzae Rd
aaacuacaacuuuuu

SEQ ID NO: 679742 - RNA, 17 nt, Haemophilus influenzae Rd
aaacucagaauauaagu

SEQ ID NO: 679743 - RNA, 18 nt, Haemophilus influenzae Rd
auuccgucagaauuucau

SEQ ID NO: 679744 - RNA, 21 nt, Haemophilus influenzae Rd
auuauggguguuuaaauuuuu

SEQ ID NO: 679745 - RNA, 13 nt, Haemophilus influenzae Rd
auuaucugauguu

SEQ ID NO: 679746 - RNA, 12 nt, Haemophilus influenzae Rd
auuaugaaauuu

SEQ ID NO: 679747 - RNA, 14 nt, Haemophilus influenzae Rd
auuaucgugauuuu

SEQ ID NO: 679748 - RNA, 22 nt, Haemophilus influenzae Rd
auuagaugauuuuaaaauaaau

SEQ ID NO: 679749 - RNA, 21 nt, Haemophilus influenzae Rd
auuagcagguuuuuuauuucu

SEQ ID NO: 679750 - RNA, 15 nt, Haemophilus influenzae Rd
auuagcaaagaauua

SEQ ID NO: 679751 - RNA, 20 nt, Haemophilus influenzae Rd
auuacccguaccuuuaaauu

SEQ ID NO: 679752 - RNA, 23 nt, Haemophilus influenzae Rd
auuaccuucuguuuucaauacgc

SEQ ID NO: 679753 - RNA, 19 nt, Haemophilus influenzae Rd
auuacgugcaaauaaauuu

SEQ ID NO: 679754 - RNA, 19 nt, Haemophilus influenzae Rd
auuacguucauauaaauuu

SEQ ID NO: 679755 - RNA, 18 nt, Haemophilus influenzae Rd
auuaauacgucaauugcu

SEQ ID NO: 679756 - RNA, 17 nt, Haemophilus influenzae Rd
auuacauucccaaauaa

SEQ ID NO: 679757 - RNA, 18 nt, Haemophilus influenzae Rd
auuacauccacuuuuucu

SEQ ID NO: 679758 - RNA, 16 nt, Haemophilus influenzae Rd
auuacauaaaaccaau

SEQ ID NO: 679759 - RNA, 17 nt, Haemophilus influenzae Rd
auuacagaaucauuuuc

SEQ ID NO: 679760 - RNA, 21 nt, Haemophilus influenzae Rd
auuaauuuuuuauaaaauuuc

SEQ ID NO: 679761 - RNA, 18 nt, Haemophilus influenzae Rd
auuaauuccagugguaaa

SEQ ID NO: 679762 - RNA, 23 nt, Haemophilus influenzae Rd
auuaaucuuuuuucuugcuaaaa

SEQ ID NO: 679763 - RNA, 22 nt, Haemophilus influenzae Rd
auuaaucugcauucuaaaaguu

SEQ ID NO: 679764 - RNA, 21 nt, Haemophilus influenzae Rd
auuucauuggcgguuuugcca

SEQ ID NO: 679765 - RNA, 17 nt, Haemophilus influenzae Rd
auuucaucgcguuuuuu

SEQ ID NO: 679766 - RNA, 14 nt, Haemophilus influenzae Rd
auuucauuuucuaa

SEQ ID NO: 679767 - RNA, 22 nt, Haemophilus influenzae Rd
auuucuaaucauuuguuuuccg

SEQ ID NO: 679768 - RNA, 18 nt, Haemophilus influenzae Rd
auuuaauuuuuuauagug

SEQ ID NO: 679769 - RNA, 14 nt, Haemophilus influenzae Rd
auuuaucauuuaac

SEQ ID NO: 679770 - RNA, 15 nt, Haemophilus influenzae Rd
auuuaucuaaaagua

SEQ ID NO: 679771 - RNA, 23 nt, Haemophilus influenzae Rd
auuuaugaauguuucaaacaccu

SEQ ID NO: 679772 - RNA, 19 nt, Haemophilus influenzae Rd
auuuauuccaucaauaccu

SEQ ID NO: 679773 - RNA, 22 nt, Haemophilus influenzae Rd
auuuauuuugguauuuuugugg

SEQ ID NO: 679774 - RNA, 17 nt, Haemophilus influenzae Rd
auuuaauccugucaucu

SEQ ID NO: 679775 - RNA, 16 nt, Haemophilus influenzae Rd
auuuaauucacgaaug

SEQ ID NO: 679776 - RNA, 21 nt, Haemophilus influenzae Rd
auuguggcuuuugucgcuaac

SEQ ID NO: 679777 - RNA, 18 nt, Haemophilus influenzae Rd
auuuaaccguaauuucaa

SEQ ID NO: 679778 - RNA, 14 nt, Haemophilus influenzae Rd
auuuaaauugaaaa

SEQ ID NO: 679779 - RNA, 21 nt, Haemophilus influenzae Rd
auuuaauauuucuucauuuua

SEQ ID NO: 679780 - RNA, 19 nt, Haemophilus influenzae Rd
auuuaauaaggcaaaaccg

SEQ ID NO: 679781 - RNA, 15 nt, Haemophilus influenzae Rd
auuuaauacuuucuu

SEQ ID NO: 679782 - RNA, 16 nt, Haemophilus influenzae Rd
auugccauauucgcuu

SEQ ID NO: 679783 - RNA, 14 nt, Haemophilus influenzae Rd
auugcgcaauacgu

SEQ ID NO: 679784 - RNA, 19 nt, Haemophilus influenzae Rd
auucgccuugcuuuuaaua

SEQ ID NO: 679785 - RNA, 15 nt, Haemophilus influenzae Rd
auucuaaaaaaauca

SEQ ID NO: 679786 - RNA, 17 nt, Haemophilus influenzae Rd
auucuacguauugaacu

SEQ ID NO: 679787 - RNA, 14 nt, Haemophilus influenzae Rd
auucuauagaauua

SEQ ID NO: 679788 - RNA, 18 nt, Haemophilus influenzae Rd
auucucaggaaauuucaa

SEQ ID NO: 679789 - RNA, 16 nt, Haemophilus influenzae Rd
auucuccccgaugauu

SEQ ID NO: 679790 - RNA, 15 nt, Haemophilus influenzae Rd
auugugaaauuucau

SEQ ID NO: 679791 - RNA, 19 nt, Haemophilus influenzae Rd
auugugacggugaauuuau

SEQ ID NO: 679792 - RNA, 12 nt, Haemophilus influenzae Rd
auugugauguuc

SEQ ID NO: 679793 - RNA, 17 nt, Haemophilus influenzae Rd
caaauuaauaagaaaau

SEQ ID NO: 679794 - RNA, 21 nt, Haemophilus influenzae Rd
caaauuccaucaauuaaugga

SEQ ID NO: 679795 - RNA, 20 nt, Haemophilus influenzae Rd
caaauuuguugaucugcaaa

SEQ ID NO: 679796 - RNA, 15 nt, Haemophilus influenzae Rd
caaauuuuuucaaaa

SEQ ID NO: 679797 - RNA, 14 nt, Haemophilus influenzae Rd
caacaaugcuauaa

SEQ ID NO: 679798 - RNA, 19 nt, Haemophilus influenzae Rd
caaauugcuaaugaugugc

SEQ ID NO: 679799 - RNA, 19 nt, Haemophilus influenzae Rd
caaauuguccuuugccuuu

SEQ ID NO: 679800 - RNA, 17 nt, Haemophilus influenzae Rd
caaauuuagauaacaau

SEQ ID NO: 679801 - RNA, 20 nt, Haemophilus influenzae Rd
caaauuuauaauagacugaa

SEQ ID NO: 679802 - RNA, 19 nt, Haemophilus influenzae Rd
caaagaggagguagaaaau

SEQ ID NO: 679803 - RNA, 14 nt, Haemophilus influenzae Rd
caaaucaaauuuuc

SEQ ID NO: 679804 - RNA, 17 nt, Haemophilus influenzae Rd
caaauauuccacaucac

SEQ ID NO: 679805 - RNA, 17 nt, Haemophilus influenzae Rd
caaauauucuucuaaaa

SEQ ID NO: 679806 - RNA, 12 nt, Haemophilus influenzae Rd
caaaucauuuuu

SEQ ID NO: 679807 - RNA, 19 nt, Haemophilus influenzae Rd
caaauaucaaaaaaauuua

SEQ ID NO: 679808 - RNA, 18 nt, Haemophilus influenzae Rd
caaacgaaaaaaauaaaa

SEQ ID NO: 679809 - RNA, 20 nt, Haemophilus influenzae Rd
caaacauuuuuauuuuuacu

SEQ ID NO: 679810 - RNA, 13 nt, Haemophilus influenzae Rd
caaacaucaucac

SEQ ID NO: 679811 - RNA, 21 nt, Haemophilus influenzae Rd
caaacauuaaucgaucaauuu

SEQ ID NO: 679812 - RNA, 12 nt, Haemophilus influenzae Rd
caaaauuuuacc

SEQ ID NO: 679813 - RNA, 14 nt, Haemophilus influenzae Rd
caaacaaaauaaau

SEQ ID NO: 679814 - RNA, 14 nt, Haemophilus influenzae Rd
caaacaaaauuuua

SEQ ID NO: 679815 - RNA, 12 nt, Haemophilus influenzae Rd
caaaaucaucac

SEQ ID NO: 679816 - RNA, 13 nt, Haemophilus influenzae Rd
caaaauggaauuc

SEQ ID NO: 679817 - RNA, 15 nt, Haemophilus influenzae Rd
caaaauuaaugccaa

SEQ ID NO: 679818 - RNA, 22 nt, Haemophilus influenzae Rd
caaaauauucugaggauuuuau

SEQ ID NO: 679819 - RNA, 21 nt, Haemophilus influenzae Rd
caaaauauuuucaaauaaguu

SEQ ID NO: 679820 - RNA, 18 nt, Haemophilus influenzae Rd
auuuuuacuucaucaaaa

SEQ ID NO: 679821 - RNA, 22 nt, Haemophilus influenzae Rd
auuuuuaucaauaacugauuuu

SEQ ID NO: 679822 - RNA, 17 nt, Haemophilus influenzae Rd
auuuuguaauaaaaccu

SEQ ID NO: 679823 - RNA, 16 nt, Haemophilus influenzae Rd
auuuuuaauuuucucg

SEQ ID NO: 679824 - RNA, 12 nt, Haemophilus influenzae Rd
auuuuguugcag

SEQ ID NO: 679825 - RNA, 15 nt, Haemophilus influenzae Rd
auuuucgcaucaauc

SEQ ID NO: 679826 - RNA, 22 nt, Haemophilus influenzae Rd
auuuugcguguguuaucacaau

SEQ ID NO: 679827 - RNA, 15 nt, Haemophilus influenzae Rd
auuuuugaauuucac

SEQ ID NO: 679828 - RNA, 20 nt, Haemophilus influenzae Rd
auuuuuaugauuaauuuuau

SEQ ID NO: 679829 - RNA, 19 nt, Haemophilus influenzae Rd
auuuuucaguauuuuuucg

SEQ ID NO: 679830 - RNA, 14 nt, Haemophilus influenzae Rd
auuuuucaaaacgu

SEQ ID NO: 679831 - RNA, 17 nt, Haemophilus influenzae Rd
auuuuuuauaugaguuu

SEQ ID NO: 679832 - RNA, 13 nt, Haemophilus influenzae Rd
auuuuuucugaau

SEQ ID NO: 679833 - RNA, 21 nt, Haemophilus influenzae Rd
auuuuuugcucuuuaacaaua

SEQ ID NO: 679834 - RNA, 21 nt, Haemophilus influenzae Rd
auuuuuuaaccgcuuguguuu

SEQ ID NO: 679835 - RNA, 18 nt, Haemophilus influenzae Rd
auuuuuuauuuuuucuaa

SEQ ID NO: 679836 - RNA, 12 nt, Haemophilus influenzae Rd
auuuuuuucuau

SEQ ID NO: 679837 - RNA, 16 nt, Haemophilus influenzae Rd
caaaagaaauuaagca

SEQ ID NO: 679838 - RNA, 22 nt, Haemophilus influenzae Rd
caaaagagcgguugaaaauuua

SEQ ID NO: 679839 - RNA, 14 nt, Haemophilus influenzae Rd
caaaaguauugagc

SEQ ID NO: 679840 - RNA, 15 nt, Haemophilus influenzae Rd
caaaagauccuucca

SEQ ID NO: 679841 - RNA, 15 nt, Haemophilus influenzae Rd
caaaaaccaaacugc

SEQ ID NO: 679842 - RNA, 22 nt, Haemophilus influenzae Rd
caaaaagaacggucaaaaugca

SEQ ID NO: 679843 - RNA, 20 nt, Haemophilus influenzae Rd
caaaacagacugaaauucug

SEQ ID NO: 679844 - RNA, 22 nt, Haemophilus influenzae Rd
caaaacagggcgacaauuuauc

SEQ ID NO: 679845 - RNA, 15 nt, Haemophilus influenzae Rd
caaaaagucaaaaua

SEQ ID NO: 679846 - RNA, 22 nt, Haemophilus influenzae Rd
caaaaagugcggugauuuuacc

SEQ ID NO: 679847 - RNA, 17 nt, Haemophilus influenzae Rd
caaaaauuugaauguaa

SEQ ID NO: 679848 - RNA, 15 nt, Haemophilus influenzae Rd
caaaaaugcacccgc

SEQ ID NO: 679849 - RNA, 18 nt, Haemophilus influenzae Rd
caaaaaugcucgcuggcu

SEQ ID NO: 679850 - RNA, 19 nt, Haemophilus influenzae Rd
auuuugaaugguuguucug

SEQ ID NO: 679851 - RNA, 22 nt, Haemophilus influenzae Rd
auuuugaaugguuguucuggug

SEQ ID NO: 679852 - RNA, 15 nt, Haemophilus influenzae Rd
auuuucuuguucucc

SEQ ID NO: 679853 - RNA, 17 nt, Haemophilus influenzae Rd
auuuucugcauccaaac

SEQ ID NO: 679854 - RNA, 21 nt, Haemophilus influenzae Rd
auuuucauccauuuacggcuu

SEQ ID NO: 679855 - RNA, 19 nt, Haemophilus influenzae Rd
auuuuccucuuuuauguuu

SEQ ID NO: 679856 - RNA, 16 nt, Haemophilus influenzae Rd
auuuucaccguugccg

SEQ ID NO: 679857 - RNA, 15 nt, Haemophilus influenzae Rd
auuuuccacauuuug

SEQ ID NO: 679858 - RNA, 14 nt, Haemophilus influenzae Rd
auuuuacuaaacgu

SEQ ID NO: 679859 - RNA, 20 nt, Haemophilus influenzae Rd
auuuuaaccaguuuguguuu

SEQ ID NO: 679860 - RNA, 14 nt, Haemophilus influenzae Rd
auuuuaaaucccaa

SEQ ID NO: 679861 - RNA, 21 nt, Haemophilus influenzae Rd
auuuuaaugaaaguaacaaug

SEQ ID NO: 679862 - RNA, 22 nt, Haemophilus influenzae Rd
auuuuaauuaucuaaauuacau

SEQ ID NO: 679863 - RNA, 22 nt, Haemophilus influenzae Rd
auuuuaucuaaucauuaacaaa

SEQ ID NO: 679864 - RNA, 16 nt, Haemophilus influenzae Rd
auuuuauucugcaccu

SEQ ID NO: 679865 - RNA, 15 nt, Haemophilus influenzae Rd
auuugaauuaccaca

SEQ ID NO: 679866 - RNA, 17 nt, Haemophilus influenzae Rd
auuugaccuucauaaac

SEQ ID NO: 679867 - RNA, 22 nt, Haemophilus influenzae Rd
auuucuuuucaaacacaaaaua

SEQ ID NO: 679868 - RNA, 19 nt, Haemophilus influenzae Rd
auuuggucuaacauuucau

SEQ ID NO: 679869 - RNA, 16 nt, Haemophilus influenzae Rd
auuuggaaaccugcaa

SEQ ID NO: 679870 - RNA, 17 nt, Haemophilus influenzae Rd
auuugcuaagauugcaa

SEQ ID NO: 679871 - RNA, 15 nt, Haemophilus influenzae Rd
auuuggcauagaaaa

SEQ ID NO: 679872 - RNA, 18 nt, Haemophilus influenzae Rd
auuugcgauaauuugcau

SEQ ID NO: 679873 - RNA, 17 nt, Haemophilus influenzae Rd
auuugauuuuuauagug

SEQ ID NO: 679874 - RNA, 15 nt, Haemophilus influenzae Rd
auuuuaaauaaaaua

SEQ ID NO: 679875 - RNA, 15 nt, Haemophilus influenzae Rd
auuuguguggaaaaa

SEQ ID NO: 679876 - RNA, 12 nt, Haemophilus influenzae Rd
auuuguagaaag

SEQ ID NO: 679877 - RNA, 21 nt, Haemophilus influenzae Rd
auuuguagaaaggcaauauuu

SEQ ID NO: 679878 - RNA, 18 nt, Haemophilus influenzae Rd
auuugugagcgaucugca

SEQ ID NO: 679879 - RNA, 16 nt, Haemophilus influenzae Rd
caauaaaauuugcgug

SEQ ID NO: 679880 - RNA, 21 nt, Haemophilus influenzae Rd
caauaaacagaaauauugucu

SEQ ID NO: 679881 - RNA, 14 nt, Haemophilus influenzae Rd
caauaauaucugcu

SEQ ID NO: 679882 - RNA, 19 nt, Haemophilus influenzae Rd
caagucugcugaaauacaa

SEQ ID NO: 679883 - RNA, 13 nt, Haemophilus influenzae Rd
caaguuaaaaaau

SEQ ID NO: 679884 - RNA, 20 nt, Haemophilus influenzae Rd
caaguuaaaaaaugauuaag

SEQ ID NO: 679885 - RNA, 18 nt, Haemophilus influenzae Rd
caagugcgguaaaauuuu

SEQ ID NO: 679886 - RNA, 12 nt, Haemophilus influenzae Rd
caagaagauuug

SEQ ID NO: 679887 - RNA, 13 nt, Haemophilus influenzae Rd
caacacuuuauua

SEQ ID NO: 679888 - RNA, 14 nt, Haemophilus influenzae Rd
caacuuaaacaagc

SEQ ID NO: 679889 - RNA, 15 nt, Haemophilus influenzae Rd
caacuuccgcuaaua

SEQ ID NO: 679890 - RNA, 13 nt, Haemophilus influenzae Rd
cacaaugauuaau

SEQ ID NO: 679891 - RNA, 12 nt, Haemophilus influenzae Rd
caaugguuuuac

SEQ ID NO: 679892 - RNA, 20 nt, Haemophilus influenzae Rd
caaugugaccaaauaaucgu

SEQ ID NO: 679893 - RNA, 16 nt, Haemophilus influenzae Rd
caauuugaaaauuuau

SEQ ID NO: 679894 - RNA, 16 nt, Haemophilus influenzae Rd
caauuugagucucaaa

SEQ ID NO: 679895 - RNA, 20 nt, Haemophilus influenzae Rd
caauuugagucucaaauuuu

SEQ ID NO: 679896 - RNA, 21 nt, Haemophilus influenzae Rd
caauuugagucucaaauuuuu

SEQ ID NO: 679897 - RNA, 21 nt, Haemophilus influenzae Rd
caaugaaaucgcaguuucuuu

SEQ ID NO: 679898 - RNA, 20 nt, Haemophilus influenzae Rd
caaucgguuaaaaguaagca

SEQ ID NO: 679899 - RNA, 16 nt, Haemophilus influenzae Rd
caaugaauuaaaaguu

SEQ ID NO: 679900 - RNA, 21 nt, Haemophilus influenzae Rd
caaugccuuuuguauccaauc

SEQ ID NO: 679901 - RNA, 21 nt, Haemophilus influenzae Rd
caauggggguuagguaaaaau

SEQ ID NO: 679902 - RNA, 13 nt, Haemophilus influenzae Rd
caauaccuaacgu

SEQ ID NO: 679903 - RNA, 15 nt, Haemophilus influenzae Rd
caauaccuaacguua

SEQ ID NO: 679904 - RNA, 19 nt, Haemophilus influenzae Rd
caauaauguugcugauugc

SEQ ID NO: 679905 - RNA, 17 nt, Haemophilus influenzae Rd
caauaauugaugcuaaa

SEQ ID NO: 679906 - RNA, 22 nt, Haemophilus influenzae Rd
caauaauugaugcuaaauuaua

SEQ ID NO: 679907 - RNA, 15 nt, Haemophilus influenzae Rd
caauccaaguauuuu

SEQ ID NO: 679908 - RNA, 18 nt, Haemophilus influenzae Rd
caccacgaccuaagaaaa

SEQ ID NO: 679909 - RNA, 17 nt, Haemophilus influenzae Rd
caccagagugaccacca

SEQ ID NO: 679910 - RNA, 16 nt, Haemophilus influenzae Rd
caccacagaaccagca

SEQ ID NO: 679911 - RNA, 16 nt, Haemophilus influenzae Rd
cacaguaccuacauuu

SEQ ID NO: 679912 - RNA, 17 nt, Haemophilus influenzae Rd
cacagucuuuuaacaca

SEQ ID NO: 679913 - RNA, 17 nt, Haemophilus influenzae Rd
cacaccauuuuuaauua

SEQ ID NO: 679914 - RNA, 21 nt, Haemophilus influenzae Rd
cacagauuuuuacuucaucaa

SEQ ID NO: 679915 - RNA, 21 nt, Haemophilus influenzae Rd
cacccauuucaccacuucauc

SEQ ID NO: 679916 - RNA, 14 nt, Haemophilus influenzae Rd
caccuuuaaaaauu

SEQ ID NO: 679917 - RNA, 22 nt, Haemophilus influenzae Rd
caccuucuuuuggauacacaaa

SEQ ID NO: 679918 - RNA, 16 nt, Haemophilus influenzae Rd
caccuuaaaggcugaa

SEQ ID NO: 679919 - RNA, 15 nt, Haemophilus influenzae Rd
cacgaucauaaauuu

SEQ ID NO: 679920 - RNA, 16 nt, Haemophilus influenzae Rd
cacgauuucuaucacg

SEQ ID NO: 679921 - RNA, 20 nt, Haemophilus influenzae Rd
cacuauuaccgcguaaaaau

SEQ ID NO: 679922 - RNA, 23 nt, Haemophilus influenzae Rd
cacuugauuugcuuggaauaaau

SEQ ID NO: 679923 - RNA, 19 nt, Haemophilus influenzae Rd
cacuuggguaaauauaaau

SEQ ID NO: 679924 - RNA, 13 nt, Haemophilus influenzae Rd
cacuucauuaaaa

SEQ ID NO: 679925 - RNA, 22 nt, Haemophilus influenzae Rd
cacuucagaaccugucgcaaug

SEQ ID NO: 679926 - RNA, 14 nt, Haemophilus influenzae Rd
cacuucauauaaau

SEQ ID NO: 679927 - RNA, 16 nt, Haemophilus influenzae Rd
cacuucauauaaauua

SEQ ID NO: 679928 - RNA, 16 nt, Haemophilus influenzae Rd
cagaacccgcuaaagu

SEQ ID NO: 679929 - RNA, 16 nt, Haemophilus influenzae Rd
cacuuuaaaaauaaac

SEQ ID NO: 679930 - RNA, 15 nt, Haemophilus influenzae Rd
cagaaauaucuucaa

SEQ ID NO: 679931 - RNA, 14 nt, Haemophilus influenzae Rd
cagaguuaaaaguc

SEQ ID NO: 679932 - RNA, 20 nt, Haemophilus influenzae Rd
cagauaaaauuggugcaaaa

SEQ ID NO: 679933 - RNA, 13 nt, Haemophilus influenzae Rd
cagauaaaaacug

SEQ ID NO: 679934 - RNA, 13 nt, Haemophilus influenzae Rd
cagacaaguuuaa

SEQ ID NO: 679935 - RNA, 20 nt, Haemophilus influenzae Rd
cagacaaguuuaauacaauc

SEQ ID NO: 679936 - RNA, 13 nt, Haemophilus influenzae Rd
aaagacaauaauu

SEQ ID NO: 679937 - RNA, 14 nt, Haemophilus influenzae Rd
aaagacuaaaacca

SEQ ID NO: 679938 - RNA, 17 nt, Haemophilus influenzae Rd
aaagaguaccacuuuca

SEQ ID NO: 679939 - RNA, 22 nt, Haemophilus influenzae Rd
cagauuaaaaauucaaugaaau

SEQ ID NO: 679940 - RNA, 21 nt, Haemophilus influenzae Rd
cagauuuuuuuauugauuucc

SEQ ID NO: 679941 - RNA, 17 nt, Haemophilus influenzae Rd
cagcggcauuugcauca

SEQ ID NO: 679942 - RNA, 19 nt, Haemophilus influenzae Rd
cagggauuucaauaaauuc

SEQ ID NO: 679943 - RNA, 18 nt, Haemophilus influenzae Rd
aaagauguuccuacagaa

SEQ ID NO: 679944 - RNA, 23 nt, Haemophilus influenzae Rd
cagguuuaauaaucgaaaaaguu

SEQ ID NO: 679945 - RNA, 12 nt, Haemophilus influenzae Rd
caguaccuacau

SEQ ID NO: 679946 - RNA, 20 nt, Haemophilus influenzae Rd
cagucgauacaaguuuuacc

SEQ ID NO: 679947 - RNA, 17 nt, Haemophilus influenzae Rd
caguccccauaucucug

SEQ ID NO: 679948 - RNA, 21 nt, Haemophilus influenzae Rd
caguauuuuuucgaucuaauc

SEQ ID NO: 679949 - RNA, 15 nt, Haemophilus influenzae Rd
cagugauguaaauuu

SEQ ID NO: 679950 - RNA, 17 nt, Haemophilus influenzae Rd
cagucuuuuaacacaua

SEQ ID NO: 679951 - RNA, 14 nt, Haemophilus influenzae Rd
cauccauuccugca

SEQ ID NO: 679952 - RNA, 20 nt, Haemophilus influenzae Rd
caucagcuccuacauuaaaa

SEQ ID NO: 679953 - RNA, 18 nt, Haemophilus influenzae Rd
cauaauguucccuauaaa

SEQ ID NO: 679954 - RNA, 15 nt, Haemophilus influenzae Rd
cauaaugauuucuaa

SEQ ID NO: 679955 - RNA, 22 nt, Haemophilus influenzae Rd
cauaacgcuaucuuuugguaaa

SEQ ID NO: 679956 - RNA, 13 nt, Haemophilus influenzae Rd
caguuaagaaaau

SEQ ID NO: 679957 - RNA, 14 nt, Haemophilus influenzae Rd
cauaauuuauauua

SEQ ID NO: 679958 - RNA, 13 nt, Haemophilus influenzae Rd
cauagaaagcauu

SEQ ID NO: 679959 - RNA, 12 nt, Haemophilus influenzae Rd
cauagaaaucac

SEQ ID NO: 679960 - RNA, 14 nt, Haemophilus influenzae Rd
caucacauuuucaa

SEQ ID NO: 679961 - RNA, 21 nt, Haemophilus influenzae Rd
caucacgccaucgccauucuc

SEQ ID NO: 679962 - RNA, 23 nt, Haemophilus influenzae Rd
caucacggguuugguaagcaaua

SEQ ID NO: 679963 - RNA, 23 nt, Haemophilus influenzae Rd
caucagaaauaucuucaauuucu

SEQ ID NO: 679964 - RNA, 19 nt, Haemophilus influenzae Rd
caucacaaacacguucuaa

SEQ ID NO: 679965 - RNA, 12 nt, Haemophilus influenzae Rd
caucaauuaaug

SEQ ID NO: 679966 - RNA, 23 nt, Haemophilus influenzae Rd
caucaauuaauggaaugauauuc

SEQ ID NO: 679967 - RNA, 15 nt, Haemophilus influenzae Rd
caucaaacacccaau

SEQ ID NO: 679968 - RNA, 22 nt, Haemophilus influenzae Rd
cauauucgacaggaacauucac

SEQ ID NO: 679969 - RNA, 22 nt, Haemophilus influenzae Rd
cauauuuuaaauaauuaaaaau

SEQ ID NO: 679970 - RNA, 23 nt, Haemophilus influenzae Rd
cauauuuuaaauaauuaaaaaua

SEQ ID NO: 679971 - RNA, 22 nt, Haemophilus influenzae Rd
cauagauuaucgccuaaaauug

SEQ ID NO: 679972 - RNA, 19 nt, Haemophilus influenzae Rd
cauagauaaaguauaaguu

SEQ ID NO: 679973 - RNA, 15 nt, Haemophilus influenzae Rd
caucgcuucaucauc

SEQ ID NO: 679974 - RNA, 19 nt, Haemophilus influenzae Rd
caucguuaaaccaaauaau

SEQ ID NO: 679975 - RNA, 17 nt, Haemophilus influenzae Rd
caucuaaacuuauauua

SEQ ID NO: 679976 - RNA, 19 nt, Haemophilus influenzae Rd
caucuaauaauaagauuuu

SEQ ID NO: 679977 - RNA, 20 nt, Haemophilus influenzae Rd
caucuaaugcaggcaacuca

SEQ ID NO: 679978 - RNA, 22 nt, Haemophilus influenzae Rd
caucuacacggagauauuguaa

SEQ ID NO: 679979 - RNA, 18 nt, Haemophilus influenzae Rd
caucucuaaccuaaaaua

SEQ ID NO: 679980 - RNA, 19 nt, Haemophilus influenzae Rd
caucuuccgugacaucauc

SEQ ID NO: 679981 - RNA, 20 nt, Haemophilus influenzae Rd
caucuguugugaaugcaaua

SEQ ID NO: 679982 - RNA, 20 nt, Haemophilus influenzae Rd
caucuugcguuaaaucaaaa

SEQ ID NO: 679983 - RNA, 15 nt, Haemophilus influenzae Rd
caucuuuauaacaua

SEQ ID NO: 679984 - RNA, 21 nt, Haemophilus influenzae Rd
caucuuuuggguuaaauaaug

SEQ ID NO: 679985 - RNA, 18 nt, Haemophilus influenzae Rd
ccaaucccucaaauacac

SEQ ID NO: 679986 - RNA, 14 nt, Haemophilus influenzae Rd
ccaaucaucagaau

SEQ ID NO: 679987 - RNA, 12 nt, Haemophilus influenzae Rd
ccaaucaucauc

SEQ ID NO: 679988 - RNA, 21 nt, Haemophilus influenzae Rd
ccaauauucuuuaaaacauuc

SEQ ID NO: 679989 - RNA, 22 nt, Haemophilus influenzae Rd
ccaagcaaugcuuuaaucauuu

SEQ ID NO: 679990 - RNA, 23 nt, Haemophilus influenzae Rd
ccacaaacuuaccgaucauuucu

SEQ ID NO: 679991 - RNA, 21 nt, Haemophilus influenzae Rd
ccaaugcgagucgcacccgcc

SEQ ID NO: 679992 - RNA, 19 nt, Haemophilus influenzae Rd
ccaauuuuucaaaacguuc

SEQ ID NO: 679993 - RNA, 19 nt, Haemophilus influenzae Rd
aaagccuugauuaucaagg

SEQ ID NO: 679994 - RNA, 15 nt, Haemophilus influenzae Rd
ccaagagucuugcca

SEQ ID NO: 679995 - RNA, 21 nt, Haemophilus influenzae Rd
ccaacauuucacuaaauaaau

SEQ ID NO: 679996 - RNA, 14 nt, Haemophilus influenzae Rd
ccaacauaaacauu

SEQ ID NO: 679997 - RNA, 22 nt, Haemophilus influenzae Rd
ccaaaguuuccuucgccauuuu

SEQ ID NO: 679998 - RNA, 16 nt, Haemophilus influenzae Rd
ccaaauagaugaaauu

SEQ ID NO: 679999 - RNA, 18 nt, Haemophilus influenzae Rd
ccacauuucccuuagauu

SEQ ID NO: 680000 - RNA, 16 nt, Haemophilus influenzae Rd
aaagcuaagacauuca

SEQ ID NO: 680001 - RNA, 17 nt, Haemophilus influenzae Rd
aaagcuacaucaacaaa

SEQ ID NO: 680002 - RNA, 17 nt, Haemophilus influenzae Rd
aaaggauuaaauaacaa

SEQ ID NO: 680003 - RNA, 13 nt, Haemophilus influenzae Rd
aaaggaaagugcg

SEQ ID NO: 680004 - RNA, 23 nt, Haemophilus influenzae Rd
ccagauugguucauaugcgauca

SEQ ID NO: 680005 - RNA, 23 nt, Haemophilus influenzae Rd
ccagauguuggaaauuuaaguga

SEQ ID NO: 680006 - RNA, 19 nt, Haemophilus influenzae Rd
ccagacgguggauuaauug

SEQ ID NO: 680007 - RNA, 20 nt, Haemophilus influenzae Rd
aaauaagaggcauaacccac

SEQ ID NO: 680008 - RNA, 13 nt, Haemophilus influenzae Rd
aaaguuauaaagc

SEQ ID NO: 680009 - RNA, 21 nt, Haemophilus influenzae Rd
aaaguucucgcaaaagugcgg

SEQ ID NO: 680010 - RNA, 22 nt, Haemophilus influenzae Rd
aaaguucucgcaaaagugcggu

SEQ ID NO: 680011 - RNA, 18 nt, Haemophilus influenzae Rd
aaagugaccgccuuuauu

SEQ ID NO: 680012 - RNA, 15 nt, Haemophilus influenzae Rd
aaagugcgguaaaaa

SEQ ID NO: 680013 - RNA, 18 nt, Haemophilus influenzae Rd
aaagugcagcccaaauaa

SEQ ID NO: 680014 - RNA, 22 nt, Haemophilus influenzae Rd
aaaguauuuucuuuccaaccag

SEQ ID NO: 680015 - RNA, 12 nt, Haemophilus influenzae Rd
aaaguaagaauu

SEQ ID NO: 680016 - RNA, 20 nt, Haemophilus influenzae Rd
aaagguugaaugcgccgaua

SEQ ID NO: 680017 - RNA, 17 nt, Haemophilus influenzae Rd
aaaggcugcuugauaua

SEQ ID NO: 680018 - RNA, 15 nt, Haemophilus influenzae Rd
aaaucagcuuuuguu

SEQ ID NO: 680019 - RNA, 20 nt, Haemophilus influenzae Rd
aaaucaucggcuacagguuc

SEQ ID NO: 680020 - RNA, 23 nt, Haemophilus influenzae Rd
aaaucaucguauuaaaagugcgg

SEQ ID NO: 680021 - RNA, 22 nt, Haemophilus influenzae Rd
aaaucaucauauucacuuucau

SEQ ID NO: 680022 - RNA, 13 nt, Haemophilus influenzae Rd
aaaucacuuucau

SEQ ID NO: 680023 - RNA, 18 nt, Haemophilus influenzae Rd
aaaucauuuguaaguugu

SEQ ID NO: 680024 - RNA, 15 nt, Haemophilus influenzae Rd
aaaucccuuagaaaa

SEQ ID NO: 680025 - RNA, 22 nt, Haemophilus influenzae Rd
aaauccgcacgcgugaugaaac

SEQ ID NO: 680026 - RNA, 20 nt, Haemophilus influenzae Rd
ccagcuacauucaucaaaac

SEQ ID NO: 680027 - RNA, 18 nt, Haemophilus influenzae Rd
cccgcuuucgcuucugcu

SEQ ID NO: 680028 - RNA, 22 nt, Haemophilus influenzae Rd
aaauccuuaauuggggauaaau

SEQ ID NO: 680029 - RNA, 15 nt, Haemophilus influenzae Rd
ccauugaaaauacag

SEQ ID NO: 680030 - RNA, 22 nt, Haemophilus influenzae Rd
ccauugguggguucaucuaaua

SEQ ID NO: 680031 - RNA, 14 nt, Haemophilus influenzae Rd
aaaucgcaauuuuu

SEQ ID NO: 680032 - RNA, 16 nt, Haemophilus influenzae Rd
ccauuauuuaucaucc

SEQ ID NO: 680033 - RNA, 17 nt, Haemophilus influenzae Rd
ccauuuggucuaacauu

SEQ ID NO: 680034 - RNA, 15 nt, Haemophilus influenzae Rd
ccauuucuuuuugca

SEQ ID NO: 680035 - RNA, 20 nt, Haemophilus influenzae Rd
ccauuuuuaaccgcacuugc

SEQ ID NO: 680036 - RNA, 11 nt, Haemophilus influenzae Rd
cccaaauaaag

SEQ ID NO: 680037 - RNA, 22 nt, Haemophilus influenzae Rd
ccgaccguguuuuucaucaaug

SEQ ID NO: 680038 - RNA, 20 nt, Haemophilus influenzae Rd
ccgaauauccacuucauuaa

SEQ ID NO: 680039 - RNA, 22 nt, Haemophilus influenzae Rd
cccuuuaaauuacauucccaaa

SEQ ID NO: 680040 - RNA, 19 nt, Haemophilus influenzae Rd
aaaucugccugauuuuuuu

SEQ ID NO: 680041 - RNA, 12 nt, Haemophilus influenzae Rd
aaaucuucgcuc

SEQ ID NO: 680042 - RNA, 21 nt, Haemophilus influenzae Rd
aaaucugugauauauaucaca

SEQ ID NO: 680043 - RNA, 14 nt, Haemophilus influenzae Rd
aaaucuuacugcgc

SEQ ID NO: 680044 - RNA, 15 nt, Haemophilus influenzae Rd
aaaucguuugauaua

SEQ ID NO: 680045 - RNA, 22 nt, Haemophilus influenzae Rd
aaaucuagagauuguaugaaaa

SEQ ID NO: 680046 - RNA, 16 nt, Haemophilus influenzae Rd
cccuaaucguucauaa

SEQ ID NO: 680047 - RNA, 20 nt, Haemophilus influenzae Rd
aaaucuucuuuaccaacuaa

SEQ ID NO: 680048 - RNA, 15 nt, Haemophilus influenzae Rd
aaaucuuuaccaaaa

SEQ ID NO: 680049 - RNA, 20 nt, Haemophilus influenzae Rd
aaaucuuuaucugauuuaau

SEQ ID NO: 680050 - RNA, 14 nt, Haemophilus influenzae Rd
cgaauuacaucauu

SEQ ID NO: 680051 - RNA, 22 nt, Haemophilus influenzae Rd
cgaauuaaacgugauuuaccaa

SEQ ID NO: 680052 - RNA, 17 nt, Haemophilus influenzae Rd
cgaauguggcagcaaag

SEQ ID NO: 680053 - RNA, 10 nt, Haemophilus influenzae Rd
aacaacugcu

SEQ ID NO: 680054 - RNA, 14 nt, Haemophilus influenzae Rd
aacaagaaauuuug

SEQ ID NO: 680055 - RNA, 20 nt, Haemophilus influenzae Rd
aacaagcacaagauuugcca

SEQ ID NO: 680056 - RNA, 12 nt, Haemophilus influenzae Rd
aacaaagugcgg

SEQ ID NO: 680057 - RNA, 16 nt, Haemophilus influenzae Rd
aacaaauaaaaagugg

SEQ ID NO: 680058 - RNA, 22 nt, Haemophilus influenzae Rd
cgaggauuugcgaugauaaagu

SEQ ID NO: 680059 - RNA, 23 nt, Haemophilus influenzae Rd
cgauaaaugcacauuuuuaccaa

SEQ ID NO: 680060 - RNA, 17 nt, Haemophilus influenzae Rd
cgauaaauucaaucgcu

SEQ ID NO: 680061 - RNA, 17 nt, Haemophilus influenzae Rd
cgaguuuuaucuucaaa

SEQ ID NO: 680062 - RNA, 20 nt, Haemophilus influenzae Rd
aacacaucgcuugcauuucu

SEQ ID NO: 680063 - RNA, 21 nt, Haemophilus influenzae Rd
aacacagauuuuuacuucauc

SEQ ID NO: 680064 - RNA, 15 nt, Haemophilus influenzae Rd
cgagauaaaauuuuu

SEQ ID NO: 680065 - RNA, 16 nt, Haemophilus influenzae Rd
aacaagcuggcuuucu

SEQ ID NO: 680066 - RNA, 12 nt, Haemophilus influenzae Rd
cgccaucuaaug

SEQ ID NO: 680067 - RNA, 14 nt, Haemophilus influenzae Rd
cgccauaauaaaaa

SEQ ID NO: 680068 - RNA, 20 nt, Haemophilus influenzae Rd
cgccaauacaaaguguagca

SEQ ID NO: 680069 - RNA, 21 nt, Haemophilus influenzae Rd
cgaugugaccacggauaaaug

SEQ ID NO: 680070 - RNA, 14 nt, Haemophilus influenzae Rd
cgcaaaaauacuaa

SEQ ID NO: 680071 - RNA, 20 nt, Haemophilus influenzae Rd
cgcaaaaccuaacauaaugc

SEQ ID NO: 680072 - RNA, 20 nt, Haemophilus influenzae Rd
cgcaaaauaucacuuuuuua

SEQ ID NO: 680073 - RNA, 12 nt, Haemophilus influenzae Rd
cgcacuuuauua

SEQ ID NO: 680074 - RNA, 20 nt, Haemophilus influenzae Rd
cgcacuuuuaucuauaaaaa

SEQ ID NO: 680075 - RNA, 23 nt, Haemophilus influenzae Rd
cgcacuuuuuuaugacuaauuaa

SEQ ID NO: 680076 - RNA, 21 nt, Haemophilus influenzae Rd
cgcagaccaaagcuguaaaau

SEQ ID NO: 680077 - RNA, 23 nt, Haemophilus influenzae Rd
ccucagauaaugauagaugaauu

SEQ ID NO: 680078 - RNA, 15 nt, Haemophilus influenzae Rd
ccugaugaaaucauu

SEQ ID NO: 680079 - RNA, 22 nt, Haemophilus influenzae Rd
ccugaaagucgauucaaauaac

SEQ ID NO: 680080 - RNA, 16 nt, Haemophilus influenzae Rd
ccucuacggcaauugg

SEQ ID NO: 680081 - RNA, 15 nt, Haemophilus influenzae Rd
ccugacccacaucau

SEQ ID NO: 680082 - RNA, 22 nt, Haemophilus influenzae Rd
ccugacucaacgccacucauau

SEQ ID NO: 680083 - RNA, 13 nt, Haemophilus influenzae Rd
ccugcuacauauu

SEQ ID NO: 680084 - RNA, 18 nt, Haemophilus influenzae Rd
aaauuucgcucaauaauu

SEQ ID NO: 680085 - RNA, 23 nt, Haemophilus influenzae Rd
aaauuucuugcucuaauuuuacc

SEQ ID NO: 680086 - RNA, 18 nt, Haemophilus influenzae Rd
aaauuuaggguauuuauu

SEQ ID NO: 680087 - RNA, 13 nt, Haemophilus influenzae Rd
aaauuuaccgcac

SEQ ID NO: 680088 - RNA, 20 nt, Haemophilus influenzae Rd
aaauuuaccgcacuuugauu

SEQ ID NO: 680089 - RNA, 22 nt, Haemophilus influenzae Rd
ccgucuaaaaauccugaagauu

SEQ ID NO: 680090 - RNA, 21 nt, Haemophilus influenzae Rd
ccgugauaacaacucacaaua

SEQ ID NO: 680091 - RNA, 23 nt, Haemophilus influenzae Rd
ccgugauaacaacucacaauaau

SEQ ID NO: 680092 - RNA, 15 nt, Haemophilus influenzae Rd
ccgcugcucuaccga

SEQ ID NO: 680093 - RNA, 14 nt, Haemophilus influenzae Rd
ccgcuacaaauaag

SEQ ID NO: 680094 - RNA, 18 nt, Haemophilus influenzae Rd
aaaugcuaaauuccccaa

SEQ ID NO: 680095 - RNA, 23 nt, Haemophilus influenzae Rd
aaaugccgccuuuuaauaaauug

SEQ ID NO: 680096 - RNA, 15 nt, Haemophilus influenzae Rd
aaaugccuacuaaac

SEQ ID NO: 680097 - RNA, 21 nt, Haemophilus influenzae Rd
cgcuuguuaauacacuuuuac

SEQ ID NO: 680098 - RNA, 15 nt, Haemophilus influenzae Rd
cggaauagccgcgau

SEQ ID NO: 680099 - RNA, 18 nt, Haemophilus influenzae Rd
cgcuugacgcauuaauug

SEQ ID NO: 680100 - RNA, 14 nt, Haemophilus influenzae Rd
cgcuugcaccaaug

SEQ ID NO: 680101 - RNA, 20 nt, Haemophilus influenzae Rd
cgcuguccaauauaaacguu

SEQ ID NO: 680102 - RNA, 20 nt, Haemophilus influenzae Rd
cgcugauucuaaugccauug

SEQ ID NO: 680103 - RNA, 16 nt, Haemophilus influenzae Rd
cgcugcagcugcugcu

SEQ ID NO: 680104 - RNA, 20 nt, Haemophilus influenzae Rd
aacacgccaccauuuguaau

SEQ ID NO: 680105 - RNA, 20 nt, Haemophilus influenzae Rd
aacacgaaaccaacgaaaau

SEQ ID NO: 680106 - RNA, 13 nt, Haemophilus influenzae Rd
aaccauuuucucu

SEQ ID NO: 680107 - RNA, 22 nt, Haemophilus influenzae Rd
aaccauuuucucugcgauuucu

SEQ ID NO: 680108 - RNA, 23 nt, Haemophilus influenzae Rd
aaccaucuguugcgacaccacca

SEQ ID NO: 680109 - RNA, 22 nt, Haemophilus influenzae Rd
aaccauaaaaaauggaauaaaa

SEQ ID NO: 680110 - RNA, 21 nt, Haemophilus influenzae Rd
aaccauacaacgaguuaagua

SEQ ID NO: 680111 - RNA, 17 nt, Haemophilus influenzae Rd
cgguaaauuuuaaaaua

SEQ ID NO: 680112 - RNA, 14 nt, Haemophilus influenzae Rd
aacauuuuuucaac

SEQ ID NO: 680113 - RNA, 13 nt, Haemophilus influenzae Rd
aaccaaaaccaca

SEQ ID NO: 680114 - RNA, 16 nt, Haemophilus influenzae Rd
cggcuaaauugugccg

SEQ ID NO: 680115 - RNA, 23 nt, Haemophilus influenzae Rd
aacaguuuucaaauuaaccgcac

SEQ ID NO: 680116 - RNA, 12 nt, Haemophilus influenzae Rd
ggcauuggcaag

SEQ ID NO: 680117 - RNA, 12 nt, Haemophilus influenzae Rd
ggcacauaagua

SEQ ID NO: 680118 - RNA, 22 nt, Haemophilus influenzae Rd
ggcacauaaguaaaauagucac

SEQ ID NO: 680119 - RNA, 19 nt, Haemophilus influenzae Rd
ggcaaacguggucgcagug

SEQ ID NO: 680120 - RNA, 12 nt, Haemophilus influenzae Rd
ggaugcuaauuc

SEQ ID NO: 680121 - RNA, 14 nt, Haemophilus influenzae Rd
ggcggauuuauuau

SEQ ID NO: 680122 - RNA, 17 nt, Haemophilus influenzae Rd
ggcgaugacauuguugu

SEQ ID NO: 680123 - RNA, 17 nt, Haemophilus influenzae Rd
ggcuuuaagcuuuucua

SEQ ID NO: 680124 - RNA, 23 nt, Haemophilus influenzae Rd
ggcuuuuguuuauaucuuuauua

SEQ ID NO: 680125 - RNA, 17 nt, Haemophilus influenzae Rd
ggcuuaguuaaauauaa

SEQ ID NO: 680126 - RNA, 15 nt, Haemophilus influenzae Rd
ggcguucauaucuuu

SEQ ID NO: 680127 - RNA, 17 nt, Haemophilus influenzae Rd
ggcguuuacuuggcauu

SEQ ID NO: 680128 - RNA, 19 nt, Haemophilus influenzae Rd
ggcuacuuuauuuacccaa

SEQ ID NO: 680129 - RNA, 14 nt, Haemophilus influenzae Rd
gguuugaaauuuau

SEQ ID NO: 680130 - RNA, 15 nt, Haemophilus influenzae Rd
gguuugcacuuuaaa

SEQ ID NO: 680131 - RNA, 23 nt, Haemophilus influenzae Rd
guaaugucuuuaggauuguugau

SEQ ID NO: 680132 - RNA, 14 nt, Haemophilus influenzae Rd
guaauggaauaugg

SEQ ID NO: 680133 - RNA, 20 nt, Haemophilus influenzae Rd
aagucguuucaucgagaaau

SEQ ID NO: 680134 - RNA, 13 nt, Haemophilus influenzae Rd
guauacuuuauaa

SEQ ID NO: 680135 - RNA, 20 nt, Haemophilus influenzae Rd
guauaagcuaaagcaauugc

SEQ ID NO: 680136 - RNA, 12 nt, Haemophilus influenzae Rd
gguucaauaaug

SEQ ID NO: 680137 - RNA, 17 nt, Haemophilus influenzae Rd
gguucgauaucuaaaau

SEQ ID NO: 680138 - RNA, 20 nt, Haemophilus influenzae Rd
gguuacagaaauauuauuaa

SEQ ID NO: 680139 - RNA, 13 nt, Haemophilus influenzae Rd
gguuaauuuucac

SEQ ID NO: 680140 - RNA, 14 nt, Haemophilus influenzae Rd
gguuuaaauuuuaa

SEQ ID NO: 680141 - RNA, 18 nt, Haemophilus influenzae Rd
ggugggcugaagcccacc

SEQ ID NO: 680142 - RNA, 19 nt, Haemophilus influenzae Rd
ggugggcugaagcccaccc

SEQ ID NO: 680143 - RNA, 20 nt, Haemophilus influenzae Rd
ggguaaaauaaugcaaaaac

SEQ ID NO: 680144 - RNA, 13 nt, Haemophilus influenzae Rd
gguacaaauuuag

SEQ ID NO: 680145 - RNA, 21 nt, Haemophilus influenzae Rd
gguacauguugggcuaaaaau

SEQ ID NO: 680146 - RNA, 21 nt, Haemophilus influenzae Rd
gguagacacaagggauuuaaa

SEQ ID NO: 680147 - RNA, 18 nt, Haemophilus influenzae Rd
gugaaauucuaccugcug

SEQ ID NO: 680148 - RNA, 17 nt, Haemophilus influenzae Rd
gugaacuuucaauaauc

SEQ ID NO: 680149 - RNA, 17 nt, Haemophilus influenzae Rd
gugaacuuugugccauu

SEQ ID NO: 680150 - RNA, 21 nt, Haemophilus influenzae Rd
gugaaugcauuggcugaauuu

SEQ ID NO: 680151 - RNA, 19 nt, Haemophilus influenzae Rd
gucuaagguuuccauaaug

SEQ ID NO: 680152 - RNA, 20 nt, Haemophilus influenzae Rd
gucguuuugauuuaggcauu

SEQ ID NO: 680153 - RNA, 21 nt, Haemophilus influenzae Rd
gucugcgccuaaaauauuuuc

SEQ ID NO: 680154 - RNA, 18 nt, Haemophilus influenzae Rd
gucuucaagucuuuuuuu

SEQ ID NO: 680155 - RNA, 23 nt, Haemophilus influenzae Rd
gucuugaaaaccggcgaggguuu

SEQ ID NO: 680156 - RNA, 13 nt, Haemophilus influenzae Rd
gucuuuuggcguu

SEQ ID NO: 680157 - RNA, 14 nt, Haemophilus influenzae Rd
gcucuuuuaucucg

SEQ ID NO: 680158 - RNA, 16 nt, Haemophilus influenzae Rd
gcugaaauaccuucuu

SEQ ID NO: 680159 - RNA, 19 nt, Haemophilus influenzae Rd
gcugaaagaaauuuuaucc

SEQ ID NO: 680160 - RNA, 23 nt, Haemophilus influenzae Rd
gcugacaaauuuguugaucugca

SEQ ID NO: 680161 - RNA, 14 nt, Haemophilus influenzae Rd
gcugaaauuuagug

SEQ ID NO: 680162 - RNA, 21 nt, Haemophilus influenzae Rd
gcugaucuacacgaauuaguu

SEQ ID NO: 680163 - RNA, 15 nt, Haemophilus influenzae Rd
gcuuucuuauucagu

SEQ ID NO: 680164 - RNA, 16 nt, Haemophilus influenzae Rd
gcuuuuuccucagcaa

SEQ ID NO: 680165 - RNA, 22 nt, Haemophilus influenzae Rd
gcuuuuaaaauacugcacaauc

SEQ ID NO: 680166 - RNA, 14 nt, Haemophilus influenzae Rd
ggaaagucgcagua

SEQ ID NO: 680167 - RNA, 15 nt, Haemophilus influenzae Rd
gcuugugaaauaaaa

SEQ ID NO: 680168 - RNA, 22 nt, Haemophilus influenzae Rd
gcuuucagauaacguaaguaau

SEQ ID NO: 680169 - RNA, 14 nt, Haemophilus influenzae Rd
gcuuucaauuaaug

SEQ ID NO: 680170 - RNA, 22 nt, Haemophilus influenzae Rd
gcuugguaauaaucaauuaaug

SEQ ID NO: 680171 - RNA, 13 nt, Haemophilus influenzae Rd
gcuuccauuugga

SEQ ID NO: 680172 - RNA, 19 nt, Haemophilus influenzae Rd
gcuucgggcaccauuuaaa

SEQ ID NO: 680173 - RNA, 17 nt, Haemophilus influenzae Rd
gcuucgcgcuaaaucau

SEQ ID NO: 680174 - RNA, 15 nt, Haemophilus influenzae Rd
gcuugaauaaaugac

SEQ ID NO: 680175 - RNA, 16 nt, Haemophilus influenzae Rd
gcuucuuuaucggcaa

SEQ ID NO: 680176 - RNA, 21 nt, Haemophilus influenzae Rd
gcuucgugaauacgaucugca

SEQ ID NO: 680177 - RNA, 14 nt, Haemophilus influenzae Rd
gcuguagaaauuaa

SEQ ID NO: 680178 - RNA, 19 nt, Haemophilus influenzae Rd
gcuuaauggaccaauuggu

SEQ ID NO: 680179 - RNA, 16 nt, Haemophilus influenzae Rd
gcuuaauucuugccau

SEQ ID NO: 680180 - RNA, 17 nt, Haemophilus influenzae Rd
gcuuaccuuaauuaauc

SEQ ID NO: 680181 - RNA, 17 nt, Haemophilus influenzae Rd
gcuuaaagcaaucaaaa

SEQ ID NO: 680182 - RNA, 20 nt, Haemophilus influenzae Rd
gcuuacucauuuaucaaaca

SEQ ID NO: 680183 - RNA, 13 nt, Haemophilus influenzae Rd
gcuucaaucgcaa

SEQ ID NO: 680184 - RNA, 22 nt, Haemophilus influenzae Rd
gcuuauggagggggauaacgac

SEQ ID NO: 680185 - RNA, 16 nt, Haemophilus influenzae Rd
gcuucagaaaauaaau

SEQ ID NO: 680186 - RNA, 17 nt, Haemophilus influenzae Rd
gcguagaaugcaaacau

SEQ ID NO: 680187 - RNA, 15 nt, Haemophilus influenzae Rd
gcguggauaaucgau

SEQ ID NO: 680188 - RNA, 14 nt, Haemophilus influenzae Rd
gcguuaaaucacaa

SEQ ID NO: 680189 - RNA, 19 nt, Haemophilus influenzae Rd
gcguguuucgcgugauuua

SEQ ID NO: 680190 - RNA, 16 nt, Haemophilus influenzae Rd
aaggacuaaacuuuua

SEQ ID NO: 680191 - RNA, 13 nt, Haemophilus influenzae Rd
gcggucuuuuuuu

SEQ ID NO: 680192 - RNA, 16 nt, Haemophilus influenzae Rd
gcggucugaaaaucaa

SEQ ID NO: 680193 - RNA, 14 nt, Haemophilus influenzae Rd
gcgguugauuuucc

SEQ ID NO: 680194 - RNA, 18 nt, Haemophilus influenzae Rd
gcgguucuuguuuuaaau

SEQ ID NO: 680195 - RNA, 13 nt, Haemophilus influenzae Rd
gcguaaaccuaca

SEQ ID NO: 680196 - RNA, 13 nt, Haemophilus influenzae Rd
aagcguuuuaaaa

SEQ ID NO: 680197 - RNA, 16 nt, Haemophilus influenzae Rd
aagcuaagaaaaucca

SEQ ID NO: 680198 - RNA, 12 nt, Haemophilus influenzae Rd
aagcgauaaaua

SEQ ID NO: 680199 - RNA, 18 nt, Haemophilus influenzae Rd
aagcggauuuguuaagua

SEQ ID NO: 680200 - RNA, 18 nt, Haemophilus influenzae Rd
gccuugugcauaaacaaa

SEQ ID NO: 680201 - RNA, 13 nt, Haemophilus influenzae Rd
gccuuuaaaguca

SEQ ID NO: 680202 - RNA, 23 nt, Haemophilus influenzae Rd
gcgacagaggggauaaaauaaac

SEQ ID NO: 680203 - RNA, 15 nt, Haemophilus influenzae Rd
gccuagauauuucua

SEQ ID NO: 680204 - RNA, 18 nt, Haemophilus influenzae Rd
aagccaauagauuacgua

SEQ ID NO: 680205 - RNA, 20 nt, Haemophilus influenzae Rd
gccucagcgugaauauaaga

SEQ ID NO: 680206 - RNA, 20 nt, Haemophilus influenzae Rd
gaugauggccaugacaagca

SEQ ID NO: 680207 - RNA, 16 nt, Haemophilus influenzae Rd
gaucucagaauuuauu

SEQ ID NO: 680208 - RNA, 22 nt, Haemophilus influenzae Rd
gaucugcaucuaauucacuacc

SEQ ID NO: 680209 - RNA, 17 nt, Haemophilus influenzae Rd
gaugaccucgcuauaaa

SEQ ID NO: 680210 - RNA, 18 nt, Haemophilus influenzae Rd
gaugacauaucaauuugc

SEQ ID NO: 680211 - RNA, 21 nt, Haemophilus influenzae Rd
gaugaaaaaaagugcgguuga

SEQ ID NO: 680212 - RNA, 18 nt, Haemophilus influenzae Rd
gaugaaaugccgauaaua

SEQ ID NO: 680213 - RNA, 15 nt, Haemophilus influenzae Rd
gaugaaauuuauuau

SEQ ID NO: 680214 - RNA, 14 nt, Haemophilus influenzae Rd
gauuaaacaaccaa

SEQ ID NO: 680215 - RNA, 15 nt, Haemophilus influenzae Rd
gauuaaugcuauaaa

SEQ ID NO: 680216 - RNA, 23 nt, Haemophilus influenzae Rd
gauuaauuuuccuaacaauaauu

SEQ ID NO: 680217 - RNA, 12 nt, Haemophilus influenzae Rd
gauucacuaauu

SEQ ID NO: 680218 - RNA, 14 nt, Haemophilus influenzae Rd
gauucgauaaauua

SEQ ID NO: 680219 - RNA, 16 nt, Haemophilus influenzae Rd
gauucgccuugcuuuu

SEQ ID NO: 680220 - RNA, 16 nt, Haemophilus influenzae Rd
gauuuuuucuaaucca

SEQ ID NO: 680221 - RNA, 23 nt, Haemophilus influenzae Rd
gauuuauacgugaaccaacccaa

SEQ ID NO: 680222 - RNA, 15 nt, Haemophilus influenzae Rd
gauuuuaaaauaaau

SEQ ID NO: 680223 - RNA, 21 nt, Haemophilus influenzae Rd
gauuuuccccgcucuuuccau

SEQ ID NO: 680224 - RNA, 14 nt, Haemophilus influenzae Rd
gauuuucacuaauu

SEQ ID NO: 680225 - RNA, 20 nt, Haemophilus influenzae Rd
gcaaagugcgguaagaaaau

SEQ ID NO: 680226 - RNA, 17 nt, Haemophilus influenzae Rd
gcaaaguuaccauuuau

SEQ ID NO: 680227 - RNA, 19 nt, Haemophilus influenzae Rd
gcaaaugaggaaaauaaag

SEQ ID NO: 680228 - RNA, 20 nt, Haemophilus influenzae Rd
aacuugauugauaaauugac

SEQ ID NO: 680229 - RNA, 22 nt, Haemophilus influenzae Rd
gaucaccaagacuauuaaguuc

SEQ ID NO: 680230 - RNA, 13 nt, Haemophilus influenzae Rd
gauauuuuuauca

SEQ ID NO: 680231 - RNA, 19 nt, Haemophilus influenzae Rd
gauauggcguucacguaau

SEQ ID NO: 680232 - RNA, 14 nt, Haemophilus influenzae Rd
gauauuaaacaguc

SEQ ID NO: 680233 - RNA, 16 nt, Haemophilus influenzae Rd
gauauauuauuuacaa

SEQ ID NO: 680234 - RNA, 18 nt, Haemophilus influenzae Rd
gauauauuaacuugcuau

SEQ ID NO: 680235 - RNA, 18 nt, Haemophilus influenzae Rd
gauagccguccauuucaa

SEQ ID NO: 680236 - RNA, 18 nt, Haemophilus influenzae Rd
gauaacccuccgcauuaa

SEQ ID NO: 680237 - RNA, 14 nt, Haemophilus influenzae Rd
gauaacaaauugcu

SEQ ID NO: 680238 - RNA, 17 nt, Haemophilus influenzae Rd
gauaagguauguaccau

SEQ ID NO: 680239 - RNA, 20 nt, Haemophilus influenzae Rd
gagcuuuauuauuggcuauu

SEQ ID NO: 680240 - RNA, 14 nt, Haemophilus influenzae Rd
aacugccaaacaaa

SEQ ID NO: 680241 - RNA, 15 nt, Haemophilus influenzae Rd
aacugcaacaauuuc

SEQ ID NO: 680242 - RNA, 15 nt, Haemophilus influenzae Rd
gagcggucaauuuuu

SEQ ID NO: 680243 - RNA, 16 nt, Haemophilus influenzae Rd
aacucuggacaagcca

SEQ ID NO: 680244 - RNA, 22 nt, Haemophilus influenzae Rd
gcagcuaacaaaauuaaugcca

SEQ ID NO: 680245 - RNA, 22 nt, Haemophilus influenzae Rd
gcagccgcuuuuacguaugaca

SEQ ID NO: 680246 - RNA, 17 nt, Haemophilus influenzae Rd
gcaguaacuucugcugc

SEQ ID NO: 680247 - RNA, 17 nt, Haemophilus influenzae Rd
gcaguagccuauaacga

SEQ ID NO: 680248 - RNA, 14 nt, Haemophilus influenzae Rd
aagaacggucaaaa

SEQ ID NO: 680249 - RNA, 17 nt, Haemophilus influenzae Rd
aagaaauacaauccuug

SEQ ID NO: 680250 - RNA, 18 nt, Haemophilus influenzae Rd
aagaaauauuuuuaccgc

SEQ ID NO: 680251 - RNA, 14 nt, Haemophilus influenzae Rd
aagaagugaaauua

SEQ ID NO: 680252 - RNA, 20 nt, Haemophilus influenzae Rd
gcaauuucccagccuacaac

SEQ ID NO: 680253 - RNA, 17 nt, Haemophilus influenzae Rd
gcaauucugcucugcac

SEQ ID NO: 680254 - RNA, 13 nt, Haemophilus influenzae Rd
gcaacaucaaacc

SEQ ID NO: 680255 - RNA, 11 nt, Haemophilus influenzae Rd
gcacaaucgca

SEQ ID NO: 680256 - RNA, 15 nt, Haemophilus influenzae Rd
gcacaaaaaauucuu

SEQ ID NO: 680257 - RNA, 18 nt, Haemophilus influenzae Rd
gcaccaauaccaauaauu

SEQ ID NO: 680258 - RNA, 12 nt, Haemophilus influenzae Rd
gcacauaacaaa

SEQ ID NO: 680259 - RNA, 18 nt, Haemophilus influenzae Rd
gcagauuuuuuuauugau

SEQ ID NO: 680260 - RNA, 17 nt, Haemophilus influenzae Rd
aacuuuugcaaaauugc

SEQ ID NO: 680261 - RNA, 11 nt, Haemophilus influenzae Rd
aacuuuuaaag

SEQ ID NO: 680262 - RNA, 16 nt, Haemophilus influenzae Rd
gcacuuuuaauuaaua

SEQ ID NO: 680263 - RNA, 20 nt, Haemophilus influenzae Rd
gcacuuuuggauaaaguauu

SEQ ID NO: 680264 - RNA, 14 nt, Haemophilus influenzae Rd
gcacuuuuuuaucg

SEQ ID NO: 680265 - RNA, 22 nt, Haemophilus influenzae Rd
gccacuugugcaucaaagcguu

SEQ ID NO: 680266 - RNA, 15 nt, Haemophilus influenzae Rd
gccacuguugugaag

SEQ ID NO: 680267 - RNA, 19 nt, Haemophilus influenzae Rd
gccacuucagcuaauaaag

SEQ ID NO: 680268 - RNA, 13 nt, Haemophilus influenzae Rd
gccaccauuuggu

SEQ ID NO: 680269 - RNA, 18 nt, Haemophilus influenzae Rd
gccaauaaaaaguacagc

SEQ ID NO: 680270 - RNA, 12 nt, Haemophilus influenzae Rd
gccaagugcagc

SEQ ID NO: 680271 - RNA, 18 nt, Haemophilus influenzae Rd
gccaaguccccauuugua

SEQ ID NO: 680272 - RNA, 22 nt, Haemophilus influenzae Rd
gccaaguccccauuuguagaaa

SEQ ID NO: 680273 - RNA, 15 nt, Haemophilus influenzae Rd
aagagaggagaaaua

SEQ ID NO: 680274 - RNA, 18 nt, Haemophilus influenzae Rd
gccccaauggggcuuuuu

SEQ ID NO: 680275 - RNA, 19 nt, Haemophilus influenzae Rd
aagacaccugcaagugcgg

SEQ ID NO: 680276 - RNA, 14 nt, Haemophilus influenzae Rd
gccauugugauguu

SEQ ID NO: 680277 - RNA, 18 nt, Haemophilus influenzae Rd
gcccaaucuagaagauca

SEQ ID NO: 680278 - RNA, 14 nt, Haemophilus influenzae Rd
gccauuuuuuccua

SEQ ID NO: 680279 - RNA, 20 nt, Haemophilus influenzae Rd
gccauuuucgguuaaguaau

SEQ ID NO: 680280 - RNA, 17 nt, Haemophilus influenzae Rd
gccauuuucugcaucca

SEQ ID NO: 680281 - RNA, 13 nt, Haemophilus influenzae Rd
gccauuuuuaaaa

SEQ ID NO: 680282 - RNA, 13 nt, Haemophilus influenzae Rd
gcccacauuugga

SEQ ID NO: 680283 - RNA, 19 nt, Haemophilus influenzae Rd
gcccugugccguaaaacuc

SEQ ID NO: 680284 - RNA, 13 nt, Haemophilus influenzae Rd
gccgaaaauuuac

SEQ ID NO: 680285 - RNA, 18 nt, Haemophilus influenzae Rd
aagaucauuuuuuuaaau

SEQ ID NO: 680286 - RNA, 18 nt, Haemophilus influenzae Rd
aagaucaauauaaccuug

SEQ ID NO: 680287 - RNA, 14 nt, Haemophilus influenzae Rd
aagauaauaaaugc

SEQ ID NO: 680288 - RNA, 15 nt, Haemophilus influenzae Rd
aagauaccaauaauc

SEQ ID NO: 680289 - RNA, 22 nt, Haemophilus influenzae Rd
aagcaauuucaucacaucaaua

SEQ ID NO: 680290 - RNA, 21 nt, Haemophilus influenzae Rd
aagauuuuucuugcuauucuu

SEQ ID NO: 680291 - RNA, 16 nt, Haemophilus influenzae Rd
aagauuuuugauaaaa

SEQ ID NO: 680292 - RNA, 16 nt, Haemophilus influenzae Rd
aagauuuuauacauuc

SEQ ID NO: 680293 - RNA, 12 nt, Haemophilus influenzae Rd
aagauuuucucg

SEQ ID NO: 680294 - RNA, 12 nt, Haemophilus influenzae Rd
aagauuuuaaaa

SEQ ID NO: 680295 - RNA, 17 nt, Haemophilus influenzae Rd
cuggcacaucaaauucu

SEQ ID NO: 680296 - RNA, 23 nt, Haemophilus influenzae Rd
cuggcaaaaaugucaggcgauuu

SEQ ID NO: 680297 - RNA, 14 nt, Haemophilus influenzae Rd
cuggcuaaauuuuu

SEQ ID NO: 680298 - RNA, 15 nt, Haemophilus influenzae Rd
cugugccuagggcaa

SEQ ID NO: 680299 - RNA, 19 nt, Haemophilus influenzae Rd
cuguuuucauuauauuuaa

SEQ ID NO: 680300 - RNA, 20 nt, Haemophilus influenzae Rd
cuguuacuaaaucgcccaac

SEQ ID NO: 680301 - RNA, 17 nt, Haemophilus influenzae Rd
cuuaaaugggaaacuga

SEQ ID NO: 680302 - RNA, 14 nt, Haemophilus influenzae Rd
cuuaaauucauaau

SEQ ID NO: 680303 - RNA, 20 nt, Haemophilus influenzae Rd
cuuaauagcugggcaaaauc

SEQ ID NO: 680304 - RNA, 21 nt, Haemophilus influenzae Rd
cuuaauagcugggcaaaauca

SEQ ID NO: 680305 - RNA, 22 nt, Haemophilus influenzae Rd
cuuaauaggugcuuaacugaaa

SEQ ID NO: 680306 - RNA, 15 nt, Haemophilus influenzae Rd
cuuaacuaauuguuu

SEQ ID NO: 680307 - RNA, 16 nt, Haemophilus influenzae Rd
cuuaauaaauauugau

SEQ ID NO: 680308 - RNA, 17 nt, Haemophilus influenzae Rd
cuucaucugcaucacaa

SEQ ID NO: 680309 - RNA, 20 nt, Haemophilus influenzae Rd
cuuccacaacggaagauuua

SEQ ID NO: 680310 - RNA, 23 nt, Haemophilus influenzae Rd
cuucaacaacgauaucggauucu

SEQ ID NO: 680311 - RNA, 23 nt, Haemophilus influenzae Rd
cuuauuaagguaauauguaauau

SEQ ID NO: 680312 - RNA, 16 nt, Haemophilus influenzae Rd
cuuauucaaacgcccu

SEQ ID NO: 680313 - RNA, 20 nt, Haemophilus influenzae Rd
cuucgaaaauaacuucaucc

SEQ ID NO: 680314 - RNA, 16 nt, Haemophilus influenzae Rd
cuuggaaauguuuaau

SEQ ID NO: 680315 - RNA, 14 nt, Haemophilus influenzae Rd
cuugcugauaaauu

SEQ ID NO: 680316 - RNA, 13 nt, Haemophilus influenzae Rd
cuugcguuaaauc

SEQ ID NO: 680317 - RNA, 20 nt, Haemophilus influenzae Rd
cuugcguuugguucaucauu

SEQ ID NO: 680318 - RNA, 15 nt, Haemophilus influenzae Rd
cuucuaaaggcuaaa

SEQ ID NO: 680319 - RNA, 15 nt, Haemophilus influenzae Rd
cuugggaaucuggcu

SEQ ID NO: 680320 - RNA, 16 nt, Haemophilus influenzae Rd
cuuuaagcuuuucuac

SEQ ID NO: 680321 - RNA, 12 nt, Haemophilus influenzae Rd
cuuuaauuguuu

SEQ ID NO: 680322 - RNA, 22 nt, Haemophilus influenzae Rd
cuuuacucauaucuaaagcauu

SEQ ID NO: 680323 - RNA, 13 nt, Haemophilus influenzae Rd
cuuuaaauuguuu

SEQ ID NO: 680324 - RNA, 14 nt, Haemophilus influenzae Rd
cuuuaacaccaaua

SEQ ID NO: 680325 - RNA, 14 nt, Haemophilus influenzae Rd
cuugugaaauaaaa

SEQ ID NO: 680326 - RNA, 17 nt, Haemophilus influenzae Rd
aaccgugcucaauuucu

SEQ ID NO: 680327 - RNA, 11 nt, Haemophilus influenzae Rd
cuuuauuuaga

SEQ ID NO: 680328 - RNA, 22 nt, Haemophilus influenzae Rd
cuuuauuucauaucucacaaua

SEQ ID NO: 680329 - RNA, 23 nt, Haemophilus influenzae Rd
cuuuuccaguauagugcgcauau

SEQ ID NO: 680330 - RNA, 16 nt, Haemophilus influenzae Rd
cuuuuaauaugcugac

SEQ ID NO: 680331 - RNA, 21 nt, Haemophilus influenzae Rd
cuuuugaggcuaauaaugcca

SEQ ID NO: 680332 - RNA, 14 nt, Haemophilus influenzae Rd
cuuuuguagaaaag

SEQ ID NO: 680333 - RNA, 23 nt, Haemophilus influenzae Rd
cuuuuggauacacaaauugaaga

SEQ ID NO: 680334 - RNA, 21 nt, Haemophilus influenzae Rd
cuuuuggguuaaauaaugccc

SEQ ID NO: 680335 - RNA, 16 nt, Haemophilus influenzae Rd
cuuuuuccucagcaaa

SEQ ID NO: 680336 - RNA, 17 nt, Haemophilus influenzae Rd
cuuuuuuauucuccaaa

SEQ ID NO: 680337 - RNA, 14 nt, Haemophilus influenzae Rd
cuuuuuucaaugcu

SEQ ID NO: 680338 - RNA, 17 nt, Haemophilus influenzae Rd
cuuuuuucucaauaccu

SEQ ID NO: 680339 - RNA, 19 nt, Haemophilus influenzae Rd
cuuugguuuaguuuacuuu

SEQ ID NO: 680340 - RNA, 19 nt, Haemophilus influenzae Rd
cuuucauucguauaaauau

SEQ ID NO: 680341 - RNA, 17 nt, Haemophilus influenzae Rd
cuuuccaaucauauuuc

SEQ ID NO: 680342 - RNA, 13 nt, Haemophilus influenzae Rd
cuuucuuauauuc

SEQ ID NO: 680343 - RNA, 18 nt, Haemophilus influenzae Rd
cuuucuacgacauuuuua

SEQ ID NO: 680344 - RNA, 18 nt, Haemophilus influenzae Rd
gaaccauagaaagcauug

SEQ ID NO: 680345 - RNA, 15 nt, Haemophilus influenzae Rd
gaacguucacguaag

SEQ ID NO: 680346 - RNA, 11 nt, Haemophilus influenzae Rd
gaaaaugguua

SEQ ID NO: 680347 - RNA, 20 nt, Haemophilus influenzae Rd
gaaaauucucuucaacuugc

SEQ ID NO: 680348 - RNA, 22 nt, Haemophilus influenzae Rd
gaaaauuggcgcgccgauaugg

SEQ ID NO: 680349 - RNA, 15 nt, Haemophilus influenzae Rd
gaaaaucgcaauaaa

SEQ ID NO: 680350 - RNA, 17 nt, Haemophilus influenzae Rd
aaccuugcugauaaauu

SEQ ID NO: 680351 - RNA, 19 nt, Haemophilus influenzae Rd
aaccuuauuuuaaauaaaa

SEQ ID NO: 680352 - RNA, 19 nt, Haemophilus influenzae Rd
aaccuuuagacaacaacuu

SEQ ID NO: 680353 - RNA, 23 nt, Haemophilus influenzae Rd
aaccguuuuuauuuguucuacuu

SEQ ID NO: 680354 - RNA, 23 nt, Haemophilus influenzae Rd
aaccuaauuguucagcaauuucu

SEQ ID NO: 680355 - RNA, 22 nt, Haemophilus influenzae Rd
gaaaaguucagauucaauaaua

SEQ ID NO: 680356 - RNA, 21 nt, Haemophilus influenzae Rd
gaaaauacuguuuuaugcuaa

SEQ ID NO: 680357 - RNA, 16 nt, Haemophilus influenzae Rd
gaaaagugcggucgau

SEQ ID NO: 680358 - RNA, 14 nt, Haemophilus influenzae Rd
gaaaagcauggauu

SEQ ID NO: 680359 - RNA, 16 nt, Haemophilus influenzae Rd
gaacaccuugcguguu

SEQ ID NO: 680360 - RNA, 22 nt, Haemophilus influenzae Rd
gaacaauuaauacgucaauugc

SEQ ID NO: 680361 - RNA, 15 nt, Haemophilus influenzae Rd
gaaauuaaaauaaua

SEQ ID NO: 680362 - RNA, 18 nt, Haemophilus influenzae Rd
gaaauuuauguuacaaau

SEQ ID NO: 680363 - RNA, 16 nt, Haemophilus influenzae Rd
gaaauucgcuuuuuua

SEQ ID NO: 680364 - RNA, 16 nt, Haemophilus influenzae Rd
gaaauugccaaaaaag

SEQ ID NO: 680365 - RNA, 22 nt, Haemophilus influenzae Rd
gaaauagacuacuuaaaauuca

SEQ ID NO: 680366 - RNA, 14 nt, Haemophilus influenzae Rd
gaaauauaauaaau

SEQ ID NO: 680367 - RNA, 20 nt, Haemophilus influenzae Rd
gaaauaauauucaaaacauu

SEQ ID NO: 680368 - RNA, 15 nt, Haemophilus influenzae Rd
gaaauacaaagcacu

SEQ ID NO: 680369 - RNA, 18 nt, Haemophilus influenzae Rd
gaaauaaacgcaucaacu

SEQ ID NO: 680370 - RNA, 12 nt, Haemophilus influenzae Rd
gaaauaaaucua

SEQ ID NO: 680371 - RNA, 21 nt, Haemophilus influenzae Rd
gaaaguuuaacuuucaacacg

SEQ ID NO: 680372 - RNA, 21 nt, Haemophilus influenzae Rd
gaaacuacggacuaaauaaau

SEQ ID NO: 680373 - RNA, 16 nt, Haemophilus influenzae Rd
gacauagaaaguuuaa

SEQ ID NO: 680374 - RNA, 19 nt, Haemophilus influenzae Rd
aacgacgcacuguugugaa

SEQ ID NO: 680375 - RNA, 20 nt, Haemophilus influenzae Rd
gacaaaagagcgguuaaaaa

SEQ ID NO: 680376 - RNA, 19 nt, Haemophilus influenzae Rd
gaauuuucaccguuuuucc

SEQ ID NO: 680377 - RNA, 21 nt, Haemophilus influenzae Rd
gaauuugccugcccauaagug

SEQ ID NO: 680378 - RNA, 14 nt, Haemophilus influenzae Rd
gaauuuaugguuau

SEQ ID NO: 680379 - RNA, 18 nt, Haemophilus influenzae Rd
gaauuguuuucgucacaa

SEQ ID NO: 680380 - RNA, 22 nt, Haemophilus influenzae Rd
gaauuuaagucgucgagacuuu

SEQ ID NO: 680381 - RNA, 15 nt, Haemophilus influenzae Rd
gaauauuccauuaac

SEQ ID NO: 680382 - RNA, 22 nt, Haemophilus influenzae Rd
gaaucgaacacuguaaauaaac

SEQ ID NO: 680383 - RNA, 17 nt, Haemophilus influenzae Rd
gaauaacuuuaauuuuc

SEQ ID NO: 680384 - RNA, 13 nt, Haemophilus influenzae Rd
gaauaauaaauug

SEQ ID NO: 680385 - RNA, 23 nt, Haemophilus influenzae Rd
gaauaauaaugccugcauuaaua

SEQ ID NO: 680386 - RNA, 20 nt, Haemophilus influenzae Rd
gaauaauccccuaaacuaag

SEQ ID NO: 680387 - RNA, 14 nt, Haemophilus influenzae Rd
gaauauaaauaaaa

SEQ ID NO: 680388 - RNA, 16 nt, Haemophilus influenzae Rd
gaaguugcauaacuuc

SEQ ID NO: 680389 - RNA, 13 nt, Haemophilus influenzae Rd
gaauaaaagucag

SEQ ID NO: 680390 - RNA, 15 nt, Haemophilus influenzae Rd
gaauaaaagucagua

SEQ ID NO: 680391 - RNA, 20 nt, Haemophilus influenzae Rd
gaauaaaugcaucauuaaua

SEQ ID NO: 680392 - RNA, 17 nt, Haemophilus influenzae Rd
gaauaacaugcaaaaua

SEQ ID NO: 680393 - RNA, 14 nt, Haemophilus influenzae Rd
aacgcguuaaauca

SEQ ID NO: 680394 - RNA, 14 nt, Haemophilus influenzae Rd
aacgcucaaaaauu

SEQ ID NO: 680395 - RNA, 17 nt, Haemophilus influenzae Rd
aacgcguacuuuuuuac

SEQ ID NO: 680396 - RNA, 21 nt, Haemophilus influenzae Rd
aacgccuagauauuguucuac

SEQ ID NO: 680397 - RNA, 18 nt, Haemophilus influenzae Rd
aacgccauuggauacaua

SEQ ID NO: 680398 - RNA, 16 nt, Haemophilus influenzae Rd
gacgauuugacguaaa

SEQ ID NO: 680399 - RNA, 19 nt, Haemophilus influenzae Rd
gaccuucaauugugccgua

SEQ ID NO: 680400 - RNA, 15 nt, Haemophilus influenzae Rd
aacgucgaauaacuu

SEQ ID NO: 680401 - RNA, 18 nt, Haemophilus influenzae Rd
aacgucgaauaacuuuau

SEQ ID NO: 680402 - RNA, 13 nt, Haemophilus influenzae Rd
cguagauauugau

SEQ ID NO: 680403 - RNA, 21 nt, Haemophilus influenzae Rd
cguaucaacuaaaucaucuac

SEQ ID NO: 680404 - RNA, 20 nt, Haemophilus influenzae Rd
cgguuauuacuucaccaauc

SEQ ID NO: 680405 - RNA, 16 nt, Haemophilus influenzae Rd
cgguuugaaauuuaug

SEQ ID NO: 680406 - RNA, 18 nt, Haemophilus influenzae Rd
cguaacaaaugcaaauaa

SEQ ID NO: 680407 - RNA, 16 nt, Haemophilus influenzae Rd
cgguugauuuuugacg

SEQ ID NO: 680408 - RNA, 13 nt, Haemophilus influenzae Rd
cguucagaauuug

SEQ ID NO: 680409 - RNA, 16 nt, Haemophilus influenzae Rd
cguuaaaccaaauaau

SEQ ID NO: 680410 - RNA, 14 nt, Haemophilus influenzae Rd
cguugaaaauaaau

SEQ ID NO: 680411 - RNA, 17 nt, Haemophilus influenzae Rd
cgugagauccuuuaucg

SEQ ID NO: 680412 - RNA, 15 nt, Haemophilus influenzae Rd
aaccgacugagcuaa

SEQ ID NO: 680413 - RNA, 21 nt, Haemophilus influenzae Rd
aaccgacuuugucaauauaaa

SEQ ID NO: 680414 - RNA, 21 nt, Haemophilus influenzae Rd
cgugaaucguuuguaaaagua

SEQ ID NO: 680415 - RNA, 21 nt, Haemophilus influenzae Rd
cgugaauacgcggcggaacag

SEQ ID NO: 680416 - RNA, 21 nt, Haemophilus influenzae Rd
cugauuacuuaaaguuaucaa

SEQ ID NO: 680417 - RNA, 15 nt, Haemophilus influenzae Rd
cugauuauauuguug

SEQ ID NO: 680418 - RNA, 19 nt, Haemophilus influenzae Rd
cugauucauugcauuuuua

SEQ ID NO: 680419 - RNA, 14 nt, Haemophilus influenzae Rd
cugauuuaucauuc

SEQ ID NO: 680420 - RNA, 13 nt, Haemophilus influenzae Rd
cugccacaucauc

SEQ ID NO: 680421 - RNA, 15 nt, Haemophilus influenzae Rd
cugcauagaaugcaa

SEQ ID NO: 680422 - RNA, 16 nt, Haemophilus influenzae Rd
cugauaaguagaaaaa

SEQ ID NO: 680423 - RNA, 21 nt, Haemophilus influenzae Rd
cugauaaguucauaaaagggg

SEQ ID NO: 680424 - RNA, 15 nt, Haemophilus influenzae Rd
cugacguaauuguuc

SEQ ID NO: 680425 - RNA, 18 nt, Haemophilus influenzae Rd
cugacauuacauaaauuc

SEQ ID NO: 680426 - RNA, 16 nt, Haemophilus influenzae Rd
cugacacccaaauuaa

SEQ ID NO: 680427 - RNA, 21 nt, Haemophilus influenzae Rd
cugaauacacuuuaaauuuuc

SEQ ID NO: 680428 - RNA, 14 nt, Haemophilus influenzae Rd
cugaaggugcguuc

SEQ ID NO: 680429 - RNA, 12 nt, Haemophilus influenzae Rd
cugaauaaauuu

SEQ ID NO: 680430 - RNA, 21 nt, Haemophilus influenzae Rd
cucuaauucagcaaaaagugc

SEQ ID NO: 680431 - RNA, 19 nt, Haemophilus influenzae Rd
cucaauaaauaucuaaacu

SEQ ID NO: 680432 - RNA, 14 nt, Haemophilus influenzae Rd
cucaauaauuucaa

SEQ ID NO: 680433 - RNA, 23 nt, Haemophilus influenzae Rd
cuauuuuauaauuaauaaaaaau

SEQ ID NO: 680434 - RNA, 22 nt, Haemophilus influenzae Rd
cuauuuuuuccugccuugcaaa

SEQ ID NO: 680435 - RNA, 12 nt, Haemophilus influenzae Rd
cuauccauuucu

SEQ ID NO: 680436 - RNA, 15 nt, Haemophilus influenzae Rd
cuauuacaauuggug

SEQ ID NO: 680437 - RNA, 16 nt, Haemophilus influenzae Rd
cuaugauuucauuuuc

SEQ ID NO: 680438 - RNA, 14 nt, Haemophilus influenzae Rd
cuagaguaaguaac

SEQ ID NO: 680439 - RNA, 15 nt, Haemophilus influenzae Rd
cuauaugauauauaa

SEQ ID NO: 680440 - RNA, 15 nt, Haemophilus influenzae Rd
cuauauucguuaaau

SEQ ID NO: 680441 - RNA, 21 nt, Haemophilus influenzae Rd
cuauaagaaaauuaucuggca

SEQ ID NO: 680442 - RNA, 18 nt, Haemophilus influenzae Rd
cuauauacauuaacaaug

SEQ ID NO: 680443 - RNA, 20 nt, Haemophilus influenzae Rd
cuaguugcgguggugaaaau

SEQ ID NO: 680444 - RNA, 12 nt, Haemophilus influenzae Rd
cuagugcuaaaa

SEQ ID NO: 680445 - RNA, 22 nt, Haemophilus influenzae Rd
cuagcaacgacacacuauuaau

SEQ ID NO: 680446 - RNA, 23 nt, Haemophilus influenzae Rd
cucaauguuaaguucaucauaaa

SEQ ID NO: 680447 - RNA, 15 nt, Haemophilus influenzae Rd
cucaauuccuucauc

SEQ ID NO: 680448 - RNA, 13 nt, Haemophilus influenzae Rd
cucacuuuauaua

SEQ ID NO: 680449 - RNA, 14 nt, Haemophilus influenzae Rd
cucagauaaugaua

SEQ ID NO: 680450 - RNA, 13 nt, Haemophilus influenzae Rd
cuccaaucaucau

SEQ ID NO: 680451 - RNA, 13 nt, Haemophilus influenzae Rd
cucgaucauuuuu

SEQ ID NO: 680452 - RNA, 17 nt, Haemophilus influenzae Rd
acgauagguaaacuuug

SEQ ID NO: 680453 - RNA, 20 nt, Haemophilus influenzae Rd
acgcaagcgcguuuaucauc

SEQ ID NO: 680454 - RNA, 13 nt, Haemophilus influenzae Rd
acgauuuuucucu

SEQ ID NO: 680455 - RNA, 19 nt, Haemophilus influenzae Rd
acgauuaauaccaauaaua

SEQ ID NO: 680456 - RNA, 17 nt, Haemophilus influenzae Rd
acgauuacaucuaaugc

SEQ ID NO: 680457 - RNA, 22 nt, Haemophilus influenzae Rd
aaacaaaccuaaaccuuauuuu

SEQ ID NO: 680458 - RNA, 13 nt, Haemophilus influenzae Rd
aaacaaacgauga

SEQ ID NO: 680459 - RNA, 18 nt, Haemophilus influenzae Rd
aaaauuucucucauuuuu

SEQ ID NO: 680460 - RNA, 17 nt, Haemophilus influenzae Rd
aaaauuucugcugccau

SEQ ID NO: 680461 - RNA, 13 nt, Haemophilus influenzae Rd
accuugcauuucu

SEQ ID NO: 680462 - RNA, 20 nt, Haemophilus influenzae Rd
accuugagcaauauaaucuu

SEQ ID NO: 680463 - RNA, 14 nt, Haemophilus influenzae Rd
acgaaaugaaauua

SEQ ID NO: 680464 - RNA, 14 nt, Haemophilus influenzae Rd
acgaaaccaacgaa

SEQ ID NO: 680465 - RNA, 11 nt, Haemophilus influenzae Rd
accuuuuugcg

SEQ ID NO: 680466 - RNA, 15 nt, Haemophilus influenzae Rd
accuuuuguagaaaa

SEQ ID NO: 680467 - RNA, 18 nt, Haemophilus influenzae Rd
accuuuuaccaauugauu

SEQ ID NO: 680468 - RNA, 19 nt, Haemophilus influenzae Rd
accuuugcugacaauuucu

SEQ ID NO: 680469 - RNA, 15 nt, Haemophilus influenzae Rd
acgaacagccgcaau

SEQ ID NO: 680470 - RNA, 21 nt, Haemophilus influenzae Rd
acgaauaccccaaguuucuaa

SEQ ID NO: 680471 - RNA, 19 nt, Haemophilus influenzae Rd
acgaauuaagcgaacaccu

SEQ ID NO: 680472 - RNA, 22 nt, Haemophilus influenzae Rd
accgucaucgcuucuaaaucua

SEQ ID NO: 680473 - RNA, 20 nt, Haemophilus influenzae Rd
accguuuuuauuuguucuac

SEQ ID NO: 680474 - RNA, 16 nt, Haemophilus influenzae Rd
accuaccggaaaccag

SEQ ID NO: 680475 - RNA, 24 nt, Haemophilus influenzae Rd
accuaacauacugcuuucuagaug

SEQ ID NO: 680476 - RNA, 20 nt, Haemophilus influenzae Rd
accgccuacaugaucaccgu

SEQ ID NO: 680477 - RNA, 19 nt, Haemophilus influenzae Rd
accgcacuuuaaauauuua

SEQ ID NO: 680478 - RNA, 16 nt, Haemophilus influenzae Rd
accgcacuuucuucuu

SEQ ID NO: 680479 - RNA, 20 nt, Haemophilus influenzae Rd
accgcacuuuggcaauaaaa

SEQ ID NO: 680480 - RNA, 21 nt, Haemophilus influenzae Rd
accgcacuuuuuuaugacuaa

SEQ ID NO: 680481 - RNA, 16 nt, Haemophilus influenzae Rd
accgcaaaaauacuaa

SEQ ID NO: 680482 - RNA, 23 nt, Haemophilus influenzae Rd
accgauaaaaccuaaaauugauu

SEQ ID NO: 680483 - RNA, 17 nt, Haemophilus influenzae Rd
acauaaacggcugccgc

SEQ ID NO: 680484 - RNA, 18 nt, Haemophilus influenzae Rd
acaguuagaacaacaaua

SEQ ID NO: 680485 - RNA, 18 nt, Haemophilus influenzae Rd
acaguucaauaaaaauau

SEQ ID NO: 680486 - RNA, 19 nt, Haemophilus influenzae Rd
acauaaguacauucaacca

SEQ ID NO: 680487 - RNA, 22 nt, Haemophilus influenzae Rd
aaaaucaaaauagcuuuuuaau

SEQ ID NO: 680488 - RNA, 13 nt, Haemophilus influenzae Rd
aaaaucacuucuc

SEQ ID NO: 680489 - RNA, 16 nt, Haemophilus influenzae Rd
aaaaucagcgcauuuu

SEQ ID NO: 680490 - RNA, 18 nt, Haemophilus influenzae Rd
aaaauagaagccaaauca

SEQ ID NO: 680491 - RNA, 20 nt, Haemophilus influenzae Rd
aaaauaucccuuauuuuagu

SEQ ID NO: 680492 - RNA, 18 nt, Haemophilus influenzae Rd
aaaaucuugguuuaaauu

SEQ ID NO: 680493 - RNA, 14 nt, Haemophilus influenzae Rd
aaaaucuuugaauu

SEQ ID NO: 680494 - RNA, 13 nt, Haemophilus influenzae Rd
aaaaucuuuuauu

SEQ ID NO: 680495 - RNA, 21 nt, Haemophilus influenzae Rd
aaaauuaucuggcaaucgcca

SEQ ID NO: 680496 - RNA, 21 nt, Haemophilus influenzae Rd
accauucuuucaauaauuuuu

SEQ ID NO: 680497 - RNA, 22 nt, Haemophilus influenzae Rd
accauugcguucacucacuuua

SEQ ID NO: 680498 - RNA, 14 nt, Haemophilus influenzae Rd
acuaauucauuaca

SEQ ID NO: 680499 - RNA, 20 nt, Haemophilus influenzae Rd
acuaauuguuuuaaaaugga

SEQ ID NO: 680500 - RNA, 20 nt, Haemophilus influenzae Rd
acuaauuucacaccauuuuu

SEQ ID NO: 680501 - RNA, 11 nt, Haemophilus influenzae Rd
acuaauuucau

SEQ ID NO: 680502 - RNA, 16 nt, Haemophilus influenzae Rd
acuaaggugcagauuu

SEQ ID NO: 680503 - RNA, 17 nt, Haemophilus influenzae Rd
acuaauacuucauagug

SEQ ID NO: 680504 - RNA, 23 nt, Haemophilus influenzae Rd
acuaaaucuuaugaaacagcuaa

SEQ ID NO: 680505 - RNA, 19 nt, Haemophilus influenzae Rd
acuaaauaaaucacacagu

SEQ ID NO: 680506 - RNA, 19 nt, Haemophilus influenzae Rd
acuaaauuauuugauuuuu

SEQ ID NO: 680507 - RNA, 15 nt, Haemophilus influenzae Rd
acuaaauucaauuuu

SEQ ID NO: 680508 - RNA, 23 nt, Haemophilus influenzae Rd
acuaaccgcacuuuggaauauuc

SEQ ID NO: 680509 - RNA, 22 nt, Haemophilus influenzae Rd
acuaacucacauugccauuuuu

SEQ ID NO: 680510 - RNA, 14 nt, Haemophilus influenzae Rd
acguuuauauugaa

SEQ ID NO: 680511 - RNA, 19 nt, Haemophilus influenzae Rd
acguuuauuuauuccauca

SEQ ID NO: 680512 - RNA, 15 nt, Haemophilus influenzae Rd
acuaaaauaauuuuu

SEQ ID NO: 680513 - RNA, 17 nt, Haemophilus influenzae Rd
acuaaaaacaaauauau

SEQ ID NO: 680514 - RNA, 23 nt, Haemophilus influenzae Rd
acguuacuaaaauccuugcacca

SEQ ID NO: 680515 - RNA, 12 nt, Haemophilus influenzae Rd
acguuaaaugaa

SEQ ID NO: 680516 - RNA, 16 nt, Haemophilus influenzae Rd
acguuaaaugaacguu

SEQ ID NO: 680517 - RNA, 13 nt, Haemophilus influenzae Rd
acguucaaaaaua

SEQ ID NO: 680518 - RNA, 19 nt, Haemophilus influenzae Rd
acguuaucgacuuuuucac

SEQ ID NO: 680519 - RNA, 14 nt, Haemophilus influenzae Rd
acguaguacaucau

SEQ ID NO: 680520 - RNA, 23 nt, Haemophilus influenzae Rd
acgugcaauuaauucuuuugcua

SEQ ID NO: 680521 - RNA, 19 nt, Haemophilus influenzae Rd
acgggauuuuuucgcaaua

SEQ ID NO: 680522 - RNA, 16 nt, Haemophilus influenzae Rd
acggugggcugaagcc

SEQ ID NO: 680523 - RNA, 15 nt, Haemophilus influenzae Rd
acgguuaauaaauuc

SEQ ID NO: 680524 - RNA, 18 nt, Haemophilus influenzae Rd
acgguuauuuuuuucuaa

SEQ ID NO: 680525 - RNA, 20 nt, Haemophilus influenzae Rd
acgcucaaaaauuucagaau

SEQ ID NO: 680526 - RNA, 23 nt, Haemophilus influenzae Rd
aaacaggguguuuauaagugcca

SEQ ID NO: 680527 - RNA, 18 nt, Haemophilus influenzae Rd
aaacagggcgacaauuua

SEQ ID NO: 680528 - RNA, 17 nt, Haemophilus influenzae Rd
aaacagucugcgccuaa

SEQ ID NO: 680529 - RNA, 21 nt, Haemophilus influenzae Rd
acgccuuggaucguuuucucg

SEQ ID NO: 680530 - RNA, 14 nt, Haemophilus influenzae Rd
acgcgcaauuucag

SEQ ID NO: 680531 - RNA, 22 nt, Haemophilus influenzae Rd
acgcgcacauacuucuucuguu

SEQ ID NO: 680532 - RNA, 23 nt, Haemophilus influenzae Rd
acggcauaauccgcugcagcuuc

SEQ ID NO: 680533 - RNA, 16 nt, Haemophilus influenzae Rd
acggauaauuucccua

SEQ ID NO: 680534 - RNA, 14 nt, Haemophilus influenzae Rd
acggauuaaaaguc

SEQ ID NO: 680535 - RNA, 22 nt, Haemophilus influenzae Rd
acuguggcuaauccaauuucac

SEQ ID NO: 680536 - RNA, 17 nt, Haemophilus influenzae Rd
acugugcauuaaaucaa

SEQ ID NO: 680537 - RNA, 16 nt, Haemophilus influenzae Rd
acuguggauaauucau

SEQ ID NO: 680538 - RNA, 13 nt, Haemophilus influenzae Rd
acuuagauaaauu

SEQ ID NO: 680539 - RNA, 14 nt, Haemophilus influenzae Rd
acuuagauaaauuc

SEQ ID NO: 680540 - RNA, 13 nt, Haemophilus influenzae Rd
acuguuuauagcg

SEQ ID NO: 680541 - RNA, 15 nt, Haemophilus influenzae Rd
acuuaaaucuuuacc

SEQ ID NO: 680542 - RNA, 14 nt, Haemophilus influenzae Rd
acugcaauuaucaa

SEQ ID NO: 680543 - RNA, 19 nt, Haemophilus influenzae Rd
acugacuuucuaacuuuua

SEQ ID NO: 680544 - RNA, 21 nt, Haemophilus influenzae Rd
acuuuuggcaucgugaugauu

SEQ ID NO: 680545 - RNA, 15 nt, Haemophilus influenzae Rd
acuuuguucauuuuu

SEQ ID NO: 680546 - RNA, 19 nt, Haemophilus influenzae Rd
acuuuuacgcguuuuucug

SEQ ID NO: 680547 - RNA, 20 nt, Haemophilus influenzae Rd
acuuuggauuggauuuugaa

SEQ ID NO: 680548 - RNA, 14 nt, Haemophilus influenzae Rd
acuuugcacuuuaa

SEQ ID NO: 680549 - RNA, 14 nt, Haemophilus influenzae Rd
agaaagggcaucaa

SEQ ID NO: 680550 - RNA, 14 nt, Haemophilus influenzae Rd
agaaauauuuuuac

SEQ ID NO: 680551 - RNA, 17 nt, Haemophilus influenzae Rd
agaaaugcgauuuccaa

SEQ ID NO: 680552 - RNA, 19 nt, Haemophilus influenzae Rd
agaaagaccaaaaaucgca

SEQ ID NO: 680553 - RNA, 12 nt, Haemophilus influenzae Rd
agaaacauugau

SEQ ID NO: 680554 - RNA, 13 nt, Haemophilus influenzae Rd
agaaaccaacaga

SEQ ID NO: 680555 - RNA, 15 nt, Haemophilus influenzae Rd
agaacguaauaauuc

SEQ ID NO: 680556 - RNA, 23 nt, Haemophilus influenzae Rd
agaauauuuuaaugaaaguaaca

SEQ ID NO: 680557 - RNA, 21 nt, Haemophilus influenzae Rd
agaagugcggggacaauugca

SEQ ID NO: 680558 - RNA, 22 nt, Haemophilus influenzae Rd
agaauccacauuuuuuguaauu

SEQ ID NO: 680559 - RNA, 20 nt, Haemophilus influenzae Rd
agaaucgcccacgaaaagca

SEQ ID NO: 680560 - RNA, 15 nt, Haemophilus influenzae Rd
agaauguuuugauug

SEQ ID NO: 680561 - RNA, 19 nt, Haemophilus influenzae Rd
agauauuucucacuucuuu

SEQ ID NO: 680562 - RNA, 20 nt, Haemophilus influenzae Rd
agauaaaagugcgguuaaaa

SEQ ID NO: 680563 - RNA, 21 nt, Haemophilus influenzae Rd
agauaaaagugcgguuaaaaa

SEQ ID NO: 680564 - RNA, 23 nt, Haemophilus influenzae Rd
agaucgacuccacuuugcucuaa

SEQ ID NO: 680565 - RNA, 12 nt, Haemophilus influenzae Rd
agaugauaaauu

SEQ ID NO: 680566 - RNA, 15 nt, Haemophilus influenzae Rd
agagauaauaaauau

SEQ ID NO: 680567 - RNA, 17 nt, Haemophilus influenzae Rd
agaauuuucaaccgcac

SEQ ID NO: 680568 - RNA, 19 nt, Haemophilus influenzae Rd
aacugcgccaauauaaggg

SEQ ID NO: 680569 - RNA, 23 nt, Haemophilus influenzae Rd
aacugauuuuguuuucuuuuuuu

SEQ ID NO: 680570 - RNA, 12 nt, Haemophilus influenzae Rd
aacucauuacac

SEQ ID NO: 680571 - RNA, 12 nt, Haemophilus influenzae Rd
aacuuuucuaaa

SEQ ID NO: 680572 - RNA, 18 nt, Haemophilus influenzae Rd
aacuuuguucauuuuuac

SEQ ID NO: 680573 - RNA, 16 nt, Haemophilus influenzae Rd
aagaacguaaauuaug

SEQ ID NO: 680574 - RNA, 18 nt, Haemophilus influenzae Rd
aagaacaucaaauccuug

SEQ ID NO: 680575 - RNA, 19 nt, Haemophilus influenzae Rd
aagaaauuuuguuuuguuc

SEQ ID NO: 680576 - RNA, 14 nt, Haemophilus influenzae Rd
aagaauacaaauuc

SEQ ID NO: 680577 - RNA, 14 nt, Haemophilus influenzae Rd
aagaauguuugaaa

SEQ ID NO: 680578 - RNA, 20 nt, Haemophilus influenzae Rd
aagaauucuggugcauuuau

SEQ ID NO: 680579 - RNA, 22 nt, Haemophilus influenzae Rd
aagaagugcggggacaauugca

SEQ ID NO: 680580 - RNA, 15 nt, Haemophilus influenzae Rd
aagaaucuuaaauuc

SEQ ID NO: 680581 - RNA, 14 nt, Haemophilus influenzae Rd
aacuucugcugcac

SEQ ID NO: 680582 - RNA, 17 nt, Haemophilus influenzae Rd
aacuugcuauuuucuaa

SEQ ID NO: 680583 - RNA, 17 nt, Haemophilus influenzae Rd
aacuuagucucuuuauu

SEQ ID NO: 680584 - RNA, 15 nt, Haemophilus influenzae Rd
aacuggaauaaagca

SEQ ID NO: 680585 - RNA, 22 nt, Haemophilus influenzae Rd
aacgcucaaaaauuucagaauu

SEQ ID NO: 680586 - RNA, 14 nt, Haemophilus influenzae Rd
aacgagcauauuuu

SEQ ID NO: 680587 - RNA, 12 nt, Haemophilus influenzae Rd
aaccuuaaauca

SEQ ID NO: 680588 - RNA, 20 nt, Haemophilus influenzae Rd
aacgacgccacuguugugaa

SEQ ID NO: 680589 - RNA, 14 nt, Haemophilus influenzae Rd
aacacuaugauuuu

SEQ ID NO: 680590 - RNA, 21 nt, Haemophilus influenzae Rd
aaccuaaaccuuauuuuaaau

SEQ ID NO: 680591 - RNA, 19 nt, Haemophilus influenzae Rd
aaccuaaagccaaggcgau

SEQ ID NO: 680592 - RNA, 15 nt, Haemophilus influenzae Rd
aaccugaguaaauaa

SEQ ID NO: 680593 - RNA, 14 nt, Haemophilus influenzae Rd
aaccgucuuuaaau

SEQ ID NO: 680594 - RNA, 22 nt, Haemophilus influenzae Rd
aagccuacgcuaccuaauacgu

SEQ ID NO: 680595 - RNA, 14 nt, Haemophilus influenzae Rd
aagacuauuaaguu

SEQ ID NO: 680596 - RNA, 19 nt, Haemophilus influenzae Rd
aagaccugcuucuuuuaau

SEQ ID NO: 680597 - RNA, 18 nt, Haemophilus influenzae Rd
aagccacugugcauuaaa

SEQ ID NO: 680598 - RNA, 23 nt, Haemophilus influenzae Rd
aagcauuuugauaauuuuucacc

SEQ ID NO: 680599 - RNA, 23 nt, Haemophilus influenzae Rd
aagacuuugguguuacaucuaca

SEQ ID NO: 680600 - RNA, 20 nt, Haemophilus influenzae Rd
aaggccuccgccaagugcgg

SEQ ID NO: 680601 - RNA, 13 nt, Haemophilus influenzae Rd
aagguaacgcccc

SEQ ID NO: 680602 - RNA, 17 nt, Haemophilus influenzae Rd
aagguaucuauaauuuc

SEQ ID NO: 680603 - RNA, 16 nt, Haemophilus influenzae Rd
aaggccauauuuuccc

SEQ ID NO: 680604 - RNA, 17 nt, Haemophilus influenzae Rd
aauaugcgcuucaucaa

SEQ ID NO: 680605 - RNA, 20 nt, Haemophilus influenzae Rd
aauauuaauuaaaagugcgg

SEQ ID NO: 680606 - RNA, 22 nt, Haemophilus influenzae Rd
aauauguuuaccaccgauaaac

SEQ ID NO: 680607 - RNA, 22 nt, Haemophilus influenzae Rd
aauauucugaggauuuuauggc

SEQ ID NO: 680608 - RNA, 13 nt, Haemophilus influenzae Rd
aaucaaccauuug

SEQ ID NO: 680609 - RNA, 12 nt, Haemophilus influenzae Rd
aaucaacaaucc

SEQ ID NO: 680610 - RNA, 23 nt, Haemophilus influenzae Rd
aaucaaggacuaggcucuguaau

SEQ ID NO: 680611 - RNA, 17 nt, Haemophilus influenzae Rd
aaucaaggcuuuguaau

SEQ ID NO: 680612 - RNA, 12 nt, Haemophilus influenzae Rd
aaucaaauaaaa

SEQ ID NO: 680613 - RNA, 20 nt, Haemophilus influenzae Rd
aaucaaaaauuggguuaaua

SEQ ID NO: 680614 - RNA, 13 nt, Haemophilus influenzae Rd
aauauuuuuuugc

SEQ ID NO: 680615 - RNA, 19 nt, Haemophilus influenzae Rd
aauauugguagcuaaaaau

SEQ ID NO: 680616 - RNA, 14 nt, Haemophilus influenzae Rd
aauauaauaaauuc

SEQ ID NO: 680617 - RNA, 20 nt, Haemophilus influenzae Rd
aauacuguuuuaugcuaaag

SEQ ID NO: 680618 - RNA, 22 nt, Haemophilus influenzae Rd
aauacugcgacuuucccugcaa

SEQ ID NO: 680619 - RNA, 18 nt, Haemophilus influenzae Rd
aauaaucacuugauaaaa

SEQ ID NO: 680620 - RNA, 20 nt, Haemophilus influenzae Rd
aauaauucauuauuuggugc

SEQ ID NO: 680621 - RNA, 20 nt, Haemophilus influenzae Rd
aauacgcgucuuucugcaau

SEQ ID NO: 680622 - RNA, 19 nt, Haemophilus influenzae Rd
aauaucauugacuuuuggc

SEQ ID NO: 680623 - RNA, 17 nt, Haemophilus influenzae Rd
aauaucaaucacuucuc

SEQ ID NO: 680624 - RNA, 20 nt, Haemophilus influenzae Rd
aauaucaaucgguuucacaa

SEQ ID NO: 680625 - RNA, 23 nt, Haemophilus influenzae Rd
aauauauuucuaauaaagugcgg

SEQ ID NO: 680626 - RNA, 18 nt, Haemophilus influenzae Rd
aauauaggguaaauaaaa

SEQ ID NO: 680627 - RNA, 16 nt, Haemophilus influenzae Rd
aaguucucaaaaaguu

SEQ ID NO: 680628 - RNA, 14 nt, Haemophilus influenzae Rd
aauaaaugcuaaaa

SEQ ID NO: 680629 - RNA, 21 nt, Haemophilus influenzae Rd
aauaacaagcucagguucaaa

SEQ ID NO: 680630 - RNA, 11 nt, Haemophilus influenzae Rd
aauaacaaucc

SEQ ID NO: 680631 - RNA, 17 nt, Haemophilus influenzae Rd
aauaaaguaaaauauug

SEQ ID NO: 680632 - RNA, 16 nt, Haemophilus influenzae Rd
aauaaagucgguucau

SEQ ID NO: 680633 - RNA, 12 nt, Haemophilus influenzae Rd
aauaaaguugag

SEQ ID NO: 680634 - RNA, 20 nt, Haemophilus influenzae Rd
aauaaccuaauuucauaaaa

SEQ ID NO: 680635 - RNA, 13 nt, Haemophilus influenzae Rd
aauaauauaagug

SEQ ID NO: 680636 - RNA, 15 nt, Haemophilus influenzae Rd
aauaaccuugcugau

SEQ ID NO: 680637 - RNA, 14 nt, Haemophilus influenzae Rd
aauaaucuauuucu

SEQ ID NO: 680638 - RNA, 12 nt, Haemophilus influenzae Rd
aauaaugcaaaa

SEQ ID NO: 680639 - RNA, 19 nt, Haemophilus influenzae Rd
aauaauguuuuuaugaccg

SEQ ID NO: 680640 - RNA, 22 nt, Haemophilus influenzae Rd
aagugaaauucuaccugcugua

SEQ ID NO: 680641 - RNA, 15 nt, Haemophilus influenzae Rd
aagucguuucaucga

SEQ ID NO: 680642 - RNA, 24 nt, Haemophilus influenzae Rd
aagguggauuggucacgauaagau

SEQ ID NO: 680643 - RNA, 21 nt, Haemophilus influenzae Rd
aagguggcacgccuaauucuu

SEQ ID NO: 680644 - RNA, 16 nt, Haemophilus influenzae Rd
aagugcgguaagaaaa

SEQ ID NO: 680645 - RNA, 13 nt, Haemophilus influenzae Rd
aagugcggaaaau

SEQ ID NO: 680646 - RNA, 21 nt, Haemophilus influenzae Rd
aaguuaaaaaaugauuaaguu

SEQ ID NO: 680647 - RNA, 13 nt, Haemophilus influenzae Rd
aaguucaucaacu

SEQ ID NO: 680648 - RNA, 20 nt, Haemophilus influenzae Rd
aaguucaccgggcgauaaaa

SEQ ID NO: 680649 - RNA, 23 nt, Haemophilus influenzae Rd
aaugcccacguccacuucaucga

SEQ ID NO: 680650 - RNA, 21 nt, Haemophilus influenzae Rd
aaugacuuucacuacagguug

SEQ ID NO: 680651 - RNA, 19 nt, Haemophilus influenzae Rd
aaugcuuguucugauuacu

SEQ ID NO: 680652 - RNA, 22 nt, Haemophilus influenzae Rd
aaugcuauuaucauaaacaauu

SEQ ID NO: 680653 - RNA, 12 nt, Haemophilus influenzae Rd
aaugcuauucuc

SEQ ID NO: 680654 - RNA, 22 nt, Haemophilus influenzae Rd
aaugcugaagucguuucaucga

SEQ ID NO: 680655 - RNA, 14 nt, Haemophilus influenzae Rd
aaugcuguagaaau

SEQ ID NO: 680656 - RNA, 16 nt, Haemophilus influenzae Rd
aaucuuuuuguuaaua

SEQ ID NO: 680657 - RNA, 20 nt, Haemophilus influenzae Rd
aaugaacgaacuaaaauggu

SEQ ID NO: 680658 - RNA, 20 nt, Haemophilus influenzae Rd
aaugaacgccgcaacuaaua

SEQ ID NO: 680659 - RNA, 18 nt, Haemophilus influenzae Rd
aaugaacuuucuacgaca

SEQ ID NO: 680660 - RNA, 21 nt, Haemophilus influenzae Rd
aaugaagugcgguugaaauuu

SEQ ID NO: 680661 - RNA, 20 nt, Haemophilus influenzae Rd
aaugaauaaaauuuuuaaag

SEQ ID NO: 680662 - RNA, 23 nt, Haemophilus influenzae Rd
aaucuuuaaguguuguuccaccu

SEQ ID NO: 680663 - RNA, 20 nt, Haemophilus influenzae Rd
aauuguguguuuuaaaccac

SEQ ID NO: 680664 - RNA, 14 nt, Haemophilus influenzae Rd
aauuuaaaaucgca

SEQ ID NO: 680665 - RNA, 19 nt, Haemophilus influenzae Rd
aauuguuuguauaagccac

SEQ ID NO: 680666 - RNA, 19 nt, Haemophilus influenzae Rd
aauugaccgcacuuguaau

SEQ ID NO: 680667 - RNA, 13 nt, Haemophilus influenzae Rd
aauuaaagugcag

SEQ ID NO: 680668 - RNA, 14 nt, Haemophilus influenzae Rd
aauuaaccgcacuu

SEQ ID NO: 680669 - RNA, 23 nt, Haemophilus influenzae Rd
aauuaauacgucaauugcuaaac

SEQ ID NO: 680670 - RNA, 14 nt, Haemophilus influenzae Rd
aauggcuuuaauuu

SEQ ID NO: 680671 - RNA, 20 nt, Haemophilus influenzae Rd
aauguuuaauuauagaaaag

SEQ ID NO: 680672 - RNA, 14 nt, Haemophilus influenzae Rd
aauuaaaaauaaau

SEQ ID NO: 680673 - RNA, 13 nt, Haemophilus influenzae Rd
aauguucuacgua

SEQ ID NO: 680674 - RNA, 15 nt, Haemophilus influenzae Rd
aauguucuuuuaaaa

SEQ ID NO: 680675 - RNA, 18 nt, Haemophilus influenzae Rd
acaauccuaacuuuucuu

SEQ ID NO: 680676 - RNA, 15 nt, Haemophilus influenzae Rd
acacaccuuuuaagu

SEQ ID NO: 680677 - RNA, 19 nt, Haemophilus influenzae Rd
acaauucacugcaacguua

SEQ ID NO: 680678 - RNA, 22 nt, Haemophilus influenzae Rd
acaauuucaucagaaggaauau

SEQ ID NO: 680679 - RNA, 22 nt, Haemophilus influenzae Rd
acaauuugaccgcggaaaauau

SEQ ID NO: 680680 - RNA, 19 nt, Haemophilus influenzae Rd
acaaggguaucuaaauuug

SEQ ID NO: 680681 - RNA, 21 nt, Haemophilus influenzae Rd
acaaggagauuuccaucuaaa

SEQ ID NO: 680682 - RNA, 21 nt, Haemophilus influenzae Rd
acaaucacuguaucuuuuugu

SEQ ID NO: 680683 - RNA, 19 nt, Haemophilus influenzae Rd
acaagucucuaugauuuuu

SEQ ID NO: 680684 - RNA, 21 nt, Haemophilus influenzae Rd
acaauaauucagcgagagaau

SEQ ID NO: 680685 - RNA, 16 nt, Haemophilus influenzae Rd
acaaguuugauccaca

SEQ ID NO: 680686 - RNA, 21 nt, Haemophilus influenzae Rd
acaaguuuuaccuucaguuuu

SEQ ID NO: 680687 - RNA, 14 nt, Haemophilus influenzae Rd
acaacguaaaagua

SEQ ID NO: 680688 - RNA, 11 nt, Haemophilus influenzae Rd
acaacuggaau

SEQ ID NO: 680689 - RNA, 21 nt, Haemophilus influenzae Rd
acaacgauuacaucuaaugcc

SEQ ID NO: 680690 - RNA, 19 nt, Haemophilus influenzae Rd
acaaauuuguugcauuucu

SEQ ID NO: 680691 - RNA, 14 nt, Haemophilus influenzae Rd
acaaagucaauuuu

SEQ ID NO: 680692 - RNA, 21 nt, Haemophilus influenzae Rd
acaaagucgcuucauccaaua

SEQ ID NO: 680693 - RNA, 17 nt, Haemophilus influenzae Rd
acaaagucuucaucuuu

SEQ ID NO: 680694 - RNA, 13 nt, Haemophilus influenzae Rd
acaaauaaaucau

SEQ ID NO: 680695 - RNA, 19 nt, Haemophilus influenzae Rd
acaaaucugccugauuuuu

SEQ ID NO: 680696 - RNA, 15 nt, Haemophilus influenzae Rd
acaaaugaucauuuu

SEQ ID NO: 680697 - RNA, 21 nt, Haemophilus influenzae Rd
aauuuuucggauuaagugcgg

SEQ ID NO: 680698 - RNA, 13 nt, Haemophilus influenzae Rd
aauuuuuccgcug

SEQ ID NO: 680699 - RNA, 16 nt, Haemophilus influenzae Rd
aauuuuuaauuuucuc

SEQ ID NO: 680700 - RNA, 15 nt, Haemophilus influenzae Rd
aauuuuuauuuuuac

SEQ ID NO: 680701 - RNA, 15 nt, Haemophilus influenzae Rd
aauuuuucuuuucuu

SEQ ID NO: 680702 - RNA, 14 nt, Haemophilus influenzae Rd
aauuuuuucugaau

SEQ ID NO: 680703 - RNA, 20 nt, Haemophilus influenzae Rd
aauuuuuucugaauaaauuu

SEQ ID NO: 680704 - RNA, 16 nt, Haemophilus influenzae Rd
aauuuuuuucaagcaa

SEQ ID NO: 680705 - RNA, 21 nt, Haemophilus influenzae Rd
aauuuccugagaauuuucaac

SEQ ID NO: 680706 - RNA, 18 nt, Haemophilus influenzae Rd
aauuucgacauauucuac

SEQ ID NO: 680707 - RNA, 21 nt, Haemophilus influenzae Rd
aauuucuuucgcuuuugcuac

SEQ ID NO: 680708 - RNA, 20 nt, Haemophilus influenzae Rd
aauuucugaacacaagccca

SEQ ID NO: 680709 - RNA, 19 nt, Haemophilus influenzae Rd
acaccuuuaaaaauuacaa

SEQ ID NO: 680710 - RNA, 13 nt, Haemophilus influenzae Rd
acaccugaagcau

SEQ ID NO: 680711 - RNA, 21 nt, Haemophilus influenzae Rd
acacgcucaggaaaacguuca

SEQ ID NO: 680712 - RNA, 21 nt, Haemophilus influenzae Rd
aaaaguaggagcaaucuuuuu

SEQ ID NO: 680713 - RNA, 19 nt, Haemophilus influenzae Rd
aaaagugcggaaaauuuuc

SEQ ID NO: 680714 - RNA, 20 nt, Haemophilus influenzae Rd
aaaagugcgguaaaaauuca

SEQ ID NO: 680715 - RNA, 17 nt, Haemophilus influenzae Rd
aaaagugcggucuuuuu

SEQ ID NO: 680716 - RNA, 19 nt, Haemophilus influenzae Rd
aaaagugcggucuuuuuuu

SEQ ID NO: 680717 - RNA, 20 nt, Haemophilus influenzae Rd
aaaagugcggugaaauuuca

SEQ ID NO: 680718 - RNA, 19 nt, Haemophilus influenzae Rd
aaaagugcggugauuuuac

SEQ ID NO: 680719 - RNA, 21 nt, Haemophilus influenzae Rd
aaaaguugaaacuguuuuggc

SEQ ID NO: 680720 - RNA, 15 nt, Haemophilus influenzae Rd
aaaauaaagugcggu

SEQ ID NO: 680721 - RNA, 20 nt, Haemophilus influenzae Rd
aaaauacguacauugucuga

SEQ ID NO: 680722 - RNA, 16 nt, Haemophilus influenzae Rd
acacgguaguaaauaa

SEQ ID NO: 680723 - RNA, 20 nt, Haemophilus influenzae Rd
acacguuugccagaaagcau

SEQ ID NO: 680724 - RNA, 22 nt, Haemophilus influenzae Rd
acagaaagaaugucaucuaauu

SEQ ID NO: 680725 - RNA, 16 nt, Haemophilus influenzae Rd
acagaaccuaaugcag

SEQ ID NO: 680726 - RNA, 15 nt, Haemophilus influenzae Rd
acacuuuaaauuuuc

SEQ ID NO: 680727 - RNA, 21 nt, Haemophilus influenzae Rd
acagcaaaagaaauaacguca

SEQ ID NO: 680728 - RNA, 22 nt, Haemophilus influenzae Rd
acaggcuaucaucaucauuuug

SEQ ID NO: 680729 - RNA, 20 nt, Haemophilus influenzae Rd
acagcuugguaguuuuucac

SEQ ID NO: 680730 - RNA, 14 nt, Haemophilus influenzae Rd
aaaaaggaaauaau

SEQ ID NO: 680731 - RNA, 22 nt, Haemophilus influenzae Rd
aaaaagcccaaaugcaacaaua

SEQ ID NO: 680732 - RNA, 23 nt, Haemophilus influenzae Rd
aaaaagcccaaaugcaacaauaa

SEQ ID NO: 680733 - RNA, 14 nt, Haemophilus influenzae Rd
aaaaagaacgguca

SEQ ID NO: 680734 - RNA, 14 nt, Haemophilus influenzae Rd
aaaaagaacuacau

SEQ ID NO: 680735 - RNA, 22 nt, Haemophilus influenzae Rd
aaaaaucggugcaacaauauca

SEQ ID NO: 680736 - RNA, 18 nt, Haemophilus influenzae Rd
aaaaaucgucaaaaucau

SEQ ID NO: 680737 - RNA, 21 nt, Haemophilus influenzae Rd
aaaaaucaccgcacuuugugc

SEQ ID NO: 680738 - RNA, 19 nt, Haemophilus influenzae Rd
aaaaaucaucaauuugugc

SEQ ID NO: 680739 - RNA, 23 nt, Haemophilus influenzae Rd
aaaaauccugaagauuuuggugc

SEQ ID NO: 680740 - RNA, 14 nt, Haemophilus influenzae Rd
aaaaauaaaaacau

SEQ ID NO: 680741 - RNA, 19 nt, Haemophilus influenzae Rd
aaaaauaaaaacauugcca

SEQ ID NO: 680742 - RNA, 14 nt, Haemophilus influenzae Rd
aaaaauaaauagau

SEQ ID NO: 680743 - RNA, 21 nt, Haemophilus influenzae Rd
aaaaagugcgguaaaauuuca

SEQ ID NO: 680744 - RNA, 20 nt, Haemophilus influenzae Rd
aaaaagugcggucaauuuca

SEQ ID NO: 680745 - RNA, 19 nt, Haemophilus influenzae Rd
aaaaagugcggugaaauuu

SEQ ID NO: 680746 - RNA, 21 nt, Haemophilus influenzae Rd
aaaaagugcggugaaauuuca

SEQ ID NO: 680747 - RNA, 20 nt, Haemophilus influenzae Rd
aaaaagugcgguugaaauuu

SEQ ID NO: 680748 - RNA, 23 nt, Haemophilus influenzae Rd
aaaaaccgaccgcacuuuuuagc

SEQ ID NO: 680749 - RNA, 17 nt, Haemophilus influenzae Rd
aaaaaccgcuuuuaugc

SEQ ID NO: 680750 - RNA, 18 nt, Haemophilus influenzae Rd
aaaacggcguuagguuuu

SEQ ID NO: 680751 - RNA, 14 nt, Haemophilus influenzae Rd
aaaacuacuuguuc

SEQ ID NO: 680752 - RNA, 20 nt, Haemophilus influenzae Rd
aaaacuacuuuccaauucca

SEQ ID NO: 680753 - RNA, 20 nt, Haemophilus influenzae Rd
aaaacgaugaaguuuucauu

SEQ ID NO: 680754 - RNA, 20 nt, Haemophilus influenzae Rd
aaaagagagcuucucuuuuu

SEQ ID NO: 680755 - RNA, 22 nt, Haemophilus influenzae Rd
aaaacuguauuucgucuuaauu

SEQ ID NO: 680756 - RNA, 14 nt, Haemophilus influenzae Rd
aaaacgaaauuuuu

SEQ ID NO: 680757 - RNA, 16 nt, Haemophilus influenzae Rd
aaaacgaacaauuucu

SEQ ID NO: 680758 - RNA, 14 nt, Haemophilus influenzae Rd
aaaaauuacuuaau

SEQ ID NO: 680759 - RNA, 20 nt, Haemophilus influenzae Rd
aaaaguaagcaauuuucugc

SEQ ID NO: 680760 - RNA, 17 nt, Haemophilus influenzae Rd
aaaagugcgauauuuuu

SEQ ID NO: 680761 - RNA, 19 nt, Haemophilus influenzae Rd
aaaagugcggcuucauuuu

SEQ ID NO: 680762 - RNA, 19 nt, Haemophilus influenzae Rd
aaaagugcgguaaaaauuc

SEQ ID NO: 680763 - RNA, 19 nt, Haemophilus influenzae Rd
aaaagugcgguaaauuuuu

SEQ ID NO: 680764 - RNA, 20 nt, Haemophilus influenzae Rd
aaaagugcgguuaaaauuca

SEQ ID NO: 680765 - RNA, 13 nt, Haemophilus influenzae Rd
aaaauauuuaacu

SEQ ID NO: 680766 - RNA, 15 nt, Haemophilus influenzae Rd
aaaauauccacauaa

SEQ ID NO: 680767 - RNA, 14 nt, Haemophilus influenzae Rd
aaaauccaaccgau

SEQ ID NO: 680768 - RNA, 13 nt, Haemophilus influenzae Rd
aaaauaauaucca

SEQ ID NO: 680769 - RNA, 14 nt, Haemophilus influenzae Rd
aaaauaacuucauc

SEQ ID NO: 680770 - RNA, 18 nt, Haemophilus influenzae Rd
aaaauagaaugaaaaaca

SEQ ID NO: 680771 - RNA, 14 nt, Haemophilus influenzae Rd
aaaauauacaauuc

SEQ ID NO: 680772 - RNA, 19 nt, Haemophilus influenzae Rd
aaaaugucgugaauacgcg

SEQ ID NO: 680773 - RNA, 16 nt, Haemophilus influenzae Rd
aaaauggcuuuuuugc

SEQ ID NO: 680774 - RNA, 13 nt, Haemophilus influenzae Rd
aaaaaccuugugc

SEQ ID NO: 680775 - RNA, 16 nt, Haemophilus influenzae Rd
aaaaaccagauaaaaa

SEQ ID NO: 680776 - RNA, 14 nt, Haemophilus influenzae Rd
aaaaaauaauucca

SEQ ID NO: 680777 - RNA, 20 nt, Haemophilus influenzae Rd
aaaauuacaaaaccaaucau

SEQ ID NO: 680778 - RNA, 20 nt, Haemophilus influenzae Rd
aaaaagcgaaucuuucgauu

SEQ ID NO: 680779 - RNA, 16 nt, Haemophilus influenzae Rd
aaaaagcccaaaugca

SEQ ID NO: 680780 - RNA, 17 nt, Haemophilus influenzae Rd
aaaaagcccaaguaaua

SEQ ID NO: 680781 - RNA, 21 nt, Haemophilus influenzae Rd
aaaaagaaaaccaaaacauaa

SEQ ID NO: 680782 - RNA, 21 nt, Haemophilus influenzae Rd
aaaaagaacggucaaaaugca

SEQ ID NO: 680783 - RNA, 16 nt, Haemophilus influenzae Rd
aaaccuucaaacauca

SEQ ID NO: 680784 - RNA, 17 nt, Haemophilus influenzae Rd
aaacccacaacuuuuuc

SEQ ID NO: 680785 - RNA, 18 nt, Haemophilus influenzae Rd
aaaccgaccgcacuuuuu

SEQ ID NO: 680786 - RNA, 19 nt, Haemophilus influenzae Rd
aaacaacgcguacuuuuuu

SEQ ID NO: 680787 - RNA, 14 nt, Haemophilus influenzae Rd
aaacacguccgcaa

SEQ ID NO: 680788 - RNA, 20 nt, Haemophilus influenzae Rd
aaaauucucaggaaauuuca

SEQ ID NO: 680789 - RNA, 18 nt, Haemophilus influenzae Rd
aaaccaacucuugucauu

SEQ ID NO: 680790 - RNA, 17 nt, Haemophilus influenzae Rd
aaaccaaaacauaagaa

SEQ ID NO: 680791 - RNA, 14 nt, Haemophilus influenzae Rd
aaacauuaugaaaa

SEQ ID NO: 680792 - RNA, 18 nt, Haemophilus influenzae Rd
aaacagugagcuuauugc

SEQ ID NO: 680793 - RNA, 20 nt, Haemophilus influenzae Rd
aaacagugagcuuauugcca

SEQ ID NO: 680794 - RNA, 15 nt, Haemophilus influenzae Rd
aaagggaaauaacaa

SEQ ID NO: 680795 - RNA, 20 nt, Haemophilus influenzae Rd
aaaggcuuucuaacacagaa

SEQ ID NO: 680796 - RNA, 18 nt, Haemophilus influenzae Rd
aaaguaaaaauaaaaaca

SEQ ID NO: 680797 - RNA, 12 nt, Haemophilus influenzae Rd
aaaguaaaauau

SEQ ID NO: 680798 - RNA, 19 nt, Haemophilus influenzae Rd
aaagaauauaaauaaaaca

SEQ ID NO: 680799 - RNA, 21 nt, Haemophilus influenzae Rd
aaagacugcuacuuuugacgc

SEQ ID NO: 680800 - RNA, 17 nt, Haemophilus influenzae Rd
aaagaagcucacuuuau

SEQ ID NO: 680801 - RNA, 20 nt, Haemophilus influenzae Rd
aaagaaacguaaacaaaaua

SEQ ID NO: 680802 - RNA, 14 nt, Haemophilus influenzae Rd
aaagaaaagugcgg

SEQ ID NO: 680803 - RNA, 22 nt, Haemophilus influenzae Rd
aaagcagguuuuucuuuuaauu

SEQ ID NO: 680804 - RNA, 17 nt, Haemophilus influenzae Rd
aaagaggagguagaaaa

SEQ ID NO: 680805 - RNA, 23 nt, Haemophilus influenzae Rd
aaacggcguuagguuuugauucg

SEQ ID NO: 680806 - RNA, 20 nt, Haemophilus influenzae Rd
aaacggcugccgcaucaacu

SEQ ID NO: 680807 - RNA, 15 nt, Haemophilus influenzae Rd
aaaagacaauaauuc

SEQ ID NO: 680808 - RNA, 19 nt, Haemophilus influenzae Rd
aaaacuugcaaaccaaccu

SEQ ID NO: 680809 - RNA, 21 nt, Haemophilus influenzae Rd
aaauuuaaaggcggauuuauu

SEQ ID NO: 680810 - RNA, 20 nt, Haemophilus influenzae Rd
aaauuuaucgggaauaauau

SEQ ID NO: 680811 - RNA, 12 nt, Haemophilus influenzae Rd
aaauuucugaac

SEQ ID NO: 680812 - RNA, 14 nt, Haemophilus influenzae Rd
aaauuucuuuuuua

SEQ ID NO: 680813 - RNA, 15 nt, Haemophilus influenzae Rd
aaauuuuuaccgcac

SEQ ID NO: 680814 - RNA, 11 nt, Haemophilus influenzae Rd
aaauuuuaaaa

SEQ ID NO: 680815 - RNA, 16 nt, Haemophilus influenzae Rd
aaauuuucggcaagaa

SEQ ID NO: 680816 - RNA, 18 nt, Haemophilus influenzae Rd
aaauuuucggcaagaaau

SEQ ID NO: 680817 - RNA, 15 nt, Haemophilus influenzae Rd
aaauuagaauuuagu

SEQ ID NO: 680818 - RNA, 18 nt, Haemophilus influenzae Rd
aaauuagacaaaaaugca

SEQ ID NO: 680819 - RNA, 22 nt, Haemophilus influenzae Rd
aaaacggcguuagguuuugauu

SEQ ID NO: 680820 - RNA, 16 nt, Haemophilus influenzae Rd
aaaacuauuuuuaauu

SEQ ID NO: 680821 - RNA, 18 nt, Haemophilus influenzae Rd
aaauuaaaaagacuaaac

SEQ ID NO: 680822 - RNA, 14 nt, Haemophilus influenzae Rd
aaauguucauuuuu

SEQ ID NO: 680823 - RNA, 15 nt, Haemophilus influenzae Rd
aaauuaaaauaauau

SEQ ID NO: 680824 - RNA, 13 nt, Haemophilus influenzae Rd
aaauuaagaaaau

SEQ ID NO: 680825 - RNA, 23 nt, Haemophilus influenzae Rd
aaauuaacuggcguuucuaccac

SEQ ID NO: 680826 - RNA, 15 nt, Haemophilus influenzae Rd
aaauuaauacugaaa

SEQ ID NO: 680827 - RNA, 14 nt, Haemophilus influenzae Rd
aaauuacauuuuuu

SEQ ID NO: 680828 - RNA, 23 nt, Haemophilus influenzae Rd
aacaccauugagcauuuuuuauu

SEQ ID NO: 680829 - RNA, 18 nt, Haemophilus influenzae Rd
aacacaccuauuuuuucc

SEQ ID NO: 680830 - RNA, 17 nt, Haemophilus influenzae Rd
aacaccaaacagagugc

SEQ ID NO: 680831 - RNA, 20 nt, Haemophilus influenzae Rd
aacaauggcugaaaaauuca

SEQ ID NO: 680832 - RNA, 14 nt, Haemophilus influenzae Rd
aacaauuacugcaa

SEQ ID NO: 680833 - RNA, 14 nt, Haemophilus influenzae Rd
aacaaaagccacca

SEQ ID NO: 680834 - RNA, 15 nt, Haemophilus influenzae Rd
aacaaaggguaaaua

SEQ ID NO: 680835 - RNA, 17 nt, Haemophilus influenzae Rd
aacaaauaggauaaaaa

SEQ ID NO: 680836 - RNA, 19 nt, Haemophilus influenzae Rd
aacaaacuuucauucguau

SEQ ID NO: 680837 - RNA, 23 nt, Haemophilus influenzae Rd
aaaucgcacucacaauaccaagu

SEQ ID NO: 680838 - RNA, 23 nt, Haemophilus influenzae Rd
aaaucgcuugccagucauuuuuu

SEQ ID NO: 680839 - RNA, 15 nt, Haemophilus influenzae Rd
aaaucggugcgguaa

SEQ ID NO: 680840 - RNA, 16 nt, Haemophilus influenzae Rd
aaaucgucaaaaucau

SEQ ID NO: 680841 - RNA, 22 nt, Haemophilus influenzae Rd
aaaugccacugcccuauuugug

SEQ ID NO: 680842 - RNA, 13 nt, Haemophilus influenzae Rd
aaaugccgauaau

SEQ ID NO: 680843 - RNA, 21 nt, Haemophilus influenzae Rd
aaaugacagucgauuacaaaa

SEQ ID NO: 680844 - RNA, 20 nt, Haemophilus influenzae Rd
aaaugaguaaaccgauuaau

SEQ ID NO: 680845 - RNA, 12 nt, Haemophilus influenzae Rd
aaaucauuacac

SEQ ID NO: 680846 - RNA, 21 nt, Haemophilus influenzae Rd
aaaucauuauccaacauuaau

SEQ ID NO: 680847 - RNA, 23 nt, Haemophilus influenzae Rd
aaaaccgcagcuaauccaaauca

SEQ ID NO: 680848 - RNA, 22 nt, Haemophilus influenzae Rd
aaaacccgaaccgauuuuaaau

SEQ ID NO: 680849 - RNA, 15 nt, Haemophilus influenzae Rd
aaaucaucacaggaa

SEQ ID NO: 680850 - RNA, 20 nt, Haemophilus influenzae Rd
aaaacagagaaaaaaauagu

SEQ ID NO: 680851 - RNA, 14 nt, Haemophilus influenzae Rd
aaaacaucuuuaau

SEQ ID NO: 680852 - RNA, 21 nt, Haemophilus influenzae Rd
aaaucaucuaccacgauaaau

SEQ ID NO: 680853 - RNA, 17 nt, Haemophilus influenzae Rd
aaaacaagacaaaauaa

SEQ ID NO: 680854 - RNA, 18 nt, Haemophilus influenzae Rd
aaauaacccuuacuuuau

SEQ ID NO: 680855 - RNA, 18 nt, Haemophilus influenzae Rd
aaauaaccgcacuucaau

SEQ ID NO: 680856 - RNA, 18 nt, Haemophilus influenzae Rd
aaauaaccgcacuuuagu

SEQ ID NO: 680857 - RNA, 17 nt, Haemophilus influenzae Rd
aaauaaccgcacuuuau

SEQ ID NO: 680858 - RNA, 15 nt, Haemophilus influenzae Rd
aaauaaaaaauccac

SEQ ID NO: 680859 - RNA, 18 nt, Haemophilus influenzae Rd
aaauaaacaaacuuucau

SEQ ID NO: 680860 - RNA, 21 nt, Haemophilus influenzae Rd
aaauaaauuugguacauguug

SEQ ID NO: 680861 - RNA, 23 nt, Haemophilus influenzae Rd
aaauaauuauggugaauaaaacc

SEQ ID NO: 680862 - RNA, 19 nt, Haemophilus influenzae Rd
aaauaauaauuagcuaaau

SEQ ID NO: 680863 - RNA, 11 nt, Haemophilus influenzae Rd
uuuuuuuaaau

SEQ ID NO: 680864 - RNA, 15 nt, Haemophilus influenzae Rd
uuuuuugaacgaauu

SEQ ID NO: 680865 - RNA, 14 nt, Haemophilus influenzae Rd
uuuuuugaaucuca

SEQ ID NO: 680866 - RNA, 13 nt, Haemophilus influenzae Rd
uuuuuucuuaaau

SEQ ID NO: 680867 - RNA, 18 nt, Haemophilus influenzae Rd
uuuuuucuuaaauauauc

SEQ ID NO: 680868 - RNA, 14 nt, Haemophilus influenzae Rd
uuuuuucuucaaug

SEQ ID NO: 680869 - RNA, 19 nt, Haemophilus influenzae Rd
uuuuuucauauuuuaaaua

SEQ ID NO: 680870 - RNA, 18 nt, Haemophilus influenzae Rd
uuuuucauacaaucucua

SEQ ID NO: 680871 - RNA, 23 nt, Haemophilus influenzae Rd
uuuuucaucauaauuuauucaaa

SEQ ID NO: 680872 - RNA, 19 nt, Haemophilus influenzae Rd
uuuuucagucuauuauaaa

SEQ ID NO: 680873 - RNA, 11 nt, Haemophilus influenzae Rd
uuuuucauuuu

SEQ ID NO: 680874 - RNA, 22 nt, Haemophilus influenzae Rd
uuuuucauugcaucagguacgu

SEQ ID NO: 680875 - RNA, 19 nt, Haemophilus influenzae Rd
uuuugaggggaauuuuuua

SEQ ID NO: 680876 - RNA, 14 nt, Haemophilus influenzae Rd
uuuugagauaaauu

SEQ ID NO: 680877 - RNA, 22 nt, Haemophilus influenzae Rd
uuuugacaucacgaggauuuuu

SEQ ID NO: 680878 - RNA, 18 nt, Haemophilus influenzae Rd
uuuugacgagauuuuuug

SEQ ID NO: 680879 - RNA, 19 nt, Haemophilus influenzae Rd
uuuugacgcagcaucugcc

SEQ ID NO: 680880 - RNA, 17 nt, Haemophilus influenzae Rd
uuuucuugaucuuugac

SEQ ID NO: 680881 - RNA, 16 nt, Haemophilus influenzae Rd
uuuucuuuuauacuua

SEQ ID NO: 680882 - RNA, 16 nt, Haemophilus influenzae Rd
uuuucuuuuuccugaa

SEQ ID NO: 680883 - RNA, 17 nt, Haemophilus influenzae Rd
uuuugcacgaauuucag

SEQ ID NO: 680884 - RNA, 17 nt, Haemophilus influenzae Rd
uuuugcaauaaaguuga

SEQ ID NO: 680885 - RNA, 21 nt, Haemophilus influenzae Rd
uuuugcaauaaaguugagaau

SEQ ID NO: 680886 - RNA, 15 nt, Haemophilus influenzae Rd
uuuugccaaaaaacu

SEQ ID NO: 680887 - RNA, 13 nt, Haemophilus influenzae Rd
uuuugcaugauau

SEQ ID NO: 680888 - RNA, 16 nt, Haemophilus influenzae Rd
uuuugcaugauauuuu

SEQ ID NO: 680889 - RNA, 20 nt, Haemophilus influenzae Rd
uuuugcauguuauucuccuu

SEQ ID NO: 680890 - RNA, 21 nt, Haemophilus influenzae Rd
uuuucugcgccguacugcuca

SEQ ID NO: 680891 - RNA, 21 nt, Haemophilus influenzae Rd
uuuucugcgcgcaauccaacg

SEQ ID NO: 680892 - RNA, 20 nt, Haemophilus influenzae Rd
uuuucugcucuucaucaaaa

SEQ ID NO: 680893 - RNA, 19 nt, Haemophilus influenzae Rd
uuuucugguacaaauuuag

SEQ ID NO: 680894 - RNA, 11 nt, Haemophilus influenzae Rd
uuuucugcaga

SEQ ID NO: 680895 - RNA, 21 nt, Haemophilus influenzae Rd
uuuucugcauuugauuucaga

SEQ ID NO: 680896 - RNA, 13 nt, Haemophilus influenzae Rd
uuuucuugccaaa

SEQ ID NO: 680897 - RNA, 20 nt, Haemophilus influenzae Rd
uuuucuugcuauucuuuaga

SEQ ID NO: 680898 - RNA, 22 nt, Haemophilus influenzae Rd
uuuucuugcuauucuuuagauu

SEQ ID NO: 680899 - RNA, 15 nt, Haemophilus influenzae Rd
uuuucuucuuugacu

SEQ ID NO: 680900 - RNA, 18 nt, Haemophilus influenzae Rd
uuuucuuguaaugcugua

SEQ ID NO: 680901 - RNA, 18 nt, Haemophilus influenzae Rd
uuuucuuucaguuuugcu

SEQ ID NO: 680902 - RNA, 13 nt, Haemophilus influenzae Rd
uuuucuuuccaac

SEQ ID NO: 680903 - RNA, 19 nt, Haemophilus influenzae Rd
uuuucucgugccuauuuau

SEQ ID NO: 680904 - RNA, 21 nt, Haemophilus influenzae Rd
uuuucucgugccuauuuauuu

SEQ ID NO: 680905 - RNA, 23 nt, Haemophilus influenzae Rd
uuuucggcaagaaauucacucaa

SEQ ID NO: 680906 - RNA, 21 nt, Haemophilus influenzae Rd
uuuucucguucguuuaaauua

SEQ ID NO: 680907 - RNA, 13 nt, Haemophilus influenzae Rd
uuuucucucgcca

SEQ ID NO: 680908 - RNA, 18 nt, Haemophilus influenzae Rd
uuuucgccccauuauuug

SEQ ID NO: 680909 - RNA, 20 nt, Haemophilus influenzae Rd
uuuucgcaauaucaucauca

SEQ ID NO: 680910 - RNA, 19 nt, Haemophilus influenzae Rd
uuuucgcaccaaugccagu

SEQ ID NO: 680911 - RNA, 18 nt, Haemophilus influenzae Rd
uuuucgaccaagucagcu

SEQ ID NO: 680912 - RNA, 18 nt, Haemophilus influenzae Rd
uuuucgauuuaacacuuu

SEQ ID NO: 680913 - RNA, 22 nt, Haemophilus influenzae Rd
uuuucgauuuaacacuuuuucu

SEQ ID NO: 680914 - RNA, 16 nt, Haemophilus influenzae Rd
uuuucgcaaaauauca

SEQ ID NO: 680915 - RNA, 13 nt, Haemophilus influenzae Rd
uuuucaccgcacu

SEQ ID NO: 680916 - RNA, 21 nt, Haemophilus influenzae Rd
uuuucaccgcacuuucuucuu

SEQ ID NO: 680917 - RNA, 19 nt, Haemophilus influenzae Rd
uuuucaaauuaaccgcacu

SEQ ID NO: 680918 - RNA, 20 nt, Haemophilus influenzae Rd
uuuucacgauauugcacaau

SEQ ID NO: 680919 - RNA, 18 nt, Haemophilus influenzae Rd
uuuucacgccuuugucuu

SEQ ID NO: 680920 - RNA, 19 nt, Haemophilus influenzae Rd
uuuucaccaacaaauucua

SEQ ID NO: 680921 - RNA, 18 nt, Haemophilus influenzae Rd
uuuucaaauugaaaagaa

SEQ ID NO: 680922 - RNA, 21 nt, Haemophilus influenzae Rd
uuuucaacaaacggucgaguu

SEQ ID NO: 680923 - RNA, 22 nt, Haemophilus influenzae Rd
uuuucaaauaaguuugauugaa

SEQ ID NO: 680924 - RNA, 17 nt, Haemophilus influenzae Rd
uuuaccuugcauuucuu

SEQ ID NO: 680925 - RNA, 14 nt, Haemophilus influenzae Rd
uuuaccuuuuaauu

SEQ ID NO: 680926 - RNA, 13 nt, Haemophilus influenzae Rd
uuuucaaaauuuu

SEQ ID NO: 680927 - RNA, 14 nt, Haemophilus influenzae Rd
uuuucaaaauuuug

SEQ ID NO: 680928 - RNA, 23 nt, Haemophilus influenzae Rd
uuuaccuuguaaacuuuccucaa

SEQ ID NO: 680929 - RNA, 23 nt, Haemophilus influenzae Rd
uuuaccgucagccaaauuuuucu

SEQ ID NO: 680930 - RNA, 18 nt, Haemophilus influenzae Rd
uuuucaucaauuuugaca

SEQ ID NO: 680931 - RNA, 23 nt, Haemophilus influenzae Rd
uuuucaucauaauuuauucaaaa

SEQ ID NO: 680932 - RNA, 18 nt, Haemophilus influenzae Rd
uuuucauguacaagugaa

SEQ ID NO: 680933 - RNA, 22 nt, Haemophilus influenzae Rd
uuuucagguaaacgcucgcgau

SEQ ID NO: 680934 - RNA, 19 nt, Haemophilus influenzae Rd
uuuucagguacaacauuuu

SEQ ID NO: 680935 - RNA, 14 nt, Haemophilus influenzae Rd
uuuucaggugcuau

SEQ ID NO: 680936 - RNA, 14 nt, Haemophilus influenzae Rd
uuuucagcaaaaug

SEQ ID NO: 680937 - RNA, 12 nt, Haemophilus influenzae Rd
uuuucagcacug

SEQ ID NO: 680938 - RNA, 18 nt, Haemophilus influenzae Rd
uuuuccugaugaauuuag

SEQ ID NO: 680939 - RNA, 20 nt, Haemophilus influenzae Rd
uuuuccugccuugcaaaaac

SEQ ID NO: 680940 - RNA, 17 nt, Haemophilus influenzae Rd
uuuuccguuaaaaguuu

SEQ ID NO: 680941 - RNA, 20 nt, Haemophilus influenzae Rd
uuuucaugcauuaaaaaaca

SEQ ID NO: 680942 - RNA, 22 nt, Haemophilus influenzae Rd
uuuuccuuuuucuaacaucucu

SEQ ID NO: 680943 - RNA, 18 nt, Haemophilus influenzae Rd
uuuuccuucuauaucaga

SEQ ID NO: 680944 - RNA, 17 nt, Haemophilus influenzae Rd
uuuuccuuaaucugaau

SEQ ID NO: 680945 - RNA, 15 nt, Haemophilus influenzae Rd
uuuuuacguaauaag

SEQ ID NO: 680946 - RNA, 19 nt, Haemophilus influenzae Rd
uuuuuacguucauguaaau

SEQ ID NO: 680947 - RNA, 23 nt, Haemophilus influenzae Rd
uuuuuacuaauucaagcaaauau

SEQ ID NO: 680948 - RNA, 21 nt, Haemophilus influenzae Rd
uuuuuaccccacccauuucac

SEQ ID NO: 680949 - RNA, 13 nt, Haemophilus influenzae Rd
uuuuuaauuuaaa

SEQ ID NO: 680950 - RNA, 13 nt, Haemophilus influenzae Rd
uuuuuaauuacuc

SEQ ID NO: 680951 - RNA, 22 nt, Haemophilus influenzae Rd
uuuuuaauuagagagaaaaauc

SEQ ID NO: 680952 - RNA, 23 nt, Haemophilus influenzae Rd
uuuuuacaaggacaauaauaagc

SEQ ID NO: 680953 - RNA, 11 nt, Haemophilus influenzae Rd
uuuuuacauua

SEQ ID NO: 680954 - RNA, 19 nt, Haemophilus influenzae Rd
uuuuuaaguaguauuuuau

SEQ ID NO: 680955 - RNA, 17 nt, Haemophilus influenzae Rd
uuuuuaaguaguguuuu

SEQ ID NO: 680956 - RNA, 22 nt, Haemophilus influenzae Rd
uuuuuaauacgaaaaauuacuu

SEQ ID NO: 680957 - RNA, 23 nt, Haemophilus influenzae Rd
uuuuuaaguucuacccauucaaa

SEQ ID NO: 680958 - RNA, 21 nt, Haemophilus influenzae Rd
uuuuuaaucaaauaaaauauu

SEQ ID NO: 680959 - RNA, 14 nt, Haemophilus influenzae Rd
uuuuuaaucuccca

SEQ ID NO: 680960 - RNA, 10 nt, Haemophilus influenzae Rd
uuuuuaaaac

SEQ ID NO: 680961 - RNA, 14 nt, Haemophilus influenzae Rd
uuuuuaaaauagaa

SEQ ID NO: 680962 - RNA, 17 nt, Haemophilus influenzae Rd
uuuuuaaacgaauauca

SEQ ID NO: 680963 - RNA, 13 nt, Haemophilus influenzae Rd
uuuuuaaauauuu

SEQ ID NO: 680964 - RNA, 15 nt, Haemophilus influenzae Rd
uuuuucagauaauca

SEQ ID NO: 680965 - RNA, 17 nt, Haemophilus influenzae Rd
uuuuucagauaaucaaa

SEQ ID NO: 680966 - RNA, 16 nt, Haemophilus influenzae Rd
uuuuucaaggccauau

SEQ ID NO: 680967 - RNA, 21 nt, Haemophilus influenzae Rd
uuuuucaccgcacuuucuucu

SEQ ID NO: 680968 - RNA, 23 nt, Haemophilus influenzae Rd
uuuuucaaacugaucauaaucca

SEQ ID NO: 680969 - RNA, 14 nt, Haemophilus influenzae Rd
uuuuuauuuuuccu

SEQ ID NO: 680970 - RNA, 13 nt, Haemophilus influenzae Rd
uuuuuauucaaua

SEQ ID NO: 680971 - RNA, 17 nt, Haemophilus influenzae Rd
uuuuuauagccuuguuc

SEQ ID NO: 680972 - RNA, 20 nt, Haemophilus influenzae Rd
uuuuuaugagcaaauacaau

SEQ ID NO: 680973 - RNA, 15 nt, Haemophilus influenzae Rd
uuuuuauuaauaaac

SEQ ID NO: 680974 - RNA, 23 nt, Haemophilus influenzae Rd
uuuuuauuaauuauaaaauagcc

SEQ ID NO: 680975 - RNA, 16 nt, Haemophilus influenzae Rd
uuuuuauaucuucucu

SEQ ID NO: 680976 - RNA, 12 nt, Haemophilus influenzae Rd
uuuuuaucaaau

SEQ ID NO: 680977 - RNA, 20 nt, Haemophilus influenzae Rd
uuuuuauaaaguaagccauu

SEQ ID NO: 680978 - RNA, 21 nt, Haemophilus influenzae Rd
uuuuuauaaauuaccuuguuu

SEQ ID NO: 680979 - RNA, 23 nt, Haemophilus influenzae Rd
uuuuguuuucaggauagagaaac

SEQ ID NO: 680980 - RNA, 22 nt, Haemophilus influenzae Rd
uuuuguuuguaauaaauuuuau

SEQ ID NO: 680981 - RNA, 13 nt, Haemophilus influenzae Rd
uuuuguucaucua

SEQ ID NO: 680982 - RNA, 13 nt, Haemophilus influenzae Rd
uuuuguuucuaaa

SEQ ID NO: 680983 - RNA, 15 nt, Haemophilus influenzae Rd
uuuuguuuauuuacu

SEQ ID NO: 680984 - RNA, 14 nt, Haemophilus influenzae Rd
uuuuguucuaauuu

SEQ ID NO: 680985 - RNA, 14 nt, Haemophilus influenzae Rd
uuuuguuauuaaau

SEQ ID NO: 680986 - RNA, 23 nt, Haemophilus influenzae Rd
uuuuguacguccaugaacuguaa

SEQ ID NO: 680987 - RNA, 18 nt, Haemophilus influenzae Rd
uuuugucccaaaauauuu

SEQ ID NO: 680988 - RNA, 16 nt, Haemophilus influenzae Rd
uuuuguccgugccaaa

SEQ ID NO: 680989 - RNA, 14 nt, Haemophilus influenzae Rd
uuuugucugaaauu

SEQ ID NO: 680990 - RNA, 23 nt, Haemophilus influenzae Rd
uuuugugaagauugaaauagacu

SEQ ID NO: 680991 - RNA, 23 nt, Haemophilus influenzae Rd
uuuuguggcaaucguucuaaaau

SEQ ID NO: 680992 - RNA, 20 nt, Haemophilus influenzae Rd
uuuugccgagaauaaaggga

SEQ ID NO: 680993 - RNA, 12 nt, Haemophilus influenzae Rd
uuuugcucuuua

SEQ ID NO: 680994 - RNA, 23 nt, Haemophilus influenzae Rd
uuuuggugcauguuuacuuaaau

SEQ ID NO: 680995 - RNA, 21 nt, Haemophilus influenzae Rd
uuuuguaagcauuaaaaauuu

SEQ ID NO: 680996 - RNA, 13 nt, Haemophilus influenzae Rd
uuuuggcauuuuc

SEQ ID NO: 680997 - RNA, 21 nt, Haemophilus influenzae Rd
uuuuggcuucaucuuuuaaca

SEQ ID NO: 680998 - RNA, 12 nt, Haemophilus influenzae Rd
uuuugcuuugcc

SEQ ID NO: 680999 - RNA, 20 nt, Haemophilus influenzae Rd
uuuuggauaaaguauucaua

SEQ ID NO: 681000 - RNA, 11 nt, Haemophilus influenzae Rd
uucuccacgca

SEQ ID NO: 681001 - RNA, 12 nt, Haemophilus influenzae Rd
uucuccacaaac

SEQ ID NO: 681002 - RNA, 16 nt, Haemophilus influenzae Rd
uucucauaauagaaaa

SEQ ID NO: 681003 - RNA, 19 nt, Haemophilus influenzae Rd
uucucauaauagaaaacau

SEQ ID NO: 681004 - RNA, 18 nt, Haemophilus influenzae Rd
uucuccuacaucgccuug

SEQ ID NO: 681005 - RNA, 17 nt, Haemophilus influenzae Rd
uucucaggaaauuucaa

SEQ ID NO: 681006 - RNA, 18 nt, Haemophilus influenzae Rd
uucuagaaaauaaccaau

SEQ ID NO: 681007 - RNA, 20 nt, Haemophilus influenzae Rd
uucuagaaaauaaccaauau

SEQ ID NO: 681008 - RNA, 12 nt, Haemophilus influenzae Rd
uucuacuuuuuu

SEQ ID NO: 681009 - RNA, 20 nt, Haemophilus influenzae Rd
uucuacuuccgauuuuaauu

SEQ ID NO: 681010 - RNA, 16 nt, Haemophilus influenzae Rd
uucuacuuguucaaaa

SEQ ID NO: 681011 - RNA, 14 nt, Haemophilus influenzae Rd
uucuacuuuugugc

SEQ ID NO: 681012 - RNA, 12 nt, Haemophilus influenzae Rd
uucuaaucccau

SEQ ID NO: 681013 - RNA, 17 nt, Haemophilus influenzae Rd
uucuaauuaacugaaaa

SEQ ID NO: 681014 - RNA, 12 nt, Haemophilus influenzae Rd
uucuaauguuaa

SEQ ID NO: 681015 - RNA, 19 nt, Haemophilus influenzae Rd
uucuaauucaguguaaugu

SEQ ID NO: 681016 - RNA, 15 nt, Haemophilus influenzae Rd
uucuaaugaaauuuc

SEQ ID NO: 681017 - RNA, 22 nt, Haemophilus influenzae Rd
uucuaagguuaugccaaugcua

SEQ ID NO: 681018 - RNA, 21 nt, Haemophilus influenzae Rd
uucuaauaauccucuuuaaaa

SEQ ID NO: 681019 - RNA, 18 nt, Haemophilus influenzae Rd
uucuaagguauaaauaau

SEQ ID NO: 681020 - RNA, 12 nt, Haemophilus influenzae Rd
uucuaaguguuu

SEQ ID NO: 681021 - RNA, 22 nt, Haemophilus influenzae Rd
uucguucaacccauuuuccauu

SEQ ID NO: 681022 - RNA, 18 nt, Haemophilus influenzae Rd
uucuaaauagcuaacaau

SEQ ID NO: 681023 - RNA, 21 nt, Haemophilus influenzae Rd
uucuaaauagcuaacaauauc

SEQ ID NO: 681024 - RNA, 22 nt, Haemophilus influenzae Rd
uucuaaccgcacuuuuuaauaa

SEQ ID NO: 681025 - RNA, 23 nt, Haemophilus influenzae Rd
uucuaacauuucuuuuggccaua

SEQ ID NO: 681026 - RNA, 16 nt, Haemophilus influenzae Rd
uucuaacgcuuuuaaa

SEQ ID NO: 681027 - RNA, 22 nt, Haemophilus influenzae Rd
uucuaaauauugauuauguaaa

SEQ ID NO: 681028 - RNA, 22 nt, Haemophilus influenzae Rd
uucuaacaauguaguuucuucu

SEQ ID NO: 681029 - RNA, 12 nt, Haemophilus influenzae Rd
uucgucgcuuuu

SEQ ID NO: 681030 - RNA, 12 nt, Haemophilus influenzae Rd
uucgugauuuug

SEQ ID NO: 681031 - RNA, 19 nt, Haemophilus influenzae Rd
uucgugaaauuagacaaaa

SEQ ID NO: 681032 - RNA, 20 nt, Haemophilus influenzae Rd
uucgugaauacgaucugcau

SEQ ID NO: 681033 - RNA, 22 nt, Haemophilus influenzae Rd
uucggagggaucgcauuaucaa

SEQ ID NO: 681034 - RNA, 19 nt, Haemophilus influenzae Rd
uucugaacuaaaauaaccu

SEQ ID NO: 681035 - RNA, 14 nt, Haemophilus influenzae Rd
uucucgugccuauu

SEQ ID NO: 681036 - RNA, 23 nt, Haemophilus influenzae Rd
uucugaaagauauuauuauuaaa

SEQ ID NO: 681037 - RNA, 19 nt, Haemophilus influenzae Rd
uucugaacacucuaucuaa

SEQ ID NO: 681038 - RNA, 16 nt, Haemophilus influenzae Rd
uucucuaaaacauugu

SEQ ID NO: 681039 - RNA, 20 nt, Haemophilus influenzae Rd
uucucgggcugaaauaccuu

SEQ ID NO: 681040 - RNA, 15 nt, Haemophilus influenzae Rd
uucucgcucuaguuu

SEQ ID NO: 681041 - RNA, 16 nt, Haemophilus influenzae Rd
uucugauaacucuaaa

SEQ ID NO: 681042 - RNA, 19 nt, Haemophilus influenzae Rd
uucugcuuuacguuuugcu

SEQ ID NO: 681043 - RNA, 14 nt, Haemophilus influenzae Rd
uucuguaaauaugc

SEQ ID NO: 681044 - RNA, 19 nt, Haemophilus influenzae Rd
uucuguaaauaugccuuau

SEQ ID NO: 681045 - RNA, 14 nt, Haemophilus influenzae Rd
uucuuccauuucaa

SEQ ID NO: 681046 - RNA, 21 nt, Haemophilus influenzae Rd
uucuucgaaaauaacuucauc

SEQ ID NO: 681047 - RNA, 14 nt, Haemophilus influenzae Rd
uucuugaucuuuga

SEQ ID NO: 681048 - RNA, 21 nt, Haemophilus influenzae Rd
uucuugauuauuuaauuucaa

SEQ ID NO: 681049 - RNA, 14 nt, Haemophilus influenzae Rd
uucuucaucgcuua

SEQ ID NO: 681050 - RNA, 19 nt, Haemophilus influenzae Rd
uucuucauuuuaaauuauu

SEQ ID NO: 681051 - RNA, 20 nt, Haemophilus influenzae Rd
uucuuccaaagaaucaucuu

SEQ ID NO: 681052 - RNA, 22 nt, Haemophilus influenzae Rd
uucuucagggcgguuuauuuga

SEQ ID NO: 681053 - RNA, 19 nt, Haemophilus influenzae Rd
uucuucaguaccagucacu

SEQ ID NO: 681054 - RNA, 14 nt, Haemophilus influenzae Rd
uucuucauaaaaaa

SEQ ID NO: 681055 - RNA, 18 nt, Haemophilus influenzae Rd
uucuucacugcaucuguu

SEQ ID NO: 681056 - RNA, 19 nt, Haemophilus influenzae Rd
uucuuauuggacugcauau

SEQ ID NO: 681057 - RNA, 19 nt, Haemophilus influenzae Rd
uucuucaaauugcaaaaaa

SEQ ID NO: 681058 - RNA, 20 nt, Haemophilus influenzae Rd
uucuucaauacguuuaauau

SEQ ID NO: 681059 - RNA, 20 nt, Haemophilus influenzae Rd
uucuucaccugcguuaguga

SEQ ID NO: 681060 - RNA, 20 nt, Haemophilus influenzae Rd
uucuuaauauaggauuuuaa

SEQ ID NO: 681061 - RNA, 16 nt, Haemophilus influenzae Rd
uucuuaauuaagauaa

SEQ ID NO: 681062 - RNA, 13 nt, Haemophilus influenzae Rd
uucuuaauuuuau

SEQ ID NO: 681063 - RNA, 16 nt, Haemophilus influenzae Rd
uucuuaccccaacaaa

SEQ ID NO: 681064 - RNA, 18 nt, Haemophilus influenzae Rd
uucuuaauuuuauuaauu

SEQ ID NO: 681065 - RNA, 23 nt, Haemophilus influenzae Rd
uucuuagcuucaucuucaucaau

SEQ ID NO: 681066 - RNA, 15 nt, Haemophilus influenzae Rd
uucuuagauaaaaac

SEQ ID NO: 681067 - RNA, 23 nt, Haemophilus influenzae Rd
uugaacuauauccaaaucaaaaa

SEQ ID NO: 681068 - RNA, 15 nt, Haemophilus influenzae Rd
uugaacuaaaauauc

SEQ ID NO: 681069 - RNA, 19 nt, Haemophilus influenzae Rd
uugaacuaauaucacuuug

SEQ ID NO: 681070 - RNA, 14 nt, Haemophilus influenzae Rd
uugaacgucucaaa

SEQ ID NO: 681071 - RNA, 18 nt, Haemophilus influenzae Rd
uugaacgggguuaaaagu

SEQ ID NO: 681072 - RNA, 16 nt, Haemophilus influenzae Rd
uugaacgcuauuaagc

SEQ ID NO: 681073 - RNA, 14 nt, Haemophilus influenzae Rd
uugaacuucuaaaa

SEQ ID NO: 681074 - RNA, 18 nt, Haemophilus influenzae Rd
uugaacuugaauugaaga

SEQ ID NO: 681075 - RNA, 12 nt, Haemophilus influenzae Rd
uugaagaaaguu

SEQ ID NO: 681076 - RNA, 22 nt, Haemophilus influenzae Rd
uugaauugcuccuccuaaugca

SEQ ID NO: 681077 - RNA, 21 nt, Haemophilus influenzae Rd
uugaauugcauuuucuuccaa

SEQ ID NO: 681078 - RNA, 15 nt, Haemophilus influenzae Rd
uugaauguuuuucau

SEQ ID NO: 681079 - RNA, 14 nt, Haemophilus influenzae Rd
uugaauuaaaaaug

SEQ ID NO: 681080 - RNA, 21 nt, Haemophilus influenzae Rd
uugaauggcuaaagaaauacg

SEQ ID NO: 681081 - RNA, 17 nt, Haemophilus influenzae Rd
uugaaugucuuaaagau

SEQ ID NO: 681082 - RNA, 22 nt, Haemophilus influenzae Rd
uugaauguggguuccagguugu

SEQ ID NO: 681083 - RNA, 18 nt, Haemophilus influenzae Rd
uugaaugaaauucaguga

SEQ ID NO: 681084 - RNA, 14 nt, Haemophilus influenzae Rd
uugaagaauuuguu

SEQ ID NO: 681085 - RNA, 19 nt, Haemophilus influenzae Rd
uugacuuucgaguaauaga

SEQ ID NO: 681086 - RNA, 19 nt, Haemophilus influenzae Rd
uugacggcuucagaaaaua

SEQ ID NO: 681087 - RNA, 19 nt, Haemophilus influenzae Rd
uugaccuuuucgaauuaaa

SEQ ID NO: 681088 - RNA, 13 nt, Haemophilus influenzae Rd
uugacgaaauaaa

SEQ ID NO: 681089 - RNA, 20 nt, Haemophilus influenzae Rd
uugaccgcuucauuaaaaga

SEQ ID NO: 681090 - RNA, 21 nt, Haemophilus influenzae Rd
uugaauuucuuuuucugcugg

SEQ ID NO: 681091 - RNA, 17 nt, Haemophilus influenzae Rd
uugaauuuuuuuaguuu

SEQ ID NO: 681092 - RNA, 19 nt, Haemophilus influenzae Rd
uucuugcguuucaaaugcu

SEQ ID NO: 681093 - RNA, 16 nt, Haemophilus influenzae Rd
uucuugcuaaaaagaa

SEQ ID NO: 681094 - RNA, 20 nt, Haemophilus influenzae Rd
uucuugcguaaccaaagaaa

SEQ ID NO: 681095 - RNA, 15 nt, Haemophilus influenzae Rd
uucuugccaaaaauu

SEQ ID NO: 681096 - RNA, 17 nt, Haemophilus influenzae Rd
uucuugcuuaaauugac

SEQ ID NO: 681097 - RNA, 17 nt, Haemophilus influenzae Rd
uucuugugcaaaauaac

SEQ ID NO: 681098 - RNA, 13 nt, Haemophilus influenzae Rd
uucuuuuaaaaga

SEQ ID NO: 681099 - RNA, 15 nt, Haemophilus influenzae Rd
uucuuuuaaaagacc

SEQ ID NO: 681100 - RNA, 14 nt, Haemophilus influenzae Rd
uucuuuuaauaaua

SEQ ID NO: 681101 - RNA, 21 nt, Haemophilus influenzae Rd
uucuuuuaaugcuucugccgc

SEQ ID NO: 681102 - RNA, 20 nt, Haemophilus influenzae Rd
uugaaaccucccaaaaacua

SEQ ID NO: 681103 - RNA, 19 nt, Haemophilus influenzae Rd
uugaaaccugaguaaauaa

SEQ ID NO: 681104 - RNA, 13 nt, Haemophilus influenzae Rd
uugaaacagguaa

SEQ ID NO: 681105 - RNA, 22 nt, Haemophilus influenzae Rd
uugaaaaaguuagacuaugaaa

SEQ ID NO: 681106 - RNA, 21 nt, Haemophilus influenzae Rd
uugaaaaaaucuuccaauaca

SEQ ID NO: 681107 - RNA, 15 nt, Haemophilus influenzae Rd
uucuuuuuugcuuau

SEQ ID NO: 681108 - RNA, 17 nt, Haemophilus influenzae Rd
uugaacccauuaaccaa

SEQ ID NO: 681109 - RNA, 15 nt, Haemophilus influenzae Rd
uugaaaccuuguaaa

SEQ ID NO: 681110 - RNA, 22 nt, Haemophilus influenzae Rd
uugaaacuguuuuggcauuuuc

SEQ ID NO: 681111 - RNA, 13 nt, Haemophilus influenzae Rd
uugauaaaaacac

SEQ ID NO: 681112 - RNA, 14 nt, Haemophilus influenzae Rd
uugauaaaaaugag

SEQ ID NO: 681113 - RNA, 18 nt, Haemophilus influenzae Rd
uugauaacgucgaauaac

SEQ ID NO: 681114 - RNA, 13 nt, Haemophilus influenzae Rd
uugauaaaguuuu

SEQ ID NO: 681115 - RNA, 16 nt, Haemophilus influenzae Rd
uugaucgaaugauuca

SEQ ID NO: 681116 - RNA, 11 nt, Haemophilus influenzae Rd
uugaucuacag

SEQ ID NO: 681117 - RNA, 18 nt, Haemophilus influenzae Rd
uugaucguauugcauaaa

SEQ ID NO: 681118 - RNA, 23 nt, Haemophilus influenzae Rd
uugauauucaaggagcuuuauua

SEQ ID NO: 681119 - RNA, 13 nt, Haemophilus influenzae Rd
uugauauucaauu

SEQ ID NO: 681120 - RNA, 16 nt, Haemophilus influenzae Rd
uugauauuaagccauu

SEQ ID NO: 681121 - RNA, 18 nt, Haemophilus influenzae Rd
uugauauuuggauaacaa

SEQ ID NO: 681122 - RNA, 19 nt, Haemophilus influenzae Rd
uugagugaauuucuugccg

SEQ ID NO: 681123 - RNA, 21 nt, Haemophilus influenzae Rd
uugagugaugaguucugucac

SEQ ID NO: 681124 - RNA, 21 nt, Haemophilus influenzae Rd
uugagaaaauguauaaagcau

SEQ ID NO: 681125 - RNA, 22 nt, Haemophilus influenzae Rd
uugagaaaauguauaaagcaua

SEQ ID NO: 681126 - RNA, 14 nt, Haemophilus influenzae Rd
uugagaauuuuuuc

SEQ ID NO: 681127 - RNA, 19 nt, Haemophilus influenzae Rd
uugagaauuuuuucuucaa

SEQ ID NO: 681128 - RNA, 22 nt, Haemophilus influenzae Rd
  misc_feature (13)..(13): n is a, c, g or u
uugagcgguuugnucugucgcu

SEQ ID NO: 681129 - RNA, 16 nt, Haemophilus influenzae Rd
uugagcguaacccaaa

SEQ ID NO: 681130 - RNA, 21 nt, Haemophilus influenzae Rd
uugagccaguuuaucuacuug

SEQ ID NO: 681131 - RNA, 19 nt, Haemophilus influenzae Rd
uugauuuaaauugaaaaaa

SEQ ID NO: 681132 - RNA, 15 nt, Haemophilus influenzae Rd
uugauuuaauugaaa

SEQ ID NO: 681133 - RNA, 15 nt, Haemophilus influenzae Rd
uugauuuacauuaau

SEQ ID NO: 681134 - RNA, 21 nt, Haemophilus influenzae Rd
uugauuuacauuaauuuuucc

SEQ ID NO: 681135 - RNA, 23 nt, Haemophilus influenzae Rd
uugauuuaacucggcuuuuucaa

SEQ ID NO: 681136 - RNA, 15 nt, Haemophilus influenzae Rd
uugauugacuuguuu

SEQ ID NO: 681137 - RNA, 17 nt, Haemophilus influenzae Rd
uugauugagaugccauu

SEQ ID NO: 681138 - RNA, 19 nt, Haemophilus influenzae Rd
uugaugcccacuuuuccua

SEQ ID NO: 681139 - RNA, 19 nt, Haemophilus influenzae Rd
uugauuccgauuuuacgau

SEQ ID NO: 681140 - RNA, 13 nt, Haemophilus influenzae Rd
uugaugccaagau

SEQ ID NO: 681141 - RNA, 21 nt, Haemophilus influenzae Rd
uugaugccaagauaaccaauu

SEQ ID NO: 681142 - RNA, 15 nt, Haemophilus influenzae Rd
uugaugauuaacuau

SEQ ID NO: 681143 - RNA, 19 nt, Haemophilus influenzae Rd
uugaugauuccaaaguuua

SEQ ID NO: 681144 - RNA, 21 nt, Haemophilus influenzae Rd
uugaugaagcuaaacuuuaga

SEQ ID NO: 681145 - RNA, 18 nt, Haemophilus influenzae Rd
uugaugaaaauuaucugc

SEQ ID NO: 681146 - RNA, 19 nt, Haemophilus influenzae Rd
uugaugaaaauuaucugcu

SEQ ID NO: 681147 - RNA, 11 nt, Haemophilus influenzae Rd
uugaucugcac

SEQ ID NO: 681148 - RNA, 19 nt, Haemophilus influenzae Rd
uugaucuccgcgacauuaa

SEQ ID NO: 681149 - RNA, 12 nt, Haemophilus influenzae Rd
uugcaauaacca

SEQ ID NO: 681150 - RNA, 13 nt, Haemophilus influenzae Rd
uugcaauaaucac

SEQ ID NO: 681151 - RNA, 14 nt, Haemophilus influenzae Rd
uugcaauuucagcu

SEQ ID NO: 681152 - RNA, 12 nt, Haemophilus influenzae Rd
uugcaauggcuu

SEQ ID NO: 681153 - RNA, 19 nt, Haemophilus influenzae Rd
uugcaaaaaguacuugcaa

SEQ ID NO: 681154 - RNA, 14 nt, Haemophilus influenzae Rd
uugcaagccaauag

SEQ ID NO: 681155 - RNA, 18 nt, Haemophilus influenzae Rd
uugcaagggauuugaaaa

SEQ ID NO: 681156 - RNA, 12 nt, Haemophilus influenzae Rd
uugauuuuuaua

SEQ ID NO: 681157 - RNA, 19 nt, Haemophilus influenzae Rd
uugauuuucagaaaguguu

SEQ ID NO: 681158 - RNA, 20 nt, Haemophilus influenzae Rd
uugauuuucagcacugguua

SEQ ID NO: 681159 - RNA, 17 nt, Haemophilus influenzae Rd
uugauuuaguucaagga

SEQ ID NO: 681160 - RNA, 14 nt, Haemophilus influenzae Rd
uugauuucagaaca

SEQ ID NO: 681161 - RNA, 12 nt, Haemophilus influenzae Rd
uugauuuuaaag

SEQ ID NO: 681162 - RNA, 14 nt, Haemophilus influenzae Rd
uugauuuuaaugua

SEQ ID NO: 681163 - RNA, 13 nt, Haemophilus influenzae Rd
uugccagauuuuu

SEQ ID NO: 681164 - RNA, 14 nt, Haemophilus influenzae Rd
uugccaguaacuuu

SEQ ID NO: 681165 - RNA, 12 nt, Haemophilus influenzae Rd
uugccagaaagc

SEQ ID NO: 681166 - RNA, 21 nt, Haemophilus influenzae Rd
uugccacuuccacuucugaau

SEQ ID NO: 681167 - RNA, 17 nt, Haemophilus influenzae Rd
uugccacgccaaagcca

SEQ ID NO: 681168 - RNA, 20 nt, Haemophilus influenzae Rd
uugcagggauuucaauaaau

SEQ ID NO: 681169 - RNA, 12 nt, Haemophilus influenzae Rd
uugcauaauucc

SEQ ID NO: 681170 - RNA, 13 nt, Haemophilus influenzae Rd
uugccucuucuuu

SEQ ID NO: 681171 - RNA, 15 nt, Haemophilus influenzae Rd
uugccuaauaaaaaa

SEQ ID NO: 681172 - RNA, 20 nt, Haemophilus influenzae Rd
uugccuaauaaaaaauaaag

SEQ ID NO: 681173 - RNA, 20 nt, Haemophilus influenzae Rd
uugccuaauagaaaaaugcc

SEQ ID NO: 681174 - RNA, 16 nt, Haemophilus influenzae Rd
uugccauuuacagguu

SEQ ID NO: 681175 - RNA, 15 nt, Haemophilus influenzae Rd
uugcccaauaaaagu

SEQ ID NO: 681176 - RNA, 18 nt, Haemophilus influenzae Rd
uugccauagacauuagua

SEQ ID NO: 681177 - RNA, 18 nt, Haemophilus influenzae Rd
uugccauauuuaauaagg

SEQ ID NO: 681178 - RNA, 14 nt, Haemophilus influenzae Rd
uugccauaaaaaau

SEQ ID NO: 681179 - RNA, 17 nt, Haemophilus influenzae Rd
uugcgcauuuaauacug

SEQ ID NO: 681180 - RNA, 12 nt, Haemophilus influenzae Rd
uugcgccaauaa

SEQ ID NO: 681181 - RNA, 19 nt, Haemophilus influenzae Rd
uugcuaguaagauuuugac

SEQ ID NO: 681182 - RNA, 17 nt, Haemophilus influenzae Rd
uugcuagccaauaaucu

SEQ ID NO: 681183 - RNA, 20 nt, Haemophilus influenzae Rd
uugcuaauuuauccaauacu

SEQ ID NO: 681184 - RNA, 17 nt, Haemophilus influenzae Rd
uugcuacagcaaauccu

SEQ ID NO: 681185 - RNA, 15 nt, Haemophilus influenzae Rd
uugcuaaugaugugc

SEQ ID NO: 681186 - RNA, 14 nt, Haemophilus influenzae Rd
uugcuccuccuaau

SEQ ID NO: 681187 - RNA, 17 nt, Haemophilus influenzae Rd
uugcuauggcaaugaau

SEQ ID NO: 681188 - RNA, 15 nt, Haemophilus influenzae Rd
uugcuauucuuuaga

SEQ ID NO: 681189 - RNA, 14 nt, Haemophilus influenzae Rd
uugcucuuuuucca

SEQ ID NO: 681190 - RNA, 13 nt, Haemophilus influenzae Rd
uugcucugacacu

SEQ ID NO: 681191 - RNA, 16 nt, Haemophilus influenzae Rd
uugcucugccacggcu

SEQ ID NO: 681192 - RNA, 22 nt, Haemophilus influenzae Rd
uugcucgugcaggauaaagguu

SEQ ID NO: 681193 - RNA, 20 nt, Haemophilus influenzae Rd
uugcucguuauuauuaagug

SEQ ID NO: 681194 - RNA, 14 nt, Haemophilus influenzae Rd
uugcucuaaaugug

SEQ ID NO: 681195 - RNA, 16 nt, Haemophilus influenzae Rd
uuggcaagaagugcgg

SEQ ID NO: 681196 - RNA, 17 nt, Haemophilus influenzae Rd
uuggcaaaaaauacauu

SEQ ID NO: 681197 - RNA, 17 nt, Haemophilus influenzae Rd
uuggcaaaaguaagcaa

SEQ ID NO: 681198 - RNA, 22 nt, Haemophilus influenzae Rd
uuggcaaacucuugugccaaau

SEQ ID NO: 681199 - RNA, 21 nt, Haemophilus influenzae Rd
uuggcaaaugggugcuuguuc

SEQ ID NO: 681200 - RNA, 16 nt, Haemophilus influenzae Rd
uuggauaauugccacu

SEQ ID NO: 681201 - RNA, 14 nt, Haemophilus influenzae Rd
uuggaagaauguuu

SEQ ID NO: 681202 - RNA, 16 nt, Haemophilus influenzae Rd
uuggaucuaagauacc

SEQ ID NO: 681203 - RNA, 14 nt, Haemophilus influenzae Rd
uuggaugaaaucaa

SEQ ID NO: 681204 - RNA, 17 nt, Haemophilus influenzae Rd
uuggauaucuuguugau

SEQ ID NO: 681205 - RNA, 14 nt, Haemophilus influenzae Rd
uugcugcuuuaauu

SEQ ID NO: 681206 - RNA, 20 nt, Haemophilus influenzae Rd
uugcuucaacgacuaaaauu

SEQ ID NO: 681207 - RNA, 14 nt, Haemophilus influenzae Rd
uugcuucaauuuga

SEQ ID NO: 681208 - RNA, 13 nt, Haemophilus influenzae Rd
uugcuuguaaaaa

SEQ ID NO: 681209 - RNA, 19 nt, Haemophilus influenzae Rd
uuggaaaggcacugcgggu

SEQ ID NO: 681210 - RNA, 23 nt, Haemophilus influenzae Rd
uuggaaauaauauucaaaacauu

SEQ ID NO: 681211 - RNA, 16 nt, Haemophilus influenzae Rd
uuggcugaaauucuaa

SEQ ID NO: 681212 - RNA, 21 nt, Haemophilus influenzae Rd
uuggcucuucuuuaauuucuu

SEQ ID NO: 681213 - RNA, 17 nt, Haemophilus influenzae Rd
uuggcuuucauuacaag

SEQ ID NO: 681214 - RNA, 16 nt, Haemophilus influenzae Rd
uugggauaagcuuuug

SEQ ID NO: 681215 - RNA, 12 nt, Haemophilus influenzae Rd
uuggugcaaaag

SEQ ID NO: 681216 - RNA, 23 nt, Haemophilus influenzae Rd
uuggugcaacgacaaucacuggc

SEQ ID NO: 681217 - RNA, 16 nt, Haemophilus influenzae Rd
uugguuuucuugccaa

SEQ ID NO: 681218 - RNA, 22 nt, Haemophilus influenzae Rd
uugguuuuguaagcgauaaaua

SEQ ID NO: 681219 - RNA, 20 nt, Haemophilus influenzae Rd
uugguuuguuaaaugaaaag

SEQ ID NO: 681220 - RNA, 23 nt, Haemophilus influenzae Rd
uuggucgaagguucgaauccuuc

SEQ ID NO: 681221 - RNA, 14 nt, Haemophilus influenzae Rd
uugguaaucaaauu

SEQ ID NO: 681222 - RNA, 16 nt, Haemophilus influenzae Rd
uuggucgcaacaaaca

SEQ ID NO: 681223 - RNA, 21 nt, Haemophilus influenzae Rd
uuggucgcaacaaacauuaau

SEQ ID NO: 681224 - RNA, 15 nt, Haemophilus influenzae Rd
uuggucggaauguaa

SEQ ID NO: 681225 - RNA, 12 nt, Haemophilus influenzae Rd
uugguaaauacu

SEQ ID NO: 681226 - RNA, 16 nt, Haemophilus influenzae Rd
uugguaagaaagauag

SEQ ID NO: 681227 - RNA, 17 nt, Haemophilus influenzae Rd
uugguaaacauuuguac

SEQ ID NO: 681228 - RNA, 19 nt, Haemophilus influenzae Rd
uugggucguuagcucaguc

SEQ ID NO: 681229 - RNA, 13 nt, Haemophilus influenzae Rd
uuggguaaucaaa

SEQ ID NO: 681230 - RNA, 13 nt, Haemophilus influenzae Rd
uugugaaaaaacg

SEQ ID NO: 681231 - RNA, 16 nt, Haemophilus influenzae Rd
uugucuuuuacguuau

SEQ ID NO: 681232 - RNA, 13 nt, Haemophilus influenzae Rd
uugucugaaauuu

SEQ ID NO: 681233 - RNA, 14 nt, Haemophilus influenzae Rd
uugucugaaauuuu

SEQ ID NO: 681234 - RNA, 15 nt, Haemophilus influenzae Rd
uuguccuuugccuuu

SEQ ID NO: 681235 - RNA, 20 nt, Haemophilus influenzae Rd
uugucgcaggugucacagca

SEQ ID NO: 681236 - RNA, 14 nt, Haemophilus influenzae Rd
uuguaaagauuguc

SEQ ID NO: 681237 - RNA, 16 nt, Haemophilus influenzae Rd
uuguaaaauauccaca

SEQ ID NO: 681238 - RNA, 18 nt, Haemophilus influenzae Rd
uuguaaacugcuuucaaa

SEQ ID NO: 681239 - RNA, 20 nt, Haemophilus influenzae Rd
uuguaggugggcuuuagccc

SEQ ID NO: 681240 - RNA, 14 nt, Haemophilus influenzae Rd
uuguagccauuuuc

SEQ ID NO: 681241 - RNA, 14 nt, Haemophilus influenzae Rd
uuguagcccaaucu

SEQ ID NO: 681242 - RNA, 15 nt, Haemophilus influenzae Rd
uuguagauuaucuga

SEQ ID NO: 681243 - RNA, 17 nt, Haemophilus influenzae Rd
uuguuuaugucuaaacu

SEQ ID NO: 681244 - RNA, 15 nt, Haemophilus influenzae Rd
uuguuucaacauauc

SEQ ID NO: 681245 - RNA, 19 nt, Haemophilus influenzae Rd
uuguuuccaaguauuuucu

SEQ ID NO: 681246 - RNA, 13 nt, Haemophilus influenzae Rd
uuguuucuaaauu

SEQ ID NO: 681247 - RNA, 19 nt, Haemophilus influenzae Rd
uuguuucuaauuuuucacu

SEQ ID NO: 681248 - RNA, 15 nt, Haemophilus influenzae Rd
uuguugcuuggucaa

SEQ ID NO: 681249 - RNA, 16 nt, Haemophilus influenzae Rd
uuguuggaaaaaugcu

SEQ ID NO: 681250 - RNA, 20 nt, Haemophilus influenzae Rd
uuguucaagacugaauuuua

SEQ ID NO: 681251 - RNA, 15 nt, Haemophilus influenzae Rd
uuguucaauaauauu

SEQ ID NO: 681252 - RNA, 16 nt, Haemophilus influenzae Rd
uuguuaucuaaauaau

SEQ ID NO: 681253 - RNA, 15 nt, Haemophilus influenzae Rd
uuguuaugaaauugc

SEQ ID NO: 681254 - RNA, 16 nt, Haemophilus influenzae Rd
uuguugagcaauccaa

SEQ ID NO: 681255 - RNA, 13 nt, Haemophilus influenzae Rd
uuguugaucugca

SEQ ID NO: 681256 - RNA, 17 nt, Haemophilus influenzae Rd
uuguugauuuugguucg

SEQ ID NO: 681257 - RNA, 18 nt, Haemophilus influenzae Rd
uuguucaggugucaucac

SEQ ID NO: 681258 - RNA, 14 nt, Haemophilus influenzae Rd
uuguugcacauuaa

SEQ ID NO: 681259 - RNA, 16 nt, Haemophilus influenzae Rd
uugugucacauaauca

SEQ ID NO: 681260 - RNA, 14 nt, Haemophilus influenzae Rd
uugugguauugauu

SEQ ID NO: 681261 - RNA, 20 nt, Haemophilus influenzae Rd
uuguguaacagcucuguaaa

SEQ ID NO: 681262 - RNA, 17 nt, Haemophilus influenzae Rd
uuguuauagaaaauauc

SEQ ID NO: 681263 - RNA, 19 nt, Haemophilus influenzae Rd
uugugaaguuuuuuaaguu

SEQ ID NO: 681264 - RNA, 17 nt, Haemophilus influenzae Rd
uugugaaauaaaauaua

SEQ ID NO: 681265 - RNA, 17 nt, Haemophilus influenzae Rd
uugugagcgaucugcac

SEQ ID NO: 681266 - RNA, 23 nt, Haemophilus influenzae Rd
uugugaggaaguuaaaauacuuu

SEQ ID NO: 681267 - RNA, 21 nt, Haemophilus influenzae Rd
uugugacuacaaacaaauuuu

SEQ ID NO: 681268 - RNA, 20 nt, Haemophilus influenzae Rd
uugugguaauuuauuuacau

SEQ ID NO: 681269 - RNA, 15 nt, Haemophilus influenzae Rd
uugugaguucaagca

SEQ ID NO: 681270 - RNA, 21 nt, Haemophilus influenzae Rd
uuuaccgcacuuuuaaaauua

SEQ ID NO: 681271 - RNA, 23 nt, Haemophilus influenzae Rd
uuuaccgcacuuuuuuucuuauu

SEQ ID NO: 681272 - RNA, 17 nt, Haemophilus influenzae Rd
uuuacccaagccaauua

SEQ ID NO: 681273 - RNA, 15 nt, Haemophilus influenzae Rd
uuuacccacuucaua

SEQ ID NO: 681274 - RNA, 23 nt, Haemophilus influenzae Rd
uuuaccaaauagggaugcuaauu

SEQ ID NO: 681275 - RNA, 11 nt, Haemophilus influenzae Rd
uuuacaucuug

SEQ ID NO: 681276 - RNA, 23 nt, Haemophilus influenzae Rd
uuuaauuuuuucuguuuuuccau

SEQ ID NO: 681277 - RNA, 19 nt, Haemophilus influenzae Rd
uuuaaugcuuacaaaauua

SEQ ID NO: 681278 - RNA, 17 nt, Haemophilus influenzae Rd
uuuaauguuuguuccac

SEQ ID NO: 681279 - RNA, 21 nt, Haemophilus influenzae Rd
uuuacaauccuaacuuuucuu

SEQ ID NO: 681280 - RNA, 14 nt, Haemophilus influenzae Rd
uuuacaaugagugu

SEQ ID NO: 681281 - RNA, 19 nt, Haemophilus influenzae Rd
uuuacaacugcaaaugaaa

SEQ ID NO: 681282 - RNA, 16 nt, Haemophilus influenzae Rd
uuuacaagcugaaauu

SEQ ID NO: 681283 - RNA, 22 nt, Haemophilus influenzae Rd
uuuaauaugccaaauaaaauua

SEQ ID NO: 681284 - RNA, 13 nt, Haemophilus influenzae Rd
uuuaauauuucuu

SEQ ID NO: 681285 - RNA, 14 nt, Haemophilus influenzae Rd
uuuaaucauaaaaa

SEQ ID NO: 681286 - RNA, 15 nt, Haemophilus influenzae Rd
uuuaaucauaaaaaa

SEQ ID NO: 681287 - RNA, 23 nt, Haemophilus influenzae Rd
uuuaaucauaaaaaaaucugcac

SEQ ID NO: 681288 - RNA, 18 nt, Haemophilus influenzae Rd
uuuaauauuuuuuucaaa

SEQ ID NO: 681289 - RNA, 21 nt, Haemophilus influenzae Rd
uuuaaugauaaucuaaaaaac

SEQ ID NO: 681290 - RNA, 12 nt, Haemophilus influenzae Rd
uuuaaugaugaa

SEQ ID NO: 681291 - RNA, 15 nt, Haemophilus influenzae Rd
uuuaaugaaacuugg

SEQ ID NO: 681292 - RNA, 13 nt, Haemophilus influenzae Rd
uuuaaugaaagua

SEQ ID NO: 681293 - RNA, 15 nt, Haemophilus influenzae Rd
uuuaagcuacaguga

SEQ ID NO: 681294 - RNA, 15 nt, Haemophilus influenzae Rd
uuuaagcuauuguua

SEQ ID NO: 681295 - RNA, 14 nt, Haemophilus influenzae Rd
uuuaaggacuaaau

SEQ ID NO: 681296 - RNA, 14 nt, Haemophilus influenzae Rd
uuuaagcuuuucua

SEQ ID NO: 681297 - RNA, 23 nt, Haemophilus influenzae Rd
uuuaagggcuaaguucuauaauu

SEQ ID NO: 681298 - RNA, 14 nt, Haemophilus influenzae Rd
uuuaagguuuuuuc

SEQ ID NO: 681299 - RNA, 19 nt, Haemophilus influenzae Rd
uuuaaguaguauuuuauuu

SEQ ID NO: 681300 - RNA, 13 nt, Haemophilus influenzae Rd
uuuaaauuuuccu

SEQ ID NO: 681301 - RNA, 21 nt, Haemophilus influenzae Rd
uuuaacuuuuuuauuuguuaa

SEQ ID NO: 681302 - RNA, 21 nt, Haemophilus influenzae Rd
uuuaagauuuacagaacaaaa

SEQ ID NO: 681303 - RNA, 13 nt, Haemophilus influenzae Rd
uuuaagcaaaauc

SEQ ID NO: 681304 - RNA, 20 nt, Haemophilus influenzae Rd
uuuaagaaaaaauauaaaac

SEQ ID NO: 681305 - RNA, 13 nt, Haemophilus influenzae Rd
uuuaaauuaaaaa

SEQ ID NO: 681306 - RNA, 15 nt, Haemophilus influenzae Rd
uuuaaauaaaaaaua

SEQ ID NO: 681307 - RNA, 13 nt, Haemophilus influenzae Rd
uuuaaauaaaaua

SEQ ID NO: 681308 - RNA, 14 nt, Haemophilus influenzae Rd
uuuaaauaaaauaa

SEQ ID NO: 681309 - RNA, 15 nt, Haemophilus influenzae Rd
uuuaaauaaaauauu

SEQ ID NO: 681310 - RNA, 21 nt, Haemophilus influenzae Rd
uuuaaagagaucacuguaaau

SEQ ID NO: 681311 - RNA, 19 nt, Haemophilus influenzae Rd
uuuaaagccauuuugcuca

SEQ ID NO: 681312 - RNA, 15 nt, Haemophilus influenzae Rd
uuuaaaggacuaaau

SEQ ID NO: 681313 - RNA, 15 nt, Haemophilus influenzae Rd
uuuaaauugagauaa

SEQ ID NO: 681314 - RNA, 19 nt, Haemophilus influenzae Rd
uuuaaauuacauucccaaa

SEQ ID NO: 681315 - RNA, 12 nt, Haemophilus influenzae Rd
uuuaaauuauua

SEQ ID NO: 681316 - RNA, 14 nt, Haemophilus influenzae Rd
uuuaaaauuuauuu

SEQ ID NO: 681317 - RNA, 13 nt, Haemophilus influenzae Rd
uuuaaaauuauaa

SEQ ID NO: 681318 - RNA, 14 nt, Haemophilus influenzae Rd
uuuaaaauuauaau

SEQ ID NO: 681319 - RNA, 21 nt, Haemophilus influenzae Rd
uuuaaacaucgcuucaucauc

SEQ ID NO: 681320 - RNA, 13 nt, Haemophilus influenzae Rd
uuuaaagaaauaa

SEQ ID NO: 681321 - RNA, 16 nt, Haemophilus influenzae Rd
uuuaaaaauuaauguc

SEQ ID NO: 681322 - RNA, 18 nt, Haemophilus influenzae Rd
uuuaaaaauauuaagcaa

SEQ ID NO: 681323 - RNA, 17 nt, Haemophilus influenzae Rd
uuuaaaaaguaguauca

SEQ ID NO: 681324 - RNA, 16 nt, Haemophilus influenzae Rd
uuuaaaaauaacauaa

SEQ ID NO: 681325 - RNA, 14 nt, Haemophilus influenzae Rd
uuguuuuuucuauu

SEQ ID NO: 681326 - RNA, 15 nt, Haemophilus influenzae Rd
uuguuuuuuucuaaa

SEQ ID NO: 681327 - RNA, 17 nt, Haemophilus influenzae Rd
uuguuuuuuucuaaaua

SEQ ID NO: 681328 - RNA, 15 nt, Haemophilus influenzae Rd
uuuaaaaaaacguua

SEQ ID NO: 681329 - RNA, 19 nt, Haemophilus influenzae Rd
uuuaaaaaaacguuaaauu

SEQ ID NO: 681330 - RNA, 20 nt, Haemophilus influenzae Rd
uuguuugaaaaauuaucaaa

SEQ ID NO: 681331 - RNA, 13 nt, Haemophilus influenzae Rd
uuguuugccaucu

SEQ ID NO: 681332 - RNA, 18 nt, Haemophilus influenzae Rd
uuccguuaaaaguuuuuu

SEQ ID NO: 681333 - RNA, 13 nt, Haemophilus influenzae Rd
uuccguuuacuac

SEQ ID NO: 681334 - RNA, 20 nt, Haemophilus influenzae Rd
uuccuaaaaucgcacuuugu

SEQ ID NO: 681335 - RNA, 12 nt, Haemophilus influenzae Rd
uuccguuuucua

SEQ ID NO: 681336 - RNA, 18 nt, Haemophilus influenzae Rd
uuccucagcaaaagacga

SEQ ID NO: 681337 - RNA, 15 nt, Haemophilus influenzae Rd
uuccuauucuaaaua

SEQ ID NO: 681338 - RNA, 19 nt, Haemophilus influenzae Rd
uuccugcaagaaaaauguu

SEQ ID NO: 681339 - RNA, 14 nt, Haemophilus influenzae Rd
uuccugcaaacaua

SEQ ID NO: 681340 - RNA, 13 nt, Haemophilus influenzae Rd
uuccuguuugagc

SEQ ID NO: 681341 - RNA, 14 nt, Haemophilus influenzae Rd
uuccuguuaauucu

SEQ ID NO: 681342 - RNA, 19 nt, Haemophilus influenzae Rd
uuccuguacucgaauuauu

SEQ ID NO: 681343 - RNA, 15 nt, Haemophilus influenzae Rd
uuccuugccaaagug

SEQ ID NO: 681344 - RNA, 22 nt, Haemophilus influenzae Rd
uuccuucggcauauaagauuuu

SEQ ID NO: 681345 - RNA, 11 nt, Haemophilus influenzae Rd
uuccuucaucg

SEQ ID NO: 681346 - RNA, 17 nt, Haemophilus influenzae Rd
uuccuucaucgucuucu

SEQ ID NO: 681347 - RNA, 19 nt, Haemophilus influenzae Rd
uuccuuauuuuacuucaac

SEQ ID NO: 681348 - RNA, 22 nt, Haemophilus influenzae Rd
uuccuucaaucgcaucauucaa

SEQ ID NO: 681349 - RNA, 14 nt, Haemophilus influenzae Rd
uuccuuauucaaau

SEQ ID NO: 681350 - RNA, 16 nt, Haemophilus influenzae Rd
uucgaaaauaacuuca

SEQ ID NO: 681351 - RNA, 18 nt, Haemophilus influenzae Rd
uucgaaaauaacuucauc

SEQ ID NO: 681352 - RNA, 14 nt, Haemophilus influenzae Rd
uuccuuuucauaaa

SEQ ID NO: 681353 - RNA, 21 nt, Haemophilus influenzae Rd
uuccuuuggcuugaaaauauu

SEQ ID NO: 681354 - RNA, 17 nt, Haemophilus influenzae Rd
uuccuuucgcugcaaau

SEQ ID NO: 681355 - RNA, 18 nt, Haemophilus influenzae Rd
uuccuuugagccuucaaa

SEQ ID NO: 681356 - RNA, 15 nt, Haemophilus influenzae Rd
uucgcggacuuuuuu

SEQ ID NO: 681357 - RNA, 16 nt, Haemophilus influenzae Rd
uucgcguuguucaauu

SEQ ID NO: 681358 - RNA, 17 nt, Haemophilus influenzae Rd
uucgcgccaccuccaau

SEQ ID NO: 681359 - RNA, 22 nt, Haemophilus influenzae Rd
uucgcuucugcuugguaauaau

SEQ ID NO: 681360 - RNA, 16 nt, Haemophilus influenzae Rd
uucgcuucuuuuaaug

SEQ ID NO: 681361 - RNA, 14 nt, Haemophilus influenzae Rd
uucgcuuucauaaa

SEQ ID NO: 681362 - RNA, 14 nt, Haemophilus influenzae Rd
uucgcucaauaauu

SEQ ID NO: 681363 - RNA, 16 nt, Haemophilus influenzae Rd
uucgcuccaaucauca

SEQ ID NO: 681364 - RNA, 18 nt, Haemophilus influenzae Rd
uucgcuuacaaaauauac

SEQ ID NO: 681365 - RNA, 15 nt, Haemophilus influenzae Rd
uucgccuaaugccuu

SEQ ID NO: 681366 - RNA, 22 nt, Haemophilus influenzae Rd
uucgccuaauucaauaucugca

SEQ ID NO: 681367 - RNA, 22 nt, Haemophilus influenzae Rd
uucgcaggaauaucggcaagua

SEQ ID NO: 681368 - RNA, 15 nt, Haemophilus influenzae Rd
uucgcaucaaucaca

SEQ ID NO: 681369 - RNA, 15 nt, Haemophilus influenzae Rd
uucgcauuuuaacuc

SEQ ID NO: 681370 - RNA, 13 nt, Haemophilus influenzae Rd
uucgaucuaaucc

SEQ ID NO: 681371 - RNA, 23 nt, Haemophilus influenzae Rd
uucgaguuugucaugacuauuac

SEQ ID NO: 681372 - RNA, 17 nt, Haemophilus influenzae Rd
uucgauacuuucuugcu

SEQ ID NO: 681373 - RNA, 18 nt, Haemophilus influenzae Rd
uucgcaagauagcaaaau

SEQ ID NO: 681374 - RNA, 20 nt, Haemophilus influenzae Rd
uucgcaagauagcaaaauau

SEQ ID NO: 681375 - RNA, 20 nt, Haemophilus influenzae Rd
uucgcaccacgauauuucgc

SEQ ID NO: 681376 - RNA, 16 nt, Haemophilus influenzae Rd
uucgauugcauuuuuu

SEQ ID NO: 681377 - RNA, 15 nt, Haemophilus influenzae Rd
uucgauuuuucuaaa

SEQ ID NO: 681378 - RNA, 18 nt, Haemophilus influenzae Rd
uucgcaaaaucuugcuga

SEQ ID NO: 681379 - RNA, 14 nt, Haemophilus influenzae Rd
uucgauuucaucuu

SEQ ID NO: 681380 - RNA, 17 nt, Haemophilus influenzae Rd
uucgauuucaucuucau

SEQ ID NO: 681381 - RNA, 23 nt, Haemophilus influenzae Rd
uucgaccguuuuuucuuuuuccu

SEQ ID NO: 681382 - RNA, 22 nt, Haemophilus influenzae Rd
uucgagcgugaagauaugcucg

SEQ ID NO: 681383 - RNA, 22 nt, Haemophilus influenzae Rd
uuccauuaauacuuuugcacug

SEQ ID NO: 681384 - RNA, 20 nt, Haemophilus influenzae Rd
uuccauuaauucauauugga

SEQ ID NO: 681385 - RNA, 15 nt, Haemophilus influenzae Rd
uuccauucacuuuca

SEQ ID NO: 681386 - RNA, 18 nt, Haemophilus influenzae Rd
uuccauucacuuucacau

SEQ ID NO: 681387 - RNA, 23 nt, Haemophilus influenzae Rd
uuccauuuuuuaugguaaauauu

SEQ ID NO: 681388 - RNA, 14 nt, Haemophilus influenzae Rd
uucccaagauuuua

SEQ ID NO: 681389 - RNA, 19 nt, Haemophilus influenzae Rd
uucccaaccgauauacucu

SEQ ID NO: 681390 - RNA, 17 nt, Haemophilus influenzae Rd
uucccacaugucaaauc

SEQ ID NO: 681391 - RNA, 15 nt, Haemophilus influenzae Rd
uucccgcaacuuuug

SEQ ID NO: 681392 - RNA, 12 nt, Haemophilus influenzae Rd
uuccccugaaug

SEQ ID NO: 681393 - RNA, 20 nt, Haemophilus influenzae Rd
uucccaguaaucuuuuaauu

SEQ ID NO: 681394 - RNA, 15 nt, Haemophilus influenzae Rd
uucccaguaaauauc

SEQ ID NO: 681395 - RNA, 18 nt, Haemophilus influenzae Rd
uucccauuugucucaaaa

SEQ ID NO: 681396 - RNA, 14 nt, Haemophilus influenzae Rd
uuccgauuuuaauu

SEQ ID NO: 681397 - RNA, 16 nt, Haemophilus influenzae Rd
uuccgacauuuuacua

SEQ ID NO: 681398 - RNA, 15 nt, Haemophilus influenzae Rd
uuccgauuaauauac

SEQ ID NO: 681399 - RNA, 12 nt, Haemophilus influenzae Rd
uuccgcuuguuu

SEQ ID NO: 681400 - RNA, 17 nt, Haemophilus influenzae Rd
uuccgcuuuaauaauca

SEQ ID NO: 681401 - RNA, 19 nt, Haemophilus influenzae Rd
uucccugauagguaauaau

SEQ ID NO: 681402 - RNA, 16 nt, Haemophilus influenzae Rd
uucccuagccuuuucu

SEQ ID NO: 681403 - RNA, 20 nt, Haemophilus influenzae Rd
uuccaguauagugcgcauau

SEQ ID NO: 681404 - RNA, 13 nt, Haemophilus influenzae Rd
uuccaucaucuua

SEQ ID NO: 681405 - RNA, 19 nt, Haemophilus influenzae Rd
uuccaucaucuuaucuaga

SEQ ID NO: 681406 - RNA, 15 nt, Haemophilus influenzae Rd
uuccaucauugcucg

SEQ ID NO: 681407 - RNA, 22 nt, Haemophilus influenzae Rd
uuccauauuguuucaauuuauu

SEQ ID NO: 681408 - RNA, 16 nt, Haemophilus influenzae Rd
uuccaucaauaccuaa

SEQ ID NO: 681409 - RNA, 15 nt, Haemophilus influenzae Rd
uuccauauaacaaca

SEQ ID NO: 681410 - RNA, 18 nt, Haemophilus influenzae Rd
uuccauacccuugcuucu

SEQ ID NO: 681411 - RNA, 23 nt, Haemophilus influenzae Rd
uuccauaccaaaaugucgccauu

SEQ ID NO: 681412 - RNA, 23 nt, Haemophilus influenzae Rd
uuccauaaaugacagaaacaaau

SEQ ID NO: 681413 - RNA, 14 nt, Haemophilus influenzae Rd
uuccagcaaaaaaa

SEQ ID NO: 681414 - RNA, 16 nt, Haemophilus influenzae Rd
uuccagcaaaaaaauu

SEQ ID NO: 681415 - RNA, 21 nt, Haemophilus influenzae Rd
uuccaccacccuucuuucaaa

SEQ ID NO: 681416 - RNA, 21 nt, Haemophilus influenzae Rd
uuccacgccuguggcaaaauc

SEQ ID NO: 681417 - RNA, 19 nt, Haemophilus influenzae Rd
uuccacuucugaauccaau

SEQ ID NO: 681418 - RNA, 14 nt, Haemophilus influenzae Rd
uuccacuucauaaa

SEQ ID NO: 681419 - RNA, 18 nt, Haemophilus influenzae Rd
uuccacaauucaaacaau

SEQ ID NO: 681420 - RNA, 18 nt, Haemophilus influenzae Rd
uuccacaccaaaaaugcc

SEQ ID NO: 681421 - RNA, 17 nt, Haemophilus influenzae Rd
uuccaccacaacagauu

SEQ ID NO: 681422 - RNA, 15 nt, Haemophilus influenzae Rd
uuccaccacagccca

SEQ ID NO: 681423 - RNA, 20 nt, Haemophilus influenzae Rd
uuccacaucgcugccuaauu

SEQ ID NO: 681424 - RNA, 14 nt, Haemophilus influenzae Rd
uuccacagguuucu

SEQ ID NO: 681425 - RNA, 15 nt, Haemophilus influenzae Rd
uuccaauaggaaacu

SEQ ID NO: 681426 - RNA, 22 nt, Haemophilus influenzae Rd
uuccaaugugaccaaauaaucg

SEQ ID NO: 681427 - RNA, 16 nt, Haemophilus influenzae Rd
uuccaauucuaguucu

SEQ ID NO: 681428 - RNA, 21 nt, Haemophilus influenzae Rd
uuccacaacaaccacauucaa

SEQ ID NO: 681429 - RNA, 17 nt, Haemophilus influenzae Rd
uuccaacaaaauaaaca

SEQ ID NO: 681430 - RNA, 22 nt, Haemophilus influenzae Rd
uuccaagugcgucguuauuuuu

SEQ ID NO: 681431 - RNA, 13 nt, Haemophilus influenzae Rd
uuccaagcagcca

SEQ ID NO: 681432 - RNA, 14 nt, Haemophilus influenzae Rd
uucauuuuuuauuu

SEQ ID NO: 681433 - RNA, 22 nt, Haemophilus influenzae Rd
uucauuuuuuauuuuuucuaaa

SEQ ID NO: 681434 - RNA, 17 nt, Haemophilus influenzae Rd
uuccaaaucauaccaau

SEQ ID NO: 681435 - RNA, 16 nt, Haemophilus influenzae Rd
uuccaaacuggaauaa

SEQ ID NO: 681436 - RNA, 16 nt, Haemophilus influenzae Rd
uuccaaacaaggcuaa

SEQ ID NO: 681437 - RNA, 14 nt, Haemophilus influenzae Rd
uuccaaaauuucug

SEQ ID NO: 681438 - RNA, 17 nt, Haemophilus influenzae Rd
uucagcguuuucaacuu

SEQ ID NO: 681439 - RNA, 18 nt, Haemophilus influenzae Rd
uucagcguugucaucaga

SEQ ID NO: 681440 - RNA, 19 nt, Haemophilus influenzae Rd
uucagcuaagccaauaauu

SEQ ID NO: 681441 - RNA, 17 nt, Haemophilus influenzae Rd
uucagcuuaaauacuaa

SEQ ID NO: 681442 - RNA, 12 nt, Haemophilus influenzae Rd
uucagcuucaau

SEQ ID NO: 681443 - RNA, 15 nt, Haemophilus influenzae Rd
uucagcuucuucauc

SEQ ID NO: 681444 - RNA, 14 nt, Haemophilus influenzae Rd
uucagcuugugaaa

SEQ ID NO: 681445 - RNA, 15 nt, Haemophilus influenzae Rd
uucagccauuccaau

SEQ ID NO: 681446 - RNA, 14 nt, Haemophilus influenzae Rd
uucagcgauuuuaa

SEQ ID NO: 681447 - RNA, 20 nt, Haemophilus influenzae Rd
uucaggcucuaacauaccgc

SEQ ID NO: 681448 - RNA, 20 nt, Haemophilus influenzae Rd
uucaggauagagaaacuaau

SEQ ID NO: 681449 - RNA, 22 nt, Haemophilus influenzae Rd
uucagcuuuaaggcacagauua

SEQ ID NO: 681450 - RNA, 17 nt, Haemophilus influenzae Rd
uucaggauaaaacaaug

SEQ ID NO: 681451 - RNA, 21 nt, Haemophilus influenzae Rd
uucaguaaacaaguauaaaaa

SEQ ID NO: 681452 - RNA, 22 nt, Haemophilus influenzae Rd
uucaguaaacaaguauaaaaaa

SEQ ID NO: 681453 - RNA, 18 nt, Haemophilus influenzae Rd
uucaguaucaaauacaca

SEQ ID NO: 681454 - RNA, 23 nt, Haemophilus influenzae Rd
uucaguaucacgcacaccaccug

SEQ ID NO: 681455 - RNA, 19 nt, Haemophilus influenzae Rd
uucaguauccgccaaugcu

SEQ ID NO: 681456 - RNA, 13 nt, Haemophilus influenzae Rd
uucauauaaauaa

SEQ ID NO: 681457 - RNA, 17 nt, Haemophilus influenzae Rd
uucauauaaauaagaau

SEQ ID NO: 681458 - RNA, 18 nt, Haemophilus influenzae Rd
uucauauaauucauuagc

SEQ ID NO: 681459 - RNA, 13 nt, Haemophilus influenzae Rd
uucauaucuauug

SEQ ID NO: 681460 - RNA, 20 nt, Haemophilus influenzae Rd
uucaucaagcucaaaaguau

SEQ ID NO: 681461 - RNA, 22 nt, Haemophilus influenzae Rd
uucaucaaaucauuuuuugcaa

SEQ ID NO: 681462 - RNA, 13 nt, Haemophilus influenzae Rd
uucaucaauuucu

SEQ ID NO: 681463 - RNA, 15 nt, Haemophilus influenzae Rd
uucaucaaaaugaaa

SEQ ID NO: 681464 - RNA, 19 nt, Haemophilus influenzae Rd
uucauauuguuucaacaua

SEQ ID NO: 681465 - RNA, 19 nt, Haemophilus influenzae Rd
uucauagaaaccaauaauu

SEQ ID NO: 681466 - RNA, 22 nt, Haemophilus influenzae Rd
uucauagaaaccaauaauuuca

SEQ ID NO: 681467 - RNA, 14 nt, Haemophilus influenzae Rd
uucauaaauucauc

SEQ ID NO: 681468 - RNA, 19 nt, Haemophilus influenzae Rd
uucauaagauaacaagaaa

SEQ ID NO: 681469 - RNA, 22 nt, Haemophilus influenzae Rd
uucauaagauaacaagaaaaau

SEQ ID NO: 681470 - RNA, 23 nt, Haemophilus influenzae Rd
uucauaaaaggcaaagcaaaauc

SEQ ID NO: 681471 - RNA, 16 nt, Haemophilus influenzae Rd
uucauaaaaauugauc

SEQ ID NO: 681472 - RNA, 15 nt, Haemophilus influenzae Rd
uucaguuuugcuuuu

SEQ ID NO: 681473 - RNA, 17 nt, Haemophilus influenzae Rd
uucagucuuaauuuguu

SEQ ID NO: 681474 - RNA, 21 nt, Haemophilus influenzae Rd
uucagucuuaauuuguugaau

SEQ ID NO: 681475 - RNA, 18 nt, Haemophilus influenzae Rd
uucaguccgcauugaaac

SEQ ID NO: 681476 - RNA, 21 nt, Haemophilus influenzae Rd
uucaguugauagacaauauaa

SEQ ID NO: 681477 - RNA, 17 nt, Haemophilus influenzae Rd
uucaguguaguuuucug

SEQ ID NO: 681478 - RNA, 19 nt, Haemophilus influenzae Rd
uucaguuaaauuuucaaug

SEQ ID NO: 681479 - RNA, 13 nt, Haemophilus influenzae Rd
uucaguuaagaaa

SEQ ID NO: 681480 - RNA, 14 nt, Haemophilus influenzae Rd
uucauuguuucuca

SEQ ID NO: 681481 - RNA, 15 nt, Haemophilus influenzae Rd
uucauuguuucucaa

SEQ ID NO: 681482 - RNA, 15 nt, Haemophilus influenzae Rd
uucauuuaaaauaua

SEQ ID NO: 681483 - RNA, 21 nt, Haemophilus influenzae Rd
uucauuugaacaauuaacgca

SEQ ID NO: 681484 - RNA, 15 nt, Haemophilus influenzae Rd
uucauuuagugacca

SEQ ID NO: 681485 - RNA, 17 nt, Haemophilus influenzae Rd
uucauuugagaagcccg

SEQ ID NO: 681486 - RNA, 22 nt, Haemophilus influenzae Rd
uucauuugcacccgcuuuaaua

SEQ ID NO: 681487 - RNA, 20 nt, Haemophilus influenzae Rd
uucauuugcuuuaacccauu

SEQ ID NO: 681488 - RNA, 21 nt, Haemophilus influenzae Rd
uucauuuuccaaccaaucagu

SEQ ID NO: 681489 - RNA, 19 nt, Haemophilus influenzae Rd
uucauuuugagauaaauuu

SEQ ID NO: 681490 - RNA, 13 nt, Haemophilus influenzae Rd
uucauuuugagcc

SEQ ID NO: 681491 - RNA, 16 nt, Haemophilus influenzae Rd
uucauuauuacuuuuu

SEQ ID NO: 681492 - RNA, 17 nt, Haemophilus influenzae Rd
uucauucaacaaaaaug

SEQ ID NO: 681493 - RNA, 20 nt, Haemophilus influenzae Rd
uucauugauggaauaaauuu

SEQ ID NO: 681494 - RNA, 15 nt, Haemophilus influenzae Rd
uucauugcaucaggu

SEQ ID NO: 681495 - RNA, 23 nt, Haemophilus influenzae Rd
uucauugcaucagguacgucuuu

SEQ ID NO: 681496 - RNA, 16 nt, Haemophilus influenzae Rd
uucaugguuuguucca

SEQ ID NO: 681497 - RNA, 17 nt, Haemophilus influenzae Rd
uucaucuuuuuauaaaa

SEQ ID NO: 681498 - RNA, 17 nt, Haemophilus influenzae Rd
uucaugauuuuccaaaa

SEQ ID NO: 681499 - RNA, 15 nt, Haemophilus influenzae Rd
uucaugcauuaaaaa

SEQ ID NO: 681500 - RNA, 22 nt, Haemophilus influenzae Rd
uucaugugggcuuuacaaugag

SEQ ID NO: 681501 - RNA, 19 nt, Haemophilus influenzae Rd
uucauuauauuccuuauuc

SEQ ID NO: 681502 - RNA, 19 nt, Haemophilus influenzae Rd
uucauuacgugcaaauaaa

SEQ ID NO: 681503 - RNA, 20 nt, Haemophilus influenzae Rd
uucauuacgugcaaauaaau

SEQ ID NO: 681504 - RNA, 21 nt, Haemophilus influenzae Rd
uucaucacuaaauucuuguuu

SEQ ID NO: 681505 - RNA, 22 nt, Haemophilus influenzae Rd
uucaucacaaaucuucuugaaa

SEQ ID NO: 681506 - RNA, 14 nt, Haemophilus influenzae Rd
uucaucauaaauuu

SEQ ID NO: 681507 - RNA, 15 nt, Haemophilus influenzae Rd
uucaucaucggcagu

SEQ ID NO: 681508 - RNA, 17 nt, Haemophilus influenzae Rd
uucaucauucugguaau

SEQ ID NO: 681509 - RNA, 15 nt, Haemophilus influenzae Rd
uucauccaaagaaau

SEQ ID NO: 681510 - RNA, 16 nt, Haemophilus influenzae Rd
uucaucgagaaauacg

SEQ ID NO: 681511 - RNA, 15 nt, Haemophilus influenzae Rd
uucaucgccauuaaa

SEQ ID NO: 681512 - RNA, 19 nt, Haemophilus influenzae Rd
uucaucgccugacugcccg

SEQ ID NO: 681513 - RNA, 18 nt, Haemophilus influenzae Rd
uucaucgccuguuaagcc

SEQ ID NO: 681514 - RNA, 18 nt, Haemophilus influenzae Rd
uucaucccaauuauugga

SEQ ID NO: 681515 - RNA, 16 nt, Haemophilus influenzae Rd
uucaucugcaucacaa

SEQ ID NO: 681516 - RNA, 17 nt, Haemophilus influenzae Rd
uucaucugcaucacaaa

SEQ ID NO: 681517 - RNA, 21 nt, Haemophilus influenzae Rd
uucaucguuugaacaaauuca

SEQ ID NO: 681518 - RNA, 22 nt, Haemophilus influenzae Rd
uucaucgcgcaaaauaauaucc

SEQ ID NO: 681519 - RNA, 22 nt, Haemophilus influenzae Rd
uucaucuucugcugauaaucca

SEQ ID NO: 681520 - RNA, 23 nt, Haemophilus influenzae Rd
uucaucuucugcugauaauccag

SEQ ID NO: 681521 - RNA, 13 nt, Haemophilus influenzae Rd
uucaucuucagua

SEQ ID NO: 681522 - RNA, 16 nt, Haemophilus influenzae Rd
uucaucuucaucaaua

SEQ ID NO: 681523 - RNA, 21 nt, Haemophilus influenzae Rd
uucaucuuagcuuuuuucuua

SEQ ID NO: 681524 - RNA, 14 nt, Haemophilus influenzae Rd
uucaucuuccguga

SEQ ID NO: 681525 - RNA, 15 nt, Haemophilus influenzae Rd
uucaucuuuuaaaua

SEQ ID NO: 681526 - RNA, 22 nt, Haemophilus influenzae Rd
uucaucuuuuaacacgaaacca

SEQ ID NO: 681527 - RNA, 19 nt, Haemophilus influenzae Rd
uucaugauguaauucugcu

SEQ ID NO: 681528 - RNA, 20 nt, Haemophilus influenzae Rd
uucaugagcugggcaaacaa

SEQ ID NO: 681529 - RNA, 14 nt, Haemophilus influenzae Rd
uucaccaaucacag

SEQ ID NO: 681530 - RNA, 18 nt, Haemophilus influenzae Rd
uucaccaauuuaucugcu

SEQ ID NO: 681531 - RNA, 14 nt, Haemophilus influenzae Rd
uucacauuagugaa

SEQ ID NO: 681532 - RNA, 17 nt, Haemophilus influenzae Rd
uucacauaaauuacaau

SEQ ID NO: 681533 - RNA, 18 nt, Haemophilus influenzae Rd
uucacagggcugaguccu

SEQ ID NO: 681534 - RNA, 21 nt, Haemophilus influenzae Rd
uucacagaaacggcgaagauu

SEQ ID NO: 681535 - RNA, 16 nt, Haemophilus influenzae Rd
uucacagagaauaaau

SEQ ID NO: 681536 - RNA, 18 nt, Haemophilus influenzae Rd
uucacagagaauaaauca

SEQ ID NO: 681537 - RNA, 16 nt, Haemophilus influenzae Rd
uucaauuuuuuaucaa

SEQ ID NO: 681538 - RNA, 20 nt, Haemophilus influenzae Rd
uucaauuuuuuaucaaauaa

SEQ ID NO: 681539 - RNA, 21 nt, Haemophilus influenzae Rd
uucaauuuuuuaucaaauaac

SEQ ID NO: 681540 - RNA, 13 nt, Haemophilus influenzae Rd
uucaauuuuaaaa

SEQ ID NO: 681541 - RNA, 14 nt, Haemophilus influenzae Rd
uucaauuuuaaaau

SEQ ID NO: 681542 - RNA, 16 nt, Haemophilus influenzae Rd
uucaauuuuaauuggu

SEQ ID NO: 681543 - RNA, 19 nt, Haemophilus influenzae Rd
uucaauuuuccccucaauu

SEQ ID NO: 681544 - RNA, 20 nt, Haemophilus influenzae Rd
uucacaaaaguuugcaacau

SEQ ID NO: 681545 - RNA, 15 nt, Haemophilus influenzae Rd
uucacaaaauauuag

SEQ ID NO: 681546 - RNA, 13 nt, Haemophilus influenzae Rd
uucacaaacccau

SEQ ID NO: 681547 - RNA, 21 nt, Haemophilus influenzae Rd
uucacaaaucuaaaaauaugu

SEQ ID NO: 681548 - RNA, 18 nt, Haemophilus influenzae Rd
uucacaaucgccaauucu

SEQ ID NO: 681549 - RNA, 22 nt, Haemophilus influenzae Rd
uucacaaucgccaauucuucag

SEQ ID NO: 681550 - RNA, 13 nt, Haemophilus influenzae Rd
uucacaagcauag

SEQ ID NO: 681551 - RNA, 14 nt, Haemophilus influenzae Rd
uucaauuacauauu

SEQ ID NO: 681552 - RNA, 15 nt, Haemophilus influenzae Rd
uucaaugucuuuuuc

SEQ ID NO: 681553 - RNA, 11 nt, Haemophilus influenzae Rd
uucaauguuug

SEQ ID NO: 681554 - RNA, 13 nt, Haemophilus influenzae Rd
uucaauuaaugaa

SEQ ID NO: 681555 - RNA, 21 nt, Haemophilus influenzae Rd
uucaauugugccguauuuuuu

SEQ ID NO: 681556 - RNA, 22 nt, Haemophilus influenzae Rd
uucaauugugccguauuuuuua

SEQ ID NO: 681557 - RNA, 14 nt, Haemophilus influenzae Rd
uucaauuuaaauca

SEQ ID NO: 681558 - RNA, 14 nt, Haemophilus influenzae Rd
uucaauuuaacauu

SEQ ID NO: 681559 - RNA, 16 nt, Haemophilus influenzae Rd
uucaauuuaagcccug

SEQ ID NO: 681560 - RNA, 20 nt, Haemophilus influenzae Rd
uucaauuuacccacuucaua

SEQ ID NO: 681561 - RNA, 17 nt, Haemophilus influenzae Rd
uucaauuugaacaaacg

SEQ ID NO: 681562 - RNA, 15 nt, Haemophilus influenzae Rd
uucaauuugagaaau

SEQ ID NO: 681563 - RNA, 18 nt, Haemophilus influenzae Rd
uucaauuugagucucaaa

SEQ ID NO: 681564 - RNA, 13 nt, Haemophilus influenzae Rd
uucaauuuggaaa

SEQ ID NO: 681565 - RNA, 19 nt, Haemophilus influenzae Rd
uucaauuuggaaaccugca

SEQ ID NO: 681566 - RNA, 14 nt, Haemophilus influenzae Rd
uucaaugcagaaau

SEQ ID NO: 681567 - RNA, 15 nt, Haemophilus influenzae Rd
uucaaugcagaaaua

SEQ ID NO: 681568 - RNA, 16 nt, Haemophilus influenzae Rd
uucaaugcagaaauaa

SEQ ID NO: 681569 - RNA, 19 nt, Haemophilus influenzae Rd
uucaaugcagaaauacuuu

SEQ ID NO: 681570 - RNA, 19 nt, Haemophilus influenzae Rd
uucaaugcaacaauacguu

SEQ ID NO: 681571 - RNA, 20 nt, Haemophilus influenzae Rd
uucaauggcuuauugcuauc

SEQ ID NO: 681572 - RNA, 17 nt, Haemophilus influenzae Rd
uucaaugguuuauaaca

SEQ ID NO: 681573 - RNA, 15 nt, Haemophilus influenzae Rd
uucaaugaaauauua

SEQ ID NO: 681574 - RNA, 17 nt, Haemophilus influenzae Rd
uucaaucgcaucauuca

SEQ ID NO: 681575 - RNA, 21 nt, Haemophilus influenzae Rd
uucaaucaucauuuauuaaaa

SEQ ID NO: 681576 - RNA, 16 nt, Haemophilus influenzae Rd
uucaauaucuaagaaa

SEQ ID NO: 681577 - RNA, 22 nt, Haemophilus influenzae Rd
uucaauaucuaagaaaauagaa

SEQ ID NO: 681578 - RNA, 23 nt, Haemophilus influenzae Rd
uucaauaucucgugaugcagaaa

SEQ ID NO: 681579 - RNA, 22 nt, Haemophilus influenzae Rd
uucaauacuuuucccaaugcac

SEQ ID NO: 681580 - RNA, 18 nt, Haemophilus influenzae Rd
uucaauaucaaagaaaaa

SEQ ID NO: 681581 - RNA, 13 nt, Haemophilus influenzae Rd
uucaauauguucu

SEQ ID NO: 681582 - RNA, 22 nt, Haemophilus influenzae Rd
uucaauauugucuauuuuauuu

SEQ ID NO: 681583 - RNA, 19 nt, Haemophilus influenzae Rd
uucaauaauugaagcaauu

SEQ ID NO: 681584 - RNA, 20 nt, Haemophilus influenzae Rd
uucaauaauugaagcaauug

SEQ ID NO: 681585 - RNA, 11 nt, Haemophilus influenzae Rd
uucaauaauau

SEQ ID NO: 681586 - RNA, 21 nt, Haemophilus influenzae Rd
uucaauagguuauaaguuuuu

SEQ ID NO: 681587 - RNA, 16 nt, Haemophilus influenzae Rd
uucaauaagcaaguaa

SEQ ID NO: 681588 - RNA, 18 nt, Haemophilus influenzae Rd
uucaauaagcucgccuuu

SEQ ID NO: 681589 - RNA, 13 nt, Haemophilus influenzae Rd
uucaaguaaaugc

SEQ ID NO: 681590 - RNA, 18 nt, Haemophilus influenzae Rd
uucaaguaaaugcgcuuu

SEQ ID NO: 681591 - RNA, 16 nt, Haemophilus influenzae Rd
uucaagcuuugcaaca

SEQ ID NO: 681592 - RNA, 21 nt, Haemophilus influenzae Rd
uucaaggaaaaaggcaucuuu

SEQ ID NO: 681593 - RNA, 18 nt, Haemophilus influenzae Rd
uucaaggccauauuuucc

SEQ ID NO: 681594 - RNA, 22 nt, Haemophilus influenzae Rd
uucaaggccauauuuucccagu

SEQ ID NO: 681595 - RNA, 17 nt, Haemophilus influenzae Rd
uucaaggacugaguucu

SEQ ID NO: 681596 - RNA, 13 nt, Haemophilus influenzae Rd
uucaaguguuuuu

SEQ ID NO: 681597 - RNA, 15 nt, Haemophilus influenzae Rd
uucaauaaaaauaua

SEQ ID NO: 681598 - RNA, 15 nt, Haemophilus influenzae Rd
uucacgguuauacca

SEQ ID NO: 681599 - RNA, 15 nt, Haemophilus influenzae Rd
uucacgguacgcugc

SEQ ID NO: 681600 - RNA, 15 nt, Haemophilus influenzae Rd
uucacggcauaguaa

SEQ ID NO: 681601 - RNA, 23 nt, Haemophilus influenzae Rd
uucacguccgccgaugaauaauu

SEQ ID NO: 681602 - RNA, 19 nt, Haemophilus influenzae Rd
uucacguaguuaaaccaaa

SEQ ID NO: 681603 - RNA, 17 nt, Haemophilus influenzae Rd
uucacguguuuuuucac

SEQ ID NO: 681604 - RNA, 18 nt, Haemophilus influenzae Rd
uucacuaaauaaaugguc

SEQ ID NO: 681605 - RNA, 13 nt, Haemophilus influenzae Rd
uucacugaauaca

SEQ ID NO: 681606 - RNA, 19 nt, Haemophilus influenzae Rd
uucacugauuuccuguaaa

SEQ ID NO: 681607 - RNA, 14 nt, Haemophilus influenzae Rd
uucacuauuucauc

SEQ ID NO: 681608 - RNA, 23 nt, Haemophilus influenzae Rd
uucacugcaucuguugugaaugc

SEQ ID NO: 681609 - RNA, 22 nt, Haemophilus influenzae Rd
uucaccgcacuuuuaucucuaa

SEQ ID NO: 681610 - RNA, 23 nt, Haemophilus influenzae Rd
uucaccguuaagcaaauuucugu

SEQ ID NO: 681611 - RNA, 14 nt, Haemophilus influenzae Rd
uucaccguuuuucc

SEQ ID NO: 681612 - RNA, 13 nt, Haemophilus influenzae Rd
uucaccuaauccu

SEQ ID NO: 681613 - RNA, 15 nt, Haemophilus influenzae Rd
uucacgaucauaaau

SEQ ID NO: 681614 - RNA, 23 nt, Haemophilus influenzae Rd
uucacgagagacgccuuuaaaac

SEQ ID NO: 681615 - RNA, 17 nt, Haemophilus influenzae Rd
uucaccuugaucuacag

SEQ ID NO: 681616 - RNA, 16 nt, Haemophilus influenzae Rd
uucaccuucgaauaaa

SEQ ID NO: 681617 - RNA, 20 nt, Haemophilus influenzae Rd
uucacgcuaaggcaaaaaaa

SEQ ID NO: 681618 - RNA, 23 nt, Haemophilus influenzae Rd
uucacgccuucgcgagauaaaau

SEQ ID NO: 681619 - RNA, 19 nt, Haemophilus influenzae Rd
uucacgcccaaauacuuca

SEQ ID NO: 681620 - RNA, 17 nt, Haemophilus influenzae Rd
uucagcaucaacauaaa

SEQ ID NO: 681621 - RNA, 20 nt, Haemophilus influenzae Rd
uucagcagggauuuuaaguu

SEQ ID NO: 681622 - RNA, 13 nt, Haemophilus influenzae Rd
uucagcaauuaau

SEQ ID NO: 681623 - RNA, 15 nt, Haemophilus influenzae Rd
uucagcaaguucugc

SEQ ID NO: 681624 - RNA, 16 nt, Haemophilus influenzae Rd
uucagcaaguucugca

SEQ ID NO: 681625 - RNA, 13 nt, Haemophilus influenzae Rd
uucagcacuugca

SEQ ID NO: 681626 - RNA, 21 nt, Haemophilus influenzae Rd
uucagcacuuucgcuuaaaaa

SEQ ID NO: 681627 - RNA, 15 nt, Haemophilus influenzae Rd
uucagauuuuauauc

SEQ ID NO: 681628 - RNA, 16 nt, Haemophilus influenzae Rd
uucagauucaauaaua

SEQ ID NO: 681629 - RNA, 22 nt, Haemophilus influenzae Rd
uucagauucaauaauagccaua

SEQ ID NO: 681630 - RNA, 19 nt, Haemophilus influenzae Rd
uucacuuuuccacaauuca

SEQ ID NO: 681631 - RNA, 16 nt, Haemophilus influenzae Rd
uucagaaaauaaauaa

SEQ ID NO: 681632 - RNA, 11 nt, Haemophilus influenzae Rd
uucagaaaaag

SEQ ID NO: 681633 - RNA, 19 nt, Haemophilus influenzae Rd
uucagacuagcaucaaaau

SEQ ID NO: 681634 - RNA, 16 nt, Haemophilus influenzae Rd
uucagacugaauuuga

SEQ ID NO: 681635 - RNA, 18 nt, Haemophilus influenzae Rd
uucagacaaaacuuauca

SEQ ID NO: 681636 - RNA, 17 nt, Haemophilus influenzae Rd
uucagaagucacauauu

SEQ ID NO: 681637 - RNA, 16 nt, Haemophilus influenzae Rd
uucagaauaaagaaau

SEQ ID NO: 681638 - RNA, 19 nt, Haemophilus influenzae Rd
uggcuaaaccgauuuugac

SEQ ID NO: 681639 - RNA, 14 nt, Haemophilus influenzae Rd
uggcucaaguauuc

SEQ ID NO: 681640 - RNA, 16 nt, Haemophilus influenzae Rd
uggcuaugucaauuac

SEQ ID NO: 681641 - RNA, 22 nt, Haemophilus influenzae Rd
uggcuauuaugaggaauuuguu

SEQ ID NO: 681642 - RNA, 20 nt, Haemophilus influenzae Rd
uggcuauugaaaauuauugu

SEQ ID NO: 681643 - RNA, 15 nt, Haemophilus influenzae Rd
uggcugaaaaauuca

SEQ ID NO: 681644 - RNA, 19 nt, Haemophilus influenzae Rd
uggcucuaaauuaauuuac

SEQ ID NO: 681645 - RNA, 21 nt, Haemophilus influenzae Rd
uggcucuacuuugcgccugua

SEQ ID NO: 681646 - RNA, 14 nt, Haemophilus influenzae Rd
uggcucauuuuaaa

SEQ ID NO: 681647 - RNA, 12 nt, Haemophilus influenzae Rd
uggcuccgccac

SEQ ID NO: 681648 - RNA, 23 nt, Haemophilus influenzae Rd
uggcguucugucuauuuauuuuc

SEQ ID NO: 681649 - RNA, 17 nt, Haemophilus influenzae Rd
uggcguuuuuuauaaac

SEQ ID NO: 681650 - RNA, 13 nt, Haemophilus influenzae Rd
uggcuaacaaaua

SEQ ID NO: 681651 - RNA, 17 nt, Haemophilus influenzae Rd
uggcuaacaaauaaugc

SEQ ID NO: 681652 - RNA, 15 nt, Haemophilus influenzae Rd
uggcuaacaccauug

SEQ ID NO: 681653 - RNA, 14 nt, Haemophilus influenzae Rd
uggcggguuucuuu

SEQ ID NO: 681654 - RNA, 16 nt, Haemophilus influenzae Rd
uggcguaaugccauca

SEQ ID NO: 681655 - RNA, 15 nt, Haemophilus influenzae Rd
uggcgguuuugccaa

SEQ ID NO: 681656 - RNA, 17 nt, Haemophilus influenzae Rd
uggaaaauaaaaugaca

SEQ ID NO: 681657 - RNA, 21 nt, Haemophilus influenzae Rd
ugggaaauggcuuuucaauuu

SEQ ID NO: 681658 - RNA, 17 nt, Haemophilus influenzae Rd
uggcuugugaaauaaaa

SEQ ID NO: 681659 - RNA, 23 nt, Haemophilus influenzae Rd
uggcuuauuuacuuuauaaauga

SEQ ID NO: 681660 - RNA, 17 nt, Haemophilus influenzae Rd
uggcuuacagcaaaagc

SEQ ID NO: 681661 - RNA, 12 nt, Haemophilus influenzae Rd
uggcuuaauuac

SEQ ID NO: 681662 - RNA, 14 nt, Haemophilus influenzae Rd
uggcuuaauuacua

SEQ ID NO: 681663 - RNA, 23 nt, Haemophilus influenzae Rd
uggcuucgggcaccauuuaaaca

SEQ ID NO: 681664 - RNA, 18 nt, Haemophilus influenzae Rd
uggcuucaucuuuuaaca

SEQ ID NO: 681665 - RNA, 16 nt, Haemophilus influenzae Rd
uggcuugaaaauauuc

SEQ ID NO: 681666 - RNA, 13 nt, Haemophilus influenzae Rd
uggcuugauuuua

SEQ ID NO: 681667 - RNA, 16 nt, Haemophilus influenzae Rd
uggcugagagaagaaa

SEQ ID NO: 681668 - RNA, 16 nt, Haemophilus influenzae Rd
uggcuguguaaaacau

SEQ ID NO: 681669 - RNA, 14 nt, Haemophilus influenzae Rd
uggcuguuguuuug

SEQ ID NO: 681670 - RNA, 23 nt, Haemophilus influenzae Rd
uggcugggauuucaaacaauaug

SEQ ID NO: 681671 - RNA, 23 nt, Haemophilus influenzae Rd
ugggcgaguggcuuguaaugcaa

SEQ ID NO: 681672 - RNA, 14 nt, Haemophilus influenzae Rd
ugggaauuuuccca

SEQ ID NO: 681673 - RNA, 14 nt, Haemophilus influenzae Rd
ugggaauucauaaa

SEQ ID NO: 681674 - RNA, 20 nt, Haemophilus influenzae Rd
ugggacuggacuccaaggca

SEQ ID NO: 681675 - RNA, 19 nt, Haemophilus influenzae Rd
uggggaaaaauauuaaaga

SEQ ID NO: 681676 - RNA, 16 nt, Haemophilus influenzae Rd
uggggaaguaauauuu

SEQ ID NO: 681677 - RNA, 22 nt, Haemophilus influenzae Rd
uggggacgcaccuuuugaaaaa

SEQ ID NO: 681678 - RNA, 22 nt, Haemophilus influenzae Rd
ugggcguaauguuggaucccaa

SEQ ID NO: 681679 - RNA, 17 nt, Haemophilus influenzae Rd
uggugcgaccucgccau

SEQ ID NO: 681680 - RNA, 22 nt, Haemophilus influenzae Rd
uggucgcaguguugcagggaaa

SEQ ID NO: 681681 - RNA, 16 nt, Haemophilus influenzae Rd
uggucugcauuacugc

SEQ ID NO: 681682 - RNA, 23 nt, Haemophilus influenzae Rd
uggugcaacgacaaucacuggca

SEQ ID NO: 681683 - RNA, 18 nt, Haemophilus influenzae Rd
uggugaaaggugguuuuu

SEQ ID NO: 681684 - RNA, 16 nt, Haemophilus influenzae Rd
uggucuguuucuucua

SEQ ID NO: 681685 - RNA, 14 nt, Haemophilus influenzae Rd
uggucuguuucuuc

SEQ ID NO: 681686 - RNA, 24 nt, Haemophilus influenzae Rd
uggucaaagauguuccuacagaac

SEQ ID NO: 681687 - RNA, 20 nt, Haemophilus influenzae Rd
uggucaauuagcaaagaauu

SEQ ID NO: 681688 - RNA, 23 nt, Haemophilus influenzae Rd
ugguaguggcaauccaacagcuu

SEQ ID NO: 681689 - RNA, 15 nt, Haemophilus influenzae Rd
ugguagcuaaaaaua

SEQ ID NO: 681690 - RNA, 19 nt, Haemophilus influenzae Rd
uggucauugcugccuaacc

SEQ ID NO: 681691 - RNA, 13 nt, Haemophilus influenzae Rd
ugguaacaacugc

SEQ ID NO: 681692 - RNA, 14 nt, Haemophilus influenzae Rd
ugguaacaacugcu

SEQ ID NO: 681693 - RNA, 18 nt, Haemophilus influenzae Rd
uggguaaaccaaacgaga

SEQ ID NO: 681694 - RNA, 13 nt, Haemophilus influenzae Rd
ugguacaaauuua

SEQ ID NO: 681695 - RNA, 20 nt, Haemophilus influenzae Rd
ugguaauuugcgucuuaaau

SEQ ID NO: 681696 - RNA, 16 nt, Haemophilus influenzae Rd
ugguaauuugcucaaa

SEQ ID NO: 681697 - RNA, 19 nt, Haemophilus influenzae Rd
ugguaaugcacguucuaau

SEQ ID NO: 681698 - RNA, 23 nt, Haemophilus influenzae Rd
ugguaauaaaccguuagguuuaa

SEQ ID NO: 681699 - RNA, 21 nt, Haemophilus influenzae Rd
ugguaauaaaucaaaagaauu

SEQ ID NO: 681700 - RNA, 15 nt, Haemophilus influenzae Rd
ugguaauaaucaauu

SEQ ID NO: 681701 - RNA, 19 nt, Haemophilus influenzae Rd
ugguuuaugccauagcucc

SEQ ID NO: 681702 - RNA, 15 nt, Haemophilus influenzae Rd
ugguuguaauaauga

SEQ ID NO: 681703 - RNA, 16 nt, Haemophilus influenzae Rd
ugguuuauaacaaguu

SEQ ID NO: 681704 - RNA, 20 nt, Haemophilus influenzae Rd
ugguuuaguuuacuuuugau

SEQ ID NO: 681705 - RNA, 18 nt, Haemophilus influenzae Rd
ugguuaaaaauagccuca

SEQ ID NO: 681706 - RNA, 14 nt, Haemophilus influenzae Rd
ugguucauuauuaa

SEQ ID NO: 681707 - RNA, 19 nt, Haemophilus influenzae Rd
ugguucgagaaacuuucaa

SEQ ID NO: 681708 - RNA, 20 nt, Haemophilus influenzae Rd
ugguucgagaaacuuucaaa

SEQ ID NO: 681709 - RNA, 24 nt, Haemophilus influenzae Rd
ugguucgauuucaucuucauucca

SEQ ID NO: 681710 - RNA, 11 nt, Haemophilus influenzae Rd
ugguucugcag

SEQ ID NO: 681711 - RNA, 23 nt, Haemophilus influenzae Rd
ugguucgcauaucgauaauuuaa

SEQ ID NO: 681712 - RNA, 19 nt, Haemophilus influenzae Rd
ugguucuaaauauuuuuca

SEQ ID NO: 681713 - RNA, 16 nt, Haemophilus influenzae Rd
ugguugaguucuugca

SEQ ID NO: 681714 - RNA, 19 nt, Haemophilus influenzae Rd
uguaagcauuaaaaauuua

SEQ ID NO: 681715 - RNA, 17 nt, Haemophilus influenzae Rd
uguaacaguauauccug

SEQ ID NO: 681716 - RNA, 21 nt, Haemophilus influenzae Rd
uguaagauaaacgcauagaaa

SEQ ID NO: 681717 - RNA, 17 nt, Haemophilus influenzae Rd
uguaaggcgagaucuug

SEQ ID NO: 681718 - RNA, 18 nt, Haemophilus influenzae Rd
uguaaguagcguaaaccu

SEQ ID NO: 681719 - RNA, 17 nt, Haemophilus influenzae Rd
uguaacacaaaaucuug

SEQ ID NO: 681720 - RNA, 17 nt, Haemophilus influenzae Rd
uguaaauuauuuuaaua

SEQ ID NO: 681721 - RNA, 22 nt, Haemophilus influenzae Rd
uguaaauugacggcuucagaaa

SEQ ID NO: 681722 - RNA, 13 nt, Haemophilus influenzae Rd
uguaaaaaauaau

SEQ ID NO: 681723 - RNA, 22 nt, Haemophilus influenzae Rd
uguaaaaagggaugguuaauuu

SEQ ID NO: 681724 - RNA, 13 nt, Haemophilus influenzae Rd
ugguuucuguugc

SEQ ID NO: 681725 - RNA, 21 nt, Haemophilus influenzae Rd
ugguuuucuugccaaaauuca

SEQ ID NO: 681726 - RNA, 20 nt, Haemophilus influenzae Rd
ugguuuugugaguaaaauac

SEQ ID NO: 681727 - RNA, 15 nt, Haemophilus influenzae Rd
uguaauguuuuaaua

SEQ ID NO: 681728 - RNA, 16 nt, Haemophilus influenzae Rd
uguaaugcaaaccauu

SEQ ID NO: 681729 - RNA, 11 nt, Haemophilus influenzae Rd
uguaauuccau

SEQ ID NO: 681730 - RNA, 12 nt, Haemophilus influenzae Rd
uguacacacacc

SEQ ID NO: 681731 - RNA, 14 nt, Haemophilus influenzae Rd
uguacaccaaaaua

SEQ ID NO: 681732 - RNA, 16 nt, Haemophilus influenzae Rd
uguacaccaaaauaac

SEQ ID NO: 681733 - RNA, 12 nt, Haemophilus influenzae Rd
uguaauucugcu

SEQ ID NO: 681734 - RNA, 17 nt, Haemophilus influenzae Rd
uguaauugauuuucaga

SEQ ID NO: 681735 - RNA, 21 nt, Haemophilus influenzae Rd
uguaauccuuuuguuuuauca

SEQ ID NO: 681736 - RNA, 23 nt, Haemophilus influenzae Rd
uguaauccuuuuguuuuaucaga

SEQ ID NO: 681737 - RNA, 23 nt, Haemophilus influenzae Rd
uguaaucuacagggcuuaguccu

SEQ ID NO: 681738 - RNA, 23 nt, Haemophilus influenzae Rd
uguaaguguagcaauaaacagaa

SEQ ID NO: 681739 - RNA, 18 nt, Haemophilus influenzae Rd
uguacaucccauauacuu

SEQ ID NO: 681740 - RNA, 16 nt, Haemophilus influenzae Rd
uguaucugauuuuuua

SEQ ID NO: 681741 - RNA, 16 nt, Haemophilus influenzae Rd
uguaugaaaaaugcuu

SEQ ID NO: 681742 - RNA, 15 nt, Haemophilus influenzae Rd
ugucaguaacuacaa

SEQ ID NO: 681743 - RNA, 14 nt, Haemophilus influenzae Rd
uguccauaacuguc

SEQ ID NO: 681744 - RNA, 14 nt, Haemophilus influenzae Rd
ugucccaaaauauu

SEQ ID NO: 681745 - RNA, 20 nt, Haemophilus influenzae Rd
ugucauuaaaaaauaauucc

SEQ ID NO: 681746 - RNA, 17 nt, Haemophilus influenzae Rd
ugucauuaaaccaaaag

SEQ ID NO: 681747 - RNA, 17 nt, Haemophilus influenzae Rd
uguccaaaaaugccuac

SEQ ID NO: 681748 - RNA, 19 nt, Haemophilus influenzae Rd
ugucauugccauuucugca

SEQ ID NO: 681749 - RNA, 20 nt, Haemophilus influenzae Rd
ugucauuuauggaaauaaau

SEQ ID NO: 681750 - RNA, 22 nt, Haemophilus influenzae Rd
uguccaauaauuaaacuuucaa

SEQ ID NO: 681751 - RNA, 21 nt, Haemophilus influenzae Rd
ugucaucagaaauaucuucaa

SEQ ID NO: 681752 - RNA, 21 nt, Haemophilus influenzae Rd
ugucaucuaauuguucuucug

SEQ ID NO: 681753 - RNA, 16 nt, Haemophilus influenzae Rd
ugucaucuaguaccug

SEQ ID NO: 681754 - RNA, 20 nt, Haemophilus influenzae Rd
ugucaugacuauuacaauug

SEQ ID NO: 681755 - RNA, 13 nt, Haemophilus influenzae Rd
ugucgcagucugu

SEQ ID NO: 681756 - RNA, 19 nt, Haemophilus influenzae Rd
ugucgcaggugucacagca

SEQ ID NO: 681757 - RNA, 18 nt, Haemophilus influenzae Rd
ugucgcacguuuacuuuu

SEQ ID NO: 681758 - RNA, 17 nt, Haemophilus influenzae Rd
ugucgccauuuaagccu

SEQ ID NO: 681759 - RNA, 14 nt, Haemophilus influenzae Rd
ugucgaaauuuuuc

SEQ ID NO: 681760 - RNA, 15 nt, Haemophilus influenzae Rd
uguccuuuaucaagc

SEQ ID NO: 681761 - RNA, 14 nt, Haemophilus influenzae Rd
ugucucauuuugcu

SEQ ID NO: 681762 - RNA, 12 nt, Haemophilus influenzae Rd
ugucguucuuuu

SEQ ID NO: 681763 - RNA, 15 nt, Haemophilus influenzae Rd
ugucgugaaagaaua

SEQ ID NO: 681764 - RNA, 14 nt, Haemophilus influenzae Rd
ugucgcuuucuuau

SEQ ID NO: 681765 - RNA, 19 nt, Haemophilus influenzae Rd
ugugaaauauucuuggaga

SEQ ID NO: 681766 - RNA, 22 nt, Haemophilus influenzae Rd
ugugaaguuuaugaucuacacc

SEQ ID NO: 681767 - RNA, 14 nt, Haemophilus influenzae Rd
ugugaaguuuuuua

SEQ ID NO: 681768 - RNA, 16 nt, Haemophilus influenzae Rd
ugugaaauaaaauaua

SEQ ID NO: 681769 - RNA, 16 nt, Haemophilus influenzae Rd
ugugaguguaaugcgu

SEQ ID NO: 681770 - RNA, 13 nt, Haemophilus influenzae Rd
ugugaaugcaaua

SEQ ID NO: 681771 - RNA, 19 nt, Haemophilus influenzae Rd
ugugaauauccaaacuuuc

SEQ ID NO: 681772 - RNA, 12 nt, Haemophilus influenzae Rd
ugugauuaaaau

SEQ ID NO: 681773 - RNA, 15 nt, Haemophilus influenzae Rd
ugugauguucuaaau

SEQ ID NO: 681774 - RNA, 18 nt, Haemophilus influenzae Rd
ugugauaaauguguuaaa

SEQ ID NO: 681775 - RNA, 17 nt, Haemophilus influenzae Rd
ugucuucuguuuggaua

SEQ ID NO: 681776 - RNA, 14 nt, Haemophilus influenzae Rd
ugugaaaaaacgua

SEQ ID NO: 681777 - RNA, 21 nt, Haemophilus influenzae Rd
ugucuggcugaguaaauaauu

SEQ ID NO: 681778 - RNA, 21 nt, Haemophilus influenzae Rd
uguggaguuauuucuuuaaau

SEQ ID NO: 681779 - RNA, 21 nt, Haemophilus influenzae Rd
uguggaaaaauguaauucugg

SEQ ID NO: 681780 - RNA, 17 nt, Haemophilus influenzae Rd
uguggaaacgugcaauu

SEQ ID NO: 681781 - RNA, 18 nt, Haemophilus influenzae Rd
ugugcuugaugucaguga

SEQ ID NO: 681782 - RNA, 14 nt, Haemophilus influenzae Rd
uguguaggcauauc

SEQ ID NO: 681783 - RNA, 13 nt, Haemophilus influenzae Rd
uguguggaaaaau

SEQ ID NO: 681784 - RNA, 23 nt, Haemophilus influenzae Rd
uguguggaaaaauguaauucugg

SEQ ID NO: 681785 - RNA, 15 nt, Haemophilus influenzae Rd
uguggugaccgauaa

SEQ ID NO: 681786 - RNA, 16 nt, Haemophilus influenzae Rd
ugugcuugcuuuaauu

SEQ ID NO: 681787 - RNA, 15 nt, Haemophilus influenzae Rd
ugugcauuugggaau

SEQ ID NO: 681788 - RNA, 17 nt, Haemophilus influenzae Rd
ugugccaaauucauucu

SEQ ID NO: 681789 - RNA, 19 nt, Haemophilus influenzae Rd
ugugccaauccauaaaaua

SEQ ID NO: 681790 - RNA, 17 nt, Haemophilus influenzae Rd
ugugcaagcauuucaag

SEQ ID NO: 681791 - RNA, 16 nt, Haemophilus influenzae Rd
ugugauuuuagaaaaa

SEQ ID NO: 681792 - RNA, 23 nt, Haemophilus influenzae Rd
ugugcaaaguuaccauuuauucc

SEQ ID NO: 681793 - RNA, 14 nt, Haemophilus influenzae Rd
uguuauauugaacg

SEQ ID NO: 681794 - RNA, 18 nt, Haemophilus influenzae Rd
uguuauauaaacaauucc

SEQ ID NO: 681795 - RNA, 15 nt, Haemophilus influenzae Rd
uguucaaauaaugug

SEQ ID NO: 681796 - RNA, 20 nt, Haemophilus influenzae Rd
uguucaaccacuucagcaga

SEQ ID NO: 681797 - RNA, 14 nt, Haemophilus influenzae Rd
uguucaagauguga

SEQ ID NO: 681798 - RNA, 18 nt, Haemophilus influenzae Rd
uguucaaguaaaugcgcu

SEQ ID NO: 681799 - RNA, 15 nt, Haemophilus influenzae Rd
uguuacaucgaauug

SEQ ID NO: 681800 - RNA, 13 nt, Haemophilus influenzae Rd
uguuaccuaauuc

SEQ ID NO: 681801 - RNA, 21 nt, Haemophilus influenzae Rd
uguuagaaagccuuuuaaaau

SEQ ID NO: 681802 - RNA, 14 nt, Haemophilus influenzae Rd
uguuaauuaucaaa

SEQ ID NO: 681803 - RNA, 14 nt, Haemophilus influenzae Rd
uguuacaaauuccu

SEQ ID NO: 681804 - RNA, 14 nt, Haemophilus influenzae Rd
uguuaccaauaacu

SEQ ID NO: 681805 - RNA, 22 nt, Haemophilus influenzae Rd
uguguuagaaagccuuuuaaaa

SEQ ID NO: 681806 - RNA, 16 nt, Haemophilus influenzae Rd
uguuaauagaauauaa

SEQ ID NO: 681807 - RNA, 15 nt, Haemophilus influenzae Rd
uguguuuauuuaaca

SEQ ID NO: 681808 - RNA, 17 nt, Haemophilus influenzae Rd
uguugccauuguuaaau

SEQ ID NO: 681809 - RNA, 20 nt, Haemophilus influenzae Rd
uguugccauuguuaaauguu

SEQ ID NO: 681810 - RNA, 17 nt, Haemophilus influenzae Rd
uguugaauuggaaguuu

SEQ ID NO: 681811 - RNA, 16 nt, Haemophilus influenzae Rd
uguugaaaagaauaau

SEQ ID NO: 681812 - RNA, 17 nt, Haemophilus influenzae Rd
uguucuucuaauguagu

SEQ ID NO: 681813 - RNA, 13 nt, Haemophilus influenzae Rd
uguuccacauuau

SEQ ID NO: 681814 - RNA, 20 nt, Haemophilus influenzae Rd
uguucgaguuggcucauugu

SEQ ID NO: 681815 - RNA, 23 nt, Haemophilus influenzae Rd
uguucgaguuggcucauugugau

SEQ ID NO: 681816 - RNA, 20 nt, Haemophilus influenzae Rd
uguucaugugggcuuuacaa

SEQ ID NO: 681817 - RNA, 19 nt, Haemophilus influenzae Rd
uguucgcugguuaaauuaa

SEQ ID NO: 681818 - RNA, 20 nt, Haemophilus influenzae Rd
uguucgcugguuaaauuaac

SEQ ID NO: 681819 - RNA, 21 nt, Haemophilus influenzae Rd
uguucauccuuauccugccuu

SEQ ID NO: 681820 - RNA, 14 nt, Haemophilus influenzae Rd
uguucauuuuaaaa

SEQ ID NO: 681821 - RNA, 19 nt, Haemophilus influenzae Rd
uguucauuuuuacuuucuu

SEQ ID NO: 681822 - RNA, 20 nt, Haemophilus influenzae Rd
uguucauuuuuacuuucuuu

SEQ ID NO: 681823 - RNA, 14 nt, Haemophilus influenzae Rd
uguucugcaucaau

SEQ ID NO: 681824 - RNA, 13 nt, Haemophilus influenzae Rd
uguucugcauuag

SEQ ID NO: 681825 - RNA, 22 nt, Haemophilus influenzae Rd
uguucugauuacuuaaaguuau

SEQ ID NO: 681826 - RNA, 17 nt, Haemophilus influenzae Rd
uguucgguuaaagaagc

SEQ ID NO: 681827 - RNA, 15 nt, Haemophilus influenzae Rd
uguucugacacuucc

SEQ ID NO: 681828 - RNA, 23 nt, Haemophilus influenzae Rd
uuacugucaccucguaaaauauu

SEQ ID NO: 681829 - RNA, 20 nt, Haemophilus influenzae Rd
uuacuguucaaauaagcguu

SEQ ID NO: 681830 - RNA, 17 nt, Haemophilus influenzae Rd
uuacuguuuuuauauuu

SEQ ID NO: 681831 - RNA, 13 nt, Haemophilus influenzae Rd
uuacuuaaaucuu

SEQ ID NO: 681832 - RNA, 17 nt, Haemophilus influenzae Rd
uuacuuuauaaaugauu

SEQ ID NO: 681833 - RNA, 19 nt, Haemophilus influenzae Rd
uuacuuuucgauagaacaa

SEQ ID NO: 681834 - RNA, 16 nt, Haemophilus influenzae Rd
uuacuuuuacaauccu

SEQ ID NO: 681835 - RNA, 18 nt, Haemophilus influenzae Rd
uuacuuuuacuuaaagca

SEQ ID NO: 681836 - RNA, 22 nt, Haemophilus influenzae Rd
uuagaauaaaccaaugagaaaa

SEQ ID NO: 681837 - RNA, 14 nt, Haemophilus influenzae Rd
uuagaagugaaaua

SEQ ID NO: 681838 - RNA, 18 nt, Haemophilus influenzae Rd
uuagaaguaaauucaguu

SEQ ID NO: 681839 - RNA, 19 nt, Haemophilus influenzae Rd
uuagaaugcagauuaauuu

SEQ ID NO: 681840 - RNA, 23 nt, Haemophilus influenzae Rd
uuagaaucgcccacgaaaagcac

SEQ ID NO: 681841 - RNA, 17 nt, Haemophilus influenzae Rd
uuagaaucguuagcuuu

SEQ ID NO: 681842 - RNA, 14 nt, Haemophilus influenzae Rd
uuagaauccaaaau

SEQ ID NO: 681843 - RNA, 19 nt, Haemophilus influenzae Rd
uuacuggaaauucuucaau

SEQ ID NO: 681844 - RNA, 21 nt, Haemophilus influenzae Rd
uuacucuuuuuuagauaaaaa

SEQ ID NO: 681845 - RNA, 14 nt, Haemophilus influenzae Rd
uuacuauauaguuu

SEQ ID NO: 681846 - RNA, 15 nt, Haemophilus influenzae Rd
uuacuauauaguuuu

SEQ ID NO: 681847 - RNA, 17 nt, Haemophilus influenzae Rd
uuacuauuaaugcucua

SEQ ID NO: 681848 - RNA, 20 nt, Haemophilus influenzae Rd
uuacuauucuuauauucuua

SEQ ID NO: 681849 - RNA, 19 nt, Haemophilus influenzae Rd
uuacuaauucauuacauaa

SEQ ID NO: 681850 - RNA, 15 nt, Haemophilus influenzae Rd
uuacuacuuuggauu

SEQ ID NO: 681851 - RNA, 19 nt, Haemophilus influenzae Rd
uuacucacuauaacuuuuc

SEQ ID NO: 681852 - RNA, 12 nt, Haemophilus influenzae Rd
uuacucauucua

SEQ ID NO: 681853 - RNA, 23 nt, Haemophilus influenzae Rd
uuacuccuagcagcaauagauaa

SEQ ID NO: 681854 - RNA, 22 nt, Haemophilus influenzae Rd
uuacgauuuuccgaaaaaacaa

SEQ ID NO: 681855 - RNA, 19 nt, Haemophilus influenzae Rd
uuaccccaacaaacacgca

SEQ ID NO: 681856 - RNA, 13 nt, Haemophilus influenzae Rd
uuacccacuaagu

SEQ ID NO: 681857 - RNA, 14 nt, Haemophilus influenzae Rd
uuacgacuaaaauu

SEQ ID NO: 681858 - RNA, 18 nt, Haemophilus influenzae Rd
uuacccacuucauauaaa

SEQ ID NO: 681859 - RNA, 21 nt, Haemophilus influenzae Rd
uuacccacuugguaaacauuu

SEQ ID NO: 681860 - RNA, 17 nt, Haemophilus influenzae Rd
uuaccaugccauuuccu

SEQ ID NO: 681861 - RNA, 17 nt, Haemophilus influenzae Rd
uuaccauuacauaaaac

SEQ ID NO: 681862 - RNA, 14 nt, Haemophilus influenzae Rd
uuacgcuuuacuac

SEQ ID NO: 681863 - RNA, 17 nt, Haemophilus influenzae Rd
uuacggauuuauauauu

SEQ ID NO: 681864 - RNA, 14 nt, Haemophilus influenzae Rd
uuacggaugcaauc

SEQ ID NO: 681865 - RNA, 17 nt, Haemophilus influenzae Rd
uuacggauaauuucccu

SEQ ID NO: 681866 - RNA, 21 nt, Haemophilus influenzae Rd
uuacgccuccauuaguuguuu

SEQ ID NO: 681867 - RNA, 19 nt, Haemophilus influenzae Rd
uuacgcgcugauucuaaug

SEQ ID NO: 681868 - RNA, 20 nt, Haemophilus influenzae Rd
uuacgugcaauagauguuaa

SEQ ID NO: 681869 - RNA, 19 nt, Haemophilus influenzae Rd
uuacgugcgaauuuuuauu

SEQ ID NO: 681870 - RNA, 18 nt, Haemophilus influenzae Rd
uuacgugugcgauucauc

SEQ ID NO: 681871 - RNA, 15 nt, Haemophilus influenzae Rd
uuacuaauuaaaagg

SEQ ID NO: 681872 - RNA, 13 nt, Haemophilus influenzae Rd
uuacuaaaucccu

SEQ ID NO: 681873 - RNA, 22 nt, Haemophilus influenzae Rd
uuacuaaaugugacauuguaaa

SEQ ID NO: 681874 - RNA, 11 nt, Haemophilus influenzae Rd
uuacuaaaaua

SEQ ID NO: 681875 - RNA, 15 nt, Haemophilus influenzae Rd
uuacguuuuaaauua

SEQ ID NO: 681876 - RNA, 14 nt, Haemophilus influenzae Rd
uuacguuuaguaaa

SEQ ID NO: 681877 - RNA, 23 nt, Haemophilus influenzae Rd
uuacauauaaagauugcauaacg

SEQ ID NO: 681878 - RNA, 22 nt, Haemophilus influenzae Rd
uuacagauaaaucagcgaguuu

SEQ ID NO: 681879 - RNA, 18 nt, Haemophilus influenzae Rd
uuacauaccaaucacaac

SEQ ID NO: 681880 - RNA, 17 nt, Haemophilus influenzae Rd
uuaccaaccgguaaaau

SEQ ID NO: 681881 - RNA, 22 nt, Haemophilus influenzae Rd
uuaccaaccgguaaaauuaaug

SEQ ID NO: 681882 - RNA, 16 nt, Haemophilus influenzae Rd
uuacauuuggcaaaau

SEQ ID NO: 681883 - RNA, 13 nt, Haemophilus influenzae Rd
uuacauugcuuaa

SEQ ID NO: 681884 - RNA, 14 nt, Haemophilus influenzae Rd
uuacaucuaaugcc

SEQ ID NO: 681885 - RNA, 16 nt, Haemophilus influenzae Rd
uuacaucuugcguuaa

SEQ ID NO: 681886 - RNA, 14 nt, Haemophilus influenzae Rd
uuacagaaauauua

SEQ ID NO: 681887 - RNA, 23 nt, Haemophilus influenzae Rd
uuacagaaccgccguauugaaua

SEQ ID NO: 681888 - RNA, 17 nt, Haemophilus influenzae Rd
uuacaaggacaauaaua

SEQ ID NO: 681889 - RNA, 20 nt, Haemophilus influenzae Rd
uuacaaauuccucugaaccu

SEQ ID NO: 681890 - RNA, 23 nt, Haemophilus influenzae Rd
uuacaacgccaucuuuaaagugu

SEQ ID NO: 681891 - RNA, 19 nt, Haemophilus influenzae Rd
uuacaaguacuagcaaaac

SEQ ID NO: 681892 - RNA, 17 nt, Haemophilus influenzae Rd
uuacaaguauaaagagu

SEQ ID NO: 681893 - RNA, 18 nt, Haemophilus influenzae Rd
uuacaaagguugaaugcg

SEQ ID NO: 681894 - RNA, 19 nt, Haemophilus influenzae Rd
uuaauuuagagccauacua

SEQ ID NO: 681895 - RNA, 16 nt, Haemophilus influenzae Rd
uuaauuuagauaaaaa

SEQ ID NO: 681896 - RNA, 18 nt, Haemophilus influenzae Rd
uuaauuuauuuucuaaua

SEQ ID NO: 681897 - RNA, 21 nt, Haemophilus influenzae Rd
uuaauuuauuuucuaauaaga

SEQ ID NO: 681898 - RNA, 15 nt, Haemophilus influenzae Rd
uuaauuucacauuau

SEQ ID NO: 681899 - RNA, 12 nt, Haemophilus influenzae Rd
uuaauuuaaaua

SEQ ID NO: 681900 - RNA, 15 nt, Haemophilus influenzae Rd
uuaauuuaaauaaag

SEQ ID NO: 681901 - RNA, 22 nt, Haemophilus influenzae Rd
uuaauggagguuuuacauauaa

SEQ ID NO: 681902 - RNA, 22 nt, Haemophilus influenzae Rd
uuaaugguauugugauuacucu

SEQ ID NO: 681903 - RNA, 23 nt, Haemophilus influenzae Rd
uuaaugggggaauaaauucugag

SEQ ID NO: 681904 - RNA, 20 nt, Haemophilus influenzae Rd
uuaaugggugauccauaaug

SEQ ID NO: 681905 - RNA, 20 nt, Haemophilus influenzae Rd
uuaaugcggugcuuuaagua

SEQ ID NO: 681906 - RNA, 21 nt, Haemophilus influenzae Rd
uuaaugcggugcuuuaaguaa

SEQ ID NO: 681907 - RNA, 15 nt, Haemophilus influenzae Rd
uuaaugcgugcuagu

SEQ ID NO: 681908 - RNA, 15 nt, Haemophilus influenzae Rd
uuaaugcuaaaccaa

SEQ ID NO: 681909 - RNA, 20 nt, Haemophilus influenzae Rd
uuaaugccccuaauuauuua

SEQ ID NO: 681910 - RNA, 13 nt, Haemophilus influenzae Rd
uuaauguaaacaa

SEQ ID NO: 681911 - RNA, 18 nt, Haemophilus influenzae Rd
uuaauguaaacaaaaaua

SEQ ID NO: 681912 - RNA, 14 nt, Haemophilus influenzae Rd
uuaauguaggcucu

SEQ ID NO: 681913 - RNA, 12 nt, Haemophilus influenzae Rd
uuaauuauauuu

SEQ ID NO: 681914 - RNA, 17 nt, Haemophilus influenzae Rd
uuaauuaucaaaaagaa

SEQ ID NO: 681915 - RNA, 17 nt, Haemophilus influenzae Rd
uuaauuaguuauacuua

SEQ ID NO: 681916 - RNA, 20 nt, Haemophilus influenzae Rd
uuaauuaguuauacuuaauc

SEQ ID NO: 681917 - RNA, 20 nt, Haemophilus influenzae Rd
uuaauuagaauaacaacaaa

SEQ ID NO: 681918 - RNA, 22 nt, Haemophilus influenzae Rd
uuaauucauugaguuuagucuu

SEQ ID NO: 681919 - RNA, 16 nt, Haemophilus influenzae Rd
uuaauuauuuuaaaua

SEQ ID NO: 681920 - RNA, 18 nt, Haemophilus influenzae Rd
uuaauuauuuuaaauaaa

SEQ ID NO: 681921 - RNA, 16 nt, Haemophilus influenzae Rd
uuaauuauuuuacuuu

SEQ ID NO: 681922 - RNA, 22 nt, Haemophilus influenzae Rd
uuaauucacuacgauuuaaugu

SEQ ID NO: 681923 - RNA, 23 nt, Haemophilus influenzae Rd
uuaauucacuacgauuuaaugua

SEQ ID NO: 681924 - RNA, 21 nt, Haemophilus influenzae Rd
uuaauucagggauuaagaaaa

SEQ ID NO: 681925 - RNA, 16 nt, Haemophilus influenzae Rd
uuaaucugaauuucca

SEQ ID NO: 681926 - RNA, 17 nt, Haemophilus influenzae Rd
uuaauacuuuuguaugu

SEQ ID NO: 681927 - RNA, 15 nt, Haemophilus influenzae Rd
uuaauacuuucagcu

SEQ ID NO: 681928 - RNA, 21 nt, Haemophilus influenzae Rd
uuaauacuuucuuuucaauuu

SEQ ID NO: 681929 - RNA, 15 nt, Haemophilus influenzae Rd
uuaauaccauacaua

SEQ ID NO: 681930 - RNA, 22 nt, Haemophilus influenzae Rd
uuaauacgacggcaucguaauc

SEQ ID NO: 681931 - RNA, 18 nt, Haemophilus influenzae Rd
uuaauacgccaagauaac

SEQ ID NO: 681932 - RNA, 18 nt, Haemophilus influenzae Rd
uuaauacguuguuguucu

SEQ ID NO: 681933 - RNA, 14 nt, Haemophilus influenzae Rd
uuaaucuuaaagaa

SEQ ID NO: 681934 - RNA, 21 nt, Haemophilus influenzae Rd
uuaaucuuaaagaauuucuuu

SEQ ID NO: 681935 - RNA, 22 nt, Haemophilus influenzae Rd
uuaaugaaccaaaucuaacauu

SEQ ID NO: 681936 - RNA, 21 nt, Haemophilus influenzae Rd
uuaaugaacgaacuaaaaugg

SEQ ID NO: 681937 - RNA, 23 nt, Haemophilus influenzae Rd
uuaaugaacuuucuacgacauuu

SEQ ID NO: 681938 - RNA, 20 nt, Haemophilus influenzae Rd
uuaaugaugaaacugaacca

SEQ ID NO: 681939 - RNA, 23 nt, Haemophilus influenzae Rd
uuaaugcaguaauaaauccuuca

SEQ ID NO: 681940 - RNA, 23 nt, Haemophilus influenzae Rd
uuaaugcauugauugcuaaauaa

SEQ ID NO: 681941 - RNA, 14 nt, Haemophilus influenzae Rd
uguugcgauuucca

SEQ ID NO: 681942 - RNA, 21 nt, Haemophilus influenzae Rd
uguugccuaucgguucgccau

SEQ ID NO: 681943 - RNA, 15 nt, Haemophilus influenzae Rd
uguugcccuagugca

SEQ ID NO: 681944 - RNA, 16 nt, Haemophilus influenzae Rd
uguugcccuagugcaa

SEQ ID NO: 681945 - RNA, 17 nt, Haemophilus influenzae Rd
uuaaacagccaaacaaa

SEQ ID NO: 681946 - RNA, 13 nt, Haemophilus influenzae Rd
uuaaacaucgcag

SEQ ID NO: 681947 - RNA, 13 nt, Haemophilus influenzae Rd
uuaaaccaaauaa

SEQ ID NO: 681948 - RNA, 21 nt, Haemophilus influenzae Rd
uuaaaccaaauugauucauuu

SEQ ID NO: 681949 - RNA, 18 nt, Haemophilus influenzae Rd
uuaaaccaacaacugcac

SEQ ID NO: 681950 - RNA, 14 nt, Haemophilus influenzae Rd
uuaaaccacguugu

SEQ ID NO: 681951 - RNA, 20 nt, Haemophilus influenzae Rd
uuaaaccgucauuuauaaaa

SEQ ID NO: 681952 - RNA, 18 nt, Haemophilus influenzae Rd
uuaaagcugaauaaauaa

SEQ ID NO: 681953 - RNA, 15 nt, Haemophilus influenzae Rd
uuaaagguuauuucu

SEQ ID NO: 681954 - RNA, 15 nt, Haemophilus influenzae Rd
uuaaaggcaguauaa

SEQ ID NO: 681955 - RNA, 15 nt, Haemophilus influenzae Rd
uuaaaggcugaauaa

SEQ ID NO: 681956 - RNA, 14 nt, Haemophilus influenzae Rd
uuaaauaauuaaaa

SEQ ID NO: 681957 - RNA, 17 nt, Haemophilus influenzae Rd
uuaaauaauuaaaaaua

SEQ ID NO: 681958 - RNA, 20 nt, Haemophilus influenzae Rd
uuaaauacacuucuaaaaua

SEQ ID NO: 681959 - RNA, 21 nt, Haemophilus influenzae Rd
uuaaauaagcuagaggcugaa

SEQ ID NO: 681960 - RNA, 20 nt, Haemophilus influenzae Rd
uuaaauaauaaauccaaaua

SEQ ID NO: 681961 - RNA, 13 nt, Haemophilus influenzae Rd
uuaaaguaagaau

SEQ ID NO: 681962 - RNA, 13 nt, Haemophilus influenzae Rd
uuaaaguaauagc

SEQ ID NO: 681963 - RNA, 14 nt, Haemophilus influenzae Rd
uuaaauaaccaacu

SEQ ID NO: 681964 - RNA, 20 nt, Haemophilus influenzae Rd
uuaaaguaaauuuuaaaauc

SEQ ID NO: 681965 - RNA, 13 nt, Haemophilus influenzae Rd
uuaaagaaauuuc

SEQ ID NO: 681966 - RNA, 13 nt, Haemophilus influenzae Rd
uuaaagaacaucu

SEQ ID NO: 681967 - RNA, 22 nt, Haemophilus influenzae Rd
uuaaagagaucacuguaaauaa

SEQ ID NO: 681968 - RNA, 15 nt, Haemophilus influenzae Rd
uuaaauauuuaaaaa

SEQ ID NO: 681969 - RNA, 18 nt, Haemophilus influenzae Rd
uuaaauagcgaacaugcg

SEQ ID NO: 681970 - RNA, 16 nt, Haemophilus influenzae Rd
uuaaauauaaugaaaa

SEQ ID NO: 681971 - RNA, 18 nt, Haemophilus influenzae Rd
uuaaauauaaugaaaaca

SEQ ID NO: 681972 - RNA, 19 nt, Haemophilus influenzae Rd
uuaaauauaaugaaaacag

SEQ ID NO: 681973 - RNA, 17 nt, Haemophilus influenzae Rd
uuaaauauaauuuagca

SEQ ID NO: 681974 - RNA, 19 nt, Haemophilus influenzae Rd
uuaaauauaggguaaauaa

SEQ ID NO: 681975 - RNA, 17 nt, Haemophilus influenzae Rd
uuaaaucaauuaacuau

SEQ ID NO: 681976 - RNA, 18 nt, Haemophilus influenzae Rd
uuaaaucaauuaacuauu

SEQ ID NO: 681977 - RNA, 17 nt, Haemophilus influenzae Rd
uuaaauauuuuuacaaa

SEQ ID NO: 681978 - RNA, 18 nt, Haemophilus influenzae Rd
uuaaauauuuuuacaaaa

SEQ ID NO: 681979 - RNA, 11 nt, Haemophilus influenzae Rd
uuaaaucaaaa

SEQ ID NO: 681980 - RNA, 12 nt, Haemophilus influenzae Rd
uuaaaucaaaaa

SEQ ID NO: 681981 - RNA, 15 nt, Haemophilus influenzae Rd
uuaaaucaaacaaaa

SEQ ID NO: 681982 - RNA, 22 nt, Haemophilus influenzae Rd
uuaaaucacccgcauaaccacu

SEQ ID NO: 681983 - RNA, 15 nt, Haemophilus influenzae Rd
uuaaaugcaguauaa

SEQ ID NO: 681984 - RNA, 12 nt, Haemophilus influenzae Rd
uuaaauuaaaaa

SEQ ID NO: 681985 - RNA, 18 nt, Haemophilus influenzae Rd
uuaaauggcauuuauaaa

SEQ ID NO: 681986 - RNA, 21 nt, Haemophilus influenzae Rd
uuaaauuagacuaauuuuuua

SEQ ID NO: 681987 - RNA, 21 nt, Haemophilus influenzae Rd
uuaaauucaucagaaaguggu

SEQ ID NO: 681988 - RNA, 20 nt, Haemophilus influenzae Rd
uuaaauucaucgcaucacgc

SEQ ID NO: 681989 - RNA, 20 nt, Haemophilus influenzae Rd
uuaaauucauuuaaaauaua

SEQ ID NO: 681990 - RNA, 20 nt, Haemophilus influenzae Rd
uuaaauuagcguaaacauuu

SEQ ID NO: 681991 - RNA, 19 nt, Haemophilus influenzae Rd
uuaaauuauagauaaauau

SEQ ID NO: 681992 - RNA, 21 nt, Haemophilus influenzae Rd
uuaaauuauagauaaauauca

SEQ ID NO: 681993 - RNA, 21 nt, Haemophilus influenzae Rd
uuaaauuauauuuuccuguua

SEQ ID NO: 681994 - RNA, 16 nt, Haemophilus influenzae Rd
uuaaauugaaaaaaua

SEQ ID NO: 681995 - RNA, 17 nt, Haemophilus influenzae Rd
uuaaauugaaaaaauaa

SEQ ID NO: 681996 - RNA, 22 nt, Haemophilus influenzae Rd
uuaaauuuaguuaauauauuca

SEQ ID NO: 681997 - RNA, 21 nt, Haemophilus influenzae Rd
uuaaauuuaugcuguuuuaua

SEQ ID NO: 681998 - RNA, 23 nt, Haemophilus influenzae Rd
uuaaauuuauuuuuuaaaacuua

SEQ ID NO: 681999 - RNA, 21 nt, Haemophilus influenzae Rd
uuaaauuuggcaauccugcuu

SEQ ID NO: 682000 - RNA, 14 nt, Haemophilus influenzae Rd
uuaaauuuuaaaaa

SEQ ID NO: 682001 - RNA, 18 nt, Haemophilus influenzae Rd
uuaaauuuuaaaaaauaa

SEQ ID NO: 682002 - RNA, 12 nt, Haemophilus influenzae Rd
uuaaauuuuccu

SEQ ID NO: 682003 - RNA, 20 nt, Haemophilus influenzae Rd
uuaaauuuugcuuuaaauca

SEQ ID NO: 682004 - RNA, 22 nt, Haemophilus influenzae Rd
uuaaauuuuuaaugcuuacaaa

SEQ ID NO: 682005 - RNA, 18 nt, Haemophilus influenzae Rd
uuaaauuuuuaauuuucu

SEQ ID NO: 682006 - RNA, 20 nt, Haemophilus influenzae Rd
uuaacacauccguuaagaaa

SEQ ID NO: 682007 - RNA, 16 nt, Haemophilus influenzae Rd
uuaacacgaaaccaac

SEQ ID NO: 682008 - RNA, 21 nt, Haemophilus influenzae Rd
uuaacaauaaugugagaauaa

SEQ ID NO: 682009 - RNA, 18 nt, Haemophilus influenzae Rd
uuaacauaacuuuccaua

SEQ ID NO: 682010 - RNA, 21 nt, Haemophilus influenzae Rd
uuaacauugucauaccccaaa

SEQ ID NO: 682011 - RNA, 12 nt, Haemophilus influenzae Rd
uuaacauuuucu

SEQ ID NO: 682012 - RNA, 19 nt, Haemophilus influenzae Rd
uuaaccaacauaaacauug

SEQ ID NO: 682013 - RNA, 15 nt, Haemophilus influenzae Rd
uuaaccacuaaaaaa

SEQ ID NO: 682014 - RNA, 18 nt, Haemophilus influenzae Rd
uuaaccacuaaaaaagcc

SEQ ID NO: 682015 - RNA, 20 nt, Haemophilus influenzae Rd
uuaacgggcuuaaacuuuuu

SEQ ID NO: 682016 - RNA, 14 nt, Haemophilus influenzae Rd
uuaacguuauaaac

SEQ ID NO: 682017 - RNA, 17 nt, Haemophilus influenzae Rd
uuaacgcucaaaaauuu

SEQ ID NO: 682018 - RNA, 21 nt, Haemophilus influenzae Rd
uuaacgcgcuacaauauuuau

SEQ ID NO: 682019 - RNA, 13 nt, Haemophilus influenzae Rd
uuaaccauaaaaa

SEQ ID NO: 682020 - RNA, 14 nt, Haemophilus influenzae Rd
uuaaccauaaaaaa

SEQ ID NO: 682021 - RNA, 16 nt, Haemophilus influenzae Rd
uuaaccguuauaacgu

SEQ ID NO: 682022 - RNA, 20 nt, Haemophilus influenzae Rd
uuaaccgcacuuuaaauauu

SEQ ID NO: 682023 - RNA, 20 nt, Haemophilus influenzae Rd
uuaaccgcacuuuagaaaau

SEQ ID NO: 682024 - RNA, 21 nt, Haemophilus influenzae Rd
uuaaccgcacuuuuaauuaau

SEQ ID NO: 682025 - RNA, 18 nt, Haemophilus influenzae Rd
uuaaccgcacuuuuauua

SEQ ID NO: 682026 - RNA, 22 nt, Haemophilus influenzae Rd
uuaaccgcacuuuuuguuuuau

SEQ ID NO: 682027 - RNA, 20 nt, Haemophilus influenzae Rd
uuaaccugauuaaucaaaaa

SEQ ID NO: 682028 - RNA, 19 nt, Haemophilus influenzae Rd
uuaagcaauaaacaaagaa

SEQ ID NO: 682029 - RNA, 20 nt, Haemophilus influenzae Rd
uuaagcaccaucauagauaa

SEQ ID NO: 682030 - RNA, 17 nt, Haemophilus influenzae Rd
uuaagcaauugaauaaa

SEQ ID NO: 682031 - RNA, 14 nt, Haemophilus influenzae Rd
uuaagauggcuauu

SEQ ID NO: 682032 - RNA, 15 nt, Haemophilus influenzae Rd
uuaagauuuacagaa

SEQ ID NO: 682033 - RNA, 19 nt, Haemophilus influenzae Rd
uuaagauuuacagaacaaa

SEQ ID NO: 682034 - RNA, 23 nt, Haemophilus influenzae Rd
uuaagauaaguggggaaaaauau

SEQ ID NO: 682035 - RNA, 14 nt, Haemophilus influenzae Rd
uuaagaaaaaauau

SEQ ID NO: 682036 - RNA, 13 nt, Haemophilus influenzae Rd
uuaacuuucaaca

SEQ ID NO: 682037 - RNA, 19 nt, Haemophilus influenzae Rd
uuaagaaaaucguaucuuu

SEQ ID NO: 682038 - RNA, 12 nt, Haemophilus influenzae Rd
uuaagaaaauug

SEQ ID NO: 682039 - RNA, 13 nt, Haemophilus influenzae Rd
uuaagaaagaaac

SEQ ID NO: 682040 - RNA, 17 nt, Haemophilus influenzae Rd
uuaacuugcaaucacgc

SEQ ID NO: 682041 - RNA, 15 nt, Haemophilus influenzae Rd
uuaacuucuaaagua

SEQ ID NO: 682042 - RNA, 18 nt, Haemophilus influenzae Rd
uuaacuauuuuuuauuua

SEQ ID NO: 682043 - RNA, 14 nt, Haemophilus influenzae Rd
uuaacuauucaaau

SEQ ID NO: 682044 - RNA, 18 nt, Haemophilus influenzae Rd
uuaacuuaucuaaaaaga

SEQ ID NO: 682045 - RNA, 19 nt, Haemophilus influenzae Rd
uuaacuuaucuaaaaagau

SEQ ID NO: 682046 - RNA, 13 nt, Haemophilus influenzae Rd
uuaauaaauauua

SEQ ID NO: 682047 - RNA, 16 nt, Haemophilus influenzae Rd
uuaauaaauauuauua

SEQ ID NO: 682048 - RNA, 14 nt, Haemophilus influenzae Rd
uuaauaaauauuga

SEQ ID NO: 682049 - RNA, 19 nt, Haemophilus influenzae Rd
uuaauaaauauugauuacc

SEQ ID NO: 682050 - RNA, 18 nt, Haemophilus influenzae Rd
uuaauaaaguaaaauauu

SEQ ID NO: 682051 - RNA, 19 nt, Haemophilus influenzae Rd
uuaauaaaguaaaauauug

SEQ ID NO: 682052 - RNA, 21 nt, Haemophilus influenzae Rd
uuaauaaagucgguucauuug

SEQ ID NO: 682053 - RNA, 22 nt, Haemophilus influenzae Rd
uuaauaacauagaaaucacuaa

SEQ ID NO: 682054 - RNA, 17 nt, Haemophilus influenzae Rd
uuaauaagccauuuucu

SEQ ID NO: 682055 - RNA, 21 nt, Haemophilus influenzae Rd
uuaauaagccauuuucugcau

SEQ ID NO: 682056 - RNA, 18 nt, Haemophilus influenzae Rd
uuaauaagcccaacuuaa

SEQ ID NO: 682057 - RNA, 19 nt, Haemophilus influenzae Rd
uuaauaagccuugcauaau

SEQ ID NO: 682058 - RNA, 16 nt, Haemophilus influenzae Rd
uuaauaacugaauaau

SEQ ID NO: 682059 - RNA, 19 nt, Haemophilus influenzae Rd
uuaagccuuuguagccauu

SEQ ID NO: 682060 - RNA, 18 nt, Haemophilus influenzae Rd
uuaaguuuucuacagaaa

SEQ ID NO: 682061 - RNA, 13 nt, Haemophilus influenzae Rd
uuaauaaacauau

SEQ ID NO: 682062 - RNA, 17 nt, Haemophilus influenzae Rd
uuaauaaacauauugau

SEQ ID NO: 682063 - RNA, 22 nt, Haemophilus influenzae Rd
uuaauaaaaaaucugugauaua

SEQ ID NO: 682064 - RNA, 21 nt, Haemophilus influenzae Rd
uuaaguugggcuuauuuguuu

SEQ ID NO: 682065 - RNA, 18 nt, Haemophilus influenzae Rd
uuaaguuuccaagugcgu

SEQ ID NO: 682066 - RNA, 19 nt, Haemophilus influenzae Rd
uuaaguuugagcaaaucaa

SEQ ID NO: 682067 - RNA, 16 nt, Haemophilus influenzae Rd
uuaucgcaaucacgaa

SEQ ID NO: 682068 - RNA, 20 nt, Haemophilus influenzae Rd
uuaucgaucacuucugcaua

SEQ ID NO: 682069 - RNA, 22 nt, Haemophilus influenzae Rd
uuaucgacaaauuaauaagaaa

SEQ ID NO: 682070 - RNA, 15 nt, Haemophilus influenzae Rd
uuauccguuacauua

SEQ ID NO: 682071 - RNA, 18 nt, Haemophilus influenzae Rd
uuaucgguuauuacuuca

SEQ ID NO: 682072 - RNA, 16 nt, Haemophilus influenzae Rd
uuaucgggaauaauau

SEQ ID NO: 682073 - RNA, 22 nt, Haemophilus influenzae Rd
uuaucuaaaccguuuagcaaac

SEQ ID NO: 682074 - RNA, 18 nt, Haemophilus influenzae Rd
uuaucuacaaucaaaaaa

SEQ ID NO: 682075 - RNA, 12 nt, Haemophilus influenzae Rd
uuaucuagacaa

SEQ ID NO: 682076 - RNA, 16 nt, Haemophilus influenzae Rd
uuaucuagacaaaacc

SEQ ID NO: 682077 - RNA, 18 nt, Haemophilus influenzae Rd
uuaucuagacaaaaccug

SEQ ID NO: 682078 - RNA, 20 nt, Haemophilus influenzae Rd
uuaucuagacaaaaccugca

SEQ ID NO: 682079 - RNA, 14 nt, Haemophilus influenzae Rd
uuaucuagcacaaa

SEQ ID NO: 682080 - RNA, 16 nt, Haemophilus influenzae Rd
uuaucuaaauuucgcu

SEQ ID NO: 682081 - RNA, 21 nt, Haemophilus influenzae Rd
uuaucuaacuaaaauaguuga

SEQ ID NO: 682082 - RNA, 19 nt, Haemophilus influenzae Rd
uuaucucggcuaaaaucug

SEQ ID NO: 682083 - RNA, 15 nt, Haemophilus influenzae Rd
uuaucucuuacagua

SEQ ID NO: 682084 - RNA, 18 nt, Haemophilus influenzae Rd
uuaucuuguugccaguaa

SEQ ID NO: 682085 - RNA, 13 nt, Haemophilus influenzae Rd
uuaucuuccccca

SEQ ID NO: 682086 - RNA, 13 nt, Haemophilus influenzae Rd
uuaucuuaaaaaa

SEQ ID NO: 682087 - RNA, 12 nt, Haemophilus influenzae Rd
uuauuaaaaaag

SEQ ID NO: 682088 - RNA, 18 nt, Haemophilus influenzae Rd
uuaugugcaauuugacaa

SEQ ID NO: 682089 - RNA, 19 nt, Haemophilus influenzae Rd
uuaugccguguaauacuga

SEQ ID NO: 682090 - RNA, 22 nt, Haemophilus influenzae Rd
uuaugccguguaauacugauaa

SEQ ID NO: 682091 - RNA, 21 nt, Haemophilus influenzae Rd
uuauggauauuguaggaagac

SEQ ID NO: 682092 - RNA, 14 nt, Haemophilus influenzae Rd
uuaugguaaauauu

SEQ ID NO: 682093 - RNA, 15 nt, Haemophilus influenzae Rd
uuaugguaaauauug

SEQ ID NO: 682094 - RNA, 13 nt, Haemophilus influenzae Rd
uuaugguaacuag

SEQ ID NO: 682095 - RNA, 13 nt, Haemophilus influenzae Rd
uuauggugugcaa

SEQ ID NO: 682096 - RNA, 13 nt, Haemophilus influenzae Rd
uuaugguuuugcu

SEQ ID NO: 682097 - RNA, 17 nt, Haemophilus influenzae Rd
uuauguaaacuuccaaa

SEQ ID NO: 682098 - RNA, 15 nt, Haemophilus influenzae Rd
uuaugccguauuuuu

SEQ ID NO: 682099 - RNA, 13 nt, Haemophilus influenzae Rd
uuaugaucuacac

SEQ ID NO: 682100 - RNA, 14 nt, Haemophilus influenzae Rd
uuaugauauuucaa

SEQ ID NO: 682101 - RNA, 14 nt, Haemophilus influenzae Rd
uuaugacuauuuuu

SEQ ID NO: 682102 - RNA, 22 nt, Haemophilus influenzae Rd
uuaugaaaaaaagaaaaccaaa

SEQ ID NO: 682103 - RNA, 20 nt, Haemophilus influenzae Rd
uuaugaaagccaaugcggcu

SEQ ID NO: 682104 - RNA, 15 nt, Haemophilus influenzae Rd
uuaugaaaucuugaa

SEQ ID NO: 682105 - RNA, 23 nt, Haemophilus influenzae Rd
uuaugaaauuagguuauuuuuuc

SEQ ID NO: 682106 - RNA, 13 nt, Haemophilus influenzae Rd
uuaugaaauugcu

SEQ ID NO: 682107 - RNA, 14 nt, Haemophilus influenzae Rd
uuauaagaugacuu

SEQ ID NO: 682108 - RNA, 22 nt, Haemophilus influenzae Rd
uuauaagaugacuuguuucaua

SEQ ID NO: 682109 - RNA, 19 nt, Haemophilus influenzae Rd
uuauaagccuaaaccaaau

SEQ ID NO: 682110 - RNA, 21 nt, Haemophilus influenzae Rd
uuauaaaauggcgguuuuuua

SEQ ID NO: 682111 - RNA, 15 nt, Haemophilus influenzae Rd
uuauaaaauagccua

SEQ ID NO: 682112 - RNA, 11 nt, Haemophilus influenzae Rd
uuauaaaccag

SEQ ID NO: 682113 - RNA, 16 nt, Haemophilus influenzae Rd
uuagagccaucaauug

SEQ ID NO: 682114 - RNA, 21 nt, Haemophilus influenzae Rd
uuagagagaaaaaucgucaaa

SEQ ID NO: 682115 - RNA, 13 nt, Haemophilus influenzae Rd
uuauaaaaauauu

SEQ ID NO: 682116 - RNA, 14 nt, Haemophilus influenzae Rd
uuauaaaaauauuu

SEQ ID NO: 682117 - RNA, 16 nt, Haemophilus influenzae Rd
uuagagggauaaaaau

SEQ ID NO: 682118 - RNA, 17 nt, Haemophilus influenzae Rd
uuagagggauaaaaauc

SEQ ID NO: 682119 - RNA, 15 nt, Haemophilus influenzae Rd
uuauaggcgcucuuc

SEQ ID NO: 682120 - RNA, 23 nt, Haemophilus influenzae Rd
uuauagccuuguuccacgagaaa

SEQ ID NO: 682121 - RNA, 21 nt, Haemophilus influenzae Rd
uuauagccuauaauuaaaguu

SEQ ID NO: 682122 - RNA, 16 nt, Haemophilus influenzae Rd
uuauagcauuuaaaua

SEQ ID NO: 682123 - RNA, 19 nt, Haemophilus influenzae Rd
uuauagcauuuaaauauua

SEQ ID NO: 682124 - RNA, 19 nt, Haemophilus influenzae Rd
uuauaaucuuuaaauuuug

SEQ ID NO: 682125 - RNA, 20 nt, Haemophilus influenzae Rd
uuauacaguuagaacaacaa

SEQ ID NO: 682126 - RNA, 17 nt, Haemophilus influenzae Rd
uuauagagaaauaauca

SEQ ID NO: 682127 - RNA, 15 nt, Haemophilus influenzae Rd
uuauagaaaagacaa

SEQ ID NO: 682128 - RNA, 20 nt, Haemophilus influenzae Rd
uuauagaaaagacaauaauu

SEQ ID NO: 682129 - RNA, 13 nt, Haemophilus influenzae Rd
uuauagaaaauau

SEQ ID NO: 682130 - RNA, 18 nt, Haemophilus influenzae Rd
uuauaaguuuuuugccaa

SEQ ID NO: 682131 - RNA, 17 nt, Haemophilus influenzae Rd
uuauaagugccaacaau

SEQ ID NO: 682132 - RNA, 19 nt, Haemophilus influenzae Rd
uuauaagugccaacaauau

SEQ ID NO: 682133 - RNA, 13 nt, Haemophilus influenzae Rd
uuauacaaaaaag

SEQ ID NO: 682134 - RNA, 18 nt, Haemophilus influenzae Rd
uuauacaaaacuaaaaaa

SEQ ID NO: 682135 - RNA, 15 nt, Haemophilus influenzae Rd
uuauccaacauuaau

SEQ ID NO: 682136 - RNA, 14 nt, Haemophilus influenzae Rd
uuauccaauacugu

SEQ ID NO: 682137 - RNA, 15 nt, Haemophilus influenzae Rd
uuauccacuaaaaaa

SEQ ID NO: 682138 - RNA, 19 nt, Haemophilus influenzae Rd
uuaucaucuguaaaccauu

SEQ ID NO: 682139 - RNA, 14 nt, Haemophilus influenzae Rd
uuaucaauagauaa

SEQ ID NO: 682140 - RNA, 18 nt, Haemophilus influenzae Rd
uuaucaaucaagaauucc

SEQ ID NO: 682141 - RNA, 15 nt, Haemophilus influenzae Rd
uuaucaauaacugau

SEQ ID NO: 682142 - RNA, 17 nt, Haemophilus influenzae Rd
uuaucaauaacugauuu

SEQ ID NO: 682143 - RNA, 21 nt, Haemophilus influenzae Rd
uuaucaauaacugauuuugag

SEQ ID NO: 682144 - RNA, 15 nt, Haemophilus influenzae Rd
uuaucaacuaaaaaa

SEQ ID NO: 682145 - RNA, 18 nt, Haemophilus influenzae Rd
uuaucaagaacaguauaa

SEQ ID NO: 682146 - RNA, 12 nt, Haemophilus influenzae Rd
uuaucaucauuu

SEQ ID NO: 682147 - RNA, 12 nt, Haemophilus influenzae Rd
uuaucaaagaaa

SEQ ID NO: 682148 - RNA, 16 nt, Haemophilus influenzae Rd
uuaucaaagaaacugu

SEQ ID NO: 682149 - RNA, 17 nt, Haemophilus influenzae Rd
uuauauaccauuugauu

SEQ ID NO: 682150 - RNA, 19 nt, Haemophilus influenzae Rd
uuauauaugauaaaaauaa

SEQ ID NO: 682151 - RNA, 18 nt, Haemophilus influenzae Rd
uucaacuggcuuaaauga

SEQ ID NO: 682152 - RNA, 22 nt, Haemophilus influenzae Rd
uucaacuugccacaguagaugu

SEQ ID NO: 682153 - RNA, 15 nt, Haemophilus influenzae Rd
uucaacuugccagca

SEQ ID NO: 682154 - RNA, 16 nt, Haemophilus influenzae Rd
uucaaccauuuucucu

SEQ ID NO: 682155 - RNA, 14 nt, Haemophilus influenzae Rd
uucaacccauuuuc

SEQ ID NO: 682156 - RNA, 15 nt, Haemophilus influenzae Rd
uucaagcaaauauuu

SEQ ID NO: 682157 - RNA, 22 nt, Haemophilus influenzae Rd
uucaagaugauauuuaauaaaa

SEQ ID NO: 682158 - RNA, 23 nt, Haemophilus influenzae Rd
uucaacaccuaaaugagaaaaau

SEQ ID NO: 682159 - RNA, 16 nt, Haemophilus influenzae Rd
uucaacaaguaaauca

SEQ ID NO: 682160 - RNA, 22 nt, Haemophilus influenzae Rd
uucaaccacuucaaauaccuca

SEQ ID NO: 682161 - RNA, 22 nt, Haemophilus influenzae Rd
uucaaauucauccaaagaaauc

SEQ ID NO: 682162 - RNA, 19 nt, Haemophilus influenzae Rd
uucaaauucccuagccuuu

SEQ ID NO: 682163 - RNA, 15 nt, Haemophilus influenzae Rd
uucaaauucugcuug

SEQ ID NO: 682164 - RNA, 12 nt, Haemophilus influenzae Rd
uucaaauugaaa

SEQ ID NO: 682165 - RNA, 16 nt, Haemophilus influenzae Rd
uucaaauugaaaagaa

SEQ ID NO: 682166 - RNA, 15 nt, Haemophilus influenzae Rd
uucaaauugcaaaaa

SEQ ID NO: 682167 - RNA, 17 nt, Haemophilus influenzae Rd
uucaaauugcaaaaaac

SEQ ID NO: 682168 - RNA, 23 nt, Haemophilus influenzae Rd
uucaaauuuuuguugauaaacau

SEQ ID NO: 682169 - RNA, 13 nt, Haemophilus influenzae Rd
uucaacaaaaaac

SEQ ID NO: 682170 - RNA, 19 nt, Haemophilus influenzae Rd
uucaaaucgaucacuuaau

SEQ ID NO: 682171 - RNA, 23 nt, Haemophilus influenzae Rd
uucaaaucgaucacuuaauaaaa

SEQ ID NO: 682172 - RNA, 14 nt, Haemophilus influenzae Rd
uucaaaucuaacgu

SEQ ID NO: 682173 - RNA, 12 nt, Haemophilus influenzae Rd
uucaaaucuuca

SEQ ID NO: 682174 - RNA, 17 nt, Haemophilus influenzae Rd
uucaaagcguuuuaaaa

SEQ ID NO: 682175 - RNA, 22 nt, Haemophilus influenzae Rd
uucaaaggcucuaccuaaaaua

SEQ ID NO: 682176 - RNA, 23 nt, Haemophilus influenzae Rd
uucaaaggcucuaccuaaaauaa

SEQ ID NO: 682177 - RNA, 19 nt, Haemophilus influenzae Rd
uucaaacucuaauuccacc

SEQ ID NO: 682178 - RNA, 16 nt, Haemophilus influenzae Rd
uucaaagauuuuaaaa

SEQ ID NO: 682179 - RNA, 15 nt, Haemophilus influenzae Rd
uucaaacaucacgcc

SEQ ID NO: 682180 - RNA, 21 nt, Haemophilus influenzae Rd
uucaaacgcguuaaaucacaa

SEQ ID NO: 682181 - RNA, 13 nt, Haemophilus influenzae Rd
uucaaacaacaag

SEQ ID NO: 682182 - RNA, 11 nt, Haemophilus influenzae Rd
uucaaacacaa

SEQ ID NO: 682183 - RNA, 22 nt, Haemophilus influenzae Rd
uucaaacaggcuuauuaaaaac

SEQ ID NO: 682184 - RNA, 16 nt, Haemophilus influenzae Rd
uucaaaauccauaauu

SEQ ID NO: 682185 - RNA, 12 nt, Haemophilus influenzae Rd
uucaaaauuuug

SEQ ID NO: 682186 - RNA, 19 nt, Haemophilus influenzae Rd
uucaaaacuaucaaaauca

SEQ ID NO: 682187 - RNA, 17 nt, Haemophilus influenzae Rd
uucaaaaaauguaucca

SEQ ID NO: 682188 - RNA, 15 nt, Haemophilus influenzae Rd
uucaaaaacauaauu

SEQ ID NO: 682189 - RNA, 13 nt, Haemophilus influenzae Rd
uucaaaaaccaaa

SEQ ID NO: 682190 - RNA, 13 nt, Haemophilus influenzae Rd
uuauuuugaacaa

SEQ ID NO: 682191 - RNA, 15 nt, Haemophilus influenzae Rd
uucaaaaauuugaau

SEQ ID NO: 682192 - RNA, 14 nt, Haemophilus influenzae Rd
uucaaaaauuuuug

SEQ ID NO: 682193 - RNA, 18 nt, Haemophilus influenzae Rd
uucaaaaauuuuugcaaa

SEQ ID NO: 682194 - RNA, 20 nt, Haemophilus influenzae Rd
uucaaaaauuuuugcaaaaa

SEQ ID NO: 682195 - RNA, 22 nt, Haemophilus influenzae Rd
uucaaaacaauggcugaaaaau

SEQ ID NO: 682196 - RNA, 12 nt, Haemophilus influenzae Rd
uucaaaaccaaa

SEQ ID NO: 682197 - RNA, 11 nt, Haemophilus influenzae Rd
uucaaaaauag

SEQ ID NO: 682198 - RNA, 16 nt, Haemophilus influenzae Rd
uucaaaaaucaaauua

SEQ ID NO: 682199 - RNA, 21 nt, Haemophilus influenzae Rd
uucaaaaagaacggucaaaau

SEQ ID NO: 682200 - RNA, 16 nt, Haemophilus influenzae Rd
uuauuuuuuaagcuuu

SEQ ID NO: 682201 - RNA, 13 nt, Haemophilus influenzae Rd
uuauuuuuuacua

SEQ ID NO: 682202 - RNA, 15 nt, Haemophilus influenzae Rd
uuauuuuuuaacgua

SEQ ID NO: 682203 - RNA, 12 nt, Haemophilus influenzae Rd
uuauuuuuucaa

SEQ ID NO: 682204 - RNA, 13 nt, Haemophilus influenzae Rd
uuauuuuuccuuu

SEQ ID NO: 682205 - RNA, 22 nt, Haemophilus influenzae Rd
uuauuuuuaaucaaauaaaaua

SEQ ID NO: 682206 - RNA, 19 nt, Haemophilus influenzae Rd
uuauuuuguguauuaagua

SEQ ID NO: 682207 - RNA, 21 nt, Haemophilus influenzae Rd
uuauuuuguguuugaaaagaa

SEQ ID NO: 682208 - RNA, 18 nt, Haemophilus influenzae Rd
uuauuuuguugcagcuuu

SEQ ID NO: 682209 - RNA, 20 nt, Haemophilus influenzae Rd
uuauuagaaauauauuuguu

SEQ ID NO: 682210 - RNA, 13 nt, Haemophilus influenzae Rd
uuauuaccuaguu

SEQ ID NO: 682211 - RNA, 14 nt, Haemophilus influenzae Rd
uuauuauuaaauaa

SEQ ID NO: 682212 - RNA, 14 nt, Haemophilus influenzae Rd
uuauuauuaaaucc

SEQ ID NO: 682213 - RNA, 14 nt, Haemophilus influenzae Rd
uuauuaucuaaauc

SEQ ID NO: 682214 - RNA, 12 nt, Haemophilus influenzae Rd
uuauuaaauaua

SEQ ID NO: 682215 - RNA, 15 nt, Haemophilus influenzae Rd
uuauuaaauccaaaa

SEQ ID NO: 682216 - RNA, 22 nt, Haemophilus influenzae Rd
uuauuaacaaaaagauugaaug

SEQ ID NO: 682217 - RNA, 14 nt, Haemophilus influenzae Rd
uuauuaauagauaa

SEQ ID NO: 682218 - RNA, 11 nt, Haemophilus influenzae Rd
uuauuaacaaa

SEQ ID NO: 682219 - RNA, 15 nt, Haemophilus influenzae Rd
uuauuacccuauucu

SEQ ID NO: 682220 - RNA, 21 nt, Haemophilus influenzae Rd
uuauuacccuauucuaaauuu

SEQ ID NO: 682221 - RNA, 16 nt, Haemophilus influenzae Rd
uuauucguuugcaaug

SEQ ID NO: 682222 - RNA, 22 nt, Haemophilus influenzae Rd
uuauucuccaaauauaaaauaa

SEQ ID NO: 682223 - RNA, 19 nt, Haemophilus influenzae Rd
uuauucccccauuaaaaga

SEQ ID NO: 682224 - RNA, 23 nt, Haemophilus influenzae Rd
uuauucagcuuuaaggcacagau

SEQ ID NO: 682225 - RNA, 20 nt, Haemophilus influenzae Rd
uuauucauaaauuccuuuuu

SEQ ID NO: 682226 - RNA, 17 nt, Haemophilus influenzae Rd
uuauucgcugcaaaauc

SEQ ID NO: 682227 - RNA, 15 nt, Haemophilus influenzae Rd
uuauuccuucaaucg

SEQ ID NO: 682228 - RNA, 23 nt, Haemophilus influenzae Rd
uuauucacgcucguuaaaucacg

SEQ ID NO: 682229 - RNA, 17 nt, Haemophilus influenzae Rd
uuauucaauaauauauu

SEQ ID NO: 682230 - RNA, 22 nt, Haemophilus influenzae Rd
uuauucaauaauauauuuaaug

SEQ ID NO: 682231 - RNA, 16 nt, Haemophilus influenzae Rd
uuauucaaaauuugug

SEQ ID NO: 682232 - RNA, 22 nt, Haemophilus influenzae Rd
uuauuauuacccguuugaagua

SEQ ID NO: 682233 - RNA, 14 nt, Haemophilus influenzae Rd
uuauuuuauauauu

SEQ ID NO: 682234 - RNA, 19 nt, Haemophilus influenzae Rd
uuauuuuaucuauuggaua

SEQ ID NO: 682235 - RNA, 11 nt, Haemophilus influenzae Rd
uuauuuuauuc

SEQ ID NO: 682236 - RNA, 13 nt, Haemophilus influenzae Rd
uuauuuuaaaauc

SEQ ID NO: 682237 - RNA, 14 nt, Haemophilus influenzae Rd
uuauuuuaaaauca

SEQ ID NO: 682238 - RNA, 16 nt, Haemophilus influenzae Rd
uuauuuuaaaaucauc

SEQ ID NO: 682239 - RNA, 11 nt, Haemophilus influenzae Rd
uuauuuuaaau

SEQ ID NO: 682240 - RNA, 12 nt, Haemophilus influenzae Rd
uuauuuuaaaua

SEQ ID NO: 682241 - RNA, 22 nt, Haemophilus influenzae Rd
uuauuuuaaauaaauaauagua

SEQ ID NO: 682242 - RNA, 22 nt, Haemophilus influenzae Rd
uuauuuggaacaguaaauuuaa

SEQ ID NO: 682243 - RNA, 23 nt, Haemophilus influenzae Rd
uuauuuguguggaaaaauguaau

SEQ ID NO: 682244 - RNA, 17 nt, Haemophilus influenzae Rd
uuauuugacuuaaauga

SEQ ID NO: 682245 - RNA, 16 nt, Haemophilus influenzae Rd
uuauuugacuuauucc

SEQ ID NO: 682246 - RNA, 15 nt, Haemophilus influenzae Rd
uuauuugauuaagua

SEQ ID NO: 682247 - RNA, 12 nt, Haemophilus influenzae Rd
uuauuugcaaua

SEQ ID NO: 682248 - RNA, 17 nt, Haemophilus influenzae Rd
uuauuugcaauaaaauu

SEQ ID NO: 682249 - RNA, 19 nt, Haemophilus influenzae Rd
uuauuugcauaguuuucca

SEQ ID NO: 682250 - RNA, 21 nt, Haemophilus influenzae Rd
uuauuugcauaguuuuccauu

SEQ ID NO: 682251 - RNA, 18 nt, Haemophilus influenzae Rd
uuauuuccauaaaugaca

SEQ ID NO: 682252 - RNA, 21 nt, Haemophilus influenzae Rd
uuauuucauaucucacaauaa

SEQ ID NO: 682253 - RNA, 13 nt, Haemophilus influenzae Rd
uuauuuauuuaau

SEQ ID NO: 682254 - RNA, 20 nt, Haemophilus influenzae Rd
uuauuuaaacuugaauaaua

SEQ ID NO: 682255 - RNA, 22 nt, Haemophilus influenzae Rd
uuauuuaagcuauuguuauaga

SEQ ID NO: 682256 - RNA, 14 nt, Haemophilus influenzae Rd
uuauuuaauaacaa

SEQ ID NO: 682257 - RNA, 15 nt, Haemophilus influenzae Rd
uuauuuaauaauauc

SEQ ID NO: 682258 - RNA, 23 nt, Haemophilus influenzae Rd
uuauuuaauacgaacuaaaagga

SEQ ID NO: 682259 - RNA, 19 nt, Haemophilus influenzae Rd
uuauuuaauuucaaaauca

SEQ ID NO: 682260 - RNA, 14 nt, Haemophilus influenzae Rd
uuauuuagauauaa

SEQ ID NO: 682261 - RNA, 17 nt, Haemophilus influenzae Rd
uuauuuagauauaaaaa

SEQ ID NO: 682262 - RNA, 19 nt, Haemophilus influenzae Rd
uuauuuagauauaaaaauc

SEQ ID NO: 682263 - RNA, 18 nt, Haemophilus influenzae Rd
uuauuuaggggccuuuuu

SEQ ID NO: 682264 - RNA, 17 nt, Haemophilus influenzae Rd
uuauuucaauauaauca

SEQ ID NO: 682265 - RNA, 13 nt, Haemophilus influenzae Rd
uuauuucaauauu

SEQ ID NO: 682266 - RNA, 21 nt, Haemophilus influenzae Rd
uuauuucaauauugucuauuu

SEQ ID NO: 682267 - RNA, 21 nt, Haemophilus influenzae Rd
uuauugcacuaauaaauagaa

SEQ ID NO: 682268 - RNA, 17 nt, Haemophilus influenzae Rd
uuauugcauaguuuuau

SEQ ID NO: 682269 - RNA, 17 nt, Haemophilus influenzae Rd
uuauugcguuccaauuu

SEQ ID NO: 682270 - RNA, 23 nt, Haemophilus influenzae Rd
uuauugccaaagugcgguauuuu

SEQ ID NO: 682271 - RNA, 22 nt, Haemophilus influenzae Rd
uuauugccaacuuagauuuucu

SEQ ID NO: 682272 - RNA, 15 nt, Haemophilus influenzae Rd
uuauuggaaaauuca

SEQ ID NO: 682273 - RNA, 22 nt, Haemophilus influenzae Rd
uuauuggaaaauucaaaucuug

SEQ ID NO: 682274 - RNA, 16 nt, Haemophilus influenzae Rd
uuauuggcuauugaaa

SEQ ID NO: 682275 - RNA, 14 nt, Haemophilus influenzae Rd
uuauuguacucaau

SEQ ID NO: 682276 - RNA, 21 nt, Haemophilus influenzae Rd
uuauuguagccuaguauuuuu

SEQ ID NO: 682277 - RNA, 23 nt, Haemophilus influenzae Rd
uuauugucugcuccaaauaaucc

SEQ ID NO: 682278 - RNA, 22 nt, Haemophilus influenzae Rd
uuauugugagauaugaaauaaa

SEQ ID NO: 682279 - RNA, 12 nt, Haemophilus influenzae Rd
uuauugugaugg

SEQ ID NO: 682280 - RNA, 21 nt, Haemophilus influenzae Rd
uuauugugaugggaaacugaa

SEQ ID NO: 682281 - RNA, 16 nt, Haemophilus influenzae Rd
ugcauauuaaugcggu

SEQ ID NO: 682282 - RNA, 20 nt, Haemophilus influenzae Rd
ugcauacgugccgccacaga

SEQ ID NO: 682283 - RNA, 20 nt, Haemophilus influenzae Rd
ugcauagaaugcaacaagua

SEQ ID NO: 682284 - RNA, 17 nt, Haemophilus influenzae Rd
ugcauaaucauaucuaa

SEQ ID NO: 682285 - RNA, 21 nt, Haemophilus influenzae Rd
ugcauaauggcuuaauaaugg

SEQ ID NO: 682286 - RNA, 15 nt, Haemophilus influenzae Rd
ugcauaaaauaauuu

SEQ ID NO: 682287 - RNA, 14 nt, Haemophilus influenzae Rd
ugcauaaaaucuuc

SEQ ID NO: 682288 - RNA, 13 nt, Haemophilus influenzae Rd
ugcauaaacaaau

SEQ ID NO: 682289 - RNA, 21 nt, Haemophilus influenzae Rd
ugcaguuuugugguaauuuau

SEQ ID NO: 682290 - RNA, 19 nt, Haemophilus influenzae Rd
ugcauaacuuaaauuuuua

SEQ ID NO: 682291 - RNA, 22 nt, Haemophilus influenzae Rd
ugcacuaauugugguaaagcua

SEQ ID NO: 682292 - RNA, 17 nt, Haemophilus influenzae Rd
ugcacuauauacauuaa

SEQ ID NO: 682293 - RNA, 21 nt, Haemophilus influenzae Rd
ugcacuaucuaugauuucauu

SEQ ID NO: 682294 - RNA, 16 nt, Haemophilus influenzae Rd
ugcagugcauuaaugc

SEQ ID NO: 682295 - RNA, 13 nt, Haemophilus influenzae Rd
ugcaucaggcaca

SEQ ID NO: 682296 - RNA, 14 nt, Haemophilus influenzae Rd
ugcaucagccaccu

SEQ ID NO: 682297 - RNA, 21 nt, Haemophilus influenzae Rd
ugcaucaggauuuuucgcagg

SEQ ID NO: 682298 - RNA, 17 nt, Haemophilus influenzae Rd
ugcauccacuuuuuuca

SEQ ID NO: 682299 - RNA, 21 nt, Haemophilus influenzae Rd
ugcauccacuuuuuucacgau

SEQ ID NO: 682300 - RNA, 14 nt, Haemophilus influenzae Rd
ugcaucauuaauac

SEQ ID NO: 682301 - RNA, 19 nt, Haemophilus influenzae Rd
ugcaucauuuacagaaccg

SEQ ID NO: 682302 - RNA, 14 nt, Haemophilus influenzae Rd
ugcauccacuucau

SEQ ID NO: 682303 - RNA, 16 nt, Haemophilus influenzae Rd
ugcaucgugaccuaau

SEQ ID NO: 682304 - RNA, 12 nt, Haemophilus influenzae Rd
ugcaucuguugu

SEQ ID NO: 682305 - RNA, 22 nt, Haemophilus influenzae Rd
ugcaucuguugugaaugcaaua

SEQ ID NO: 682306 - RNA, 17 nt, Haemophilus influenzae Rd
ugcaucuaaaaauaauu

SEQ ID NO: 682307 - RNA, 20 nt, Haemophilus influenzae Rd
ugcaucuuggcauuuuugcu

SEQ ID NO: 682308 - RNA, 20 nt, Haemophilus influenzae Rd
ugcaugaaauguagcacgau

SEQ ID NO: 682309 - RNA, 19 nt, Haemophilus influenzae Rd
ugcauguuuacuuaaaucu

SEQ ID NO: 682310 - RNA, 20 nt, Haemophilus influenzae Rd
ugcauguuuacuuaaaucuu

SEQ ID NO: 682311 - RNA, 23 nt, Haemophilus influenzae Rd
ugcauuaaaagucuguuuaaaaa

SEQ ID NO: 682312 - RNA, 23 nt, Haemophilus influenzae Rd
ugcauuaaagcgagaauaguuaa

SEQ ID NO: 682313 - RNA, 16 nt, Haemophilus influenzae Rd
ugcauuaagaaguuau

SEQ ID NO: 682314 - RNA, 23 nt, Haemophilus influenzae Rd
ugcaugugguaauuaacgugcau

SEQ ID NO: 682315 - RNA, 21 nt, Haemophilus influenzae Rd
ugcauuauaaccaaaguuucc

SEQ ID NO: 682316 - RNA, 16 nt, Haemophilus influenzae Rd
ugcauucacaaaaguu

SEQ ID NO: 682317 - RNA, 15 nt, Haemophilus influenzae Rd
ugcauucacuucuaa

SEQ ID NO: 682318 - RNA, 14 nt, Haemophilus influenzae Rd
ugcauucaaauuuc

SEQ ID NO: 682319 - RNA, 12 nt, Haemophilus influenzae Rd
ugccaucacuca

SEQ ID NO: 682320 - RNA, 15 nt, Haemophilus influenzae Rd
ugccaguaacuuucu

SEQ ID NO: 682321 - RNA, 18 nt, Haemophilus influenzae Rd
ugccaucacauccacaaa

SEQ ID NO: 682322 - RNA, 23 nt, Haemophilus influenzae Rd
ugccagaccuaagguuaauuuuu

SEQ ID NO: 682323 - RNA, 15 nt, Haemophilus influenzae Rd
ugccacgguuucuug

SEQ ID NO: 682324 - RNA, 15 nt, Haemophilus influenzae Rd
ugccacaaagcaaau

SEQ ID NO: 682325 - RNA, 21 nt, Haemophilus influenzae Rd
ugccaaagcauuaaguuuuua

SEQ ID NO: 682326 - RNA, 20 nt, Haemophilus influenzae Rd
ugccaaagugcgguauuuuu

SEQ ID NO: 682327 - RNA, 19 nt, Haemophilus influenzae Rd
ugcauuuuuauaaaguaag

SEQ ID NO: 682328 - RNA, 13 nt, Haemophilus influenzae Rd
ugcauuuuucaua

SEQ ID NO: 682329 - RNA, 13 nt, Haemophilus influenzae Rd
ugcauuucuucag

SEQ ID NO: 682330 - RNA, 18 nt, Haemophilus influenzae Rd
ugcauuugauuucagaac

SEQ ID NO: 682331 - RNA, 18 nt, Haemophilus influenzae Rd
ugcauuugcucaauaccu

SEQ ID NO: 682332 - RNA, 16 nt, Haemophilus influenzae Rd
ugcauuuuuuauaaau

SEQ ID NO: 682333 - RNA, 22 nt, Haemophilus influenzae Rd
ugcauuuuuuauaaauggcuca

SEQ ID NO: 682334 - RNA, 12 nt, Haemophilus influenzae Rd
ugcauuuuuaac

SEQ ID NO: 682335 - RNA, 20 nt, Haemophilus influenzae Rd
ugcauuuucuuuuucaagaa

SEQ ID NO: 682336 - RNA, 22 nt, Haemophilus influenzae Rd
ugcauuggcuagagcuaauucu

SEQ ID NO: 682337 - RNA, 23 nt, Haemophilus influenzae Rd
ugcauuggcuagagcuaauucug

SEQ ID NO: 682338 - RNA, 17 nt, Haemophilus influenzae Rd
ugcauuuaguuauugac

SEQ ID NO: 682339 - RNA, 15 nt, Haemophilus influenzae Rd
ugcauugaugacugc

SEQ ID NO: 682340 - RNA, 20 nt, Haemophilus influenzae Rd
ugcauugaugacugcaucaa

SEQ ID NO: 682341 - RNA, 15 nt, Haemophilus influenzae Rd
ugcauucuaaaaguu

SEQ ID NO: 682342 - RNA, 16 nt, Haemophilus influenzae Rd
ugcauugaauuuuucu

SEQ ID NO: 682343 - RNA, 21 nt, Haemophilus influenzae Rd
ugcccgcuacaaauaagccaa

SEQ ID NO: 682344 - RNA, 16 nt, Haemophilus influenzae Rd
ugccauguacauuaau

SEQ ID NO: 682345 - RNA, 18 nt, Haemophilus influenzae Rd
ugccauuacaagcauuaa

SEQ ID NO: 682346 - RNA, 19 nt, Haemophilus influenzae Rd
ugccauuaaacuucuguaa

SEQ ID NO: 682347 - RNA, 17 nt, Haemophilus influenzae Rd
ugccauugcgugaauau

SEQ ID NO: 682348 - RNA, 19 nt, Haemophilus influenzae Rd
ugccauugcgugaauaucu

SEQ ID NO: 682349 - RNA, 21 nt, Haemophilus influenzae Rd
ugccauugcuuguuucauaca

SEQ ID NO: 682350 - RNA, 17 nt, Haemophilus influenzae Rd
ugccauuucgcuugagu

SEQ ID NO: 682351 - RNA, 13 nt, Haemophilus influenzae Rd
ugccauuucuaaa

SEQ ID NO: 682352 - RNA, 20 nt, Haemophilus influenzae Rd
ugccgcagguucgccacugg

SEQ ID NO: 682353 - RNA, 23 nt, Haemophilus influenzae Rd
ugccgcagguucgccacuggugc

SEQ ID NO: 682354 - RNA, 16 nt, Haemophilus influenzae Rd
ugccguucaaaacaau

SEQ ID NO: 682355 - RNA, 20 nt, Haemophilus influenzae Rd
ugccguguaauacugauaaa

SEQ ID NO: 682356 - RNA, 18 nt, Haemophilus influenzae Rd
ugccuaacccccuuaauu

SEQ ID NO: 682357 - RNA, 22 nt, Haemophilus influenzae Rd
ugccuaaaaagaaguauuauuu

SEQ ID NO: 682358 - RNA, 13 nt, Haemophilus influenzae Rd
ugccuaaaaccug

SEQ ID NO: 682359 - RNA, 19 nt, Haemophilus influenzae Rd
ugccuaauagaaaaaugcc

SEQ ID NO: 682360 - RNA, 12 nt, Haemophilus influenzae Rd
ugccuaauucac

SEQ ID NO: 682361 - RNA, 13 nt, Haemophilus influenzae Rd
ugccucuuuuuuc

SEQ ID NO: 682362 - RNA, 18 nt, Haemophilus influenzae Rd
ugccucuguauuuuucau

SEQ ID NO: 682363 - RNA, 13 nt, Haemophilus influenzae Rd
ugccucuucauug

SEQ ID NO: 682364 - RNA, 14 nt, Haemophilus influenzae Rd
ugccgcuaaugguu

SEQ ID NO: 682365 - RNA, 20 nt, Haemophilus influenzae Rd
ugcggugacuuuuugugcca

SEQ ID NO: 682366 - RNA, 15 nt, Haemophilus influenzae Rd
ugcggugaaauuuua

SEQ ID NO: 682367 - RNA, 16 nt, Haemophilus influenzae Rd
ugcggucauuuuucac

SEQ ID NO: 682368 - RNA, 15 nt, Haemophilus influenzae Rd
ugcggucaauuuuca

SEQ ID NO: 682369 - RNA, 16 nt, Haemophilus influenzae Rd
ugcggucaauuuuuca

SEQ ID NO: 682370 - RNA, 13 nt, Haemophilus influenzae Rd
ugcguaauaagua

SEQ ID NO: 682371 - RNA, 19 nt, Haemophilus influenzae Rd
ugcgguuguuuuugccaaa

SEQ ID NO: 682372 - RNA, 19 nt, Haemophilus influenzae Rd
ugcgguuaaaauuuaauaa

SEQ ID NO: 682373 - RNA, 15 nt, Haemophilus influenzae Rd
ugcgguuaaauauuu

SEQ ID NO: 682374 - RNA, 21 nt, Haemophilus influenzae Rd
ugcgguuaauuuuuuguucau

SEQ ID NO: 682375 - RNA, 20 nt, Haemophilus influenzae Rd
ugcgguucuucuuuuaauaa

SEQ ID NO: 682376 - RNA, 23 nt, Haemophilus influenzae Rd
ugcgguucuucuuuuaauaauag

SEQ ID NO: 682377 - RNA, 15 nt, Haemophilus influenzae Rd
ugcgguugaaauuuc

SEQ ID NO: 682378 - RNA, 20 nt, Haemophilus influenzae Rd
ugcgguugaauuucuuuuuc

SEQ ID NO: 682379 - RNA, 9 nt, Haemophilus influenzae Rd
ugcggacgc

SEQ ID NO: 682380 - RNA, 15 nt, Haemophilus influenzae Rd
ugcggauuaagaugg

SEQ ID NO: 682381 - RNA, 22 nt, Haemophilus influenzae Rd
ugcgcuuucaauuuucugugag

SEQ ID NO: 682382 - RNA, 17 nt, Haemophilus influenzae Rd
ugcggaauaauuuuccu

SEQ ID NO: 682383 - RNA, 23 nt, Haemophilus influenzae Rd
ugcgcccauuggaauauacaguu

SEQ ID NO: 682384 - RNA, 17 nt, Haemophilus influenzae Rd
ugccuucauauaauaaa

SEQ ID NO: 682385 - RNA, 20 nt, Haemophilus influenzae Rd
ugccuucauuugcccauacc

SEQ ID NO: 682386 - RNA, 12 nt, Haemophilus influenzae Rd
ugccuucuucac

SEQ ID NO: 682387 - RNA, 20 nt, Haemophilus influenzae Rd
ugcgccaccuuuuguagaaa

SEQ ID NO: 682388 - RNA, 12 nt, Haemophilus influenzae Rd
ugcgccugaucg

SEQ ID NO: 682389 - RNA, 16 nt, Haemophilus influenzae Rd
ugcgccuaaaauauuu

SEQ ID NO: 682390 - RNA, 17 nt, Haemophilus influenzae Rd
ugcgccuaauuggaaaa

SEQ ID NO: 682391 - RNA, 19 nt, Haemophilus influenzae Rd
ugcgccuagcgcuguuacu

SEQ ID NO: 682392 - RNA, 14 nt, Haemophilus influenzae Rd
ugcgcgcaauccaa

SEQ ID NO: 682393 - RNA, 23 nt, Haemophilus influenzae Rd
ugcugcacgagcuugagcugcug

SEQ ID NO: 682394 - RNA, 17 nt, Haemophilus influenzae Rd
ugcugcaguacuuucac

SEQ ID NO: 682395 - RNA, 14 nt, Haemophilus influenzae Rd
ugcugcaguuacug

SEQ ID NO: 682396 - RNA, 18 nt, Haemophilus influenzae Rd
ugcugcaguuacugccuc

SEQ ID NO: 682397 - RNA, 16 nt, Haemophilus influenzae Rd
ugcugcaauucaacaa

SEQ ID NO: 682398 - RNA, 14 nt, Haemophilus influenzae Rd
ugcugauuagcagg

SEQ ID NO: 682399 - RNA, 16 nt, Haemophilus influenzae Rd
ugcugauuauugggcu

SEQ ID NO: 682400 - RNA, 19 nt, Haemophilus influenzae Rd
ugcugauucacgaucacuu

SEQ ID NO: 682401 - RNA, 11 nt, Haemophilus influenzae Rd
ugcugauaaag

SEQ ID NO: 682402 - RNA, 19 nt, Haemophilus influenzae Rd
ugcugauaaauuccuucca

SEQ ID NO: 682403 - RNA, 23 nt, Haemophilus influenzae Rd
ugcugaaaaugggcgggcaaacc

SEQ ID NO: 682404 - RNA, 16 nt, Haemophilus influenzae Rd
ugcugaacgcauucuc

SEQ ID NO: 682405 - RNA, 23 nt, Haemophilus influenzae Rd
ugcugacgguucaguuucaagca

SEQ ID NO: 682406 - RNA, 14 nt, Haemophilus influenzae Rd
ugcugaguaccaaa

SEQ ID NO: 682407 - RNA, 20 nt, Haemophilus influenzae Rd
ugcucgugauuaucuaaauu

SEQ ID NO: 682408 - RNA, 12 nt, Haemophilus influenzae Rd
ugcucuuucaaa

SEQ ID NO: 682409 - RNA, 17 nt, Haemophilus influenzae Rd
ugcugaaauauugggcu

SEQ ID NO: 682410 - RNA, 23 nt, Haemophilus influenzae Rd
ugcugaaauauugggcucugcau

SEQ ID NO: 682411 - RNA, 13 nt, Haemophilus influenzae Rd
ugcucuuuuucca

SEQ ID NO: 682412 - RNA, 16 nt, Haemophilus influenzae Rd
ugcucgacaaagauuu

SEQ ID NO: 682413 - RNA, 20 nt, Haemophilus influenzae Rd
ugcucgacaaagauuuucuc

SEQ ID NO: 682414 - RNA, 18 nt, Haemophilus influenzae Rd
ugcuccgcuaaaaaugca

SEQ ID NO: 682415 - RNA, 15 nt, Haemophilus influenzae Rd
ugcucgauuuuuaaa

SEQ ID NO: 682416 - RNA, 16 nt, Haemophilus influenzae Rd
ugcucgauuuuuaaaa

SEQ ID NO: 682417 - RNA, 17 nt, Haemophilus influenzae Rd
ugcguuugguucaucau

SEQ ID NO: 682418 - RNA, 18 nt, Haemophilus influenzae Rd
ugcguuugguucaucauu

SEQ ID NO: 682419 - RNA, 17 nt, Haemophilus influenzae Rd
ugcguuucaaaugcuuu

SEQ ID NO: 682420 - RNA, 18 nt, Haemophilus influenzae Rd
ugcguuucaaaugcuuug

SEQ ID NO: 682421 - RNA, 18 nt, Haemophilus influenzae Rd
ugcuguauauuuuuaauu

SEQ ID NO: 682422 - RNA, 17 nt, Haemophilus influenzae Rd
ugcuuacuuuauuuuua

SEQ ID NO: 682423 - RNA, 20 nt, Haemophilus influenzae Rd
ugcuuacuuuauuuuuaagu

SEQ ID NO: 682424 - RNA, 23 nt, Haemophilus influenzae Rd
ugcuuacuuuauuuuuaaguggu

SEQ ID NO: 682425 - RNA, 21 nt, Haemophilus influenzae Rd
ugcuguuuagugugucccccc

SEQ ID NO: 682426 - RNA, 15 nt, Haemophilus influenzae Rd
ugcuguuuggcaaug

SEQ ID NO: 682427 - RNA, 15 nt, Haemophilus influenzae Rd
ugcuguugcagcugg

SEQ ID NO: 682428 - RNA, 17 nt, Haemophilus influenzae Rd
ugcuguugguuaaaaau

SEQ ID NO: 682429 - RNA, 14 nt, Haemophilus influenzae Rd
ugcuguaacguuaa

SEQ ID NO: 682430 - RNA, 13 nt, Haemophilus influenzae Rd
ugcuguacacaca

SEQ ID NO: 682431 - RNA, 15 nt, Haemophilus influenzae Rd
ugcuguacacacacc

SEQ ID NO: 682432 - RNA, 12 nt, Haemophilus influenzae Rd
ugcuggaaaaau

SEQ ID NO: 682433 - RNA, 13 nt, Haemophilus influenzae Rd
ugcuggaaaaaug

SEQ ID NO: 682434 - RNA, 18 nt, Haemophilus influenzae Rd
ugcugcugucgcuucuaa

SEQ ID NO: 682435 - RNA, 14 nt, Haemophilus influenzae Rd
ugcugcuguuuuac

SEQ ID NO: 682436 - RNA, 23 nt, Haemophilus influenzae Rd
ugcugcuuuaacaauuacugcaa

SEQ ID NO: 682437 - RNA, 16 nt, Haemophilus influenzae Rd
ugcuuuuaaauuuuua

SEQ ID NO: 682438 - RNA, 20 nt, Haemophilus influenzae Rd
ugcuuuaauacgugauaaug

SEQ ID NO: 682439 - RNA, 13 nt, Haemophilus influenzae Rd
ugcuuuaaucauu

SEQ ID NO: 682440 - RNA, 17 nt, Haemophilus influenzae Rd
ugcuuuauuuagaauuu

SEQ ID NO: 682441 - RNA, 22 nt, Haemophilus influenzae Rd
ugcuugauaaccuucaaugguu

SEQ ID NO: 682442 - RNA, 23 nt, Haemophilus influenzae Rd
ugcuuuaacccauuuauuuaaau

SEQ ID NO: 682443 - RNA, 16 nt, Haemophilus influenzae Rd
ugcuuuaaguaaaagu

SEQ ID NO: 682444 - RNA, 14 nt, Haemophilus influenzae Rd
ugcuuuaaauuguu

SEQ ID NO: 682445 - RNA, 13 nt, Haemophilus influenzae Rd
ugcuuuaacaauu

SEQ ID NO: 682446 - RNA, 20 nt, Haemophilus influenzae Rd
ugcuucagcguugucaucag

SEQ ID NO: 682447 - RNA, 21 nt, Haemophilus influenzae Rd
ugcuucauaaaaaccuguugg

SEQ ID NO: 682448 - RNA, 17 nt, Haemophilus influenzae Rd
ugcuucauagaaaccaa

SEQ ID NO: 682449 - RNA, 17 nt, Haemophilus influenzae Rd
ugcuugaugucagugaa

SEQ ID NO: 682450 - RNA, 14 nt, Haemophilus influenzae Rd
ugcuucuuuuaaua

SEQ ID NO: 682451 - RNA, 17 nt, Haemophilus influenzae Rd
ugcuuagugaaaagaaa

SEQ ID NO: 682452 - RNA, 16 nt, Haemophilus influenzae Rd
ugcuuauaaaacagag

SEQ ID NO: 682453 - RNA, 19 nt, Haemophilus influenzae Rd
ugcuucaacgacuaaaauu

SEQ ID NO: 682454 - RNA, 17 nt, Haemophilus influenzae Rd
ugagcauaacguauuuu

SEQ ID NO: 682455 - RNA, 18 nt, Haemophilus influenzae Rd
ugagcauuuagucaauuu

SEQ ID NO: 682456 - RNA, 20 nt, Haemophilus influenzae Rd
ugagcauuuuuuauuaaaaa

SEQ ID NO: 682457 - RNA, 15 nt, Haemophilus influenzae Rd
ugagccaauaacuuc

SEQ ID NO: 682458 - RNA, 13 nt, Haemophilus influenzae Rd
ugagccaauggaa

SEQ ID NO: 682459 - RNA, 21 nt, Haemophilus influenzae Rd
ugaguccgauccauacaguaa

SEQ ID NO: 682460 - RNA, 21 nt, Haemophilus influenzae Rd
ugaguucaacgacaauuaaag

SEQ ID NO: 682461 - RNA, 19 nt, Haemophilus influenzae Rd
ugauaaaaaccgcugucau

SEQ ID NO: 682462 - RNA, 20 nt, Haemophilus influenzae Rd
ugauaaaaaccgcugucaua

SEQ ID NO: 682463 - RNA, 19 nt, Haemophilus influenzae Rd
ugauaaaaaucaaagagaa

SEQ ID NO: 682464 - RNA, 19 nt, Haemophilus influenzae Rd
ugauaaauagcuauaacgc

SEQ ID NO: 682465 - RNA, 21 nt, Haemophilus influenzae Rd
ugaguugucccgcauauaaaa

SEQ ID NO: 682466 - RNA, 18 nt, Haemophilus influenzae Rd
ugaguuuagucuuuuuaa

SEQ ID NO: 682467 - RNA, 13 nt, Haemophilus influenzae Rd
ugaguucuguaau

SEQ ID NO: 682468 - RNA, 16 nt, Haemophilus influenzae Rd
ugaguuauuuuuaauc

SEQ ID NO: 682469 - RNA, 20 nt, Haemophilus influenzae Rd
ugaguugauuuuaaaauauc

SEQ ID NO: 682470 - RNA, 23 nt, Haemophilus influenzae Rd
ugaguugauuuuaaaauaucaaa

SEQ ID NO: 682471 - RNA, 18 nt, Haemophilus influenzae Rd
ugauaauccagcuacauu

SEQ ID NO: 682472 - RNA, 20 nt, Haemophilus influenzae Rd
ugauaauccagcuacauuca

SEQ ID NO: 682473 - RNA, 15 nt, Haemophilus influenzae Rd
ugauaaucuaaaaaa

SEQ ID NO: 682474 - RNA, 17 nt, Haemophilus influenzae Rd
ugauaaucuaaaaaacc

SEQ ID NO: 682475 - RNA, 19 nt, Haemophilus influenzae Rd
ugauaagccacucuaaguu

SEQ ID NO: 682476 - RNA, 18 nt, Haemophilus influenzae Rd
ugauaagcccgaacagaa

SEQ ID NO: 682477 - RNA, 22 nt, Haemophilus influenzae Rd
ugauaaguucauaaaaggggca

SEQ ID NO: 682478 - RNA, 21 nt, Haemophilus influenzae Rd
ugauaaguuuugucugaaauu

SEQ ID NO: 682479 - RNA, 13 nt, Haemophilus influenzae Rd
ugauaaguagaaa

SEQ ID NO: 682480 - RNA, 14 nt, Haemophilus influenzae Rd
ugauaaguauaacu

SEQ ID NO: 682481 - RNA, 20 nt, Haemophilus influenzae Rd
ugauaaaugcgggaauagcu

SEQ ID NO: 682482 - RNA, 23 nt, Haemophilus influenzae Rd
ugauaaaugcgggaauagcucag

SEQ ID NO: 682483 - RNA, 15 nt, Haemophilus influenzae Rd
ugauaaauuccuucc

SEQ ID NO: 682484 - RNA, 16 nt, Haemophilus influenzae Rd
ugauaaauuccuucca

SEQ ID NO: 682485 - RNA, 13 nt, Haemophilus influenzae Rd
ugauaaauucuua

SEQ ID NO: 682486 - RNA, 12 nt, Haemophilus influenzae Rd
ugauaaauuucu

SEQ ID NO: 682487 - RNA, 18 nt, Haemophilus influenzae Rd
ugauaaccuaucaucuga

SEQ ID NO: 682488 - RNA, 17 nt, Haemophilus influenzae Rd
ugauaacucuaaagcgg

SEQ ID NO: 682489 - RNA, 12 nt, Haemophilus influenzae Rd
ugauacauuucu

SEQ ID NO: 682490 - RNA, 21 nt, Haemophilus influenzae Rd
ugauaccaagauaauaaaguu

SEQ ID NO: 682491 - RNA, 23 nt, Haemophilus influenzae Rd
ugauaccaagcauauuugcugca

SEQ ID NO: 682492 - RNA, 12 nt, Haemophilus influenzae Rd
ugauaccaauaa

SEQ ID NO: 682493 - RNA, 14 nt, Haemophilus influenzae Rd
ugauaccaaugauu

SEQ ID NO: 682494 - RNA, 14 nt, Haemophilus influenzae Rd
ugauacggaaagua

SEQ ID NO: 682495 - RNA, 20 nt, Haemophilus influenzae Rd
ugauacaaucgguuaaaagu

SEQ ID NO: 682496 - RNA, 18 nt, Haemophilus influenzae Rd
ugauaauuggaguggaca

SEQ ID NO: 682497 - RNA, 14 nt, Haemophilus influenzae Rd
ugauaauuuuuacc

SEQ ID NO: 682498 - RNA, 13 nt, Haemophilus influenzae Rd
ugauaauuuuuca

SEQ ID NO: 682499 - RNA, 14 nt, Haemophilus influenzae Rd
ugauaauuuuucac

SEQ ID NO: 682500 - RNA, 15 nt, Haemophilus influenzae Rd
ugauaaugccucuuu

SEQ ID NO: 682501 - RNA, 21 nt, Haemophilus influenzae Rd
ugauaaugccucuuuaacauu

SEQ ID NO: 682502 - RNA, 21 nt, Haemophilus influenzae Rd
ugauagaaccaauauugggaa

SEQ ID NO: 682503 - RNA, 16 nt, Haemophilus influenzae Rd
ugauacugccaaccuu

SEQ ID NO: 682504 - RNA, 23 nt, Haemophilus influenzae Rd
ugauacuucggggaucauuucau

SEQ ID NO: 682505 - RNA, 19 nt, Haemophilus influenzae Rd
ugauagugccaaucaagau

SEQ ID NO: 682506 - RNA, 16 nt, Haemophilus influenzae Rd
ugauagguaauaauag

SEQ ID NO: 682507 - RNA, 23 nt, Haemophilus influenzae Rd
ugauagcugccgaauagauuuaa

SEQ ID NO: 682508 - RNA, 13 nt, Haemophilus influenzae Rd
ugauauuaagcca

SEQ ID NO: 682509 - RNA, 22 nt, Haemophilus influenzae Rd
ugauauaaauggguuuuaucuu

SEQ ID NO: 682510 - RNA, 13 nt, Haemophilus influenzae Rd
ugaucaaggguac

SEQ ID NO: 682511 - RNA, 19 nt, Haemophilus influenzae Rd
ugaucaaggguacaacaaa

SEQ ID NO: 682512 - RNA, 19 nt, Haemophilus influenzae Rd
ugaucaaaucaaauuuucc

SEQ ID NO: 682513 - RNA, 20 nt, Haemophilus influenzae Rd
ugaucaaaucaaauuuuccu

SEQ ID NO: 682514 - RNA, 21 nt, Haemophilus influenzae Rd
ugaucaaaucaaauuuuccuu

SEQ ID NO: 682515 - RNA, 19 nt, Haemophilus influenzae Rd
ugaugaaccauaaacaaua

SEQ ID NO: 682516 - RNA, 14 nt, Haemophilus influenzae Rd
ugaugaaaauuauc

SEQ ID NO: 682517 - RNA, 15 nt, Haemophilus influenzae Rd
ugaugaaaauuaucu

SEQ ID NO: 682518 - RNA, 13 nt, Haemophilus influenzae Rd
ugaugaaacaauc

SEQ ID NO: 682519 - RNA, 16 nt, Haemophilus influenzae Rd
ugaucuucaaucauca

SEQ ID NO: 682520 - RNA, 13 nt, Haemophilus influenzae Rd
ugaugauaaucuu

SEQ ID NO: 682521 - RNA, 14 nt, Haemophilus influenzae Rd
ugaugauaaucuuc

SEQ ID NO: 682522 - RNA, 16 nt, Haemophilus influenzae Rd
ugaugauaauuuuuac

SEQ ID NO: 682523 - RNA, 21 nt, Haemophilus influenzae Rd
ugaucuaacguuuauauugaa

SEQ ID NO: 682524 - RNA, 20 nt, Haemophilus influenzae Rd
ugaucugaccccaaaaaguu

SEQ ID NO: 682525 - RNA, 15 nt, Haemophilus influenzae Rd
ugaucugcaaauggu

SEQ ID NO: 682526 - RNA, 13 nt, Haemophilus influenzae Rd
ugaucauccauuu

SEQ ID NO: 682527 - RNA, 18 nt, Haemophilus influenzae Rd
ugauuuaucgccucuuua

SEQ ID NO: 682528 - RNA, 14 nt, Haemophilus influenzae Rd
ugauuuauuaauag

SEQ ID NO: 682529 - RNA, 13 nt, Haemophilus influenzae Rd
ugauuuucauucc

SEQ ID NO: 682530 - RNA, 18 nt, Haemophilus influenzae Rd
ugauuucagaacaugacu

SEQ ID NO: 682531 - RNA, 15 nt, Haemophilus influenzae Rd
ugauuuuguuuucuu

SEQ ID NO: 682532 - RNA, 19 nt, Haemophilus influenzae Rd
ugauuuugcuuugccuuuu

SEQ ID NO: 682533 - RNA, 17 nt, Haemophilus influenzae Rd
ugauugcuuuaacugaa

SEQ ID NO: 682534 - RNA, 20 nt, Haemophilus influenzae Rd
ugauugcgcauuuaauacug

SEQ ID NO: 682535 - RNA, 15 nt, Haemophilus influenzae Rd
ugauugcuaaauaaa

SEQ ID NO: 682536 - RNA, 17 nt, Haemophilus influenzae Rd
ugauuguaaaagucccu

SEQ ID NO: 682537 - RNA, 15 nt, Haemophilus influenzae Rd
ugauuuagccaguaa

SEQ ID NO: 682538 - RNA, 18 nt, Haemophilus influenzae Rd
ugauuuagggaaguuaug

SEQ ID NO: 682539 - RNA, 11 nt, Haemophilus influenzae Rd
ugauuuauacg

SEQ ID NO: 682540 - RNA, 22 nt, Haemophilus influenzae Rd
ugcaaaauagauguaaccuuuc

SEQ ID NO: 682541 - RNA, 15 nt, Haemophilus influenzae Rd
ugcaaaaugaacagu

SEQ ID NO: 682542 - RNA, 13 nt, Haemophilus influenzae Rd
ugcaaacauacca

SEQ ID NO: 682543 - RNA, 15 nt, Haemophilus influenzae Rd
ugauuuuuacaaguu

SEQ ID NO: 682544 - RNA, 21 nt, Haemophilus influenzae Rd
ugauuuuuacaaguuaaagca

SEQ ID NO: 682545 - RNA, 15 nt, Haemophilus influenzae Rd
ugauuuuuacaccgc

SEQ ID NO: 682546 - RNA, 20 nt, Haemophilus influenzae Rd
ugcaaaaacccucaagaaac

SEQ ID NO: 682547 - RNA, 13 nt, Haemophilus influenzae Rd
ugcaaauacauau

SEQ ID NO: 682548 - RNA, 13 nt, Haemophilus influenzae Rd
ugcaaauaacuau

SEQ ID NO: 682549 - RNA, 13 nt, Haemophilus influenzae Rd
ugcaaauaaucuc

SEQ ID NO: 682550 - RNA, 19 nt, Haemophilus influenzae Rd
ugcaaauaaagaagaaaau

SEQ ID NO: 682551 - RNA, 23 nt, Haemophilus influenzae Rd
ugcaaauaaagaagaaaaucuuu

SEQ ID NO: 682552 - RNA, 16 nt, Haemophilus influenzae Rd
ugcaaaaucuaaauuu

SEQ ID NO: 682553 - RNA, 14 nt, Haemophilus influenzae Rd
ugcaaaugaaacuu

SEQ ID NO: 682554 - RNA, 15 nt, Haemophilus influenzae Rd
ugcaaaugaaacuuu

SEQ ID NO: 682555 - RNA, 14 nt, Haemophilus influenzae Rd
ugcaaaugguguuu

SEQ ID NO: 682556 - RNA, 19 nt, Haemophilus influenzae Rd
ugcaaaugguguuuuauga

SEQ ID NO: 682557 - RNA, 11 nt, Haemophilus influenzae Rd
ugauucacuaa

SEQ ID NO: 682558 - RNA, 21 nt, Haemophilus influenzae Rd
ugauucaguccgcauugaaac

SEQ ID NO: 682559 - RNA, 20 nt, Haemophilus influenzae Rd
ugauuccaacaaguucuucu

SEQ ID NO: 682560 - RNA, 21 nt, Haemophilus influenzae Rd
ugauuccaacaaguucuucua

SEQ ID NO: 682561 - RNA, 22 nt, Haemophilus influenzae Rd
ugauucauugcauuuuuauaaa

SEQ ID NO: 682562 - RNA, 16 nt, Haemophilus influenzae Rd
ugauugacauuuuacu

SEQ ID NO: 682563 - RNA, 14 nt, Haemophilus influenzae Rd
ugauugaccaauga

SEQ ID NO: 682564 - RNA, 20 nt, Haemophilus influenzae Rd
ugauucuuuaugaauuacca

SEQ ID NO: 682565 - RNA, 13 nt, Haemophilus influenzae Rd
ugauugcaccuaa

SEQ ID NO: 682566 - RNA, 14 nt, Haemophilus influenzae Rd
ugauugcaccuaau

SEQ ID NO: 682567 - RNA, 22 nt, Haemophilus influenzae Rd
ugauugagaugccauuucgcuu

SEQ ID NO: 682568 - RNA, 21 nt, Haemophilus influenzae Rd
ugauugaugcgaaaauggcua

SEQ ID NO: 682569 - RNA, 20 nt, Haemophilus influenzae Rd
ugauuaccgguuacuuggau

SEQ ID NO: 682570 - RNA, 21 nt, Haemophilus influenzae Rd
ugauuaauuuuaucuaugaaa

SEQ ID NO: 682571 - RNA, 17 nt, Haemophilus influenzae Rd
ugauuaauuaaauuacc

SEQ ID NO: 682572 - RNA, 18 nt, Haemophilus influenzae Rd
ugauuaauuaaauuacca

SEQ ID NO: 682573 - RNA, 17 nt, Haemophilus influenzae Rd
ugauuagucuacaagaa

SEQ ID NO: 682574 - RNA, 16 nt, Haemophilus influenzae Rd
ugauuagugauaaaug

SEQ ID NO: 682575 - RNA, 16 nt, Haemophilus influenzae Rd
ugauuagcuaauauaa

SEQ ID NO: 682576 - RNA, 14 nt, Haemophilus influenzae Rd
ugaugcgaaaaugg

SEQ ID NO: 682577 - RNA, 17 nt, Haemophilus influenzae Rd
ugaugcgaaaauggcua

SEQ ID NO: 682578 - RNA, 20 nt, Haemophilus influenzae Rd
ugauuaaaaugguuuaaaua

SEQ ID NO: 682579 - RNA, 22 nt, Haemophilus influenzae Rd
ugauuaaaaugguuuaaauaac

SEQ ID NO: 682580 - RNA, 20 nt, Haemophilus influenzae Rd
ugauuaacuauucaaaugaa

SEQ ID NO: 682581 - RNA, 18 nt, Haemophilus influenzae Rd
ugauuaaguuaaaagugu

SEQ ID NO: 682582 - RNA, 15 nt, Haemophilus influenzae Rd
ugcaccaccaauuaa

SEQ ID NO: 682583 - RNA, 14 nt, Haemophilus influenzae Rd
ugcaauuaauucuu

SEQ ID NO: 682584 - RNA, 15 nt, Haemophilus influenzae Rd
ugcaauuaauucuuu

SEQ ID NO: 682585 - RNA, 17 nt, Haemophilus influenzae Rd
ugcaauuaauucuuuug

SEQ ID NO: 682586 - RNA, 12 nt, Haemophilus influenzae Rd
ugcaauuucagc

SEQ ID NO: 682587 - RNA, 17 nt, Haemophilus influenzae Rd
ugcacccauuuugauug

SEQ ID NO: 682588 - RNA, 18 nt, Haemophilus influenzae Rd
ugcacccuaauucauuaa

SEQ ID NO: 682589 - RNA, 15 nt, Haemophilus influenzae Rd
ugcaccuaaaaguua

SEQ ID NO: 682590 - RNA, 16 nt, Haemophilus influenzae Rd
ugcaccuaagucagga

SEQ ID NO: 682591 - RNA, 23 nt, Haemophilus influenzae Rd
ugcacuaacacacgaucaccaag

SEQ ID NO: 682592 - RNA, 13 nt, Haemophilus influenzae Rd
ugcacuaauaaau

SEQ ID NO: 682593 - RNA, 20 nt, Haemophilus influenzae Rd
ugcaauaggauugccuucau

SEQ ID NO: 682594 - RNA, 23 nt, Haemophilus influenzae Rd
ugcaauaggauugccuucauaua

SEQ ID NO: 682595 - RNA, 13 nt, Haemophilus influenzae Rd
ugcaauaucuauu

SEQ ID NO: 682596 - RNA, 16 nt, Haemophilus influenzae Rd
ugcaauauuauucagc

SEQ ID NO: 682597 - RNA, 20 nt, Haemophilus influenzae Rd
ugcaauauuuccucuaaaua

SEQ ID NO: 682598 - RNA, 15 nt, Haemophilus influenzae Rd
ugcaacuucagcagc

SEQ ID NO: 682599 - RNA, 16 nt, Haemophilus influenzae Rd
ugcaacaauaucauug

SEQ ID NO: 682600 - RNA, 14 nt, Haemophilus influenzae Rd
ugcaacaauuucau

SEQ ID NO: 682601 - RNA, 19 nt, Haemophilus influenzae Rd
ugcaacagcugcacaagca

SEQ ID NO: 682602 - RNA, 21 nt, Haemophilus influenzae Rd
ugcaacaaagugcggcaaaaa

SEQ ID NO: 682603 - RNA, 22 nt, Haemophilus influenzae Rd
ugcaacaaagugcggcaaaaaa

SEQ ID NO: 682604 - RNA, 12 nt, Haemophilus influenzae Rd
ugcaaauuuuuc

SEQ ID NO: 682605 - RNA, 15 nt, Haemophilus influenzae Rd
ugcaaauuuuuucaa

SEQ ID NO: 682606 - RNA, 16 nt, Haemophilus influenzae Rd
ugcaaauuuuuucaaa

SEQ ID NO: 682607 - RNA, 19 nt, Haemophilus influenzae Rd
ugcaaccacacaagcacca

SEQ ID NO: 682608 - RNA, 18 nt, Haemophilus influenzae Rd
ugcaacgagcaauauuca

SEQ ID NO: 682609 - RNA, 19 nt, Haemophilus influenzae Rd
ugcaacgagcaauauucaa

SEQ ID NO: 682610 - RNA, 16 nt, Haemophilus influenzae Rd
ugacuaaaguaaauuu

SEQ ID NO: 682611 - RNA, 16 nt, Haemophilus influenzae Rd
ugacuaaucguccaau

SEQ ID NO: 682612 - RNA, 20 nt, Haemophilus influenzae Rd
ugacuagauauaaaaacuau

SEQ ID NO: 682613 - RNA, 23 nt, Haemophilus influenzae Rd
ugacuuaaauucggaauauucaa

SEQ ID NO: 682614 - RNA, 14 nt, Haemophilus influenzae Rd
ugacguaauuuacg

SEQ ID NO: 682615 - RNA, 15 nt, Haemophilus influenzae Rd
ugacuaaaacaacag

SEQ ID NO: 682616 - RNA, 15 nt, Haemophilus influenzae Rd
ugacguuguucuucu

SEQ ID NO: 682617 - RNA, 15 nt, Haemophilus influenzae Rd
ugacuaaacaaauaa

SEQ ID NO: 682618 - RNA, 12 nt, Haemophilus influenzae Rd
ugacgugcuaau

SEQ ID NO: 682619 - RNA, 18 nt, Haemophilus influenzae Rd
ugacgugcuaauucugcu

SEQ ID NO: 682620 - RNA, 15 nt, Haemophilus influenzae Rd
ugagaaaguaaugga

SEQ ID NO: 682621 - RNA, 16 nt, Haemophilus influenzae Rd
ugagaaaguaauggaa

SEQ ID NO: 682622 - RNA, 18 nt, Haemophilus influenzae Rd
ugagaaaguuaaucaaac

SEQ ID NO: 682623 - RNA, 23 nt, Haemophilus influenzae Rd
ugagaaaguuaaucaaacuuuua

SEQ ID NO: 682624 - RNA, 13 nt, Haemophilus influenzae Rd
ugagaauuuucaa

SEQ ID NO: 682625 - RNA, 17 nt, Haemophilus influenzae Rd
ugagaauuuuuucuuca

SEQ ID NO: 682626 - RNA, 19 nt, Haemophilus influenzae Rd
ugagaauuuuuucuucaau

SEQ ID NO: 682627 - RNA, 12 nt, Haemophilus influenzae Rd
ugacuuauucca

SEQ ID NO: 682628 - RNA, 18 nt, Haemophilus influenzae Rd
ugagaaagggauuuuaau

SEQ ID NO: 682629 - RNA, 16 nt, Haemophilus influenzae Rd
ugagaaagaauauaaa

SEQ ID NO: 682630 - RNA, 18 nt, Haemophilus influenzae Rd
ugagaaagaauauaaaua

SEQ ID NO: 682631 - RNA, 12 nt, Haemophilus influenzae Rd
ugagauaaaugg

SEQ ID NO: 682632 - RNA, 20 nt, Haemophilus influenzae Rd
ugagauaaaugggcaaacau

SEQ ID NO: 682633 - RNA, 16 nt, Haemophilus influenzae Rd
ugagcaauccaaucag

SEQ ID NO: 682634 - RNA, 20 nt, Haemophilus influenzae Rd
ugagcaaaucaaaaccuuuc

SEQ ID NO: 682635 - RNA, 20 nt, Haemophilus influenzae Rd
ugagcaaauuacccaaauga

SEQ ID NO: 682636 - RNA, 17 nt, Haemophilus influenzae Rd
ugagcaaccacuaaaac

SEQ ID NO: 682637 - RNA, 16 nt, Haemophilus influenzae Rd
ugagcaagaugaauua

SEQ ID NO: 682638 - RNA, 15 nt, Haemophilus influenzae Rd
ugaccugcguagccu

SEQ ID NO: 682639 - RNA, 13 nt, Haemophilus influenzae Rd
ugaccuuuuaaug

SEQ ID NO: 682640 - RNA, 14 nt, Haemophilus influenzae Rd
ugaccuucaauugu

SEQ ID NO: 682641 - RNA, 14 nt, Haemophilus influenzae Rd
ugaccuuuucgaau

SEQ ID NO: 682642 - RNA, 17 nt, Haemophilus influenzae Rd
ugaccuuuuuuuagaau

SEQ ID NO: 682643 - RNA, 22 nt, Haemophilus influenzae Rd
ugacaauguuuuagagaaaugc

SEQ ID NO: 682644 - RNA, 14 nt, Haemophilus influenzae Rd
ugacauauucuguu

SEQ ID NO: 682645 - RNA, 11 nt, Haemophilus influenzae Rd
ugacaauuucu

SEQ ID NO: 682646 - RNA, 14 nt, Haemophilus influenzae Rd
ugacauuggauuaa

SEQ ID NO: 682647 - RNA, 22 nt, Haemophilus influenzae Rd
ugacauuuuacuuuagcaaugc

SEQ ID NO: 682648 - RNA, 12 nt, Haemophilus influenzae Rd
ugaccaaaauug

SEQ ID NO: 682649 - RNA, 15 nt, Haemophilus influenzae Rd
ugacauuacauaaau

SEQ ID NO: 682650 - RNA, 15 nt, Haemophilus influenzae Rd
ugaccagucauugau

SEQ ID NO: 682651 - RNA, 16 nt, Haemophilus influenzae Rd
ugacccgcuuuuaaug

SEQ ID NO: 682652 - RNA, 17 nt, Haemophilus influenzae Rd
ugaccagagccaaauac

SEQ ID NO: 682653 - RNA, 16 nt, Haemophilus influenzae Rd
ugaccgcccaacauuu

SEQ ID NO: 682654 - RNA, 15 nt, Haemophilus influenzae Rd
ugaccgauuaauuca

SEQ ID NO: 682655 - RNA, 14 nt, Haemophilus influenzae Rd
ugaacuguaauuuc

SEQ ID NO: 682656 - RNA, 16 nt, Haemophilus influenzae Rd
ugaacuguaauuucgg

SEQ ID NO: 682657 - RNA, 14 nt, Haemophilus influenzae Rd
ugaacugugagauu

SEQ ID NO: 682658 - RNA, 20 nt, Haemophilus influenzae Rd
ugaacuuaugugcaccuuca

SEQ ID NO: 682659 - RNA, 20 nt, Haemophilus influenzae Rd
ugaacucacaauugauguaa

SEQ ID NO: 682660 - RNA, 18 nt, Haemophilus influenzae Rd
ugaacgggguuaaaagug

SEQ ID NO: 682661 - RNA, 15 nt, Haemophilus influenzae Rd
ugaacguuuaacuuc

SEQ ID NO: 682662 - RNA, 17 nt, Haemophilus influenzae Rd
ugaagaaauggcgacca

SEQ ID NO: 682663 - RNA, 15 nt, Haemophilus influenzae Rd
ugaagaacaagggga

SEQ ID NO: 682664 - RNA, 14 nt, Haemophilus influenzae Rd
ugaacuucuaaaaa

SEQ ID NO: 682665 - RNA, 21 nt, Haemophilus influenzae Rd
ugaacuuugugccauuucuaa

SEQ ID NO: 682666 - RNA, 15 nt, Haemophilus influenzae Rd
ugaacuuuguucauu

SEQ ID NO: 682667 - RNA, 14 nt, Haemophilus influenzae Rd
ugaacuuuuuuaua

SEQ ID NO: 682668 - RNA, 19 nt, Haemophilus influenzae Rd
ugaacuuuuuuauaaucuu

SEQ ID NO: 682669 - RNA, 16 nt, Haemophilus influenzae Rd
ugaagacaucauauau

SEQ ID NO: 682670 - RNA, 20 nt, Haemophilus influenzae Rd
ugaagaauuuguuguuugcu

SEQ ID NO: 682671 - RNA, 16 nt, Haemophilus influenzae Rd
ugaagaauacaagcga

SEQ ID NO: 682672 - RNA, 19 nt, Haemophilus influenzae Rd
ugaagagauugauuuucuu

SEQ ID NO: 682673 - RNA, 20 nt, Haemophilus influenzae Rd
ugaagagaauuuucaucaau

SEQ ID NO: 682674 - RNA, 14 nt, Haemophilus influenzae Rd
ugaagcuaagaaaa

SEQ ID NO: 682675 - RNA, 18 nt, Haemophilus influenzae Rd
ugaagcuaagaaaaucca

SEQ ID NO: 682676 - RNA, 21 nt, Haemophilus influenzae Rd
ugaagcuccaguaagcauauu

SEQ ID NO: 682677 - RNA, 19 nt, Haemophilus influenzae Rd
ugaagcaacaaucacugua

SEQ ID NO: 682678 - RNA, 15 nt, Haemophilus influenzae Rd
ugaagcccacccuac

SEQ ID NO: 682679 - RNA, 18 nt, Haemophilus influenzae Rd
ugaagccgaugaaagcua

SEQ ID NO: 682680 - RNA, 22 nt, Haemophilus influenzae Rd
ugaagccucugcagggaaaaau

SEQ ID NO: 682681 - RNA, 15 nt, Haemophilus influenzae Rd
ugaauuuuguaccaa

SEQ ID NO: 682682 - RNA, 20 nt, Haemophilus influenzae Rd
ugaauuuucaccguuuuucc

SEQ ID NO: 682683 - RNA, 22 nt, Haemophilus influenzae Rd
ugaauuuuacagguguaguuag

SEQ ID NO: 682684 - RNA, 18 nt, Haemophilus influenzae Rd
ugaauuuuacuucuucag

SEQ ID NO: 682685 - RNA, 20 nt, Haemophilus influenzae Rd
ugaauuaccacaucauuauu

SEQ ID NO: 682686 - RNA, 16 nt, Haemophilus influenzae Rd
ugaauuaccauaaaac

SEQ ID NO: 682687 - RNA, 18 nt, Haemophilus influenzae Rd
ugaauuaccauaaaacgu

SEQ ID NO: 682688 - RNA, 22 nt, Haemophilus influenzae Rd
ugaauuagauucggcuaaaaca

SEQ ID NO: 682689 - RNA, 13 nt, Haemophilus influenzae Rd
ugaauuaaaaguu

SEQ ID NO: 682690 - RNA, 17 nt, Haemophilus influenzae Rd
ugaauuaacguuauaaa

SEQ ID NO: 682691 - RNA, 11 nt, Haemophilus influenzae Rd
ugaauuaauac

SEQ ID NO: 682692 - RNA, 14 nt, Haemophilus influenzae Rd
ugaauguuuuucau

SEQ ID NO: 682693 - RNA, 21 nt, Haemophilus influenzae Rd
ugaaugugcgguagauuuuca

SEQ ID NO: 682694 - RNA, 15 nt, Haemophilus influenzae Rd
ugaauguaaaaaaua

SEQ ID NO: 682695 - RNA, 16 nt, Haemophilus influenzae Rd
ugaauguaaaaauaac

SEQ ID NO: 682696 - RNA, 23 nt, Haemophilus influenzae Rd
ugaauguaaaaauaaccuauaau

SEQ ID NO: 682697 - RNA, 20 nt, Haemophilus influenzae Rd
ugaaugucuuaaagauaaaa

SEQ ID NO: 682698 - RNA, 21 nt, Haemophilus influenzae Rd
ugaauccaacguauuuauacc

SEQ ID NO: 682699 - RNA, 23 nt, Haemophilus influenzae Rd
ugaaucauuucaucuacaccaaa

SEQ ID NO: 682700 - RNA, 20 nt, Haemophilus influenzae Rd
ugaaucaauuagaugacugg

SEQ ID NO: 682701 - RNA, 21 nt, Haemophilus influenzae Rd
ugaaucacaacauauaaaucu

SEQ ID NO: 682702 - RNA, 22 nt, Haemophilus influenzae Rd
ugaaucacaacauauaaaucuc

SEQ ID NO: 682703 - RNA, 19 nt, Haemophilus influenzae Rd
ugaauggauuauaaauaga

SEQ ID NO: 682704 - RNA, 15 nt, Haemophilus influenzae Rd
ugaagucuauaaaag

SEQ ID NO: 682705 - RNA, 18 nt, Haemophilus influenzae Rd
ugaaguacauucaagccu

SEQ ID NO: 682706 - RNA, 19 nt, Haemophilus influenzae Rd
ugaaguuagaaacagaagu

SEQ ID NO: 682707 - RNA, 19 nt, Haemophilus influenzae Rd
ugaaguuguaauaaagcug

SEQ ID NO: 682708 - RNA, 16 nt, Haemophilus influenzae Rd
ugaaguucacuucauc

SEQ ID NO: 682709 - RNA, 13 nt, Haemophilus influenzae Rd
ugaauaaaagaga

SEQ ID NO: 682710 - RNA, 22 nt, Haemophilus influenzae Rd
ugaauaaaagagagcuucucuu

SEQ ID NO: 682711 - RNA, 17 nt, Haemophilus influenzae Rd
ugaauaaaaucaauaau

SEQ ID NO: 682712 - RNA, 20 nt, Haemophilus influenzae Rd
ugaauaaaaucaauaauauu

SEQ ID NO: 682713 - RNA, 18 nt, Haemophilus influenzae Rd
ugaauaaaauuuuuaaag

SEQ ID NO: 682714 - RNA, 18 nt, Haemophilus influenzae Rd
ugaaguuuucauuaaaga

SEQ ID NO: 682715 - RNA, 13 nt, Haemophilus influenzae Rd
ugaauaaauauuc

SEQ ID NO: 682716 - RNA, 16 nt, Haemophilus influenzae Rd
ugaaguuuuuuaaguu

SEQ ID NO: 682717 - RNA, 13 nt, Haemophilus influenzae Rd
ugaauauaaaauu

SEQ ID NO: 682718 - RNA, 15 nt, Haemophilus influenzae Rd
ugaauauaagaaauc

SEQ ID NO: 682719 - RNA, 18 nt, Haemophilus influenzae Rd
ugaauauaagaaaucucu

SEQ ID NO: 682720 - RNA, 16 nt, Haemophilus influenzae Rd
ugaauaguaaagaaua

SEQ ID NO: 682721 - RNA, 14 nt, Haemophilus influenzae Rd
ucagcgaguuugau

SEQ ID NO: 682722 - RNA, 16 nt, Haemophilus influenzae Rd
ucagcgauuuuaacug

SEQ ID NO: 682723 - RNA, 15 nt, Haemophilus influenzae Rd
uccugucaguuugcu

SEQ ID NO: 682724 - RNA, 18 nt, Haemophilus influenzae Rd
uccuucaucgucuucuuc

SEQ ID NO: 682725 - RNA, 22 nt, Haemophilus influenzae Rd
uccuucagggcggagauauaag

SEQ ID NO: 682726 - RNA, 13 nt, Haemophilus influenzae Rd
uccuucaaucgca

SEQ ID NO: 682727 - RNA, 20 nt, Haemophilus influenzae Rd
uccuucaaucgcaucauuca

SEQ ID NO: 682728 - RNA, 18 nt, Haemophilus influenzae Rd
uccuuccaacaauuucac

SEQ ID NO: 682729 - RNA, 16 nt, Haemophilus influenzae Rd
uccuucaaauucuaca

SEQ ID NO: 682730 - RNA, 23 nt, Haemophilus influenzae Rd
uccuucaaacgccguucaaaauc

SEQ ID NO: 682731 - RNA, 21 nt, Haemophilus influenzae Rd
uccuuauccugccuugcauuc

SEQ ID NO: 682732 - RNA, 20 nt, Haemophilus influenzae Rd
uccuuauucgcugcaaaauc

SEQ ID NO: 682733 - RNA, 13 nt, Haemophilus influenzae Rd
uccuuaauuucau

SEQ ID NO: 682734 - RNA, 17 nt, Haemophilus influenzae Rd
uccuuaauuucauuaau

SEQ ID NO: 682735 - RNA, 20 nt, Haemophilus influenzae Rd
uccuuagaaaguaaacaauu

SEQ ID NO: 682736 - RNA, 17 nt, Haemophilus influenzae Rd
uccuucuauaucagaaa

SEQ ID NO: 682737 - RNA, 19 nt, Haemophilus influenzae Rd
uccuucgccuucggcuccc

SEQ ID NO: 682738 - RNA, 18 nt, Haemophilus influenzae Rd
uccuucggcauauaagau

SEQ ID NO: 682739 - RNA, 20 nt, Haemophilus influenzae Rd
uccuucggcauauaagauuu

SEQ ID NO: 682740 - RNA, 18 nt, Haemophilus influenzae Rd
uccuucgccauuuuuaac

SEQ ID NO: 682741 - RNA, 10 nt, Haemophilus influenzae Rd
uccuucuucg

SEQ ID NO: 682742 - RNA, 22 nt, Haemophilus influenzae Rd
uccuucugccauaacgcuaucu

SEQ ID NO: 682743 - RNA, 15 nt, Haemophilus influenzae Rd
uccuugcugauucac

SEQ ID NO: 682744 - RNA, 21 nt, Haemophilus influenzae Rd
uccuucuucggcgaggcauuc

SEQ ID NO: 682745 - RNA, 18 nt, Haemophilus influenzae Rd
uccuugaauaucaaggag

SEQ ID NO: 682746 - RNA, 22 nt, Haemophilus influenzae Rd
ucgaaaucacaggcuucaauuu

SEQ ID NO: 682747 - RNA, 13 nt, Haemophilus influenzae Rd
ucgaaaucauaau

SEQ ID NO: 682748 - RNA, 21 nt, Haemophilus influenzae Rd
ucgaaaucauaaucugaaagu

SEQ ID NO: 682749 - RNA, 13 nt, Haemophilus influenzae Rd
ucgaaacauaaaa

SEQ ID NO: 682750 - RNA, 17 nt, Haemophilus influenzae Rd
ucgaaaaaguucuuucu

SEQ ID NO: 682751 - RNA, 22 nt, Haemophilus influenzae Rd
ucgaaaaaguucuuucugucau

SEQ ID NO: 682752 - RNA, 13 nt, Haemophilus influenzae Rd
uccuuuuuuugaa

SEQ ID NO: 682753 - RNA, 21 nt, Haemophilus influenzae Rd
ucgaaaaaacgcggucuaaau

SEQ ID NO: 682754 - RNA, 20 nt, Haemophilus influenzae Rd
ucgaaaauaacuucauccau

SEQ ID NO: 682755 - RNA, 17 nt, Haemophilus influenzae Rd
uccuuuugcauuauuga

SEQ ID NO: 682756 - RNA, 15 nt, Haemophilus influenzae Rd
uccuuuacauuuaaa

SEQ ID NO: 682757 - RNA, 14 nt, Haemophilus influenzae Rd
uccuugguuuucuu

SEQ ID NO: 682758 - RNA, 15 nt, Haemophilus influenzae Rd
uccuugguuaauccu

SEQ ID NO: 682759 - RNA, 13 nt, Haemophilus influenzae Rd
uccuuugcugcca

SEQ ID NO: 682760 - RNA, 16 nt, Haemophilus influenzae Rd
uccuuucuuuccgauu

SEQ ID NO: 682761 - RNA, 14 nt, Haemophilus influenzae Rd
uccuuuagaaaacu

SEQ ID NO: 682762 - RNA, 21 nt, Haemophilus influenzae Rd
uccuuuauuuugcaacuguuu

SEQ ID NO: 682763 - RNA, 22 nt, Haemophilus influenzae Rd
ucgaccguuuuuucuuuuuccu

SEQ ID NO: 682764 - RNA, 23 nt, Haemophilus influenzae Rd
ucgaccguuuuuucuuuuuccug

SEQ ID NO: 682765 - RNA, 15 nt, Haemophilus influenzae Rd
ucgacaauuucugca

SEQ ID NO: 682766 - RNA, 16 nt, Haemophilus influenzae Rd
ucgacaauuuguccuu

SEQ ID NO: 682767 - RNA, 22 nt, Haemophilus influenzae Rd
ucgaauauugagggcuuuuuua

SEQ ID NO: 682768 - RNA, 18 nt, Haemophilus influenzae Rd
ucgaauccuucacgaccc

SEQ ID NO: 682769 - RNA, 21 nt, Haemophilus influenzae Rd
ucgaacaugaaguuggagauu

SEQ ID NO: 682770 - RNA, 14 nt, Haemophilus influenzae Rd
ucgaaaucuaauuu

SEQ ID NO: 682771 - RNA, 20 nt, Haemophilus influenzae Rd
ucgaacuuagucucuuuauu

SEQ ID NO: 682772 - RNA, 16 nt, Haemophilus influenzae Rd
ucgaagguucgaaucc

SEQ ID NO: 682773 - RNA, 13 nt, Haemophilus influenzae Rd
ucgaaguuuugcu

SEQ ID NO: 682774 - RNA, 13 nt, Haemophilus influenzae Rd
ucgaggcaccauu

SEQ ID NO: 682775 - RNA, 19 nt, Haemophilus influenzae Rd
ucgaguaaaaauaaaaugc

SEQ ID NO: 682776 - RNA, 19 nt, Haemophilus influenzae Rd
ucgaguaauuucauaucuu

SEQ ID NO: 682777 - RNA, 19 nt, Haemophilus influenzae Rd
ucgaguuaauuauuuuaaa

SEQ ID NO: 682778 - RNA, 14 nt, Haemophilus influenzae Rd
ucgauaacaauuuu

SEQ ID NO: 682779 - RNA, 19 nt, Haemophilus influenzae Rd
ucgauaaacauuuuuucaa

SEQ ID NO: 682780 - RNA, 10 nt, Haemophilus influenzae Rd
ucgcaauaaa

SEQ ID NO: 682781 - RNA, 16 nt, Haemophilus influenzae Rd
ucgcaacuaaauucaa

SEQ ID NO: 682782 - RNA, 18 nt, Haemophilus influenzae Rd
ucgcaagauagcaaaaua

SEQ ID NO: 682783 - RNA, 14 nt, Haemophilus influenzae Rd
ucgauuuaugauaa

SEQ ID NO: 682784 - RNA, 19 nt, Haemophilus influenzae Rd
ucgauuucaacgaauaauu

SEQ ID NO: 682785 - RNA, 14 nt, Haemophilus influenzae Rd
ucgauuucauacaa

SEQ ID NO: 682786 - RNA, 14 nt, Haemophilus influenzae Rd
ucgauugcauuuuu

SEQ ID NO: 682787 - RNA, 14 nt, Haemophilus influenzae Rd
ucgaucucugccau

SEQ ID NO: 682788 - RNA, 22 nt, Haemophilus influenzae Rd
ucgcacuguuauauaaacaauu

SEQ ID NO: 682789 - RNA, 22 nt, Haemophilus influenzae Rd
ucgcaggcuuucacuauuucau

SEQ ID NO: 682790 - RNA, 20 nt, Haemophilus influenzae Rd
ucgcaauauuaaacaaaguc

SEQ ID NO: 682791 - RNA, 16 nt, Haemophilus influenzae Rd
ucgcaaucaauucuuu

SEQ ID NO: 682792 - RNA, 19 nt, Haemophilus influenzae Rd
ucgcaaucagcauauugaa

SEQ ID NO: 682793 - RNA, 12 nt, Haemophilus influenzae Rd
ucgcaauucuuu

SEQ ID NO: 682794 - RNA, 23 nt, Haemophilus influenzae Rd
ucgcaauuuuaacgccugcugca

SEQ ID NO: 682795 - RNA, 13 nt, Haemophilus influenzae Rd
ucgcaauuuuuug

SEQ ID NO: 682796 - RNA, 21 nt, Haemophilus influenzae Rd
ucgccccaaaagcugccaucu

SEQ ID NO: 682797 - RNA, 16 nt, Haemophilus influenzae Rd
ucgccaucuucuucug

SEQ ID NO: 682798 - RNA, 13 nt, Haemophilus influenzae Rd
ucgccauuuucuu

SEQ ID NO: 682799 - RNA, 21 nt, Haemophilus influenzae Rd
ucgccauuuucuuguucucca

SEQ ID NO: 682800 - RNA, 17 nt, Haemophilus influenzae Rd
ucgccauuuuuaaaaau

SEQ ID NO: 682801 - RNA, 14 nt, Haemophilus influenzae Rd
ucgccauuuuucaa

SEQ ID NO: 682802 - RNA, 14 nt, Haemophilus influenzae Rd
ucgcccaauuuggc

SEQ ID NO: 682803 - RNA, 17 nt, Haemophilus influenzae Rd
ucgccaauaaaauguua

SEQ ID NO: 682804 - RNA, 13 nt, Haemophilus influenzae Rd
ucgccaucaucag

SEQ ID NO: 682805 - RNA, 14 nt, Haemophilus influenzae Rd
ucgccaucaucagc

SEQ ID NO: 682806 - RNA, 16 nt, Haemophilus influenzae Rd
ucgcaucauucaaugc

SEQ ID NO: 682807 - RNA, 11 nt, Haemophilus influenzae Rd
ucgccaaagcu

SEQ ID NO: 682808 - RNA, 14 nt, Haemophilus influenzae Rd
ucgccaacuugaau

SEQ ID NO: 682809 - RNA, 13 nt, Haemophilus influenzae Rd
ucgccaagaauaa

SEQ ID NO: 682810 - RNA, 20 nt, Haemophilus influenzae Rd
ucgcaguguuaaaugcagua

SEQ ID NO: 682811 - RNA, 20 nt, Haemophilus influenzae Rd
ucgcauaucgauaauuuaac

SEQ ID NO: 682812 - RNA, 15 nt, Haemophilus influenzae Rd
ucgcaucaaagaauc

SEQ ID NO: 682813 - RNA, 18 nt, Haemophilus influenzae Rd
ucgcaucaaaggcuaauu

SEQ ID NO: 682814 - RNA, 20 nt, Haemophilus influenzae Rd
ucgcaucaaaggcuaauucu

SEQ ID NO: 682815 - RNA, 22 nt, Haemophilus influenzae Rd
ucgccgaguaaauucaccaauu

SEQ ID NO: 682816 - RNA, 13 nt, Haemophilus influenzae Rd
ucgccugcucuaa

SEQ ID NO: 682817 - RNA, 13 nt, Haemophilus influenzae Rd
ucgccuucacaaa

SEQ ID NO: 682818 - RNA, 16 nt, Haemophilus influenzae Rd
ucgccuucacaaaccc

SEQ ID NO: 682819 - RNA, 15 nt, Haemophilus influenzae Rd
ucgccuaaauacauu

SEQ ID NO: 682820 - RNA, 16 nt, Haemophilus influenzae Rd
ucgccguuaguuugua
